United States Patent 11,078,247 (RNA ENCODING A THERAPEUTIC PROTEIN) - sequence listing, part 19

SEQ ID NO: 34116 - RNA, 2640 nt, Artificial Sequence
  derived and/or modified sequence opt1 from OSBPL5__Homo_sapiens__NP_065947
augaaggaggaggccuuccugcgccggcgcuucagccucugcccgcccuccagcacgccccagaagguggacccccggaagcugacccgcaaccugcuccuguccggcgacaacgagcuguacccccucagcccggggaaggacauggagcccaacggccccucccugccccgggacgaggggccgcccacccccagcuccgccaccaaggugcccccggcggaguaccgccugugcaacggcagcgacaaggagugcgugucccccaccgcccgggugaccaagaaggagacgcucaaggcccagaaggagaacuaccgccaggagaagaagcgggccacccgccagcugcugagcgcccucaccgaccccuccgucgugaucauggcggacagccugaagauccgggggacccugaaguccuggacgaagcucuggugcgugcugaagcccggcguccugcucaucuacaagaccccgaaggugggccaguggguggggaccguccugcugcacugcugcgagcucaucgagcgccccagcaagaaggacggcuucugcuucaagcuguuccacccccuggaccaguccgugugggccgugaaggggcccaagggcgagagcgucggguccaucacccagccgcuccccagcuccuaccugaucuuccgggccgccagcgagagcgacggccgcugcuggcuggacgcgcucgagcuggcccugcggugcuccagccuccugcgccugggcacgugcaagcccgggcgggacggcgagcccgggaccuccccggacgccagccccuccagccucugcggccugcccgccuccgccaccgugcaccccgaccaggaccuguucccgcucaacggcagcucccuggagaacgacgcguucagcgacaaguccgagcgcgagaaccccgaggagagcgacaccgagacgcaggaccacucccggaagaccgagagcggguccgaccagagcgagacccccggcgccccggugcgccgggggaccacguacgucgagcagguccaggaggagcugggcgagcucggggaggccucccagguggagaccgucagcgaggagaacaagucccugauguggacccugcucaagcagcugcgccccggcauggaccugagccgcguggugcuccccaccuucguccuggagccccggagcuuccugaacaagcucuccgacuacuacuaccacgccgaccugcugagccgcgccgcgguggaggaggacgccuacucccggaugaagcuggugcuccgcugguaccugagcggcuucuacaagaagccgaaggggaucaagaagcccuacaaccccauccugggcgagacguuccggugcugcugguuccacccccagaccgacucccgcaccuucuacaucgccgagcaggucagccaccacccgcccguguccgccuuccacgucagcaaccggaaggacggguucugcaucuccggcagcaucaccgccaagucccgcuucuacgggaacagccucuccgcgcugcuggacggcaaggccacgcucaccuuccugaaccgggccgaggacuacacccugaccaugcccuacgcccacugcaagggcauccucuacgggacgaugacccuggagcugggcgggaaggugaccaucgagugcgccaagaacaacuuccaggcgcagcucgaguucaagcugaagcccuucuucggcgggagcaccuccaucaaccagaucagcggcaagaucacguccggcgaggaggugcuggccagccucagcgggcacugggaccgcgacgucuucaucaaggaggagggcuccgggagcuccgcccuguucuggaccccgagcggcgaggugcggcgccagcggcugcgccagcacaccgugccccucgaggagcagaccgagcuggaguccgagcggcuguggcagcacgucacccgcgccaucagcaagggcgaccagcaccgggcgacgcaggagaaguucgcccucgaggaggcccagcgccagcgggcccgcgagcgccaggagucccugaugcccuggaagccccagcuguuccaccucgacccgaucacccaggaguggcacuaccgguacgaggaccacagccccugggacccccugaaggacaucgcccaguucgagcaggacgggauccugcgcacccuccagcaggaggcgguggcccggcagaccacguuccugggcucccccgggccgcgccacgagcggagcggccccgaccagcgccugcggaaggccuccgaccagcccagcgggcacucccaggccaccgagagcuccggcagcacccccgaguccugcccggagcucagcgacgaggagcaggacggcgacuucgugcccgggggcgagucccccugcccgcgcugccggaaggaggcccgccggcugcaggcgcugcacgaggccauccucagcauccgcgaggcccagcaggagcugcaccggcaccugagcgccaugcucuccagcaccgcccgcgcggcccaggcccccacgcccgggcugcugcagagcccccgguccugguuccuccugugcgucuuccuggccugccagcuguucaucaaccacauccucaaguga

SEQ ID NO: 34117 - RNA, 2880 nt, Artificial Sequence
  derived and/or modified sequence opt1 from OSBPL6__Homo_sapiens__NP_001188409
augagcuccgacgagaagggcaucagccccgcccacaagaccuccaccccgacgcaccgcagcgccuccagcuccaccagcucccagcgggacagccgccaguccauccacauccuggagcggaccgcgagcuccagcaccgagcccuccgugagccgccagcuccuggagcccgagcccgucccgcuguccaaggaggccgacagcugggagaucaucgaggggcucaagaucggccagacgaacgugcagaagcccgacaagcacgagggguucaugcugaagaagcggaaguggccccugaagggcuggcacaagcgcuucuucgugcucgacaacgggaugcugaaguacuccaaggcgccccuggacauccagaagggcaagguccacggcagcaucgacguggggcucagcgugauguccaucaagaagaaggcccggcgcaucgaccuggacaccgaggagcacaucuaccaccugaaggucaagagccaggacugguucgacgccuggguguccaagcuccggcaccaccgccuguaccggcagaacgagaucgugcgcagcccgcgggacgccuccuuccacaucuuccccagcaccuccaccgccgagagcucccccgccgccaacgucagcgugauggacggcaagaugcagcccaacuccuucccguggcagagcccccugcccugcuccaacagccuccccgcgacgugcaccaccgggcaguccaagguggccgccuggcugcaggacagcgaggagauggaccgcugcgccgaggaccuggcccacugccaguccaaccucgucgagcugagcaagcugcuccagaaccuggagauccugcagcggacccaguccgcgccgaacuucacggacaugcaggccaacugcguggacaucagcaagaaggacaagcgcgugacccggcgcuggcggaccaagagcgucuccaaggacaccaagauccagcuccaggagggcccgcccgccaaggggcaguucagcacgacccgccggcgccagcgccuggccgccgcgguggccaccaccgugcccuucuccgccacgaugagccccguccggcugcacuccagcaaccccaaccucugcgccgacaucgaguuccagaccccgcccucccaccugaccgacccccuggagagcuccaccgacuacacgaagcuccaggaggaguucugccugaucgcccagaaggugcacagccugcucaaguccgcguucaacagcaucgccaucgagaaggagaagcugaagcagaugguguccgagcaggaccacagcaagggccacuccacccagauggcccgccugcggcagagccucucccaggcccugaaccagaacgccgagcugcgcagccggcucaaccgcauccacagcgaguccaucaucugcgaccaggucgugagcgugaacaucauccccucccccgacgaggcgggcgagcagauccacgucagccugccccugucccagcaggucgccaacgagagccggcucuccaugagcgaguccgugagcgaguucuucgacgcccaggaggugcugcuguccgccagcuccagcgagaacgaggcguccgacgacgagagcuacaucuccgacgugagcgacaacaucuccgaggacaacaccagcgucgccgacaacaucagccgccagauccucaacggggagcugaccggcggggccuuccggaacggccgccgggccugccugccggcccccugccccgacacguccaacaucaaccucuggaacauccugcgcaacaacaucggcaaggaccugagcaagguguccaugccgguggagcugaacgagccccucaacacccugcagcaccugugcgaggagauggaguacagcgagcuccuggacaaggcguccgagaccgacgaccccuacgagcggaugguccugguggccgccuucgccgugagcggguacugcuccaccuacuuccgcgccggcagcaagcccuucaacccgguccucggggagacguacgagugcauccgggaggacaagggcuuccgcuucuucuccgagcaggucagccaccacccgcccaucuccgcgugccacugcgagagcaagaacuucguguucuggcaggacauccgguggaagaacaaguucugggggaaguccauggagauccugcccgugggcacccugaacgugaugcuccccaaguacggcgacuacuacguguggaacaaggucacgaccugcauccacaacauccugagcgggcgccgguggaucgagcacuacggcgaggugaccauccgcaacaccaaguccagcgugugcaucugcaagcugaccuucgucaaggugaacuacuggaacuccaacaugaacgaggugcagggggucgugaucgaccaggagggcaaggccguguaccgccucuucgggaaguggcacgagggccuguacugcggcgucgcccccagcgccaagugcaucuggcggcccggguccaugcccaccaacuacgagcuguacuacggcuucacccgcuucgccaucgagcucaacgagcuggacccggugcugaaggaccuccugccgcccacggacgcgcgguuccgccccgaccagcgguuccuggaggaggggaaccucgaggccgccgccagcgagaagcagcgcguggaggagcugcagcggagccgccggcgcuacauggaggagaacaaccuggagcacauccccaaguucuucaagaaggucaucgacgcgaaccagcgggaggccuggguguccaacgacaccuacugggagcuccgcaaggaccccggcuucagcaagguggacucccccguccugugguga

SEQ ID NO: 34118 - RNA, 2544 nt, Artificial Sequence
  derived and/or modified sequence opt1 from OSBPL8__Homo_sapiens__NP_001003712
augagccagcgccagggcaaggaggccuaccccaccccgaccaaggaccugcaccagcccucccucagccccgccagcccccacucccagggguucgagcggggcaaggaggacaucucccagaacaaggacgagagcucccugagcauguccaagagcaaguccgagagcaagcuguacaacggguccgagaaggacagcuccacgagcuccaagcucaccaagaaggagagccugaaggugcagaagaagaacuaccgcgaggagaagaagcgggcgaccaaggagcugcucuccaccaucacggacccgagcgucaucgugauggccgacuggcugaagauccgcggcacccucaagagcuggaccaagcucuggugcgugcugaagcccgggguccugcucaucuacaagacccagaagaacggccagugggugggcacggugcugcugaacgccugcgagaucaucgagcggcccuccaagaaggacggguucugcuucaagcuguuccacccccuggagcagagcaucugggccgucaagggcccgaagggggaggccgugggcuccaucacccagccccugcccagcuccuaccucaucauccgcgcgaccagcgaguccgacgggcggugcuggauggacgcccuggagcuggcccucaagugcagcucccugcugaagcgcaccaugauccgggagggcaaggagcacgaccucagcguguccagcgacuccacgcacgucaccuucuacggccugcugcgcgccaacaaccuccacagcggggacaacuuccagcugaacgacuccgagaucgagcggcagcacuucaaggaccaggacauguacagcgacaaguccgacaaggagaacgaccaggagcacgacgagagcgacaacgaggugaugggcaaguccgaggagagcgacaccgacaccagcgagcgccaggacgacuccuacaucgagcccgagccgguggagccccugaaggagacgaccuacaccgagcagagccacgaggagcucggggaggcgggcgaggccucccagaccgagacggucagcgaggagaacaagucccugaucuggacccugcucaagcagguccggcccggcauggaccugagcaagguggugcugcccaccuucauccucgagccgcgcuccuuccuggacaagcugagcgacuacuacuaccacgccgacuuccucuccgaggccgcccuggaggagaaccccuacuuccggcugaagaagguggugaagugguaccucagcggguucuacaagaagcccaagggccugaagaagcccuacaacccgauccugggggagaccuuccgcugccucuggauccacccccggacgaacuccaagaccuucuacaucgcggagcaggucagccaccacccgcccaucuccgccuucuacgugagcaaccgcaaggacggcuucugccuguccgggagcauccuggccaaguccaaguucuacggcaacagccucagcgccauccuggagggcgaggcccggcugaccuuccugaaccgcggggaggacuacgugaugaccaugcccuacgcgcacugcaagggcauccucuacgggacgaugacccuggagcugggcgggaccgucaacaucacgugccagaagaccggcuacuccgccauccucgaguucaagcugaagcccuuccugggcagcuccgacugcgugaaccagaucagcgggaagcucaagcugggcaaggaggugcuggccacccucgaggggcacugggacuccgaggucuucaucaccgacaagaagaccgacaacagcgagguguucuggaaccccacgcccgacaucaagcaguggcggcugauccgccacaccgucaaguucgaggagcagggcgacuucgaguccgagaagcuguggcagcgcgugacccgggccaucaacgccaaggaccagaccgaggcgacccaggagaaguacgugcucgaggaggcccagcgccaggccgcccgggaccgcaagacgaagaacgaggaguggagcugcaagcuguucgagcuggacccgcucaccggggaguggcacuacaaguucgccgacacccggcccugggacccccugaacgacaugauccaguucgagaaggacggcgucauccagaccaaggugaagcaccgcacgccgaugguguccguccccaagaugaagcacaagcccacccggcagcagaagaagguggcgaagggcuacagcucccccgagccggacauccaggacagcuccgggagcgaggcccaguccgugaagcccagcacccgccggaagaagggcaucgagcugggggacauccaguccagcaucgaguccaucaagcagacccaggaggagaucaagcgcaacaucauggcccuccggaaccaccuggucagcagcacgcccgccaccgacuacuuccugcagcagaaggacuacuucaucaucuuccuccugauccugcuccaggugaucaucaacuucauguucaaguga

SEQ ID NO: 34119 - RNA, 2280 nt, Artificial Sequence
  derived and/or modified sequence opt1 from OSBPL9__Homo_sapiens__XP_011538901
auggccagcaucauggagggcccccuguccaaguggaccaacgugaugaagggguggcaguaccgcugguucguccucgacuacaacgccggccugcugagcuacuacaccuccaaggacaagaugaugcgggggagccgccggggcugcgugcgccuccgcggggcggugaucggcaucgacgacgaggacgacuccacguucaccaucaccgucgaccagaagaccuuccacuuccaggcccgggacgccgacgagcgggagaaguggauccacgcccuggaggagacgauccugcgccacacccuccagcugcagaucagcaccacccuggccuucuuccaguccagcggcaucuccccggugcucgaguucagcaagaucaucgggcuggacuccggcuucgugcccagcguccaggacuucgacaagaagcugacggaggcggacgccuaccuccagauccugaucgagcagcugaagcuguucgacgacaagcugcagaacugcaaggaggacgagcagcggaagaagaucgagacccugaaggagaccaccaacuccaugguggagagcaucaagcacugcaucgugcuccugcagaucgccaaggaccaguccaacgccgagaagcacgcggacgggaugaucagcacgaucaaccccgucgacgccaucuaccagcccuccccgcuggagcccgugaucagcaccaugcccucccagaccgugcugcccccggagcccguccagcugugcaagagcgagcagcgccccagcucccugcccgugggcccggugcucgccacccuggggcaccaccagacgcccacccccaacagcaccggcuccggccacagcccgcccuccagcucccugaccagccccucccacgucaaccucagccccaacacggugcccgaguucuccuacagcuccagcgaggacgaguucuacgacgccgacgaguuccaccaguccgggagcuccccgaagcggcugaucgacagcuccggcagcgccagcgugcugacccacuccagcuccgggaacagccucaagcgccccgacaccaccgagucccugaacagcucccugagcaacggcacguccgacgcggaccucuucgacagccacgacgaccgggacgacgacgccgaggccggcuccgucgaggagcacaagagcgugaucaugcaccuccugucccaggugcgccucgggauggaccugaccaaggucgugcugcccaccuucauccucgagcggcgcagccugcuggagauguacgccgacuucuucgcccaccccgaccucuucguguccaucagcgaccagaaggacccgaaggaccggaugguccagguggucaagugguaccuguccgcguuccacgccggccgcaaggggagcguggccaagaagcccuacaaccccauccugggcgagaucuuccagugccacuggacccuccccaacgacacggaggagaacaccgagcuggugagcgaggggccgguccccuggguguccaagaacagcgugaccuucgucgccgagcaggucucccaccacccgcccaucagcgccuucuacgcggagugcuucaacaagaagauccaguucaacgcccacaucuggaccaaguccaaguuccugggcaugagcaucggcgugcacaacaucgggcagggcugcguguccugccucgacuacgacgagcacuacauccugacguuccccaacggguacggccggagcauccugaccgugcccuggguggagcucgggggcgagugcaacaucaacugcuccaagaccggcuacagcgccaacaucaucuuccacaccaagcccuucuacgggggcaagaagcaccgcaucacggccgagaucuucuccccgaacgacaagaaguccuucugcagcaucgagggggaguggaacggcgucauguacgccaaguacgcgaccggggagaacaccguguucguggacaccaagaagcuccccaucaucaagaagaagguccggaagcuggaggaccagaacgaguacgagagccgcucccuguggaaggacgugaccuucaaccucaagauccgcgacaucgacgccgccacggaggccaagcaccggcuggaggagcgccagcgggcggaggcccgcgagcggaaggagaaggagauccagugggagacccgccuguuccacgaggacggcgagugcuggguguacgacgagccccuccugaagcggcugggcgccgccaagcacuga

SEQ ID NO: 34120 - RNA, 849 nt, Artificial Sequence
  derived and/or modified sequence opt1 from OSCAR__Homo_sapiens__NP_001269278
auggcccuggugcucauccugcagcugcucacccuguggccccugugccacaccgacaucacgccgagcgucccgcccgccuccuaccaccccaagcccuggcucggcgcccagcccgccaccguggugacccccggggucaacgugacccugcgcugccgggcgccccagccggccuggcgcuucggccuguucaagcccggggagaucgcgccccuccuguuccgggacgugagcuccgagcuggccgaguucuuccucgaggaggucacgcccgcccagggcgggagcuaccgcugcugcuaccggcgcccggacuggggccccggcguguggucccagcccagcgacgugcuggagcugcucgucaccgaggagcugccccggccgucccugguggcccuccccgggcccguggucggccccggggccaacgugagccugcgcugcgccggccggcugcgcaacauguccuucgugcucuaccgggagggggucgccgccccgcugcaguaccgccacagcgcccagcccugggccgacuucacccugcucggcgcgcgggcccccggcaccuacuccugcuacuaccacacgcccagcgccccguacgugcugucccagcgcagcgaggugcuggucaucuccugggagggggagggccccgaggcccggcccgccagcuccgcgcccgggaugcaggccccgggcccgccgcccagcgaccccggcgcccaggcccccucccucagcagcuuccgcccccgggggcuggugcugcagccccuccugccccagacccaggacuccugggaccccgcgcccccgcccagcgaccccggcguguga

SEQ ID NO: 34121 - RNA, 879 nt, Artificial Sequence
  derived and/or modified sequence opt1 from OSER1__Homo_sapiens__XP_011527155
augaaguccgaggccaaggacggcgaggaggagagccugcagaccgccuucaagaagcuccgcguggacgcgagcggguccgucgccagccuguccgugggcgaggggaccggcgugcgggcccccguccgcacggccaccgacgacaccaagccgaagaccacgugcgccagcaaggacuccuggcacgggagcacccggaaguccagccgcggcgcggugcggacccagcgccggcgccgguccaagagccccgugcugcacccgcccaaguucauccacugcuccaccaucgccagcuccagcuccagccagcucaagcacaagucccagacggacagccccgacggcagcuccgggcugggcaucagcucccccaaggaguucagcgccggggaguccagcaccucccuggacgccaaccacaccggcgcggucguggagccccuccgcaccagcgugccccggcugccguccgagagcaagaaggaggacuccagcgacgccacgcaggucccccaggccucccugaaggccagcgaccucuccgacuuccagagcguguccaagcugaaccaggggaagcccugcacgugcaucggcaaggagugccagugcaagcgcuggcacgacauggagguguacagcuucuccggccugcagagcgugcccccgcucgcccccgagcggcgcagcacccuggaggacuacucccagagccugcacgcgcggacccucuccgggagcccccgcuccugcagcgagcaggcccgggucuucguggacgacgucaccaucgaggaccuguccggcuacauggaguacuaccuguacauccccaagaagaugagccacauggccgagaugauguacaccuga

SEQ ID NO: 34122 - RNA, 1008 nt, Artificial Sequence
  derived and/or modified sequence opt1 from OSGEP__Homo_sapiens__NP_060277
augcccgccgugcugggcuucgaggggagcgccaacaagaucggcgucgggguggugcgcgacggcaagguccucgcgaacccgcggcgcaccuacgugaccccgcccgggacgggcuuccugcccggcgacaccgcccggcaccaccgcgccgugauccuggaccuccugcaggaggcccugaccgaguccgggcucaccagccaggacaucgacugcaucgccuacacgaagggccccgggaugggcgcgccccuggucuccguggccguggucgcccggaccguggcccagcuguggaacaagccccucgugggggucaaccacugcaucggccacaucgagaugggccgccugaucaccggggcgaccagccccacggugcuguacguguccggcgggaacacccaggucaucgccuacagcgagcaccgguaccgcaucuucggcgagaccaucgacaucgccgugggcaacugccucgaccgguucgcccgcgugcugaagaucuccaacgacccgagccccggguacaacaucgagcagauggccaagcggggcaagaagcuggucgagcuccccuacaccgugaaggggauggacguguccuucagcggcauccuguccuucaucgaggacgucgcgcaccgcaugcuggccacgggggagugcacccccgaggaccucugcuucagccugcaggagaccguguucgccaugcugguggagaucaccgagcgggccauggcccacugcggcucccaggaggcgcucaucgucggcggggugggcugcaacguccgccugcaggagaugauggccacgaugugccaggagcgcggggcccggcuguucgccaccgacgagcgguucugcaucgacaacggcgccaugaucgcgcaggccgggugggagauguuccgcgccggccaccggaccccgcucagcgacuccggcgugacccagcgcuaccggacggacgagguggaggucaccuggcgcgacuga

SEQ ID NO: 34123 - RNA, 1434 nt, Artificial Sequence
  derived and/or modified sequence opt1 from OSGIN1__Homo_sapiens__NP_892026
augagcuccagccgcaaggaccaccugggcgccuccagcuccgagccccucccggugaucaucgucgggaacggccccagcgggaucugccuguccuaccugcucagcggcuacacccccuacaccaagcccgacgccauccacccgcacccccugcugcagcggaagcucacggaggcgcccgggguguccauccuggaccaggaccuggacuaccucagcgagggccuggagggccgcucccagagccccguggcccuccuguucgacgcccugcugcggccggacaccgacuucgggggcaacaugaaguccguccucaccuggaagcaccgcaaggagcacgccaucccccacguggugcuggggcggaaccugcccggcggggccuggcacagcaucgagggcuccauggucauccucagccagggccaguggauggggcugcccgaccuggaggugaaggacuggaugcagaagaagcgccggggccuccgcaacucccgggcgaccgccggggacaucgcccacuacuaccgcgacuacguggucaagaagggccugggccacaacuucgugagcggggccguggucacggcgguggaguggggcaccccggaccccuccagcugcggggcccaggacagcagcccccuguuccagguguccggcuuccucacccggaaccaggcccagcagcccuucucccugugggcccgcaacgucgugcuggccaccgggacguucgacagcccggcgcggcucggcauccccggcgaggcccugcccuucauccaccacgagcuguccgcccucgaggccgccacccgcgugggggcggucacccccgccagcgacccggugcugaucaucggcgccgggcuguccgccgccgacgcggugcucuacgcccggcacuacaacauccccgucauccacgccuuccgccgggccguggacgaccccggccugguguucaaccagcugcccaagaugcucuacccggaguaccacaagguccaccagaugaugcgcgagcagagcauccugucccccagccccuacgagggguaccggucccugccccgccaccagcuccugugcuucaaggaggacugccaggccguguuccaggaccuggagggcgucgagaagguguucggcgugagccucguccuggugcugaucgggucccacccggaccucagcuuccugcccggcgcgggggccgacuucgccguggaccccgaccagccgcuguccgccaagcggaaccccaucgacgucgaccccuucaccuaccagagcacgcgccaggagggccucuacgcgauggggccccuggccggcgacaacuucgugcgcuucgugcagggcggggcccuggccgucgccuccagccugcuccggaaggagacccgcaagccgcccuga

SEQ ID NO: 34124 - RNA, 759 nt, Artificial Sequence
  derived and/or modified sequence opt1 from OSM__Homo_sapiens__NP_065391
augggcgugcugcucacccagcgcacccugcugagccucguccuggcccuccuguuccccuccauggccagcauggcggccaucggguccugcagcaaggaguaccgggugcugcugggccagcuccagaagcagacggaccugaugcaggacaccucccgccugcucgacccguacauccggauccaggggcuggacgugcccaagcugcgcgagcacugccgggagcgccccggcgccuuccccagcgaggagacccuccgggggcugggccgccggggcuuccugcagacccucaacgccacgcuggggugcguccugcaccgccucgccgaccuggagcagcggcugccgaaggcgcaggaccucgagcgcuccggccugaacaucgaggaccuggagaagcuccagauggcccggcccaacauccuggggcugcgcaacaacaucuacugcauggcccagcuccuggacaacagcgacaccgccgagcccaccaaggcgggccgcggggccucccagcccccgacccccacgcccgccagcgacgccuuccagcggaagcuggagggcugccgguuccuccacggcuaccaccgcuucaugcacuccguggggcggguguucagcaaguggggcgagucccccaaccgcagccggcgccacuccccgcaccaggcccugcgcaaggggguccggcgcacccggcccagccgcaagggcaagcggcugaugacccgcggccagcucccccgguga

SEQ ID NO: 34125 - RNA, 1029 nt, Artificial Sequence
  derived and/or modified sequence opt1 from OSMR__Homo_sapiens__NP_001161827
auggcccuguucgccguguuccagaccaccuucuuccucacgcugcugagccuccgcaccuaccaguccgagguccuggcggagcggcugccccucaccccggugagccugaagguguccaccaacagcacgcgccagucccugcaccuccaguggaccguccacaaccugcccuaccaccaggagcugaagaugguguuccagauccagaucagccggaucgagaccuccaacgugaucugggucggcaacuacagcaccacggugaaguggaaccaggugcuccacugguccugggagagcgagcugccccuggagugcgccacccacuucguccgcaucaagucccucguggacgacgccaaguuccccgagccgaacuucuggagcaacugguccagcugggaggagguguccguccaggacagcaccgggcaggacauccuguucguguuccccaaggacaagcugguggaggagggcaccaacgucacgaucugcuacgugucccggaacauccagaacaacgugagcugcuaccucgaggggaagcagauccacggcgagcagcuggacccccacgucaccgccuucaaccugaacuccgugcccuucauccgcaacaaggggaccaacaucuacugcgaggccagccagggcaacgugagcgagggcaugaaggggaucguccucuucguguccaaggugcuggaggagccgaaggacuucagcugcgagaccgaggacuucaagacgcugcacugcaccugggaccccggcaccgacaccgcgcucgggugguccaagcagcccagccaguccuacacgcuguucgagagcuucuccggcgagaagaagcugugcacccacaagaacuggugcaacuggcagaucacccaggacagccaggagaccuacaacuucacgcucaucgccgagaacuaccugcggaagcgcuccgucaacauccuguucaaccucacccaccgcggggagacccggguggucaccgcccaccggggccacuga

SEQ ID NO: 34126 - RNA, 801 nt, Artificial Sequence
  derived and/or modified sequence opt1 from OSR1__Homo_sapiens__XP_006712005
augggcagcaagacccugcccgccccggugcccauccaccccucccuccagcugaccaacuacagcuuccugcaggccgucaacgggcuccccacggugccguccgaccaccuccccaaccuguacggcuucagcgcgcugcacgccgugcaccuccaccaguggacccugggguaccccgccaugcaccucccccgcuccagcuucuccaaggucccgggcaccgugagcucccugguggacgcccgguuccagcugcccgccuuccccugguucccccacgucauccagccgaagcccgagaucaccgccgggggcagcgugcccgcgcugaagacgaagccccgcuucgacuucgccaaccuggcccuggcggccacccaggaggacccggccaagcucggccgcggggagggccccgggucccccgccggcgggcugggcgcccugcucgacgugaccaagcugagccccgagaagaagccgacccggggccggcugcccuccaagacgaagaaggaguucgucugcaaguucugcgggcgccacuucaccaagagcuacaaccuccugauccacgagcggacccacaccgacgagcgccccuacacgugcgacaucugccacaaggcguuccggcgccaggaccaccuccgggaccaccgcuacauccacuccaaggagaagcccuucaagugccaggagugcggcaagggguucugccagagccggacccuggccgugcacaagacccugcacucccaggugaaggagcugaagaccagcaagaucaagugcuga

SEQ ID NO: 34127 - RNA, 939 nt, Artificial Sequence
  derived and/or modified sequence opt1 from OSR2__Homo_sapiens__NP_001135934
augggcagcaaggcccugcccgcccccaucccccuccaccccucccugcagcugaccaacuacagcuuccuccaggcggugaacaccuuccccgccaccgucgaccaccuccaggggcuguacggccuguccgccgugcagaccaugcacaugaaccacuggacccugggguacccgaacgugcacgagaucacccgcagcacgaucaccgagauggccgccgcgcagggccuggucgacgcccgguuccccuuccccgcccuccccuucaccacccaccuguuccacccgaagcagggggccaucgcgcacgugcugcccgcccuccacaaggaccgcccccgguucgacuucgccaaccuggccguggccgcgacgcaggaggacccgcccaagaugggcgaccuguccaagcucagccccggccuggggucccccaucagcggccuguccaagcucacccccgaccgcaagccgagccgggggcgccugcccuccaagaccaagaaggaguucaucugcaaguucugcggccggcacuucaccaagagcuacaaccugcucauccacgagcgcacgcacaccgacgagcggcccuacacgugcgacaucugccacaaggccuuccgccggcaggaccaccuccgcgaccaccgguacauccacuccaaggagaagcccuucaagugccaggagugcgggaagggcuucugccagagccgcacccuggccguccacaagacccugcacaugcaggaguccccgcacaagugcccgaccugcggccggaccuucaaccagcgcagcaaccugaagacccaccuccugacgcacaccgacaucaagcccuacuccugcgagcagugcgggaagguguuccggcgcaacugcgaccugcggcgccacagccugacccacacgccccggcaggacuucuga

SEQ ID NO: 34128 - RNA, 645 nt, Artificial Sequence
  derived and/or modified sequence opt1 from OSTF1__Homo_sapiens__NP_036515
augagcaagcccccgcccaagcccgugaagcccggccaggucaagguguuccgcgcccuguacaccuucgagccgcggacccccgacgagcucuacuucgaggagggggacaucaucuacaucacggacauguccgacaccaacugguggaagggcaccagcaaggggcgcaccggccugauccccuccaacuacguggccgagcaggcggagagcaucgacaacccccugcacgaggccgccaagcgggggaaccucuccuggcugcgcgagugccuggacaaccgggucggcgugaacggccucgacaaggccgggagcacggcccuguacugggcgugccacggcgggcacaaggacaucguggagaugcuguucacccagccgaacaucgagcucaaccagcagaacaagcugggcgacaccgcccugcacgccgccgcguggaagggguacgccgacaucguccagcuccugcuggccaagggcgcccgcaccgaccuccggaacaucgagaagaagcuggccuucgacauggcgacgaacgccgccugcgccucccugcucaagaagaagcagggcaccgacgccgugcgcacccugagcaacgcggaggacuaccuggacgacgaggacuccgacuga

SEQ ID NO: 34129 - RNA, 1005 nt, Artificial Sequence
  derived and/or modified sequence opt1 from OSTM1__Homo_sapiens__NP_054747
auggagcccggcccgaccgccgcccagcgccggugcagccugccgcccuggcucccccuggggcugcuccugugguccggccuggcgcucggggcccugccguucggcagcagcccccaccgcguguuccacgaccugcucuccgagcagcagcugcuggaggucgaggaccucucccugagccugcuccagggcgggggccuggggccccugucccugcccccggaccugcccgaccuggaccccgagugccgggagcuccugcuggacuucgccaacagcuccgccgagcucaccggcugccuggugcgcagcgcccggcccgugcgccugugccagacgugcuacccccucuuccagcaggucguguccaagauggacaacaucagccgggcggccgggaacaccuccgagagccaguccugcgcccgcagccugcugauggccgaccggaugcagaucguggucauccucuccgaguucuucaacaccaccuggcaggaggcgaacugcgccaacugccugacgaacaacagcgaggagcuguccaacagcaccguguacuuccucaaccuguucaaccacacccugaccugcuucgagcacaaccuccagggcaacgcccacagccugcugcagacgaagaacuacuccgaggugugcaagaacugccgcgaggccuacaagacccucagcucccuguacagcgagaugcagaagaugaacgagcuggagaacaaggccgagcccgggacccaccucugcaucgacgucgaggacgcgaugaacaucacccggaagcuguggucccgcacguucaacugcagcgugcccugcuccgacaccgugcccgucaucgccgugagcguguucauccuguuccucccggucguguucuaccuguccagcuuccugcacuccgagcagaagaagcggaagcucauccugcccaagcgccucaagagcuccaccagcuucgccaacauccaggagaacuccaacuga

SEQ ID NO: 34130 - RNA, 1065 nt, Artificial Sequence
  derived and/or modified sequence opt1 from OTC__Homo_sapiens__NP_000522
augcuguucaaccuccgcauccugcugaacaacgccgccuuccggaacggccacaacuucauggugcgcaacuuccggugcgggcagccccuccagaacaagguccagcugaagggccgcgaccugcucacccugaagaacuucaccggggaggagaucaaguacaugcuguggcucagcgcggaccugaaguuccggaucaagcagaagggcgaguaccugccgcuccugcaggggaagucccugggcaugaucuucgagaagcgcagcacgcggacccgccucuccaccgagaccggcuucgcccugcucgggggccaccccugcuuccugacgacccaggacauccaccugggggugaacgagagccugaccgacaccgcccgggugcucuccagcauggccgacgccguccuggcgcgcguguacaagcaguccgaccuggacacgcucgccaaggaggccagcauccccaucaucaacggccuguccgaccuguaccaccccauccagauccucgccgacuaccugacccugcaggagcacuacagcucccucaaggggcugacccugagcuggaucggcgacggcaacaacauccuccacuccaucaugaugagcgcggccaaguucgggaugcaccuccaggccgccaccccgaagggcuacgagcccgacgccuccgugacgaagcuggcggagcaguacgccaaggagaacgggaccaagcugcugcugaccaacgacccccucgaggccgcccacggcggcaacguccugaucaccgacacguggaucagcauggggcaggaggaggagaagaagaagcggcugcaggccuuccagggcuaccaggugaccaugaagaccgcgaagguggccgccuccgacuggaccuuccuccacugccugccccgcaagccggaggaggucgacgacgagguguucuacagcccccggucccugguguuccccgaggccgagaaccgcaaguggacgaucauggccgucauggugagccuccugaccgacuacagcccccagcugcagaagccgaaguucuga

SEQ ID NO: 34131 - RNA, 3183 nt, Artificial Sequence
  derived and/or modified sequence opt1 from OTOA__Homo_sapiens__NP_001155155
augggcaacagcaucaccuaccgcgaccaggccgccguggagaaccaccuggagcagcggcuccaccagccccagaagcugcuggaggaccuccgcaagaccgacgcgcagcaguuccggacggccaugaagugccugcuggaggacaagaaggacgggcucgaccugaaggacaucaucaucgaccugggcgagauccgcgagcgggcccuccaguccccgggggucaaccgcagccuguuccugaucacccucgagcggugcuuccagaugcugaacucccuggagugcguggagauccucggcaaggugcugcgcgggagcuccggcagcuuccugcagcccgacaucaccgagcggcucccccgcgaccugcgggaggacgccuucaagaaccuguccgccgucuucaaggaccucuacgacaagaccagcgcgcacucccagcgcgcccuguacagcuggaugacgggcauccugcagaccuccagcaacgccaccgacgacuccgccagcuggguguccgcggagcaccucugggugcuggggcgguacaugguccaccugagcuucgaggagaucaccaagaucucccccaucgagaucggccucuucaucagcuacgacaacgccacgaagcagcuggacaugguguacgacaucaccccggagcuggcccaggccuuccucgagcgcaucuccagcagcaacuucaacaugcggaacaccuccaccauccaccgccuggggcugcucgugugcuucuacaacgaccuggagcugcucgacgccacggucgcccaggugcugcuguaccagaugaucaagugcagccaccuccggggcuuccaggcgggggugcagaagcugaaggccgagcugcucgacaucgccauggagaaccagacccugaacgagacccugggcucccucagcgacgccgucgugggccugaccuacucccagcuggagagccucucccccgaggcggugcacggggccaucagcacgcugaaccaggucuccggcugggccaagagccaggugaucauccuguccgccaaguaccuggcccacgagaaggugcucagcuucuacaacgucucccagaugggggcgcugcuggccggcgugagcacccaggccuucugcuccaugaagcgcaaggacaucagccaggugcuccgguccgccgucagccaguacguguccgaccugagccccgcccagcagcagggcauccugagcaagauggugcaggcggaggacaccgcccccgggaucgucgagauccagggcgccuucuucaaggaggugucccucuucgaccugcgccggcagccgggguucaacagcaccguccugaaggacaaggagcucggccgcucccaggcccuguuccuguacgagcuccugcugaagacgacccgccggcccgaggagcuccugagcgcggggcagcuggugaagggcgugaccugcucccacaucgacgccaugagcaccgacuucuuccucgcccacuuccaggacuuccagaacaacuucgcccugcugucccccuaccaggucaacugccucgccuggaaguacugggaggugagccgccuguccaugcccccguuccugcucgcggcccugcccgcccgguaccuggccagcgugcccgccucccagugcguccccuuccucaucagccugggcaaguccuggcuggacagccucgugcuggacucccacaagaagacgagcgugcugcgcaagguccagcagugccucgacgacuccaucgcggacgaguacaccguggacaucauggggaaccugcugugccaccucccggccgccaucaucgaccggggcaucagcccccgcgccugggccaccgcgcugcacgggcugcgggacugccccgaccucaaccccgagcagaaggccgccgugcgccugaagcugcucggccaguacgggcugccgcagcacuggaccgccgagacgaccaaggaccugggccccuuccucguccuguucagcggcgacgagcuguccagcaucgcgaccaaguuccccgagauccuccugcaggccgccuccaagauggcccggacccugcccacgaaggaguuccucugggccguguuccagagcgugcgcaacuccagcgacaagaucccguccuacgaccccaugcccgggugccacggcgucguggcgcccagcuccgacgacaucuucaagcuggccgaggccaacgccugcugggcccuggaggaccuccggugcauggaggaggacaccuucauccgcaccguggagcugcugggggcgguccagggcuucagccggccgcagcucaugacccugaaggagaaggccauccaggugugggacaugcccuccuacuggcgcgagcaccacaucgugagccuggggcggaucgcccucgcccugaacgaguccgagcuggagcagcucgaccugagcuccaucgacacggucgccagccuguccuggcagaccgaguggacccccggccaggcggagagcauccuccagggcuaccuggacgacuccggguacagcauccaggaccucaagagcuuccaccuggugggccugggggccacccugugcgccaucaacaucaccgagaucccgcucaucaagaucuccgaguuccgcguggucguggcccggaucggcacgcugcugugcagcacccacgugcucgcggaguucaagcgcaaggccgaggucguguucggcgaccccaccgaguggaccuccagcgugcugcaggagcuggggacgaucgccgccggccucaccaaggccgagcugcggaugcuggacaaggaccucaugcccuacuuccagcccuccgcgaucaagugccugccggacgagaucuucaaggagcugagcgccgagcagaucgccucccucgggcccgagaacgccgccgcggucacccacgcccagcgccgccggcugagcccccugcagcuccagucccugcagcaggcccuggacggcgccaagacccacagcuggcaggacgcccccgcguccgccgggccgacgcgcaccagcuccagccggucccccgccggcgcccuccagagcuggggccuguggcuggggugcccccuccuggugcugauggccaagcugcucugguga

SEQ ID NO: 34132 - RNA, 3693 nt, Artificial Sequence
  derived and/or modified sequence opt1 from OTOF__Homo_sapiens__NP_004793
augaucaagaccgagaaguccuaccccgagcgccggcugcgcggcgugcucgaggagcuguccugcgggugcugccgguuccugagccucgccgacaaggaccagggccacuccagccgcacccggcuggaccgcgagcggcugaaguccugcaugcgcgagcucgagaacauggggcagcaggcccggaugcugcgcgcgcaggucaagcggcacacggugcgcgacaagcugcggcucugccagaacuuccugcagaagcugcgcuuccucgccgacgagccgcagcacagcauccccgacaucuucaucuggaugauguccaacaacaagcggguggccuacgcccgcguccccagcaaggaccugcuguucuccaucguggaggaggagaccggcaaggacugcgccaaggugaagacccucuuccugaagcugcccgggaagcggggcuucggcagcgcgggguggaccguccaggccaagguggagcucuaccuguggcugggccucuccaagcagcgcaaggaguuccugugcgggcugccgugcggcuuccaggaggugaaggccgcccaggggcucggccugcacgcguucccgcccgucagccugguguacacgaagaagcaggccuuccagcuccgggcccacauguaccaggcccgcucccuguucgccgcggacagcuccggccugagcgaccccuucgcccggguguucuucaucaaccagucccagugcaccgagguccucaacgagacccugugccccaccugggaccagaugcugguguucgacaaccucgagcuguacggggaggcccacgagcugcgcgacgacccgcccaucaucgugaucgagaucuacgaccaggacagcaugggcaaggccgacuucauggggcgcacguucgccaagccccucgucaagauggcggacgaggccuacugcccgccccgguucccgccccagcuggaguacuaccagaucuaccgcggcaacgccaccgccggcgaccugcucgccgcguucgagcugcugcagaucgggcccgccggcaaggccgaccucccgcccaucaacgggcccguggacguggaccggggccccaucaugcccguccccauggggauccgccccgugcuguccaaguaccggguggagguccuguucuggggccuccgcgaccugaagcgggugaaccuggcccagguggaccgcccccgggucgacaucgagugcgccggcaagggggugcagagcagccucauccacaacuacaagaagaaccccaacuucaacacccuggucaagugguucgagguggaccugcccgagaacgagcugcuccacccgccccugaacauccgcguggucgacugccgggcguucggccgcuacacccugguggggagccacgccgugagcucccuccggcgcuucaucuaccggccgcccgaccgcagcgcccccuccuggaacacgaccggcgaggucguggugaccauggagcccgagguccccaucaagaagcuggagaccauggugaagcuggacgccacgagcgaggcgguggucaagguggacguggccgaggaggagaaggagaagaagaagaagaagaaggggaccgccgaggagcccgaggaggaggagccggacgaguccaugcucgacugguggagcaaguacuucgccuccaucgacaccaugaaggagcagcugcggcagcaggagcccagcggcaucgaccuggaggagaaggaggaggucgacaacaccgagggccucaagggguccaugaagggcaaggagaaggcccgcgcggccaaggaggagaagaagaagaagacgcagagcuccgggagcggccagggguccgaggcccccgagaagaagaagcccaagaucgacgagcugaagguguacccgaaggagcuggagagcgaguucgacaacuucgaggacuggcuccacaccuucaaccugcugcggggcaagaccggcgacgacgaggacggguccaccgaggaggagcgcaucgugggccgcuucaaggggagccucugcgucuacaaggugccccugcccgaggacgugucccgggaggccggcuacgacagcacguacggcauguuccaggggauccccagcaacgacccgaucaacguccuggugcgcguguacgucgugcgggccaccgaccuccaccccgcggacaucaacggcaaggccgaccccuacaucgccauccgccuggggaagaccgacauccgggacaaggagaacuacaucuccaagcagcugaaccccguguucggcaagagcuucgacaucgaggccuccuucccgauggagagcaugcucaccgucgccguguacgacugggaccugguggggacggacgaccugaucggcgagaccaagaucgaccucgagaaccgcuucuacuccaagcaccgggcgaccugcggcaucgcccagaccuacagcacgcacggguacaacaucuggcgcgaccccaugaagcccucccagauccugacccggcugugcaaggacggcaaggucgacgggccccacuucggcccgcccgggcgcgugaagguggccaaccgggucuucaccggccccagcgagaucgaggacgagaacggccagcgcaagcccaccgacgagcacguggcccuccuggcgcugcggcacugggaggacaucccgcgcgccgggugccggcucgugcccgagcacgucgagacgcgcccccugcugaacccggacaagcccggcaucgagcaggggcggcucgagcuguggguggacauguuccccauggacaugcccgccccgggcacgccccuggacaucagcccccgcaagcccaagaaguacgagcuccgggugaucaucuggaacaccgacgaggucgugcuggaggacgacgacuucuucaccggggagaaguccuccgacaucuucgugcgcggcuggcugaagggccagcaggaggacaagcaggacaccgacguccacuaccacagccucaccggggagggcaacuucaacuggcgguaccuguucccguucgacuaccuggccgccgaggagaagaucgugaucuccaagaaggagagcauguucuccugggacgagaccgaguacaagauccccgcgcgccucacccugcagaucugggacgccgaccacuucagcgccgacgacuuccugggggccaucgagcucgaccugaaccgcuucccccggggcgccaagaccgcgaagcagugcacgauggagauggccaccggggagguggacgucccccugguguccaucuucaagcagaagcgcgugaagggcugguggccgcuccuggcccggaacgagaacgacgaguucgagcugaccggcaaggucgaggccgagcuccaccuccugaccgccgaggaggcggagaagaaccccguggggcuggcccgcaacgagcccgacccccuggagaagccgaaccggcccgacacgagcuucaucugguuccugaacccccucaagagcgcccgcuacuuccuguggcacaccuaccgguggcugcuccugaagcugcuccugcugcuccugcugcuccugcugcucgcccuguuccuguacuccgugcccggcuaccucgucaagaagauccugggggcguga

SEQ ID NO: 34133 - RNA, 8778 nt, Artificial Sequence
  derived and/or modified sequence opt1 from OTOG__Homo_sapiens__NP_001264198
augggcgugcuggccagcgcccucugcuggcugcugugcguguggcuccccuggggcgagcaggccgccgagucccugcgcgugcagcgccugggcgagcgcgugguggacagcgggcgguccggcgcccgcgggaugcggaacgugaagggcaugcgcaacggcccggcccagacccgggugagcuccagcuccagccaccaggaggccacccucgccaugggggacaaggccaccgucgugggcgggcagcaggccgaggcccccgacuccguggcgaugagcuccugggagcgccggcugcaccgcgccaagugcgcccccagcuaccuguucuccugcuucaacggcggggagugcguccaccccgccuucugcgacugccggcgcuucaacgccaccggcccccggugccagaugguguacaacgccggccccgagcgcgacagcaucugccgggccugggggcagcaccacguggagaccuucgacggccucuacuacuaccuguccgggaagggcagcuacacccuggucggccgccacgagcccgaggggcaguccuucagcauccaggugcacaacgacccccagugcggcuccagccccuacacgugcagccgggccgugucccucuucuucgucggggagcaggagauccaccuggccaaggaggugacccacggcgggaugcgcgugcagcugccccacgucaugggcagcgcccggcuccagcagcuggcgggcuacgugaucgugcgccaccaguccgccuucacccuggccugggacggggccagcgccgucuacaucaagaugucccccgagcuccugggcuggacccacgggcugugcggcaacaacaacgcggaccccaaggacgaccucgugaccagcuccgggaagcugaccgacgacguggucgaguucgugcacagcuggcaggagcaggcccccaaccagccgcccggccccaccaccuccagccugccccggccgcccugccuccagcagaaccccggcaccaugcagggggucuacgagcagugcgaggcccugcugcgcccgcccuucgacgccugccacgccuacgugagcccccugcccuucaccgcgagcugcaccuccgaccugugccagagcaugggcgacguggccaccuggugccgcgcccuggccgaguacgcgcgggccugcgcccaggccgggcgcccccuccagggcuggcggacccagcugcgccagugcaccguccacugcaaggagaaggccuucaccuacaacgagugcaucgcgugcugccccgccuccugccacccccgggccagcugcguggacuccgagaucgccugcguggacgggugcuacugccccaacggccugaucuucgaggacggcgggugcgucgcccccgcggagugccccugcgaguuccacggcacccucuacccgcccgggagcguggugaaggaggacugcaacacgugcacgugcaccuccggcaagugggagugcagcaccgccgucugccccgccgagugcagcgugaccggcgacauccacuucaccaccuucgacgggcgccgguacaccuuccccgcgaccugccaguacauccuggccaagucccgcagcuccggcaccuucaccgugacccugcagaacgcccccugcgggcucaaccaggacggcgccugcguccagagcguguccgugauccugcaccaggacccccggcgccaggucacccugacccaggccggggacgugcuccuguucgaccaguacaagaucaucccgcccuacaccgacgacgccuucgagauccggcgccugagcuccguguuccuccggguccgcaccaacgugggcgugcggguccuguacgaccgcgagggccugcggcucuaccuccagguggaccagcgcuggguggaggacaccgucgggcugugcggcaccuucaacgggaacacccaggacgacuuccucagccccgugggcgugcccgaguccacgccccagcuguucgggaacagcuggaagacccuguccgcgugcagcccccuggucuccggcagcccccucgaccccugcgacgugcaccuccaggccgccuccuacagcgugcaggccugcuccguccugaccggcgagauguucgcccccugcagcgcguuccucagccccgugcccuacuucgagcagugccggcgcgacgccugccgcugcgggcagcccugccugugcgccacccuggcccacuacgcccaccucugccggcgccacggccugcccguggacuuccgggcgcgccugcccgccugcgcccucuccugcgaggccagcaaggaguacucccccugcgucgcccccugcgggcggaccugccaggaccuggcgagccccgaggccugcggcguggacgggggcgacgaccugucccgcgacgagugcguggagggcugcgccugcccgcccgacaccuaccucgacacgcaggccgaccugugcgucccgcggaaccagugcagcugccacuuccaggggguggacuacccgcccggcgacuccgacaucccgagccuggggcacugccacugcaaggacggcgugauguccugcgacagccgcgcgcccgccgccgccugccccgccgggcaggucuucgugaacugcuccgaccuccacaccgaccuggagcugagccgggagcggaccugcgagcagcagcuccugaaccuguccgugagcgcgcggggccccugccucuccggcugcgccugcccgcaggggcugcugcgccacggcgacgccugcuuccuccccgaggagugccccugcaccuggaaggggaaggaguacuuccccggcgaccaggucaugagcccgugccacacgugcgugugccagcggggcuccuuccagugcacccugcaccccugcgccuccacgugcaccgccuacggggaccgccacuaccggaccuucgacggccugcccuucgacuucgugggggcgugcaagguccaccucgugaaguccaccagcgacgugagcuucuccgucaucguggagaacgugaacugcuacagcuccggcaugaucugccgcaaguucaucagcaucaacgucgggaacucccugaucguguucgacgacgacagcggcaaccccuccccggagagcuuccuggacgacaagcaggagguccacaccuggcgggugggcuucuucacccucgugcacuucccccaggagcacaucacgcugcugugggaccagcgcaccaccguccacgugcaggccgggccccaguggcagggccagcucgccgggcugugcggcaacuucgaccugaagaccaucaacgagaugcggacgcccgagaaccucgagcugaccaacccgcaggaguucggguccagcugggccgccguggagugccccgacacccuggacccccgcgacaugugcguccucaacccccugcgggagccguucgcgaagaaggagugcuccauccugcucagcgagguguucgagaucugccaccccguggucgacgugaccugguucuacuccaacugccugacggacacgugcggcugcagccagggcggggacugcgagugcuucugcgccuccgugagcgccuacgcccaccagugcugccagcacggcgucgccguggacuggcgcacgccccgccugugccccuacgacugcgacuucuucaacaaggugcucgggaagggcccguaccagcuguccagccuggcggccgggggcgcccucgucggcaugaaggccgugggggacgacaucgugcugguccggaccgaggacguggcgcccgccgacaucguguccuuccugcucacggccgcccuguacaaggccaaggcgcacgaccccgacgucgugagccuggaggccgccgaccgccccaacuucuuccuccacgugaccgccaacggcagccuggagcuggccaaguggcaggggcgggacaccuuccagcagcacgcguccuuccuccugcaccgcggcacccggcaggccggccuggucgcccucgagagccuggccaagccguccagcuuccuguacguguccggggccgugcucgcgcugcgccuguacgagcacacggaggucuuccggcgcggcacccucuuccggcugcuggacgccaagcccagcggggccgccuaccccaucugcgaguggcgcuacgacgcgugcgccuccccgugcuuccagaccugccgggacccccgcgccgccagcugccgggacgugccccgcguggagggcugcguccccgugugcccgacgccccaggugcucgacgaggucacccagcggugcguguaccuggaggacugcguggagcccgccgucugggugcccaccgaggcgcuggggaacgagacccucccgcccucccagggccugcccacccccagcgacgaggagccgcagcugucccaggagagcccccgcacccccacgcaccggcccgcccucaccccggccgcgccccugaccaccgcccugaacccgcccgugacggcgaccgaggagccggucgugucccccggccccacccagaccacgcuccagcagccccuggagcugaccgccagccagcucccggccgggcccaccgagucccccgccagcaagggcgugaccgccucccugcuggcgaucccccacacgccggagagcuccagccuccccgucgcccugcagacccccaccccggggauggugagcggcgccauggagaccacgcgcgugaccgucaucuucgccgggucccccaacaucaccgugagcucccgguccccgcccgcgccgcgcuucccccugaugaccaaggccgugacgguccgcggccacggcucccuccccgugcggaccacgccgccccagcccagccugaccgccucccccagcucccgccccguggccagccccggggccaucucccggagccccacguccagcggcucccacaaggcgguccugacccccgccgugaccaaggucaucagccgcaccggggugccccagccgacgcaggcccaguccgccagcucccccagcacgccccucaccguggccggcaccgcggccgagcagguccccgugagcccgcuggccacgcggucccuggagaucgugcucagcaccgagaagggggaggccggccacucccagcccaugggcagccccgccagcccccagccgcacccccugcccagcgcgccgccccgccccgcccagcacaccaccauggccacgcggucccccgcccugccgcccgagacccccgccgcggccagccuguccaccgccaccgacgggcucgccgcgacccccuucaugagccuggaguccacgcgcccgagccagcugcucuccggccugccgcccgacaccagccugccccucgccaaggucgggaccuccgccccgguggccacccccggccccaaggccagcgugaucacgacgccccugcagccgcaggcgaccacccugcccgcccagacgcucucccccguccugcccuucaccccggccgccaugacccaggcccacccgcccacccacaucgcgcccccggccgccgggacggcccccggccugcuccugggcgccacccugcccaccagcggggugcuccccguggcggagggcaccgccuccauggucagcguggugccgcgcaagagcacgaccgggaaggucgccauccuguccaagcaggucagccugcccaccuccauguacggcagcgccgagggcgggcccaccgagcucacgccggcgaccucccacccccugacgccccugguggccgagcccgagggcgcccaggccgggaccgcccucccgguccccacgagcuacgcgcugucccgggugagcgcccggaccgcgccccaggacuccaugcuggugcuccugccccagcuggccgaggcccacggcaccagcgcggggccgcaccucgccgccgagcccgucgacgaggccaccacggagcccuccggccgcagcgcccccgcgcuguccaucguggagggccuggccgaggcccucgccaccaccaccgaggcgaacacgagcacgaccugcgugccgaucgccgagcaggacugcguccggcacaucugccuggaggggcagcugauccgcgugaaccagucccagcacugcccccagggcgccgcgccgccccgcugcgggauccucggccuggccgugcgcgucgggggcgaccggugcugcccgcugugggagugcgcgugccgcugcagcaucuuccccgaccucuccuucgugaccuucgacggcagccacguggcccuguucaaggaggccaucuacauccugagccagucccccgacgagaugcucacgguccacgugcuggacugcaagagcgccaaccuggggcaccucaacuggcccccguucugccuggugaugcugaacaugacccaccucgcccaccaggucaccaucgaccgguucaaccgcaaggugaccguggaccugcagcccgucuggccgcccgugucccgguacggcuuccgcaucgaggacacggggcacauguacaugauccugaccccgagcgacauccagauccaguggcuccacuccagcggccugaugaucguggaggcguccaagaccagcaaggcccaggggcacggccugugcggcaucugcgacggggacgccgccaacgaccucacccugaaggacggcuccgucgugggcggggccgaggaccccgcgcccuuccuggacagcuggcagguccccuccagccucaccuccgucgggcagacgcgcuuccggccggacagcugcgccaccaccgacugcucccccugccugcgcauggugagcaaccggaccuucuccgccugccaccgcuucgugcccccggagagcuucugcgagcuguggauccgggacacgaaguacguccagcagcccugcguggcccucaccguguacgucgccaugugccacaaguuccacgugugcaucgaguggcgccgguccgacuacugccccuuccugugcagcagcgacuccaccuaccaggcgugcgugaccgccugcgagcccccgaagacgugccaggacgggauccugggcccccucgaccccgagcacugccagguccugggggagggcugcgugugcagcgaggggaccauccugcaccgccggcacuccgcccucugcauccccgaggccaagugcgcgugcaccgacagcaugggcgucccgcgcgcccugggcgagaccuggaacuccagccuguccgggugcugccagcaccagugccaggcccccgacacgaucgugcccguggaccucggcugccccagcccgcggcccgaguccugccugcgcuucggggaggucgcccugcuccugcccaccaaggaccccugcugccugggcaccgugugcgugugcaaccagacccucugcgaggggcuggccccgacgugccggcccggccaccgccugcucacccacuuccaggaggacagcugcugccccuccuacagcugcgagugcgaccccgaccugugcgaggcggagcuggucccguccugccggcaggaccagauccucaucaccggccgccugggggacagcugcugcaccuccuacuucugcgccugcggcgacugccccgacagcauccccgagugccaggagggggaggcccugacggugcaccggaacaccaccgagcucugcugcccccuguaccagugcgugugcgagaacuuccgcugcccgcagguccagugcggccuggggaccgcccucguggagguguggucccccgaccggugcugccccuacaagagcugcgagugcgacugcgacacgauccccgucccgcgcugccaccugugggagaagucccagcuggacgaggaguucaugcacagcguggagaacgugugcggcugcgccaaguacgagugcgucaaggcgcccgugugccucagccgcgagcugggcgugaugcagcccgggcagaccgucguggagcuguccgccgacggcgugugccacaccagccggugcaccacgguccucgacccgcugaccaacuucuaccagaucaacaccaccuccgugcugugcgacauccacugcgaggccaaccaggaguacgagcacccccgcgaccucgccgccugcugcgggagcugccggaacguguccugccuguucacguuccccaacggcaccaccagccuguuccuccccggggcguccuggaucgccgacugcgcccgccaccacugcagcuccaccccgcugggcgccguccuggugcggagccccaucuccugcccgccccucaacgagacggagugcgcgaaggugggcgggagcgucgugccgucccuggagggcugcugccggaccugcaaggaggacgggcggagcugcaagaaggugaccauccgcaugaccauccggaagaacgagugccgcuccagcacccccgucaaccugguguccugcgacggccggugccccagcgccuccaucuacaacuacaacaucaacacguacgcccgcuucugcaagugcugccgggaggugggccugcagcgccggagcguccagcuguucugcgccaccaacgccaccugggugcccuacaccgugcaggagccgacggacugcgcgugccaguggagcuga

SEQ ID NO: 34134 - RNA, 7035 nt, Artificial Sequence
  derived and/or modified sequence opt1 from OTOGL__Homo_sapiens__NP_775862
augauccccugguccaucuuccugcuccacgugcugcuguucucccuccaggaguacaucugcgccuccuccauccugaugggcaccagcaagaacggguucaacgagaaccgccagaagcgggcccugcucgcggcccaguucgaggccaccagcccccgcuacuucuuccacgacgccaucaacuggggcgaguccaagaucaagggguccugccccuacgagugccugaacggcgccuucugcagcaagaccgggaccugcgacugccagaucuuccaggcgcugggcacccggugccagaucauccccaacaugggcaacgggcgcgacggcaucugcaagaccugggggcaguaccacuucgagaccuucgacggcaucuacuacuacuuccccgggaacugcuccuacaucuucgccaaggacugcggcgaccucgagccccgguacaccgugugggugcacaacagccccaagugccugggcuccguguacagcugcuaccgcuccaucagccuguucuucuccaaccaggaggagauccggaucuacgggcacgagaucaagaagaacggcaucagccucacccugccccagaccaucgggcagaucuucaucgagaagcuggccgacuacauccucgucaagaccaccuucggcuucucccuggccugggacggcaucagcgggaucuaccugaagcucuccgaggaccacaagggcaagagcugcgggcugugcggcaacuacaacgacauccagagcgacgacuucaucauccugcaggaggacuacaccgaggacaucgcgauguucgccaacuccuggagcgugcagacccccgacgacacgaagugcgugcucacccccuccgacuuccccaaccccugcagcuccgggaugcccgccuucgaggccaucuucuucaagugccagauccugcugcaguuccccuuccucagcugccacgaguacaucgaccccuaccuguacaucgccuccugcgucaacgaccugugcaagaccgacgacgacgagaccuacugccgcgcggccacggaguacgcccgggccugcagccacgccggcuaccccauccaggacuggcgcgacgacuuccccgcgugcaccgacaagugcgacgacuccuucgugcaccgggacugcaucagcugcugcccgccgaccugcaccuucgagaagcagugccucggcuccaaccugcacugccuggacgggugcuacugccccgacggccucgugauggacaacgggacgugcaucagccuggagaacugccccugcggcuuccacgggcuggccuacuccgucggcagcaagaucgagcaggagugcaccgagugcgugugcgugggcggggucuggaacugcaccgagcaggacugcccggugcagugcuccguggucggcgacagccacuucaccacguucgacgggcgccacuacuccuucaucggcaugugccaguacauccucgugaaggggaccggcaaggacaaguucaccaucacccugcagaaggcccccugcgagcagaaccugggccucgugugccugcagagcaucacgcugauccucgaggacgacuucaacaagcaggucacccuggggcggggcgggcagauccugaccucccccaaccagggcuucaaccucaacggcaucguggagauccagacccugagcagccuguucauccuccugaagacgaccuucgggcugaagauccucuucgccaucgacggcgagcgcaucuacauccagcugaccuccgccuggaagcggcgcacccuggggcugugcggcacguucaacgggaacauccgggacgacuuccucagccccuccggcaugaucgagggcaccccgcagcugcacgcgaacgccuggcgcgugagcagcacgugcuucgcccccguccacgugcccguggucgaccccugcaacaucaaccagcagaacaucggguacgccgcccacugcgacgugauccaccaggagcuguucgcgccgugccacaucuacaucagccccggccucuacuaccagcugugccggcacgacgccugcaagugcggguccagcugccugugcaacgcccucgcccacuacgcguaccugugcggccagcacgggguccccaucgacuuccgcacccagaucuccuucugcgccguggugugccagaagggcaugcuguaccaccacugcagcuccuucugccuccacagcugcaucucccugagcuccccggagcagugcagcgacgacugcgccgagggcugcaacugccccgaggggaaguucuacgaggacacccugaacuucugcguccccaucuuccacugccggugccacuaccgcggcuccguguaccagcccggggagcucaucccgacccccagcggccugugccagugcagcaacgggaccgugaagugcgacgagcuggccacccccuccgccguccacaucugccccgagggcaaggaguacuucgacugccgcuucccggaccccgagcuccccgcgggcggggugaacugcgagaccacgugcgccaaccuggccaugaacuucacgugcacccccagcuccccgugcaucagcggcugcgugugcgcccccgggauggccgagcaccggggcaagugcuacguccccgaguccugccccugcaucuggaaggacugggaguaccugagcggggaggugaucgcgaccccgugcuacacgugcgugugccgccggggcauguucaacugcaccuacuaccccugccccgccgucugcaccaucuacggcgaccgccacuacuacuccuucgacgggcucgaguacgacuacaucagcgacugccagguguuccugaucaaguccgccgacgacagcgacaucuccgugaucgcccagaacaagaagugcuucgacaacgacaucgucugcagcaaguccgugcugaucagcgugggcgacaccgagaucuaccucaacgacacgcccuacaagcagaagcaguccggguucuuccuggagaacaagagcaccuaccagcuguggaaggccggcuacuacaucgucguguacuucccggagaaggacaucaccauccucugggaccggaagaccacgauccacaucaaggugggcccccaguggaagaacaagcuguccgggcugugcggcaacuucgacaagugcaccagcaacgacaugaccaccuccaacaaccucgagguccgcaacgcgcggguguucggggacagcugggcccugggccagugcgagagccccgacgagacgaucaagcccugcgaggcccaccagaacaaguucccguacgccaagaaggagugcuccauccuguacagcgacaucuucgcguccugccgcaacgugaucgacgucaccagcuucgccaagaacugccacgaggacacgugcaacugcaaccucgggggcgacugcgagugccugugcaccuccaucgccgccuacgccuacaagugcugccaggagggcaucagcauccacuggcgguccagcacggugugcucccuggacugcgaguacuacaacgaggggcucggcgaggggcccuacaugcuggcgagcuacggccaguccgggcuggugcucggcgccaacaugaccagccgcuccgucuucugccugccccggagcuccgugcacaccagccuguucuucuacuucaugaucaccccgggccucuucaaggagaagguguccagccuggcccuggucucccucgagagcgccgagcgccccaacuacuuccuguacgugcacgacaacgacacgcugagccucgagcugugggaggccaacuccgcguuccaccggcgcgccaccuucuuccaccaccaggggcuguggauccccggcuacagcgccuucgagcucuacuccaagaagggguucuucaucaucuucaccgacagcuccgugaaggccagcaaguacgacgacuccgaggaguucaagcacagcuccagcuucuccaucgaggagauccaggccgcgguccccuaccggaagaugugcgaguggcgcuacgagccgugcgccacccccugcuucaagacgugcagcgaccccgaggcccuggccugcaaguuccugcccccgguggagggcugccuccccuacugccccaagaacaugauccuggacgaggugacccugaagugcgucuacccccgggacugcaucccggugauccccaccgagcccacccucaugcccccggcgaagcccacggugcccauguucaccgucugggagaugaucacccccuccgacaucaccguguucgacaugcugaccccgacgaccgggcuggagugcgagccccagaaguucgaccccguguacgacugcagccaguacaucugccucaacauggaguggcagcuguacaacuggucccugaacugccccaaggacgucgagaugccggacugcggcuuccgcggccggcccguccaggugaacagcgacaucugcugccccgagugggagugccccugccgcugcuccaugcucagcgagcuguccaucaucaccuucgacgggaacaacgccgcccuguacagcauggccagcuacauccucguccgcaucccgggcgagaucaucguggcccacaucgagaagugcuccaugaaccagaacgggaacagccugaagaagcuggcgcccuccggccggaucagcggccucugcuucaagaagcugaacgugaccacgcccauccacaagaucaucgucaaccgccuggcccggaagguggagguggacuccaucgucgugccgcuccccuucagcucccaggagcugagcaucgaggacuccgggagcauguacgucaucaccacccccgccggccugaucaucaaguggucccaccucaccgggaucaucgacauccacuucggcuuccgcuucaaccugagcuccuacacggaggggcugugcggcaucugcaacgaggaccccgacgacgaccuccggaugcagaacggcaccaucaucaccaacauggaggacaucgggcuguucaucgagagcugggagaucgagaaguccuucgaggugaccaugcgccggccggugcgcaacugcacggagcacgacugcagccagugcaucgaccugcucaaccggcgcaucuucauccccugccacgacaaggucucccccgaggacuucugcgagaagauguggaucaacuacaccuacuucuggaacuacgagugcgacgcccugagcgccuacguggcgcugugcaacaaguucgacaucugcauccaguggcggacccccgacuacugcucccucagcugcccggagggcaaggaguaccagcccugcgugcgccccugcgaggcccggaccugccugaaccagugguucuacgggcacacgagcugccugaaccuccgcgaggacugcgucugcaaggugggcaccauccugcaccggccccacuccgcccagugcaucccggagaaggagugcgccugcaccgacagcgaggaccagccccgcaccgccggggagaucuggaacggcggcaucgacgagugcacgcuguacaagugccucgagaacggguccaucauccccaucgagcccgacugcgacgaggagccgacccccgugugcgagcgggaggcggaggucgugaugggcaucaucgacaaguggaccugcugcagcaaggaggugugcgggugcgacaccacgcugugcgagaccuccaucccgaccugcaccaacagccagaagcugaucgucggccacagcccccugagcugcugcccgcaguacaagugcgagugcgacccccugaagugccccuccaucagcacgcccgagugccgcgaggaccaguucaugauccaggugcggcaggaggagccgugcugcuucucccccuucugcgugugcgagagcugcaccaagcccgucccccugugccacgacggggaguuccucaccguggaccugaacuccacccacuucugcugcccgcaguacuacugcgugugcgagcccaaccugugccccaugccgcugcucaacugcgccgaggacaugaaccuggucaaggagaacgugagcggccagugcugccccacguggcacugcgagugcaacugcgagaaccugaucaugccgaccugcgaggugggcgaguucaccgccaucgaccacaacuuccaguccgacugcgggugcauccaguaccucugcgagaaggacgacgucugcguguuccaggaggugagcguccugaaccccggccaguccaugaucaaguaccuggaggaggacuucugcuacgccaucgagugccucgaggagaaggacaaccacaccggguuccacacgcugaacuucacccuggugaacugcagcaagaagugcgacgugcaccaggucuacaccccgucccccagcgacuacggcugcugcgggaccugcaagaacgugagcugcaaguuccacauggagaacggcaccuccguggucuacgccgugggcagcacguggcacuacaacugcaccaccuacgagugcgugaagaccgacgagggggcgaucauccucaacuacacgauggucugcccgcccuucaacgagaccgagugcaagaugaacgagggcaucgugaagcuguacaacgaggggugcugcaagaucugcaagcgcgaggagcggaucugccagaaggugaucaucaaguccgucauccgcaagcaggacugcaugagccaguccccgaucaacguggccagcugcgacggcaagugccccuccgccaccaucuacaacaucaacaucgagagccaccuccgcuucugcaagugcugccgggagaacggcgugcgcaaccucuccgucccccuguacugcagcgggaacggcaccgagaucauguacacgcugcaggagcccaucgacugcacgugccaguggaacuga

SEQ ID NO: 34135 - RNA, 1434 nt, Artificial Sequence
  derived and/or modified sequence opt1 from OTOL1__Homo_sapiens__NP_001073909
auguggauguucagcuggcugugcgccauccucaucauccuggccaucgcgggcaugaacaccaucgccaagaccacgccccacaccaaguucaccaagaaguccgaggagcgcgagaugccgaaggggcugaagcccagcuccggcccgccgcccgaggaggaggagacccucuucacggagauggccgagauggccgagcccaucaccaagcccagcgcccuggacuccguguucgggaccgcgacccugagccccuucgagaacuucacgcucgaccccgccgacuucuuccugaacugcugcgacugcugcucccccguccccggccagaagggggagcccggcgagaccggccagccggggcccaagggcgaggccgggaaccugggcauccccgggcccccgggcguggugggcccccaggggccccggggcuacaagggggagaagggccucaagggcgagcgcggggaccagggcguccccggguacccgggcaagcccggggcccagggcgagcccggccccaagggggacaagggcaacaucgggcugggcggggugaagggccagaagggcagcaagggggacacgugcggcaacugcaccaagggggagaagggcgaccagggggcgaugggcuccccgggccugcacgggggccccggggccaagggcgagaagggcgagaugggggagaagggcgagaugggggacaagggcugcugcggggacagcggcgagcggggcgggaagggccagaagggggagggcgggaugaagggcgagaagggcuccaagggggacagcggcauggaggggaaguccggccgcaacgggcuccccggcgccaagggcgaccccgggaucaagggcgagaagggggagcugggcccgcccgggcugcucggccccaccggcccgaagggggacaucggcaacaagggggugcggggccccaccggcaagaaggggagccgcggcuucaagggguccaagggcgagcuggcccgggucccccgcagcgccuucuccgcggggcugagcaagcccuucccgccgcccaacauccccaucaaguucgagaagauccucuacaacgaccagggcaacuacucccccgugaccggcaaguucaacugcagcauccccgggaccuacguguucagcuaccacaucacgguccggggccgccccgcccggaucucccugguggcccagaacaagaagcaguucaagagccgcgagacccuguacgggcaggagaucgaccaggccucccuccuggugauccugaagcucagcgccggcgaccaggucuggcuggagguguccaaggacuggaacgggguguacgucagcgcggaggacgacuccaucuucaccggcuuccugcucuaccccgaggagaccagcggcaucuccccguga

SEQ ID NO: 34136 - RNA, 1839 nt, Artificial Sequence
  derived and/or modified sequence opt1 from OTOP1__Homo_sapiens__NP_819056
augcuggagggccucgggagccccgccuccccgcgcgccgcggccagcgccuccguggccggcagcuccgggcccgccgcgugcagcccgcccuccagcuccgccccgcggagccccgagucccccgcgccccgccggggcgggguccgcgccagcgugccgcagaagcuggccgagaugcuguccagccaguacggccucaucguguucgucgccggccugcugcuccugcuggccugggccgugcacgccgcggggguguccaagagcgaccuccugugcuuccugaccgcccucaugcugcugcagcuccuguggaugcugugguacgucggccgguccagcgcccaccgccgccucuuccggcugaaggacacccacgccggggccggcuggcugcggggguccaucacccucuucgcggugaucaccgugauccugggcugccugaagaucggcuacuucaucggguucagcgagugccucagcgccaccgagggcgucuuccccgugacccacuccgugcacacgcugcugcaggucuacuuccucugggggcacgccaaggacaucauccagagcuucaagacccuggagcgcuucggcgugauccacuccguguucaccaaccugcuccugugggccaacggcguccugaacgagagcaagcaccagcucaacgagcacaaggagcggcugaucacccugggguucggcaacaucacgaccgugcucgacgaccacacgccccagugcaacugcaccccgcccacgcugugcaccgccaucucccacgggaucuacuaccuguaccccuucaacaucgaguaccagauccucgcgagcaccaugcuguacgugcuguggaagaacaucggccgcaaggucgacucccaccagcaccagaagaugcaguucaagagcgacggggugauggugggcgccguccucggccugaccgugcuggccgccacgaucgccguggucguggucuaccucauccacaucgggcgguccaagaccaagagcgaguccgcgcugaucauguucuaccuguacgccaucacccuccugaugcugaugggcgccgccgggcuggcgggcauccgcaucuaccggaucgacgagaagucccucgacgagagcaagaaccccgcccgcaagcuggacagcgaccugcucguggggaccgccuccggcagcuggcugaucuccuggggcagcauccuggccauccucugcgccgaggggcacccccgguacacgugguacaaccugcccuacuccauccuggcgaucguggagaaguacauccagaaccucuucaucuucgagagcauccaccgcgagcccgagaagcugagcgaggacauccagacccugcgggucgugaccgugugcaacggcaacaccaugccccucgccuccagcugccccaaguccgggggcgucgcccgcgacguggccccgcaggggaaggacaugccgcccgccgcgaacggcaacgugugcaugcgggagagccacgacaaggaggaggagaagcaggaggaguccagcuggggcgggucccccagccccguccgccugccccgcuuccugcagggcaacgccaagcggaaggugcuccgcaacaucgccgccuuccuguuccugugcaacaucucccucuggaucccgcccgccuucgggugccggcccgaguacgacaacggccuggaggagaucguguucggcuucgagcccuggaucaucgucgugaaccuggcgaugcccuucagcaucuucuaccgcaugcacgccgccgccucccucuucgagguguacugcaagaucuga

SEQ ID NO: 34137 - RNA, 387 nt, Artificial Sequence
  derived and/or modified sequence opt1 from OTOR__Homo_sapiens__NP_064542
auggcccgcauccugcuccuguuccugcccggccucguggccgucugcgcggugcacgggaucuucauggaccggcuggccagcaagaagcugugcgccgacgacgagugcguguacaccaucucccucgccagcgcccaggaggacuacaacgcgccggacugccgcuucaucaacgucaagaagggccagcagaucuacguguacuccaagcuggugaaggagaacggggccggcgaguucugggccgggagcgucuacggcgacggccaggacgagauggggguggugggcuacuucccccggaaccuggucaaggagcagcgcguguaccaggaggccaccaaggaggugcccacgaccgacaucgacuucuucugcgaguga

SEQ ID NO: 34138 - RNA, 978 nt, Artificial Sequence
  derived and/or modified sequence opt1 from OTP__Homo_sapiens__NP_115485
augcugagccacgccgaccuccuggacgcccgccugggcaugaaggacgcggccgagcuccuggggcaccgggaggccgugaagugccgccugggcgucgggggcuccgaccccgggggccacccgggcgaccucgcccccaacagcgaccccguggagggggccacccugcugcccggcgaggacaucaccacggugggguccaccccggcgagccucgccgucuccgccaaggaccccgacaagcagcccggcccccagggcgggccgaaccccagccaggccggccagcagcaggggcagcagaagcagaagcggcaccgcacccgguucacccccgcgcagcugaacgagcuggagcgcuccuucgccaagacgcacuaccccgacaucuucaugcgggaggagcucgcccugcgcaucggccugaccgagagccggguccaggugugguuccagaaccgccgggccaaguggaagaagcgcaagaagaccaccaacguguuccgggccccggggacgcuccugcccacccccggccugccccaguucccguccgcggccgccgccgccgcggccgccaugggcgacagccucugcuccuuccacgccaacgacacccgcugggccgcggccgccaugcccggggugagccagcugccccugcccccggcccucggccggcagcaggccauggcgcagucccugagccagugcucccuggccgccgggcccccgcccaacagcaugggccucuccaacagccuggccggguccaacggcgcgggccugcagagccaccucuaccagcccgccuuccccgggauggugcccgccagccugcccggcccguccaacgucagcgggagcccccagcugugcuccucccccgacagcuccgacguguggcgcggcaccagcaucgccucccuccggcgcaaggcccuggagcacacggugagcauguccuucaccuga

SEQ ID NO: 34139 - RNA, 816 nt, Artificial Sequence
  derived and/or modified sequence opt1 from OTUB1__Homo_sapiens__NP_060140
auggccgccgaggagccccagcagcagaagcaggagccgcugggcagcgacuccgagggggugaacugccucgcguacgacgaggccaucauggcccagcaggaccgcauccagcaggagaucgccguccagaacccccuggugagcgagcggcuggagcucuccgugcuguacaaggaguacgccgaggacgacaacaucuaccagcagaagaucaaggaccugcacaagaaguacagcuacauccgcaagacccggcccgacggcaacugcuucuaccgcgcguucggguucucccaccucgaggcccugcuggacgacagcaaggagcuccagcgguucaaggccgucuccgccaagagcaaggaggaccuggugucccagggcuucaccgaguucacgaucgaggacuuccacaacaccuucauggaccugaucgagcaggucgagaagcagaccagcguggcggaccuccuggccuccuucaacgaccagagcaccuccgacuaccuggugguguaccuccgccugcugacgagcggguaccuccagcgggaguccaaguucuucgagcacuucaucgagggcggccgcaccgucaaggaguucugccagcaggagguggagcccaugugcaaggagagcgaccacauccacaucaucgcccuggcccaggcccuguccgugagcauccaggucgaguacauggaccgcggggagggcgggaccaccaacccgcacaucuuccccgagggcuccgagcccaagguguaccuccuguaccggcccgggcacuacgacauccuguacaaguga

SEQ ID NO: 34140 - RNA, 1446 nt, Artificial Sequence
  derived and/or modified sequence opt1 from OTUD1__Homo_sapiens__NP_001138845
augcagcuguacagcuccgugugcacccacuaccccgccggcgccccggggcccaccgcggccgcccccgcgcccccggccgccgccacgcccuucaaggucagccuccagccgcccggcgccgccggggcggcccccgagcccgagaccggcgagugccagcccgccgccgccgcggagcaccgcgaggccgccgccgugcccgccgcgaagaugccggccuucuccagcugcuucgagguggucuccggggccgccgcccccgcgagcgccgccgccggcccgcccggcgccuccugcaagccgccccugccgccccacuacaccagcaccgcgcagaucacggugcgggcccugggggccgaccgccuccugcugcacggccccgaccccgugcccggggccgcgggcuccgccgccgcgccccgggggcgcugccuccugcuggccccggcccccgccgcccccgugcccccgcggcgcggcagcuccgccuggcuccuggaggagcugcuccggcccgacugccccgagcccgccggccuggacgcgacccgcgaggggcccgaccggaacuuccgccugagcgagcaccggcaggcccucgccgccgccaagcaccgcggccccgcggccacccccggguccccggaccccggccccggccccuggggcgaggagcaccuggccgagcgggggccgcgcgggugggagcggggcggggaccgcugcgacgcccccggcggcgacgcggcccggcgccccgaccccgaggccgaggccccgcccgccgggagcaucgaggcggcccccuccagcgccgccgagcccgucaucgugucccggagcgacccgcgcgacgagaagcuggcccucuaccuggcggaggucgagaagcaggacaaguaccugcggcagcgcaacaaguaccgcuuccacaucauccccgacggcaacugccucuaccgggccguguccaagaccguguacggggaccagagccugcaccgcgagcugcgggagcagacgguccacuacaucgccgaccaccucgaccacuucagcccccugaucgagggcgacgugggggaguucaucaucgccgccgcgcaggacggcgccugggccggcuaccccgagcugcucgccauggggcagaugcugaacgugaacauccaccugaccaccggcgggcgccucgaguccccgaccgucagcacgaugauccacuaccugggccccgaggacucccugcggcccagcaucuggcucuccuggcugagcaacgggcacuacgacgcgguguucgaccacuccuaccccaacccggaguacgacaacuggugcaagcagacccaggugcagcgcaagcgggacgaggagcuggccaagagcauggccaucucccucagcaagauguacaucgagcagaacgccugcuccuga

SEQ ID NO: 34141 - RNA, 3150 nt, Artificial Sequence
  derived and/or modified sequence opt1 from OTUD4__Homo_sapiens__NP_001096123
auggccugcauccacuaccugcgcgagaaccgggagaaguucgaggccuucaucgagggcagcuucgaggaguaccucaagcgccuggagaacccccaggaguggguggggcaggucgagaucuccgcgcugagccucauguaccggaaggacuucaucaucuaccgcgagccgaacgugucccccagccaggugaccgagaacaacuuccccgagaagguccugcugugcuucuccaacggcaaccacuacgacaucguguaccccaucaaguacaaggagagcuccgccaugugccagagccuccuguacgagcugcucuacgagaagguguucaagaccgacgucuccaagaucgugauggagcuggacacgcuggagguggccgacgaggacaacagcgagaucuccgacagcgaggacgacuccugcaagagcaagaccgccgccgcggccgccgacgucaacggguucaagccgcucuccggcaacgagcagcugaagaacaacgggaacagcaccucccugccccucagccggaaggugcugaagucccugaaccccgccguguaccgcaacgucgaguacgagaucuggcucaagagcaagcaggcgcagcagaagcgggacuacagcaucgccgccggccugcaguacgaggugggcgacaagugccaggugcgccuggaccacaacgggaaguuccucaacgccgacguccagggcauccacuccgagaacgggcccgugcugguggaggagcugggcaagaagcacaccagcaagaaccucaaggccccgccgcccgaguccuggaacacggucagcgggaagaagaugaagaagcccuccaccagcggccagaacuuccacuccgacguggacuaccggggccccaagaaccccagcaagcccaucaaggcgcccuccgcccugccgccccgccugcagcaccccagcggggugcggcagcacgccuucuccagccacuccagcggcucccagagccagaaguucuccagcgagcacaagaaccucucccgcacccccagccagaucauccggaagccggaccgcgagcgggucgaggacuucgaccacaccagccgcgaguccaacuacuucgggcugagccccgaggagcggcgcgagaagcaggccaucgaggagucccggcugcucuacgagauccagaaccgcgacgagcaggccuuccccgcgcugagcuccagcuccgugaaccagagcgccucccagagcuccaaccccugcgugcagcgcaagagcucccacgucggcgaccggaagggcagccgccggcgcauggacacggaggagcggaaggacaaggacuccauccacgggcacagccagcuggacaagcgcccggagcccuccacccucgagaacaucaccgacgacaaguacgccaccgugagcagccccuccaagagcaagaagcuggagugccccuccccggccgagcagaagcccgccgagcacgucagccuguccaaccccgcgccgcuccuggugagccccgaggugcaccugacgcccgccguccccucccucccggccaccgugcccgccuggcccagcgagcccaccaccuucggcccgacgggggugcccgcccccauccccguccuguccgugacccagacccugaccacgggcccggacagcgcggugucccaggcccaccucacccccagccccguccccguguccauccaggccgugaaccagccgcugaugccccugccccagacccucagccuguaccaggacccccuguacccgggguuccccugcaacgagaagggcgaccgggccaucgucccgcccuacucccucugccagaccggcgaggaccugcccaaggacaagaacauccugcgcuucuucuucaaccugggggugaaggcguacagcugccccaugugggcgccccacuccuaccucuacccgcugcaccaggccuaccuggccgccugccggauguaccccaaggugcccguccccguguacccgcacaaccccugguuccaggaggcccccgccgcccagaacgagagcgacugcacgugcaccgacgcccacuuccccaugcagaccgaggccuccgugaacggccagaugccgcagcccgagaucgggccgcccaccuucagcagcccccucgucaucccgcccucccaggugagcgagucccacggccagcugagcuaccaggcggaccuggaguccgagacgcccgggcagcuccugcacgccgacuacgaggagagccuguccggcaagaacauguucccccagcccagcuucggccccaaccccuuccucgggccggugcccaucgccccgcccuucuucccccacgucugguacggcuaccccuuccagggguucaucgagaaccccgugaugcgccagaacaucgugcugcccuccgacgagaagggcgagcuggaccucagccuggagaaccuggaccucuccaaggacugcgggagcgucuccaccguggacgaguucccggaggcccggggcgagcacgugcacagccugcccgaggccuccgucagcuccaagcccgacgagggccgcaccgagcagagcucccagacccggaaggcggacacggcccuggccagcaucccgcccguggccgaggggaaggcgcacccgcccacccagauccucaaccgcgagcgggagaccgugcccgucgagcuggagcccaagcgcaccauccagagccugaaggagaagacggagaaggugaaggaccccaagaccgccgccgacguggucucccccggcgccaacagcguggacucccgggugcagcgcccgaaggaggagagcuccgaggacgagaacgaggucagcaacauccuccgguccgggcgcagcaagcaguucuacaaccagaccuacggcucccggaaguacaagagcgacuggggcuacuccgggcgcggcggguaccagcacgugcgcagcgaggaguccuggaagggccagcccagccggucccgcgacgagggguaccaguaccaccggaacgugcgcggccggcccuuccgcggcgaccggcgccggagcgggaugggcgacgggcaccgcggccagcacaccuga

SEQ ID NO: 34142 - RNA, 2781 nt, Artificial Sequence
  derived and/or modified sequence opt1 from OTUD7A__Homo_sapiens__NP_570971
auggugagcuccguccugcccaacccgaccagcgccgagugcugggccgcgcuccugcacgaccccaugacccuggacauggacgccgugcucuccgacuucgugcgcagcacgggcgccgagcccgggcuggcccgggaccugcucgagggcaagaacugggaccugaccgccgcgcuguccgacuacgagcagcuccgccagguccacaccgccaaccugccccacguguucaacgaggggcggggcccgaagcagcccgagcgcgagccccagcccgggcacaagguggagcggccgugccugcagcgccaggacgacaucgcccaggagaagcggcucagccgcggcaucucccacgccagcuccgcgaucgucagccuggcccggucccacguggccagcgagugcaacaacgagcaguucccccuggagaugcccaucuacaccuuccagcuccccgaccuguccguguacagcgaggacuuccgcuccuucaucgagcgggaccugaucgagcaggccacgauggucgcccucgagcaggcgggccgccugaacugguggagcaccgugugcaccuccugcaagcggcugcucccgcuggccaccacgggggacggcaacugccugcuccacgccgccagccuggggauguggggcuuccacgaccgcgaccuggugcuccggaaggcccuguacaccaugaugcgcaccggggcggagcgggaggcccugaagcgccgguggcgcuggcagcagacccagcagaacaaggaggaggagugggagcgggaguggacggagcuccugaagcuggccuccagcgagccccgcacccacuucagcaagaacggcggcaccgggggcggggucgacaacuccgaggaccccguguacgagagccucgaggaguuccacguguucguccuggcccacauccugcgccggcccaucgugguggucgccgacaccaugcuccgcgacuccggcggcgaggcguucgccccgauccccuucgggggcaucuaccugccccuggaggugcccccgaaccggugccacugcagcccccucgugcuggccuacgaccaggcccacuucuccgcccuggucagcauggagcagcgcgaccagcagcgggagcaggcggugaucccccucacggacuccgagcacaagcugcugccccuccacuucgccguggacccggggaaggacugggaguggggcaaggacgacaacgacaacgcccgccuggcccaccugauccucagccuggaggcgaagcugaaccugcuccacuccuacaugaacgucaccuggauccggauccccagcgagacccgcgcgccccuggcccagcccgaguccccgaccgccagcgccggggaggacgugcagucccuggccgacagccucgacuccgaccgggacagcgucugcuccaacagcaacuccaacaacggcaagaacggcaaggacaaggagaaggagaagcagcgcaaggagaaggacaagacgcgggccgacagcguggccaacaagcuggggagcuucuccaagacccugggcaucaagcucaagaagaacaugggcgggcucgggggccuggugcacggcaagauggggcgcgccaacagcgccaacggcaagaacggggacuccgcggagcggggcaaggagaagaaggccaagagccgcaagggguccaaggaggagagcggcgccuccgccagcaccucccccagcgagaagaccacgcccuccccgaccgacaaggccgcgggcgccagccccgccgagaagggcggcgggccccgcggggacgccuggaaguacuccaccgacgucaagcugagccugaacauccugcgggcggccaugcagggcgagcggaaguucaucuucgccgggcuccugcugaccucccaccgccaccaguuccacgaggagaugaucggcuacuaccucacgagcgcccaggagcgguucuccgccgagcaggagcagcgccgccgggacgcggccaccgccgccgccgcggccgccgccgccgcggccgccaccgccaagcggcccccgcgccgccccgagaccgagggggugcccgugcccgagcgggcgagcccgggcccgcccacgcagcugguccugaagcucaaggagcgccccagccccgggcccgccgccggccgggccgcccgcgcggccgccggcgggaccgccucccccggcgggggcgcccggcgcgcgagcgccuccgggcccgugccgggccggagcccgcccgcccccgcccgccaguccgugauccacguccaggccagcggcgcgcgggacgaggccugcgcccccgccgugggggcccugcgccccugcgcgaccuacccccagcagaaccggucccugagcucccagagcuacucccccgcccgcgccgccgcgcuccggaccgugaacacggucgagagccuggcccgcgccgugccgggcgcccugcccggggccgcgggcaccgccggggccgccgagcacaagucccagaccuacaccaacggcuucggcgcccuccgggacgggcuggaguucgcggacgccgacgcccccaccgcccgcagcaacggcgagugcgggcggggcgggccgggccccgugcagcgccgcugccagcgggagaacugcgccuucuacggccgcgcggagacggagcacuacugcuccuacugcuaccgggaggagcugcgccggcgccgggaggcccgcggggcccggcccuga

SEQ ID NO: 34143 - RNA, 2559 nt, Artificial Sequence
  derived and/or modified sequence opt1 from OTUD7B__Homo_sapiens__XP_011508087
augacccuggacauggacgccgugcucagcgacuucguccgcuccaccggcgccgagcccgggcuggcgcgggaccugcucgagggcaagaacugggacgugaacgccgcccugagcgacuucgagcagcugcgccaggugcacgccgggaaccucccgcccuccuucagcgagggcuccgggggcagccggacgcccgagaagggcuucuccgaccgcgagcccacccggccgccccgccccauccugcagcggcaggacgacaucguccaggagaagcgccugagccgggggaucucccacgccagcuccagcaucgugucccucgcgcgcagccacguguccagcaacggcgggggcgggggcuccaacgagcacccccuggagaugcccaucugcgccuuccagcugcccgaccucaccgucuacaacgaggacuuccggagcuucaucgagcgcgaccugaucgagcaguccaugcugguggcccucgagcaggccggccggcugaacuggugggugagcgucgaccccaccagccagcgccugcucccccuggcgacgaccggggacggcaacugccugcuccacgccgccucccuggggauguggggcuuccacgaccgggaccugaugcuccgcaaggcccuguacgcccugauggagaagggcguggagaaggaggcgcucaagcggcgcuggcgguggcagcagacccagcagaacaaggagagcgggcugguguacaccgaggacgaguggcagaaggaguggaacgagcugaucaagcucgccuccagcgagccgcgcaugcaccugggcacgaacggggccaacugcggcggggucgaguccagcgaggagcccguguacgagucccuggaggaguuccacguguucguccucgcccacgugcugcggcgccccaucguggucguggccgacaccaugcugcgcgacagcggcggcgaggcguucgcccccaucccguucgggggcaucuaccucccccuggaggugcccgccucccagugccaccggagcccccugguccucgccuacgaccaggcccacuucuccgcgcuggugagcauggagcagaaggagaacaccaaggagcaggccgugaucccgcugaccgacuccgaguacaagcuccugccccugcacuucgccgucgaccccgggaagggcugggagugggggaaggacgacagcgacaacgugcgccucgccuccgucauccugagccuggaggugaagcuccaccuccugcacuccuacaugaacgugaaguggaucccccugagcuccgacgcccaggucaagacgagcccgaccagcacccuggcgccccuggcccagcccgagucccccaccgccagcgccggcgacgagccgcgguccacgcccgagagcggcgacuccgacaaggagagcgugggguccagcuccaccagcaacgagggcgggcgccggaaggagaaguccaagcgcgaccgggagaaggacaagaagcgcgcggacagcguggccaacaagcugggcuccuucgggaagacccucggcagcaagcugaagaagaacaugggcgggcugaugcacuccaagggcagcaagcccgggggcgucggcaccgggcucggcggguccagcggcacggagacccuggagaagaagaagaagaacagccugaaguccuggaagggcgggaaggaggaggccgccggcgacgggccggugagcgagaagccgcccgccgaguccgugggcaacgggggcagcaaguacucccaggaggucaugcagagccucuccauccugcggaccgcgaugcagggggagggcaaguucaucuucgugggcacccugaagauggggcaccgccaccaguaccaggaggagaugauccagcgguaccucagcgacgccgaggagcgcuuccuggccgagcagaagcagaaggaggccgagcggaagaucaugaacggcgggaucggcgggggcccgccgcccgccaagaagcccgagcccgacgcgcgcgaggagcagcccacgggcccgcccgccgagucccgggccauggccuucagcaccggguaccccggcgacuucaccaucccccgccccuccgggggcggggugcacugccaggagccccggcgccagcuggccggcggccccugcgucgggggccucccgcccuacgcgaccuucccccggcagugcccgcccgggcgccccuacccccaccaggacagcauccccucccuggagcccggcagccacuccaaggacggccugcaccgcggggcccuccugccgccgcccuaccggguggccgacagcuacuccaacggcuaccgcgagccgcccgagcccgacgggugggccggcgggcugcggggccucccgcccacgcagaccaagugcaagcagcccaacugcagcuucuacggccaccccgagaccaacaacuucugcuccugcugcuaccgcgaggagcugcggcgccgggagcgcgagcccgacggggagcugcucgugcaccgguucuga

SEQ ID NO: 34144 - RNA, 1059 nt, Artificial Sequence
  derived and/or modified sequence opt1 from OTULIN__Homo_sapiens__NP_612357
augagccgcggcaccaugccccagccggaggccuggcccggggccuccugcgcggagacccccgcccgggaggccgccgccacggcgcgcgacggcgggaaggccgccgccagcggccagccccggccggagaugcagugccccgcggagcacgaggaggacauguaccgcgccgccgacgagaucgagaaggagaaggagcugcucauccacgagcgcggggccuccgagccccggcugagcguggcccccgagauggacaucauggacuacugcaagaaggaguggcggggcaacacccagaaggcgaccugcaugaagaugggcuacgaggaggucucccagaaguucaccagcauccgccgggugcgcggggacaacuacugcgcccugcgggccacccucuuccaggccaugucccaggccgugggccugccgcccuggcugcaggaccccgagcucaugcugcugcccgagaagcucaucagcaaguacaacuggaucaagcaguggaagcuggggcugaaguucgacggcaagaacgaggaccucgucgacaagaucaaggagucccugacgcugcuccgcaagaagugggcggggcuggccgagaugcggaccgccgaggcccgccagaucgccugcgacgagcuguucaccaacgaggcggaggaguacagccucuacgaggccgugaaguuccugaugcugaaccgggccaucgagcucuacaacgacaaggagaagggcaaggaggugccguucuucuccguccugcuguucgcccgcgacacgagcaacgaccccggccagcuccugcggaaccaccugaaccagguggggcacaccggcgggcucgagcaggucgagauguuccugcuggccuacgcggugcgccacaccauccagguguaccggcucuccaaguacaacaccgaggaguucaucacgguguaccccaccgacccgcccaaggacuggcccgucgugacccugaucgccgaggacgaccgccacuacaacauccccgugcgggucugcgaggagaccagccuguga

SEQ ID NO: 34145 - RNA, 1065 nt, Artificial Sequence
  derived and/or modified sequence opt1 from OTX1__Homo_sapiens__NP_055377
augaugagcuaccugaagcagcccccguacggcaugaacgggcucggccuggccgggcccgccauggaccugcuccaccccuccgugggcuaccccgcgaccccgcgcaagcagcggcgcgagcggaccacguucacccgcagccagcuggacguccuggaggcccucuucgccaagacccgguaccccgacaucuucaugcgcgaggagguggcccugaagaucaaccugcccgagucccgggugcaggucugguucaagaaccgccgggccaagugccgccagcagcagcagagcggguccggcaccaagagccggcccgcgaagaagaaguccagcccggugcgcgaguccagcggcuccgagagcuccgggcaguucacgccgcccgccgugagcuccagcgccuccagcuccagcagcgccuccagcuccagcgcgaaccccgccgccgccgccgcggccggccucgggggcaaccccgucgccgccgccuccagccuguccacccccgcggccagcuccaucuggagccccgccuccaucagccccggguccgccccggccagcguguccgugcccgagccccuggcggcccccagcaacaccuccugcaugcagcggagcgucgccgccggcgccgcgaccgccgccgccuccuacccgaugagcuacggccagggcgggagcuacgggcagggcuaccccacgcccuccagcuccuacuucggcgggguggacugcagcuccuaccucgcgcccaugcacagccaccaccacccgcaccagcugucccccauggcccccagcuccauggccggccaccaccaccaccacccccacgcccaccacccgcugagccaguccagcgggcaccaccaccaccaccaccaccaccaccaccagggcuacgggggcuccggccucgccuucaacagcgcggacugccuggacuacaaggagcccggggccgccgccgccuccagcgcguggaagcugaacuucaacucccccgacugccucgacuacaaggaccaggccagcuggcgcuuccaggugcuguga

SEQ ID NO: 34146 - RNA, 870 nt, Artificial Sequence
  derived and/or modified sequence opt1 from OTX2__Homo_sapiens__NP_001257453
augaugagcuaccugaagcagcccccguacgccgugaacggccucucccugaccaccagcgggauggaccugcuccaccccuccgucggcuaccccgccacgccccgcaagcagcggcgcgagcggaccaccuucacccgcgcgcagcuggacgugcuggaggcccucuucgccaagacgcgguacccggacaucuucaugcgcgaggagguggcccugaagaucaaccugcccgagagccggguccaggugugguucaagaaccgccgggccaagugccgccagcagcagcagcagcagcagaacgggggccagaacaaggugcggcccgcgaagaagaagaccucccccgcccgcgaggucagcuccgagagcgggaccuccggccaguucaccccgcccagcuccacgagcgugcccaccaucgccuccagcuccgcccccgugagcaucugguccccggcgagcaucagcccccucuccgacccccugagcaccuccagcuccugcaugcagcggagcuaccccaugaccuacacgcaggccuccggcuacagccagggguacgccggcuccaccagcuacuucgggggcauggacugcggguccuaccugaccccgaugcaccaccagcuccccggccccggcgccacccugagccccauggggacgaacgccgucaccucccaccugaaccagagcccggcgucccucagcacccagggcuacggggccuccagccugggcuucaacuccaccacggacugccuggacuacaaggaccagaccgccagcuggaagcucaacuucaacgccgacugccuggacuacaaggaccagaccuccagcuggaaguuccaggugcuguga

SEQ ID NO: 34147 - RNA, 684 nt, Artificial Sequence
  derived and/or modified sequence opt1 from OVCA2__Homo_sapiens__NP_543012
auggccgcccagcgcccccugcgggugcucugccuggcgggcuuccgccagagcgagcggggguuccgcgagaagaccggcgcccugcggaaggcccuccgcgggcgggccgagcuggucugccuguccggcccgcaccccgugcccgacccgcccgggcccgagggcgcccgcagcgacuucggcuccugcccgcccgaggagcagccccggggguggugguucagcgagcaggaggcggacguguucuccgcccucgaggagcccgccgucugccgcggccuggaggagagccuggggaugguggcccaggcgcucaaccggcugggccccuucgacgggcugcucggcuucucccagggcgccgcccuggccgcccuggugugcgcgcucgggcaggccggcgacccccgcuucccgcugccccgguucauccugcucgucagcggguucugcccccgcggcaucggcuucaaggaguccauccugcagcggccccugagccucccgucccugcacguguucggggacaccgacaaggugauccccagccaggaguccguccagcuggccagccaguuccccggcgccaucacgcucacccacuccgggggccacuucauccccgccgcggccccgcagcgccaggccuaccugaaguuccuggaccaguucgccgaguga

SEQ ID NO: 34148 - RNA, 804 nt, Artificial Sequence
  derived and/or modified sequence opt1 from OVOL1__Homo_sapiens__NP_004552
augccccgcgccuuccuggugaagaagccgugcgucagcacgugcaagcggaacugguccgagcuccccgacgaggagcgcggcgagaucuacgugcccgugagccugggguucugcccgccccagcccuaccgggagcccgagcccuccgucgccgagccgcccagcugcccccuggcgcucaacaugucccugcgcgacagcuccuacagcauggcccccggcccgugcgugguggcccagcugcccuccgaggacauggggcaccucaccgacccccagagccgggaccacggcuuccugcgcaccaagaugaaggucacccugggggacucccccagcggcgaccucuucacgugccgggugugccagaaggccuucaccuaccagcgcaugcugaaccggcacaugaagugccacaacgacgugaagcgccaccugugcaccuacugcggcaagggguucaacgacaccuucgaccucaagcggcacguccgcacccacaccggcgugcggccguacaagugcucccugugcgacaaggccuucacgcagcgcugcagccuggagucccaccucaagaagauccacggggugcagcagaaguacgcguacaaggagcggcgcgccaagcuguacgucugcgaggagugcggcugcaccagcgagucccaggaggggcacgugcugcaccucaaggagcaccaccccgacagcccccugcugcggaagaccuccaagaagguggccgucgcccuccagaacaccgugacgagccugcugcagggcagcccccaccucuga

SEQ ID NO: 34149 - RNA, 828 nt, Artificial Sequence
  derived and/or modified sequence opt1 from OVOL2__Homo_sapiens__NP_067043
augcccaagguguuccuggucaagcgccggagccucggcguguccgugcgcagcugggacgagcugccggacgagaagcgggccgacaccuacauccccgucgggcugggccgccuccugcacgacccgcccgaggacugccgguccgacgggggcagcuccagcggguccggcagcuccagcgccggcgagcccgggggcgcggaguccagcuccagcccccacgcccccgaguccgagacccccgagccgggggacgccgagggccccgacgggcaccuggccacgaagcagcgccccguggcccggagcaagaucaaguucaccaccgggaccugcuccgacagcgugguccacuccugcgaccucugcggcaagggcuuccgccugcagcggaugcugaaccgccaccucaagugccacaaccaggugaagcggcaccugugcacguucugcggcaagggguucaacgacaccuucgaccugaagcgccacgugcggacccacaccggcauccgccccuacaagugcaacgucugcaacaaggcguucacgcagcggugcagccucgagagccaccugaagaagauccacggcgugcagcagcaguacgccuacaagcagcgccgggacaagcuguacgugugcgaggacugcggguacaccggcccgacccaggaggaccucuaccugcacgucaacuccgcccaccccgggagcuccuuccugaagaagaccagcaagaagcucgccgcgcugcugcagggcaagcucacguccgcccaccaggagaacaccagccuguccgaggaggaggagcgcaaguga

SEQ ID NO: 34150 - RNA, 1488 nt, Artificial Sequence
  derived and/or modified sequence opt1 from OXA1L__Homo_sapiens__NP_005006
auggugaccuggcuguaccgcuuccuccccaccagcaacauggccgccaagcugcggagccugcucccgcccgaccugcgccugcaguucuggcuccacgcgcggcugcagaagugcuuccugagccgcggcugcggguccuacugcgccggcgccaaggccagcccccuccccgggaagauggccaugggccugaugugcgggcggcgcgagcugcuccggcugcugcaguccggccgccggguccacagcguggcgggcccgucccaguggcucgggaagccccugacgacccgccugcuguuccccgccgcccccugcugcugccggccgcacuaccuguuccuggccgcgagcggcccccgcucccucagcaccuccgccaucagcuucgccgaggugcagguccaggccccgcccgugguggccgcgacccccucccccacggccguccccgagguggccagcggggagaccgccgacgugguccagaccgccgcggagcaguccuucgccgagcugggccuggggagcuacacccccgugggccucauccagaaccugcuggaguucaugcacguggaccucggccugccgugguggggcgccaucgccgccugcacggucuucgcgcggugccugaucuucccccucaucgugaccgggcagcgcgaggccgcccggauccacaaccaccuccccgagauccagaaguucuccagccgcauccgggaggccaagcuggccggggaccacaucgaguacuacaaggcguccagcgagauggcccucuaccagaagaagcacggcaucaagcuguacaagccccugauccucccggugacccaggcccccaucuucaucagcuucuucaucgcccugcgcgagauggcgaaccugcccguccccucccuccagaccggcgggcuguggugguuccaggaccugacggugagcgacccgaucuacauccucccccuggccgugaccgccaccaugugggccguccuggagcucggcgccgagaccggggugcaguccagcgaccugcaguggaugcggaacgugauccgcaugaugccccugaucacgcuccccaucaccaugcacuucccgaccgcggucuucauguacuggcuguccagcaaccuguucucccugguccaggugagcugccuccggauccccgccgugcgcaccgugcugaagaucccccagcgcgucgugcacgaccuggacaagcucccgccccgggagggcuuccuggaguccuucaagaagggguggaagaacgccgagaugacgcgccagcugcgggagcgcgagcagcggaugcgcaaccagcucgagcuggccgcccggggcccccugcgccagaccuucacccacaacccccuccugcagccgggcaaggacaacccgcccaacauccccagcuccagcuccaagcccaaguccaaguaccccuggcacgacacccugggguga

SEQ ID NO: 34151 - RNA, 1563 nt, Artificial Sequence
  derived and/or modified sequence opt1 from OXCT1__Homo_sapiens__NP_000427
auggccgcccugaagcuccugagcuccggccugcgccucugcgcgagcgcccggggguccggcgccaccugguacaaggggugcgugugcagcuucuccaccagcgcccaccgccacacgaaguucuacaccgaccccgucgaggccgugaaggacaucccggacggcgcgaccgugcuggucgggggcuucggccugugcgggauccccgagaaccucaucgacgcccugcugaagaccggcgugaaggggcucacggccguguccaacaacgccggcgucgacaacuucgggcugggccugcuccugcggagcaagcagaucaagcgcaugguguccagcuacgugggcgagaacgcggaguucgagcggcaguaccuguccggggagcucgaggucgagcugacgccccagggcacccuggccgagcgcauccgggccgggggcgccggcgugcccgccuucuacaccccgaccggguacggcacccucgugcaggagggcgggagccccaucaaguacaacaaggacggguccgucgcgaucgccagcaagccccgcgaggugcgggaguucaacggccagcacuucauccuggaggaggccaucaccggcgacuucgcccuggugaaggccuggaaggcggaccgcgccgggaacgucaucuuccggaaguccgcccgcaacuucaaccuccccaugugcaaggccgccgagaccacggugguggaggucgaggagaucguggacaucggcgcguucgccccggaggacauccacaucccccagaucuacgugcaccggcugaucaagggggagaaguacgagaagcgcaucgagcggcugagcauccgcaaggagggcgacggggaggccaaguccgccaagcccggcgacgacguccgggagcgcaucaucaagcgggccgcgcucgaguucgaggacggcauguacgccaaccuggggaucggcaucccccugcucgccagcaacuucaucuccccgaacaucaccgugcaccuccagagcgagaacggggugcugggccuggggcccuacccccgccagcacgaggccgacgcggaccugaucaacgccggcaaggagaccgucaccauccugcccggcgccagcuucuucuccagcgacgaguccuucgccaugauccgcgggggccacguggaccucacgaugcugggggccaugcaggucagcaaguacggcgaccuggcgaacuggaugaucccgggcaagauggugaaggggaugggcggggccauggaccucguguccagcgccaagaccaaggucguggugaccauggagcacuccgccaagggcaacgcccacaagaucauggagaagugcacccugccccugacggggaagcagugcgucaaccggaucaucaccgagaaggcgguguucgacguggacaagaagaagggccucacccugaucgagcugugggagggccucaccgucgacgacgugcagaaguccacggggugcgacuucgccgugagccccaagcugaugcccaugcagcagaucgccaacuga

SEQ ID NO: 34152 - RNA, 1272 nt, Artificial Sequence
  derived and/or modified sequence opt1 from OXER1__Homo_sapiens__NP_683765
augcugugccaccgcggcgggcagcucaucgugcccaucaucccgcugugccccgagcacagcugccggggccgccggcugcagaaccuccuguccgggcccuggcccaagcagccgauggagcugcacaaccucagcucccccagccccucccugagcuccagcguccugcccccguccuucagccccucccccagcuccgcccccagcgccuucaccaccgugggcggguccagcggcggcccgugccaccccacguccagcucccucgugagcgcguuccuggcccccauccuggcccucgaguucguccuggggcuggugggcaacagccucgcccuguucaucuucugcauccacacccgccccuggaccuccaacaccguguuccuggucagccucguggccgcggacuuccugcugaucuccaaccucccgcugcggguggacuacuaccugcuccacgagacguggcgcuucggggccgccgccugcaaggucaaccuguucaugcugagcaccaaccggaccgcguccgugguguuccucaccgccaucgcccugaaccgcuaccugaaggucgugcagccccaccacgugcucagccgggccuccgucggcgccgcggcccgcguggccgggggccugugggugggcauccugcuccugaacgggcaccuccugcugagcacguucuccggccccagcugccuguccuaccgggucgggaccaagcccagcgccucccuccgcuggcaccaggcccuguaccugcucgaguucuuccugccgcuggcgcucauccuguucgccaucgugagcaucggccugaccauccggaaccgcggccucgggggccaggccgggccccagcgggccaugcgcgugcuggccauggucguggcgguguacaccaucugcuuccugcccuccaucaucuucggcauggccagcauggucgccuucuggcuguccgccugccggagccucgaccugugcacgcagcuguuccacgggucccucgccuucaccuaccugaacagcgugcuggaccccguccucuacugcuucagcuccccgaacuuccugcaccagagccgcgcgcugcucggccugacccggggccgccaggggcccguguccgacgagagcuccuaccagcccagccggcaguggcgcuaccgcgaggccucccggaaggccgaggccaucggcaagcugaaggugcagggggaggucagccucgagaaggagggcuccagccagggguga

SEQ ID NO: 34153 - RNA, 1014 nt, Artificial Sequence
  derived and/or modified sequence opt1 from OXGR1__Homo_sapiens__XP_005254103
augaacgagccccuggacuaccucgccaacgccagcgacuucccggacuacgcggccgccuucggcaacugcaccgacgagaacaucccccugaagaugcacuaccugcccgugaucuacgggaucaucuuccucgucggcuuccccgggaacgccguggugaucuccaccuacaucuucaagaugcgcccguggaaguccagcacgaucaucaugcugaaccuggccugcaccgaccuccuguaccugaccagccuccccuuccugauccacuacuacgcguccggcgagaacuggaucuucggggacuucaugugcaaguucauccgguucagcuuccacuucaaccuguacuccagcauccucuuccugaccugcuucuccaucuuccgcuacugcgucaucauccaccccaugagcugcuucuccauccacaagacgcggugcgccgugguggccugcgccgucguguggaucaucagccugguggcggucauccccaugaccuuccucaucaccuccaccaaccgcacgaaccggagcgccugccuggaccugaccuccagcgacgagcucaacaccaucaagugguacaaccugauccugaccgccacgaccuucugccucccgcuggugaucgugacccugugcuacaccacgaucauccacacccucacccacggccugcagaccgacuccugccugaagcagaaggcccgccggcucacgauccugcugcuccuggccuucuacgucugcuuccugcccuuccacauccuccgcgugauccggaucgagagccgccugcuguccaucagcugcagcaucgagaaccagauccacgaggcguacaucgugucccggccccucgccgcccugaacaccuucggcaaccugcuccuguacgucguggugagcgacaacuuccagcaggccgucugcuccaccgugcgcugcaaggugagcgggaaccuggagcaggccaagaagaucuccuacagcaacaaccccuga

SEQ ID NO: 34154 - RNA, 2625 nt, Artificial Sequence
  derived and/or modified sequence opt1 from OXR1__Homo_sapiens__NP_001185461
augaccaaggacaagaacagccccggccugaagaagaagucccagagcguggacaucaacgccccgggguucaacccccucgccggcgcggggaagcagacgccccaggccuccaagcccccggcccccaagacccccaucaucgaggaggagcagaacaacgccgccaacacccagaagcaccccagccgccgguccgagcugaagcgcuucuacaccaucgacaccggccagaagaagacgcuggacaagaaggacgggcggcgcaugagcuuccagaagccgaagggcaccaucgaguacaccgucgagucccgggacagccucaacuccaucgcgcugaaguucgacaccacgcccaacgagcuggugcagcucaacaagcuguucagccgcgccguggucaccggccaggugcuguacgugcccgaccccgaguacgucuccagcguggaguccagcccgucccucagccccgugagcccccugagccccaccuccagcgaggccgaguucgacaagaccacgaacccggacguccaccccaccgaggccacccccagcuccaccuucacggggauccggcccgcgcgcguggugagcuccaccagcgaggaggaggaggccuucaccgagaaguuccugaagaucaacugcaaguacaucaccuccggcaaggggacggucagcggcgugcuccuggugaccccgaacaacaucauguucgacccccacaagaacgacccccugguccaggagaacgggugcgaggaguacggcaucaugugccccauggaggaggugauguccgccgccauguacaaggagauccucgacagcaagaucaaggagucccugccgaucgacaucgaccagcugagcggccgggacuucugccacuccaagaagaugaccgggagcaacaccgaggagaucgacucccgcauccgggacgccggcaacgacagcgcguccacggcgccccgcagcaccgaggagucccucagcgaggacguguucaccgaguccgagcugagccccauccgggaggagcuggucagcuccgacgagcuccgccaggacaagagcuccggggccagcuccgagagcgugcagaccgugaaccaggccgaggucgagucccugacggugaaguccgaguccaccggcacccccggccaccuccggagcgacaccgagcacuccacgaacgagguggggacccugugccacaagaccgaccugaacaaccuggagauggccaucaaggaggaccagaucgccgacaacuuccagggcaucagcgggccgaaggaggacuccaccagcaucaagggcaacuccgaccaggacagcuuccuccacgagaacucccugcaccaggaggagagccagaaggagaacaugcccugcggggagacggccgaguucaagcagaagcagagcgucaacaagggcaagcagggcaaggagcagaaccaggacucccagaccgaggccgaggagcugcgcaagcucuggaagacccacaccaugcagcagaccaagcagcagcgggagaacauccagcaggucagccagaaggaggccaagcacaagaucacguccgccgacgggcacaucgagagcuccgcgcugcugaaggagaagcagcgccaccggcuccacaaguuccugugccugcgcgugggcaagcccaugcggaagaccuucgugagccaggccuccgccaccaugcagcaguacgcccagcgcgacaagaagcacgaguacugguucgccgugccgcaggagcgcaccgaccaccucuacgcguucuucauccaguggagccccgagaucuacgccgaggacacgggggaguacacccgggagcccggcuucaucgucgugaagaagaucgaggaguccgagaccaucgaggacagcuccaaccaggccgccgcgcgcgagugggagguggucagcguggccgaguaccaccggcgcaucgacgcccugaacaccgaggagcugcggacgcucugccgccggcugcagaucaccacccgcgaggacaucaacuccaagcaggucgccaccgugaaggccgaccuggagagcgaguccuuccggcccaaccucagcgacccguccgagcugcugcuccccgaccagaucgagaagcugacgaagcaccucccgccccgcaccaucggguaccccuggacccugguguacggcaccggcaagcacgggacgagccugaagacccuguaccggaccaugaccggccuggacacgcccgugcucauggucaucaaggacuccgacggccagguguucggggcgcuggccagcgagccccugaaggugagcgacggguucuacggcaccggcgagaccuucgucuucaccuucugccccgaguucgagguguucaaguggacgggggacaacauguucuucaucaagggcgacauggacucccucgccuucgggggcggcgggggcgaguucgcccuguggcuggacggggaccucuaccacggccgcagccacuccugcaagaccuucgggaaccggacccugagcaagaaggaggacuucuucauccaggacaucgagaucugggccuucgaguga

SEQ ID NO: 34155 - RNA, 1584 nt, Artificial Sequence
  derived and/or modified sequence opt1 from OXSR1__Homo_sapiens__NP_005100
augagcgaggacuccagcgcccugcccugguccaucaaccgcgacgacuacgagcuccaggaggugaucggcagcggggccaccgcggucgugcaggccgccuacugcgccccgaagaaggagaagguggccaucaagcggaucaaccuggagaagugccagaccuccauggacgagcugcucaaggagauccaggcgaugagccagugccaccaccccaacaucgucuccuacuacacgagcuucguggugaaggacgagcuguggcuggucaugaagcuccuguccggcgggagcgugcuggacaucaucaagcacaucguggccaagggcgagcacaaguccgggguccucgacgagagcaccaucgccaccauccugcgcgaggugcuggagggccucgaguaccugcacaagaacggccagauccaccgggacgugaaggccgggaacauccugcucggcgaggacggguccguccagaucgcggacuucggcgugagcgccuuccuggccaccgggggcgacaucacgcgcaacaaggugcggaagaccuucgucggcacccccugcuggauggcccccgaggugauggagcagguccgcggguacgacuucaaggccgacaucugguccuucggcaucaccgcgaucgagcuggccacgggggccgccccguaccacaaguacccgcccaugaaggugcucaugcugacccugcagaacgacccgcccagccucgagaccggcgugcaggacaaggagaugcugaagaaguacggcaaguccuuccggaagaugaucagccugugccuccagaaggaccccgagaagcgccccaccgccgcggagcugcugcggcacaaguucuuccagaaggccaagaacaaggaguuccuccaggagaagacgcugcagcgcgcccccaccaucuccgagcgggccaagaaggugcgccggguccccgggagcagcggccgccugcacaagaccgaggacgggggcugggagugguccgacgacgaguucgacgaggagagcgaggaggggaaggccgcgaucucccagcuccggagcccccgcgugaaggaguccaucagcaacuccgagcuguuccccaccacggaccccgugggcacccugcuccaggucccggagcagaucagcgcccaccucccccagcccgccggccagaucgccacccagcccacccaggugucccugccgcccacggccgagcccgcgaagaccgcccaggcccugagcuccgggagcggcucccaggagaccaagauccccaucagccugguccugcggcuccgcaacuccaagaaggagcugaacgacauccgguucgaguucaccccggggcgcgacacggccgagggcgugagccaggagcugaucuccgcggggcucguggacggccgggaccuggucaucguggccgccaaccugcagaagaucguggaggagccccagagcaaccgcuccgucaccuucaagcucgccagcggcguggaggggagcgacauccccgacgacggcaagcugaucggguucgcccagcuguccaucagcuga

SEQ ID NO: 34156 - RNA, 378 nt, Artificial Sequence
  derived and/or modified sequence opt1 from OXT__Homo_sapiens__XP_011527540
auggccggccccagccuggccugcugccuccuggggcugcucgcgcugaccuccgccugcuacauccagaacugcccgcugggcgggaagcgcgccgcccccgaccucgacgugcggaagugccugcccugcggccccgggggcaagggccgcugcuucgggccgaacaucugcugcgccgaggagcugggcugcuucgucgggaccgcggaggcccuccggugccaggaggagaacuaccugcccagccccugccaguccggccagaaggccugcgggagcggcggccgcugcgccgugcuggggcucugcugcucccccgacggcugccacgcggacccggccugcgacgccgaggccacguucagccagcgguga

SEQ ID NO: 34157 - RNA, 1170 nt, Artificial Sequence
  derived and/or modified sequence opt1 from OXTR__Homo_sapiens__NP_000907
auggagggcgcccuggccgcgaacuggagcgccgaggccgccaacgccuccgcggcgcccccgggggccgagggcaaccgcaccgccgggccgccccggcgcaacgaggcccucgcccggguggaggucgccgugcugugccugauccuccugcuggcccucagcggcaacgccugcgugcugcuggcgcuccgcaccacgcggcagaagcacucccgccuguucuucuucaugaagcaccugagcaucgccgaccucgucguggccguguuccagguccugccccagcugcucugggacaucaccuuccgguucuacgggcccgaccugcugugccgccucgugaaguaccuccagguggucggcauguucgccuccaccuaccugcugcugcugaugagccucgaccggugccuggccaucugccagccccugcgcucccuccggcgccggaccgaccgccuggcggugcuggccacguggcucggcugccugguggccagcgcgccccagguccacaucuucucccugcgggagguggccgacgggguguucgacugcugggccgucuucauccagcccuggggcccgaaggccuacaucaccuggaucacccucgccguguacaucgugcccgucaucgugcuggccgccugcuacgggcugaucagcuucaagaucuggcagaaccuccgccugaagaccgcggccgccgccgcggccgaggcccccgagggcgccgccgcgggggacggcggccggguggcccuggcccgcgucuccagcgugaagcucaucuccaaggccaagauccggacggugaagaugaccuucaucaucguccuggccuucaucgugugcuggacccccuucuucuucguccagauguggagcgugugggacgcgaacgccccgaaggaggccuccgccuucaucaucgugaugcugcucgccagccugaacuccugcugcaaccccuggaucuacaugcuguucaccgggcaccucuuccacgagcugguccagcgcuuccugugcugcagcgcguccuaccucaagggccggcgccugggggagacgagcgccagcaagaaguccaacagcuccagcuucgugcugucccaccgcagcuccagccagcgguccugcagccagcccuccaccgccuga

SEQ ID NO: 34158 - RNA, 1200 nt, Artificial Sequence
  derived and/or modified sequence opt1 from P2RX1__Homo_sapiens__NP_002549
auggcccgccgguuccaggaggagcuggccgcguuccucuucgaguacgacacgccccgcauggugcugguccggaacaagaaggugggcgugaucuuccgccugauccagcucgucgugcugguguacgucaucggguggguguuccuguacgagaagggcuaccagaccagcuccgggcucaucagcuccgugagcgucaagcugaagggccuggccgugacccagcucccggggcugggcccccaggugugggacgucgccgacuacguguuccccgcccagggcgacaacuccuucguggucaugaccaacuucaucgugacccccaagcagacccagggguacugcgccgagcacccggagggcgggaucugcaaggaggacagcggcugcacgcccgggaaggcgaagcggaaggcccagggcauccgcaccggcaagugcguggccuucaacgacaccgucaagaccugcgagaucuucggguggugccccguggagguggacgacgacaucccccggccggcccugcuccgcgaggcggagaacuucacgcuguucaucaagaacuccaucagcuucccccgguucaaggucaaccgccggaaccugguggaggaggugaacgccgcccacaugaagaccugccucuuccacaagacccugcacccccugugccccgucuuccagcucggcuacgugguccaggaguccgggcagaacuucagcacccuggccgagaagggcggcgugguggggaucacgaucgacuggcacugcgaccuggacuggcacguccgccacugccggccgaucuacgaguuccacggccucuacgaggagaagaaccugucccccggguucaacuuccgcuucgcccggcacuucguggagaacggcaccaacuaccgccaccuguucaagguguucgggauccgguucgacauccucgucgacggcaaggcgggcaaguucgacaucauccccaccaugaccacgaucgggagcggcaucgggaucuucggcguggccaccgugcugugcgaccugcuccugcugcacauccuccccaagcgccacuacuacaagcagaagaaguucaaguacgccgaggacauggggccgggcgccgccgagcgggaccuggcggccaccuccagcacccugggccuccaggagaacaugcgcacguccuga

SEQ ID NO: 34159 - RNA, 1113 nt, Artificial Sequence
  derived and/or modified sequence opt1 from P2RX2__Homo_sapiens__NP_001269093
auggccgccgcgcagcccaaguacccggccggcgccaccgcccgccggcuggcccgcgggugcuggagcgcgcucugggacuacgagacccccaaggugaucgucgugcggaaccgccggcugggcgugcuguaccgcgccguccagcuccugauccugcucuacuucgugugguacguguucaucguccagaaguccuaccaggagagcgagacggggcccgaguccagcaucaucaccaaggugaagggcaucaccaccuccgagcacaaggugugggacgucgaggaguacgugaagcccccggagagcauccgggugcacaacgccacgugccuguccgacgccgacugcgucgcgggggagcuggacaugcucggcaacggcgcccugcaggaccugcgcggggugcggcucgugcccggcgggcgcuggggccugugccagcccaucagcggguacgacggccccaaguuccaccacccgcaccaggagcagcacccccugccccagaucccccuccugcagggccagcaccggcgcccgcaccggcgcguccccgaggcccugcacgugccccgggggcuccgcccccugcugccgcaccuccaggccggccuguaccgcggggagggcuggggcgagcugcaccgggcccggacccaggggcgcggcggggugaucggcgucaucaucaacugggacugcgaccucgaccugcccgcguccgagugcaaccccaaguacagcuuccggcgccuggaccccaagcacgugccggccuccagcggguacaacuuccgcuucgccaaguacuacaagaucaacggcaccaccacgcggacccucaucaaggccuacggcauccgcaucgacgugaucguccacgggcaggccggcaaguucucccugauccccaccaucaucaaccuggcgaccgcccucacgagcgugggggugggcuccuuccugugcgacuggauccugcucaccuucaugaacaagaacaaggucuacagccacaagaaguucgacaagaugguggacacccccgccuccgagcccgcccaggccagcaccccgacggaccccaaggggcuggcgcagcuguga

SEQ ID NO: 34160 - RNA, 1194 nt, Artificial Sequence
  derived and/or modified sequence opt1 from P2RX3__Homo_sapiens__XP_011543372
augaacugcaucagcgacuucuucaccuacgagaccacgaaguccguggucgucaagagcuggaccaucggcaucaucaaccgcguggugcagcugcucaucaucuccuacuucgugggguggguguuccugcacgagaaggccuaccagguccgggacaccgccaucgagagcuccguggugaccaaggucaagggcagcgggcuguacgcgaaccgcgugauggacguguccgacuacgucacgcccccgcagggcaccagcguguucgugaucaucaccaagaugaucgucaccgagaaccagaugcagggguucugccccgaguccgaggagaaguaccggugcgugagcgacucccagugcggccccgagcgccuccccggcgggggcauccugacggggcggugcgugaacuacagcuccguccugcgcacgugcgagauccagggcuggugcccgaccgagguggacaccguggagacgcccaucaugauggaggccgagaacuucaccaucuucaucaagaacagcauccgguucccccucuucaacuucgagaaggggaaccugcugcccaaccucaccgcccgcgacaugaagaccugccgguuccacccggacaaggaccccuucugccccauccugcgcgucggcgacguggugaaguucgccggccaggacuucgccaagcuggcgcggaccgggggcguccucgggaucaagaucggcugggugugcgaccuggacaaggccugggaccagugcauccccaaguacuccuucacccgccuggacagcgucuccgagaaguccagcgugagcccgggcuacaacuuccgguucgccaaguacuacaagauggagaacgggagcgaguaccgcacccuccugaaggccuucggcauccgguucgacgugcuggucuacgggaacgcgggcaaguucaacaucauccccaccaucaucuccagcguggccgccuucacguccgugggggucggcaccgugcucugcgacaucauccugcugaacuuccucaagggcgccgaccaguacaaggccaagaaguucgaggaggugaacgagaccacccugaagaucgcggcccugacgaaccccgucuaccccagcgaccagaccaccgccgagaagcaguccaccgacagcggggccuucuccaucggccacuga

SEQ ID NO: 34161 - RNA, 1215 nt, Artificial Sequence
  derived and/or modified sequence opt1 from P2RX4__Homo_sapiens__NP_001243725
auggccggcugcugcgccgcgcuggccgccuuccucuucgaguacgacacgccccgcaucgugcugauccggagccgcaaggucgggcugaugaaccgggccgugcagcuccugauccuggccuacgugaucggcugcuaccacccgcaccucgcggaggucgagauggagagcccccgccgguggguguucgugugggagaagggguaccaggagaccgacuccgucguguccagcgugaccaccaaggucaagggcguggccgugaccaacaccuccaagcugggguuccgcaucugggacgucgccgacuacgugauccccgcccaggaggagaacagccuguucgugaugacgaacgucauccucaccaugaaccagacccagggccugugccccgagaucccggacgcgaccacggugugcaaguccgacgccagcugcaccgccggcuccgccgggacccacagcaacggcguguccaccgggcggugcgucgccuucaacggcagcgugaagacgugcgagguggcggccuggugccccgucgaggacgacacccacgugccccagcccgccuuccugaaggccgccgagaacuucacccuccuggugaagaacaacaucugguacccgaaguucaacuucuccaagcgcaacauccugcccaacaucaccacgaccuaccucaagagcugcaucuacgacgcgaagaccgaccccuucugccccaucuuccggcuggggaagaucgucgagaacgccggccacuccuuccaggacauggccguggagggcgggaucaugggcauccaggucaacugggacugcaaccuggaccgcgccgccagccucugccugccgcgguacuccuuccgccggcuggacacccgcgacguggagcacaacgugagccccggguacaacuuccgguucgcgaaguacuaccgcgaccucgccggcaacgagcagcggacgcugaucaaggccuacggcauccgcuucgacaucaucgucuucgggaaggccggcaaguucgacaucauccccaccaugaucaacaucggguccggccuggcccuccuggggauggcgaccgugcugugcgacaucaucgugcucuacugcaugaagaagcggcuguacuaccgcgagaagaaguacaaguacgucgaggacuacgagcagggccuggccagcgagcucgaccaguga

SEQ ID NO: 34162 - RNA, 1266 nt, Artificial Sequence
  derived and/or modified sequence opt1 from P2RX5__Homo_sapiens__NP_001191448
augggccaggccgggugcaagggccugugccucagccuguucgacuacaagaccgagaaguacgugaucgccaagaacaagaaggucgggcugcucuaccgccugcugcaggcguccauccucgccuaccugguggugugggucuuccugaucaagaagggcuaccaggacguggacaccagccuccaguccgccgugaucacgaaggucaaggggguggccuucaccaacaccagcgaccugggccagcggaucugggacguggccgacuacgucauccccgcgcagggcgagaacguguucuucguggucaccaaccugaucgugacgccgaaccagcgccagaacgugugcgccgagaacgaggggauccccgacggcgccugcuccaaggacagcgacugccacgccggggaggcggucaccgccggcaacggggugaagaccggccggugccuccgccgggagaaccuggcccgcgggaccugcgagaucuucgccuggugcccccuggagacguccagccggcccgaggagccguuccucaaggaggccgaggacuucaccaucuucaucaagaaccacauccgcuuccccaaguucaacuucuccaacaacgugauggacgucaaggaccggagcuuccugaaguccugccacuucggccccaagaaccacuacugccccaucuuccgccugggcagcgugauccggugggcgggguccgacuuccaggacaucgcccucgagggcggcgugaucgggaucaacaucgaguggaacugcgaccuggacaaggccgccagcgagugccacccgcacuacuccuucagccgccuggacaacaagcucuccaagagcgucuccagcggcuacaacuuccgguucgcccgcuacuaccgggacgcggccgggguggaguuccgcacccugaugaaggccuacggcauccgguucgacgugauggucaacgggaagggcgccuucuucugcgaccuggugcucaucuaccugaucaagaagcgcgaguucuaccgggacaagaaguacgaggagguccgcggccuggaggacagcucccaggaggccgaggacgaggcgagcgggcucggccuguccgagcagcugaccagcgggcccggccuccuggggaugcccgagcagcaggagcugcaggagcccccggaggccaagcggggcuccagcucccagaagggcaacgggagcgugugcccccagcuccuggagccccaccgcuccacguga

SEQ ID NO: 34163 - RNA, 1248 nt, Artificial Sequence
  derived and/or modified sequence opt1 from P2RX6__Homo_sapiens__NP_001153026
augugcccccagcuggccggcgccgggagcaugggcuccccgggggcgaccaccggcugggggcuccuggacuacaagacggagaagugggcccugcucgccaagaagggcuaccaggagcgcgaccuggagccccaguucagcaucaucaccaagcugaagggcguguccgucacccagaucaaggagcucgggaaccggcugugggacguggccgacuucgugaagccgccccagggcgagaacgucuucuuccuggugaccaacuuccucgugacgcccgcccagguccaggggcgcugccccgagcaccccagcgugccccuggcgaacugcuggguggacgaggacugcccggagggcgagggcgggacccacucccacggcgucaagaccgggcagugcgugguguucaacggcacccaccggacgugcgagaucuggagcuggugccccgucgaguccgggguggugcccagccgcccccugcucgcccaggcccagaacuucacccuguucaucaagaacaccgucaccuucuccaaguucaacuucagcaaguccaacgcccuggagacgugggacccgaccuacuucaagcacugccgguacgagccccaguucagccccuacugccccguguuccgcaucggcgaccucguggcgaaggccggcgggaccuucgaggaccuggcccugcucggcggguccgucggcauccgggugcacugggacugcgaccuggacaccggggacagcggcugcuggccgcacuacuccuuccagcugcaggagaaguccuacaacuuccgcacggccacccacuggugggagcagcccggcguggaggcccggacccuccugaagcuguacgggauccgcuucgacauccucgucaccggccaggcggggaaguucggccugauccccacggccgugacccuggggaccggcgccgccuggcucggcguggucaccuucuucugcgaccugcugcuccuguacguggaccgggaggcccacuucuacuggcgcacgaaguacgaggaggcgaaggcccccaaggccaccgccaacagcgucuggcgggagcuggcccucgcgagccaggcccgccuggccgagugccugcggcgcuccagcgccccggcccccaccgcgaccgccgccgggagccagacgcagacccccggcuggcccugcccguccagcgacacccaccuccccacccacuccgggagccuguga

SEQ ID NO: 34164 - RNA, 1788 nt, Artificial Sequence
  derived and/or modified sequence opt1 from P2RX7__Homo_sapiens__NP_002553
augcccgccugcugcagcugcuccgacguguuccaguacgagaccaacaaggucacccgcauccagagcaugaacuacggcacgaucaagugguucuuccacgugaucaucuucuccuacgugugcuucgcccuggucagcgacaagcucuaccagcggaaggagccggugaucuccagcgugcacaccaaggucaaggggaucgcggaggugaaggaggagaucguggagaacggcgucaagaagcuggugcacuccguguucgacaccgccgacuacaccuucccccugcaggggaacagcuucuucgucaugacgaacuuccucaagaccgagggccaggagcagcgccugugccccgaguaccccacccggcgcacccugugcuccagcgaccgggggugcaagaagggcuggauggacccgcaguccaagggcauccagacggggcgcugcgugguguacgagggcaaccagaagaccugcgaggucagcgccuggugccccaucgaggccguggaggaggcgccccggcccgcccuccugaacuccgccgagaacuucaccgugcugaucaagaacaacaucgacuucccggggcacaacuacaccacgcgcaacauccuccccggccugaacaucacgugcaccuuccacaagacccagaacccccagugccccaucuuccggcugggggacaucuuccgcgagacgggcgacaacuucagcgacgucgccauccagggcgggaucaugggcaucgagaucuacugggacugcaaccucgaccggugguuccaccacugccgcccgaaguacuccuuccggcgccuggacgacaagaccaccaacgugagccuguaccccggguacaacuuccgguacgccaaguacuacaaggagaacaacguggagaagcgcacccucaucaaggucuucggcauccgguucgacauccugguguucggcaccgggggcaaguucgacaucauccagcugguggucuacaucggguccacccucagcuacuucggccuggcggccguguucaucgacuuccugaucgacaccuacuccagcaacugcugccgcagccacaucuaccccuggugcaagugcugccagcccugcgucgugaacgaguacuacuaccggaagaagugcgaguccaucguggagccgaagcccacccucaaguacgucagcuucguggacgagucccacauccgcauggugaaccagcagcugcuggggcggagccuccaggacgucaagggccaggaggugccccgccccgccauggacuucacggaccugucccgccugccgcucgcccugcacgacaccccgcccauccccggccagcccgaggagauccagcugcuccggaaggaggccacgccccgcagccgggacucccccguguggugccagugcgggagcugccugcccucccagcugccggagagccaccgcugccucgaggagcugugcugccggaagaagcccggcgcgugcaucaccaccuccgagcuguuccgcaagcucguccugagccggcacgugcugcaguuccuccugcuguaccaggagccccuccuggcccuggacguggacuccaccaacagccgccuccggcacugcgccuaccgcugcuacgccaccuggcgguucgggucccaggacauggccgacuucgcgauccugccgagcugcugccgcuggcggauccgcaaggaguuccccaaguccgagggccaguacagcggguucaagucccccuacuga

SEQ ID NO: 34165 - RNA, 1125 nt, Artificial Sequence
  derived and/or modified sequence opt1 from P2RY11__Homo_sapiens__NP_002557
auggccgccaacgugagcggcgcgaaguccugccccgccaacuuccuggccgccgccgacgacaagcucagcggguuccagggcgacuuccuguggccgauccuggucguggaguuccucguggcggucgccuccaacgggcuggcccuguaccgcuucagcauccggaagcagcgccccuggcaccccgccgugguguucuccguccagcucgcggugagcgaccugcugugcgcccucacccugcccccgcuggccgccuaccucuacccgcccaagcacuggcgguacggcgaggccgcgugccgccuggagcgguuccuguucacgugcaaccuccugggguccgugaucuucaucacgugcaucagccugaaccgcuaccucggcaucguccaccccuucuucgcccggucccaccuccgccccaagcacgccugggccgugagcgccgcgggcugggugcuggccgcccugcuggccaugcccacccuguccuucagccaccucaagcggccccagcagggggccggcaacugcuccgucgcgcgccccgaggccugcaucaagugccuggggaccgccgaccacggccuggccgccuaccgggcguacagccucgugcuggccgggcugggcugcggccucccgcugcugcucacccuggccgccuacggggcgcugggccgcgccgugcuccggucccccgggaugaccgucgccgagaagcugcgcguggccgcccugguggcgagcggcgucgcccucuacgccuccagcuacgugcccuaccacaucaugcgggugcugaacgucgacgcccgccggcgcugguccacccggugccccagcuucgccgacaucgcgcaggccaccgccgcccuggagcucggcccguacgugggguaccaggugaugcgcggccugaugccccuggccuucugcguccacccccuccuguacauggcggccgugcccagccuggggugcugcugccggcacugcccgggcuaccgcgacuccuggaaccccgaggacgccaagagcaccgggcaggcccucccccugaacgcgacggccgcccccaagccguccgagccccagagccgcgagcugucccaguga

SEQ ID NO: 34166 - RNA, 1029 nt, Artificial Sequence
  derived and/or modified sequence opt1 from P2RY12__Homo_sapiens__NP_795345
augcaggccguggacaaccugaccagcgcccccggcaacaccucccucugcacgcgcgacuacaagaucacccagguccuguucccgcugcucuacaccgugcuguucuucguggggcugaucaccaacggccucgcgaugcggaucuucuuccagauccgcagcaaguccaacuucaucaucuuccugaagaacacggucaucagcgaccugcucaugauccugaccuuccccuucaagauccuguccgacgccaagcucgggaccggcccccugcggaccuucgugugccaggugacgagcgucaucuucuacuucaccauguacaucuccaucagcuuccuggggcucaucaccaucgaccgcuaccagaagaccacgcggcccuucaagaccuccaacccgaagaaccugcugggcgccaagauccucagcguggugaucugggccuucauguuccugcugucccuccccaacaugauccugaccaaccgccagccccgggacaagaacgucaagaagugcagcuuccugaaguccgaguucggccucguguggcacgagaucgugaacuacaucugccaggucaucuucuggaucaacuuccugaucgugaucgugugcuacacccugaucacgaaggagcucuaccgcagcuacguccggacccgcggggugggcaaggugccccggaagaaggucaacgugaagguguucaucaucaucgccgucuucuucaucugcuucgugccguuccacuucgcgcgcauccccuacacccugucccagacccgggacguguucgacugcacggccgagaacacccuguucuacgucaaggagagcacccucuggcugaccucccugaacgccugccucgaccccuucaucuacuucuuccugugcaagagcuuccgcaacucccugaucagcaugcucaagugccccaacagcgccacgucccugagccaggacaaccggaagaaggagcaggacgggggcgacccgaacgaggagacccccauguga

SEQ ID NO: 34167 - RNA, 1065 nt, Artificial Sequence
  derived and/or modified sequence opt1 from P2RY13__Homo_sapiens__NP_795713
augaccgccgccauccgccggcagcgcgagcugagcauccuccccaaggugacccuggaggcgaugaacacgaccgucaugcagggcuucaaccgguccgagcgcugcccgcgggacacccgcaucgugcagcugguguuccccgcccucuacaccgucguguuccugacggggauccugcucaacacccuggcccuguggguguucguccacauccccagcuccagcaccuucaucaucuaccucaagaacacccugguggccgaccugaucaugacgcucaugcugcccuucaagauccuguccgacagccaccucgccccguggcagcugcgggcguucgugugccgcuucuccagcgucaucuucuacgagaccauguacgugggcaucgugcugcucgggcugaucgccuucgaccgguuccugaagaucauccgcccccuccggaacaucuuccugaagaagcccgucuucgccaagaccguguccaucuucaucugguucuuccuguucuucaucagccuccccaacaccauccuguccaacaaggaggccacgccgagcuccgugaagaagugcgcgagccugaagggcccccucgggcugaaguggcaccagauggucaacaacaucugccaguucaucuucuggaccguguucauccugaugcucguguucuacgucgugaucgccaagaagguguacgacuccuaccgcaagagcaaguccaaggaccggaagaacaacaagaagcuggagggcaaggucuucgugguggucgccguguucuucgucugcuucgcccccuuccacuucgcccgcgugcccuacacccacagccagaccaacaacaagacggacugccggcugcagaaccagcuguucaucgcgaaggagaccacccucuuccuggccgccaccaacaucugcauggacccgcucaucuacaucuuccugugcaagaaguucacggagaagcugcccugcaugcagggccgcaagaccaccgccuccagccaggagaaccacagcucccagaccgacaacaucacgcucggguga

SEQ ID NO: 34168 - RNA, 1017 nt, Artificial Sequence
  derived and/or modified sequence opt1 from P2RY14__Homo_sapiens__NP_055694
augaucaacagcaccuccacccagcccccggacgagagcugcucccagaaccugcucaucacgcagcagaucauccccgugcuguacugcauggucuucaucgccggcauccugcucaacggggugagcggcuggaucuucuucuacgugcccuccagcaaguccuucaucaucuaccugaagaacaucgucaucgccgacuucgugaugagccugaccuuccccuucaagauccucggggacuccggccuggggccguggcagcugaacguguucgucugccgcgugagcgcgguccucuucuacgugaacauguacguguccaucguguucuucggccugaucagcuucgaccgguacuacaagaucgucaagccccuguggaccuccuucauccagagcguguccuacagcaagcuccuguccgugaucgucuggaugcugaugcuccugcuggccgugcccaacaucauccucaccaaccagagcgugcgcgaggucacgcagaucaagugcaucgagcugaaguccgagcugggccggaaguggcacaaggccagcaacuacaucuucguggccaucuucuggaucguguuccuccugcugaucgucuucuacaccgccaucaccaagaagaucuucaagagccaccucaaguccagccgcaacuccaccagcgugaagaagaaguccagccggaacaucuucuccaucguguucgucuucuucgugugcuucguccccuaccacaucgcgcgcaucccguacaccaagagccagacggaggcccacuacuccugccagagcaaggagauccugcgguacaugaaggaguucacccugcuccuguccgccgccaacgugugccuggaccccaucaucuacuucuuccucugccagcccuuccgcgagauccugugcaagaagcugcacaucccccucaaggcgcagaacgaccuggacaucagccggaucaagcgcgggaacaccacgcuggaguccaccgacacccucuga

SEQ ID NO: 34169 - RNA, 1122 nt, Artificial Sequence
  derived and/or modified sequence opt1 from P2RY1__Homo_sapiens__NP_002554
augaccgaggugcuguggcccgccgucccgaacggcaccgacgccgcguuccucgccgggcccggcagcuccugggggaacagcacgguggccuccaccgccgccgugagcuccagcuucaagugcgcgcugaccaagaccggcuuccaguucuacuaccugcccgccgucuacauccucguguucaucaucggguuccugggcaacuccguggccaucuggauguucgucuuccacaugaagcccuggagcggcaucuccguguacauguucaaccuggcccucgcggacuuccuguacgugcugacgcucccggcccugaucuucuacuacuucaacaagaccgacuggaucuucggggacgccaugugcaagcugcagcgcuucaucuuccacgucaaccucuacggcagcauccuguuccugaccugcaucuccgcccaccgguacagcggggugguguacccccucaagucccugggccgccugaagaagaagaacgccaucugcaucagcguccucguguggcugaucguggucguggcgaucucccccauccuguucuacagcgggaccggcgugcggaagaacaagacgaucacgugcuacgacaccaccuccgacgaguaccuccgcagcuacuucaucuacuccaugugcaccaccgucgccauguucugcgugccccuggugcugauccucggcugcuacgggcugaucguccgggcccugaucuacaaggaccucgacaacagcccgcugcgccgcaagagcaucuaccuggugaucaucgugcucaccgucuucgccguguccuacauccccuuccacgucaugaagaccaugaaccugcgggcccggcuggacuuccagacgcccgcgaugugcgccuucaacgaccgcguguacgccaccuaccaggugacccggggccucgccagccugaacuccugcgucgaccccauccuguacuuccucgccggggacaccuuccgccggcgccugagccgggcgacgcgcaaggccucccggcgcagcgaggccaaccugcaguccaagagcgaggacaugacccucaacauccugccggaguucaagcagaacggcgacaccucccuguga

SEQ ID NO: 34170 - RNA, 1134 nt, Artificial Sequence
  derived and/or modified sequence opt1 from P2RY2__Homo_sapiens__NP_788085
auggccgccgaccugggccccuggaacgacaccaucaacgggaccugggacggcgacgagcucggguaccgcugccgguucaacgaggacuucaaguacgugcugcugccggucagcuacggcguggugugcguccucgggcugugccugaacgcgguggcccucuacaucuuccugugccgccugaagacguggaacgccuccaccaccuacauguuccaccucgccgugagcgacgcccuguacgcggccucccugccccuccuggucuacuacuacgcccggggcgaccacuggcccuucagcaccgugcugugcaagcucgugcgcuuccuguucuacacgaaccuguacugcuccauccucuuccugaccugcaucagcguccaccggugccugggcgugcuccgcccccugcggucccugcgcugggggcgggcccgcuacgcgcggcgcguggccggcgccgucugggugcucgugcuggccugccaggccccgguccuguacuucgugaccaccagcgcgcgcgggggccgggugacgugccacgacaccuccgcccccgagcuguucagccgguucgucgccuacuccagcgugaugcuggggcuccucuucgccgugcccuucgccgucauccuggugugcuacgugcugauggcgcgccggcuccugaagcccgccuacggcaccuccggcgggcugccgcgcgccaagcgcaagagcguccggaccaucgccgugguccucgccguguucgcgcugugcuuccugcccuuccacgugacgcggacccucuacuacuccuuccgcagccuggaccuguccugccacacccucaacgccaucaacauggccuacaaggucacccgcccccuggccagcgccaacuccugccuggaccccgugcucuacuuccuggcgggccagcggcuggugcgcuucgcccgggacgccaagccgcccacggggcccagccccgccaccccggcgcgccggcgccucggccugcggcgcagcgaccggaccgacaugcagcgcaucgaggacguccugggcuccagcgaggacucccggcgcaccgagagcacgcccgccggguccgagaacaccaaggacauccggcuguga

SEQ ID NO: 34171 - RNA, 1098 nt, Artificial Sequence
  derived and/or modified sequence opt1 from P2RY4__Homo_sapiens__NP_002556
auggccagcaccgaguccagccugcuccgcucccugggccugagccccgggccgggcuccagcgagguggagcucgacugcugguucgacgaggacuucaaguucauccugcugcccgucuccuacgccgugguguucguccucgggcugggccugaacgcgcccacccucuggcuguucaucuuccggcugcgccccugggacgccacggccaccuacauguuccaccucgcccugagcgacacccuguacgugcucucccugccgacccugaucuacuacuacgccgcgcacaaccacuggcccuucgggacggagaucugcaaguucgugcgguuccucuucuacuggaaccuguacugcagcguccuguuccugaccugcaucuccgugcaccgcuaccucggcaucugccacccccugcgggcccuccgcuggggccggccccgccuggccgggcugcucugccuggccguguggcuggucguggcgggcugccucgugccgaaccuguucuucgucaccaccagcaacaaggggacgaccgugcugugccacgacaccacccggcccgaggaguucgaccacuacgugcacuucuccagcgccgucaugggccuccuguucggggugcccugccuggugacgcucgucugcuacggccugauggcccgccggcuguaccagccccucccgggcuccgcccagagcuccagccgccugcggucccugcgcaccaucgccguggugcucaccgucuucgcggugugcuucgugcccuuccacaucacccggacgaucuacuaccuggcccgccugcucgaggccgacugccggguccugaacaucgugaacgucguguacaaggugacccgcccccuggccagcgccaacagcugccucgaccccguccuguaccugcugaccggggacaaguaccggcgccagcuccggcagcugugcggcgggggcaagccgcagccccgcaccgcggccuccagccuggcccucgugucccugcccgaggacagcuccugccgcugggccgccacgccccaggacagcuccugcagcaccccgcgggcggaccgccuguga

SEQ ID NO: 34172 - RNA, 987 nt, Artificial Sequence
  derived and/or modified sequence opt1 from P2RY6__Homo_sapiens__NP_001264134
auggagugggacaacggcaccgggcaggcccugggccugcccccgaccacgugcguguaccgcgagaacuucaagcagcuccugcucccgcccgucuacagcgccgugcuggcggccgggcugccccucaacaucugcgugaucacccagaucugcaccucccggcgcgcccugacccggacggccgucuacacccugaaccucgcccuggcggaccugcucuacgccugcagccugccccugcucaucuacaacuacgcccagggcgaccacuggcccuucggggacuucgccugccgccuggugcgguuccuguucuacgcgaaccuccacggcuccauccuguuccugaccugcaucagcuuccagcgcuaccucggcaucugccacccccuggcccccuggcacaagcgcgggggccggcgggccgccuggcuggugugcgucgccguguggcucgcggugaccacgcagugccugccgaccgccaucuucgccgccaccgggauccagcgcaaccggaccgucugcuacgaccuguccccgcccgcccucgcgacgcacuacaugcccuacggcauggcccugaccgugaucggguuccugcuccccuucgccgcccugcuggccugcuacugccuccuggcgugccgccugugccggcaggacggccccgccgagcccguggcccaggagcgccggggcaaggccgcccgcauggcggucgugguggccgccgccuucgcgaucagcuuccuccccuuccacaucaccaagaccgccuaccuggccguccgguccacgccgggggugcccugcaccgugcuggaggccuucgccgcggccuacaagggcacccgccccuucgccagcgccaacuccguccucgaccccauccuguucuacuucacccagaagaaguuccggcgccggccgcacgagcugcuccagaagcugacggccaaguggcagcgccaggggcgcuga

SEQ ID NO: 34173 - RNA, 1080 nt, Artificial Sequence
  derived and/or modified sequence opt1 from P2RY8__Homo_sapiens__XP_005274835
augcagguccccaacagcaccggcccggacaacgccacccugcagaugcuccgcaaccccgccaucgcggucgcccugcccgugguguacucccuggucgccgccgugagcauccccgggaaccucuucucccugugggugcugugccggcgcaugggcccgcggagccccuccgucaucuucaugaucaaccucagcgugacggaccugaugcuggccuccgugcuccccuuccagaucuacuaccacugcaaccgccaccacugggucuucggggugcugcugugcaacguggucaccguggcguucuacgccaacauguacagcuccauccucaccaugaccugcaucagcguggagcgguuccugggcguccuguacccccucuccagcaagcgcuggcggcgccggcgcuacgccguggccgcgugcgccgggacguggcugcugcuccugaccgcccuguccccgcucgcccggaccgaccugaccuaccccgugcacgcccugggcaucaucacgugcuucgacguccucaaguggaccaugcugcccagcguggcgaugugggccguguuccuguucaccaucuucauccuccuguuccugauccccuucgucaucaccguggccugcuacacggccaccauccucaagcugcugcgcaccgaggaggcccacggccgggagcagcgccggcgcgcgguggggcucgccgccgucgugcugcuggccuucgugaccugcuucgccccgaacaacuucgugcuccuggcgcacaucgugucccggcuguucuacggcaagagcuacuaccacgucuacaagcucacgcugugccuguccugccucaacaacugccuggaccccuucguguacuacuucgccagccgcgaguuccagcugcggcuccgcgaguaccuggggugccggcgcgugccccgcgacacccuggacacccggcgcgagucccucuucagcgcccggaccacgagcguccgcuccgaggccggcgcccaccccgaggggauggagggcgcgacccggccgggccugcagcgccaggagagcguguucuga

SEQ ID NO: 34174 - RNA, 1584 nt, Artificial Sequence
  derived and/or modified sequence opt1 from P3H2__Homo_sapiens__NP_001127890
auggagaugcagcagaacaucgagaacuaccgcgccaccgccggcguggaggcgcugcagcucgucgaccgggaggccaagccccacauggagagcuacaacgccggggugaagcacuacgaggccgacgacuucgagauggccauccgccacuucgagcaggcgcugcgggaguacuucguggaggacaccgagugccgcacgcugugcgagggcccgcagcgguucgaggaguacgaguaccucggguacaaggccggccuguacgaggccaucgccgaccacuacaugcagguccuggugugccagcacgagugcgugcgcgagcucgcgacccggcccgggcgccugucccccaucgagaacuuccugccccuccacuacgacuaccugcaguucgccuacuaccgggucggcgaguacgugaaggcccuggagugcgccaaggccuaccuccugugccacccggacgacgaggacgugcuggacaacgucgacuacuacgagagccuccuggacgacuccaucgaccccgcgagcaucgaggcccgcgaggaccugaccauguucgugaagcggcacaagcucgaguccgagcugaucaagagcgccgccgagggccugggguucuccuacaccgagcccaacuacuggauccgcuacggcgggcggcaggacgagaaccgcgugcccagcggcgucaacguggagggggccgaggugcacggcuucuccaugggcaagaagcucagcccgaagaucgaccgggaccugcgcgagggcgggccccugcucuacgagaacaucacguucgucuacaacuccgagcagcugaacgggacccagcgggugcugcucgacaacgugcugagcgaggagcagugccgcgagcugcacuccgucgcgagcggcaucaugcucgugggcgacggguaccggggcaagaccagcccccacacccccaacgagaaguucgagggggccacggugcugaaggcccugaaguccggcuacgaggggcgcgucccgcucaaguccgcccggcuguucuacgacaucagcgagaaggcccgccgcaucguggaguccuacuucaugcugaacagcacccucuacuucagcuacacccacauggugugccggaccgcgcuguccggccagcaggaccgccggaacgaccugagccaccccauccacgccgacaacugccuccuggaccccgaggccaacgagugcuggaaggagcccccggccuacacguuccgcgacuacuccgcccugcucuacaugaacgacgacuucgagggcggggaguucaucuucaccgagauggacgcgaagaccgucaccgccagcaucaagcccaagugcggccggaugaucuccuucagcuccgggggcgagaacccccacggggugaaggccgucacgaagggcaagcgcugcgccguggcgcugugguucacccuggacccccucuaccgggagcuggagcgcauccaggccgacgaggugaucgccauccuggaccaggagcagcagggcaagcacgagcucaacaucaacccgaaggacgagcuguga

SEQ ID NO: 34175 - RNA, 2211 nt, Artificial Sequence
  derived and/or modified sequence opt1 from P3H3__Homo_sapiens__NP_055077
augcugcgccuccugcggccccugcuccugcugcuccugcugccgccgcccggcagccccgagccgcccgggcucacccagcugucccccggcgccccgccccaggcccccgaccugcucuacgccgacgggcugcgcgccuacgccgccggcgccugggcgcccgccguggcccugcuccgggaggcccugcgcagccaggcggcccuggggcggguccgccucgacugcggcgccuccugcgccgccgaccccggcgcggcccugcccgccgugcugcucggggcccccgagcccgacagcggccccgggccgacccagggcuccugggagcggcagcugcugcgcgccgcgcuccggcgcgccgacugccugacgcagugcgccgcccggcgccuggggcccggcggcgccgcgcggcuccgcguggggagcgcccugcgggacgccuuccgccggcgcgagcccuacaacuaccugcagcgggccuacuaccagcucaagaagcuggaccuggccgcggccgccgcccacaccuucuucgucgcgaaccccaugcaccuccagaugcgcgaggacauggccaaguaccggcgcauguccggcgugcgcccgcagagcuuccgggaccuggagaccccgccccacugggccgccuacgacaccgggcuggagcuccugggccgccaggaggccggccuggcgcucccccggcuggaggaggcccugcaggggucccucgcccagauggagagcugccgcgccgacugcgagggccccgaggagcagcagggggccgaggaggaggaggacggcgcggccucccagggcgggcuguacgaggccaucgccggccacuggauccaggugcugcagugccggcagcgcugcgucggggagacggccacccggcccggccgcagcuuccccgugcccgacuuccucccgaaccagcugcggcgccugcacgaggcgcacgcccagguggggaaccucucccaggccaucgagaacguccugagcgugcugcuguucuaccccgaggacgaggccgcgaagcgggcccucaaccaguaccaggcccagcugggcgagccccgcccggggcugggcccccgggaggacauccagcgcuucauccuccggucccugggcgagaagcgccagcuguacuacgccauggagcaccucgggaccagcuucaaggaccccgaccccuggaccccggccgcgcugauccccgaggcccugcgggagaagcuccgcgaggaccaggagaagcggcccugggaccacgagcccgugaagccgaagccccugacguacuggaaggacguccugcuccuggagggcgugacccugacccaggacucccgccagcucaacgggagcgagcgcgccgugcuggacggccugcucacccccgccgagugcgggguccugcugcagcucgccaaggacgcggccggcgccggcgcccgguccggguaccgcggccggcgcagcccccacacgccgcacgagcgguucgaggggcugaccgugcugaaggccgcgcagcucgcccgcgccggcaccgugggcagccagggggccaagcugcugcucgaggucuccgagcgggugcgcacccugacgcaggcguacuucagccccgagcggccccugcaccucuccuucacccaccuggugugccgcagcgccaucgagggcgagcaggagcagcggauggaccugucccaccccguccacgccgacaacugcgugcucgacccggacaccggggagugcuggcgcgagccgcccgccuacaccuaccgggacuacagcggccugcuguaccucaacgacgacuuccagggcggggaccuguucuucacggagcccaacgcccugaccgugaccgcgcgcguccggccccgcugcggccggcucguggccuucuccagcggggucgagaacccccacggcgugugggccgugacccgcgggcggcgcugcgcccuggcccuguggcacacgugggcgcccgagcaccgggagcaggaguggaucgaggccaaggagcuccugcaggagucccaggaggaggaggaggaggaggaggaggagaugcccagcaaggacccgucccccgagcccccgagccgccgccaccagcggguccaggacaagaccggccgcgcgccccgggugcgcgaggagcuguga

SEQ ID NO: 34176 - RNA, 1314 nt, Artificial Sequence
  derived and/or modified sequence opt1 from P3H4__Homo_sapiens__NP_006446
auggcccgcguggccuggggccugcucuggcugcugcucgggagcgcgggcgcccaguacgagaaguacuccuuccggggguucccgcccgaggaccugaugccccuggccgccgccuacggccacgcgcucgagcaguacgagggggagagcuggcgcgaguccgcccgguaccuggaggccgcccugcgccuccaccggcugcugcgcgacagcgaggcguucugccacgccaacugcuccggccccgcccccgccgccaagccggaccccgacggcgggcgggcggacgagugggccugcgagcuccgccuguucggccggguccuggagcgcgccgccugccuccggcgcugcaagcggacccugcccgccuuccaggugcccuacccgccccgccagcugcuccgggacuuccagagccgccugcccuaccaguaccugcacuacgcccucuucaaggcgaaccggcuggagaaggccguggccgccgcguacaccuuccugcagcgcaaccccaagcacgagcucacggccaaguaccugaacuacuaccaggggaugcuggacgucgccgacgagucccucaccgaccuggaggcccagccguacgaggccguguuccugcgggcggugaagcucuacaacagcggcgacuuccgcuccagcaccgaggacauggagcgggcccuguccgaguaccuggccgucuucgcccgcugccucgcggggugcgagggcgcccacgagcaggucgacuucaaggacuucuaccccgccaucgccgaccuguucgccgagagccugcagugcaagguggacugcgaggcgaaccucacccccaacgugggcggguacuucguggacaaguucguggccacgauguaccacuaccugcaguucgccuacuacaagcugaacgacguccgccaggccgcccgguccgcggccagcuacaugcuguucgaccccaaggacuccgugaugcagcagaaccucguguacuaccgcuuccaccgggcccgcuggggccuggaggaggaggacuuccagccgcgggaggaggccaugcucuaccacaaccagaccgccgagcugcgcgagcugcucgaguucacccacauguaccugcagagcgacgacgagauggagcuggaggagaccgagccgccccucgagcccgaggacgcgcuguccgacgccgaguucgagggggagggcgacuacgaggagggcauguacgccgacugguggcaggagcccgacgccaagggggacgaggcggaggccgagcccgagcccgagcuggccuga

SEQ ID NO: 34177 - RNA, 1605 nt, Artificial Sequence
  derived and/or modified sequence opt1 from P4HA1__Homo_sapiens__NP_000908
augaucugguacauccugaucaucggcauccuccugccccagagccuggcccacccgggguucuucaccuccaucggccagaugaccgaccucauccacacggagaaggaccuggugaccagccugaaggacuacaucaaggccgaggaggacaagcucgagcagaucaagaagugggcggagaagcuggaccgccugaccuccaccgccacgaaggaccccgagggguucgucggccaccccgugaacgccuucaagcucaugaagcggcugaacaccgaguggagcgagcuggagaaccucgugcugaaggacauguccgacggguucaucagcaaccugaccauccagcgccaguacuuccccaacgacgaggaccaggucggcgccgccaaggcgcuccugcggcugcaggacaccuacaaccucgacacggacaccaucuccaagggcaaccugccgggggugaagcacaagagcuuccugaccgccgaggacugcuucgagcucggcaagguggccuacaccgaggccgacuacuaccacacggagcuguggauggagcaggcgcugcgccagcucgacgagggggagaucuccaccaucgacaaggucagcgugcuggacuaccuguccuacgccguguaccagcagggcgaccucgacaaggcccugcugcucaccaagaagcugcuggagcucgaccccgagcaccagcgggccaacgggaaccugaaguacuucgaguacaucauggccaaggagaaggacgucaacaagagcgcguccgacgaccagagcgaccagaagaccacgcccaagaagaagggcguggccguggacuaccugcccgagcgccagaaguacgagaugcucugccggggcgaggggaucaagaugaccccgcgccggcagaagaagcuguucugccgcuaccacgacggcaaccggaaccccaaguucauccuggcccccgccaagcaggaggacgagugggacaagccccgcaucauccgguuccacgacaucaucuccgacgccgagaucgagaucgucaaggaccucgcgaagccgcgccugagccgggccaccgugcacgaccccgagaccgggaagcugacgaccgcccaguaccgcguguccaagagcgccuggcucuccggcuacgagaaccccgucgugagccggaucaacaugcgcauccaggaccugaccggccuggacgugagcaccgccgaggagcuccaggucgcgaacuacggggugggcgggcaguacgagccccacuucgacuucgcccggaaggacgagccggacgccuucaaggagcugggcacggggaaccgcaucgccaccuggcuguucuacauguccgacgugagcgccggcggcgcgaccgucuuccccgaggugggggccuccguguggcccaagaagggcaccgccgucuucugguacaaccucuucgccagcggggagggcgacuacuccacgcggcacgcggccugccccgugcuggucgggaacaagugggugagcaacaaguggcugcacgagcgcggccaggaguuccgccggccgugcacccuguccgagcucgaguga

SEQ ID NO: 34178 - RNA, 1608 nt, Artificial Sequence
  derived and/or modified sequence opt1 from P4HA2__Homo_sapiens__XP_005272177
augaagcugugggugagcgcccuccugauggccugguucggcguccuguccugcgugcaggcggaguucuucaccagcaucgggcacaugaccgaccucaucuacgccgagaaggagcuggugcagucccugaaggaguacauccucgucgaggaggccaagcugagcaagaucaaguccugggccaacaagauggaggcccugacgagcaaguccgcggccgacgccgagggcuaccucgcccaccccgugaacgcguacaagcuggugaagcgccugaacaccgacuggccggcccucgaggaccugguccugcaggacagcgccgccggguucaucgccaaccucuccgugcagcggcaguucuuccccaccgacgaggacgagaucggcgcggccaaggcccugaugcgccugcaggacaccuaccggcucgaccccgggacgaucagccgcggcgagcugcccggcaccaaguaccaggccaugcuguccguggacgacugcuucgggaugggccggagcgccuacaacgagggggacuacuaccacaccguccucuggauggagcagguccugaagcagcuggacgcgggcgaggaggccaccacgaccaagucccaggugcucgacuaccugagcuacgccguguuccagcugggggaccuccaccgcgcccuggagcugacccggcgccuccugucccuggacccgagccacgagcgggccggcggcaaccuccgcuacuucgagcagcugcuggaggaggagcgggagaagacccucacgaaccagaccgaggcggagcuggccacccccgaggggaucuacgagcgccccguggacuaccugcccgagcgggacguguacgagucccucugccgcggcgagggggucaagcugaccccgcggcgccagaagcggcuguucugccgcuaccaccacggcaaccgggcgccccagcuccugaucgcccccuucaaggaggaggacgagugggacagcccccacaucgugcgcuacuacgacgugauguccgacgaggagaucgagcggaucaaggagaucgccaagccgaagcuggcccgcgccacgguccgcgaccccaagaccggcgugcucaccguggccagcuaccgggucagcaaguccagcuggcuggaggaggacgacgaccccgugguggcccgcgucaaccggcgcaugcagcacaucaccgggcugacggugaagaccgcggagcuccugcaggucgccaacuacggcgucgggggccaguacgagccccacuucgacuucucccggaacgacgagcgcgacaccuucaagcaccuggggaccggcaaccggguggccacguuccugaacuacaugagcgacguggaggccggcggggccaccguguucccggaccucggcgcggccaucuggcccaagaaggggaccgccguguucugguacaaccugcugcgcuccggcgagggggacuaccggacccgccacgccgccugccccguccucgugggcugcaagugggugagcaacaagugguuccacgagcggggccaggaguuccugcgccccugcggguccacggaggucgacuga

SEQ ID NO: 34179 - RNA, 1527 nt, Artificial Sequence
  derived and/or modified sequence opt1 from P4HB__Homo_sapiens__NP_000909
augcugcgccgggcccuccugugccuggccguggcggcccucguccgcgccgacgcccccgaggaggaggaccacgugcuggugcugcgcaagagcaacuucgccgaggcgcucgccgcccacaaguaccugcuggucgaguucuacgccccguggugcggccacugcaaggcgcucgcccccgaguacgccaaggccgccgggaagcugaaggcggagggcuccgagauccggcuggccaagguggacgccaccgaggagagcgaccucgcccagcaguacggggugcggggcuaccccaccaucaaguucuuccgcaacggggacacggccucccccaaggaguacaccgcgggccgggaggccgacgacaucgucaacuggcugaagaagcgcaccggcccggccgccaccacgcugcccgacggggccgcggccgagagccucguggaguccagcgagguggccgucaucggcuucuucaaggacguggaguccgacagcgccaagcaguuccugcaggccgcggaggccaucgacgacauccccuucgggaucaccuccaacagcgacguguucuccaaguaccagcuggacaaggacggcgucgugcuguucaagaaguucgacgaggggcggaacaacuucgagggcgaggugaccaaggagaaccugcuggacuucaucaagcacaaccagcucccccuggucaucgaguucaccgagcagacggccccgaagaucuucggcggggagaucaagacccacauccuccucuuccugcccaagagcguguccgacuacgacggcaagcugagcaacuucaagaccgccgcggaguccuucaaggggaagauccucuucaucuucaucgacagcgaccacaccgacaaccagcgcauccuggaguucuucggccugaagaaggaggagugccccgccgugcggcucaucacgcuggaggaggagaugaccaaguacaagcccgaguccgaggagcugaccgccgagcgcaucaccgaguucugccaccgguuccucgagggcaagaucaagccgcaccugaugagccaggagcugcccgaggacugggacaagcagcccgucaaggugcucguggggaagaacuucgaggacgucgccuucgacgagaagaagaacguguucguggaguucuacgcccccuggugcggccacugcaagcagcuggcgccgaucugggacaagcugggggagacguacaaggaccacgagaacaucgucaucgccaagauggacuccaccgccaacgagguggaggccgucaaggugcacagcuuccccacccucaaguucuuccccgccagcgcggaccgcaccgugaucgacuacaacggcgagcggacgcuggacggguucaagaaguuccuggaguccggcggccaggacggggccggcgacgacgacgaccucgaggaccuggaggaggccgaggagcccgacauggaggaggacgacgaccagaaggccgucaaggacgagcuguga

SEQ ID NO: 34180 - RNA, 1692 nt, Artificial Sequence
  derived and/or modified sequence opt1 from P4HTM__Homo_sapiens__NP_808807
auggccgccgcggccgugaccggccagcgccccgagaccgccgccgccgaggaggcgagccggccgcagugggccccgcccgaccacugccaggcccaggccgcggccgggcugggcgacggggaggacgcccccguccgcccccucugcaagccccggggcaucugcucccgcgccuacuuccuggugcugaugguguucguccaccucuaccuggggaacgugcuggcccuccugcuguucgugcacuacagcaacggcgacgaguccagcgaccccggcccccagcaccgggcgcaggggccgggccccgagcccacgcucgggccccugacccgccuggagggcaucaaggucgggcacgagcggaaggugcagcucgugaccgaccgcgaccacuucauccggacccugucccugaagccgcuccuguucgagauccccggcuuccugacggacgaggagugccgccucaucauccaccuggcccagaugaagggccugcagcggagccagauccuccccaccgaggaguacgaggaggccauguccaccaugcaggucagccagcuggaccuguuccgccuccuggaccagaaccgggacgggcaccuccagcugcgcgaggugcuggcccagacccggcugggcaacgggugguggaugacgcccgaguccauccaggagauguacgccgcgaucaaggccgacccggacggcgacggcgugcucagccugcaggaguucuccaacauggaccugcgcgacuuccacaaguacaugcggagccacaaggccgaguccagcgagcucguccgcaacucccaccacaccuggcuguaccagggggagggcgcccaccacaucaugcgggccauccgccagcgggugcugcgccucacccgccugagccccgagaucguggagcuguccgagccccuccaggucgugcgguacggggagggcgggcacuaccacgcgcacguggacagcggccccgucuacccggagaccaucugcucccacacgaagcugguggccaacgagagcgugcccuucgagaccagcugccgccaggucucccccaacuggggccugcccagcauccuccggccggggacccccaugacccaggcccagcccugcacggugggcgugccccuggggaugggcccgggggaccacugggucauccccgugucccccugggagcacccgcagcuggggaccugcagcgucccgccccuccccuacuccuacaugaccgugcuguucuaccugaacaacgugaccggcggcggcgagacggucuuccccguggccgacaaccgcaccuacgacgagaugagccucauccaggacgacguggaccugcgggacacccgccggcacugcgacaaggggaaccugcgcgucaagccccagcagggcaccgccguguucugguacaacuaccugcccgacgggcagggcugggugggcgacgucgacgacuacucccuccacgggggcugccuggugacgcgggggaccaaguggaucgcgaacaacuggaucaacguggaccccagccgcgcccggcaggcccuguuccagcaggagauggcccgccucgcgcgggagggcggcaccgacucccagccggagugggcccuggaccgcgccuaccgggacgcccgcgucgagcuguga

SEQ ID NO: 34181 - RNA, 1185 nt, Artificial Sequence
  derived and/or modified sequence opt1 from PA2G4__Homo_sapiens__NP_006182
augagcggcgaggacgagcagcaggagcagaccaucgccgaggaccugguggucaccaaguacaagaugggcggggacaucgccaaccgcgugcuccggucccugguggaggcgagcuccagcggggucuccgugcugagccucugcgagaagggcgacgccaugaucauggaggagacggggaagaucuucaagaaggagaaggagaugaagaagggcaucgccuuccccaccuccaucagcgugaacaacugcgucugccacuucuccccgcucaagagcgaccaggacuacauccugaaggagggcgaccuggugaagaucgaccugggggugcacgucgacggcuucaucgccaacguggcccacaccuucguggucgacguggcgcaggggacccaggugacgggccgcaaggccgacgucaucaaggccgcccaccugugcgcggaggccgcccuccggcuggugaagcccgggaaccagaacacccaggugaccgaggccuggaacaaggucgcccacuccuucaacugcacccccaucgagggcaugcugagccaccagcucaagcagcacgugaucgacggcgagaagacgaucauccagaaccccaccgaccagcagaagaaggaccacgagaaggcggaguucgaggugcacgaggucuacgccguggacgugcuggucuccagcggggagggcaaggccaaggacgccgggcagcgcaccaccaucuacaagcgggacccguccaagcaguacggccugaagaugaagacgagccgcgccuucuucuccgagguggagcggcgcuucgacgcgaugcccuucacccuccgggccuucgaggacgagaagaaggcccgcaugggcgucguggagugcgccaagcacgagcugcugcagcccuucaacgugcucuacgagaaggagggggaguucgucgcccaguucaaguucaccgugcugcugaugcccaacggcccgaugcggaucaccagcgggcccuucgagcccgaccucuacaaguccgagauggaggugcaggacgcggagcugaaggcccugcuccagagcagcgccucccgcaagacgcagaagaagaagaagaagaaggccagcaagaccgccgagaacgcgaccuccggcgagacccuggaggagaacgaggccggggacuga

SEQ ID NO: 34182 - RNA, 1911 nt, Artificial Sequence
  derived and/or modified sequence opt1 from PABPC1__Homo_sapiens__XP_005250918
augaaccccagcgccccguccuaccccauggccagccuguacgugggcgaccuccaccccgacgucaccgaggcgaugcuguacgagaaguucucccccgccgggccgauccugagcauccgcgugugccgggacaugaucacccgccggucccucggcuacgccuacgugaacuuccagcagcccgccgacgccgagcgcgcgcuggacacgaugaacuucgacgucaucaaggggaagcccgugcggaucauguggagccagcgcgaccccucccugcggaaguccggcguggggaacaucuucaucaagaaccucgacaaguccaucgacaacaaggcccuguacgacaccuucagcgccuucggcaacauccuguccugcaaggucgugugcgacgagaacggcagcaagggguacggcuucgugcacuucgagacccaggaggccgcggagcgcgccaucgagaagaugaacgggaugcuccugaacgaccggaaggucuucgugggccgcuucaagucccggaaggagcgcgaggccgagcugggggcccgggccaaggaguucaccaacguguacaucaagaacuucggcgaggacauggacgacgagcgccucaaggaccuguucggcaaguucgggccggcgcugagcgucaaggugaugacggacgaguccggcaagagcaagggguucggcuucguguccuucgagcggcacgaggacgcccagaaggccgucgacgagaugaacggcaaggagcucaacgggaagcagaucuacgugggccgcgcccagaagaagguggagcggcagaccgagcugaagcgcaaguucgagcagaugaagcaggaccggaucacccgcuaccagggggucaaccuguacgugaagaaccucgacgacggcaucgacgacgagcggcugcgcaaggaguucagccccuucgggaccaucacguccgccaaggugaugauggagggcggccgcagcaagggguucggcuucgucugcuucagcucccccgaggaggcgaccaaggccgugaccgagaugaacgggcggaucguggccaccaagccccuguacgucgcccucgcccagcgcaaggaggagcggcaggcgcaccugacgaaccaguacaugcagcgcauggccagcgugcgggccgucccgaaccccgugaucaaccccuaccagcccgccccgcccuccggcuacuucauggccgcgaucccccagacccagaaccgcgccgccuacuacccgcccagccagaucgcccagcugcggcccagcccccgcuggaccgcgcagggggcccggccccacccguuccagaacaugcccggcgccauccgccccgccgcgccccggccgcccuucagcaccaugcgccccgccuccagccaggugccgcgggucauguccacgcagcgcguggccaacaccagcacccagaccaugggcccccggcccgccgccgccgcggccgccgccacgcccgccgugcgcaccgucccgcaguacaaguacgcggccggggugcggaacccccagcagcaccucaacgcccagccccaggugaccaugcagcagcccgccguccacgugcagggccaggagccgcugaccgcguccaugcuggccagcgccccgccccaggagcagaagcagaugcucggggagcgccuguucccccugauccaggccaugcaccccacgcucgccggcaagaucaccgggaugcugcuggagaucgacaacuccgagcuccugcacaugcuggagagccccgagucccuccggagcaagguggacgaggcggucgccgugcugcaggcccaccaggccaaggaggccgcgcagaaggccgugaacuccgccaccggcguccccaccguguga

SEQ ID NO: 34183 - RNA, 1896 nt, Artificial Sequence
  derived and/or modified sequence opt1 from PABPC3__Homo_sapiens__NP_112241
augaaccccagcaccccguccuaccccaccgccagccuguacgugggcgaccuccaccccgacgucacggaggccaugcuguacgagaaguucucccccgcggggccgauccugagcauccgcaucugccgggaccucaucaccuccggcagcuccaacuacgccuacgugaacuuccagcacaccaaggacgccgagcacgcccuggacaccaugaacuucgacgugaucaaggggaagcccguccgcaucauguggagccagcgggaccccucccugcgcaagagcggcguggggaacaucuucgugaagaaccucgacaaguccaucaacaacaaggcccuguacgacacggucagcgcguucggcaacauccuguccugcaacguggugugcgacgagaacggcagcaagggguacggcuucguccacuucgagacccacgaggccgccgagcgggccaucaagaagaugaacgggaugcuccugaacggccgcaagguguucguggggcaguucaagucccggaaggagcgcgaggcggagcugggcgcccgggccaaggaguuccccaacgucuacaucaagaacuucggcgaggacauggacgacgagcgccucaaggaccuguucgggaaguucggcccggcccugagcgugaaggugaugaccgacgaguccggcaagagcaagggguucggcuucgucuccuucgagcggcacgaggacgcccagaaggcgguggacgagaugaacgggaaggagcucaacggcaagcagaucuacguggggcgcgcccagaagaaggucgagcggcagaccgagcugaagcgcacguucgagcagaugaagcaggaccggaucacccgcuaccagguggugaaccuguacgucaagaaccucgacgacggcaucgacgacgagcggcugcgcaaggccuucagccccuucgggaccaucaccagcgccaaggugaugauggagggcggccgguccaagggguucggcuucgugugcuucagcucccccgaggaggccacgaaggcggucaccgagaugaacgggcgcaucguggccaccaagccccuguacgucgcccucgcccagcggaaggaggagcgccaggccuaccugaccaacgaguacaugcagcgcauggcgagcgugcgggccgugccgaaccagcgcgccccgcccuccggcuacuucaugacggccgucccccagacccagaaccacgccgcguacuacccgcccagccagaucgcccggcugcgccccagcccccgguggaccgcccagggggcccgcccccaccccuuccagaacaagcccuccgcgauccggcccggcgccccgcgcgugcccuucuccaccaugcggcccgccagcucccaggugccccgcgucaugagcacgcagcggguggccaacaccuccacccagaccgugggcccgcgccccgccgcggccgccgccgccgcggccacgcccgccguccggaccgugccgcgcuacaaguacgccgccggggugcggaacccccagcagcaccgcaacgcgcagccccaggucaccaugcagcagcucgccgugcacgugcagggccaggagacccugacggccagccggcuggccuccgcgcccccgcagaagcagaagcagaugcucggggagcgccuguucccccugauccaggccaugcaccccacccucgccggcaagaucaccgggaugcugcuggagaucgacaacagcgagcuccuguacaugcuggagucccccgagagccuccgguccaaggucgacgaggccguggccgugcugcaggcgcaccaggccaaggaggccacccagaaggccgucaacagcgccacgggcgugccgaccguguga

SEQ ID NO: 34184 - RNA, 1287 nt, Artificial Sequence
  derived and/or modified sequence opt1 from PABPC4L__Homo_sapiens__NP_001108206
augcgcgugcugcccgagcucggcgagagcugccugaacuccaucgccuggccgcugugcggggaccccgaggccagcacccucgagcccggccaguccugcgaccuggucagcccccaccgggacugcuccaagaacagccgcgggcagacccacuccggcaaggacaaggagaugaacguggcggccaaguaccggauggccagccuguacgugggggaccuccacgccgacgucacggaggaccugcuguuccgcaaguucuccaccgugggcccggugcucagcauccggaucugccgcgaccaggucacccggcgcucccugggcuacgccuacgugaacuuccugcagcucgcggacgcccagaaggcccuggacaccaugaacuucgacaucaucaagggcaagagcauccggcugauguggucccagcgcgacgccuaccuccggcgcagcgggaucgggaacguguucaucaagaaccuggacaaguccaucgacaacaagacgcuguacgagcacuucagcgcguucggcaagauccucuccagcaaggucauguccgacgaccaggggagcaagggcuacgccuucgugcacuuccagaaccagagcgccgccgaccgggccaucgaggagaugaacggcaagcugcugaaggggugcaagguguucgucggccgcuucaagaaccggaaggaccgcgaggcggagcuccgguccaaggccagcgaguucaccaacguguacaucaagaacuucgggggcgacauggacgacgagcgccugaaggacguguucuccaaguacggcaagacccugagcgucaaggugaugaccgacuccagcgggaaguccaagggcuucggguucgugagcuucgacucccacgaggccgccaagaaggccgucgaggagaugaacggccgggacaucaacgggcagcucaucuucgugggccgcgcgcagaagaagguggagcggcaggccgagcugaagcagauguucgagcagcugaagcgcgagcgcauccggggcugccagggggucaagcucuacaucaagaaccuggacgacacgaucgacgacgagaagcugcgcaacgaguucagcuccuucggcagcaucucccgggugaaggugaugcaggaggaggggcagagcaagggcuucgggcucaucugcuucuccagccccgaggacgccaccaaggccaugaccgagaugaacggccgcauccugggcuccaagccccugagcaucgcccucgcgcagcggcacuga

SEQ ID NO: 34185 - RNA, 921 nt, Artificial Sequence
  derived and/or modified sequence opt1 from PABPN1__Homo_sapiens__NP_004634
auggccgccgcggccgccgccgccgcggccgccggcgccgccgggggccgcgggagcggccccgggcggcgccggcaccuggugccgggcgcgggcggggaggccggcgagggggcccccggcggggccggcgacuacggcaacgggcucgaguccgaggagcuggagcccgaggagcugcuccuggagcccgagccggagcccgagcccgaggaggagcccccgcgcccccgggcgccgcccggcgcccccgggcccggccccggcagcggggcccccggcucccaggaggaggaggaggagccggggcuggucgagggcgaccccggggacggcgccaucgaggaccccgagcucgaggccaucaaggcgcgcgugcgggagauggaggaggaggccgagaagcugaaggagcugcagaacgagguggagaagcagaugaacaugagcccgccgcccggcaacgccgggcccgucaucauguccaucgaggagaagauggaggccgacgcccgcagcaucuacgugggcaacguggacuacggggcgaccgccgaggagcucgaggcccacuuccacggcugcggguccgucaaccgggugaccauccugugcgacaaguucagcggccaccccaagggcuucgccuacaucgaguucuccgacaaggagagcgugcgcacgucccuggcccucgacgagagccuguuccgggggcgccagaucaaggucauccccaagcggaccaaccgccccggcaucuccaccaccgaccggggguucccccgcgcgcgguaccgcgcccggacgaccaacuacaacagcucccgcagccgguucuacuccggcuucaacagccgcccccgcgggcggguguaccgcggccgggcccgcgccaccuccugguacagcccguacuga

SEQ ID NO: 34186 - RNA, 774 nt, Artificial Sequence
  derived and/or modified sequence opt1 from PACRG__Homo_sapiens__NP_001073848
augguggccgagaaggagacccugagccucaacaagugccccgacaagaugccgaagcgcaccaagcugcuggcccagcagccccuccccguccaccagccccacucccuggugagcgagggcuucacggugaaggcgaugaugaagaacuccgucgugcgggggccgcccgccgccggcgccuucaaggagcgccccaccaagcccaccgccuuccggaaguucuacgagcgcggggacuucccgaucgcgcuggagcacgacagcaagggcaacaagaucgccuggaagguggagaucgagaagcucgacuaccaccacuaccugccccuguucuucgacgggcucugcgagaugaccuuccccuacgaguucuucgcccggcagggcauccacgacaugcuggagcacggcgggaacaagauccugcccguccucccgcagcugaucauccccaucaagaacgcccugaaccuccgcaaccgccaggugaucugcgugacgcugaagguccugcagcaccucgugguguccgcggagauggucggcaaggcccuggugcccuacuaccggcagauccugcccgugcucaacaucuucaagaacaugaacgucaacagcggggacggcaucgacuacucccagcagaagcgggagaacaucggggaccugauccaggagacccuggaggccuucgagcgcuacggcggcgagaacgccuucaucaacaucaaguacguggugccgaccuacgagagcugccuccugaacuga

SEQ ID NO: 34187 - RNA, 2892 nt, Artificial Sequence
  derived and/or modified sequence opt1 from PACS1__Homo_sapiens__NP_060496
auggccgagcgcggcggggccggcgggggccccgggggcgcgggcgggggcagcgggcagcggggcuccgggguggcccagagcccgcagcagcccccgccccagcagcagcagcagcagccgccccagcagcccaccccgcccaagcuggcccaggccaccuccagcuccagcuccacgagcgccgcggccgccuccagcuccagcuccagcaccuccaccagcauggccgucgcgguggccuccggcagcgccccgcccggcgggcccggccccgggcgcacccccgcccccgugcagaugaaccucuacgccacgugggaggucgaccgguccagcagcuccugcgugccccgccuguucagccugacccucaagaagcuggugaugcugaaggagauggacaaggaccucaacuccgucgugaucgcggugaagcugcagggcagcaagcggauccugcgcuccaacgagaucguccuccccgccagcggccugguggagaccgagcugcagcucaccuucucccugcaguacccccacuuccugaagcgggacgccaacaagcuccagaucaugcugcagcgccggaagcgcuacaagaaccggacgauccugggguacaagacccucgccgugggccugaucaacauggccgaggucaugcagcaccccaacgagggggcgcuggugcucggccugcacagcaacgugaaggacgucuccgugcccguggccgagaucaagaucuacagccuguccagccagccgaucgaccacgaggggaucaaguccaagcucagcgaccgcucccccgacaucgacaacuacagcgaggaggaggaggaguccuucagcuccgagcaggagggcagcgacgacccccugcacggccaggaccuguucuacgaggacgaggaccuccggaaggucaagaagacccgccggaagcugaccagcacguccgccaucacccgccagcccaacaucaagcagaaguucguggcccugcucaagcgguucaaggugagcgacgaggucggguucggccuggagcacgugucccgcgagcagauccgggagguggaggaggaccuggacgagcucuacgacagccuggagauguacaacccguccgacagcgggcccgagauggaggagaccgaguccauccugagcacccccaagcccaagcucaagccguucuucgagggcaugucccagagcuccagccagacggagaucgggucccugaacagcaagggcucccugggcaaggacaccaccagccccauggagcucgccgcgcuggagaagaucaaguccaccuggaucaagaaccaggacgacagccugacggagaccgacacccucgagaucaccgaccaggacauguucggggacgccagcacgucccuggucgugcccgagaaggucaagaccccgaugaaguccagcaagaccgaccugcagggcagcgccucccccagcaagguggagggggugcacaccccgcgccagaagcgguccacgccccucaaggagcgccagcugagcaagccccuguccgagcgcaccaacagcuccgacagcgagcggucccccgaccucggccacagcacccagaucccccgcaaggucguguacgaccagcugaaccagauccugguguccgacgccgcccugcccgagaacgucauccucgugaacaccacggacuggcaggggcaguacguggcggagcugcugcaggaccagcggaagccggucgugugcacgugcagcaccguggagguccaggccgugcucuccgcccugcugacccgcauccagcgguacugcaacugcaacagcuccaugccccgccccgugaaggucgccgcggugggcggccagagcuaccucagcuccauccugcgguucuucgucaagagccuggccaacaagaccuccgacuggcucggguacaugcgcuuccugaucaucccccugggcagccacccgguggccaaguaccucggguccguggacagcaaguacuccagcuccuuccuggacagcggcuggcgggaccuguucucccgcagcgagccgcccguguccgagcagcucgacgucgccggccgggugaugcaguacgugaacggggccgcgaccacccaccagcugcccgucgccgaggccaugcugaccugccgccacaaguuccccgacgaggacagcuaccagaaguucauccccuucaucggcguggugaaggucgggcucguggaggacucccccagcaccgccggcgacggggacgacucccccguggucagccugacggugccguccaccagcccgcccagcuccagcggccugucccgggacgccaccgcgacgccgcccagcucccccagcauguccagcgcccucgccaucgugggcucccccaacagccccuacggggacgucaucggccuccagguggacuacuggcuggggcaccccggcgagcgccggcgcgagggggacaagcgggacgccuccagcaagaacacccugaaguccguguuccgcagcguccaggugucccggcugccccacagcggcgaggcccagcuguccggcaccauggcgaugaccguggucaccaaggagaagaacaagaaggugcccacgaucuuccucagcaagaagccgcgcgagaaggagguggacuccaagagccaggucaucgaggggaucagccgccugaucugcuccgccaagcagcagcagaccaugcugcgggugagcaucgacggcguggagugguccgacaucaaguucuuccagcucgccgcccaguggcccacccacgucaagcacuuccccguggggcuguucagcggcuccaaggcgaccuga

SEQ ID NO: 34188 - RNA, 2715 nt, Artificial Sequence
  derived and/or modified sequence opt1 from PACS2__Homo_sapiens__NP_001094383
auggccgagcgcggccggcuggggcuccccggcgccccgggggcgcugaacacccccgugcccaugaaccuguucgccaccugggaggucgacggcagcucccccagcugcgugccgcgccucugcucccugacgcugaagaagcucguggucuucaaggagcuggagaaggagcugaucagcguggugaucgccgucaagaugcagggguccaagcggauccuccgcagccacgagaucgugcugccgcccuccggccagguggagaccgaccuggcccucaccuucagccugcaguacccccacuuccugaagcgggagggcaacaagcuccagaucaugcugcagcgccggaagcgcuacaagaaccggaccauccugggguacaagacgcucgccgcgggcuccaucagcauggccgaggucaugcagcaccccuccgagggcggccaggugcugagccugugcuccagcaucaaggaggcccccgugaaggccgcggagaucuggaucgccucccucagcucccagcccaucgaccacgaggacagcaccaugcaggccgggcccaaggccaaguccaccgacaacuacagcgaggaggaguacgagagcuucuccagcgagcaggaggccuccgacgacgcgguccaggggcaggaccuggacgaggacgacuucgacgugggcaagccgaagaagcagcgccggagcaucgugcgcaccacguccaugacccggcagcagaacuucaagcagaaggucguggcccugcuccgccgguucaaggugagcgacgagguccuggacuccgagcaggaccccgccgagcacauccccgaggccgaggaggaccuggaccuccuguacgacacccuggacauggagcaccccagcgacuccgggccggacauggaggacgacgacagcgugcucuccacccccaagcccaagcugcgccccuacuucgagggccugagccacuccagcucccagacggagaucgggagcauccacuccgcccggagccacaaggagccgcccucccccgcggacgugcccgagaagacccgcagccucggcggccggcagccgagcgacuccgucagcgacaccguggcccugggggugcccggcccccgcgagcaccccgggcagccggaggacucccccgaggccgaggccagcacccuggacgucuucacggagcggcugcccccguccggccgcaucaccaagaccgagagccuggugauccccuccacccgcagcgaggggaagcaggccggccggcgcggccgguccacgagccugaaggagcgccaggcggcccggccccagaacgagcgcgccaacucccucgacaacgagcggugccccgacgcccgcagccagcugcagguccagcugcagaucccgcggaagaccguguacgaccagcucaaccacauccugaucuccgacgaccagcugcccgagaacaucauccucgugaacaccagcgacuggcaggggcaguuccuguccgacguccugcagcgccacacccuccccguggugugcacgugcagccccgccgacguccaggcggccuucuccaccaucgugagccggauccagcgcuacugcaacugcaacagccagccgcccacccccgugaagaucgccgucgccggcgcgcagcacuaccuguccgccauccugcggcuguucguggagcagcucagccacaagacccccgacuggcugggguacaugcgcuuccuggugaucccgcucggcucccaccccgucgcccgguaccuggggagcguggacuaccgcuacaacaacuucuuccaggaccuggccuggcgggaccucuucaacaagcuggaggcccaguccgcggugcaggacacgcccgacaucgucagccgcaucacccaguacaucgccggcgccaacugcgcccaccagcugcccaucgccgaggcgaugcucaccuacaagcagaagcggaagaagcacuuccacuucgacuucacccuguccccggacgaggagagcucccagaaguucauccccuucgugggcguggucaagguggggaucguggagcccagcuccgccacgagcggcgacuccgacgacgccgcccccagcggguccggcacccugagcuccaccccgcccagcgccucccccgcggccaaggaggccagccccaccccgcccagcucccccagcgucuccgggggccucagcuccccgagccagggcgugggggccgagcugaugggccuccagguggacuacuggacggcggcccagcccgccgaccgcaagcgcgacgccgagaagaaggaccuccccgucaccaagaacacccugaagugcaccuuccggucccuccaggugagccgccugcccuccagcggggaggccgcggccaccccgacgauguccaugaccguggucaccaaggagaagaacaagaaggugauguuccugcccaagaaggccaaggacaaggacguggagagcaagucccagugcaucgagggcaucagccggcugaucugcaccgcccgccagcagcagaacaugcuccggguccugaucgacggcguggagugcuccgacgugaaguucuuccagcuggccgcgcaguggagcucccacgucaagcacuuccccaucugcaucuucgggcacagcaaggccacguucuga

SEQ ID NO: 34189 - RNA, 1335 nt, Artificial Sequence
  derived and/or modified sequence opt1 from PACSIN1__Homo_sapiens__XP_011512843
augagcuccagcuacgacgaggccucccuggcccccgaggagaccaccgacagcuucugggaggugggcaacuacaagcgcacggucaagcggaucgacgacgggcaccgccucugcaacgaccugaugaacugcgugcaggagcgggcgaagaucgagaaggccuacggccagcagcugaccgacugggccaagcgcuggcggcagcucaucgagaaggggccgcaguacggcucccuggagcgcgccuggggcgccaucaugaccgaggcggacaaggugagcgagcugcaccaggaggucaagaacaaccuccugaacgaggaccuggagaaggugaagaacuggcagaaggacgccuaccacaagcagaucaugggcggguucaaggagaccaaggaggccgaggacggguuccggaaggcccagaagcccugggcgaagaagaugaaggagcucgaggccgccaagaaggccuaccaccuggccugcaaggaggagaagcuggcgaugacgcgcgagaugaacuccaagaccgagcagagcgugacccccgagcagcagaagaagcuccaggacaaggucgacaagugcaagcaggacgugcagaagacccaggagaaguacgagaaggugcuggaggacgucggcaagacgacgccccaguacauggagaacauggagcaggucuucgagcagugccagcaguucgaggagaagcggcugguguuccucaaggaggugcugcuggacaucaagcgccaccucaaccuggccgagaacuccagcuacauccacguguaccgggagcuggagcaggccauccgcggggccgacgcccaggaggaccuccggugguuccgcuccaccagcggcccggggaugcccaugaacuggccccaguucgaggaguggaaccccgaccugccgcacaccaccaccaagaaggagaagcagcccaagaaggcggagggcguggcccugaccaacgccaccggcgccgucgaguccacgagccaggccggggaccggggcuccgugagcuccuacgaccgcgggcagcccuacgcgaccgaguggagcgacgacgaguccggcaaccccuucggcgggagcgagaccaacggcggggccaacccguucgaggacgacagcaagggcgugcggguccgcgcccucuacgacuacgacgggcaggagcaggacgagcuguccuucaaggccggcgacgagcugaccaagcucggcgaggaggacgagcagggguggugccggggccgccuggacagcgggcagcugggccucuaccccgccaacuacguggaggcgaucuga

SEQ ID NO: 34190 - RNA, 1461 nt, Artificial Sequence
  derived and/or modified sequence opt1 from PACSIN2__Homo_sapiens__NP_001171899
augagcgugaccuacgacgacuccgucggcguggaggugagcuccgacagcuucugggaggucgggaacuacaagcgcaccgugaagcggaucgacgacggccaccgccugugcuccgaccucaugaacugccugcacgagcgggcccgcaucgagaaggccuacgcgcagcagcugacggagugggcccggcgcuggcggcagcucguggagaaggggccccaguacggcaccgucgagaaggccuggauggccuucaugagcgaggccgagcgcguguccgagcugcaccuggaggugaaggcgagccucaugaacgacgacuucgagaagaucaagaacuggcagaaggaggccuuccacaagcagaugaugggcggguucaaggagaccaaggaggccgaggacggcuuccggaaggcccagaagccgugggcgaagaagcugaaggaggucgaggccgccaagaaggcccaccacgccgcgugcaaggaggagaagcuggccaucucccgcgaggccaacagcaaggccgaccccucccucaaccccgagcagcugaagaagcugcaggacaagaucgagaagugcaagcaggacgugcucaagaccaaggagaaguacgagaagucccugaaggagcuggaccaggggacgccccaguacauggagaacauggagcaggucuucgagcagugccagcaguucgaggagaagcggcuccgcuucuuccgggaggugcugcuggaggugcagaagcaccucgaccugagcaacguggccggcuacaaggcgaucuaccacgaccuggagcagagcauccgcgccgccgacgccgucgaggaccuccggugguuccgcgccaaccacgggccgggcauggcgaugaacuggccccaguucgaggagugguccgccgaccugaaccggacccugagccgccgggagaagaagaaggccaccgacggggugacccucacgggcaucaaccagaccggcgaccagucccugcccagcaagcccuccagcacccugaacgugccgagcaaccccgcccaguccgcccagagccaguccagcuacaaccccuucgaggacgaggacgacaccggguccacggucagcgagaaggacgacaccaaggcgaagaacguguccagcuacgagaagacccaguccuaccccaccgacuggagcgacgacgaguccaacaacccguucagcuccacggacgccaacggcgacagcaaccccuucgacgacgacgccaccuccgggaccgaggugcgcguccgggcccucuacgacuacgagggccaggagcacgacgagcugagcuucaaggcgggcgacgagcugaccaagauggaggacgaggacgagcagggguggugcaagggccgccucgacaacggccagguggggcuguaccccgccaacuacguggaggccauccaguga

SEQ ID NO: 34191 - RNA, 1806 nt, Artificial Sequence
  derived and/or modified sequence opt1 from PADI4__Homo_sapiens__XP_011539452
auggcccagggcacccugauccgcgugacccccgagcagccgacgcacgccgucugcgugcucgggacccugacccagcuggacaucugcagcuccgcgcccgaggacugcaccagcuucuccaucaacgccagccccggcguggucguggacaucgcccacgggcccccggccaagaagaaguccacgggcagcuccaccuggccccucgaccccgggguggaggucacccugaccaugaagguggccagcggcuccacgggcgaccagaaggugcagaucagcuacuacgggcccaagaccccgcccgucaaggcgcugcucuaccugaccggcguggaccugcaggacaugucccucaugacccugagcacgaagacccccaaggacuucuucaccaaccacacccuggugcuccacgucgcccgguccgagauggacaaggugcgcguguuccaggccacgcgggggaagcugagcuccaagugcagcgucgugcugggccccaaguggccgucccacuaccucauggugcccgggggcaagcacaacauggacuucuacgucgaggcccuggcguuccccgacaccgacuuccccggccugaucacccucaccaucagccugcuggacacguccaaccucgagcugccggaggccgugguguuccaggacagcgucguguuccgcguggcccccuggaucaugacccccaacacccagcccccgcaggaggucuacgccugcagcaucuucgagaacgaggacuuccugaaguccgugaccacgcucgccaugaaggcgaagugcaagcugaccaucugccccgaggaggagaacauggacgaccaguggaugcaggacgagauggagaucggguacauccaggcgccccacaagacccugcccgucguguucgacagcccgcggaaccgcggccucaaggaguuccccaucaagcgggugauggggcccgacuucggcuacgucacccgcggcccccagaccgggggcaucuccgggcuggacagcuucggcaaccuggagguguccccgcccgugacgguccgggggaaggaguacccccucggccgcauccuguucggcgacagcugcuacccguccaacgacagccggcagaugcaccaggcccugcaggacuuccucuccgcccagcagguccaggcccccgugaagcuguacagcgacuggcuguccguggggcacguggacgaguuccucagcuucgugcccgcccccgaccgcaagggcuuccggcugcugcucgccuccccgcgcagcugcuacaagcuguuccaggagcagcagaacgaggggcacggcgaggcccuccuguucgaggggaucaagaagaagaagcagcagaagaucaagaacauccuguccaacaagacccugcgggagcacaacagcuucgucgagcgcugcaucgacuggaaccgggagcuccugaagcgcgagcugggccucgccgaguccgacaucaucgacaucccccagcuguucaagcugaaggaguucagcaaggccgaggcguucuuccccaacauggugaacaugcuggugcucggcaagcaccuggggauccccaagccguucggccccgucaucaacgggcggugcugccuggaggagaaggugugcucccuccuggagccccugggccuccagugcaccuucaucaacgacuucuucacguaccacauccgccacggggaggugcacugcggcaccaacguccggcgcaagcccuucagcuucaagugguggaacauggugccguga

SEQ ID NO: 34192 - RNA, 543 nt, Artificial Sequence
  derived and/or modified sequence opt1 from PAEP__Homo_sapiens__NP_001018059
augcugugccuccugcugacccucggcguggcccuggucugcggggugcccgccauggacaucccgcagaccaagcaggaccuggagcuccccaagcuggcgggcacguggcacagcauggccauggccaccaacaacaucucccugauggccacccucaaggcgccccugcgcgugcacaucaccagccugcuccccacgccggaggacaaccuggagaucguccugcaccggugggagaacaacuccugcguggagaagaaggugcucggggagaagaccgagaaccccaagaaguucaagaucaacuacaccgucgccaacgaggccacccugcuggacacggacuacgacaacuuccucuuccugugccugcaggacaccaccacccccauccagagcaugaugugccaguaccucgcccgcgugcugguggaggacgacgagaucaugcagggcuucauccgggccuuccgcccccugccgcggcaccucugguaccugcuggaccucaagcagauggaggagcccugccgcuucuga

SEQ ID NO: 34193 - RNA, 1458 nt, Artificial Sequence
  derived and/or modified sequence opt1 from PAF1__Homo_sapiens__NP_001243755
auggcccccaccauccagacccaggcccagcgcgaggacggccaccggagcgggguggucugccgcgugaaguacugcaacucccugccggacauccccuucgaccccaaguucaucacguaccccuucgaccagaaccgguucgugcaguacaaggcgaccagccucgagaagcagcacaagcacgaccugcugaccgagccggaccucggcgucaccaucgaccugaucaaccccgacacguaccgcaucgaccccaacgugcugcucgaccccgccgacgagaagcugcuggaggaggagauccaggccccgaccuccagcaagcggucccagcagcacgccaaggugguccccuggaugcgcaagaccgaguacaucagcaccgaguucaaccgguacgggaucuccaacgagaagcccgaggugaagaucggcgugagcgucaagcagcaguucacggaggaggagaucuacaaggaccgcgacucccagaucaccgccaucgagaagaccuucgaggacgcgcagaaguccaucagccagcacuacagcaagccccgggugaccccgguggaggucaugcccguguuccccgacuucaagauguggaucaaccccugcgcccaggugaucuucgacuccgacccggcccccaaggacacgagcggggccgcggcccucgagaugaugucccaggccaugauccgcggcaugauggacgaggagggcaaccaguucgucgccuacuuccugcccguggaggagacccugaagaagcggaagcgcgaccaggaggaggagauggacuacgcccccgacgacguguacgacuacaagaucgcgcgggaguacaacuggaacgucaagaacaaggccagcaagggguacgaggagaacuacuucuucaucuuccgcgagggcgacgggguguacuacaacgagcucgagacccgggugcgccuguccaagcggcgcgccaaggccggcguccagagcgggaccaacgcccugcucguggugaagcaccgggacaugaacgagaaggagcuggaggcgcaggaggcccgcaaggcccagcuggagaaccacgagccggaggaggaggaggaggaggagauggagacggaggagaaggaggccggcggcuccgucaugcucauccugcggaccaugcccacccugaugaugcgcaccgaggaccgccccaagguggccgucacgaugauccagaccgcggccgccauggggguggccagcggcgccggggcgaccgccgccgcccccgugccgagccccgucgcggccuccacccggccccgccggauggccgugaagcuccagcugcugauccccgugaagcucaucgucacggugaccgagagccagggcauccagggcugguuccgccaccacuacugcgagcagcaguccaccuuccugguggucugccuguga

SEQ ID NO: 34194 - RNA, 1233 nt, Artificial Sequence
  derived and/or modified sequence opt1 from PAFAH1B1__Homo_sapiens__NP_000421
auggugcugagccagcgccagcgggacgagcucaaccgcgccaucgccgacuaccugcgguccaacggcuacgaggaggcguacagcgucuucaagaaggaggccgagcuggacgugaacgaggagcucgacaagaaguacgccgggcugcuggagaagaaguggaccuccgugauccgccuccagaagaaggucauggagcuggagagcaagcugaacgaggccaaggaggaguucaccuccggcgggccccucggccagaagcgggacccgaaggaguggaucccccgcccgcccgagaaguacgcccugagcgggcaccggucccccgugacgcgcgugaucuuccaccccgucuucagcgugaugguguccgcgagcgaggacgccaccaucaaggucugggacuacgagaccggcgacuucgagcggacccugaagggccacacggacuccgugcaggacaucagcuucgaccacuccgggaagcuccuggccagcugcuccgccgacaugaccaucaagcugugggacuuccagggcuucgagugcauccgcaccaugcacgggcacgaccacaacgugagcuccgucgcgaucaugcccaacggcgaccacaucgugagcgccucccgggacaagaccaucaagaugugggaggugcagacgggguacugcgucaagaccuucaccggccaccgcgagugggugcggauggugcgccccaaccaggacggcacccucaucgccagcugcagcaacgaccagacgguccggguguggguggucgccaccaaggagugcaaggccgagcugcgcgagcacgagcacgugguggagugcaucuccugggcgccggagagcuccuacagcuccaucagcgaggccaccggguccgagaccaagaaguccggcaagcccgggcccuuccugcucagcggcagccgggacaagacgaucaagaugugggacgucuccaccggcaugugccugaugacccugguggggcacgacaacuggguccgcggcguccucuuccacagcgggggcaaguucauccuguccugcgccgacgacaagacccugcgggugugggacuacaagaacaagcgcugcaugaagacgcucaacgcccacgagcacuucgugaccagccuggacuuccacaagaccgcccccuacguggugaccggguccgucgaccagacggugaaggugugggagugccgguga

SEQ ID NO: 34195 - RNA, 609 nt, Artificial Sequence
  derived and/or modified sequence opt1 from PAFAH1B2__Homo_sapiens__NP_001171675
augagccagggcgacuccaaccccgccgccaucccgcacgcggccgaggacauccagggggacgaccgcuggaugagccagcacaaccgguucgugcuggacugcaaggacaaggagcccgacguccucuucgugggcgacuccauggugcagcugaugcagcaguacgagaucuggcgcgagcuguucagcccccuccacgcccugaacuucgggaucggcggggacaccacccggcacguccuguggcgccucaagaacggcgagcuggagaacaucaagcccaaggugaucguggucugggugggcacgaacaaccacgagaacaccgccgaggagguggccgggggcaucgaggcgaucguccagcugaucaacacccggcagccgcaggccaagaucaucgugcucgggaaggccgccgcguccaaguacagcaucuccgagaucgugcgccuggagcagggcagcgucaacugguccaucgggaccuaccccgacgacacgcccgccaccacccggcccgccauccugcagcuguucaccggcaagaugagccgcaucacgaugaaggagaagucccgguggaccgaggagauccuccacuga

SEQ ID NO: 34196 - RNA, 1251 nt, Artificial Sequence
  derived and/or modified sequence opt1 from PAFAH2__Homo_sapiens__XP_011539830
augaccguggcccccagcgucuccgccagcaaguucuccagcggcaaguccuucgacagcccgggggacgagaugggcgugaaccaguccgugggguucccgcccgucaccggcccccaccugguggggugcggcgacgugauggagggccagaaccuccaggggagcuucuuccgccuguucuaccccugccagaaggcggaggagacgauggagcagccccuguggaucccccgguacgaguacugcaccggccucgccgaguaccugcaguucaacaagcgcugcgggggccuccuguucaaccuggccgucggguccugccggcugcccgugagcuggaacggcccguucaagaccaaggacuccggcuacccccucaucaucuucagccacgggcugggcgccuuccgcacccuguacuccgccuucugcauggagcucgcgagccggggguucguggucgccgugcccgagcaccgcgaccgguccgccgccacgaccuacuucugcaagcaggcgcccgaggagaaccagccgaccaacgagagccugcaggaggaguggauccccuuccgccggguggaggagggcgagaaggaguuccacguccgcaacccccaggugcaccagcggguguccgagugccugcgcguccucaagauccugcaggaggugaccgccggccagacgguguucaacauccugcccgggggccucgaccugaugacccugaaggggaacaucgacaugagccgggucgccgugaugggccacuccuucgggggcgccaccgccauccucgcgcuggccaaggagacccaguuccgcugcgccguggcccuggacgccuggauguucccgcucgagcgggacuucuaccccaaggcgcgcggccccgucuucuucaucaacacggagaaguuccagaccauggagagcgugaaccugaugaagaagaucugcgcccagcacgagcagagccggaucaucaccgugcugggguccguccaccgcagccagaccgacuucgccuucgugacgggcaaccucaucgggaaguucuucuccaccgagacccggggcagccuggaccccuacgaggggcaggaggucauggugcgcgccaugcuggccuuccuccagaagcaccuggaccugaaggaggacuacaaccaguggaacaaccucaucgagggcaucggcccgucccugacccccggggcgccccaccaccugagcucccucuga

SEQ ID NO: 34197 - RNA, 1299 nt, Artificial Sequence
  derived and/or modified sequence opt1 from PAG1__Homo_sapiens__XP_011515867
augggccccgccgggagccugcucggcuccgggcagaugcagaucacccuguggggcagccuggccgcgguggccaucuucuucgucaucaccuuccucaucuuccugugcuccagcugcgaccgcgagaagaagccgcggcagcacuccggggaccacgagaaccugaugaacgugcccagcgacaaggagauguucucccgcagcgugacgucccucgccaccgacgcccccgccagcuccgagcagaacggcgcgcugaccaacggcgacauccugagcgaggacuccacccucacgugcaugcagcacuacgaggagguccagaccagcgccuccgaccugcuggacagccaggacuccaccgggaagcccaagugccaccagagccgggagcucccgcgcaucccgcccgaguccgccguggacaccaugcugacggcccggagcguggacggcgaccaggggcugggcauggaggggcccuacgagguccucaaggacagcuccagccaggagaacaugguggaggacugccuguacgagaccgugaaggagaucaaggaggucgcggccgccgcccaccuggagaagggccacuccggcaaggccaagagcaccuccgcgagcaaggagcuccccgggccccagaccgagggcaaggccgaguucgccgaguacgccuccguggaccgcaacaagaagugccggcagagcgugaacgucgaguccauccuggggaacagcugcgaccccgaggaggaggcgcccccgcccgugcccgugaagcugcucgacgagaacgagaaccugcaggagaaggagggcggcgaggccgaggaguccgccacggacaccaccagcgagaccaacaagcgcuucuccagccuguccuacaagagccgggaggaggaccccacgcucaccgaggaggagaucuccgccauguacagcuccgucaacaagccggggcagcuggugaacaagagcggccagagccugaccgugcccgaguccaccuacacgagcauccagggggacccccagcgcucccccagcuccugcaacgaccucuacgccaccgucaaggacuucgagaagaccccgaacagcacccugccgcccgccggccggcccuccgaggagcccgagcccgacuacgaggcgauccagacgcugaaccgcgaggaggagaaggccacccucgggaccaacggccaccacggccuggugcccaaggagaacgacuacgagagcaucuccgaccugcagcaggggcgggacaucacccgccucuga

SEQ ID NO: 34198 - RNA, 441 nt, Artificial Sequence
  derived and/or modified sequence opt1 from PAGE1__Homo_sapiens__NP_003776
augggcuuccugcgccggcucaucuaccgccggcgccccaugaucuacguggagagcuccgaggagagcuccgacgagcagccggacgaggucgagagccccacccagucccaggacagcacccccgccgaggagcgggaggacgagggggccuccgcggcccagggccaggagcccgaggccgacagccaggagcuggugcagccgaagacggggugcgagcugggcgacgggcccgacaccaagcgcgugugccuccggaacgaggagcagaugaagcugcccgccgagggccccgagccggaggccgacucccaggagcagguccaccccaagaccggcugcgagcgcggggacggccccgacgugcaggagcuggggcuccccaacccggaggaggugaagacccccgaggaggacgagggccagagccagcccuga

SEQ ID NO: 34199 - RNA, 309 nt, Artificial Sequence
  derived and/or modified sequence opt1 from PAGE4__Homo_sapiens__NP_008934
augagcgcccgcgugcggucccgcagccggggccgcggggacggccaggaggcccccgacgucguggcguucguggcccccggggagucccagcaggaggagccgcccaccgacaaccaggacaucgagcccggccaggagcgggaggggaccccgcccaucgaggagcgcaaggucgagggcgacugccaggagauggaccuggagaagacgcggagcgagcgcggcgacggguccgacgugaaggagaagaccccgcccaaccccaagcacgccaagaccaaggaggccggcgacgggcagcccuga

SEQ ID NO: 34200 - RNA, 333 nt, Artificial Sequence
  derived and/or modified sequence opt1 from PAGE5__Homo_sapiens__NP_001013453
augagcgagcacgugacccgcucccagagcuccgagcggggcaacgaccaggagagcucccagcccgucgggccggugaucgugcagcagcccaccgaggagaagcgccaggaggaggagccgcccacggacaaccagggcaucgcccccagcggggagaucaagaacgagggcgcccccgcgguccaggggaccgacguggaggccuuccagcaggagcuggcccuccugaagaucgaggacgcccccggcgacggccccgacgugcgggaggggacccugccgaccuucgaccccacgaagguccucgaggccggcgaggggcagcuguga

SEQ ID NO: 34201 - RNA, 765 nt, Artificial Sequence
  derived and/or modified sequence opt1 from PAGR1__Homo_sapiens__NP_078792
augagccuggcccgcggccacggggacaccgccgcguccaccgccgcgccccucagcgaggagggcgaggugacguccgggcugcaggcccuggccgucgaggacaccggcgggcccagcgccuccgccggcaaggccgaggacgagggcgagggcgggcgggaggagaccgagcgcgaggggagcggcggggaggaggcccagggcgaggugcccuccgcgggcggggaggagcccgccgaggaggacagcgaggacuggugcgugcccugcuccgacgaggaggucgagcucccggccgacggccagcccuggaugcccccgcccagcgagauccagcggcuguacgagcugcucgccgcccacgggacccuggagcugcaggcggagauccucccccgccggccgcccacgcccgaggcccaguccgaggaggagcgcagcgacgaggagcccgaggccaaggaggaggaggaggagaagccccacaugcccaccgaguucgacuucgacgacgagccggugacccccaaggacucccugaucgaccggcgccggacccccggcagcuccgcccgcagccagaagcgggaggcccgccuggacaaggugcucuccgacaugaagcggcacaagaagcuggaggagcagauccugcgcacgggccgggaccucuucagccuggacuccgaggaccccagcccggcgagcccgccccugcgcuccagcggguccagccucuucccccggcagcgcaaguacuga

SEQ ID NO: 34202 - RNA, 1359 nt, Artificial Sequence
  derived and/or modified sequence opt1 from PAH__Homo_sapiens__NP_000268
augagcaccgccgugcuggagaaccccggccucgggcgcaagcuguccgacuucggccaggagaccagcuacaucgaggacaacugcaaccagaacggggccaucucccugaucuucagccucaaggaggaggucggcgcgcuggccaaggugcugcggcuguucgaggagaacgacgugaaccugacgcacaucgagucccgcccgagccggcugaagaaggacgaguacgaguucuucacccaccucgacaagcgcucccugcccgcccugaccaacaucaucaagauccuccggcacgacaucggggccaccguccacgagcugagccgcgacaagaagaaggacacggugcccugguucccccggaccauccaggagcuggaccgcuucgccaaccagauccucuccuacggcgcggagcuggacgccgaccacccgggcuucaaggaccccguguaccgggcccgccggaagcaguucgccgacaucgcguacaacuaccgccacgggcagcccaucccccgggucgaguacauggaggaggagaagaagaccuggggcaccguguucaagacgcucaagagccucuacaagacccacgccugcuacgaguacaaccacaucuucccgcugcuggagaaguacugcggguuccacgaggacaacaucccccagcucgaggacgugucccaguuccugcagaccugcaccggcuuccgccugcggcccgucgccgggcuccugagcucccgcgacuuccugggcggccucgccuuccggguguuccacugcacgcaguacauccgccacgggagcaagcccauguacaccccggagcccgacaucugccacgagcugcugggccacgugccccucuucuccgaccggagcuucgcccaguucucccaggagaucgggcuggcgagccugggcgcccccgacgaguacaucgagaagcucgccaccaucuacugguucaccgucgaguucggccugugcaagcagggggacuccaucaaggccuacggcgccgggcugcucagcagcuucggcgagcugcaguacugccuguccgagaagccgaagcuccugccccuggagcucgagaagacggcgauccagaacuacaccgugaccgaguuccagccccuguacuacguggccgagagcuucaacgacgccaaggagaagguccgcaacuucgccgccaccaucccccggccguucuccgugcgcuacgaccccuacacgcagcgcaucgaggugcuggacaacacccagcagcucaagauccuggcggacagcaucaacuccgagaucgggauccugugcagcgcccuccagaagaucaaguga

SEQ ID NO: 34203 - RNA, 1278 nt, Artificial Sequence
  derived and/or modified sequence opt1 from PAICS__Homo_sapiens__NP_001072992
auggccaccgccgaggugcugaacaucggcaagaagcucuacgaggggaagaccaaggaggucuacgagcugcuggacagccccggcaaggugcuccugcaguccaaggaccagaucacggcggggaacgccgcccgcaagaaccaccuggagggcaaggccgccaucagcaacaagaucaccuccugcaucuuccagcuccugcaggaggcggggaucaagaccgccuucacccggaagugcggcgagacggccuucaucgccccgcagugcgagaugauccccaucgagugggugugccgccggaucgcgaccggcagcuuccugaagcgcaaccccggggucaaggagggcuacaaguucuacccgcccaagguggagcuguucuucaaggacgacgccaacaacgacccccagugguccgaggagcagcugaucgccgccaaguucugcuucgccgggcugcucaucggccagaccgagguggacaucaugagccacgcgacccaggccaucuucgagauccuggagaaguccuggcugccccagaacugcacgcucgucgacaugaagaucgaguucgggguggacgugaccaccaaggagaucguccuggccgacgugaucgacaacgacagcuggcggcuguggcccuccggcgaccgcagccagcagaaggacaagcaguccuaccgggaccucaaggaggugaccccggagggccugcagauggucaagaagaacuucgaguggguggccgagcgcguggagcugcuccucaagagcgagucccagugccgggucguggugcugauggggagcacguccgaccucggccacugcgagaagaucaagaaggccugcgggaacuucggcauccccugcgagcugcgcgucaccagcgcgcacaagggccccgacgagacccugcggaucaaggccgaguacgagggggacggcauccccaccguguucguggccgucgccgggcgcuccaacggccucgggccggugaugagcggcaacacggccuaccccgugaucuccugcccgccccugacccccgacuggggcguccaggacguguggagcagccugcggcuccccuccgggcugggcugcagcaccguccugucccccgaggggagcgcgcaguucgccgcccagaucuucggccucuccaaccaccugguguggagcaagcugcgcgccuccauccucaacaccuggaucagccugaagcaggccgacaagaagauccgggagugcaaccuguga

SEQ ID NO: 34204 - RNA, 1440 nt, Artificial Sequence
  derived and/or modified sequence opt1 from PAIP1__Homo_sapiens__NP_006442
augagcgacggcuucgaccgcgcccccggggccggccgggggcgcucccggggccuggggcgcggcggcgggggcccggagggcggcggguuccccaacggggcgggccccgccgagcgggcccgccaccagcccccgcagcccaaggcccccggguuccuccagcccccgccccugcggcagccccgcaccacgcccccgcccggcgcccagugcgaggugcccgcgagcccccagcggccgucccgccccggggcccugcccgagcagacccggccccuccgcgccccgcccagcucccaggacaagaucccccagcagaacagcgaguccgccauggcgaagccccaggucgugguggccccgguccugaugagcaagcuguccgugaacgcccccgaguucuaccccagcggcuacuccagcuccuacaccgagagcuacgaggacggcugcgaggacuaccccacccucuccgaguacgugcaggacuuccugaaccaccugaccgagcagccggggagcuucgagacggagaucgagcaguucgccgagacccucaacggcugcgucaccaccgacgacgcccugcaggagcugguggagcucaucuaccagcaggcgacguccauccccaacuucagcuacaugggggcccggcugugcaacuaccugucccaccaccucaccaucagcccccagagcggcaacuuccgccagcugcugcuccagcggugccgcaccgaguacgaggugaaggaccaggccgccaagggggacgaggucacccggaagcgcuuccacgccuucgugcuguuccugggcgagcucuaccugaaccuggagaucaagggcacgaacggccaggugacccgggcggacauccuccaggucgggcugcgcgagcugcucaacgcccuguucuccaacccgauggacgacaaccugaucugcgccgugaagcuccugaagcugaccgggagcgugcucgaggacgccuggaaggagaagggcaagauggacauggaggagaucauccagcggaucgagaacgucgugcuggacgccaacugcucccgcgacgugaagcagaugcugcucaagcuggucgagcugcgcagcuccaacugggggcgggugcacgcgaccagcacguaccgcgaggccacccccgagaacgaccccaacuacuucaugaacgagcccaccuucuacaccuccgacggcgugccguucacggccgccgaccccgacuaccaggagaaguaccaggagcuccuggagcgggaggacuucuuccccgacuacgaggagaacggcaccgaccugagcggggccggcgaccccuaccucgacgacaucgacgacgagauggacccggagaucgaggaggcguacgagaaguucugccuggaguccgagcgcaagcggaagcaguga

SEQ ID NO: 34205 - RNA, 384 nt, Artificial Sequence
  derived and/or modified sequence opt1 from PAIP2__Homo_sapiens__XP_011541730
augaaggaccccagccgcuccagcaccuccccgagcaucaucaacgaggacgugaucaucaacggccacucccacgaggacgacaaccccuucgccgaguacauguggauggagaacgaggaggaguucaaccggcagaucgaggaggagcugugggaggaggaguucaucgagcgcugcuuccaggagaugcucgaggaggaggaggagcacgagugguucauccccgcccgggaccugccccagaccauggaccagauccaggaccaguucaacgaccuggucaucagcgacggguccagccucgaggaccugguggugaaguccaaccugaacccgaacgcgaaggaguucguccccggcgugaaguacgggaacaucuga

SEQ ID NO: 34206 - RNA, 1638 nt, Artificial Sequence
  derived and/or modified sequence opt1 from PAK1__Homo_sapiens__NP_002567
augagcaacaacggccuggacauccaggacaagcccccggccccgcccaugcgcaacaccuccaccaugaucggggccggcagcaaggacgcggggacgcucaaccacggcuccaagccccugccgcccaaccccgaggagaagaagaagaaggaccgguucuaccgcagcauccugcccggggacaagaccaacaagaagaaggagaaggagcggccggagaucucccuccccagcgacuucgagcacaccauccacgugggcuucgacgccgucaccggcgaguucacggggaugcccgagcagugggcccgccugcugcagaccuccaacaucaccaagagcgagcagaagaagaacccccaggccgugcucgacgugcuggaguucuacaacuccaagaagaccagcaacucccagaaguacaugagcuucacggacaaguccgccgaggacuacaacagcuccaacgcgcugaacgucaaggccgugagcgagaccccggccgugccgcccgucuccgaggacgaggacgacgacgacgacgacgccaccccgccgcccgugaucgcgccccggcccgagcacaccaagagcguguacacgcgcuccgucaucgagccccuccccgugacccccacccgggacguggccaccagccccaucagccccacggagaacaacaccaccccgcccgacgcccugacccgcaacacggagaagcagaagaagaagcccaagauguccgacgaggagauccuggagaagcuccggagcaucgucuccgugggcgaccccaagaagaaguacacccgcuucgagaagaucgggcagggcgccagcgggaccguguacaccgccauggacgucgcgacgggccaggagguggccaucaagcagaugaaccugcagcagcagcccaagaaggagcugaucaucaacgagauccucgugaugcgggagaacaagaaccccaacaucgucaacuaccuggacuccuaccuggugggcgacgagcucuggguggucauggaguaccuggccgggggcagccugaccgacguggugaccgagaccugcauggacgaggggcagaucgccgccgucugccgcgagugccuccaggcgcuggaguuccugcacuccaaccaggugauccaccgggacaucaagagcgacaacauccuccugggcauggacggcuccgucaagcugacggacuucggguucugcgcccagaucacccccgagcagagcaagcgcuccaccauggugggcacccccuacuggauggcccccgagguggucacgcggaaggccuacgggcccaagguggacaucuggagccucggcaucauggccaucgagaugaucgagggggagccgcccuaccugaacgagaacccccugcgcgcgcucuaccugaucgccaccaacggcacccccgagcugcagaacccggagaagcucuccgccaucuuccgggacuuccugaaccgcugccuggagauggacguggagaagcggggcagcgccaaggagcuccugcagcaccaguuccugaagaucgccaagccccucuccagccugacgccccugaucgcggccgccaaggaggccaccaagaacaaccacuga

SEQ ID NO: 34207 - RNA, 1179 nt, Artificial Sequence
  derived and/or modified sequence opt1 from PAK1IP1__Homo_sapiens__NP_060376
auggagcugguggccggcugcuacgagcagguccucuucggguucgccgugcaccccgagccggaggcgugcggcgaccacgagcaguggacccugguggccgacuucacccaccacgcccacacggccagccuguccgccgucgcggugaacagccgcuucguggucaccggguccaaggacgagaccauccacaucuacgacaugaagaagaagaucgagcacggcgcccucgugcaccacagcgggaccaucacgugccugaaguucuacggcaaccggcaccugaucuccggcgccgaggacgggcucaucugcaucugggacgccaagaagugggagugccucaagagcaucaaggcgcacaagggccaggugaccuuccuguccauccaccccagcgggaagcucgcccuguccgucggcaccgacaagacccugcgcacguggaaccucguggaggggcggagcgccuucaucaagaacaucaagcagaacgcccacaucguggaguggagcccccgcggcgagcaguacgucgugaucauccagaacaagaucgacaucuaccagcuggacaccgccuccaucuccggcaccaucaccaacgagaagcggaucagcuccgugaaguuccugagcgaguccguccucgcgguggccggggacgaggaggugauccgcuucuucgacugcgacagccuggucugccugugcgaguucaaggcccacgagaaccgggugaaggacauguucuccuucgagauccccgagcaccacgugaucgucagcgccagcuccgacggcuucaucaagauguggaagcucaagcaggacaagaaggugccgcccagccugcugugcgagaucaacacgaacgcccgccugaccugccuggggguguggcuggacaaggucgcggacaugaaggagucccucccgcccgccgccgagcccagccccguguccaaggagcagagcaagaucggcaagaaggagcccggcgacaccguccacaaggaggagaagcgguccaagcccaacaccaagaagcgcgggcugacgggcgacagcaagaaggccaccaaggaguccgggcugaucagcaccaagaagcggaagaugguggagaugcucgagaagaagcgcaagaagaagaagaucaagaccaugcaguga

SEQ ID NO: 34208 - RNA, 1575 nt, Artificial Sequence
  derived and/or modified sequence opt1 from PAK2__Homo_sapiens__NP_002568
augagcgacaacggcgagcuggaggacaagcccccggccccgcccgugcgcaugagcagcaccaucuucuccaccgggggcaaggacccccucagcgccaaccacucccugaagccccugcccagcguccccgaggagaagaagccccggcacaagaucaucuccaucuucagcgggacggagaagggcuccaagaagaaggagaaggagcgcccggagaucagcccgcccuccgacuucgagcacaccauccacgugggguucgacgcggugaccggcgaguucaccggcaugcccgagcagugggcccggcuccugcagacgagcaacaucaccaagcuggagcagaagaagaacccccaggccguccucgacgugcugaaguucuacgacuccaacaccgugaagcagaaguaccugagcuucaccccgcccgagaaggacggguuccccuccggcacgcccgcccucaacgccaaggggaccgaggcgcccgccgucgugaccgaggaggaggacgacgacgaggagaccgccccgcccgugaucgcgccccgccccgaccacaccaagagcaucuacacccgguccgucaucgaccccgugcccgccccggugggcgacagccacgucgacggggccgccaagucccuggacaagcagaagaagaagaccaagaugaccgacgaggagaucauggagaagcugcgcacgaucgugagcaucggcgaccccaagaagaaguacacccgguacgagaagaucggccagggggccagcggcaccguguucaccgccacggacgucgcgcucgggcaggagguggccaucaagcagaucaaccugcagaagcagcccaagaaggagcugaucaucaacgagauccucgugaugaaggagcugaagaaccccaacaucgucaacuuccuggacuccuaccucgugggcgacgagcuguucguggucauggaguaccuggccggcgggagccucaccgacguggugaccgagaccugcauggacgaggcccagaucgccgcggucugccgcgagugccugcaggcccuggaguuccuccacgccaaccaggugauccaccgggacaucaaguccgacaacguccugcugggcauggaggggagcgugaagcucacggacuucggcuucugcgcccagaucaccccggagcaguccaagcgcagcaccaugguggggacccccuacuggauggcccccgaggucgugacgcggaaggcguacggcccgaagguggacaucuggucccugggcaucauggccaucgagauggucgagggggagccgcccuaccugaacgagaacccccuccgcgcccuguaccugaucgccaccaacggcacccccgagcuccagaaccccgagaagcugagccccaucuuccgggacuuccugaaccgcugccucgagauggacguggagaagcggggguccgccaaggagcugcugcagcaccccuuccucaagcuggcgaagccgcugagcucccucacgccccugaucauggccgccaaggaggccaugaaguccaaccgcuga

SEQ ID NO: 34209 - RNA, 1635 nt, Artificial Sequence
  derived and/or modified sequence opt1 from PAK3__Homo_sapiens__NP_001121639
augagcgacggccuggacaacgaggagaagcccccggccccgccccuccgcaugaacuccaacaaccgggacagcuccgcccugaaccacagcuccaagccccugcccauggcgcccgaggagaagaacaagaaggcccgccuccggagcaucuuccccgggggcggggacaagaccaacaagaagaaggagaaggagcgccccgagaucucccugccgagcgacuucgagcacaccauccacgugggcuucgacgccgucacgggggaguucaccggcauccccgagcagugggcccggcugcuccagaccuccaacaucaccaagcuggagcagaagaagaacccccaggccgugcuggacgugcucaaguucuacgacagcaaggagacggucaacaaccagaaguacauguccuucaccagcggcgacaaguccgcgcacggguacaucgccgcccaccccagcuccaccaagaccgccagcgagccgccccuggcgccgcccguguccgaggaggaggacgaggaggaggaggaggaggaggacgagaacgagcccccgcccgugaucgcgccccgccccgagcacaccaagagcaucuacacccgguccgucguggagagcaucgccagccccgccgugcccaacaaggaggucacgcccccguccgccgagaacgcgaacagcuccacccuguaccgcaacacggaccggcagcgcaagaaguccaagaugaccgacgaggagauccucgagaagcugcggagcaucgugagcgugggcgaccccaagaagaaguacacccgcuucgagaagaucgggcagggcgccuccgggaccgucuacacggcccuggacaucgccaccggccaggagguggccaucaagcagaugaaccuccagcagcagcccaagaaggagcugaucaucaacgagauccuggugaugcgggagaacaagaaccccaacaucgucaacuaccucgacagcuaccuggugggcgacgagcuguggguggucauggaguaccucgccgggggcucccugaccgacguggugaccgagacgugcauggacgaggggcagaucgccgccgucugccgcgagugccugcaggcccucgacuuccugcacagcaaccaggugauccaccgggacaucaaguccgacaacauccugcucggcauggacggcagcgugaagcugaccgacuucggguucugcgcccagaucaccccggagcaguccaagcgcagcaccauggucggcacgcccuacuggauggcgcccgagguggucacccggaaggccuacgggccgaagguggacaucuggucccugggcaucauggccaucgagaugguggagggggagccgcccuaccucaacgagaacccccugcgcgcccuguaccucaucgccaccaacggcacccccgagcugcagaaccccgagcggcugagcgcggucuuccgcgacuuccucaaccggugccuggagauggacguggaccgccgcggcuccgccaaggagcugcuccagcaccccuuccugaagcuggccaagccccucagcucccugacgccgcugaucaucgccgcgaaggaggccaucaagaacagcagccgguga

SEQ ID NO: 34210 - RNA, 1776 nt, Artificial Sequence
  derived and/or modified sequence opt1 from PAK4__Homo_sapiens__NP_001014832
auguucggcaagcgcaagaagcggguggagaucagcgcccccuccaacuucgagcaccgcguccacaccggguucgaccagcacgagcagaaguucaccggccugccgcggcaguggcagagccucaucgaggaguccgcccgccggcccaagccccugguggaccccgcgugcaucacgagcauccagccgggggcccccaagaccaucgugcgcggcuccaagggggccaaggacggcgcccugacccuccugcuggacgaguucgagaacaugagcgucacccgguccaacagccuccgccgggacuccccccccccgcccgcccgcgcgcggcaggagaacggcaugcccgaggagcccgccacgaccgcccgcgggggcccggggaaggccggcagccgggggcgcuucgcgggccacuccgaggccggcgggggcagcggggaccggcgccgggccggccccgagaagcgccccaaguccagccgggagggcuccgggggcccccaggagagcucccgcgacaagcggccgcugagcgggcccgacgugggcaccccccagcccgccgggcuggccuccggcgcgaagcucgccgccggccgcccguucaacaccuacccccgcgccgacacggaccaccccagccggggggcccagggcgagccccacgacguggcgccgaacgggcccagcgccggcgggcuggccaucccccaguccagcuccagcuccagccgccccccgacccgggcccgcggcgcccccucccccggcguccuggggccgcacgcgagcgagccccagcucgccccccccgccugcaccccggccgcccccgcggugcccggccccccggggccccgguccccccagcgcgagccccagcgggugagccacgagcaguuccgcgccgcccugcagcuggucguggacccgggcgacccccgguccuaccucgacaacuucaucaagaucggggagggcagcaccggcaucgugugcaucgccacgguccgcuccagcgggaagcugguggcggugaagaagauggaccugcggaagcagcagcgccgggagcuccuguucaacgaggucgugaucaugcgcgacuaccagcacgagaacguggucgagauguacaacuccuaccuggugggcgacgagcucuggguggucauggaguuccuggaggggggcgcccugaccgacaucgugacccacacccggaugaacgaggagcagaucgccgccgugugccucgccguccugcaggcgcugagcgugcuccacgcccagggcgucauccaccgcgacaucaaguccgacagcauccugcugacgcacgacgggcgggugaagcucuccgacuucggcuucugcgcccaggugagcaaggaggucccccgccggaagagccugguggggacccccuacuggauggccccggagcugaucucccgccuccccuacggccccgagguggacaucuggagccuggggaucauggucaucgagaugguggacggcgagcccccguacuucaacgagcccccccugaaggccaugaagaugauccgcgacaaccuccccccgcggcugaagaaccugcacaaggugucccccagccucaagggcuuccuggaccgccugcucguccgggaccccgcgcagcgcgccaccgccgccgagcugcugaagcacccguuccucgccaaggcggggccccccgccuccaucgugccccugaugcggcagaaccgcacccgguga

SEQ ID NO: 34211 - RNA, 2046 nt, Artificial Sequence
  derived and/or modified sequence opt1 from PAK6__Homo_sapiens__NP_001263646
auguuccgcaagaagaagaagaagcggcccgagaucagcgccccgcagaacuuccagcaccgcgugcacaccuccuucgaccccaaggagggcaaguucgucgggcugccgccccaguggcagaacauccucgacacccugcggcgccccaagcccgugguggaccccagccggaucacccgcguccagcugcagcccaugaagaccguggugcggggcuccgccaugccggucgacggguacaucagcggccuccugaacgacauccagaagcuguccgugaucagcuccaacacccuccgcgggcggagccccaccucccgccggcgcgcgcagagccugggccugcucggcgacgagcacugggccacggaccccgacauguaccugcagagcccccagagcgagcggaccgacccgcacgggcuguaccucuccugcaacggcgggacccccgccggccacaagcagaugcccuggcccgagccgcagagcccccgcgugcugcccaacgggcuggccgccaaggcgcagucccucggccccgccgaguuccagggcgccagccagcggugccugcagcugggggccugccuccaguccagcccgcccggcgcguccccgcccaccgggacgaaccgccacggcaugaaggccgccaagcacggcagcgaggaggcccggccccagagcugccuggucggguccgccaccggccgccccgggggcgaggggagccccucccccaagacccgggagagcucccugaagcgccgccucuuccggagcauguuccuguccaccgcggccacggccccgcccagcuccagcaagcccggcccgccgccccaguccaagcccaacagcuccuuccgcccgccccagaaggacaacccgcccagccugguggccaaggcccagucccuccccagcgaccagcccgugggcaccuucagcccccugaccaccuccgacacguccagcccccagaagucccugcggaccgcgcccgccaccgggcagcuccccggccgcuccagccccgccgggagcccccggaccuggcacgcccagaucuccacguccaaccuguaccugccgcaggaccccaccgucgccaagggcgcgcucgccggggaggacaccggcguggugacccacgagcaguucaaggccgcccugcgcauggucguggaccagggcgacccccggcugcuccuggacagcuacgugaagaucggggagggcuccacggggaucgucugccuggcccgcgagaagcacagcggccgccagguggcggugaagaugauggaccuccggaagcagcagcggcgcgagcugcuguucaacgaggucgugaucaugcgggacuaccagcacuucaacguggucgagauguacaaguccuaccucgugggggaggagcuguggguccugauggaguuccuccagggcggcgcccugaccgacaucgugagccaggugcgccugaacgaggagcagaucgccaccgucugcgaggccgugcuccaggcgcuggccuaccugcacgcccagggggugauccaccgggacaucaaguccgacagcauccuccugacccuggacggccgcgucaagcuguccgacuucggguucugcgcccagaucagcaaggacgugcccaagcggaagucccucgugggcacgccguacuggauggcccccgaggucaucagccgcucccuguacgcgaccgagguggacaucuggagccugggcaucauggugaucgagauggucgacggggagccgcccuacuucagcgacucccccgugcaggccaugaagcggcuccgcgacagcccgccgcccaagcugaagaacucccacaaggugagccccguccugcgggacuuccucgagcgcaugcuggugcgcgacccccaggagcgggccaccgcccaggagcugcucgaccaccccuuccugcugcagaccggccuccccgagugccuggugccccugauccagcucuaccgcaagcagacguccacgugcuga

SEQ ID NO: 34212 - RNA, 2160 nt, Artificial Sequence
  derived and/or modified sequence opt1 from PAK7__Homo_sapiens__NP_065074
auguucggcaagaagaagaagaagaucgagaucagcgggcccuccaacuucgagcaccgcgugcacaccggcuucgacccccaggagcagaaguucaccgggcugccccagcaguggcacagccuccuggccgacacggccaaccggcccaagcccauggucgaccccuccugcaucacccccauccagcuggcgcccaugaagaccaucgugcgcggcaacaagcccugcaaggagaccagcaucaacgggcuccuggaggacuucgacaacaucuccgugacgcggagcaacucccugcgcaaggagagcccgcccacccccgaccagggcgccuccagccacggccccgggcacgccgaggagaacggcuucaucaccuucucccaguacagcuccgagagcgacaccacggccgacuacaccaccgagaaguaccgggagaagucccucuacggggacgaccuggacccguacuaccgcggcagccacgccgcgaagcagaacgggcacgucaugaagaugaagcacggcgaggccuacuacuccgaggugaagccccucaagagcgacuucgcccgguucuccgccgacuaccacagccaccuggacagccuguccaagcccagcgaguacuccgaccugaagugggaguaccagcgcgcgagcuccagcagcccccucgacuacuccuuccaguucaccccgucccggacggccggcaccagcgggugcuccaaggagagccuggccuacuccgagagcgaguggggccccucccuggacgacuacgaccgccggcccaagagcuccuaccucaaccagaccagcccccagccgaccaugcgccagcggucccgcagcgggagcggccugcaggagcccaugaugcccuucggcgccuccgccuucaagacgcacccccaggggcacagcuacaacuccuacaccuacccgcggcugagcgagcccaccaugugcauccccaagguggacuacgaccgcgcgcagaugguccucagcccgccccuguccggcuccgacaccuacccccgggggcccgccaagcugccgcagagccaguccaagagcggcuacuccagcuccagccaccaguaccccuccggguaccacaaggccacgcucuaccaccaccccagccugcaguccagcagccaguacaucuccaccgccagcuaccuguccagccucucccugagcuccagcaccuacccgccgcccuccuggggcagcuccagcgaccagcagcccucccgcgugagccacgagcaguuccgggccgcgcugcagcucguggucucccccggcgacccccgcgaguaccuggccaacuucaucaagaucggggagggcagcaccgggaucgugugcaucgccacggagaagcacaccggcaagcaggucgccgugaagaagauggaccugcggaagcagcagcgccgcgagcuccuguucaacgagguggugaucaugcgggacuaccaccacgacaacgucguggacauguacuccagcuaccuggugggggacgagcucugggucgugauggaguuccuggagggcggcgcccugaccgacaucgugacccacacgcgcaugaacgaggagcagaucgcgaccgucugccucuccgugcugcgggcccugagcuaccuccacaaccagggggugauccaccgcgacaucaagagcgacuccauccugcugaccagcgacggccggaucaagcucuccgacuucggguucugcgcccaggucagcaaggaggugcccaagcgcaagucccuggucggcacccccuacuggauggcccccgaggugaucagccggcugccguacgggacggagguggacaucuggucccucggcaucauggucaucgagaugaucgacggcgagccgcccuacuucaacgagccgccccugcaggccaugcgccggauccgcgacagccugccgccccgggugaaggaccuccacaagguguccagcguccugcgcggguuccuggaccugaugcucgugcgggagcccucccagcgcgcgaccgcccaggagcugcugggccaccccuuccucaagcuggccgggccgcccagcugcaucgugccccugaugcggcaguaccgccaccacuga

SEQ ID NO: 34213 - RNA, 3561 nt, Artificial Sequence
  derived and/or modified sequence opt1 from PALB2__Homo_sapiens__NP_078951
auggacgagcccccgggcaagccccugagcugcgaggagaaggagaagcucaaggagaagcuggccuuccugaagcgcgaguacuccaagacccucgcccggcugcagcgcgcgcagcgggccgagaagaucaagcacagcaucaagaagaccguggaggagcaggacugccugucccagcaggaccucagcccccagcugaagcacuccgagcccaagaacaagaucugcgucuacgacaagcugcacaucaagacgcaccucgacgaggagaccggggagaagaccagcaucacccuggacgugggcccggaguccuucaaccccggggacggccccgggggccugcccauccagcgcacggacgacacccaggagcacuucccgcaccgggugagcgaccccuccggcgagcagaagcagaagcuccccagccgccggaagaagcagcagaagcgcaccuucaucucccaggagcgggacugcgucuucgggaccgacagccugcgccuguccggcaagcggcucaaggagcaggaggagaucagcuccaagaaccccgcccgcagcccggugacggagauccggacccaccugcugucccucaagagcgagcugcccgacucccccgagcccgugaccgagaucaacgaggacagcguccugaucccgcccaccgcccagcccgagaaggggguggacacguuccuccgccggcccaacuucacccgcgccaccaccgugccgcugcagacgcugagcgacuccggcagcucccagcaccucgagcacaucccccccaaggggagcuccgagcugaccacccacgaccugaagaacauccgguucaccagccccgucucccucgaggcgcagggcaagaagaugacggugagcaccgacaaccugcuggugaacaaggccaucuccaagagcggccagcucccgaccuccagcaaccuggaggccaacaucuccugcagccugaacgagcucaccuacaacaaccugcccgccaacgagaaccagaaccugaaggagcagaaccagacggagaagucccucaagagccccuccgacacccuggacgggcgcaacgagaaccugcaggagagcgagauccucucccagcccaagagccugagccuggaggcgaccuccccgcucagcgccgagaagcacuccugcaccguccccgagggccugcuguuccccgccgaguacuacgugcggacgacccgcagcauguccaacugccagcggaagguggccgucgaggccgugauccagagccaccucgacgugaagaagaagggguucaagaacaagaacaaggacgcguccaagaaccugaaccugagcaacgaggagaccgaccaguccgagauccgcaugagcggcaccugcacgggccagccguccagccgcaccucccagaagcuccugagccugaccaaggucuccagccccgccgggcccaccgaggacaacgaccugucccggaaggccguggcccaggcccccggccgccgguacacggggaagcgcaagagcgcgugcaccccggccagcgaccacugcgagccccuccugcccaccuccagccuguccaucgugaaccggagcaaggaggaggucaccucccacaaguaccagcacgagaagcucuucauccaggugaagggcaagaagagccgccaccagaaggaggacucccugagcugguccaacagcgccuaccugucccucgacgacgacgccuucaccgcccccuuccaccgggacgggaugcugagccugaagcagcuccuguccuuccugagcaucacggacuuccagcucccggacgaggacuucggcccccugaagcuggagaaggugaaguccugcagcgagaagcccgucgagcccuucgaguccaagauguucggcgagcgccaccucaaggaggggagcugcaucuucccggaggagcugucccccaagcggauggacaccgagauggaggaccuggaggaggaccucaucgugcugcccggcaagagccaccccaagcgcccgaacagccagucccagcacaccaagaccgggcugagcuccagcauccuccuguacacgccccugaacaccgucgcgcccgacgacaacgaccggcccaccaccgacaugugcuccccggccuuccccauccucggcacgacccccgccuucgggccccagggcagcuacgagaaggccuccaccgagguggccggccgcaccugcugcacgccgcagcuggcgcaccugaaggacagcgugugccucgccuccgacaccaagcaguucgacagcuccgggagccccgccaagccccacaccacccugcaggucuccggccggcaggggcagccgacgugcgacugcgacagcgugccccccggcacccccccgcccaucgaguccuucaccuucaaggagaaccagcugugccgcaacaccugccaggagcuccacaagcacagcguggagcagacggagaccgccgagcugcccgcguccgacagcaucaaccccgggaaccugcagcucgucuccgagcugaagaacccgagcggcagcugcuccguggacgugagcgccauguucugggagcgggccggcugcaaggagcccugcaucaucaccgccugcgaggacgucgugucccuguggaaggcccucgacgcguggcagugggagaagcuguacaccuggcacuucgccgaggugcccguccugcagaucgugcccgugccggacgucuacaaccucgugugcguggcccuggggaaccuggagauccgcgagauccgggcccucuucugcagcuccgacgacgagagcgagaagcagguccugcugaaguccggcaacaucaaggccgugcucgggcugacgaagcgccggcuggugagcuccagcggcacccucuccgaccagcaggucgaggugaugaccuucgcggaggacggcgggggcaaggagaaccaguuccugaugccccccgaggagaccauccugacguucgccgaggugcaggggaugcaggaggcccuccugggcaccaccaucaugaacaacaucgucaucuggaaccugaagaccgggcagcuccugaagaagaugcacaucgacgacagcuaccaggccuccgugugccacaaggccuacagcgagaugggccugcucuucaucgugcugucccaccccugcgcgaaggagagcgagucccugcgcagcccggucuuccagcucaucgugaucaaccccaagacgacccuguccgugggcgucaugcuguacugccucccccccgggcaggccggccgcuuccuggagggggacgugaaggaccacugcgccgccgcgauccugaccagcggcaccaucgccaucugggaccuccugcuggggcagugcacggcccuccugccgcccgugagcgaccagcacugguccuucgucaaguggagcggcaccgacucccaccugcucgccggccagaaggacgggaacaucuucguguaccacuacagcuga

SEQ ID NO: 34214 - RNA, 2571 nt, Artificial Sequence
  derived and/or modified sequence opt1 from PALD1__Homo_sapiens__NP_055246
augggcaccaccgccagcacggcccagcagaccguguccgcggggacccccuucgagggccugcaggggagcggcaccauggacucccgccacagcgucuccauccacagcuuccaguccacgagccuccacaacuccaaggccaagagcaucaucccgaacaagguggcccccguggucaucaccuacaacugcaaggaggaguuccagauccacgacgagcugcugaaggcccacuacacccucgggcggcuguccgacaacacccccgagcacuaccuggugcagggccgcuacuuccucgugcgggacgucacggagaagauggacgugcugggcaccguggggagcugcggcgcccccaacuuccgccagguccagggcgggcugaccguguucgggaugggccagccgucccucagcggcuuccggcgcgugcugcagaagcugcagaaggacgggcaccgggagugcgucaucuucugcgugcgcgaggagcccgugcuguuccugcgggcggacgaggacuucgucuccuacacgccccgcgacaagcagaaccugcacgagaaccuccagggccuggggcccggcgugcggguggagagccuggagcucgccauccgcaaggagauccacgacuucgcccagcuguccgagaacaccuaccacgucuaccacaacaccgaggaccuguggggcgagccgcacgccguggcgauccacggggaggacgaccuccacgugaccgaggaggucuacaagcggccccuguuccugcagcccaccuaccgcuaccaccggcucccccugccggagcagggcagcccccuggaggcccagcucgacgccuucguguccgugcugcgcgagacgcccagccugcuccagcugcgggacgcccacgggcccccgcccgcccuggucuucagcugccagaugggcguggggcgcaccaaccucggcaugguccugggcacccugauccuccugcaccgguccgggaccacgagccagcccgaggcggcccccacccaggccaagccgcugcccauggagcaguuccaggugauccaguccuuccuccgcauggugccccagggccggcgcauggucgaggagguggaccgcgccaucaccgccugcgcggagcugcacgaccugaaggaggugguccucgagaaccagaagaagcuggaggggauccggcccgagagcccggcccagggcuccgggagccgccacuccguguggcagcgggcccuguggagccucgagcgcuacuucuaccugauccuguucaacuacuaccuccacgagcaguacccccuggccuucgcccuguccuucagccgguggcugugcgcgcaccccgagcucuaccgccugcccgugacccuguccagcgccggcccggucgcgccccgggaccucaucgcccgcggcucccugcgggaggacgaccuggugagccccgacgcccucuccacggugcgcgagauggacgucgccaacuuccggcgcgugccgcggaugcccaucuacgggaccgcccagcccagcgccaaggcccugggcuccauccuggcguaccucaccgacgccaagcgccggcugcgcaagguggucugggugagccugcgggaggaggccgugcucgagugcgacgggcacaccuacucccugcgcuggcccggcccgcccgucgcccccgaccagcuggagacgcucgaggcccagcugaaggcgcaccugagcgagcccccgcccgggaaggagggcccccucaccuaccgguuccagaccugccugaccaugcaggagguguucagccagcaccgccgcgccugccccggccugacguaccaccggaucccgaugcccgacuucugcgcgccccgcgaggaggacuucgaccagcuccuggaggcccugcgggccgcccucuccaaggaccccgggaccggcuucguguucagcugccuguccgggcagggccgcaccaccacggccauggucguggccgugcuggccuucuggcacauccagggcuucccggaggucggggaggaggagcucgugagcgugcccgacgccaaguucaccaagggcgaguuccaggucgugaugaaggugguccagcugcugcccgacgggcaccgggugaagaaggagguggacgcggcccucgacaccgucuccgagaccaugacccccaugcacuaccaccuccgcgagaucaucaucugcacguaccggcaggccaaggccgcgaaggaggcccaggagaugcgccggcugcagcuccgcagccugcaguaccuggagcgguacgugugccucauccuguucaacgccuaccugcaccucgagaaggccgacuccuggcagcgcccguucagcaccuggaugcaggagguggccuccaaggcgggcaucuacgagauccugaacgagcugggguuccccgagcucgagagcggcgaggaccagcccuucucccggcugcgcuaccgguggcaggagcagagcugcucccuggagcccagcgccccggaggaccuccuguga

SEQ ID NO: 34215 - RNA, 3372 nt, Artificial Sequence
  derived and/or modified sequence opt1 from PALLD__Homo_sapiens__NP_001159580
augagcggcaccuccagccacgaguccuucuacgacagccuguccgacaugcaggaggagagcaagaacaccgacuucuuccccgggcucuccgccuuccugagccaggaggagaucaacaagucccuggaccucgcccgccgggcgaucgccgacagcgagacggaggacuucgacuccgagaaggagaucagccagaucuucuccaccagccccgccucccugugcgagcaccccagccacaaggagaccaagcugggcgagcacgccucccgccggccccaggacaaccgcagcacccccgugcagccgcucgccgagaagcagacgaaguccaucagcagccccgucuccaagcggaagcccgcgaugagcccccugcugacccgcccguccuacauccggagccuccgcaaggccgagaagcgcggggccaagacccccuccaccaacgugaagcccaagacgccccaccagcggaagggcgggccgcagagccagcugugcgacaaggccgcgaaccugaucgaggagcucaccuccaucuucaaggccgccaagccccggaaccgcagccccaacggcgaguccagcucccccgacagcggcuaccuguccccgaagaaccagcccagcgcccugcucuccgccagcgcgucccagagccccauggaggaccagggggagauggagcgggaggugaagucccccggcgcccgccacugcuaccaggacaaccaggaccuggccgucccgcacaaccgcaagagccacccccagccccacagcgcccugcacuuccccgccgcgccgcgcuucauccagaagcuccggucccaggagguggccgaggggagccgcguguaccuggagugccgggucaccggcaaccccacgccccgcgugcggugguucugcgaggggaaggagcugcacaacacccccgacauccagauccacugcgagggcggcgaccuccacacccugaucaucgccgaggccuucgaggacgacaccgggcgcuacacgugccuggccacgaacccguccggcagcgacaccaccuccgcggagguguucaucgagggggccagcuccaccgacagcgacuccgagagccucgccuucaagucccgggccggcgccaugccccaggcgcagaagaagaccaccagcgucucccugaccaucggcagcuccagccccaagaccggggugacgaccgccgugauccagccgcuguccguccccgugcagcagguccacagccccaccagcuaccucugccggcccgacggcaccacgaccgccuacuucccgcccguguucaccaaggagcugcagaacaccgccguggcggagggccagguggucgugcuggagugccgcgugcgcggggcgccgccccuccagguccagugguuccggcagggguccgagauccaggacagccccgacuuccggauccugcagaagaagccccgcuccacggccgagcccgaggagaucugcacccuggugaucgccgagaccuuccccgaggacgccggcaucuucacgugcagcgcccggaacgacuacggcuccgccaccagcaccgcccagcucguggucaccuccgccaacaccgagaacugcagcuacgaguccaugggggagagcaacaacgaccacuuccagcacuucccgcccccgccgcccauccuggagaccuccagccuggagcucgccuccaagaagcccagcgagauccagcaggucaacaaccccgagcugggccugucccgcgcggcccuccagaugcaguucaacgccgccgagcgggagacgaacggggugcaccccagccgcggcgugaacgggcugaucaacggcaaggccaacuccaacaagagccugcccacccccgcggugcuccugucccccaccaaggagcccccgccccugcucgccaagcccaagcugggcuucccgaagaaggccagccggaccgcccgcaucgcgagcgacgaggagauccaggggacgaaggacgccgucauccaggaccuggagcggaagcuccgcuucaaggaggaccugcugaacaacggccagccccggcugaccuacgaggagcgcauggcccggcgccuccugggggccgacuccgccaccguguucaacauccaggagcccgaggaggagaccgcgaaccaggacaucggcagcccccacgccuccguggggagcccgcuggacggccagaaggaguacaaggucuccagcugcgagcagcggcucaucuccgagaucgaguaccgccuggagcgcagccccguggacgaguccggcgacgaggugcaguacggggacguccccguggagaacggcauggcccccuucuucgagaugaagcugaagcacuacaagaucuucgaggggaugccggugacguucacgugccgggucgccggcaaccccaagcccaagaucuacugguucaaggacggcaagcagaucagccccaaguccgaccacuacaccauccagcgcgaccucgacgggaccugcagccugcacaccaccgccuccacccuggacgacgacggcaacuacaccaucauggcggccaacccgcaggggcggaucagcugcacgggccgccucauggugcaggccgugaaccagcgggggcgcagcccccggucccccuccggccacccccacguccgccggccgcgcagccggucccgcgacagcggcgacgagaacgagcccauccaggagcgguucuuccgcccccacuuccugcaggcccccggggaccugaccgugcaggagggcaagcucugccggauggacugcaaggugagcgggcugccgacccccgaccuguccuggcagcucgacggcaagcccguccgccccgacagcgcccacaagaugcuggugcgggagaacggggugcacucccugaucaucgagccggucaccagccgcgacgcgggcaucuacacgugcaucgccaccaaccgggccggccagaacuccuucagccucgagcuggugguggccgcgaaggaggcccacaagccgcccgucuucaucgagaagcugcagaacaccgggguggccgacggcuaccccgugcgccucgagugccggguccugggggugcccccgccccagaucuucuggaagaaggagaacgagucccugacccacagcacggaccgcguguccaugcaccaggacaaccacggcuacaucugccuccugauccagggggccaccaaggaggacgccggcugguacaccgucagcgcgaagaacgaggccggcaucguguccugcaccgcccgccuggacguguacaucagccggcacuga

SEQ ID NO: 34216 - RNA, 3312 nt, Artificial Sequence
  derived and/or modified sequence opt1 from PALM2-AKAP2__Homo_sapiens__NP_009134
auggccgaggccgagcugcacaaggagcgccuccaggcgaucgccgagaagcggaagcgccagaccgagaucgagggcaagcggcagcagcuggacgagcagauccugcuccugcagcacagcaaguccaaggugcugcgcgagaaguggcuccugcaggggauccccgccggcaccgccgaggaggaggaggcccggcgccggcagagcgaggaggacgaguuccgcgucaagcagcuggaggacaacauccagcggcucgagcaggagauccagacgcuggaguccgaggagagccagaucuccgcgaaggagcagaucauccuggagaagcucaaggagaccgagaagagcuucaaggacuuccagaagggguucuccagcaccgacggcgacgccgugaacuacaucuccagccagcugccggaccugcccauccucugcucccgcaccgccgagcccagccccgggcaggacggcacgucccgggccgcgggcguggggugggagaacguccugcugaaggagggcgagagcgccuccaacgccaccgagaccagcgggccggacaugaccaucaagaagcccccccagcucuccgaggacgacaucuggcugaagagcgagggcgacaacuacuccgccacgcugcucgagcccgccgcgagcagccuguccccggaccacaagaacauggagaucgaggugagcguggccgagugcaaguccguccccgggaucaccagcaccccccaccccauggaccacccguccgccuucuacagccccccccacaacggccugcucaccgaccaccacgagucccuggacaacgacguggcccgcgagauccgguaccuggacgaggugcucgaggccaacugcugcgacagcgcggucgacggcacguacaacgggaccuccagccccgagccgggcgccguggugcuggucgggggccuguccccccccgugcacgaggccacccagcccgagccgaccgagcgcacggccagccggcaggcccccccccacaucgagcucuccaacagcucccccgacccgauggcggaggccgagcgcaccaacggccacagccccucccagccccgggacgcccugggggacagccugcaggugcccgucuccccgagcagcaccaccuccagccgcugcuccagccgggacggcgaguucacgcucaccacccugaagaaggaggccaaguucgagcugcgcgccuuccacgaggacaagaagcccuccaagcucuucgaggacgacgagcacgagaaggagcaguacugcauccggaaggugcgccccagcgaggagaugcuggagcuggagaaggagcgccgggagcucauccgcucccaggcggugaagaagaacccggggaucgccgccaagugguggaaccccccccaggagaagaccaucgaggagcagcuggacgaggagcaccuggagagccacaagaaguacaaggagcggaaggagcgccgggcccagcaggagcagcuccugcugcagaagcagcuccagcagcagcagcagcagcccccgucccagcugugcacggcgcccgccagcucccacgagcgcgccagcaugaucgacaaggccaaggaggacaucgucaccgagcagaucgacuucuccgccgcgcggaagcaguuccagcugauggagaacagccgccaggccguggccaagggccaguccaccccccggcucuucagcaucaagcccuucuaccgcccgcugggguccgugaacagcgacaagccccugaccaacccccggcccccgagcgucggcggcccccccgaggacuccggggccagcgccgcgaagggccagaagucccccggggcccuggagacgccgagcgccgccggcucccaggggaacaccgccagccagggcaaggagggccccuacuccgagcccagcaagcgcgggccccucuccaagcugugggcggaggacggcgaguucaccagcgcccgggccgugcugaccguggucaaggacgacgaccacgggauccucgaccaguucucccgcagcgugaacgucucccugacgcaggaggagcuggacagcggccucgacgagcuguccgugcggagccaggacaccaccgugcuggagacccucuccaacgacuucagcauggacaacaucuccgacagcggggccagcaacgagacgaccaacgcgcugcaggagaacucccuggccgacuucagccucccgcagaccccccagaccgacaaccccuccgagggccgcggcgagggggucagcaaguccuucagcgaccacggcuucuacucccccagcuccacccugggggacagcccgcugguggacgacccccucgaguaccaggccggccugcuggugcagaacgccauccagcaggccaucgcggagcaggucgacaaggccguguccaagacgagccgggacggcgccgagcagcaggggcccgaggccaccguggaggaggccgaggcggccgccuucggcuccgagaagccgcagagcauguucgagcccccccaggucuccagccccgugcaggagaagcgcgacgugcucccgaagauccugcccgccgaggaccgggcccugcgcgagcgcgggcccccccagccgcuccccgcgguccagcccuccggccccaucaacauggaggagacccggccggaggggagcuacuucuccaaguacagcgaggccgccgagcugcgcagcaccgccucccugcucgcgacgcaggagagcgacgugauggugggccccuucaagcugcggucccgcaagcagcggacccugagcaugaucgaggaggagauccgcgccgcccaggagcgggaggaggagcucaagcgccagcggcagguccugcaguccacccagagcccccgcaccaagaacgcccccucccugccgagccggacgugcuacaagaccgcccccggcaagaucgagaaggugaagccccccccgucccccaccaccgaggggcccagccuccagcccgaccuggcgccggaggaggccgccggcacgcagcgccccaagaaccugaugcagacccucauggaggacuacgagacccacaaguccaagcggcgcgagcggauggacgacagcuccuacaccagcaagcugcuguccugcaaggugacgagcgagguccucgaggccacccgcgugaaccggcgcaaguccgcccuggcgcugcggugggaggccgggaucuacgccaaccaggaggaggaggacaacgaguga

SEQ ID NO: 34217 - RNA, 378 nt, Artificial Sequence
  derived and/or modified sequence opt1 from PAM16__Homo_sapiens__NP_057153
auggccaaguaccuggcccagaucaucgugaugggcguccaggugguggggcgcgcguucgcccgggcccuccgccaggaguucgccgccagccgggcggccgccgacgcccgcggccgggcggggcaccgcuccgccgccgccagcaaccuguccggccugagccuccaggaggcccagcagauccugaacgucuccaagcugagccccgaggaggugcagaagaacuacgagcaccucuucaaggugaacgacaaguccgucgggggcagcuucuaccugcaguccaagguggugcgggcgaaggagcgccuggacgaggagcucaagauccaggcccaggaggaccgggagaagggccagaugccgcacaccuga

SEQ ID NO: 34218 - RNA, 2664 nt, Artificial Sequence
  derived and/or modified sequence opt1 from PAM__Homo_sapiens__NP_620177
auggccggccgcgugcccagccugcucguccugcugguguucccguccagcugccucgccuuccggagcccccuguccguguucaagcgcuucaaggagaccacccggcccuucuccaacgagugccuggggacgacccgccccgucgugccgaucgacagcuccgacuucgcccucgacauccggaugcccggcgugacccccaagcagagcgacaccuacuucugcauguccaugcgcauccccgucgacgaggaggccuucgugaucgacuucaagccgcgggccagcauggacacggugcaccacaugcugcuguucgggugcaacaugcccuccagcaccggcuccuacugguucugcgacgaggggaccugcaccgacaaggccaacauccucuacgccugggcgcgcaacgccccgcccacgcggcugcccaagggcgucggcuuccgcgugggcggggagaccgggagcaaguacuucgugcugcagguccacuacggcgacaucuccgccuuccgggacaacaacaaggacugcagcggggugucccuccaccugacccgccugccccagccccucaucgccggcauguaccugaugaugagcguggacaccgucauccccgcgggcgagaagguggugaacuccgacaucagcugccacuacaagaacuacccgaugcacgucuucgccuaccgggugcacacgcaccaccuggggaagguggucagcggcuaccgcgugcggaacgggcaguggacccucaucggccgccagagcccccagcugccccaggccuucuaccccgugggccacccggucgacguguccuucggggaccugcucgccgcccggugcgucuucaccggcgaggggcgcaccgaggcgacgcacaucggcgggaccuccagcgacgagaugugcaaccuguacaucauguacuacauggaggccaagcacgccguguccuucaugaccugcacccagaacguggcccccgacauguuccggacgaucccgcccgaggccaacauccccauccccgucaagagcgacauggugaugaugcacgagcaccacaaggagaccgaguacaaggacaagaucccccugcuccagcagcccaagcgcgaggaggaggaggugcuggaccagggcgacuucuacucccugcucagcaagcugcugggcgagcgggaggacgucgugcacgugcacaaguacaacccgaccgagaaggcggaguccgagagcgaccucgucgccgagaucgccaacguggugcagaagaaggaccuggggcgcuccgacgcccgcgagggcgccgagcacgagcgggggaacgcgauccugguccgcgaccggauccacaaguuccaccgccucgugagcacccugcggccgcccgagucccgcguguucagccugcagcagcccccgcccggcgaggggacgugggagcccgagcacaccggcgacuuccacauggaggaggcccucgacuggcccggcgucuaccugcugcccggccagguguccgggguggcccucgaccccaagaacaaccuggucaucuuccaccgcggggaccacgugugggacggcaacagcuucgacuccaaguucguguaccagcagaucgggcugggccccaucgaggaggacaccauccucgucaucgacccgaacaacgccgccgugcugcagagcuccggcaagaaccuguucuaccucccccacgggcugagcaucgacaaggacggcaacuacugggugaccgacgucgcgcugcaccagguguucaagcucgaccccaacaacaaggaggggcccgugcugauccugggccggagcaugcagccgggcuccgaccagaaccacuucugccagcccacggacgucgccguggaccccgggaccggcgccaucuacgugagcgacggguacugcaacucccggaucguccaguucagccccuccggcaaguucaucacccaguggggcgaggagagcuccgggagcuccccgcugcccggccaguucaccgugccccacagccucgcccuggugccccugcucgggcagcugugcgucgcggaccgcgagaacggccggauccagugcuucaagacggacaccaaggaguucgugcgcgagaucaagcacuccagcuucgggcggaacguguucgccaucuccuacaucccgggccuccuguucgccgucaacgggaagccccacuucggcgaccaggagcccgugcagggcuucgugaugaacuucagcaacggggagaucaucgacaucuucaagcccguccgcaagcacuucgacaugccgcacgacaucguggccuccgaggacggcaccguguacaucggggacgcccacaccaacacggucuggaaguucacccugaccgagaagcuggagcaccggagcgugaagaaggcgggcaucgaggugcaggagaucaaggggaagggcuccggcgggcucaaccugggcaacuucuucgccagccgcaagggguacagccggaagggcuucgaccgccuguccaccgaggggagcgaccaggagaaggaggacgacggcuccgagagcgaggaggaguacuccgcgccccuccccgcccuggccccgagcuccagcuga

SEQ ID NO: 34219 - RNA, 2163 nt, Artificial Sequence
  derived and/or modified sequence opt1 from PAMR1__Homo_sapiens__NP_001001991
auggagcugggcugcuggacccagcucgggcugaccuuccugcagcuccugcugaucagcucccucccccgcgaguacacggugaucaacgaggccugcccgggcgccgaguggaacaucaugugccgggagugcugcgaguacgaccagaucgagugcgucugccccgggaagcgcgagguggugggcuacaccauccccugcugccggaacgaggagaacgagugcgacagcugccugauccaccccgggugcaccaucuucgagaacugcaaguccugccgcaacggcagcuggggcgggacccuggacgacuucuacgucaagggcuucuacugcgcggagugccgggccgggugguacggcggggacugcaugcgcugcggccaggugcuccgggccccgaagggccagauccugcuggaguccuacccccucaacgcccacugcgaguggacgauccacgccaagcccggguucgugauccagcugcgcuucgucaugcugagccucgaguucgacuacaugugccaguacgacuacguggaggugcgggacggcgacaaccgcgacgggcagaucaucaagcgggucugcggcaacgagcgccccgcgccgauccaguccaucggcagcucccugcacgugcuguuccacagcgacggguccaagaacuucgacggcuuccacgccaucuacgaggagaucaccgccugcagcuccagccccugcuuccacgacgggaccugcgugcucgacaaggccggcuccuacaagugcgcgugccuggccggguacaccggccagcggugcgagaaccugcucgaggagcgcaacugcagcgaccccggcgggcccgucaacggcuaccagaagaucaccgggggcccggggcugaucaacggccggcacgccaagaucggcaccgugguguccuucuucugcaacaacagcuacguccuguccgggaacgagaagcgcacgugccagcagaacggcgaguggagcgggaagcagcccaucugcaucaaggccugccgggagcccaagaucagcgaccucgugcgccggcgcgugcugcccaugcagguccagucccgggagaccccgcugcaccagcucuacagcgccgcguucuccaagcagaagcugcagagcgcccccacgaagaagcccgcccugcccuucggcgaccucccgaugggguaccagcaccuccacacccagcugcaguacgagugcaucucccccuucuaccgccgccugggcagcucccggcggaccugccugcgcaccggcaaguggagcgggcgcgcccccuccugcauccccaucugcggcaagaucgagaacaucacggccccgaagacccaggggcugcgguggcccuggcaggcggccaucuaccgccggaccagcggcgugcacgacggcucccuccacaagggggccugguuccuggugugcagcggcgcccuggucaacgagcgcaccgugguggucgccgcgcacugcgugacggaccucgggaaggucaccaugaucaagaccgccgaccugaagguggugcugggcaaguucuaccgggacgacgaccgcgacgagaagaccauccagucccuccagaucagcgccaucauccugcaccccaacuacgaccccauccugcucgacgccgacaucgccauccugaagcugcucgacaaggcgcggaucuccacgcgcguccagccgaucugccuggccgccagccgggaccuguccaccagcuuccaggagucccacaucaccguggccggguggaacgugcuggcggacguccgcagccccggcuucaagaacgacacccuccggagcggcgugguguccgucguggacagccugcugugcgaggagcagcacgaggaccacgggauccccguguccgucacggacaacauguucugcgccagcugggagccgaccgcccccuccgacaucugcaccgccgagaccggcgggaucgccgcggugagcuuccccggccgcgccucccccgagccgcgguggcaccucauggggcuggugagcugguccuacgacaagacgugcagccaccgccuguccaccgccuucaccaagguccuccccuucaaggacuggaucgagcggaacaugaaguga

SEQ ID NO: 34220 - RNA, 3609 nt, Artificial Sequence
  derived and/or modified sequence opt1 from PAN2__Homo_sapiens__NP_001120932
augaacuucgagggccuggaccccgggcucgccgaguacgccccggcgaugcacagcgcccuggaccccgugcuggacgcccaccucaaccccucccugcugcagaacgucgagcucgaccccgagggcguggcccuggaggcccugccggugcaggagagcguccacaucauggaggggguguacuccgagcuccacagcguggucgcggaggugggcgugcccgucuccgugagccacuucgaccugcacgaggagaugcuguggguggggucccacggcggccacgccaccagcuucuucgggcccgcccucgagcgcuacuccagcuuccaggucaacggcuccgacgacauccggcagauccagagccuggagaacgggauccuguuccucaccaagaacaaccugaaguacauggcccgcggcgggcugaucaucuucgacuaccuccuggacgagaacgaggacaugcacucccugcuccugacggacagcuccacccugcucgugggcggccugcagaaccacauccuggagaucgaccucaacaccgugcaggagacccagaaguacgcggucgagacgcccggggugaccaucaugcggcagaccaaccgcuucuucuucugcggccacaccagcgggaaggugucccugcgggaccugcgcacguucaaggucgagcacgaguucgacgccuucagcggcucccucagcgacuucgacgugcacggcaaccugcuggccgccugcggguucagcucccggcucaccggccuggccugcgaccgcuuccugaagguguacgaccuccggaugaugcgcgcgaucaccccgcugcagguccacguggaccccgccuuccugcgguucauccccaccuacacgagccgccucgccaucaucucccagagcgggcagugccaguucugcgagcccaccggccuggccaacccggccgacaucuuccacgugaaccccgucgggccccugcucaugaccuucgacguguccgcgagcaagcaggcccuggccuucggcgacuccgagggcugcguccaccuguggaccgacagccccgagccguccuucaaccccuacagccgggagacggaguucgcccuccccugccugguggacucccugcccccgcucgacuggagccaggaccugcugccccugucccucauccccgugccccugaccaccgacacccugcucagcgacuggccggccgcgaacuccgcccccgcgccccgccgggcgcccccggucgacgccgagauccugcgcacgaugaagaaggugggguucaucggcuacgcccccaacccccggacccgccugcggaaccagaucccguaccgccucaaggagagcgacuccgaguucgacagcuucucccaggugaccgagagccccgucgggcgggaggaggagccccaccuccacauggugagcaagaaguaccgcaaggugaccaucaaguacuccaagcugggccucgaggacuucgacuucaagcacuacaacaagacgcuguucgccgggcuggagccccacaucccgaacgccuacugcaacugcaugauccagguccucuacuuccuggagcccgugcgcugccugauccagaaccaccucugccagaaggaguucugccuggccugcgagcugggcuuccucuuccacaugcuggaccugagccggggcgaccccugccaggggaacaacuuccuccgcgccuuccggaccauccccgaggccuccgcccugggccugauccucgccgacagcgacgaggccuccgggaagggcaaccuggcgcgccugauccagcgguggaaccgcuucauccucacccagcugcaccaggacaugcaggagcuggagaucccgcaggccuaccgcggggccggcggcagcuccuucugcagcuccggggacagcgugaucggccagcuguucuccugcgagauggagaacugcagccugugccggugcggguccgagaccguccgggccagcuccacgcugcuguucacccugagcuaccccgacggcuccaagagcgacaagaccggcaagaacuacgacuucgcccaggugcugaagcgcagcaucugccucgaccagaacacccaggcguggugcgacacgugcgagaaguaccagcccaccauccagacccggaacauccgccaccuccccgacauccuggugaucaacugcgaggucaacuccagcaaggaggccgacuucuggcggaugcaggccgagguggccuucaagauggccgugaagaagcacgggggcgagaucuccaagaacaaggaguucgcgcucgccgacuggaaggagcuggggagcccggagggcguccuggugugccccuccaucgaggagcucaagaacguguggcugcccuucagcauccgcaugaagaugaccaagaacaaggggcuggacgucugcaacuggacggacggcgacgagaugcaguggggccccgcccgggccgaggaggagcacgggguguacguguacgaccucauggcgaccgucgugcacauccuggacucccgcaccggcgggagccugguggcccacaucaaggucggcgagaccuaccaccagcggaaggagggggugacccaccagcagugguaccucuucaacgacuuccugaucgagccgaucgacaagcacgaggccgugcaguucgacaugaacuggaagguccccgccauccuguacuacgugaagcgcaaccucaacucccgguacaaccugaacaucaagaaccccaucgaggccagcgugcugcucgcggaggccucccuggcccgcaagcagcgcaagacgcacaccaccuucaucccccugaugcucaacgagaugccgcagaucggcgaccuggucggccuggacgccgaguucgugacccucaacgaggaggaggccgagcugcggagcgacgggacgaaguccaccaucaagcccagccagauguccguggcgcgcaucacgugcguccggggccaggggcccaacgagggcauccccuucaucgacgacuacaucagcacccaggagcaggucguggacuaccugacccaguacuccgggaucaagccgggcgaccucgacgccaagaucagcuccaagcaccugaccacccucaagagcaccuaccugaagcugcgcuuccugaucgacaucggcgugaaguucguggggcacggccuccagaaggacuuccgggugaucaaccugaugguccccaaggaccaggugcuggacacgguguaccucuuccacaugccccgcaagcggaugaucagccugcgcuuccuggccugguacuuccucgaccugaagauccagggggagacccacgacuccaucgaggacgcccggaccgcccugcagcucuaccgcaaguaccuggagcugagcaagaacggcaccgagccggaguccuuccacaagguccucaaggggcuguacgagaagggccggaagauggacuggaaggugcccgagcccgagggccagacgagccccaagaacgcggccguguucuccagcguccuggcccucuga

SEQ ID NO: 34221 - RNA, 2664 nt, Artificial Sequence
  derived and/or modified sequence opt1 from PAN3__Homo_sapiens__NP_787050
augaacagcggcgggggccugcccccgcccuccgccgccgcgagccccuccagcuccagccucgccgccgccguggccgucguggcgcccccgggggugggcgggguccccggcggcgccgccgugggggugaagcugaaguacugccgcuacuacgccaaggacaagaccugcuucuacggcgaggagugccaguuccugcacgaggaccccgcggccggggccgcccccggccucgggcugcacuccaacagcgucccgcuggcccucgcgggcgcccccguggccggcuucccgcccggggccguggccggcgggggcgcggggcccccgcccggccccaagaagcccgaccugggcgaccccgggaccggcgccgccgccgggggcggcggguccagcggcgggcuggacggcccccggcucgccauccccgggauggacggcggcgcgcugacggacaccucccugaccgacagcuacuucuccaccagcuucaucggggucaacggcuucggguccccgguggagacgaaguacccccucaugcagcgcaugaccaacagcuccagcucccccagccugcugaacgacagcgccaagcccuacuccgcccacgacccgcucaccagccccgccuccagccuguucaacgacuucggcgcccugaacaucucccagcggcgcaagccccggaaguaccgccucgggaugcuggaggagcggcuggugcccaugggcagcaaggcgcgcaaggccaagaacccgaucggcugccucgccgaccggugcaaguccgggguccccaucaacauggugugguggaaccgcgugaccgagaacaaccugcagacgcccaacccgaccgccagcgaguucauccccaagggcggguccaccagccggcuguccaacgucagccaguccaacaugagcgcguucucccagguguucagccaccccuccaugggcagccccgccaccgccggccucgccccggggaugucccugagcgccggcagcagcccccugcacagccccaagaucacgccccacaccuccccggcgccccgccggcgcagccacacccccaaccccgccuccuacauggugccgagcuccgccagcaccuccgucaacaaccccgugagccagacgcccuccagcgggcaggucauccagaaggagaccgugggcgggaccaccuacuucuacacggacaccacccccgccccgcucaccggcaugguguuccccaacuaccacaucuacccgcccacggcgccccacguggccuacaugcagcccaaggccaacgcccccuccuucuucauggccgacgagcugcggcaggagcugaucaaccgccaccucaucaccauggcccagaucgaccaggcggacaugcccgccgucccgaccgagguggacagcuaccacucccuguucccccuggagccccucccgccgcccaaccggauccagaaguccuccaacuucggcuacaucaccagcugcuacaaggccgucaacagcaaggacgaccugcccuacugccugcgccggauccacggguuccgccucgugaacacgaagugcauggugcuggucgacauguggaagaagauccagcacuccaacaucgugacccugcgggagguguucaccaccaaggccuucgcggagcccagccucgucuucgccuacgacuuccacgccggcggggagacgaugaugucccgccacuucaacgaccccaacgccgacgccuacuucaccaagcgcaaguggggccagcacgaggggccccugccccggcagcacgcgggccugcucccggagagccugaucugggccuacaucgugcagcuguccagcgcccuccgcaccauccacaccgccggccuggccugccgggugauggaccccacgaagauccugaucaccgggaagacccgccuccgggucaacugcgugggcguguucgacguccugaccuucgacaacucccagaacaacaacccccuggcgcugauggcccaguaccagcaggccgaccucaucagccuggggaagguggugcuggcccucgccugcaacucccuggcgggcauccagcgcgagaaccugcagaaggccauggagcucgucaccaucaacuacagcuccgaccugaagaaccugauccucuaccugcugacggaccagaaccggaugcgcagcgugaacgacaucaugcccaugaucggggcccgguucuacacccagcucgacgccgcgcagaugcgcaacgacgugaucgaggaggaccuggccaaggagguccagaacggccggcuguuccgccuccuggccaagcugggcaccaucaacgagcggccggaguuccagaaggaccccaccugguccgagacgggggaccgcuaccuccugaagcuguuccgggaccaccucuuccaccaggugaccgaggccggcgcccccuggaucgaccugagccacaucaucuccugccugaacaagcucgacgcgggggugcccgagaagaucagccugaucucccgcgacgagaaguccguccugguggugaccuacagcgaccucaagcggugcuucgagaacaccuuccaggagcugaucgccgccgccaacggccagcuguga

SEQ ID NO: 34222 - RNA, 945 nt, Artificial Sequence
  derived and/or modified sequence opt1 from PANK1__Homo_sapiens__NP_612189
augaagcugaucaacggcaagaagcagaccuuccccugguucgggauggacaucggcgggacccucgugaagcuggucuacuucgagccgaaggacaucacggccgaggaggagcaggaggagguggagaaccucaagagcauccgcaaguaccucaccuccaacaccgccuacggcaagaccgggauccgggacgugcaccuggagcugaagaaccucacgaugugcggccgcaagggcaaccugcacuucauccgguuccccagcugcgcgaugcaccgcuucauccagaugggguccgagaagaacuucagcucccugcacaccacccucugcgccaccggcgggggcgccuucaaguucgaggaggacuuccggaugaucgccgaccugcagcugcacaagcucgacgagcuggacugccugauccaggggcuccuguacgucgacagcgugggcuucaacggcaagcccgagugcuacuacuucgagaaccccacgaacccggagcugugccagaagaagcccuacugccucgacaaccccuaccccaugcugcuggugaacaugggguccggcgucagcauccucgccguguacuccaaggacaacuacaagcgcgugaccgggaccagcuucggcaacaugauguccaaggagaagcgggacagcaucuccaaggaggaccuggcgcgcgccacccuggucacgaucaccaacaacaucggcagcaucgcccggaugugcgcccucaacgagaacaucgaccgcgugguguucgucgggaacuuccugcggaucaacaugguguccaugaagcugcucgcguacgccauggacuucuggagcaagggccagcugaaggcccuguuccucgagcacgagggguacuucggcgccgugggggcccugcuggagcuguucaagaugaccgacgacaaguga

SEQ ID NO: 34223 - RNA, 1713 nt, Artificial Sequence
  derived and/or modified sequence opt1 from PANK2__Homo_sapiens__NP_705902
augcgccggcugggccccuuccacccgcgcgugcacugggccgccccgcccagccucuccagcgggcugcaccggcuccuguuccugcgcggcacccggauccccuccagcaccacgcuguccccgccccgccacgacagccucucccuggacgggggcaccgucaacccgccccgggugcgcgagcccaccgggcgggaggcguucggccccagccccgccuccagcgacuggcugcccgcccgcuggcggaacggccgcgggggccggccgcgcgcccggcucugcuccggguggaccgccgcggaggaggcccgccggaaccccacgcugggcgggcugcucggccgccagcggcugcugcuccgcaugggcgggggccggcugggggcccccauggagcgccacggccgcgccagcgcgaccuccgugagcuccgccggcgagcaggccgccggggaccccgagggccggcgccaggagccgcugcggcgccgggccagcuccgcgagcguccccgccgugggggccuccgccgagggcacccgccgggaccgccucgggagcuacagcggccccaccuccgugagccggcagcgcgucgagucccugcggaagaagcgcccccuguuccccugguucggccucgacaucgggggcacgcuggugaagcugguguacuucgagcccaaggacaucaccgccgaggaggaggaggaggaggucgagagccucaaguccauccggaaguaccugaccagcaacguggcguacggguccaccggcauccgcgacgugcaccuggagcucaaggaccugacgcugugcgggcggaagggcaaccuccacuucauccgcuuccccacccacgacaugcccgccuucauccagaugggccgggacaagaacuucagcucccugcacaccgucuucugcgccaccgggggcggggccuacaaguucgagcaggacuuccugacgaucggcgaccuccagcugugcaagcuggacgagcucgacugccugaucaaggggauccuguacaucgacagcgugggcuucaacggccgcucccagugcuacuacuucgagaacccggccgacagcgagaagugccagaagcuccccuucgaccugaagaaccccuacccccugcuccuggugaacaucggguccggcgucagcauccuggcgguguacuccaaggacaacuacaagcgggugaccgggaccagccucggcggcgggaccuucuucggccugugcugccugcucacggggugcaccaccuucgaggaggcccuggagauggccucccgcggcgacagcaccaaggucgacaagcuggugcgcgacaucuacgggggcgacuacgagcgguucggccugccggggugggccguggccuccagcuucggcaacaugaugagcaaggagaagcgcgaggcggucuccaaggaggaccucgcccgggccacgcugaucaccaucaccaacaacaucgggagcaucgcccgcaugugcgcgcugaacgagaacaucaaccaggugguguucgucggcaacuuccuccggaucaacaccaucgccaugcgccugcuggccuacgcccucgacuacugguccaaggggcagcugaaggcccuguucagcgagcacgagggcuacuucggcgcggugggggcccuccuggagcugcucaagauccccuga

SEQ ID NO: 34224 - RNA, 1281 nt, Artificial Sequence
  derived and/or modified sequence opt1 from PANX1__Homo_sapiens__NP_056183
auggccaucgcccagcuggcgaccgaguacguguucagcgacuuccuccugaaggagcccaccgagccgaaguucaagggccugcgccucgagcuggccgucgacaagauggugacgugcaucgccguggggcugccccuccugcugaucucccucgccuucgcccaggagaucagcaucggcacccagaucuccugcuucagccccuccagcuucuccuggcggcaggcggccuucgucgacagcuacugcugggccgccgugcagcagaagaacucccugcagagcgaguccgggaaccugccccucuggcugcacaaguucuucccguacauccugcuccuguucgcgauccugcucuaccugccgccccuguucuggcgcuucgccgccgcgccccacaucugcagcgaccucaaguucaucauggaggagcuggacaagguguacaaccgggccaucaaggccgccaaguccgcccgcgaccuggacaugcgggacggcgccugcagcguccccggggugaccgagaaccucggccagucccugugggaggugagcgagucccacuucaaguaccccaucgucgagcaguaccugaagaccaagaagaacagcaacaaccucaucaucaaguacaucuccugccgccugcugacgcucaucaucauccugcuggccugcaucuaccucggcuacuacuucagccugagcucccugagcgacgaguucgugugcuccaucaagagcgggauccuccggaacgacuccaccgugcccgaccaguuccagugcaagcugaucgcggucggcaucuuccagcugcucagcgugaucaaccugguggucuacgugcugcucgcccccguggucguguacacccuguucgugccguuccgccagaagaccgacguccugaagguguacgagauccuccccacguucgacgugcugcacuucaaguccgagggguacaacgaccugagccucuacaaccuguuccuggaggagaacaucuccgaggucaagagcuacaagugccugaaggugcucgagaacaucaaguccagcggccaggggaucgaccccaugcugcugcucaccaaccugggcaugaucaagauggacgucguggacggcaagacccccauguccgccgagaugcgggaggagcaggggaaccagaccgccgagcugcagggcaugaacaucgacagcgagacgaaggccaacaacggggagaagaacgcgcgccagcggcuccuggacuccagcugcuga

SEQ ID NO: 34225 - RNA, 2034 nt, Artificial Sequence
  derived and/or modified sequence opt1 from PANX2__Homo_sapiens__NP_443071
augcaccaccuccuggagcagagcgccgacauggccaccgcccugcuggccggcgagaagcuccgcgagcugauccugcccggggcccaggacgacaaggccggcgcccucgcggcccugcugcuccagcugaagcuggagcucccguucgaccggguggucaccaucgggacggugcuggugcccauccugcucgucacccugguguucaccaagaacuucgccgaggagcccaucuacugcuacacgccccacaacuucacccgcgaccaggcccuguacgcgcggggcuacugcuggaccgagcuccgcgacgcccugccggggguggacgccucccuguggcccagccucuucgagcacaaguuccugcccuacgcccugcucgccuucgcggccaucauguacguccccgcccugggcugggaguuccuggccuccacccggcucaccagcgagcugaacuuccugcuccaggagaucgacaacugcuaccaccgcgccgcggagggccgggccccgaagaucgagaagcagauccaguccaaggggcccggcaucacggagcgcgagaagcgggagaucaucgagaacgccgagaaggagaagucccccgagcagaaccuguucgagaaguaccuggagcgccgggggcgcagcaacuuccucgccaagcuguaccuggcccggcacgugcucauccugcugcucagcgcggugcccaucuccuaccugugcaccuacuacgccacccagaagcagaacgaguucacgugcgcccugggcgccagcccggacggggccgcgggcgccggccccgccguccgcguguccugcaagcuccccagcgugcagcugcagcggaucaucgccggggucgacaucgugcugcucugcgugaugaaccugaucauccuggucaaccucauccaccuguucaucuuccgcaaguccaacuucaucuucgacaagcugcacaaggugggcaucaagacccggcgccaguggcggcgcagccaguucugcgacaucaacauccuggcgauguucugcaacgagaaccgggaccacaucaagucccucaaccgccuggacuucaucaccaacgagagcgaccugauguacgacaacgugguccgccagcuccuggccgcccuggcccaguccaaccacgacgccacccccaccgugcgggacagcggggugcagacggucgacccguccgcgaaccccgccgagcccgacggcgccgccgagcccccgguggugaagcgcccccggaagaagaugaaguggauccccaccagcaacccccucccgcagcccuucaaggagccccuggccaucaugcgcgucgagaacagcaaggcggagaagcccaagccggcccggcgcaagaccgccaccgacacgcugaucgcgccccuccuggaccgguccgcccaccacuacaagggcgggggcggggaccccggcccggggcccgcccccgcccccgccccgccgcccgcccccgacaagaagcacgcgcgccacuucagccuggacgugcaccccuacauccucggcaccaagaaggccaaggccgaggccguccccgccgcgcugcccgccucccggagccaggagggcggguuccugucccaggccgaggacugcggccucgggcuggcccccgccccgaucaaggacgcgccccugcccgagaaggagauccccuacccgaccgagcccgcccgcgccggccuccccagcgggggccccuuccacgugcgguccccgcccgccgcccccgcgguggcgccccugaccccggccagccugggcaaggccgagccccucacgauccugucccgcaacgccacccacccccugcuccacaucaacacccuguacgaggcccgggaggaggaggacgggggcccgcgccugccccaggacgucggggaccucaucgccauccccgcgccccagcagauccugaucgccaccuucgacgagccgcggacgguggugagcaccgucgaguucuga

SEQ ID NO: 34226 - RNA, 1536 nt, Artificial Sequence
  derived and/or modified sequence opt1 from PAOX__Homo_sapiens__NP_690875
auggagagcaccggcuccgugggggaggcccccggcgggccgcgcguccugguggugggcgggggcaucgccggccucggggcggcccagcggcugugcggccacagcgccuucccccaccuccgcguccuggaggccaccgcccgggccgggggccgcauccgguccgagcgcugcuucgggggcgugguggaggucggcgcccacuggauccacgggcccagccggggcaaccccguguuccagcuggccgccgaguacgggcugcucggcgagaaggagcugucccaggagaaccagcugguggagacgggcgggcacgucggccucccgagcguguccuacgcgagcuccggggccagcgugucccugcagcuggucgccgagauggccacccucuucuacggccugaucgaccagacccgcgaguuccugcacgccgcggagacccccgugcccagcgugggggaguaccucaagaaggagaucggccagcacgucgccggcuggacggaggacgaggagacccggaagcugaagcuggccgugcucaacuccuucuucaaccuggagugcugcgugagcgggacccacuccauggaccuggucgcccucgcccccuucggcgaguacaccgugcugccggggcuggacugcacguucagcaagggcuaccaggggcucaccaacugcaugauggcggcccugcccgaggacaccguggucuucgagaagcccgugaagaccauccacuggaacggcuccuuccaggaggccgccuuccccggcgagacguucccggugagcgucgagugcgaggacggggaccgcuuccccgcccaccacgugaucgucaccgugccccugggcuuccuccgggagcaccuggacaccuucuucgacccgccccugcccgcggagaaggccgaggccauccgcaagaucggguucggcaccaacaacaagaucuuccucgaguucgaggagcccuucugggagcccgacugccagcugauccagcuggugugggaggacacguccccgcucgaggacgccgcccccgagcugcaggacgcgugguuccggaagcugaucggguucgucgugcuccccgccuucgccagcgugcacguccugugcggcuucaucgccggccuggagagcgaguucauggagacccucuccgacgaggaggugcugcugugccucacccaggugcugcgccgggucaccgggaacccccgccugccggcgcccaagagcgugcuccggucccgcuggcacagcgcccccuacacgcggggcuccuacagcuacguggccgucggguccaccggcggcgaccuggaccugcucgcccagccccugccggccgacggggcgggcgcccagcugcagauccuguucgccggggaggccacccaccgcaccuucuacagcacgacccacggcgcccuccuguccggguggcgggaggcggaccgccugcucagccugugggcgccccaggugcagcagccccgcccgcggcuguga

SEQ ID NO: 34227 - RNA, 2379 nt, Artificial Sequence
  derived and/or modified sequence opt1 from PAPD7__Homo_sapiens__XP_005248291
auggacccccgcguggccuggauccagccggagcagaagggccccgccaacgcgcuguggaugcagaucugggagaccagccagggggucggccgcgggggcuccggguucgccagcuacuucugccucaacucccccgcccuggacaccgccgccgcggccggcgccgccggccgggggagcggcgggcugggccccgcgcucccggccgccuccccgcccccgcccgggcccacggcccccgccgcgcugcccccggcccugcucaccgcccugggccccgccgccgagggcgcgcggcgccugcacaagagccccucccucagcuccagcuccagcuccagcuccagcaacgccgaguccgggaccgagagccccggcugcuccagcagcuccagcuccagcgccucccuggggcggccgggcggcgggcgcggcggggccuucuucaacuucgccgacggcgcgcccagcgcccccgggaccgccaacggccaccccggcccgcgggggcccgcccccgccggcucccccagccagcaccaguuccacccggggcgccggaagcgcgagaacaaggcguccacguacggccugaacuaccuccugagcgggucccgggccgccgcccugagcggcggcgggggccccggggcgcaggcgccccgccccggcaccccguggaagucccgggccuacagccccgggauccagggccuccacgaggagaucaucgacuucuacaacuucaugucccccugcccggaggaggccgccaugcgccgggagguggugaagcgcaucgagaccgucgugaaggaccuguggcccaccgccgacgugcagaucuucggcagcuucuccacggggcuguaccuccccaccagcgacaucgaccuggucguguucggcaagugggagcggcccccgcugcagcuccuggagcaggcccugcgcaagcacaacguggccgagcccugcuccaucaagguccucgacaaggccaccgugcccaucaucaagcugaccgaccaggagacggaggugaaggucgacaucagcuucaacauggagaccggggugcgggccgcggaguucaucaagaacuacaugaagaaguacagccugcuccccuaccugauccuggugcucaagcaguuccugcugcagcgcgaccucaacgaggucuucaccggcggcaucuccagcuacucccugauccugauggccaucagcuuccuccagcugcacccgcggaucgacgcccgccgcgccgacgagaaccuggggaugcuccugguggaguucuucgagcuguacggccggaacuucaacuaccucaagaccgggauccgcaucaaggagggcggggccuacaucgcgaaggaggagaucaugaaggccaugacguccggcuaccggcccagcaugcugugcaucgaggacccccugcuccccggcaacgacguggggcgcuccagcuacggcgccaugcaggucaagcaggucuucgacuacgccuacaucgugcugucccacgcggugagcccgcuggcccgguccuaccccaaccgcgacgccgagagcacccucgggcggaucaucaaggugacccaggaggugaucgacuaccgccgguggaucaaggagaaguggggcuccaaggcccaccccagccccgggauggacucccgcaucaagaucaaggagcggaucgcgaccugcaacggcgagcagacgcagaaccgcgagccggagagccccuacggccagcggcugacccugucccugagcagcccccagcuccuguccagcggguccagcgccuccagcgucuccagccuguccggcagcgacguggacuccgacaccccgcccugcaccacgcccagcgucuaccaguucucccuccaggcccccgcgccccugauggccgggcugcccaccgcccuccccaugcccagcggcaagccgcagcccaccaccucccgcacgcugaucaugaccaccaacaaccagacccgguucacgaucccgccgcccacccuggggguggcccccgugcccugccgccaggccggcgucgagggcaccgccagccucaaggccgugcaccacauguccagccccgccauccccuccgcgagccccaacccccugagcagcccccaccuguaccacaagcagcacaacgggaugaagcucuccaugaagggcucccacgggcacacccagggcgggggcuacagcuccgugggcagcgggggcguccggccgcccguggggaaccgcggccaccaccaguacaaccggacgggcuggcgccgcaagaagcacacccacacccgggacucccugcccgugagccugucccgcuga

SEQ ID NO: 34228 - RNA, 1317 nt, Artificial Sequence
  derived and/or modified sequence opt1 from PAPL__Homo_sapiens__NP_001004318
augcacccccugccgggcuacuggagcugcuacugccuccugcuccuguucucccugggggugcagggcagccugggggcccccuccgccgcgcccgagcagguccaccucagcuaccccggcgagccgggguccaugaccgugaccuggacgaccugggugcccacccgcagcgagguccaguucggccugcagcccuccggcccccugccgcuccgggcccaggggaccuucgugcccuucguggacggcgggauccugcgccggaagcuguacauccaccgcgucacgcuccggaagcugcugcccggcgugcaguacguguaccgcugcgggagcgcccagggcuggucccggcgcuuccgguuccgcgcccucaagaacggcgcccacuggagcccccggcuggcggucuucggggaccugggcgccgacaacccgaaggccgugccccgccuccggcgcgacacccagcaggggauguacgacgccgugcugcacgucggcgacuucgcguacaaccuggaccaggacaacgcccgggugggcgaccgcuucaugcggcucaucgagcccguggccgccucccugcccuacaugaccugcccggggaaccacgaggagcgcuacaacuucagcaacuacaaggcccgguucuccaugcccggcgacaacgaggggcugugguacagcugggaccucggccccgcgcacaucaucuccuucagcaccgaggucuacuucuuccugcacuacgggcgccaccuggugcagcggcaguuccgcuggcucgaguccgaccugcagaaggccaacaagaaccgcgccgcccggcccuggaucaucacgaugggccaccgcccgauguacugcagcaacgccgaccuggacgacugcacccggcacgaguccaaggugcgcaagggccuccaggggaagcuguacggccuggaggaccucuucuacaaguacggggucgaccugcagcugugggcgcacgagcacagcuacgagcggcucuggcccaucuacaacuaccagguguucaacggcagccgcgagaugcccuacaccaacccccgggggccggugcacaucaucaccggcuccgccggcugcgaggagcgccugacgcccuucgccgucuucccccggcccuggagcgccgugcgcgugaaggaguacggguacacccggcugcacauccucaacggcacccacauccacauccagcaggucuccgacgaccaggacgggaagaucguggacgacgucuggguggugcgcccgcuguucggccggcgcauguaccuguga

SEQ ID NO: 34229 - RNA, 858 nt, Artificial Sequence
  derived and/or modified sequence opt1 from PAPOLA__Homo_sapiens__NP_001238935
augcccuucccggugaccacccagggcagccagcagacgcagccgccccagaagcacuacgggaucaccucccccaucagccuggccgcccccaaggagaccgacugcguccucacccagaagcugaucgagacgcugaagcccuucggcguguucgaggaggaggaggagcuccagcgccggauccugauccuggggaagcucaacaaccuggugaaggaguggauccgcgagaucuccgagagcaagaaccugccccaguccgucaucgagaacgugggcgggaagaucuucaccuucggcagcuaccggcucggcgugcacaccaagggggcggacaucgacgcccugugcgucgcgccccgccacguggaccgguccgacuucuucaccagcuucuacgacaagcugaagcuccaggaggaggugaaggaccugcgcgccgucgaggaggccuucgugccggugaucaagcugugcuucgacggcaucgagaucgacauccucuucgcccggcuggcccugcagacgauccccgaggaccucgaccugcgcgacgacucccugcucaagaaccuggacauccggugcauccgcagccugaacgggugccgggucaccgacgagauccuccaccuggugcccaacaucgacaacuuccgccugacccuccgggccaucaagcugugggccaagcgccacaacaucuacuccaacauccugggcuuccucgggggcgugagcugggcgaugcuggucgcccggaccugccagcuguaccccaacgccaucgccuccacgcucgugcacaaguucuuccugguguucagcaagugguacgucuuccgccuguacuga

SEQ ID NO: 34230 - RNA, 2211 nt, Artificial Sequence
  derived and/or modified sequence opt1 from PAPOLG__Homo_sapiens__NP_075045
augaaggagaugagcgccaacaccgugcuggacucccagcgccagcagaagcacuacggcaucaccagccccaucucccucgccagcccgaaggagaucgaccacaucuacacgcagaagcugaucgacgcgaugaagcccuucggggucuucgaggacgaggaggagcugaaccaccggcucguggugcugggcaagcugaacaaccucgucaaggaguggaucuccgacgugagcgaguccaagaaccugccgcccagcguggucgccaccgucgggggcaagaucuucaccuucggguccuaccgccugggcgugcacaccaagggcgccgacaucgacgcccucugcgucgccccgcggcacguggagcgcagcgacuucuuccaguccuucuucgagaagcugaagcaccaggacgggauccggaaccugcgcgcgguggaggacgccuucguccccgugaucaaguucgaguucgacggcaucgagaucgaccucguguucgcccggcuggccauccagacgaucagcgacaaccuggaccuccgcgacgacucccggcugcgcagccuggacauccggugcauccgcucccucaacgggugccgggucaccgacgagauccugcaccuggugcccaacaaggagaccuuccgccucacccugcgggcggugaagcugugggccaagcgccggggcaucuacagcaacaugcucggguuccugggcggcgucuccugggccaugcugguggcccgcacgugccagcucuaccccaacgccgcggccagcacccuggugcacaaguucuuccuggucuucuccaagugggaguggccgaaccccgugcuccugaagcagcccgaggagagcaaccugaaccuccccgugugggacccgcgggucaaccccagcgaccgcuaccaccugaugcccaucaucacccccgccuacccgcagcagaacuccaccuacaacgugagcacguccacccggaccgucaugguggaggaguucaagcaggggcuggccgugaccgacgagauccuccagggcaagagcgacugguccaagcugcuggagccgcccaacuucuuccagaaguaccgccacuacaucguccucacggccagcgcguccaccgaggagaaccaccuggaguggguggggcugguggagagcaagauccgcguccucgugggcaaccuggagcggaacgaguucaucacccuggcccacgugaacccccaguccuuccccggcaacaaggagcaccacaaggacaacaacuacgucagcaugugguuccucgggaucaucuuccgccggguggagaacgccgaguccgugaacaucgaccugaccuacgacauccagagcuucacggacaccgucuaccgccaggccaacaacaucaacaugcugaaggagggcaugaagaucgaggccacccacgugaagaagaagcagcuccaccacuaccugcccgcggagauccugcagaagaagaagaagcagucccugagcgacgugaaccgguccagcgggggccuccaguccaagcgccugagccuggacuccagcugccucgacagcucccgggacaccgacaacgggacgcccuucaacagccccgccuccaagagcgacuccccgagcgucggcgagaccgagcgcaacuccgccgagcccgccgccgugaucguggagaagccccugagcgugcccccggcgcagggccuguccauccccgugaucggggccaagguggacagcaccgucaagaccguguccccgcccacggugugcaccauccccaccgucgugggccggaacgugaucccccgcaucaccacgccccacaaccccgcccaggggcagccccaccucaacggcaugagcaacaucaccaagaccgucacccccaagcggucccacagccccuccaucgacgggacgccgaagcgccugaaggacguggagaaguucauccggcuggagagcaccuucaaggacccccgcaccgccgaggagcggaagcgcaaguccguggacgcgaucggcggcgagagcaugcccauccccaccaucgacaccagccggaagaagcgccucccguccaaggagcugcccgacagcuccagccccguccccgccaacaacauccgggugaucaagaacuccauccgccugacgcucaaccgcuga

SEQ ID NO: 34231 - RNA, 2484 nt, Artificial Sequence
  derived and/or modified sequence opt1 from PAPPA2__Homo_sapiens__NP_068755
augaugugccugaagauccuccgcaucagccuggccauccuggccggcugggcgcucugcuccgccaacagcgagcugggguggacccggaagaagucccugguggagcgcgagcaccucaaccagguccugcuggagggcgagcggugcuggcucggggccaaggugcgccggccccgcgccagcccgcagcaccaccuguucggcguguaccccucccgggccgggaacuaccugcgccccuaccccgucggcgagcaggagauccaccacaccggccggagcaagccggacacggaggggaacgcggugucccucgugccgcccgaccugaccgagaaccccgccggccugcgcggggccgucgaggagccggccgcgcccugggugggcgacagccccaucgggcaguccgagcuccugggcgacgacgacgccuaccugggcaaccagcggagcaaggagucccucggggaggccggcauccagaaggggagcgccauggccgcgaccaccacgaccgccaucuucaccacccugaacgagcccaagccggagacgcagcgccggggcugggccaagucccgccagcggcgccagguguggaagcggcgcgccgaggacggccagggggacagcggcaucuccagccacuuccagcccuggcccaagcacucccugaagcaccgggucaagaaguccccgcccgaggagagcaaccagaacgggggcgaggggagcuaccgcgaggccgagaccuucaacagccaggugggccuccccauccuguacuucuccggccggcgcgagcgccugcuccugcggcccgaggugcuggcggagaucccccgcgaggccuucaccgucgaggccugggugaagccggagggcgggcagaacaaccccgccaucaucgccgggguguucgacaacugcagccacaccgucuccgacaagggcugggcgcucgggauccggagcggcaaggacaagggcaagcgcgacgcccgguucuucuucucccugugcacggaccgcgugaagaaggccaccauccugaucagccacucccgguaccagcccgggaccuggacccacguggccgccacguacgacggccgccacauggcgcucuacgucgacgggacccagguggccagcucccuggaccagagcggcccccugaacuccccguucauggccagcugccggucccuccugcucgggggcgacagcuccgaggacggccacuacuuccgcgggcaccugggcacccugguguucuggagcaccgcccugccccagucccacuuccagcacagcucccagcacagcagcggggaggaggaggcgacggaccucguccugaccgccuccuucgagcccgugaacaccgagugggugcccuuccgggacgagaaguacccgcgccuggagguccuccagggcuucgagcccgagcccgagauccugagcccgcugcagccgccccucugcggccagaccgugugcgacaacgucgagcugaucucccaguacaacggguacuggccccugcggggcgagaaggugauccgcuaccagguggucaacaucugcgacgacgaggggcucaaccccaucgugagcgaggagcagauccggcugcagcacgaggcccugaacgaggccuucucccgcuacaacaucagcuggcagcuguccgugcaccagguccacaacagcacgcuccggcaccgcguggugcuggucaacugcgagcccuccaagaucggcaacgaccacugcgaccccgagugcgagcacccccugaccggguacgacggcggcgacugccggcuccaggggcgcugcuacagcuggaaccgccgggacggccugugccacguggagugcaacaacaugcugaacgacuucgacgacggggacugcugcgacccccagguggccgacguccgcaagaccugcuucgaccccgacucccccaagcgggcguacaugagcgugaaggagcucaaggaggcccugcagcugaacuccacccacuuccucaacaucuacuucgccagcuccgugcgcgaggaccuggccggcgccgcgacguggcccugggacaaggacgccgucacccaccucgggggcaucgugcugagcccggccuacuacggcaugcccgggcacaccgacaccaugauccacgaggugggccacguccuggggcuguaccacguguucaagggcguguccgagcgggagagcugcaacgaccccugcaaggagacgguccccagcauggagaccggggaccucugcgccgacaccgccccgacccccaaguccgagcugugccgcgagcccgagcccacgagcgacacgugcggcuucacccgguucccgggcgcgcccuucaccaacuacauguccuacaccgggaucaccaccgugcuguucugcuuccuccugcgcauccacggcgggcuguga

SEQ ID NO: 34232 - RNA, 4884 nt, Artificial Sequence
  derived and/or modified sequence opt1 from PAPPA__Homo_sapiens__NP_002572
augcgccuguggagcugggugcuccaccugggccugcucuccgccgcccuggggugcggccuggcggagcggccccgccgggcccgccgggacccgcgcgccgggcggccgccccgccccgccgccggccccgcgaccugcgccacccgggccgcccgcgggcggcgcgcgagcccgccgccgcccccgccgcccggcggcgccugggaggccguccgggugccccgccggcgccagcagcgggaggcccgcggggccacggaggagcccuccccgcccagccgggcgcucuacuucuccggccgcggggagcagcugcggcugcgcgccgaccucgagcugccccgcgacgccuucacccuccagguguggcuccgggccgagggcgggcagcgcagccccgccgucaucaccggccuguacgacaagugcuccuacaucagccgggaccgcggcugggugguggggauccacaccaucuccgaccaggacaacaaggacccccgguacuucuucagccugaagacggaccgcgcgcggcaggucaccaccaucaacgcccaccgcuccuaccuccccggccaguggguguaccuggccgccaccuacgacgggcaguucaugaagcuguacgugaacggcgcccaggucgcgacgagcggcgagcaggucgggggcaucuucagcccccucacccagaagugcaaggugcugaugcucgggggcuccgcccugaaccacaacuaccggggguacaucgagcacuucucccuguggaaggucgcccgcacccagcgggagauccugagcgacauggagacccacggcgcccacacggcccucccccagcugcugcuccaggagaacugggacaacgugaagcacgcguggucccccaugaaggacggcagcucccccaagguggaguucagcaacgcccacggguuccugcuggacaccagccucgagccgccccugugcggccagacccugugcgacaacaccgaggucaucgccuccuacaaccagcucagcuccuuccgccagcccaagguggugcgguaccgcgucgugaaccuguacgaggacgaccacaagaaccccacggugacccgggagcaggucgacuuccagcaccaccagcuggccgaggcguucaagcaguacaacaucagcugggagcucgacgugcuggagguguccaacagcucccugcgccggcgccucauccuggccaacugcgacaucagcaagaucggggacgagaacugcgaccccgagugcaaccacacccugaccggccacgacgggggcgacugccggcaccuccgccaccccgccuucgucaagaagcagcacaacggcgugugcgacauggacugcaacuacgagcgcuucaacuucgacgggggcgagugcugcgaccccgagaucacgaacgucacccagaccugcuucgaccccgacagcccccaccgggccuaccuggacgugaacgagcugaagaacauccucaagcuggacggguccacccaccugaacaucuucuucgccaaguccagcgaggaggagcucgcgggcguggccacguggcccugggacaaggaggcccugaugcaccucgggggcaucgugcugaaccccuccuucuacggcaugccggggcacacccacaccaugauccacgagaucggccacagccuggggcuguaccacguguuccgcggcaucuccgagauccagagcugcuccgaccccugcauggagaccgagcccagcuucgagacgggcgaccugugcaacgacaccaaccccgccccgaagcacaaguccugcggggaccccggccccgggaacgacacgugcggcuuccacagcuucuucaacacccccuacaacaacuucaugagcuacgccgacgacgacugcaccgacuccuucaccccgaaccagguggcgcggaugcacugcuaccuggaccuggucuaccagggguggcagcccagccgcaagcccgcccccguggcccuggcgccccaggugcucggccacaccaccgacuccgucacgcuggagugguucccgcccaucgacggccacuucuucgagcgggagcuggggagcgccugccaccucugccuggagggccgcauccuggugcaguacgccuccaacgccagcucccccaugccgugcagccccuccgggcacuggagcccccgggaggccgagggccaccccgacguggagcagccgugcaaguccagcguccgcaccuggucccccaacagcgccgugaacccccacaccgugccgcccgcgugccccgagccccaggggugcuaccucgagcuggaguuccuguacccgcucguccccgagucccugaccaucugggugaccuucgugagcacggacugggacuccagcggcgccgucaacgacaucaagcugcucgccgugagcggcaagaacaucucccuggggccccagaacguguucugcgacgucccccugaccauccggcucugggacgugggcgaggagguguacgggauccagaucuacacccuggacgagcaccuggagaucgacgccgccaugcucaccagcacggcggacaccccgcugugccugcagugcaagccccucaaguacaaggucgugcgcgacccgccccugcagauggacguggccuccauccugcaccucaaccggaaguucgucgacauggaccugaaccugggcagcguguaccaguacugggugaucaccaucuccgggaccgaggagagcgagcccucccccgccgucacguacauccacggcagcggcuacugcggggacggcaucauccagaaggaccagggggagcagugcgacgacaugaacaagaucaacggcgacgggugcucccucuucugccgccaggaggugagcuucaacugcaucgacgagcccucccggugcuacuuccacgacggcgacggcgugugcgaggaguucgagcagaagaccagcaucaaggacugcggggucuacacgccccagggcuuccuggaccagugggccuccaacgccagcgugucccaccaggaccagcagugcccggggugggugaucaucggccagcccgcggccagccaggucugccgcaccaaggugaucgaccuguccgagggcaucagccagcacgccugguaccccugcaccaucuccuaccccuacagccagcucgcccagaccaccuucuggcugcgggccuacuucagccagccgaugguggcggccgccgucaucgugcaccuggugaccgacgggacguacuacggcgaccagaagcaggagaccaucuccguccagcuccuggacaccaaggaccagagccacgaccuggggcuccacgugcuguccugccgcaacaacccccugaucauccccgugguccacgaccucagccagcccuucuaccacucccaggccgugcgggugagcuucuccagcccgcuggucgcgaucuccggcguggcccugcgcagcuucgacaacuucgaccccgugacccucuccagcugccagcgcggggagacguacucccccgccgagcagagcugcguccacuucgccugcgagaagaccgacugccccgagcuggccguggagaacgcgucccugaacugcagcuccagcgaccgguaccacggcgcccagugcaccgucuccugccggaccggcuacgugcuccagauccgccgcgacgacgagcugaucaagagccagacggggccgagcgugaccgucacgugcaccgagggcaaguggaacaagcaggucgccugcgagcccguggacugcuccauccccgaccaccaccagguguacgccgccagcuucuccugcccggaggggaccaccuucggcagccagugcuccuuccagugccggcaccccgcgcagcugaaggggaacaacagccuccugaccugcauggaggacggccugugguccuuccccgaggcccucugcgagcugaugugccuggcgcccccgcccgugcccaacgccgaccuccagaccgcccgcugccgggagaacaagcacaaggugggcagcuucugcaaguacaagugcaagcccggguaccacgucccgggcuccagccgcaaguccaagaagcgggccuucaagacgcagugcacccaggacgggagcuggcaggagggcgccugcgugcccgugaccugcgacccgcccccgcccaaguuccacgggcuguaccagugcaccaacggcuuccaguucaacuccgagugccgcaucaagugcgaggacagcgacgccucccagggccuggggagcaacgucauccacugccggaaggacggcacguggaacggguccuuccacgugugccaggagaugcagggccagugcagcgugcccaacgagcucaacuccaaccugaagcugcagugccccgacggcuacgccaucgggagcgagugcgccaccagcugccucgaccacaacuccgagagcaucauccugcccaugaacgucaccgugcgcgacaucccccacuggcugaaccccacccggguggagcgcgucgugugcaccgcgggccucaagugguacccccacccggcccugauccacugcgugaaggggugcgagcccuucaugggcgacaacuacugcgacgccaucaacaaccgggccuucugcaacuacgacgggggcgacugcugcacguccaccgucaagaccaagaaggugacccccuuccccaugagcugcgaccugcagggcgacugcgcgugccgcgacccgcaggcccaggagcacucccggaaggaccuccgcggguacagccacggcuga

SEQ ID NO: 34233 - RNA, 1875 nt, Artificial Sequence
  derived and/or modified sequence opt1 from PAPSS1__Homo_sapiens__NP_005434
auggagauccccggcagccugugcaagaaggugaagcucuccaacaacgcccagaacugggggaugcagcgcgccaccaacgucaccuaccaggcgcaccacgugagccggaacaagcgcggccagguggucgggacgcggggcggguuccgcggcugcaccguguggcugaccggccuguccggggccggcaagaccacggugagcauggcccucgaggaguaccuggucugccacgggaucccgugcuacacccuggacggcgacaacauccggcaggggcucaacaagaaccugggcuucucccccgaggaccgcgaggagaacgugcggcgcaucgccgagguggccaagcuguucgcggacgccggccucgucugcaucaccagcuucaucucccccuacacccaggaccggaacaacgcccgccagauccacgagggggccagccugcccuucuucgagguguucguggacgcgccgcugcacgucugcgagcagcgggacgugaagggccucuacaagaaggcccgcgccggggagaucaagggcuucacgggcaucgacuccgaguacgagaagcccgaggcccccgagcuggugcugaagaccgacagcugcgacgucaacgacugcgugcagcaggucguggagcuccugcaggagcgggacaucgugcccguggacgccuccuacgaggucaaggagcuguacgugccggagaacaagcuccaccuggcgaagaccgacgccgagacccugcccgcccucaagaucaacaagguggacaugcaguggguccaggugcuggccgaggggugggccacgccccugaacggcuucaugcgcgagcgggaguaccuccagugccugcacuucgacugccugcucgacgggggcgucaucaaccugagcgugcccaucgugcugaccgcgacccacgaggacaaggagcgccucgacgggugcaccgccuucgcccugauguacgagggccggcgcgucgccauccugcggaacccggaguucuucgagcaccgcaaggaggagcggugcgcccgccaguggggcacgaccugcaagaaccaccccuacaucaagauggugauggagcagggggacuggcucaucggcggggaccuccaggugcuggaccgcgucuacuggaacgacggccuggaccaguaccggcugacccccaccgagcugaagcagaaguucaaggacaugaacgcggacgccguguucgccuuccagcuccgcaaccccgugcacaacgggcacgcccugcugaugcaggacacgcacaagcagcuccuggagcggggcuaccgccggccgguccugcuccugcacccccugggcggguggaccaaggacgacgacgugccccucauguggcgcaugaagcagcacgccgcggugcuggaggagggcguccugaaccccgagaccaccgugguggccaucuucccgucccccaugauguacgccgggcccacggagguccaguggcacugccgggcccgcaugguggcgggcgccaacuucuacaucguggggcgggaccccgccggcaugccgcaccccgagaccggcaaggaccuguacgagcccagccacggggccaagguccucaccauggcccccggccugaucacccuggagaucgugccguuccgcguggcggccuacaacaagaagaagaagcggauggacuacuacgacuccgagcaccacgaggacuucgaguucaucagcgggacgcgcaugcggaagcucgcccgcgagggccagaagccgcccgagggcuucauggcccccaaggccuggaccguccugaccgaguacuacaagucccuggagaaggcguga

SEQ ID NO: 34234 - RNA, 1860 nt, Artificial Sequence
  derived and/or modified sequence opt1 from PAPSS2__Homo_sapiens__NP_001015880
augagcggcaucaagaagcagaagaccgagaaccagcagaaguccaccaacguggucuaccaggcccaccacgugagccgcaacaagcggggccagguggucgggacgcgcgggggcuuccgggggugcaccguguggcugaccggccucuccggcgccgggaagaccacgaucagcuucgcgcuggaggaguaccuggugucccacgccauccccugcuacagccucgacggcgacaacguccgccacgggcugaaccggaaccugggcuucuccccgggggaccgcgaggagaacauccggcgcaucgccgagguggccaagcuguucgccgacgcgggccuggugugcaucaccagcuucaucucccccuucgccaaggaccgggagaacgcccgcaagauccacgagagcgccggccugcccuucuucgagaucuucgucgacgcgccccucaacaucugcgagucccgggacgugaaggggcuguacaagcgcgcccgggccggcgagaucaagggguucaccggcaucgacagcgacuacgagaagccggagacccccgagcgcgugcugaagacgaaccucuccaccgucagcgacugcgugcaccagguggucgagcugcugcaggagcagaacaucgugcccuacaccaucaucaaggacauccacgagcuguucgugcccgagaacaagcucgaccacguccgggccgaggccgagacccugccgucccucagcaucacgaagcuggaccugcaguggguccaggugcucuccgagggcugggcgaccccgcugaagggguucaugcgcgagaaggaguaccuccaggugaugcacuucgacacccugcuggacggcauggcccugcccgacggggugaucaacaugagcauccccaucgugcuccccgucuccgccgaggacaagacccggcuggagggcugcagcaaguucgugcuggcccacgggggccgccgggucgccauccuccgcgacgcggaguucuacgagcaccggaaggaggagcgcugcagccgcguguggggcacgaccugcaccaagcacccccacaucaagauggugauggaguccggggacuggcuggucggcggggaccuccaggugcucgagaagauccgguggaacgacggccuggaccaguaccgccugacgccccucgagcugaagcagaagugcaaggagaugaacgccgacgccguguucgccuuccagcugcggaaccccguccacaacgggcacgcccuccugaugcaggacacccgccggcgccugcucgagcggggcuacaagcacccggugcugcugcuccacccccugggcggguggaccaaggacgacgacgugccccuggacuggcgcaugaagcagcacgcggccguccucgaggagggcgugcuggaccccaagagcaccaucguggccaucuucccgucccccaugcuguacgccgggcccaccgagguccaguggcacugccggagccgcaugaucgccggcgcgaacuucuacaucguggggcgggaccccgccggcaugccgcaccccgagacgaagaaggaccuguacgagcccacccacggcgggaaggugcucuccauggcccccggccugaccagcgucgagaucaucccguuccgcguggccgcguacaacaaggccaagaaggccauggacuucuacgaccccgcccggcacaacgaguucgacuucaucuccgggacccgcaugcggaagcuggcccgcgagggcgagaacccgcccgacggcuucauggcgcccaaggccuggaaggugcucacggacuacuaccggagccuggagaagaacuga

SEQ ID NO: 34235 - RNA, 936 nt, Artificial Sequence
  derived and/or modified sequence opt1 from PAQR3__Homo_sapiens__NP_001035292
augcaccagaagcugcucaagagcgcccacuacaucgagcugggcuccuaccaguacuggcccgugcuggucccgcgcgggauccggcucuacaccuacgagcagauccccggcagccugaaggacaaccccuacaucaccgacggguaccgcgccuaccugcccucccggcucugcaucaagagccuguucauccuguccaacgagacggugaacaucuggagccaccuccugggcuucuuccuguucuucacccucgggaucuacgacaugaccuccgugcugccgagcgcguccgccagccgcgaggacuucgucaucugcuccaucugccuguucugcuuccaggugugcaugcucugcagcgugggcuaccaccuguucuccugccaccggagcgagaagaccugccgccgguggauggcccuggacuacgccggcaucuccaucgggauccucggcugcuacgucagcgggguguucuacgccuucuacugcaacaacuacuggcgccagguguaccugaucacgguccuggcgaugauccucgccguguucuucgcccagauccaccccaacuaccugacccagcaguggcagcggcugcgcuccaucaucuucugcagcguguccggcuacggggucauccccacccuccacuggguguggcugaacggcggcaucggggcccccaucgugcaggacuucgcgccgcgggucaucgugauguacaugaucgcccugcucgccuuccuguucuacaucagcaaggugcccgagcgcuacuuccccggccagcugaacuaccucgggagcucccaccagaucuggcacauccuggccgucgugaugcuguacugguggcaccagagcaccguguacgucaugcaguaccggcacuccaagcccugcccggacuacgugagccaccucuga

SEQ ID NO: 34236 - RNA, 993 nt, Artificial Sequence
  derived and/or modified sequence opt1 from PAQR5__Homo_sapiens__NP_060175
augcugagccucaagcugccccgccuguucuccaucgaccagaucccccagguguuccacgagcagggcauccucuucggguaccggcacccgcagagcuccgccaccgccugcauccugagccuguuccagaugaccaacgagacgcucaacaucuggacccaccuccugcccuucugguucuucgcguggcgcuucgucaccgcccucuacaugaccgacaucaagaacgacuccuacagcuggcccaugcugguguacaugugcacguccugcguguacccgcuggucagcuccugcgcccacaccuucagcuccaugagcaagaacgcccggcacaucugcuacuuccucgacuacggcgccgugaaccuguucucccuggggagcgcgaucgccuacuccgccuacaccuuccccgacgcccucaugugcaccacguuccacgacuacuacguggcgcuggccguccugaacaccauccucagcaccggccuguccugcuacagccgcuuccuggagauccagaagccccggcucugcaaggugauccgcgugcuggccuucgccuaccccuacaccugggacucccugccgaucuucuaccggcuguuccuguuccccggggagagcgcccagaacgaggcgacgagcuaccaccagaagcacaugaucaugacccugcucgccuccuuccuguacagcgcccaccuccccgagcgccuggcccccggccgguucgacuacaucggccacucccaccagcuguuccacgucugcgugauccuggccacccacaugcagauggaggcgauccuccuggacaagacccugcgcaaggaguggcuccuggccacgagcaagccguucuccuucagccagaucgccggggccauccugcucugcaucaucuucucccugagcaacaucaucuacuucuccgccgcgcuguaccggauccccaagcccgagcuccacaagaaggagaccuga

SEQ ID NO: 34237 - RNA, 1041 nt, Artificial Sequence
  derived and/or modified sequence opt1 from PAQR7__Homo_sapiens__XP_011539164
auggccauggcccagaagcugagccaccuccugcccucccugcgccaggugauccaggagccgcagcucagccugcagcccgagcccgucuucaccguggaccgggcggaggugcccccgcuguucuggaagcccuacaucuacgccggcuaccgcccccuccaccagaccuggcgguucuacuuccgcacgcuguuccagcagcacaacgaggccgucaacguguggacccaccuccucgccgcccuggugcugcuccugcggcuggcccucuucgucgagaccguggacuucuggggcgacccccacgcgcugccgcuguucaucaucgugcucgccuccuucaccuaccugagcuucuccgcccuggcgcaccuccugcaggccaagagcgaguucuggcacuacuccuucuucuuccuggacuacgucgggguggccguguaccaguucgggagcgcccucgcccacuucuacuacgcgaucgagcccgccuggcacgcccagguccaggccguguuccugcccauggccgcguuccuggccuggcucuccugcaucggcagcugcuacaacaaguacauccagaagcccgggcugcugggccgcacgugccaggaggugccguccguccucgccuacgcccuggacaucagccccguggugcaccggaucuucgucuccagcgaccccaccaccgacgaccccgcccugcucuaccacaagugccaggugguguucuuccugcuggcggccgccuucuucuccaccuucaugccggagcgcugguuccccggcagcugccacgucuucgggcagggccaccagcuguuccacaucuuccuggugcugugcacgcucgcccagcuggaggccguggcgcuggacuacgaggcccggcgccccaucuacgagccccuccacacccacuggccgcacaacuucuccgggcuguuccugcucaccgucggcagcuccauccugaccgccuuccugcucagccagcuggugcagcggaagcuggaccagaagacgaaguga

SEQ ID NO: 34238 - RNA, 3618 nt, Artificial Sequence
  derived and/or modified sequence opt1 from PARD3B__Homo_sapiens__NP_001289698
augaaggugaccgucugcuucggccgcaccgggaucguggugcccugcaaggagggccagcugcgggucggggagcucacgcagcaggcccugcagcgcuaccugaagacccgggagaagggcccgggguacugggugaagauccaccaccucgaguacaccgacggcggcauccuggaccccgacgacgugcuggccgacgucguggaggacaaggacaagcucaucgcgguguucgaggagcaggagccccugcacaagaucgagagccccuccgggaacccggccgaccgccagagccccgacgccuucgagaccgaggucgccgcccagcuggcggccuucaagcccaucggcggggagaucgaggugacgcccuccgcccucaagcugggcaccccgcugcucgugcggcgcagcuccgaccccguccccgggcccccggccgacacccagcccagcgcgucccaccccggcggccagagccugaagcugguggugcccgacuccacccagaaccucgaggaccgggagguccugaacggggugcagacggagcugcucaccagcccgcgcaccaaggacacccuguccgacaugacgcggaccguggagaucagcggcgaggggggcccccugggcauccacgucgugcccuucuucuccagccucuccgggcgcauccugggccuguucauccgggggaucgaggacaacagccgcuccaagcgggagggccucuuccacgagaacgagugcaucgugaagaucaacaacgucgaccugguggacaagaccuucgcccaggcccaggacguguuccgccaggccaugaagagccccuccguccugcuccacgugcugccgccccagaaccgggagcaguacgagaagagcgucaucgggagccugaacaucuucggcaacaacgacggcgugcucaagaccaaggugccccccccgguccacgggaaguccggccugaagacggccaaccugaccgggaccgacagccccgagaccgacgcguccgccagccuccagcagaacaaguccccccgcgugccccggcugggcgggaagccgagcucccccagccuguccccccucaugggcuucggcagcaacaagaacgccaagaagaucaagaucgaccugaagaaggggccggagggccugggguucacgguggucacccgcgacuccagcauccacggccccgggcccaucuucgugaagaacauccuccccaagggcgccgccaucaaggacggccggcugcaguccggggaccgcauccuggaggugaacggccgggacgucaccgggcgcacccaggaggagcucguggcgaugcugcgcagcacgaagcagggcgagaccgccucccuggugaucgcccggcaggagggccacuuccucccgcgcgagcugaagggggagcccgacugcugcgcccugagccucgagaccuccgagcagcugaccuucgagaucccccugaacgacagcggcuccgccgggcugggcgucagccucaaggggaacaagagccgggagacgggcaccgaccugggcaucuucaucaaguccaucauccacgggggcgcggccuucaaggacgggcgccugcggaugaacgaccagcucaucgccgugaacggcgagagccugcuggggaaguccaaccacgaggccauggagacccuccgccggagcauguccauggagggcaacauccgcggcaugauccagcuggugauccugcggcgccccgagcggccgauggaggaccccgccgagugcggggcguucagcaagcccugcuucgagaacugccagaacgccgucaccacgucccgccggaacgacaacagcauccuccacccccugggcaccugcuccccgcaggacaagcagaaggggcugcuccugcccaacgacggcugggccgagagcgaggugccccccuccccgaccccccacagcgcccuggggcucggccuggaggacuacucccacagcuccggcguggacagcgcggucuacuuccccgaccagcacaucaacuuccgcuccgugacccccgcccggcagccggagagcaucaaccugaaggccagcaaguccauggaccucgugcccgacgagagcaagguccacucccuggccgggcagaagagcgagucccccagcaaggacuucggccccacgcuggggcucaagaaguccagcucccuggagagccugcagaccgccguggcggaggugcgcaagaacgaccucccguuccaccggccccgcccccacaugguccggggccgcgggugcaacgaguccuuccgcgccgccaucgacaagagcuacgacggcccggaggagaucgaggccgacggccuguccgacaagagcucccacagcgggcagggcgcccugaacugcgaguccgcgccccaggggaacagcgagcucgaggacauggagaacaaggcccggaaggugaagaagaccaaggagaaggagaagaagaaggagaagggcaagcugaaggugaaggagaagaagcgcaaggaggagaacgaggaccccgagcggaagaucaagaagaagggcuucggggccaugcugcgcuucggcaagaagaaggaggacaaggggggcaaggccgagcagaaggggacccucaagcacggcggccugcgggaggaggagcuggagaagaugaaggaggagcgcgagcggaucggggccaagcaccaggagcuccgcgagaagcaggcgcggggccugcuggacuacgccaccggggccaucggcuccgucuacgacauggacgacgacgagauggaccccaacuacgcccgcgugaaccacuuccgggagccgugcacgagcgcgaacguguuccgcagccccucccccccccgggccgggccguucggcuacccccgcgacggccacccccucagccccgagcgggaccaccuggaggggcuguacgccaaggucaacaagccguaccacccccucgugcccgccgacuccggccgccccaccgggggcagcaccgaccggauccagaagcugcgcaaggaguacuaccaggcccggcgcgagggguucccgcuguacgaggacgacgagggccgggcgcgccccuccgaguacgaccuccugugggugcccggccgcgggcccgacggcaacgcccacaaccugcgguucgaggggauggagcgccaguacgccagccucccgcggggcggccccgccgaccccgucgacuaccugcccgccgcgccgcgcgggcuguacaaggagcgggagcuccccuacuaccccggcgcccaccccaugcacccgcccaagggguccuacccccgcccgaccgagcugcggguggccgaccugcgcuacccccagcacuacccccccccgcccgccccccagcacaagggccccuuccggcaggacgugccgcccagccccccccagcaccagcgcaugccggccuaccaggagacggggcggcccggcccccgcggcgggucccccgaccaguacccguaccggacccaggacagccgccagaagaaccccaugaccgcggccgucuga

SEQ ID NO: 34239 - RNA, 4062 nt, Artificial Sequence
  derived and/or modified sequence opt1 from PARD3__Homo_sapiens__NP_001171714
augaaggugaccgucugcuucggccgcacccggguggugguccccugcggggacggccacaugaagguguucagccugauccagcaggccgugacgcgcuaccggaaggccaucgcgaaggacccgaacuacuggauccagguccaccgccucgagcacggggacggcgggauccuggaccuggacgacauccucugcgacguggccgacgacaaggaccggcugguggccgucuucgacgagcaggacccccaccacggcggcgacgggaccuccgccagcuccaccggcacccagagccccgagaucuucggguccgagcugggcacgaacaacgugagcgccuuccagcccuaccaggcgaccuccgagaucgaggugaccccgagcguccuccgcgccaacaugccccugcacgugcggcgcuccagcgaccccgcccugaucgggcucuccaccagcguguccgacagcaacuucuccagcgaggagcccucccggaagaacccgacgcgcuggagcaccaccgccggcuuccugaagcagaacaccgcgggcucccccaagacgugcgaccggaagaaggacgagaacuaccgcagccugccccgggacaccagcaacugguccaaccaguuccagcgcgacaacgcccggagcucccucagcgccucccaccccauggucgggaaguggcuggagaagcaggagcaggacgaggacggcaccgaggaggacaacagccgcguggagccgguggggcacgccgacaccggccuggagcacauccccaacuucucccucgacgacauggucaagcugguggaggugcccaacgacggcgggccccugggcauccacgucgugccguucagcgcccgcgggggccggacgcucgggcugcuggugaagcggcucgagaagggcggcaaggcggagcacgagaaccuguuccgcgagaacgacugcaucguccggaucaacgacggggaccugcgcaaccgccgguucgagcaggcccagcacauguuccgccaggccaugcggacccccaucaucugguuccacgugguccccgccgccaacaaggagcaguacgagcagcucucccagagcgagaagaacaacuacuacuccagccgcuucucccccgacagccaguacaucgacaaccgguccgugaacagcgcgggccugcacaccgugcagcgcgccccgcggcugaaccacccgcccgagcagaucgacucccacagccgccucccccacuccgcccaccccagcgggaagccgcccagcgcccccgccuccgcgccccagaacgucuucagcaccacgguguccagcggcuacaacaccaagaagaucgggaagcggcugaacauccagcugaagaagggcaccgagggccucggguucuccaucaccagccgcgacgugacgaucggcggguccgcccccaucuacgucaagaacauccugccccggggcgccgccauccaggacgggcgccugaaggccggcgaccggcucaucgaggugaacggcguggaccuggucggcaagagccaggaggagguggugucccugcuccgcagcaccaagauggaggggaccgucucccugcugguguuccggcaggaggacgcguuccacccgcgcgagcucaacgccgagcccagccagaugcagauccccaaggagaccaaggccgaggacgaggacaucgugcugacgcccgacgggacccgggaguuccugaccuucgaggucccgcucaacgacuccggcagcgccggccuggggguguccgugaagggcaaccgcagcaaggagaaccacgcggaccuggggaucuucgucaaguccaucaucaacggcggggccgccagcaaggacggccggcuccgcgugaacgaccagcugaucgccgugaacggcgagagccugcucgggaagaccaaccaggacgccauggagacgcugcgccgguccaugagcaccgagggcaacaagcgcgggaugauccagcugaucgucgcgcggcgcaucuccaagugcaacgagcucaagagccccggcuccccgcccgggcccgagcugcccaucgagaccgcccuggacgaccgggagcgccggaucagccacucccuguacagcggcaucgagggccucgacgagucccccagccgcaacgccgcccugucccggaucauggggaaguaccagcugagccccaccgugaacaugccgcaggacgacacggugaucaucgaggacgaccgccuccccguccugccgccccaccuguccgaccagagcuccagcuccagccacgacgacgugggcuucgugaccgccgacgcggggaccugggccaaggccgccaucuccgacagcgccgacugcagccucucccccgacgucgaccccgugcuggcguuccagcgggagggcuucgggcgccagagcauguccgagaagcggaccaagcaguucagcgacgccucccagcuggacuucgugaagacccgcaagagcaaguccauggaccucggcaucgccgacgagacgaagcugaacaccgucgacgaccagaaggccggcagccccucccgggacguggggcccagccugggccucaagaaguccagcucccuggagagccugcagaccgcgguggccgaggucacccucaacggggacaucccguuccaccgcccccggccccgcaucauccggggccgcgggugcaacgaguccuuccgggccgccaucgacaagagcuacgacaagcccgccguggacgacgacgacgagggcauggagacgcuggaggaggacaccgaggaguccagccgcuccggccgcgagagcgugagcaccgcguccgaccagccgagccacucccuggagcggcagaugaacgggaaccaggagaagggcgacaagaccgaccgcaagaaggacaagacggggaaggagaagaagaaggaccgggacaaggagaaggacaagaugaaggccaagaagggcaugcucaagggccugggggacauguuccgcuucggcaagcaccggaaggacgacaagaucgagaagaccgggaagaucaagauccaggagagcuucaccuccgaggaggagcgcauccggaugaagcaggagcaggagcgcauccaggccaagacccgggaguuccgcgagcggcaggcccgcgagcgggacuacgccgagauccaggacuuccaccgcacguucggcugcgacgacgagcugauguacgggggcgucagcuccuacgagggcagcauggcgcucaacgcccggccccagagcccccgcgaggggcacaugauggacgcccuguacgcccaggugaagaagccgcggaacuccaagcccucccccguggacagcaaccgcuccacccccagcaaccacgaccggauccagcgccugcgccaggaguuccagcaggccaagcaggacgaggacgucgaggaccggcgccggaccuacuccuucgagcagccguggcccaacgcgcgccccgccacccagagcggccggcacuccgugagcguggagguccagaugcagcgccagcggcaggaggagcgcgaguccagccagcaggcccagcggcaguacagcucccucccccgccagagccggaagaacgccuccagcgugucccaggacagcugggagcagaacuacuccccgggggagggcuuccagagcgcgaaggagaacccccgcuacuccagcuaccaggggucccggaacggcuaccugggcgggcacggcuucaacgcccgcgugaugcuggagacgcaggagcuccugcggcaggagcagcgccggaaggagcagcagaugaagaagcagccgcccagcgaggggcccuccaacuacgacagcuacaagaagguccaggaccccuccuacgccccgcccaagggccccuuccgccaggacgugccgcccagccccucccagguggcccggcugaaccgccuccagacccccgagaaggggcggcccuucuacagcuga

SEQ ID NO: 34240 - RNA, 1038 nt, Artificial Sequence
  derived and/or modified sequence opt1 from PARD6A__Homo_sapiens__NP_001032358
auggcccgcccccagcggaccccggcccgcagccccgacuccaucguggaggucaagagcaaguucgacgcggaguuccggcgcuucgcccugccccgggccuccgugagcggcuuccaggaguucucccgccuccugcgggccgugcaccagauccccgggcuggacguccuccugggcuacaccgacgcccacggggaccugcucccgcugacgaacgacgacagccugcaccgcgcgcucgccuccggcccgccgccccugcggcugcucgugcagaagcgcgaggccgacagcuccgggcuggccuucgcgagcaacucccugcagcggcgcaagaagggccuccugcugcggcccguggcgccccuccgcacccggccgccccugcugaucagccucccccaggacuuccgccaggucuccagcgugaucgacguggaccugcugcccgagacccaccggcgcguccggcuccacaagcacggcuccgaccgcccccugggguucuacauccgggacggcaugagcgugcgcguggcgccccaggggcuggagcgcguccccggcaucuucaucucccggcucgugcgcgggggccuggccgagagcaccggccugcucgccguguccgacgagauccuggaggucaacgggaucgagguggccggcaagacgcuggaccaggugaccgacaugauggucgccaacagccacaaccucaucgugaccgugaagcccgccaaccagcggaacaacgucgugcgcggggccagcggccggcugaccggcccgcccuccgccgggcccggccccgccgagcccgacagcgacgacgacuccagcgaccuggugaucgagaaccgccagcccccguccagcaacgggcucucccagggcccgcccugcugggaccugcaccccgggugccggcaccccggcacgcgcagcucccugcccagccucgacgaccaggagcaggccuccagcggcugggggucccggauccgcggcgacgggagcggcuucucccuguga

SEQ ID NO: 34241 - RNA, 1119 nt, Artificial Sequence
  derived and/or modified sequence opt1 from PARD6B__Homo_sapiens__NP_115910
augaaccgcagccaccggcacggcgccggguccggcugccuggggaccauggaggucaagagcaaguucggcgccgaguuccgccgguucucccucgagcgcagcaagcccgggaaguucgaggaguucuacggccugcugcagcacgugcacaagaucccgaacguggacgugcucgucggcuacgcggacauccacggggaccugcugcccaucaacaacgacgacaacuaccacaaggccguguccaccgccaacccccuccugcggaucuucauccagaagaaggaggaggccgacuacagcgccuucggcacggacacccugaucaagaagaagaacgugcucaccaacguccugcgccccgacaaccaccggaagaagccgcacaucgugaucuccaugccccaggacuuccgccccgugagcuccaucaucgacgucgacauccugcccgagacccaccggcgcgugcggcucuacaaguacgggacggagaagccgcugggcuucuacauccgcgacgggagcuccgugcgggucacgccccacggccuggagaaggugcccggcaucuucaucagccgccucgugcccgggggccuggcgcaguccaccgggcugcucgccgucaacgacgaggugcuggaggugaacggcaucgaggucagcggcaagucccuggaccaggugaccgacaugaugaucgccaacagccggaaccucaucaucaccgugcgcccggccaaccagcggaacaacgucgugcgcaacucccggaccagcggguccagcggccagagcaccgacaacucccugcugggguacccccagcagaucgagcccagcuucgagcccgaggacgaggacuccgaggaggacgacaucaucaucgaggacaacggcgugccgcagcagauccccaaggcgguccccaacaccgagagccucgagucccugacgcagaucgagcugagcuucgaguccgggcagaacggcuucauccccagcaacgaggugucccucgccgccaucgccagcuccagcaacaccgaguucgagacccacgccccggaccagaagcugcuggaggaggacggcaccaucaucacgcucuga

SEQ ID NO: 34242 - RNA, 2685 nt, Artificial Sequence
  derived and/or modified sequence opt1 from PARG__Homo_sapiens__NP_001290415
auggacaccaagggcaucaagaccgccgagagcgagucccuggacagcaaggagaacaacaacacgcgcaucgaguccaugaugagcuccgugcagaaggacaacuucuaccagcacaacgucgagaagcucgagaacgugagccagcugucccuggacaagagccccaccgagaaguccacccaguaccucaaccagcaccagaccgccgcgaugugcaaguggcagaacgaggggaagcacacggagcagcugcuggagagcgagccgcagaccgugacccucguccccgagcaguucuccaacgccaacaucgaccggagcccccagaacgacgaccacuccgacaccgacagcgaggagaaccgcgacaaccagcaguuccugacgaccgugaagcuggccaacgccaagcagaccaccgaggacgagcaggcccgggaggcgaagucccaccagaagugcagcaaguccugcgaccccggcgaggacugcgccagcugccagcaggacgagaucgacguggucccggagagcccccucuccgacguggggagcgaggacgugggcacggggcccaagaacgacaacaagcugacccgccaggaguccugccugggcaacagcccgcccuucgagaaggaguccgagcccgagagccccauggacgucgacaacuccaagaacagcugccaggacuccgaggccgacgaggagaccagccccggcuucgacgagcaggaggacggguccagcucccagaccgccaacaagccgagccgguuccaggcgcgcgacgccgacaucgaguuccggaagcgcuacuccacgaagggcggggaggugcggcuccacuuccaguucgagggcggggagagccgcaccggcaugaacgaccugaacgccaagcugcccggcaacaucuccagccucaacguggagugccggaacuccaagcagcacgggaagaaggacagcaagaucaccgaccacuucaugcgccugcccaaggccgaggaccggcgcaaggagcagugggagaccaagcaccagcggacggagcgcaagauccccaaguacgucccgccccaccugucccccgacaagaaguggcucggcacccccaucgaggagaugcggcgcaugccgcggugcgggauccgccugccccugcuccggcccagcgccaaccacaccgugaccauccgcguggaccugcugcgcgcgggcgagguccccaagccguuccccacgcacuacaaggaccucugggacaacaagcacgugaagaugcccugcagcgagcagaaccuguaccccguggaggacgagaacggcgagcggaccgccgggucccgcugggagcugauccagaccgcccuccugaacaaguucacccggccgcagaaccugaaggacgccauccucaaguacaacgucgccuacagcaagaagugggacuucacggcgcugaucgacuucugggacaaggugcuggaggaggccgaggcccagcaccucuaccaguccauccugcccgacauggugaagaucgcccugugccuccccaacaucugcacccagccgaucccccugcugaagcagaagaugaaccacagcaucaccaugucccaggagcagaucgccagccuccuggcgaacgccuucuucugcaccuucccccgccggaacgccaagaugaaguccgaguacagcuccuaccccgacaucaacuucaaccgccuguucgagggccggagcucccgcaagccggagaagcucaagacgcuguucugcuacuuccggcgcgucaccgagaagaagcccaccgggcuggugaccuucacgcggcagagccucgaggacuuccccgagugggagcgcugcgagaagccccugacccggcugcacgugaccuacgagggcaccaucgaggagaacgggcagggcaugcuccaggucgacuucgccaaccgcuucgugggcgggggcgucaccuccgccgggcuggugcaggaggagauccgguuccugaucaacccggagcugaucaucagccgccucuucacggaggugcuggaccacaacgagugccugaucaucaccggcaccgagcaguacuccgaguacaccggguacgcggagacguaccgguggagccgcucccacgaggacggcagcgagcgggacgacuggcagcgccgcugcaccgagaucgucgccaucgacgcccuccacuuccggcgcuaccuggaccaguucgugcccgagaagaugcggcgcgagcugaacaaggccuacugcggcuuccuccggcccggggugagcuccgagaaccugagcgcggucgccaccggcaacugggggugcggcgccuucgggggcgacgcccgccugaaggcccucauccagauccuggcggccgccgccgccgagcgggacgugguguacuucaccuucggcgacuccgagcugaugcgcgacaucuacagcaugcacaucuuccucacggagcggaagcugaccgucggggacguguacaagcugcuccugcgcuacuacaacgaggagugccggaacugcuccacccccggcccggacaucaagcuguaccccuucaucuaccacgcgguggagagcugcgccgagaccgccgaccacuccgggcagcgcacgggcaccuga

SEQ ID NO: 34243 - RNA, 1398 nt, Artificial Sequence
  derived and/or modified sequence opt1 from PARK2__Homo_sapiens__NP_004553
augaucguguucguccgcuucaacagcucccacggcuuccccguggagguggacagcgacaccuccaucuuccagcugaaggaggucguggccaagcggcagggggugccggccgaccagcuccgcgucaucuucgcgggcaaggagcugcggaacgacuggaccgugcagaacugcgaccuggaccagcagagcaucgugcacaucguccagcgccccuggcggaaggggcaggagaugaacgccacgggcggggacgacccccgcaacgccgccggcggcugcgagcgggagccccagucccucacccgcguggaccugagcuccagcgugcugccgggggacuccgucggccucgccgugauccugcacaccgacagccggaaggacuccccgcccgcggggagccccgccggccgcuccaucuacaacagcuucuacguguacugcaaggggcccugccagcggguccagcccggcaagcugcgcgugcagugcuccacgugccggcaggccacccucacccugacccagggccccagcugcugggacgacgugcugauccccaaccgcauguccggggagugccagagcccgcacugccccggcaccuccgccgaguucuucuucaagugcggggcgcaccccacgagcgacaaggagaccagcgucgcccuccaccugaucgccaccaacucccggaacaucacgugcaucacgugcaccgacgugcgcagccccgugcuggucuuccagugcaacucccggcacgugaucugccucgacugcuuccaccuguacugcgugacccgccugaacgaccggcaguucguccacgacccgcagcucggcuacagccugcccugcguggccggcugccccaacucccugaucaaggagcuccaccacuuccgcauccugggggaggagcaguacaaccgguaccagcaguacggcgccgaggagugcguccugcagaugggcggggugcucugcccccgcccggggugcggcgcgggccugcugcccgagcccgaccagcgcaaggugaccugcgagggcgggaacgggcucggcugcggguucgccuucugccgggagugcaaggaggccuaccacgagggcgagugcagcgccgucuucgaggccuccggcaccaccacccaggcguaccgcguggacgagcgggccgccgagcaggcccgcugggaggccgcgagcaaggagaccaucaagaagacgaccaagcccugcccgcggugccacgugcccgucgagaagaacgggggcugcaugcacaugaagugcccccagccccagugccgccuggaguggugcuggaacugcgggugcgaguggaaccgggugugcaugggcgaccacugguucgacguguga

SEQ ID NO: 34244 - RNA, 990 nt, Artificial Sequence
  derived and/or modified sequence opt1 from PARL__Homo_sapiens__NP_001032728
auggccuggcgcggcugggcccagcggggguggggcugcgggcaggcguggggcgccagcgucgggggccgcuccugcgaggagcugaccgccgugcucacgcccccgcagcugcugggccggcgcuucaacuucuucauccagcagaagugcggguuccggaaggcgccccgcaagguggagccccggcgcagcgaccccggcaccuccggggaggccuacaagcggagcgcccucaucccgcccguggaggagaccgucuucuaccccucccccuacccgauccgcagccugaucaagccccuguucuucaccgugggcuucaccgggugcgccuucggcuccgccgccaucuggcaguacgagagccucaagucccgggugcagagcuacuucgacggcaucaaggcggacuggcuggacuccauccgcccccagaaggagggggacuuccggaaggagaucaacaagugguggaacaaccugagcgacggccagcgcacggucaccgggaucaucgccgccaacgugcucguguucugccuguggcggguccccucccugcagcgcaccaugauccgguacuucaccagcaacccggccuccagcgugaucuccaacuucgugagcuacgucggcaagguggccacgggccgcuacgggcccucccucggcgcgagcggggccaucaugaccgugcuggccgccgucugcaccaagauccccgagggccggcuggccaucaucuuccuccccauguucaccuucacggcggggaacgcccugaaggccaucaucgccauggacaccgccggcaugauccugggcuggaaguucuucgaccacgcggcccaccucgggggcgcccuguucgggaucugguacgugaccuacggccacgagcugaucuggaagaaccgcgagccgcucgugaagaucuggcacgagauccggaccaacgggcccaagaagggcggcgggagcaaguga

SEQ ID NO: 34245 - RNA, 933 nt, Artificial Sequence
  derived and/or modified sequence opt1 from PARM1__Homo_sapiens__NP_056208
augguguacaagacccuguucgcccucugcauccugaccgccggcuggcgcguccagagccugcccacguccgcgccgcucagcgugucccugcccaccaacaucgugccgcccaccaccaucuggacgagcuccccgcagaacaccgacgccgacaccgccagccccuccaacgggacccacaacaacagcguccugcccgugacggccuccgcccccaccagccuccugccgaagaacaucuccaucgagagccgggaggaggagaucaccucccccggcagcaacugggaggggaccaacacggaccccucccccagcggcuucuccagcaccuccgggggcgugcaccugaccaccacgcucgaggagcacagcagcggcacccccgaggcgggggucgccgccacccugucccagagcgccgcggagccgcccacccugaucagcccccaggcccccgccuccucccccagcucccucagcacguccccgcccgagguguucagcgccuccgugaccaccaaccacagcuccaccgucacgagcacccagcccaccggcgcccccaccgcgcccgagucccccacggaggagagcuccagcgaccacaccccgaccucccacgccaccgccgagcccgugccccaggagaagacgcccccgaccaccgugagcgggaaggucaugugcgagcugaucgacauggagaccacgaccaccuucccccgcgugaucaugcaggagguggagcacgcccugagcuccggcagcaucgccgcgaucaccgucaccgugaucgccgugguccuccugguguucgggguggccgccuaccugaagauccggcacuccagcuacggccgccuccuggacgaccacgacuacggcuccugggggaacuacaacaacccccuguacgacgacagcuga

SEQ ID NO: 34246 - RNA, 1737 nt, Artificial Sequence
  derived and/or modified sequence opt1 from PARN__Homo_sapiens__NP_001127949
auggacuuccuccucuuccaguucggccugugcaccuucaaguacgacuacaccgacagcaaguacaucacgaaguccuucaacuucuacguguuccccaagccguucaaccgcagcucccccgacgucaaguucgugugccagagcuccagcaucgacuuccuggccucccagggguucgacuucaacaagguguuccggaacggcauccccuaccucaaccaggaggaggagcgccagcugcgggagcaguacgacgagaagcgcagccaggccaacggggcgggcgcccuguccuacgucagccccaacaccuccaagugcccggugaccauccccgaggaccagaagaaguucaucgaccagguggucgagaagaucgaggaccuccugcagagcgaggagaacaagaaccuggaccucgagcccugcaccggguuccagcggaagcugaucuaccagacgcuguccuggaaguaccccaagggcauccacguggagacccucgagaccgagaagaaggagcgcuacaucgugaucagcaaggucgacgaggaggagcggaagcgccgggagcagcagaagcacgccaaggagcaggaggagcugaacgacgccgugggcuucucccgcgugauccacgccaucgcgaacagcgggaagcuggucaucggccacaacaugcuccuggacgugaugcacaccgugcaccaguucuacugcccgcugcccgccgaccucuccgaguucaaggagaugacgaccugcgucuucccccggcugcuggacaccaagcucauggccagcacccagcccuucaaggacaucaucaacaacacgucccuggccgagcuggagaagcgccucaaggagaccccguucaacccgcccaagguggagagcgcggagggguuccccagcuacgacaccgccuccgagcagcugcacgaggccggcuacgacgccuacaucaccgggcugugcuucaucagcauggccaacuaccucggcuccuuccugagcccgcccaagauccacguguccgcgcggagcaagcugaucgagcccuucuucaacaagcuguuccugaugcgcgucauggacauccccuaccugaaccucgagggccccgaccugcagcccaagcgggaccacgugcugcacgugacguuccccaaggaguggaagaccuccgaccucuaccagcuguucagcgccuucgggaacauccagaucuccuggaucgacgacaccagcgccuucgucucccugagccagcccgagcaggucaagaucgccgugaacaccuccaaguacgccgagagcuaccgcauccagacguacgcggaguacaugggccggaagcaggaggagaagcagaucaagcgcaaguggaccgaggacuccuggaaggaggccgacagcaagcggcucaacccgcagugcauccccuacacccugcagaaccacuacuaccgcaacaacuccuucaccgcccccagcacgguggggaagcggaaccugucccccagccaggaggaggccggccucgaggacggcgugagcggggagaucuccgacaccgagcuggagcagaccgacagcugcgccgagccgcuguccgagggccgcaagaaggcgaagaagcucaagcgcaugaagaaggagcugagccccgccggguccaucagcaagaacucccccgccacccuguucgaggucccggacacgugguga

SEQ ID NO: 34247 - RNA, 2106 nt, Artificial Sequence
  derived and/or modified sequence opt1 from PARP12__Homo_sapiens__NP_073587
auggcccaggccggcguggucggggaggugacccaggugcugugcgcggccggcggggcccucgagcugcccgagcugcgccggcgccuccggaugggccugagcgccgacgcccuggagcgccuccugcggcagcgcgggcgguucgucguggcggugcgcgccggcggcgccgccgcggccccggagcgggucgugcuggccgccagcccccuccgccugugccgggcccaccagggguccaagcccggcugcguggggcugugcgcgcagcuccaccugugccgcuucauggucuacggcgccugcaaguuccugcgggccgggaagaacugccgcaacucccacagccucaccacggagcacaaccuguccgugcugcggacccacggcguggaccaccucagcuacaacgagcugugccagcuccucuuccagaacgaccccuggcugcugccggagaucugccagcacuacaacaagggcgacgggccccacggcuccugcgccuuccagaagcagugcaucaagcuccacaucugccaguacuuccugcagggggagugcaaguucggcaccagcugcaagcgcucccacgacuucagcaacuccgagaaccuggagaagcucgagaagcugggcaugagcuccgaccuggucagccggcuccccaccaucuaccgcaacgcccacgacaucaagaacaaguccagcgcgcccucccgggugccgccccuguucgugccccaggggacgagcgagcgcaaggacuccagcggcagcgucucccccaacacccugagccaggaggagggggaccagaucugccucuaccacauccggaaguccugcagcuuccaggacaagugccaccgcgugcacuuccaccucccguaccgcuggcaguuccuggaccggggcaagugggaggaccuggacaacauggagcugaucgaggaggccuacugcaaccccaagaucgagcgcauccugugcuccgagagcgccuccaccuuccacagccacugccucaacuucaacgccaugaccuacggggccacgcaggcgcggcgccuguccaccgccagcuccgugaccaagccgccccacuucauccugaccacggacuggaucugguacuggagcgacgaguucggcuccuggcaggaguacggccggcaggggaccguccaccccgugaccaccgugagcuccagcgacgucgagaaggccuaccucgccuacugcacgcccggcuccgacgggcaggccgcgacccugaaguuccaggccggcaagcacaacuacgagcuggacuucaaggccuucgugcagaagaaccucguguacgggaccaccaagaaggucugccgccggcccaaguacgugagcccccaggacgucacgaccaugcagaccugcaacaccaaguucccgggccccaaguccauccccgacuacugggacagcagcgcccugcccgacccgggcuuccagaagaucacgcuguccagcuccagcgaggaguaccagaagguguggaaccucuucaaccgcacccugcccuucuacuucgugcagaagaucgagcggguccagaaccuggcgcugugggagguguaccaguggcagaaggggcagaugcagaagcagaacggcgggaaggccguggacgagcgccagcuguuccacggcaccuccgccaucuucgucgacgccaucugccagcagaacuucgacuggcgggugugcggggugcacggcaccagcuacggcaagggguccuacuucgcccgcgacgcggccuacagccaccacuacuccaagagcgacacgcagacccacaccauguuccuggcccggguccuggugggcgaguucgugcgcgggaacgccuccuucguccggccgcccgccaaggagggcuggagcaacgcguucuacgacuccugcgugaacagcguguccgaccccagcaucuucgucaucuucgagaagcaccagguguaccccgaguacgugauccaguacaccacguccagcaagcccagcgucaccccguccauccuccuggcccugggcagccucuucuccagccgccaguga

SEQ ID NO: 34248 - RNA, 5406 nt, Artificial Sequence
  derived and/or modified sequence opt1 from PARP14__Homo_sapiens__NP_060024
auggccgugcccggcagcuucccgcugcucgucgagggguccuggggccccgacccccccaagaaccugaacaccaagcugcagauguacuuccagagcccgaagcgcuccgggggcggggagugcgaggugcggcaggacccccgcagccccucccgguuccucguguucuucuaccccgaggacguccgccagaaggugcuggagcggaagaaccacgagcugguguggcagggcaagggcaccuucaagcucacgguccagcugccggccacccccgacgagaucgaccacguguucgaggaggagcugcucaccaaggagagcaagaccaaggaggacgugaaggagcccgacgucuccgaggagcuggacacgaagcugccccucgacgggggccuggacaagauggaggacaucccggaggagugcgagaacaucagcucccugguggcguucgagaaccucaaggccaacgugaccgacaucaugcugauccugcucgucgagaacaucagcgggcuguccaacgacgacuuccagguggagaucauccgcgacuucgacguggccgucgugaccuuccagaagcacaucgacaccauccgguucguggacgacugcacgaagcaccacagcaucaagcagcugcagcucuccccccgccugcuggaggucaccaacaccauccggguggagaaccucccccccggcgccgacgacuacagccugaagcuguucuucgagaacccguacaacgggggcggccgcguggccaacgucgaguacuuccccgaggaguccagcgcgcucaucgaguucuucgaccggaaggugcuggacaccaucauggccacgaagcuggacuucaacaagaugccccucuccguguuccccuacuacgccagccuggggaccgcccuguacggcaaggagaagccgcucaucaagcugcccgcgcccuucgaggagucccuggaccucccccuguggaaguuccugcagaagaagaaccaccucaucgaggagaucaacgacgagaugcgccggugccacugcgagcugaccuggagccagcugagcgggaaggucaccauccgcccggccgccacgcucgugaacgagggccggccccgcaucaagaccuggcaggccgacaccuccaccacgcugagcuccauccggagcaaguacaaggucaaccccaucaagguggaccccaccaugugggacaccaucaagaacgacgugaaggacgaccgcauccugaucgaguucgacacccucaaggagauggucauccuggccggcaaguccgaggacgugcagagcaucgaggugcagguccgggagcugaucgaguccacgacccagaagaucaagcgcgaggagcagagccucaaggagaagaugaucaucuccccggggcgguacuuccugcugugccacagcucccugcucgaccaccugcugaccgagugccccgagaucgagaucugcuacgaccgcgugacccagcaccucugccugaagggccccagcgcggacguguacaaggccaagugcgagauccaggagaaggucuacacgauggcccagaagaacauccagguguccccggagaucuuccaguuccugcagcaggugaacuggaaggaguucagcaagugccucuucaucgcccagaagauccuggcccuguacgagcucgaggggaccaccguccugcugaccuccugcagcuccgaggcgcuccuggaggccgagaagcagaugcugagcgcccucaacuacaagcgcaucgagguggagaacaaggaggugcugcacggcaagaaguggaaggggcugacgcacaaccuccugaagaagcagaacuccagccccaacaccgucaucaucaacgagcugaccagcgagaccacggccgaggugaucaucaccggcugcgugaaggaggucaacgagaccuacaagcuccuguucaacuucguggagcagaacaugaagaucgagcggcugguggaggucaagcccucccucgugaucgacuaccugaagaccgagaagaagcuguucuggcccaagaucaagaaggugaacguccaggugagcuucaacccggagaacaagcagaagggcauccuccugaccggguccaagacggaggugcugaaggccgucgacaucgugaagcaggugugggacagcgucugcgugaaguccgugcacaccgacaagcccggcgcgaagcaguucuuccaggacaaggcccgcuucuaccagagcgagaucaagcggcucuucgggugcuacaucgagcugcaggagaacgaggucaugaaggagggcgggucccccgccggccagaagugcuucagccgcaccgugcuggcccccggcgugguccucaucgugcagcagggggaccuggcccggcugccgguggacgucguggugaacgcguccaacgaggaccucaagcacuacggcgggcuggccgccgcccugagcaaggcggccggccccgagcuccaggccgacugcgaccagaucgucaagcgcgaggggcggcugcugcccggcaacgccaccaucuccaaggccggcaagcuccccuaccaccacgugauccacgcgguggggccgcgcuggagcggcuacgaggccccccggugcgucuaccugcugcgccgggccgugcagcucucccugugccuggccgagaaguacaaguaccgcagcaucgccauccccgcgaucuccagcgggguguucggcuucccccucggccggugcgucgagacgaucguguccgccaucaaggagaacuuccaguucaagaaggacgggcacugccugaaggagaucuaccugguggacgucagcgagaagaccguggaggccuucgccgaggccgucaagaccguguucaaggcgacccucccggacacggccgccccccccggccugcccccggccgcggccgggcccggcaagaccagcugggagaaggggucccuggugagccccggcggccuccagaugcugcuggucaaggagggggugcagaacgccaagaccgacguggucgugaacuccgugccccucgaccugguccugagccgcggcccgcucuccaagagccugcuggagaaggccgggcccgagcuccaggaggagcuggacaccgugggccaggggguggccgucuccaugggcacggugcugaagaccagcuccuggaaccucgacugccgguacgugcugcacgucguggcgcccgaguggcgcaacggcagcaccuccagccugaagaucauggaggacaucauccgggagugcauggagaucaccgagucccucagccugaaguccaucgccuucccggccaucgggacgggcaaccugggguuccccaagaacaucuucgccgagcucaucaucagcgagguguucaaguucuccagcaagaaccagcugaagacccugcaggagguccacuuccuccugcaccccuccgaccacgagaacauccaggccuucagcgacgaguucgcgcgccgggccaacggcaaccuggugagcgacaagauccccaaggccaaggacacccagggguucuacggcaccguguccagcccggacuccggcgucuacgagaugaagaucgggagcaucaucuuccagguggccuccggcgacaucacgaaggaggaggccgacgugaucgucaacagcaccuccaacagcuucaaccucaaggcggggguguccaaggccauccuggagugcgccggccagaacguggagcgcgagugcagccagcaggcccagcagcgcaagaacgacuacaucaucaccgggggcggcuuccugcggugcaagaacaucauccacgucaucgggggcaacgacgugaaguccagcguguccagcguccuccaggagugcgagaagaagaacuacuccagcaucugccugcccgcgaucgggaccggcaacgccaagcagcaccccgacaagguggccgaggccaucaucgacgccaucgaggacuucgugcagaagggcuccgcgcagagcgucaagaaggugaagguggucaucuuccugccccaggugcucgacguguucuacgccaacaugaagaagcgcgaggggacgcagcuguccagccagcagagcgucauguccaagcuggccagcuuccucggcuucuccaagcagagcccgcagaagaagaaccaccuggugcuggagaagaagaccgaguccgccaccuuccgggugugcggggagaacgucaccugcguggaguacgccaucagcuggcuccaggaccugaucgagaaggagcagugccccuacacguccgaggacgagugcaucaaggacuucgacgagaaggaguaccaggagcugaacgagcuccagaagaagcugaacaucaacaucagccuggaccacaagcgcccccugaucaaggugcucggcaucucccgggacgucaugcaggcgcgcgacgagaucgaggccaugaucaagcgggugcgccuggccaaggagcaggagagccgggccgacugcaucuccgaguucaucgaguggcaguacaacgacaacaacaccagccacugcuucaacaagaugaccaaccugaagcucgaggacgcccgccgggagaagaagaagaccguggacgucaagaucaaccaccgccacuacacggugaaccugaacaccuacaccgcgaccgacacgaaggggcacucccugagcgugcagcggcucaccaaguccaaggucgacauccccgcccacuggagcgacaugaagcagcagaacuucugcguggucgagcugcugccguccgaccccgaguacaacaccguggccagcaaguucaaccagaccugcucccacuuccgcaucgagaagaucgagcggauccagaaccccgaccucuggaacagcuaccaggccaagaagaagaccauggacgccaagaacggccagacgaugaacgagaagcagcuguuccacggcaccgacgcggggagcgugccccacgucaaccgcaacggcuucaaccgguccuacgccgggaagaacgccguggccuacggcaaggggaccuacuucgcggugaacgccaacuacagcgccaacgacaccuacucccgcccggacgccaacggccggaagcacgucuacuacgugcgcgugcugacgggcaucuacacccacgggaaccacagccucaucgucccccccuccaagaacccccagaacccgaccgaccuguacgacaccgugacggacaacgugcaccaccccagccuguucgucgccuucuacgacuaccaggcguaccccgaguaccucaucaccuuccggaaguga

SEQ ID NO: 34249 - RNA, 2037 nt, Artificial Sequence
  derived and/or modified sequence opt1 from PARP15__Homo_sapiens__NP_001106995
auggccgcccccggcccgcugcccgcggccgcccucagccccggggcccccaccccgcgcgagcugaugcacggcguggccggggucaccucccgggcgggccgcgaccgggaggccgggagcgugcugcccgccggcaaccgcggcgcccggaaggcgucccgccggagcuccagccgcuccaugagccgggacaacaaguucuccaagaaggacugccucagcauccgcaacguggucgccuccauccagacgaaggaggggcugaaccugaagcucaucagcggcgacgugcuguacaucugggccgacgugaucgucaacuccgugcccaugaaccugcagcucgggggcgggccccugagccgggccuuccugcagaaggccggcccgaugcuccagaaggagcuggacgaccgccggcgcgagaccgaggagaaggugggcaacaucuucaugaccuccgggugcaaccuggacugcaaggcgguccuccacgccguggcccccuacuggaacaacggcgccgagaccagcuggcagaucauggccaacaucaucaagaagugccugacgaccguggagguccuguccuucagcuccaucaccuuccccaugaucgggaccggcagccuccaguuccccaaggcgguguucgccaagcugauccugagcgagguguucgaguacuccagcuccacgcggccgaucaccagcccccuccaggagguccacuuccugguguacaccaacgacgacgagggcugccaggccuuccuggacgaguucaccaacuggucccgcaucaaccccaacaaggcccggauccccauggccggggacacgcagggcguggucgggaccgugagcaagccgugcuucaccgcguacgagaugaagaucggcgccaucaccuuccagguggccacgggggacaucgccaccgagcaggucgacgugaucgugaacuccaccgcccgcaccuucaaccgcaagagcggcgucucccgcgcgauccucgagggcgccgggcaggccguggagagcgagugcgccguccuggcggcccagccccaccgggacuucaucaucacgcccggcgggugccugaagugcaagaucaucauccacgugcccggcgggaaggacgugcgcaagaccgucaccuccgugcucgaggagugcgagcagcgcaaguacaccagcgugucccugccggccaucggcacgggcaacgccgggaagaaccccaucaccgucgccgacaacaucaucgacgcgaucguggacuucagcucccagcacagcacccccucccugaagaccgugaaggucgugaucuuccagcccgagcuccugaacaucuucuacgacagcaugaagaagcgggaccuguccgccagccucaacuuccagagcacguucuccaugacgaccugcaaccugccggagcacuggaccgacaugaaccaccagcuguucugcauggugcagcucgagcccggccagagcgaguacaacaccaucaaggacaaguucacccggaccugcuccagcuacgccaucgagaagaucgagcggauccagaacgccuuccuguggcaguccuaccaggucaagaagcgccagauggacaucaagaacgaccacaagaacaacgagcggcuccuguuccacgggaccgacgccgacagcgugcccuacgugaaccagcacggcuucaaccgcuccugcgcggggaagaacgccgucagcuacggcaagggcacguacuucgccguggacgccuccuacagcgccaaggacaccuacuccaagcccgacagcaacgggcggaagcacauguacgugguccgcgugcugaccggcguguucaccaaggggcgggcgggccuggucaccccgccgcccaagaacccccacaaccccacggaccucuucgacuccgugaccaacaacacccgcagccccaagcuguucguggucuucuucgacaaccaggccuaccccgaguaccugaucaccuucacggccuga

SEQ ID NO: 34250 - RNA, 3045 nt, Artificial Sequence
  derived and/or modified sequence opt1 from PARP1__Homo_sapiens__NP_001609
auggccgagagcuccgacaagcuguaccgcguggaguacgccaagagcggccgggcguccugcaagaagugcagcgaguccauccccaaggacagccuccgcauggccaucaugguccaguccccgauguucgacgggaaggugccccacugguaccacuucagcugcuucuggaaggugggccacuccauccggcaccccgacgucgagguggacggguucagcgagcugcgcugggacgaccagcagaaggugaagaagaccgccgaggccggcggggucaccggcaagggccaggacgggaucggcuccaaggccgagaagacgcugggggacuucgcggccgaguacgccaagagcaaccgguccacgugcaagggcugcauggagaagaucgagaagggccaggugcgccucagcaagaagaugguggaccccgagaagccgcagcuggggaugaucgaccggugguaccaccccggcugcuucgucaagaaccgcgaggagcugggguuccggcccgaguacuccgccagccagcucaagggcuucucccugcuggcgaccgaggacaaggaggcccucaagaagcagcugcccggggucaagagcgagggcaagcgcaagggcgacgagguggacgggguggacgagguggccaagaagaaguccaagaaggagaaggacaaggacagcaagcuggagaaggcccucaaggcccagaacgaccugaucuggaacaucaaggacgagcugaagaaggugugcagcaccaacgaccucaaggagcugcugaucuucaacaagcagcaggucccguccggcgagagcgcgauccucgaccggguggccgacgggaugguguucggcgcccugcugcccugcgaggagugcuccgggcagcucgucuucaagagcgacgccuacuacugcaccggcgacgugaccgccuggaccaagugcauggugaagacccagacgcccaaccgcaaggagugggucacccccaaggaguuccgggagaucuccuaccugaagaagcugaaggugaagaagcaggaccgcaucuucccgcccgagaccagcgcguccguggccgccaccccgccgcccagcacggccuccgcccccgcggccgucaacagcuccgccagcgccgacaagccccucuccaacaugaagauccugacccugggcaagcucagccggaacaaggacgaggugaaggccaugaucgagaagcucgggggcaagcugaccgggaccgcgaacaaggccucccucugcaucagcacgaagaaggaggucgagaagaugaacaagaagauggaggaggugaaggaggccaacauccgcguggucuccgaggacuuccugcaggacgugagcgccuccaccaagagccugcaggagcuguuccuggcgcacauccugagccccuggggcgccgaggugaaggccgagcccgucgaggugguggcgccccgggggaaguccggcgccgcccucagcaagaaguccaagggccaggucaaggaggaggggaucaacaagagcgagaagcgcaugaagcugacccugaagggcggggccgccguggaccccgacuccggccucgagcacagcgcccacgugcuggagaagggcgggaaggucuucuccgccacccugggccucguggacaucgugaaggggacgaacagcuacuacaagcugcagcugcucgaggacgacaaggagaaccgguacuggaucuuccgcuccuggggccgggucgggaccgugaucggcagcaacaagcuggagcagaugcccuccaaggaggacgcgaucgagcacuucaugaagcuguacgaggagaagaccggcaacgccuggcacagcaagaacuucaccaaguacccgaagaaguucuacccccucgagaucgacuacgggcaggacgaggaggccgugaagaagcugacggucaaccccggcaccaaguccaagcugcccaagccggugcaggaccugaucaagaugaucuucgacguggagagcaugaagaaggccauggucgaguacgagaucgaccuccagaagaugccccuggggaagcuguccaagcgccagauccaggccgcguacagcauccucuccgaggugcagcaggccgugagccagggcagcuccgacagccagauccuggaccuguccaaccgcuucuacacccucaucccccacgacuucgggaugaagaagccgccccugcugaacaacgccgacagcguccaggccaagguggagaugcucgacaaccugcuggacaucgagguggcguacucccuccugcggggcggcagcgacgacuccagcaaggaccccaucgacgucaacuacgagaagcugaagaccgacaucaaggugguggaccgcgacuccgaggaggccgagaucauccggaaguacgucaagaacacgcacgccaccacccacaacgccuacgaccucgaggugaucgacaucuucaagaucgagcgcgagggggagugccagcgguacaagcccuucaagcagcugcacaaccgccggcugcucuggcacggcagccgcaccacgaacuucgccgggauccugucccagggccugcggaucgcgccgcccgaggcccccgugaccggguacauguucggcaagggcaucuacuucgccgacauggucagcaaguccgccaacuacugccacaccagccagggggaccccaucggccucauccugcugggggagguggcccucggcaacauguacgagcugaagcacgcgucccacaucagcaagcugccgaaggggaagcacuccgugaagggccucggcaagaccacgcccgaccccagcgccaacaucucccuggacggggucgacgugccccugggcaccgggaucagcagcggcgugaacgacaccucccuccuguacaacgaguacaucgucuacgacaucgcccaggugaaccugaaguaccuccugaagcugaaguucaacuucaagaccagccucugguga

SEQ ID NO: 34251 - RNA, 1713 nt, Artificial Sequence
  derived and/or modified sequence opt1 from PARP2__Homo_sapiens__NP_001036083
auggccgcccgccggcgccggagcaccggcgggggccgcgcgcgggcccugaacgaguccaagcgcgugaacaacgggaacaccgcccccgaggacagcuccccggccaagaagacgcggcgcugccagcggcaggagagcaagaagaugcccgucgccggcgggaaggcgaacaaggaccgcaccgaggacaagcaggacgaguccgugaaggcccuccugcugaagggcaaggcccccguggaccccgagugcaccgccaaggucggcaaggcgcacguguacugcgaggggaacgacguguacgacgucaugcucaaccagaccaaccugcaguucaacaacaacaaguacuaccugauccagcuccuggaggacgacgcccagcggaacuucagcguguggaugcgcuggggccggguggggaagaugggccagcacucccuggucgccugcagcgggaaccucaacaaggccaaggagaucuuccagaagaaguuccuggacaagacgaagaacaacugggaggaccgcgagaaguucgagaaggugccgggcaaguacgacaugcugcagauggacuacgccaccaacacccaggacgaggaggagaccaagaaggaggagucccucaagagcccccugaagcccgagucccagcuggaccuccgggugcaggagcugaucaagcugaucugcaacguccaggcgauggaggagaugaugauggagaugaaguacaacacgaagaaggcgccccucggcaagcugaccguggcccagaucaaggccggguaccagagccugaagaagaucgaggacugcauccgcgccggccagcacgggcgggcccucauggaggccugcaacgaguucuacacccgcaucccgcacgacuucggccugcggaccccgccccugauccgcacgcagaaggagcucuccgagaagauccagcugcuggaggcccucggcgacaucgagaucgccaucaagcuggugaagaccgagcugcagagccccgagcacccccucgaccagcacuaccggaaccugcacugcgcccugcgcccccucgaccacgaguccuacgaguucaaggucaucagccaguaccugcaguccacccacgcgcccacccacagcgacuacacgaugacccugcucgaccuguucgagguggagaaggacggggagaaggaggccuuccgcgaggaccugcacaaccggaugcuccuguggcacggcucccgcaugagcaacuggguggggauccugagccacggccuccggaucgcgcccccggaggcccccaucaccggguacauguucggcaagggcaucuacuucgccgacauguccagcaaguccgccaacuacugcuucgccagccgccugaagaacaccgggcugcuccugcuguccgaggucgcccucggccagugcaacgagcugcuggaggccaaccccaaggcggaggggcugcuccagggcaagcacagcacgaaggggcugggcaagauggcccccuccagcgcccacuucgugacccugaacggcuccaccgugccgcucgggcccgccagcgacaccggcauccugaaccccgacggguacacgcugaacuacaacgaguacaucgucuacaaccccaaccaggugcggaugcgcuaccuccugaaggugcaguucaacuuccugcagcucugguga

SEQ ID NO: 34252 - RNA, 1623 nt, Artificial Sequence
  derived and/or modified sequence opt1 from PARP3__Homo_sapiens__NP_001003931
augagccuccuguuccuggccauggcccccaagccgaagcccugggugcagaccgagggccccgagaagaagaaggggcgccaggcgggccgggaggaggaccccuuccgcuccaccgccgaggcccugaaggccaucccggccgagaagcggaucauccgcgucgaccccacgugcccccucagcuccaaccccgggacccagguguacgaggacuacaacugcacccugaaccagaccaacaucgagaacaacaacaacaaguucuacaucauccagcugcuccaggacagcaaccgguucuucacgugcuggaaccgcuggggccgggugggggaggucggccaguccaagaucaaccacuucacccgccuggaggacgcgaagaaggacuucgagaagaaguuccgggagaagaccaagaacaacugggccgagcgcgaccacuucgugagccacccgggcaaguacacccugaucgaggugcaggccgaggacgaggcccaggaggcggucgugaagguggaccgggggcccguccgcacggugaccaagcgggugcagcccugcucccucgaccccgccacccagaagcugaucaccaacaucuucagcaaggagauguucaagaacacgauggcccugauggaccucgacgucaagaagaugccgcugggcaagcuguccaagcagcagaucgcccgcggguucgaggcccucgaggcgcuggaggaggcccugaagggccccaccgacgggggccagagccucgaggagcuguccagccacuucuacaccgugaucccccacaacuucggccacucccagcccccgcccaucaacagccccgagcugcuccaggccaagaaggacaugcugcuggugcucgccgacaucgagcuggcccaggcgcugcaggccgucuccgagcaggagaagaccguggaggaggugccccacccgcucgaccgggacuaccagcugcugaagugccagcuccagcugcuggacagcggggcccccgaguacaaggucauccagacguaccucgagcagaccggcuccaaccaccgcugccccacccugcagcacaucuggaaggugaaccaggagggggaggaggaccgguuccaggcccacagcaagcugggcaaccgcaagcuccuguggcacggcaccaacauggccguggucgcggccauccugacguccgggcuccggaucaugccccacagcggcgggcgcgugggcaaggggaucuacuucgccagcgagaacuccaagagcgccggcuacgugaucggcaugaagugcggggcccaccacgucggcuacauguuccugggggagguggcgcugggccgggagcaccacaucaacaccgacaacccgucccucaagagcccgccgcccggguucgacuccgucaucgcccgcggccacaccgagcccgaccccacccaggacacggagcuggagcuggacggccagcaggucguggugccccaggggcagcccgugcccugccccgaguucagcuccagcaccuucucccagagcgaguaccucaucuaccaggagucccagugccgccugcgguaccugcucgaggugcaccuguga

SEQ ID NO: 34253 - RNA, 5175 nt, Artificial Sequence
  derived and/or modified sequence opt1 from PARP4__Homo_sapiens__NP_006428
auggugaugggcaucuucgccaacugcaucuucugccugaaggucaaguaccucccccagcagcagaagaagaagcugcagaccgacaucaaggagaacgggggcaaguucagcuucagccugaacccccagugcacccacaucauccucgacaacgccgacgugcugagccaguaccagcugaacuccauccagaagaaccacgugcacaucgccaaccccgacuucaucuggaaguccauccgggagaagcggcuccuggacgucaagaacuacgaccccuacaagccccuggacaucacgccgccgcccgaccagaaggccuccagcuccgaggugaagaccgaggggcucugccccgacagcgccaccgaggaggaggacaccguggagcugacggaguucggcaugcagaacgucgagaucccgcaccucccccaggacuucgagguggccaaguacaacacccucgagaagguggggauggagggcggccaggaggccgucgugguggagcugcagugcucccgggacagccgggacugccccuuccugaucuccagccacuuccuccuggacgacgggauggagacccgccggcaguucgccaucaagaagaccuccgaggacgccagcgaguacuucgagaacuacaucgaggagcugaagaagcagggcuuccuccugcgcgagcacuucacgcccgaggccacccagcuggccuccgagcagcuccaggcgcugcugcucgaggaggucaugaacagcuccacccugagccaggagguguccgaccugguggagaugaucugggccgaggcccucgggcaccuggagcacaugcugcucaagccggucaaccggaucagccugaacgacgugagcaaggccgagggcauccugcuccuggugaaggccgcgcugaagaacggggagaccgccgagcagcuccagaagaugaugacggaguucuaccgccugaucccccacaagggcaccaugcccaaggaggucaaccugggccuccuggccaagaaggccgaccugugccagcucauccgggacauggugaacgugugcgagaccaaccuguccaagcccaacccgcccagccuggccaaguaccgcgcgcuccggugcaagaucgagcacgucgagcagaacaccgaggaguuccugcgcgugcggaaggaggugcugcagaaccaccacuccaagagccccgucgacgugcuccagaucuuccgcgucgggcgggugaacgagacgaccgaguuccuguccaagcugggcaacgugcgcccccugcuccacgggagcccgguccagaacaucgugggcauccugugccggggccugcuccugcccaagguggucgaggaccgcggggugcagcggaccgacgugggcaaccugggguccggcaucuacuucagcgacucccucagcaccuccaucaaguacagccaccccggggagacggacggcacccgccugcugcucaucugcgacgucgcccugggcaagugcauggaccugcacgagaaggacuucucccucaccgaggcgccgcccggguacgacagcgugcacggcgugucccagaccgccagcgucacgaccgacuucgaggacgacgaguucgugguguacaagaccaaccaggucaagaugaaguacaucaucaaguucuccaugcccggggaccagaucaaggacuuccaccccagcgaccacaccgagcuggaggaguaccggcccgaguucuccaacuucagcaagguggaggacuaccagcugcccgacgccaagacgagcuccagcaccaaggcgggccuccaggacgccuccgggaaccuggugccccuggaggacguccacaucaagggccgcaucaucgacaccguggcccaggugaucgucuuccagaccuacacgaacaagagccacgugcccaucgaggccaaguacaucuucccgcucgacgacaaggccgcggugugcggcuucgaggccuucaucaacgggaagcacaucgucggcgagaucaaggagaaggaggaggcccagcaggaguaccuggaggccgugacccaggggcacggcgcguaccugaugucccaggacgcccccgacguguucaccgucagcguggggaaccugccgcccaaggccaaggugcugaucaagaucaccuacaucacggagcuguccauccucggcaccgucggcguguucuucaugccggccaccguggcccccuggcagcaggacaaggcgcugaacgagaaccugcaggacaccgucgagaagaucugcaucaaggagaucgggaccaagcagagcuucucccucacgaugagcaucgagaugcccuacgugaucgaguucaucuucuccgacacccacgagcugaagcagaagcgcaccgacugcaaggccgugaucagcaccauggagggcuccagccuggacuccagcggguucucccuccacaucggccugagcgccgccuaccugccccggaugugggucgagaagcacccggagaaggagagcgaggccugcaugcucguguuccagcccgaccuggacguggaccugcccgaccucgcguccgagagcgaggucaucaucugccuggacugcuccagcuccauggagggcgugacguuccugcaggccaagcagaucgcccuccacgcccugagccuggugggggagaagcagaaggucaacaucauccaguucggcaccggguacaaggagcuguucuccuaccccaagcacaucaccagcaacaccauggccgcggaguucaucauguccgccacgccgaccaugggcaacaccgacuucuggaagacccugcgcuaccugagccuccuguaccccgcccgggggucccgcaacauccugcucgugagcgacggccaccuccaggacgagucccugacgcuccagcuggugaagcggagccgcccccacacccggcuguucgccugcggcaucggguccaccgcgaaccgccacguccuccggauccugagccagugcggcgccgggguguucgaguacuucaacgccaaguccaagcacagcuggcgcaagcagaucgaggaccagaugacccggcugugcucccccagcugccacagcguguccgucaaguggcagcagcucaacccggacgugcccgaggcccugcaggcccccgcccaggugcccagccuguuccucaacgaccgccugcuggucuacggcuucaucccgcacugcacgcaggccacccucugcgcccugauccaggagaaggaguuccggaccaugguguccaccacggagcugcagaagaccaccgggaccaugauccacaagcucgccgcccgcgcgcugauccgggacuacgaggacggcauccugcacgagaacgagacgagccacgagaugaagaagcagacccucaagucccugaucaucaagcugagcaaggagaacucccucaucacccaguucaccagcuucgucgccguggagaagcgcgacgagaacgagucccccuuccccgacauccccaaggugagcgagcugaucgccaaggaggacgucgacuuccugccguacauguccuggcagggcgagccccaggaggccgugcggaaccagagccuccuggccuccagcgaguggcccgagcugcgccucuccaagcggaagcaccgcaagaucccguucagcaagcgcaagauggagcugucccagcccgaggugagcgaggacuucgaggaggacgggcugggcguccuccccgcguucacguccaaccuggagcgcggcggcguggagaagcugcucgaccugagcuggaccgagagcugcaagcccaccgccaccgagccgcuguucaagaaggugucccccugggagacgagcaccuccagcuucuuccccauccucgcccccgccgucggguccuaccugccgcccaccgcgcgcgcccacagccccgccucccugagcuucgccuccuaccgccagguggccagcuucggcuccgcggcgccgccccgccaguucgacgccagccaguucucccagggccccgugcccgggaccugcgccgacuggaucccccagagcgccuccugccccacggggccgccccagaacccgcccagcucccccuacugcgggaucgucuucagcggcuccagccucagcuccgcgcagagcgcgccccugcagcaccccgggggcuucaccacccggccguccgccggcaccuuccccgagcuggacagcccccagcuccacuucucccugcccaccgacccggaccccauccgcggguucggcagcuaccaccccuccgccagcuccccguuccacuuccagcccagcgccgcgucccugacggccaaccugcggcuccccauggccagcgcccugcccgaggcccugugcucccagagccgcaccaccccgguggaccucugccugcuggaggaguccguggggagccucgagggcucccggugccccgucuucgcguuccagagcuccgacaccgagagcgacgagcugagcgaggugcugcaggacuccugcuuccuccagaucaagugcgacacgaaggacgacagcauccugugcuuccuggaggugaaggaggaggacgagaucgucugcauccagcacuggcaggacgccgugcccuggaccgagcuccugucccugcagaccgaggacggcuucuggaagcucacccccgagcuggggcugauccucaaccugaacacgaacggccugcacagcuuccucaagcagaaggggauccagucccugggcgugaaggggcgcgagugccugcucgaccugaucgccaccaugcugguccuccaguucauccggacccgccuggagaaggagggcaucguguucaagagccugaugaagauggacgacgccuccaucagccggaacaucccgugggcguucgaggccaucaagcaggccuccgagugggugcgccggaccgagggccaguaccccagcaucugcccccgccucgagcuggggaacgacugggacuccgccacgaagcagcugcucggccugcagcccaucagcaccgucuccccgcugcaccgggugcuccacuacagccagggguga

SEQ ID NO: 34254 - RNA, 1893 nt, Artificial Sequence
  derived and/or modified sequence opt1 from PARP6__Homo_sapiens__NP_064599
auggacaucaagggccaguucuggaacgacgacgacagcgagggggacaacgaguccgaggaguuccuguacggcgugcaggggagcugcgccgccgaccucuaccgccacccccagcuggacgcggacaucgaggccgucaaggagaucuacuccgagaacagcguguccauccgggaguacggcaccaucgacgacguggacaucgaccugcacaucaacaucagcuuccucgacgaggaggucuccaccgccuggaaggugcugcgcacggagccgaucgugcugcggcuccgcuucagccugucccaguaccuggacgggcccgagcccagcaucgaggucuuccagcccuccaacaaggagggcuucggccucgggcugcagcugaagaagauccucggcauguucaccagccagcaguggaagcaccuguccaacgacuuccugaagacccagcaggagaagcggcacagcugguucaaggccuccgggaccaucaagaaguuccgcgccggccucagcaucuucuccccgauccccaagagccccuccuuccccaucauccaggacagcaugcugaaggggaagcugggcgugccggagcuccgggugggccgccugaugaaccggagcaucuccugcacgaugaagaaccccaaggucgagguguucggguacccgcccagcccccaggcgggccugcucugcccccagcacguggggcugcccccgcccgcccgcaccagcccccuggucuccggccacugcaagaacauccccacccucgaguacggcuuccuggugcagaucaugaaguacgccgagcagcggauccccacccugaacgaguacugcguggucugcgacgagcagcacguguuccagaacggguccaugcucaagccggccgugugcacgcgcgagcugugcgucuucagcuucuacacccugggcgugauguccggggcggccgaggagguggccaccggcgccgaggucguggaccuccugguggccaugugccgggcggcccuggagagcccccgcaaguccaucaucuucgagcccuaccccagcgucguggacccgaccgaccccaagacgcucgccuucaaccccaagaagaagaacuacgagcggcugcagaaggcccuggacuccgucaugagcauccgcgagaugacccagggguccuaccucgagaucaagaagcagauggacaagcuggacccccuggcccacccgcuccugcaguggaucaucagcuccaaccggagccacaucgugaagcugccccucucccgccugaaguucaugcacaccagccaccaguuccugcuccuguccagcccgcccgcgaaggaggcccgguuccgcaccgccaagaagcuguacggcagcacguucgccuuccacggcucccacaucgagaacuggcacagcauccuccggaacgggcuggugaacgccuccuacaccaagcugcagcugcacggcgcggccuacgggaagggcaucuaccucagccccaucuccagcaucuccuucggguacagcggcaugggcaaggggcagcaccgcaugcccuccaaggacgagcugguccagcgcuacaaccggaugaacaccaucccccagacccgcagcauccagucccgguuccugcagagccgcaaccucaacugcaucgcccugugcgaggugaucacguccaaggaccugcagaagcacggcaacaucugggugugcccggucagcgaccacgugugcacccgguucuucuucguguacgaggacgggcaggucggcgacgccaacaucaacacccaggaccccaagauccagaaggagaucaugcgcgugaucgggacccagguguacacgaacuga

SEQ ID NO: 34255 - RNA, 2565 nt, Artificial Sequence
  derived and/or modified sequence opt1 from PARP9__Homo_sapiens__NP_001139574
auggacuucagcaugguggccggcgccgcggccuacaacgagaaguccgggcgcaucaccagccugucccuccuguuccagaaggucuucgcccagaucuucccccaguggcggaagggcaacaccgaggagugccugccguacaagugcagcgagacgggggcccucggcgagaacuacuccuggcagauccccaucaaccacaacgacuucaagauccugaagaacaacgagcgccagcugugcgaggugcuccagaacaaguucgggugcaucagcacccuggugucccccguccaggagggcaacagcaagucccuccagguguuccggaagaugcugacgccccgcaucgagcugagcguguggaaggacgaccugaccacccacgccgucgacgcgguggugaacgccgccaacgaggaccuccugcacggcgggggccuggcccucgcgcuggucaaggccgggggcuucgagauccaggaggaguccaagcaguucguggcccgguacgggaaggugagcgccggcgagaucgccgucaccggcgcggggcgccugccgugcaagcagaucauccacgccgugggcccccgguggauggagugggacaagcaggggugcaccggcaagcuccagcgcgccaucguguccauccugaacuacgucaucuacaagaacacccacaucaagacgguggccauccccgcccugagcuccggcaucuuccaguucccccucaaccugugcaccaagaccaucguggagaccauccgggucagccugcaggggaagccgaugauguccaaccucaaggagauccaccuggugagcaacgaggaccccacgguggcggccuucaaggccgccuccgaguucauccugggcaagagcgagcucgggcaggagaccacccccagcuucaacgccauggucgugaacaaccugacccugcagaucgugcagggccacaucgaguggcagacggcggacgucaucgugaacuccgucaacccccacgacaucaccguggggccgguggccaagagcauccuccagcaggccggcgucgagaugaaguccgaguuccuggccaccaaggccaagcaguuccagcgcagccagcuggugcucgugaccaagggcuucaaccuguucugcaaguacaucuaccacguccuguggcacuccgaguuccccaagccccagauccucaagcacgcgaugaaggagugccuggagaagugcaucgagcagaacaucacgagcaucuccuuccccgcccuggggaccggcaacauggagaucaagaaggagaccgccgccgagauccucuucgacgaggugcugaccuucgcgaaggaccacgugaagcaccagcugacggucaaguucgugaucuucccgaccgaccucgagaucuacaaggccuucagcuccgagauggccaagcggagcaagaugcugucccugaacaacuacagcgugccccaguccacccgcgaggagaagcgggagaacgggcucgaggcccgcagccccgccaucaaccugaugggcuucaacgucgaggagauguacgaggcgcacgccuggauccagcggauccugucccuccagaaccaccacaucaucgagaacaaccacauccuguaccuggggcgcaaggagcacgacauccugagccagcuccagaagaccuccagcguguccaucacggagaucaucagccccggccggaccgagcuggagaucgagggcgcccgcgccgaccugaucgagguggucaugaacaucgaggacaugcucugcaaggugcaggaggagauggcccggaagaaggagcgcgggcuguggcggagccugggccaguggaccauccagcagcagaagacccaggacgagaugaaggagaacaucaucuuccucaagugcccggugccgcccacgcaggagcugcuggaccagaagaagcaguucgagaagugcgggcuccagguccugaagguggagaagaucgacaacgaggugcugauggcggccuuccagcgcaagaagaagaugauggaggagaagcuccaccgccagcccgucucccaccggcuguuccagcagguccccuaccaguucugcaacguggugugccgcgugggcuuccagcggauguacagcacccccugcgaccccaaguacggggccggcaucuacuucaccaagaaccugaagaaccucgccgagaaggccaagaagaucuccgcggccgacaagcugaucuacguguucgaggccgagguccugaccggcuucuucugccaggggcacccccucaacaucgugccgccgccccugagccccggcgccaucgacgggcacgacuccguggucgacaacgugagcucccccgagacguucgugaucuucagcggcaugcaggcgaucccccaguaccuguggaccugcacccaggaguacguccagucccaggacuacagcuccggccccaugcgcccguucgcccagcaccccuggcggggguucgccagcggcucccccguggacuga

SEQ ID NO: 34256 - RNA, 1752 nt, Artificial Sequence
  derived and/or modified sequence opt1 from PARPBP__Homo_sapiens__XP_011536808
auggagcugaucauggccguguucaaccagaaguccgucagcgacaugaucaaggaguuccgcaagaacuggcgggcccucugcaacagcgagcgcaccacccugugcggcgcggacuccaugcugcucgcccugcagcugagcauggccgagaacaacaagcagcacuccggggaguucacggugagccucuccgacgugcugcugaccuggaaguaccuccugcacgagaagcugaaccuccccgucgagaacauggacgugaccgaccacuacgaggacgugcggaagaucuacgacgacuuccugaagaacagcaacaugcuggaccucaucgacgucuaccagaagugccgcgcccugaccuccaacugcgagaacuacaacacggugagcccgucccagcugcucgacuuccugagcggcaagcaguacgccgugggggacgagaccgaccuguccauccccaccagccccaccuccaaguacaaccgggacaacgagaagguccagcuccuggcgcgcaagaucaucuucagcuaccugaaccuccuggugaacuccaagaacgaccuggccguggccuacauccucaacauccccgaccggggccuggggcgcgaggccuucacggaccugaagcacgcggcccgggagaagcagaugagcaucuuccucgucgccaccuccuucauccgcaccaucgagcugggcggcaagggguacgccccgccgcccagcgacccccugcggacccacgugaagggccucagcaacuucaucaacuucaucgacaagcuggacgagauccugggggagauccccaaccccuccaucgccggcgggcagauccucagcgugaucaagaugcagcugaucaagggccagaacucccgcgaccccuucugcaaggcgaucgaggaggucgcccaggaccuggaccuccggaucaagaacaucaucaacagccaggagggcgugguggcccuguccacgaccgacaucagccccgcccgcccgaagucccacgccaucaaccacgggaccgcguacugcggccgggacaccgucaaggcccugcucgugcugcuggacgaggaggccgccaacgcccccacgaagaacaaggcggagcuccuguacgacgaggagaacaccauccaccaccacgggaccagcauccugacccucuuccgcucccccacccaggugaacaacagcaucaagccccugcgggagcgcaucugcgucuccaugcaggagaagaagaucaagaugaagcagacgcugauccggagccaguucgccugcaccuacaaggacgacuacaugaucuccaaggacaacuggaacaacgugaaccuggccagcaagccgcucugcgugcuguacauggagaacgaccuguccgagggcgucaaccccagcgugggccgcuccaccaucgggacgagcuucggcaacguccaccucgaccgguccaagaacgagaaggugagccgcaagagcaccucccagaccgggaacaagagcuccaagcgcaagcaggucgaccuggacggcgagaacauccugugcgacaaccggaacgagccgccccagcacaagaacgccaagauccccaagaaguccaacgacagccagaaccgccucuacgggaagcuggccaagguggccaagagcaacaagugcaccgcgaaggacaagcugaucuccggccaggccaagcucacgcaguucuuccggcuguga

SEQ ID NO: 34257 - RNA, 1605 nt, Artificial Sequence
  derived and/or modified sequence opt1 from PARS2__Homo_sapiens__XP_011539505
augcgcgccgcccugcccggccucagccuggggcggcgcgagucccacaccgugcuggaggucccggcgcucgagcggcccugggaccaccuccugcccgagcccgccuucccguucuacgugggcgagaacgggggccccgggcgcagcgccugcgccucccggugccagggcgugauggagggccugcugacccgcugccgggcccugcccgcgcucgccacgugcagccgccagcuguccggguacguccccugccgguuccaccacugcgccccgcgccggggccgccggcugcuccugagccgcguguuccagccccagaaccugcgggaggaccgcgugcucucccugcaggacaagagcgacgaccugaccugcaagucccagcggcucaugcugcaggucgggcugaucuaccccgccagccccggcugcuaccaccuccugccguacaccgugcgcgcgauggagaagcuggugcgggucaucgaccaggagaugcaggccaucgggggccagaaggugaacaugcccucccucagccccgccgagcuguggcaggccaccaaccgcugggaccugaugggcaaggagcuccugcggcugcgcgaccgccacgggaaggaguacugccucggccccacgcacgaggaggccaucaccgcgcugaucgccucccagaagaagcugagcuacaagcagcucccguuccugcuguaccaggugacccggaaguuccgcgacgagccccggccccgcuucgggcuccugcggggccgcgaguucuacaugaaggacauguacaccuucgacuccagccccgaggccgcccagcagacguacucccuggucugcgacgccuacugcagccucuucaacaagcugggccugccguucgugaaggugcaggcggacgucgggaccaucggcgggaccgugucccacgaguuccagcuccccguggacaucggcgaggaccggcuggccaucugcccccgcugcagcuucagcgccaacauggagacccuggaccucucccagaugaacugccccgccugccaggggccgcugacgaagaccaagggcaucgaggucggccacaccuucuaccuggggaccaaguacagcuccaucuucaacgcccaguucacgaacgugugcggcaagcccacccucgcggagauggggugcuacggccugggggugacccggauccuggccgccgccaucgagguccugagcaccgaggacugcgugcgcuggcccucccuccuggcccccuaccaggcgugccugaucccgcccaagaagggcagcaaggagcaggccgccuccgagcucaucggccagcuguacgaccacaucacggaggccgugccccagcugcacggggagguccuccuggacgaccggacccaccugaccaucggcaaccgccucaaggacgcgaacaaguucggguacccguucgugaucaucgccggcaagcgggcccuggaggaccccgcccacuucgaggucuggugccagaacaccggggagguggccuuccugacgaaggacggcgugauggaccuccugacccccguccagaccguguga

SEQ ID NO: 34258 - RNA, 1239 nt, Artificial Sequence
  derived and/or modified sequence opt1 from PARVA__Homo_sapiens__NP_060692
augcugggcaucaucccccucccguucgggaagccccagccccagagccgccggcgcccccugcggccgcccuccgccagcuccgccagccgccccgcgcggggcucccugcgccgggccauggccaccagcccccagaaguccccgagcgugcccaagucccccacccccaagagcccgcccucccgcaagaaggacgacagcuuccucgggaagcugggcgggacgcuggcccggcgcaagaaggccaaggaggucuccgagcuccaggaggagggcaugaacgcgaucaaccugccccugagccccaucccguucgagcucgaccccgaggacaccaugcuggaggagaacgaggugcggaccaugguggaccccaacucccgcagcgaccccaagcugcaggagcucaugaagguccugaucgacuggaucaacgacgugcuggugggcgagcggaucaucgucaaggaccucgccgaggaccuguacgacggccaggugcugcagaagcuguucgagaagcuggaguccgagaagcugaacguggccgaggucacccagagcgagaucgcccagaagcagaagcuccagacggugcuggagaagaucaacgagacccugaagcucccgccccgcuccaucaaguggaacguggacagcguccacgccaagagccugguggcgauccugcaccuccugguggcccugucccaguacuuccgggcccccauccgccuccccgaccacgucagcauccaggugguggucgugcagaagcgggaggggauccugcagucccgccagauccaggaggagaucaccgggaacaccgaggcccugagcggccggcacgagcgcgacgcguucgacacccucuucgaccacgccccggacaagcugaacguggucaagaagacgcugaucaccuucgugaacaagcaccucaacaagcugaaccuggaggugaccgagcucgagacgcaguucgccgacggggucuaccuggugcugcucaugggccugcuggagggcuacuucgucccccuccacuccuucuuccugacccccgacagcuucgagcagaaggugcugaacguguccuucgccuucgagcucaugcaggacgggggccuggagaagcccaagccgcggcccgaggacaucgucaacugcgaccucaagagcacccugcgcgugcucuacaaccuguucaccaaguaccgcaacguggaguga

SEQ ID NO: 34259 - RNA, 1194 nt, Artificial Sequence
  derived and/or modified sequence opt1 from PARVB__Homo_sapiens__NP_001003828
augcaccacguguucaaggaccaccagcgcggcgagaagcggggguuccugagccccgagaacaagaacugccgccggcucgagcugcgccggggcugcuccugcagcugggggcugugcucccaggcccucauggccagccuggcgggcucccugcucccggggagcgaccgcuccggcgucgagaccagcgaguacgcccagggcgggguguccgaccugcaggaggagggcaagaacgccaucaacagccccaugucccccgcccugguggacguccaccccgaggacacccagcucgaggagaacgaggagcggacgaugaucgacccgaccagcaaggaggaccccaaguucaaggagcuggugaaggugcugcucgacuggaucaacgacguccugguggaggagcgcaucaucgugaagcagcuggaggaggaccucuacgacgggcagguccugcagaagcugcucgagaagcuggccggcugcaagcugaacguggcggaggugacccaguccgagaucgggcagaagcagaagcuccagaccguccuggaggccgugcacgaccugcuccggccccgcggcugggcccugcgguggagcguggacuccauccacggcaagaaccuggucgccauccuccaccuccuggugagccuggcgaugcacuuccgcgcccccauccggcugccggagcacgugacgguccaggugguggucgugcgcaagcgggaggggcugcuccacuccagccacaucuccgaggagcugaccaccaccacggagaugaugaugggccgcuucgagcgggacgccuucgacacccuguucgaccacgcccccgacaagcucagcguggucaagaagucccugaucaccuucgugaacaagcaccugaacaagcucaaccuggaggucaccgagcuggagacgcaguucgccgacgggguguaccucgugcugcugaugggccuccuggaggacuacuucgucccccugcaccacuucuaccucacccccgagagcuucgaccagaaggugcacaacgugagcuucgcguucgagcugaugcuggacggcgggcugaagaagccgaaggcccgccccgaggacgucgugaaccucgaccugaaguccacccugcgggugcucuacaaccuguucaccaaguacaagaacgucgaguga

SEQ ID NO: 34260 - RNA, 996 nt, Artificial Sequence
  derived and/or modified sequence opt1 from PARVG__Homo_sapiens__NP_001131077
auggagcccgaguuccuguacgaccuccugcagcugccgaagggcguggagccgcccgccgaggaggagcucagcaagggcgggaagaagaaguaccugccgcccaccucccgcaaggaccccaaguucgaggagcugcagaagguccucauggaguggaucaacgccacccugcugcccgagcacaucguggugcggagccucgaggaggacauguucgacgggcugauccugcaccaccucuuccagcgccuggcggcccugaagcucgaggccgaggacaucgcccugacggccaccucccagaagcacaagcugaccgucgugcucgaggcggugaaccggagccugcagcuggaggaguggcaggccaagugguccgucgagagcaucuucaacaaggaccuccuguccacccugcaccuccugguggcccuggccaagcgcuuccagcccgaccucagccugcccacgaacgugcaggucgaggugaucaccaucgaguccaccaagagcggccugaaguccgagaagcucguggagcagcugaccgaguacagcacggacaaggacgagccgcccaaggacgucuucgacgagcuguucaagcucgcgcccgagaaggugaacgccgugaaggaggccaucgucaacuucgugaaccagaagcuggaccggcuggggcucuccgugcagaaccuggacacccaguucgccgacggcgucauccugcuccugcugaucggccagcucgagggguucuuccugcaccugaaggaguucuaccucacccccaacagccccgccgagaugcugcacaacgugacccuggcgcucgagcugcugaaggacgagggccugcucuccugccccgugagccccgaggacaucgucaacaaggacgccaaguccacgcugcgcgugcuguacggccucuucugcaagcacacccagaaggcccaccgggaccgcaccccgcacggggcccccaacuga

SEQ ID NO: 34261 - RNA, 2322 nt, Artificial Sequence
  derived and/or modified sequence opt1 from PASD1__Homo_sapiens__NP_775764
augaagaugcgcggcgagaagcggcgcgacaaggugaaccccaagagcucccagcggaagcugaacuggaucccgagcuuccccaccuacgacuacuucaaccaggucacccuccagcugcuggacggguucaugaucacgcucuccaccgacggcgugaucaucugcguggccgagaacaucagcucccugcuggggcaccuccccgccgagaucgucggcaagaagcugcugagccuccugcccgacgaggagaaggacgagguguaccagaagaucauccugaaguucccgcuccugaacuccgagacccacaucgaguucugcugccaccugaagcgcgggaacguggagcacggcgacagcuccgcguacgagaacgucaaguucaucgugaacgugcgggacaucugcaacgaguuccccgucguguucagcggccucuucuccagccaccugugcgccgacuucgccgccugcgugccccaggaggaccgccuguaccucgucgggaacgugugcauccugcggacccagcugcuccagcagcuguacacguccaaggccgugagcgacgaggcgguccugacccaggacuccgacgaggagcccuucgugggcgagcucagcuccagccaggggcagcgcggccacaccuccaugaaggccguguacgucgagccggccgccgcggccgccgccgccgcgaucagcgacgaccagaucgacaucgccgagguggagcaguacgggccccaggagaacgugcacauguucgucgacagcgacuccaccuacugcagcuccacgguguuccuggacaccaugcccgagagccccgcccugucccuccaggacuuccggggcgagccggaggugaacccccuguaccgcgccgaccccgucgaccuggaguucagcguggaccaggucgacuccguggaccaggagggccccauggaccagcaggacccggagaaccccguggcgccccucgaccaggccgggcugauggaccccgucgacccggaggacagcguggaccugggcgccgccggggccuccgcccagccccuccagcccagcucccccguggcguacgacaucaucagccaggagcuggagcugaugaagaagcucaaggagcagcuggaggagcggaccuggcugcuccacgacgccauccagaaccagcagaacgcccuggagcugaugauggaccaccuccagaagcagccgaacacccugcgccacgucgugauccccgaccugcaguccagcgaggccgugcccaagaagcagcagaagcagcacgccggccaggucaagcggccccucccgcaccccaaggacgugaagugcuucugcggccugucccugagcaacucccucaagaacacgggggagcugcaggagcccugcguggcguucaaccagcagcagcugguccagcaggagcagcaccugaaggagcagcagcgccagcuccgggagcagcugcagcagcugcgcgagcagcggaaggugcagaagcagaagaagaugcaggagaagaagaagcuccaggagcagaagaugcaggagaagaagaagcugcaggagcagcgccggcagaagaagaagaagcugcaggagcgcaagaaguggcagggccagaugcuccagaaggagccggaggaggagcagcagaagcagcagcugcaggagcagccccugaagcacaacgugaucgucgggaacgagcgggugcagaucugccuccagaacccccgcgacgugagcgucccccugugcaaccacccggugcgcuuccugcaggcccagcccaucgugcccguccagcgggccgccgagcagcagcccuccggcuucuaccaggacgagaacugcgggcagcaggaggacgagagccagagcuucuacccggaggcguaccagggcccgcccgugaaccagcucccccugaucgacaccuccaacagcgaggccaucuccagcuccagcaucccccaguuccccaucaccuccgacagcaccaucuccacgcuggagacgccccaggacuacauccgccucuggcaggagcugagcgacucccugggccccgugguccaggugaacaccuggagcugcgacgagcaggggacccuccacggccagccgaccuaccaccaggugcaggucuccgagguggggguggagggcccgcccgacccccaggccuuccaggggcccgccgccuaccagcccgaccagaugcggagcgcggagcagacccgccugaugcccgccgagcagcgggacuccaacaagcccugcuga

SEQ ID NO: 34262 - RNA, 3993 nt, Artificial Sequence
  derived and/or modified sequence opt1 from PASK__Homo_sapiens__NP_001239048
auggaggacggcgggcugaccgccuucgaggaggaccagcgcugccucagccagucccugccccugccggugagcgccgagggccccgcggcccagaccacggccgagcccucccggagcuucuccagcgcccaccgccaccucucccggcgcaacgggcugagccggcugugccagucccgcaccgcccucagcgaggaccggugguccagcuacugccuguccagccuggcggcccagaacaucugcaccuccaagcuccacugccccgccgccccggagcacaccgaccccagcgagccccgcggcuccgucagcugcugcucccugcugcgggggcucagcagcggcugguccagcccccugcugccggcgcccgugugcaaccccaacaaggccaucuucacgguggacgccaagaccaccgagauccucgucgccaacgacaaggccugcggccugcugggguacuccagccaggaccucaucggccagaagcugacccaguucuuccugcgcuccgacagcgacgugguggaggcgcucuccgaggagcacauggaggccgacgggcacgccgccgucguguucggcacgguggucgacaucaucagccgguccggggagaagauccccgugagcguguggaugaagcgcaugcggcaggagcgccggcugugcugcgucguggugcuggagccggucgagcgcguguccaccuggguggccuuccagagcgacggcaccgucaccuccugcgacagccucuucgcgcaccuccacggcuacguguccggggaggacguggccggccagcacaucacggaccugauccccagcguccagcucccgcccuccgggcagcacauccccaagaaccugaagauccagcggagcgugggccgcgcccgggacggcaccaccuucccccugucccucaagcucaagagccagcccagcuccgaggaggccaccacgggggaggccgcgcccgugagcggcuaccgcgccuccgucuggguguucugcaccaucagcgggcugaucacccugcugccggacggcaccauccacgggaucaaccacuccuucgcccugacccucuucggcuacggcaagaccgagcugcuggggaagaacaucaccuuccucauccccggcuucuacagcuacauggaccuggccuacaacuccagccugcagcuccccgaccuggccuccugccuggacgucgggaacgagagcggcugcggggagcggacccucgaccccuggcagggccaggacccggcggagggcgggcaggacccccgcaucaacguggugcuggccggcgggcacgucgugccccgcgacgagauccggaagcugauggagucccaggacaucuucacgggcacccagaccgagcucaucgccgggggccagcugcugagcugccugagcccccagccggcccccggcguggacaacguccccgaggggucccucccggugcacggcgagcaggcgcugcccaaggaccagcagaucaccgcccuggggcgcgaggagcccguggccaucgagucccccggccaggaccuccugggcgagagccgguccgagccggucgacgugaagcccuucgccagcugcgaggacagcgaggcccccgugcccgcggaggacgggggcuccgacgccgggaugugcggccugugccagaaggcccagcucgagcgcaugggggucagcggcccguccggcagcgaccugugggccggggccgcgguggccaagccccaggccaagggccagcuggccgggggcucccuccugaugcacugccccugcuacgggagcgaguggggccugugguggcggucccaggaccucgcccccagcccguccggcauggcggggcugagcuucggcacgcccacccuggacgagcccuggcucgggguggagaacgaccgcgaggagcugcagaccugccugaucaaggagcagcucucccagcugagccuggccggcgcccucgacgucccccacgccgagcuggugccgaccgagugccaggcggugacggcccccgucuccagcugcgaccucgggggccgggaccugugcggcgggugcaccggcuccagcuccgccugcuacgcccuggccaccgaccugcccgggggccucgaggcgguggaggcccaggagguggacgucaacagcuucuccuggaaccugaaggagcuguucuucagcgaccagaccgaccagacgagcuccaacugcagcugcgccaccuccgagcuccgcgagacccccagcucccuggccguggggagcgacccggacgugggcucccugcaggagcagggcagcugcguccucgacgaccgggagcugcugcuccugaccgggaccugcguggaccugggccaggggcgccgguuccgcgaguccugcgugggccacgaccccacggagccccucgaggucugccuggugagcuccgagcacuacgccgcgagcgaccgggagucccccggccacgugccgagcacccuggacgccgggcccgaggacacgugccccuccgccgaggagccgcgccucaacguccaggugaccagcacgcccgugaucgucaugcggggcgccgccgggcugcagcgcgagauccaggagggcgcguacuccgggagcugcuaccaccgggacggccugcgccucuccauccaguucgaggugcggcgcguggagcugcagggccccacgccccuguucugcugcuggcucgucaaggaccugcugcacagccagcgcgacagcgccgcccggacccgccucuuccuggccucccugccggggagcacccacuccaccgcggccgagcucaccggccccagccugguggaggugcugcgggcccgccccugguucgaggagcccccgaaggccgucgagcucgaggggcuggccgcgugcgagggcgaguacucccagaaguacagcaccaugagcccccugggguccggcgccuucggcuucguguggaccgccguggacaaggagaagaacaaggaggucguggugaaguucaucaagaaggagaagguccucgaggacugcuggaucgaggaccccaagcuggggaaggugacgcuggagaucgccauccucucccggguggagcacgccaacaucaucaagguccuggacaucuucgagaaccagggcuucuuccagcuggugauggagaagcacgggagcggccucgaccuguucgcguucaucgaccgccacccccggcuggacgagccgcucgccuccuacaucuuccgccaggugcgggccgggcagagccgccuggucuccgccgugggcuaccugcggcucaaggacaucauccaccgcgacaucaaggacgagaacaucgucaucgccgaggacuucaccaucaagcugaucgacuucggcagcgcggccuaccuggagcgggggaagcuguucuacaccuucugcggcaccaucgaguacugcgcccccgaggugcugauggggaaccccuaccgcggccccgagcuggagauguggucccucggcgugacgcuguacacccuggucuucgaggagaacccguucugcgagcucgaggagaccguggaggccgccauccacccgcccuaccuggugagcaaggagcugaugucccucgucagcgggcugcugcagcccgugcccgagcggcgcaccacgcucgagaagcuggugaccgaccccugggucacccagcccgugaaccuggcggacuacaccugggaggagguguuccgggucaacaagcccgaguccggcgugcucagcgccgccagccuggagauggggaaccgcucccugagcgacguggcccaggcgcaggagcucugcggcgggccgguccccggcgaggcccccaacggccaggggugccugcaccccggcgacccgcggcugcugacguccuga

SEQ ID NO: 34263 - RNA, 381 nt, Artificial Sequence
  derived and/or modified sequence opt1 from PATE1__Homo_sapiens__NP_612151
auggacaagagccugcuccuggagcugcccauccuccugugcugcuuccgcgcccuguccggcagccucuccaugcggaacgacgccgugaacgagaucgucgcggugaagaacaacuucccggugaucgagaucguccagugccgcaugugccaccuccaguuccccggggagaagugcagccggggccgcgggaucugcaccgccaccacggaggaggccugcauggugggccggauguucaagcgcgacgggaaccccuggcugaccuucaugggcugccugaagaacugcgccgacgugaagggcauccggugguccgucuaccuggugaacuuccgcugcugccggagccacgaccugugcaacgaggaccucuga

SEQ ID NO: 34264 - RNA, 2064 nt, Artificial Sequence
  derived and/or modified sequence opt1 from PATZ1__Homo_sapiens__NP_055138
auggagcgcgugaacgacgccagcugcggccccuccgggugcuacaccuaccaggucagccggcacuccaccgagaugcugcacaaccucaaccagcagcgcaagaacggcgggcgguucugcgacgugcugcugcgcgugggcgacgagagcuucccggcccaccgggcgguccucgccgccugcuccgaguacuucgagagcguguucuccgcccagcugggggacggcggcgccgcggacgggggccccgccgacgucgggggcgccacggccgcgcccgggggcggcgccgggggcagccgcgagcuggagaugcacaccaucuccagcaagguguucggggacauccucgacuucgccuacaccucccggaucguggugcgccuggagagcuuccccgagcugaugaccgccgccaaguuccuccugaugcgguccgucaucgagaucugccaggaggugaucaagcagagcaacgugcagauccuggucccgcccgcgcgcgccgacaucaugcuguuccggccgcccggcacguccgaccucggcuucccgcuggacaugaccaacggggccgcccucgccgcgaacagcaacggcaucgccggguccaugcagcccgaggaggaggccgcccgcgccgcgggcgccgccaucgccgggcaggccagccugcccgugcugcccggcguggaccggcucccgauggucgcgggcccccugagcccccagcugcucaccucccccuucccgagcguggccuccagcgccccgccccugaccgggaagcgcggccgggggcgcccccggaaggccaaccugcucgacuccauguucggcagccccgggggccugcgcgaggcgggcauccugcccugcgggcucugcggcaagguguucacggacgccaaccggcugcgccagcacgaggcccagcacggggucaccucccugcagcucggcuacaucgaccugcccccgccccggcugggggagaacggccuccccaucagcgaggaccccgacggcccccgcaagcgcucccggacccgcaagcaggucgccugcgagaucugcgggaagaucuuccgggacguguaccaccugaaccgccacaagcugagccacuccggcgagaagcccuacagcugccccgugugcgggcuccgguucaagcgcaaggaccggauguccuaccacgugcgcagccacgacggcuccgugggcaagcccuacaucugccagagcugcgggaagggcuucucccggccggaccaccugaacgggcacaucaagcagguccacaccagcgagcgcccccacaagugccagacgugcaacgccuccuucgcgacccgggaccgccugcggagccaccucgccugccacgaggacaaggugcccugccaggucugcggcaaguaccugcgcgccgccuacauggccgaccaccugaagaagcacuccgaggggcccagcaacuucugcagcaucugcaaccggggcuucuccagcgcguccuaccucaaggugcacgugaagacccaccacggcgucccgcugccccaggugagccgccaccaggagcccauccugaacgggggcgccgccuuccacugcgcccggaccuacgggaacaaggagggccagaagugcucccaccaggaccccaucgagagcuccgacagcuacggggaccucuccgacgccagcgaccugaagacgccggagaagcaguccgcgaacggcagcuucuccugcgacauggccgugcccaagaacaagauggagagcgacggcgagaagaaguaccccugccccgagugcggguccuucuuccgcagcaaguccuaccugaacaagcacauccagaagguccacgugcgggcccucggcgggccgcugggcgaccuggggcccgcccugggcagccccuucagcccccagcagaacaugucccuccuggagagcuucggcuuccagaucgugcaguccgcguucgccagcucccuggucgacccggagguggaccagcagcccauggggcccgagggcaaguga

SEQ ID NO: 34265 - RNA, 1023 nt, Artificial Sequence
  derived and/or modified sequence opt1 from PAWR__Homo_sapiens__XP_006719498
auggccaccggcggguaccgcaccagcuccggccucgggggcagcacgaccgacuuccuggaggaguggaaggccaagcgggagaagaugcgcgcgaagcagaacccgcccgggcccgccccgcccggcggcggguccagcgacgccgccggcaagccgcccgccggggcgcugggcacccccgccgccgccgcggccaacgagcugaacaacaaccuccccgggggcgcccccgccgcccccgcggugcccggccccgggggcgucaacugcgccgugggguccgccaugcugacccgggccgccccgggcccccgccggagcgaggacgagccgcccgcggccuccgccagcgccgcgcccccgccccagcgcgacgaggaggagcccgacggcgugcccgagaaggggaaguccagcggccccuccgcccggaaggggaagggccagaucgagaagcgcaagcugcgggagaagcgccggagcacgggggucgugaacauccccgccgccgagugccucgacgaguacgaggacgacgaggccggccagaaggagcgcaagcgggaggacgccaucacccagcagaacaccauccagaacgaggcggugaaccugcuggaccccggcuccagcuaccuccugcaggagccgccccgcaccgucuccgggcgguacaagagcacgaccuccgugagcgaggaggacguguccagccgcuacagccggaccgaccgcuccggcuucccccgguacaaccgcgacgccaacgucagcgggacccugguguccagcuccacgcucgagaagaagaucgaggaccuggagaaggaggugguccgggagcgccaggagaaccugcgccucgugcggcugaugcaggacaaggaggagaugaucggcaagcugaaggaggagaucgaccuccugaaccgcgaccuggacgacaucgaggacgagaacgagcagcucaagcaggagaacaagacccugcugaagguggucgggcagcucacccgguga

SEQ ID NO: 34266 - RNA, 1605 nt, Artificial Sequence
  derived and/or modified sequence opt1 from PAX1__Homo_sapiens__NP_006183
augaaguucacccugggccucgggagccgcgccuggcggguguccugggagggcgccgcggccgccgccgccgggcccggcgccgggggcagcgcgcugcgcugccgggcccagcgcgucuccagcccccggcugggccgccgggggucccgccucagcggcgcccugccccugugccucucccgcgggggcgggggcgcgcaggcccugcccgacugcgccggccccagcccggggcaccccggccaccccggggcccggcagcuggccggcccccucgcgauggagcagaccuacggcgaggugaaccagcucgggggcguguucgucaacgggcggccgcugcccaacgccauccgccugcggaucguggagcuggcccagcugggcauccgccccugcgacaucucccggcagcuccgcgugagccacgggugcgucuccaagauccuggcccgguacaacgagacgggcagcauccugcccggcgccaucgggggcuccaagccgcgcgugaccacccccaacguggucaagcacauccgggacuacaagcagggggaccccggcaucuucgcgugggagauccgcgaccggcuccuggccgacggggugugcgacaaguacaacgugcccagcgucuccagcaucucccgcauccugcgcaacaagaucggcagccucgcccagccgggccccuacgaggccuccaagcagccgcccagccagcccacccugcccuacaaccacaucuaccaguaccccuaccccagcccggugucccccacgggggccaagaugggcagccaccccggggugcccggcaccgcggggcacgucuccaucccgcggagcuggcccuccgcccacagcguguccaacauccugggcauccgcaccuucauggagcagaccggcgcccucgccgggagcgagggcacggccuacucccccaagauggaggacugggcgggggugaaccggaccgccuucccggccacccccgccgucaacggccuggagaagcccgcgcuggaggccgacaucaaguacacccagagcgccuccacgcucagcgccgugggcggguuccugcccgccugcgcguacccggccuccaaccagcacggcguguacagcgcccccgggggcggguaccuggcccccgggcccccguggccgcccgcccagggcccgccccucgcgccgcccggcgccggcgucgccgugcacgggggcgagcuggccgccgcgaugaccuucaagcaccccucccgcgaggggagccugcccgcccccgccgcccggccccgcacccccuccguggcguacaccgacugccccagccggccccgcccgccccggggcuccagcccccgcacgcgggcccgccgggagcgccaggccgaccccggcgcccaggucugcgccgcggcccccgccaucgggaccggccggaucgggggccucgccgaggaggaggccagcgcggggccgcgcggcgcccggcccgccagcccccaggcccagcccugccuguggccggacccgccccacuuccuguacugguccggcuuccucggguucuccgagcugggcuucuga

SEQ ID NO: 34267 - RNA, 1185 nt, Artificial Sequence
  derived and/or modified sequence opt1 from PAX2__Homo_sapiens__NP_000269
auggacaugcacugcaaggccgaccccuucagcgccaugcacccgggccacgggggcgugaaccagcucgggggcgucuucgugaacgggcgcccccugcccgacgugguccggcagcgcaucguggagcuggcgcaccagggcgugcggcccugcgacaucucccgccagcugcgggucagccacggcugcguguccaagauccucgggcgcuacuacgagaccggcagcaucaagccgggggugaucggcggguccaagcccaaggucgccacccccaaggugguggacaagaucgccgaguacaagcggcagaaccccacgauguucgccugggagauccgcgaccggcugcuggccgagggcaucugcgacaacgacaccgucccgagcguguccagcaucaaccgcaucauccggaccaaggugcagcagcccuuccaccccacccccgacggcgcggggacgggcgucaccgccccggggcacaccaucgugcccuccaccgccagcccgcccguguccagcgccuccaacgaccccgucggcagcuacuccaucaacggcauccucgggaucccccgcagcaacggcgagaagcggaagcgcgacgaggacguguccgaggggagcgugcccaacggcgacucccagagcggggucgacagccugcggaagcaccuccgcgcggacacguucacccagcagcagcuggaggcccuggaccggguguucgagcgccccuccuacccggacguguuccaggccagcgagcacaucaaguccgagcagggcaacgaguacagccugcccgcccucacccccggccuggacgaggucaaguccagccuguccgccagcaccaaccccgagcucggguccaacgugagcggcacgcagaccuacccggucgugaccgggcgggacauggcguccaccacgcugcccggcuacccgccccacgugccgcccaccgggcagggcagcuaccccaccuccacccuggccggcaugguccccgggagcgaguucuccggcaaccccuacagccacccccaguacacggccuacaacgaggccuggcgcuucuccaaccccgcccuccugagcuccccguacuacuacagcgcggcgccccgggggagcgcccccgccgccgccgccgccgccuacgaccgccacuga

SEQ ID NO: 34268 - RNA, 648 nt, Artificial Sequence
  derived and/or modified sequence opt1 from PAX3__Homo_sapiens__NP_000429
augaccacccuggccggcgccgugccccgcaugaugcggccggggcccggccagaacuacccccgcagcggguucccccucgaggucuccacgccgcugggccaggggcgggugaaccagcugggcggcguguucaucaacgggcgcccccuccccaaccacauccggcacaagaucgucgagauggcgcaccacggcauccgccccugcgugaucagccggcagcugcgcgugucccacgggugcgucagcaagauccugugccgguaccaggagaccggcuccauccgcccgggggccaucggcggcagcaagcccaagcaggucaccacccccgacguggagaagaagaucgaggaguacaagcgggagaaccccgggauguucuccugggagauccgcgacaagcuccugaaggacgccgugugcgaccggaacacggugccgagcguguccagcaucucccgcauccugcggagcaaguucggcaagggggaggaggaggaggccgaccucgagcgcaaggaggccgaggaguccgagaagaaggcgaagcacagcaucgacggcauccuguccgagcggggcaagcgcuggcggcuggggcgccggaccugcugggucaccuggcgcgccagcgccuccuga

SEQ ID NO: 34269 - RNA, 1032 nt, Artificial Sequence
  derived and/or modified sequence opt1 from PAX4__Homo_sapiens__NP_006184
augaaccagcugggcggccucuucgugaacgggcgcccccugccgcuggacacccggcagcagaucguccgccucgccgugagcgggaugcggcccugcgacaucucccgcauccugaaggugagcaacggcugcgucuccaagauccuggggcgguacuaccgcaccggcgugcucgagcccaagggcaucgggggcagcaagccccggcuggccacgccgcccguggucgcgcgcaucgcccagcugaagggggagugccccgcccucuucgccugggagauccagcggcagcugugcgccgagggccugugcacccaggacaagacccccuccgugagcuccaucaaccgcgugcuccgggcgcugcaggaggaccaggggcugccgugcacccgccuccggagccccgccguccuggcccccgccgugcugacgccccacuccggcagcgagaccccgcgcggcacccaccccgggaccggccaccggaaccgcacgaucuucucccccagccaggcggaggcccucgagaaggaguuccagcgggggcaguaccccgacuccguggcccgcggcaagcuggccaccgccaccagccugccggaggacaccguccgggugugguucuccaaccgccgggcgaaguggcgccgccaggagaagcucaagugggagaugcagcugcccggcgccagccaggggcugacggugccccgggucgcccccggcaucaucuccgcccagcagagcccgggguccgugcccaccgccgcgcuccccgcccuggagccccugggcccgagcugcuaccagcucugcugggccaccgcccccgagcgcugccugagcgacaccccgcccaaggccugccugaagcccugcugggggcaccucccgccccagcccaacucccuggacagcggccugcucugccugcccugccccuccagccacugccaccuggcgucccucagcggcucccaggcccugcuguggcccgggugcccgcuccuguacggccuggaguga

SEQ ID NO: 34270 - RNA, 1074 nt, Artificial Sequence
  derived and/or modified sequence opt1 from PAX5__Homo_sapiens__NP_001267476
auggaccuggagaagaacuaccccaccccgcgcaccagccggacgggccacgggggcgugaaccagcucgggggcgucuucgugaacgggcgcccccugcccgacgugguccggcagcgcaucguggagcuggcccaccagggcgugcggcccugcgacaucucccgccagcuccgggucagccacggcugcguguccaagauccuggggcgcuacuacgagaccggcagcaucaagccgggggugaucggcggguccaagcccaaggucgccacccccaaggugguggagaagaucgcggaguacaagcggcagaaccccaccauguucgccugggagauccgcgaccggcugcucgccgagcgcgucugcgacaacgacacggugcccagcguguccagcaucaaccggaucauccgcaccaagguccagcagccgcccaaccagcccgugcccgccuccagccacuccaucgugagcaccggcuccgucacccaggugagcuccgugagcacggacuccgccggcagcuccuacagcaucagcgggauccugggcaucaccucccccagcgcggacaccaacaagcggaagcgcgacgaggggauccaggagucccccguccccaacggccacagccugccgggccgggacuuccuccgcaagcagaugcgcggggaccuguucacccagcagcagcuggaggugcucgaccggguguucgagcggcagcacuacuccgacaucuucacgaccaccgagcccaucaagcccgagcagaccacggaguacagcgccauggccucccuggccggcgggcuggacgacaugaaggcgaaccucgccagccccaccccggccgacaucggcuccagcguccccgggccccaguccuaccccaucgugaccggcagcgaguucuccggcagcccguacucccacccccaguacagcuccuacaacgacagcuggcgcuuccccaaccccgggcugcugggcuccccguacuacuacagcgccgccgcgcgcggggccgccccgcccgccgccgcgaccgccuacgaccggcacuga

SEQ ID NO: 34271 - RNA, 1311 nt, Artificial Sequence
  derived and/or modified sequence opt1 from PAX6__Homo_sapiens__NP_001245391
augcagaacagccacuccggcgugaaccagcucgggggcguguucgugaacgggcgcccccugccggacagcacccggcagaagaucguggagcuggcccacuccggcgcccgccccugcgacaucagccggauccugcagacccacgcggacgccaagguccaggugcucgacaaccagaacguguccaacgggugcgucagcaagauccugggccgcuacuacgagacgggcuccauccggccccgcgccaucgggggcagcaagccccggguggccaccccggagguggucuccaagaucgcccaguacaagcgcgagugccccagcaucuucgcgugggagauccgggaccgccugcucuccgagggggugugcaccaacgacaacauccccagcguguccagcaucaaccggguccugcgcaaccuggccuccgagaagcagcagaugggcgccgacgggauguacgacaagcuccggaugcugaacggccagaccggcagcugggggacgcgccccggcugguacccggggaccuccgugcccggccagcccacccaggacggcugccagcagcaggagggcggcggggagaacaccaacagcaucuccagcaacggggaggacagcgacgaggcccagaugcggcugcagcucaagcgcaagcugcagcggaaccgcacguccuucacccaggagcagaucgaggcgcuggagaaggaguucgagcggacccacuaccccgacguguucgcccgcgagcggcucgccgccaagaucgaccugccggaggcccgcauccaggucugguucagcaaccgccgggcgaaguggcgccgggaggagaagcugcgcaaccagcggcgccaggccuccaacacccccagccacauccccaucuccagcuccuucagcacguccguguaccagcccaucccgcagcccaccacccccgugagcuccuucaccagcggguccaugcucggccggacggacaccgcccugaccaacaccuacagcgcccugcccccgaugcccuccuucacgauggccaacaaccuccccaugcagcccccgguccccagccagaccuccagcuacuccugcaugcugcccaccagccccagcgugaacggccgcuccuacgacaccuacacgccgccccacaugcagacccacaugaacagccagcccauggggaccuccggcaccacgagcaccgggcugaucuccccgggcgugagcguccccguccaggugcccggguccgagcccgacaugagccaguacuggccgcggcuccaguga

SEQ ID NO: 34272 - RNA, 1353 nt, Artificial Sequence
  derived and/or modified sequence opt1 from PAX8__Homo_sapiens__NP_003457
augccccacaacagcauccgcuccggccacgggggccugaaccagcucgggggcgccuucgugaacgggcggccgcugcccgaggucgugcgccagcggaucguggaccuggcccaccagggcguccgccccugcgacaucagccggcagcuccgcgugucccacggcugcgugagcaagauccuggggcgguacuacgagaccggcuccauccgccccggggucaucggcgggagcaagccgaagguggcgacccccaagguggucgagaagaucggcgacuacaagcggcagaaccccacgauguucgccugggagauccgcgaccggcugcucgccgagggcgugugcgacaacgacaccgugcccuccgucagcuccaucaaccgcaucauccggaccaaggugcagcagccguucaaccugcccauggacagcugcguggccaccaagucccugagccccgggcacacgcucauccccuccagcgccgucaccccgcccgagagcccccaguccgacucccugggcagcaccuacuccaucaacgggcugcucggcaucgcgcagcccggcagcgacaagcgcaagauggacgacagcgaccaggacuccugccggcugagcaucgacucccagagcuccagcuccgggccgcgcaagcaccuccggaccgacgccuucagccagcaccaccuggagccccuggagugccccuucgagcgccagcacuaccccgaggccuacgccuccccgagccacacgaagggcgagcaggggcuguacccccucccccugcugaacuccacccucgacgacggcaaggcgacccugacccccagcaacacgccgcuggggcggaaccucuccacccaccagaccuaccccgugguggccgacccccacagccccuucgccaucaagcaggagaccccggaggucuccagcuccagcuccacgcccagcagccuguccagcuccgccuuccuggaccuccagcaggucggcagcggcgugcccccguucaacgccuucccccacgcggccuccguguacgggcaguucaccggccaggcccugcugagcgggcgcgagauggugggccccacccuccccggguacccgccccacauccccaccuccggccagggcagcuacgccuccagcgccaucgcggggaugguggccggcuccgaguacagcgggaacgccuacggccacacgcccuacuccagcuacuccgaggccuggcgguucccgaacagcucccugcugagcagccccuacuacuacuccagcaccucccgccccagcgcgcccccgaccaccgccacggccuucgaccaccucuga

SEQ ID NO: 34273 - RNA, 1026 nt, Artificial Sequence
  derived and/or modified sequence opt1 from PAX9__Homo_sapiens__NP_006185
auggagcccgccuucggcgaggugaaccagcucgggggcgucuucgugaacgggcgcccgcugcccaacgccauccggcugcgcaucguggagcuggcgcagcucggcauccggcccugcgacaucagccgccagcugcgggucucccacgggugcgugagcaagauccuggcccgcuacaacgagaccggcuccauccuccccggcgccaucgggggcagcaagccgcgggugaccacgcccaccgucgugaagcacauccgcaccuacaagcagcgggaccccgggaucuucgccugggagauccgcgaccggcugcuggccgacggcgugugcgacaaguacaacguccccuccgugagcuccaucagccgcauccuccggaacaagaucgggaaccuggcgcagcagggccacuacgacuccuacaagcagcaccagccgacgccccagcccgcccugcccuacaaccacaucuacagcuacccgucccccaucaccgccgccgcggccaaggugcccacgcccccgggcguccccgccauccccgggagcguggccaugccccgcaccuggccguccagccacuccgugaccgacauccucggcauccggagcaucaccgaccaggucuccgacagcucccccuaccacagccccaagguggaggaguggagcucccuggggcgcaacaacuuccccgccgcggccccgcacgccgugaacggccuggagaagggcgcccucgagcaggaggccaaguacgggcaggcgcccaacggccugcccgccgucgggagcuucguguccgccagcuccauggcccccuacccgacccccgcccaggugagccccuacaugaccuacuccgcggccccgagcggcuacgucgccgggcacggcuggcagcacgccggcgggaccucccugagcccccacaacugcgacauccccgccucccucgcguucaagggcaugcaggccgcccgggaggggagccacuccgugacggccagcgcgcuguga

SEQ ID NO: 34274 - RNA, 3210 nt, Artificial Sequence
  derived and/or modified sequence opt1 from PAXIP1__Homo_sapiens__NP_031375
augagcgaccaggcccccaaggugccggaggagauguuccgcgaggucaaguacuacgccgugggcgacaucgacccccaggugauccagcugcucaaggcggggaaggccaaggaggucuccuacaacgcccuggccagccacaucaucuccgaggacggcgacaaccccgaggugggggaggcccgggagguguucgaccugcccgucgugaagccgagcugggugauccucuccguccagugcggcacccugcugcccgugaacggguucagccccgaguccugccagaucuucuucggcaucaccgcgugccucagccagguguccagcgaggaccgcuccgcccugugggcccuggucacguucuacggcggggacugccagcucacccugaacaagaagugcacccaccugaucgugcccgagccgaagggcgagaaguacgagugcgcccucaagcgggcgagcaucaagaucgugacccccgacuggguccuggacugcguguccgagaagacgaagaaggacgaggccuucuaccacccccgccugaucaucuacgaggaggaggaggaggaggaggaggaggaggaggagguggagaacgaggagcaggacagccagaacgagggguccaccgacgagaaguccucccccgccagcucccaggagggcagcccgagcggggaccagcaguucucccccaagagcaacaccgagaaguccaagggcgagcucauguucgacgacagcuccgacagcucccccgagaagcaggagcggaaccugaacuggacccccgccgaggucccgcagcuggccgcggccaagcgccggcucccccagggcaaggagcccgggcugaucaaccugugcgccaacgugcccccggugcccggcaacauccucccgcccgagguccgcgggaaccugauggccgccggccagaaccugcagagcuccgagcggagcgagaugaucgcgacguggucccccgccgugcgcacccuccggaacaucaccaacaacgccgacauccagcagaugaaccgccccagcaacguggcccacauccugcagacccugagcgcccccacgaagaaccucgagcagcaggucaaccacagccagcagggccacaccaacgcgaacgccgugcuguucucccaggucaaggugacccccgagacccacaugcugcagcagcagcagcaggcccagcagcagcagcagcagcacccggugcuccaccuccagccccagcagaucaugcagcugcagcagcagcagcagcagcagaucagccagcagcccuacccgcagcagccgccccaccccuucucccagcagcagcagcagcagcagcaggcccacccccaccaguucagccagcagcagcugcaguucccccagcagcagcugcacccgccccagcagcugcaccggccccagcagcagcuccagcccuuccagcagcagcacgcccugcagcagcaguuccaccagcugcagcagcaccagcuccagcagcagcagcuggcgcagcugcagcagcagcacucccuccugcagcagcagcagcagcagcagauccagcagcagcagcugcagcgcaugcaccagcagcagcagcagcagcagaugcagagccagacggcgccccaccucagccagaccucccaggcccugcagcaccaggugcccccgcagcagccgccccagcagcagcagcagcagcagcccccgcccagcccccagcagcaccagcuguucgggcacgaccccgccguggagauccccgaggagggcuuccuccuggggugcguguucgccaucgccgacuaccccgagcagauguccgacaagcagcugcuggccaccuggaagcggaucauccaggcccacggcgggaccgucgaccccacguucaccagccgcugcacccaccuccugugcgagucccaggugagcuccgccuacgcgcaggccauccgggagcgcaagcggugcgugaccgcccacuggcugaacacgguccucaagaagaagaagauggugcccccgcaccgcgcccugcacuuccccguggccuucccgcccggcggcaagcccugcagccagcacaucaucuccgucaccggguucguggacagcgaccgggacgaccugaagcucauggcguaccuggccggcgccaaguacaccggguaccugugccgcuccaacaccgugcucaucugcaaggagcccacgggccugaaguacgagaaggccaaggaguggcgcauccccugcgucaacgcccaguggcugggggacauccuccugggcaacuucgaggcgcugcggcagauccaguacagccgcuacaccgccuucucccuccaggacccguucgcccccacccagcaccuggugcugaaccuccuggacgccuggcgggugccccugaaggucagcgcggagcuccugauguccauccgccugcccccgaagcucaagcagaacgagguggccaacgugcagcccagcuccaagcgggcccgcaucgaggacgucccgccgcccaccaagaagcugacgcccgagcugacccccuucguccucuucaccggcuucgagcccguccaggugcagcaguacaucaagaagcuguacauccucgggggcgagguggccgagagcgcccagaagugcacccaccugaucgcgagcaaggugacgcggaccgucaaguuccugaccgccaucuccguggugaagcacaucgucacccccgaguggcuggaggagugcuuccgcugccagaaguucaucgacgagcagaacuacauccuccgggacgccgaggccgaggugcuguucagcuucucccuggaggagagccucaagcgcgcccacgugagcccccuguucaaggcgaaguacuucuacaucacccccgggaucugccccucccuguccacgaugaaggccaucgucgagugcgccggcgggaaggugcucagcaagcagccguccuuccggaagcugauggagcacaagcagaacagcucccugagcgagaucauccucaucuccugcgagaacgaccugcaccugugccgcgaguacuucgcccggggcaucgacgugcacaacgccgaguucguccucaccggcgugcugacccagacccuggacuacgagagcuacaaguucaacuga

SEQ ID NO: 34275 - RNA, 969 nt, Artificial Sequence
  derived and/or modified sequence opt1 from PBK__Homo_sapiens__XP_006716431
auggagggcaucagcaacuucaagacccccuccaagcugagcgagaagaagaaguccgugcucugcagcaccccgacgaucaacauccccgccucccccuucaugcagaagcugggguucggcaccggggucaacguguaccugaugaagcgcagcccccggggccucucccacagcccgugggccgugaagaagaucaaccccaucugcaacgaccacuaccgcuccgucuaccagaagcggcugauggacgaggcgaagauccucaagagccugcaccaccccaacaucgugggguaccgcgccuucaccgaggccaacgacggcucccugugccuggccauggaguacggcggggagaagucccucaacgaccugaucgaggagcgguacaaggccagccaggaccccuucccggcggccaucauccugaagguggcccucaacauggcccgcggccugaaguaccugcaccaggagaagaagcuccugcacggggacaucaagagcuccaacgucgugaucaagggcgacuucgagaccaucaagaucugcgacgugggggucagccugccccucgacgagaacaugacggugaccgaccccgaggcgugcuacaucggcaccgagcccuggaagccgaaggaggccguggaggagaacggcgucaucaccgacaaggccgacaucuucgccuucgggcugacgcugugggagaugaugacccucuccaucccccacaucaaccugagcaacgacgacgacgacgaggacaagaccuucgacgaguccgacuucgacgacgaggccuacuacgcggcccugggcacccggccgcccaucaacauggaggagcucgacgagagcuaccagaaggugaucgagcuguucagcgugugcacgaacgaggaccccaaggaccgccccuccgccgcccacaucgucgaggcccuggagaccgacguguga

SEQ ID NO: 34276 - RNA, 843 nt, Artificial Sequence
  derived and/or modified sequence opt1 from PBLD__Homo_sapiens__NP_001028255
augaagcugcccaucuucaucgccgacgccuucaccgcgcgcgccuuccggggcaacccggccgccgugugccuccuggagaacgagcuggacgaggacaugcaccagaagaucgcccgcgagaugaaccucagcgagaccgcguucauccggaagcugcaccccacggacaacuucgcccaguccagcugcuucgggcugcgcugguucacccccgccuccgaggucccccucugcggccacgccacccuggcgagcgccgccgugcuguuccacaagaucaagaacaugaacuccacccucacguucgugacccugagcggggagcugcgggcccgccgggccgaggacggcaucguccucgaccugccgcuguaccccgcgcacccccaggacuuccacgagguggaggaccucaucaagaccgccaucgggaacacccuggugcaggacaucugcuacucccccgacacgcagaagcugcucguccgccugagcgacguguacaaccgguccuuccuggagaaccucaaggugaacaccgagaaccugcugcaggucgagaacaccggcaaggugaagggccucauccugacccugaagggggagccgggcgggcagacgcaggccuucgacuucuacagccgcuacuucgcccccugggugggcgucgccgaggaccccgugaccggguccgcgcacgccgugcucagcuccuacuggagccagcaccugggcaagaaggagaugcacggccggaccgcccuguaccaguuccucuucuaccugcccaacuccaagcuggucuuccuccugaucugcaccaucccgcugaagauguga

SEQ ID NO: 34277 - RNA, 408 nt, Artificial Sequence
  derived and/or modified sequence opt1 from PBOV1__Homo_sapiens__NP_067648
augcgcgccuuccugcggaaccagaaguacgaggacaugcacaacaucauccacauccuccagauccgcaagcugcggcaccgccugagcaacuucccccggcucccgggcauccuggcccccgagaccgugcugcuccccuucugcuacaaggucuuccgcaagaaggagaaggugaagcggucccagaaggcgaccgaguucaucgacuacagcaucgagcagucccaccacgccauccugacgccccugcagacccaccucaccaugaaggggagcuccaugaagugcagcucccugagcuccgaggccauccuguucacccucacgcugcagcugacccagacccucggccuggagugcugccugcucuaccugagcaagaccauccacccgcagaucaucuga

SEQ ID NO: 34278 - RNA, 4749 nt, Artificial Sequence
  derived and/or modified sequence opt1 from PBRM1__Homo_sapiens__NP_060783
augggcagcaagcgccggcgcgccaccucccccagcuccagcguguccggggacuucgacgacggccaccacagcgucuccaccccggggcccagccggaagcgccggcgccuguccaaccuccccacgguggaccccaucgccgugugccacgagcuguacaacaccauccgggacuacaaggacgagcagggccgccugcucugcgagcuguucauccgggcgccgaagcgccggaaccagcccgacuacuacgaggucgugagccagcccaucgaccugaugaagauccagcagaagcucaagauggaggaguacgacgacgugaaccugcugaccgccgacuuccagcuccuguucaacaacgccaaguccuacuacaagcccgacagcccggaguacaaggccgccugcaagcugugggaccucuaccugcgcacccggaacgaguucguccagaagggggaggcggacgacgaggacgacgacgaggacggccaggacaaccagggcacggugaccgagggguccagccccgccuaccugaaggagauccucgagcagcugcuggaggccaucguggucgccaccaaccccuccggccgccucaucagcgagcuguuccagaagcugcccuccaaggugcaguacccggacuacuacgcgaucaucaaggagcccaucgaccucaagaccaucgcccagcggauccagaacgggagcuacaaguccauccacgccauggccaaggacaucgaccugcuggccaagaacgcgaagacguacaacgagcccggcagccagguguucaaggacgccaacagcaucaagaagaucuucuacaugaagaaggccgagaucgagcaccacgagauggccaaguccagccuccgcaugcggacccccuccaaccuggccgcggcccgccugaccgggccgagccacuccaagggcagccucggcgaggagcggaaccccaccuccaaguacuaccgcaacaagcgggccguccaggggggccgccugagcgccaucacgauggcccugcaguacggguccgagagcgaggaggacgcggcccucgccgccgcccgcuacgaggagggcgaguccgaggcggagagcaucaccuccuucauggacgugagcaaccccuucuaccagcuguacgacaccgugcgguccugccgcaacaaccagggccagcugaucgccgagcccuucuaccaccucccgagcaagaagaaguaccccgacuacuaccagcagaucaagaugcccaucucccugcagcagauccggaccaagcugaagaaccaggaguacgagacgcucgaccaccuggagugcgaccugaaccucauguucgagaacgccaagcgcuacaacguccccaacagcgccaucuacaagcgggugcugaagcugcagcaggugaugcaggcgaagaagaaggagcucgcccgccgggacgacaucgaggacggggacuccaugaucagcagcgccaccuccgacaccggcagcgccaagcgcaaguccaagaagaacauccggaagcagcgcaugaagauccuguucaacgucgugcuggaggcccgggagccggggagcggccgccggcucugcgaccuguucauggugaagcccuccaagaaggacuaccccgacuacuacaagaucauccuggagcccauggaccucaagaucaucgagcacaacauccgcaacgacaaguacgcgggggaggagggcaugaucgaggacaugaagcugauguuccggaacgcccgccacuacaacgaggagggcagccaggucuacaacgacgcccacauccuggagaagcugcucaaggagaagcggaaggagcuggggccgcugcccgacgacgacgacauggccucccccaagcucaagcugagccgcaaguccggcaucagcccgaagaaguccaaguacaugacccccaugcagcagaagcugaacgagguguacgaggccgugaagaacuacacggacaagcgggggcgccgccucagcgcgaucuuccugcggcugcccucccgcagcgagcuccccgacuacuaccugaccaucaagaagccgauggacauggagaagauccggucccacaugauggccaacaaguaccaggacaucgacagcauggucgaggacuucgugaugauguucaacaacgccugcaccuacaacgagcccgagucccugaucuacaaggacgcccucguccugcacaaggugcugcucgagacccgccgggaccuggagggcgacgaggacagccacgugcccaacgucacgcugcucauccaggagcugauccacaaccuguucgugagcgugaugucccaccaggacgacgaggggcgcugcuacagcgacucccucgccgagauccccgcggucgacccgaacuuccccaacaagcccccccugaccuucgacaucauccggaagaacguggagaacaaccgcuaccggcgccuggaccucuuccaggagcacauguucgaggugcuggagcgggcccgccggaugaaccgcaccgacagcgagaucuacgaggacgccgucgagcugcagcaguucuucaucaagauccgggacgagcucugcaagaacggcgagauccugcuguccccggcccucagcuacaccacgaagcaccugcacaacgacguggagaaggagcgcaaggagaagcugcccaaggagaucgaggaggacaagcucaagcgggaggaggagaagcgcgaggcggagaaguccgaggacagcuccggcgccgccgggcugagcggccugcaccggaccuacucccaggacugcagcuucaagaacuccauguaccacgugggggacuacgucuacguggagcccgccgaggccaaccuccagccccacaucgugugcaucgagcgccugugggaggacagcgcggagaaggaggucuucaaguccgacuacuacaacaaggugccggugagcaagauccugggcaagugcgucgugauguucgugaaggaguacuucaagcucugccccgagaacuuccgggacgaggacgucuucgugugcgagucccgcuacagcgccaagaccaaguccuucaagaagaucaagcuguggaccaugcccaucagcagcgugcgcuucgucccccgggacgugccgcugcccgugguccgcguggccuccguguucgccaacgccgacaagggggacgacgagaagaacacggacaacagcgaggacucccgggcggaggacaacuucaaccucgagaaggagaaggaggacguccccguggagaugagcaacggcgagcccggcugccacuacuucgagcagcugcacuacaacgacauguggcugaaggugggggacugcgucuucaucaagucccacggccucgugcgcccgcggguggggcgcaucgagaaggucugggugcgggacggcgccgccuacuucuacggccccaucuucauccaccccgaggagaccgagcacgagccgaccaagauguucuacaagaaggagguguuccugagcaaccuggaggagaccugccccaugacgugcauccucgggaagugcgccguccuguccuucaaggacuuccugagcugccgccccaccgagauccccgagaacgacauccuccugugcgagucccgguacaacgagagcgacaagcagaugaagaaguucaagggccugaagcgcuucucccucagcgccaaggugguggacgacgagaucuacuacuuccggaagccgaucgucccccagaaggagcccuccccccugcuggagaagaagauccagcuccuggaggcgaaguucgccgagcuggaggggggcgacgacgacaucgaggagaugggggaggaggacagcgaguccaccccgaagagcgccaagggcuccgccaagaaggagggcagcaagcgcaagaucaacauguccggguacauccucuucagcagcgagaugcgggcggugaucaaggcccagcaccccgacuacuccuucggcgagcugagccgccugguggggaccgaguggcggaaccucgagaccgccaagaaggccgaguacgagggcaugauggggggcuacccccccggccugccgccccugcaggggcccgucgacggccucguguccauggggagcaugcagccccugcacccgggcgggccccccccccaccaccugccgcccggcgugcccggccuccccgggaucccgccccccggcgucaugaaccaggggguggcccccauggugggcacgccggcgcccgggggcucccccuacggccagcaggucggggugcugggcccgcccgggcagcaggccccccccccguaccccggcccccaccccgccggcccgcccgucauccagcagcccaccacccccauguucguggccccgccccccaagacccagcgccugcuccacagcgaggccuaccugaaguacaucgaggggcuguccgcggagagcaacuccaucagcaagugggaccagacgcucgccgcccggcgccgggacgugcaccuguccaaggagcaggagagccgccugcccucccacuggcucaagagcaagggcgcccacaccaccauggccgacgcgcuguggcgccugcgggaccucaugcugcgcgacacccugaacauccggcaggccuacaaccucgagaacgucuga

SEQ ID NO: 34279 - RNA, 1044 nt, Artificial Sequence
  derived and/or modified sequence opt1 from PBX1__Homo_sapiens__NP_001191890
auggacgagcagccccgccugaugcacagccacgccggcguggggauggccggccacccggggcucucccagcaccuccaggacggcgccgggggcaccgagggcgagggcgggcggaagcaggacaucggggacauccugcagcagaucaugaccaucacggaccagagccuggacgaggcgcaggcccgcaagcacgcccugaacugccaccggaugaagcccgcccuguucaacguccucugcgagaucaaggagaagaccgugcuguccauccgcggcgcgcaggaggaggagcccaccgacccccagcugaugcggcucgacaacaugcugcuggccgaggggguggccggcccggagaagggcgggggcagcgccgcggccgccgccgccgcggccgccuccgggggcgccggcagcgacaacuccgucgagcacagcgacuaccgcgccaagcucucccagauccggcagaucuaccacaccgagcuggagaaguacgagcaggcgugcaacgaguucacgacccacgugaugaaccugcuccgcgagcagagccggacccgccccaucucccccaaggagaucgagcggauggugagcaucauccaccgcaaguucuccagcauccagaugcagcugaagcaguccacgugcgaggccgucaugauccugcggagccgcuuccucgacgcccggcgcaagcggcgcaacuucaacaagcaggccaccgagauccugaacgaguacuucuacucccaccugagcaaccccuacccguccgaggaggccaaggaggagcucgcgaagaagugcgggaucaccgugagccaggugagcaacugguucggcaacaagcggauccgcuacaagaagaacaucgggaaguuccaggaggaggccaacaucuacgccgccaagaccgccgucaccgcgacgaacguguccgcccacggcagccaggccaacucccccagcacccccaacuccgccgggggcuaccccagcccgugcuaccagcccgaccggcgcauccaguga

SEQ ID NO: 34280 - RNA, 1293 nt, Artificial Sequence
  derived and/or modified sequence opt1 from PBX2__Homo_sapiens__NP_002577
auggacgagcgccugcucgggcccccgccgcccggcggcgggcggggcgggcugggccuggugagcggcgagcccgggggccccggggagccgcccggcgggggcgaccccggcgggggcuccgggggcguccccggcgggcgcggcaagcaggacaucggggacauccuccagcagaucaugaccaucaccgaccagagccuggacgaggcccaggccaagaagcacgcgcugaacugccaccggaugaagcccgcccucuucuccgugcugugcgagaucaaggagaagacgggccugagcauccgcuccagccaggaggaggagcccguggacccccagcucaugcggcuggacaacaugcugcucgccgagggggucgccggcccggagaagggcgggggcuccgccgcggccgccgccgcggccgccgccagcgggggcggggugucccccgacaacagcaucgagcacuccgacuaccgcagcaagcuggcccagauccggcacaucuaccacuccgagcuggagaaguacgagcaggcgugcaacgaguucaccacccacgugaugaaccuccugcgcgagcagagccggacccgccccgucgcccccaaggagauggagcggaugguguccaucauccaccgcaaguucagcgccauccagaugcagcugaagcaguccacgugcgaggccgugaugauccuccggagccgcuuccuggacgcccggcgcaagcggcgcaacuucuccaagcaggcgaccgagguccugaacgaguacuucuacagccaccucagcaacccguaccccuccgaggaggccaaggaggagcuggccaagaagugcggcaucaccgugagccagguguccaacugguucggcaacaagcggauccgcuacaagaagaacaucgggaaguuccaggaggaggccaacaucuacgccgucaagaccgcggugagcgugacgcagggcgggcacucccggaccagcucccccacgcccccgagcuccgccggcagcgggggcuccuucaaccugagcggcuccggggacauguuccucggcaugcccgggcugaacggcgacagcuacuccgccagccaggucgagucccugcgccacagcaugggccccgggggcuacggggacaaccucggcgggggccagauguacagcccccgcgagaugcgggccaacggcuccuggcaggaggccgugaccccgagcuccgugaccagccccaccgaggggcccggcuccguccacagcgacaccuccaacuga

SEQ ID NO: 34281 - RNA, 1080 nt, Artificial Sequence
  derived and/or modified sequence opt1 from PBX3__Homo_sapiens__NP_001128250
augaagcccgcccuguucagcgugcucugcgagaucaaggagaagaccggccuguccauccgcggggcccaggaggaggacccgcccgacccccagcugaugcggcucgacaacaugcugcuggcggagggcgucagcgggcccgagaagggcgggggcuccgccgccgccgccgcggccgccgccgcgagcggcggguccagcgacaacuccaucgagcacagcgacuaccgcgccaagcucacccagauccggcagaucuaccacacggagcuggagaaguacgagcaggccugcaacgaguucaccacccacgugaugaaccugcuccgcgagcagucccggacccgcccgaucagccccaaggagaucgagcggauggugggcaucauccaccgcaaguucuccagcauccagaugcagcugaagcaguccacgugcgaggccgucaugauccugcggagccgcuuccucgacgcccggcgcaagcggcgcaacuucuccaagcaggcgaccgagauccugaacgaguacuucuacagccaccuguccaaccccuaccccagcgaggaggccaaggaggagcucgccaagaagugcuccaucaccgugagccaggugagcaacugguucgggaacaagcggauccgcuacaagaagaacaucggcaaguuccaggaggaggccaaccuguacgccgcgaagaccgccgucacggccgcccacgccguggcggccgccgugcagaacaaccagaccaacuccccgaccacccccaacagcggguccagcggcuccuucaaccugcccaacagcggcgacauguucaugaacaugcagucccucaacggggacagcuaccagggcucccaggucggggccaacgugcagagccagguggacacgcugcggcacgucaucaaccagaccggcggcuacuccgacgggcugggcgggaacagccucuacagcccccacaaccugaacgccaacggcggguggcaggacgcgaccaccccguccuccgugacgagccccaccgagggccccggcuccgugcacagcgacaccuccaacuga

SEQ ID NO: 34282 - RNA, 1125 nt, Artificial Sequence
  derived and/or modified sequence opt1 from PBX4__Homo_sapiens__NP_079521
auggccgcgcccccgcgccccgcccccagcccgcccgcgccccggcgccuggacaccuccgacgugcuccagcagaucauggccaucaccgaccagagccuggacgaggcccaggcccggaagcacgcccugaacugccaccgcaugaagcccgcccucuucuccguccugugcgagaucaaggagaagacgguggugagcauccggggcauccaggacgaggacccgcccgacgcccagcugcuccgccuggacaacaugcugcucgccgagggggucugccggcccgagaagcgcggccgcgggggcgcgguggcccgggccgggaccgccacccccggcggcugccccaacgacaacuccaucgagcacagcgacuaccgggccaagcugucccagauccgccagaucuaccacagcgagcuggagaaguacgagcaggcgugccgggaguucaccacgcacgugaccaaccuccugcaggagcagucccgcaugcggccggucagccccaaggagaucgagcgcauggugggggccauccacggcaaguucuccgccauccagaugcagcugaagcagagcacgugcgaggccgugaugacccuccggucccgccugcuggacgcccggcgcaagcggcgcaacuucagcaagcaggcgaccgagguccucaacgaguacuucuacucccaccugaacaaccccuaccccagcgaggaggccaaggaggagcuggcccgcaagggcgggcucaccaucucccaggugagcaacugguucgggaacaagcggauccgcuacaagaagaacaugggcaaguuccaggaggaggccaccaucuacaccggcaagacggccguggacaccaccgaggucggggugccgggcaaccacgcguccugccugagcacccccagcuccgggagcuccggccccuucccccugccgagcgccggcgacgccuuccucacgcugcggacccuggccucccuccagcccccgcccgggggcgggugccugcagagccaggcccagggcuccuggcagggggcgacgccccagcccgccaccgccagccccgccggcgaccccggcuccaucaacagcuccaccagcaacuga

SEQ ID NO: 34283 - RNA, 315 nt, Artificial Sequence
  derived and/or modified sequence opt1 from PCBD1__Homo_sapiens__NP_000272
auggccggcaaggcccaccgccugagcgcggaggagcgggaccagcuccugcccaaccugcgcgccgugggguggaacgagcucgagggccgggacgccaucuucaagcaguuccacuucaaggacuucaaccgcgccuucggguucaugacccgggucgcccugcaggcggagaagcuggaccaccacccggagugguucaacguguacaacaaggugcacaucacccucuccacgcacgagugcgccggccugagcgagcgcgacaucaaccuggccuccuucaucgagcaggucgccgugagcaugaccuga

SEQ ID NO: 34284 - RNA, 393 nt, Artificial Sequence
  derived and/or modified sequence opt1 from PCBD2__Homo_sapiens__NP_115527
auggccgccgugcugggcgcgcucggggccacccgccggcugcuggccgcccuccgcggccagagccuggggcuggccgcgauguccagcggcacccaccggcucacggccgaggagcgcaaccaggccauccuggaccugaaggccgcggggugguccgagcucagcgagcgggacgccaucuacaaggaguucuccuuccacaacuucaaccaggccuucggcuucaugagccgcgucgcccugcaggccgagaagaugaaccaccaccccgagugguucaacguguacaacaaggugcagaucacccugaccucccacgacugcggcgagcucaccaagaaggacgucaagcuggcgaaguucaucgagaaggccgccgccagcguguga

SEQ ID NO: 34285 - RNA, 1071 nt, Artificial Sequence
  derived and/or modified sequence opt1 from PCBP1__Homo_sapiens__NP_006187
auggacgccggcgugaccgagagcgggcugaacgucacccucacgauccgccugcugaugcacggcaaggaggugggguccaucaucggcaagaagggggagagcgugaagcggauccgcgaggaguccggcgcccggaucaacaucagcgagggcaacugccccgagcgcaucaucacccucaccgggccgaccaacgcgaucuucaaggccuucgccaugaucaucgacaagcuggaggaggacaucaacuccagcaugacgaacuccaccgccgccagccggccgcccgucacccugcgccucguggugcccgcgacccagugcggcucccugaucgggaagggcgggugcaagaucaaggagauccgggagagcacgggcgcccagguccagguggccggcgacaugcugcccaacuccaccgagcgcgccaucaccaucgcgggggugccccagagcgucaccgagugcgugaagcagaucugccucgugaugcuggagacgcugucccagagcccccagggccgggucaugaccauccccuaccagccgaugcccgccuccagccccgugaucugcgccgggggccaggaccgcugcuccgacgccgccggcuacccccacgcgacccacgaccucgaggggccgccccuggacgccuacagcauccagggccagcacaccaucagcccccuggaccucgccaagcugaaccagguggcccggcagcagucccacuucgccaugaugcacgggggcacgggguucgcgggcaucgacagcuccagccccgaggucaagggcuacugggccucccuggacgccagcacccagaccacccacgagcucacgaucccgaacaaccugaucgggugcaucaucggccgccagggggccaacaucaacgagauccggcagauguccggcgcccagaucaagaucgcgaaccccguggaggggagcuccggccgccaggugaccaucaccggcagcgccgccuccaucagccuggcccaguaccucaucaacgcccggcuguccagcgagaaggggaugggcugcuccuga

SEQ ID NO: 34286 - RNA, 996 nt, Artificial Sequence
  derived and/or modified sequence opt1 from PCBP2__Homo_sapiens__NP_001092090
auggacaccggcgugaucgagggcgggcugaacgucacccucacgauccgccugcugaugcacgggaaggaggugggcagcaucaucgggaagaagggcgaguccgugaagaagaugcgggaggagagcggcgcccgcaucaacaucuccgaggggaacugccccgagcggaucaucacccucgccggcccgaccaacgcgaucuucaaggccuucgccaugaucaucgacaagcuggaggaggacaucagcuccagcaugaccaacuccacggccgccagccgcccgcccgucacccugcggcucguggugcccgcgucccagugcgggagccugaucggcaagggcgggugcaagaucaaggagauccgcgaguccaccggcgcccagguccagguggccggggacaugcugcccaacagcaccgagcgggccaucacgaucgcgggcaucccccaguccaucaucgagugcgugaagcagaucugcgucgugaugcucgagagcccgcccaagggggugaccauccccuaccgccccaagcccuccagcucccccgucaucuucgccggcggccaggccuacaccauccaggggcaguacgccaucccgcagcccgaccugaccaagcugcaccagcucgccaugcagcagagccacuuccccaugacgcacggcaacaccggguucuccggcaucgagagcagcucccccgaggugaagggguacugggcgggccuggacgccagcgcccagaccaccucccacgagcugacgaucccgaacgaccucaucggcugcaucaucgggcggcagggcgccaagaucaacgagauccgccagaugagcggggcccagaucaagaucgcgaaccccguggagggcuccaccgaccggcaggucaccaucaccgggagcgccgccuccaucagccuggcccaguaccugaucaacgugcgccucuccagcgagacgggcggcaugggguccagcuga

SEQ ID NO: 34287 - RNA, 1038 nt, Artificial Sequence
  derived and/or modified sequence opt1 from PCBP3__Homo_sapiens__NP_001123613
augggcgagggggacgccuucugggcccccagcgugcugccgcacuccacccucagcacccugucccaccacccccagccccaguucggccgccggauggagagcaaggucuccgagggcgggcugaacgugacgcucaccauccgccugcugaugcacgggaaggaggugggcagcaucaucggcaagaagggggagaccgucaagaagaugcgggaggaguccggcgcgcgcaucaacaucagcgaggggaacugccccgagcggaucgugaccaucacgggcccgaccgacgccaucuucaaggccuucgccaugaucgccuacaaguucgaggaggacaucaucaacuccaugagcaacucccccgcgaccagcaagccgcccgugacccuccgccuggucgugcccgccucccagugcgggagccugaucggcaagggcggguccaagaucaaggagauccgggagagcacgggcgcccaggugcaggucgccggggacaugcuccccaacuccaccgagcgcgcggugaccaucagcggcacccccgacgccaucauccagugcgugaagcagaucugcgucgugaugcuggaggccuacacgauccagggccaguacgccaucccccacccggaccugaccaagcuccaccagcuggccaugcagcagacccccuucccgccccuggggcagaccaaccccgcguuccccggcgagaagcucccccugcacuccagcgaggaggcccagaaccugauggggcagagcuccggccucgacgccagcccgcccgccuccacgcacgagcugaccauccccaacgaccugaucgggugcaucaucggccggcagggcaccaagaucaacgagauccgccagaugagcggggcccagaucaagaucgcgaacgccaccgagggcuccagcgagcggcagaucacgaucaccgggacccccgccaacaucucccucgcccaguaccugaucaacgcccgccugaccagcgaggugacgggcauggggacccucuga

SEQ ID NO: 34288 - RNA, 1281 nt, Artificial Sequence
  derived and/or modified sequence opt1 from PCBP4__Homo_sapiens__XP_005265387
auggaggccggccagguggccgcgcgcacccacagccaggucgccguggcccccgccucccccgaccggaugagcggguccgacggcgggcuggaggaggagcccgagcucagcaucacccugacgcugcgcaugcucaugcacggcaaggaggugggguccaucaucggcaagaagggcgagaccgucaagcggauccgcgagcagagcuccgcccggaucaccaucagcgagggguccugccccgagcgcaucaccacgaucaccggcagcaccgcggccguguuccacgccguguccaugaucgccuucaagcuggacgaggaccugugcgcggcccccgccaacgggggcaacgucagccggccgcccgugacccuccgccuggugauccccgccucccagugcgggagccugaucggcaaggccggcacgaagaucaaggagauccgggagaccaccggggcgcagguccagguggccggcgaccuccugcccaacuccaccgagcgcgccgugacggucagcggggugccggacgccaucauccugugcgugcggcagaucugcgccgucauccucgaguccccgcccaagggcgcgaccauccccuaccaccccagccugucccugggcaccgugcuccugagcgccaaccagggguucagcgugcagggccaguacggggccgucacccccgccgaggugacgaagcugcagcagcucuccagccacgccgugcccuucgcgacccccuccgucgugccgggccuggaccccgggacccagaccagcucccaggaguuccuggugcccaacgaccucaucggcugcgucaucggccgccaggggagcaagaucuccgagauccggcagaugagcggcgcccacaucaagaucgggaaccaggccgagggcgccggggagcgccacgugacgaucaccggcucccccgucagcaucgcccuggcgcaguaccugaucaccgccugccucgagaccgccaaguccacgagcggcgggaccccguccagcgcccccgcggaccugcccgcccccuucuccccgccccugaccgcccuccccaccgcgcccccgggccugcuggggacgcccuacgccaucagccucuccaacuucaucggccugaagcccaugccguuccuggcccucccgcccgccagccccgggcccccgcccggccuggccgccuacaccgccaagauggcggccgccaacggcuccaagaaggccgagcggcagaaguucagccccuacuga

SEQ ID NO: 34289 - RNA, 2187 nt, Artificial Sequence
  derived and/or modified sequence opt1 from PCCA__Homo_sapiens__NP_000273
auggccggcuucuggguggggaccgcgccccuggucgccgccggccgccgggggcgcuggccgccccagcagcucaugcugagcgccgcccugcggacccucaagcacgugcuguacuacucccgccagugccugauggugagccggaaccucggcuccgucggguacgaccccaacgagaagacguucgacaagauccugguggccaaccgcggcgagaucgcgugccgggugauccggaccugcaagaagaugggcaucaagaccgucgccauccacagcgacguggacgccuccagcgugcacgucaagauggccgacgaggcggugugcguggggcccgccccgaccuccaagagcuaccugaacauggacgccaucauggaggccaucaagaagacgcgcgcccaggcgguccaccccggcuacggguuccucuccgagaacaaggaguucgcccgcugccuggccgccgaggacgugguguucaucggccccgacacccacgccauccaggcgaugggggacaagaucgagagcaagcugcucgccaagaaggccgaggucaacaccauccccggcuucgacggcguggugaaggacgccgaggaggccguccggaucgcgcgcgagaucggguacccggugaugaucaaggccuccgccggcgggggcggcaaggggaugcggaucgccugggacgacgaggagacccgcgacggcuuccggcugagcucccaggaggccgcgagcuccuucggggacgaccgccugcucaucgagaaguucaucgacaacccccggcacaucgagauccaggugcugggcgacaagcacgggaacgcccuguggcucaacgagcgcgagugcagcauccagcggcgcaaccagaaggucguggaggaggcccccuccaucuuccuggacgccgagacgcggcgcgcgaugggcgagcaggccguggcccuggcccgcgccgucaaguacagcuccgcgggcaccguggaguuccucgucgacagcaagaagaacuucuacuuccuggagaugaacacccggcuccagguggagcaccccgugaccgagugcaucacggggcuggaccugguccaggagaugauccgcguggccaagggcuacccgcugcggcacaagcaggccgacauccgcaucaacgggugggccguggagugccgggucuacgccgaggaccccuacaagagcuucggccuccccuccaucgggcgccugagccaguaccaggagccccugcaccucccgggcgugcggguggacuccggcauccagcccgggagcgacaucuccaucuacuacgaccccaugaucagcaagcugaucaccuacggcuccgaccgcaccgaggcgcugaagcggauggccgacgcccucgacaacuacgucauccgcggggugacccacaacaucgcccugcugcgggaggugaucaucaacagccgcuucgucaagggcgacaucuccacgaaguuccucagcgacguguaccccgacggguucaagggccacaugcugaccaaguccgagaagaaccagcugcucgccaucgcgagcucccuguucguggccuuccagcugcgggcccagcacuuccaggagaacagccgcaugccggucaucaagcccgacaucgccaacugggagcucuccgugaagcugcacgacaaggugcacaccgucguggcgagcaacaacggcuccguguucagcgucgagguggacggguccaagcugaacgugaccagcacguggaaccucgccagcccccugcuguccgucagcguggacggcacccagcggaccgugcagugccucucccgcgaggccgggggcaacaugagcauccaguuccugggcaccgucuacaaggugaacauccugacgcggcuggccgccgagcucaacaaguucaugcuggagaaggugaccgaggacaccuccagcguccugcgcucccccaugccgggggugguggucgcggugagcgugaagcccggcgacgccgucgccgaggggcaggagaucugcgugaucgaggccaugaagaugcagaacuccaugaccgccggcaagacggggaccgucaagagcgugcacugccaggcgggcgacaccgugggcgagggggaccuccugguggagcuggaguga

SEQ ID NO: 34290 - RNA, 1620 nt, Artificial Sequence
  derived and/or modified sequence opt1 from PCCB__Homo_sapiens__NP_000523
auggccgccgcgcugcgcguggccgccgucggcgcccggcucagcgugcuggccuccgggcugcgcgcggccgugcggagccucugcucccaggccaccagcgucaacgagcgcaucgagaacaagcggcgcaccgcccugcugggcgggggccagcggcgcaucgacgcgcagcacaagcgggggaagcucacggcccgcgagcggaucucccugcugcucgaccccggcagcuucguggaguccgacauguucguggagcaccgcugcgccgacuucggcauggccgccgacaagaacaaguucccgggggacagcgucgugaccggccgggggcgcaucaacggccggcugguguacgucuucucccaggacuucaccguguucgggggcagccuguccggcgcgcacgcccagaagaucugcaagaucauggaccaggccaucaccgugggggcccccgucaucggccucaacgacagcgggggcgcccgcauccaggagggcguggagucccuggcgggguacgccgacaucuuccugcggaacgugacggccagcggcgucaucccccagaucucccucaucauggggcccugcgccggcggggccguguacagcccggcgcugaccgacuucaccuucauggugaaggacaccuccuaccuguucaucacgggccccgacgucgucaagagcgugaccaacgaggacgugacccaggaggagcucggcggggccaagacccacacgaccauguccggcguggcccaccgcgccuucgagaacgacguggacgcccugugcaaccugcgggacuucuucaacuaccucccccugagcagccaggaccccgcgccgguccgcgagugccacgaccccuccgaccggcuggugcccgagcucgacaccaucgucccccuggagagcaccaaggccuacaacaugguggacaucauccacuccguggucgacgagcgcgaguucuucgagaucaugccgaacuacgccaagaacaucaucgugggguucgcccgcaugaacggccggacgguggggaucgucggcaaccagcccaagguggcgagcggcugccuggacaucaacuccagcgugaagggggcccgcuucguccgguucugcgacgccuucaacaucccccucaucaccuucguggacgugcccggcuuccugccggggaccgcccaggaguacggcgggaucauccgccacggcgccaagcugcucuacgcguucgccgaggccaccguccccaaggugacggugaucacccggaaggccuacggcggggccuacgacgucauguccagcaagcaccugugcggcgacaccaacuacgcguggcccaccgccgagaucgccgugaugggggccaagggcgccguggagaucaucuucaagggccacgagaacgucgaggcggcccaggccgaguacaucgagaaguucgccaaccccuucccggcggccgugcgcggguucguggacgacaucauccagcccuccagcacgcgggcccgcaucugcugcgaccuggacguccucgccuccaagaaggugcagcggcccuggcgcaagcacgccaacaucccccuguga

SEQ ID NO: 34291 - RNA, 3123 nt, Artificial Sequence
  derived and/or modified sequence opt1 from PCDH10__Homo_sapiens__NP_116586
augaucgugcugcuccuguucgcccugcucuggauggucgagggcguguucagccagcugcacuacaccgugcaggaggagcaggagcacgggaccuucgucggcaacaucgccgaggaccuggggcucgacaucacgaagcuguccgcgcgcggcuuccagaccgugcccaacagccggacccccuaccuggaccucaaccuggagaccggggugcuguacgucaacgagaagaucgaccgcgagcagaucugcaagcagucccccagcugcgugcuccaccuggagguguuccuggagaacccccucgagcuguuccaggucgagaucgaggugcuggacaucaacgacaacccgcccuccuuccccgagcccgaccucacgguggagaucagcgaguccgccacccccggcacccgguucccgcuggagagcgccuucgaccccgacgucggcaccaacucccugcgcgacuacgagaucacgcccaacagcuacuucucccucgacgugcagacccagggggacggcaaccgguucgccgagcuggugcuggagaagccccucgaccgcgagcagcaggccguccaccgguacgugcugaccgcgguggacgggggcgggggcggcggggucggcgagggcgggggcgggggcgggggcgccgggcugccgccccagcagcagcgcaccggcacggcccuccugaccauccgggugcuggacagcaacgacaacgugcccgccuucgaccagcccgucuacaccgugucccucccggagaacagcccgcccggcacccuggugauccagcugaacgcgacggaccccgacgaggggcagaacggcgaggucguguacuccuucagcucccacaucagcccccgcgcccgggagcuguucgggcugagcccccgcaccggccggcuggaggucuccggggagcucgacuacgaggagagccccguguaccagguguacguccaggccaaggaccugggccccaacgccgugccggcccacugcaaggugcugguccgcgugcucgacgcgaacgacaacgcccccgagaucuccuucagcaccgugaaggaggccgucuccgagggcgccgcccccgggaccgugguggcgcuguucagcgucacggaccgggacuccgaggagaacggccaggugcagugcgagcugcucggggacgugcccuuccgccucaagagcuccuucaagaacuacuacaccaucgucaccgaggccccgcuggaccgggaggccggcgacagcuacacccucacggugguggcccgcgaccgcggggagcccgcccuguccaccagcaaguccauccagguccaggugagcgacgugaacgacaacgcgccccgguucucccagccggucuacgacguguacgugaccgagaacaacguccccggcgccuacaucuacgccgugagcgccaccgaccgggacgagggcgccaacgcgcagcuggccuacuccauccucgagugccagauccaggggaugagcguguucacguacgucuccaucaacagcgagaacggcuaccuguacgcccugcgcuccuucgacuacgagcagcugaaggacuucagcuuccagguggaggcccgcgacgcggggagcccccaggcccucgccggcaacgccaccgugaacauccugaucgucgaccagaacgacaacgcccccgcgaucguggccccgcugcccggccggaacgggacccccgcccgcgaggugcucccccgguccgccgagccgggcuaccugcugacccgcgucgccgcgguggacgccgacgacggggagaacgcccggcucacguacagcaucgugcgcggcaacgagaugaaccuguuccggauggacuggcgcaccggggagcugcggaccgcccgccggguccccgccaagcgcgacccccagcggcccuacgagcucgugaucgaggugcgcgaccacggccagccgccccuguccagcaccgcgacgcuggucgugcagcucguggacggcgccgucgagccccagggcgggggcggguccgggggcggcgggagcggcgagcaccagcggcccucccgcagcgggggcggggagaccucccuggaccugacccucauccugaucaucgcccugggcagcguguccuucaucuuccuccuggccaugaucgugcuggcgguccggugccagaaggagaagaagcucaacaucuacacgugccuggccagcgacugcugccugugcugcugcugcugcggcgggggcggguccacgugcugcggccgccaggcccgggcccgcaagaagaagcucagcaaguccgacaucaugcuggugcagagcuccaacgugccgagcaaccccgcccagguccccaucgaggagagcgggggcuucggcucccaccaccacaaccagaacuacugcuaccaggugugccugacccccgagagcgcgaagaccgaccucauguuccugaagccgugcucccccagccgcuccaccgacaccgagcacaaccccugcggggccaucgugaccggcuacaccgaccagcagcccgacaucaucagcaacggguccauccugagcaacgagaccaagcaccagcgggccgagcucuccuaccuggucgaccgcccgcggcgcgugaacagcuccgccuuccaggaggccgacaucgucagcuccaaggacagcggccacggcgacuccgagcagggggacagcgaccacgacgcgaccaaccgggcccaguccgccggcauggaccuguucagcaacugcacggaggagugcaaggcccucgggcacuccgaccgcugcuggaugcccagcuucgugcccagcgacggccggcaggccgcggacuaccgcuccaaccugcacgugccggggauggacagcguccccgacaccgagguguucgagacccccgaggcccagcccggcgccgagcgguccuucagcaccuucggcaaggagaaggcccugcacuccacgcucgagcgcaaggagcuggacgggcugcucaccaacacccgggcgccguacaagccgcccuaccugacccgcaagcggaucugcuga

SEQ ID NO: 34292 - RNA, 4020 nt, Artificial Sequence
  derived and/or modified sequence opt1 from PCDH11X__Homo_sapiens__NP_001161832
auggaccugcucagcggcaccuacaucuucgccgugcugcuggccugcgucguguuccacuccggggcgcaggagaagaacuacaccauccgcgaggagaugcccgagaacgugcucaucggcgaccugcugaaggaccucaaccugagccugauccccaacaagucccucaccaccgccaugcaguucaagcuggucuacaagaccggggacgugccccugauccggaucgaggaggacaccggcgagaucuucacgaccggggcccgcaucgaccgggagaagcucugcgccggcaucccccgcgacgagcacugcuucuacgagguggaggucgccauccugcccgacgagaucuuccggcuggugaagauccgcuuccucaucgaggacaucaacgacaacgcgccgcuguuccccgccaccgugaucaacaucagcauccccgagaacuccgccaucaacagcaaguacacccugcccgccgcggucgacccggacgugggcaucaacggggugcagaacuacgagcucaucaagucccagaacaucuucggccuggacgucaucgagacgcccgagggggacaagaugccccagcugaucgugcagaaggagcucgaccgggaggagaaggacaccuacgugaugaaggucaagguggaggacggcggguucccccagcgcagcuccaccgccauccuccaggugagcgucaccgacacgaacgacaaccacccgguguucaaggagaccgagaucgagguguccauccccgagaacgcccccgucggcaccagcgugacccagcugcacgccacggacgccgacaucggcgagaacgcgaagauccacuucuccuucagcaaccugguguccaacaucgcccggcgccuguuccaccugaacgccaccaccgggcucaucaccaucaaggagccccuggaccgggaggagacgccgaaccacaagcugcucguccuggccagcgacggcgggcugaugcccgcccgcgcgauggugcucgucaacgugaccgacgugaacgacaacguccccuccaucgacauccgguacaucgugaaccccgugaacgacaccgucgugcugagcgagaacaucccgcugaacaccaagaucgcccucaucacggugaccgacaaggacgccgaccacaacggccgcgugaccugcuucaccgaccacgagauccccuuccggcugcgccccgucuucuccaaccaguuccugcucgagacggccgccuaccuggacuacgagagcaccaaggaguacgcgaucaagcugcucgccgccgacgccggcaagcccccgcugaaccagagcgccaugcuguucaucaaggugaaggacgagaacgacaacgcgcccgucuucacccaguccuucgugaccgugagcauccccgagaacaacucccccgggauccagcucacgaaggucagcgccauggacgccgacuccggcccgaacgccaagaucaacuaccugcuggggcccgacgcgcccccggaguucagccucgacugccggaccggcaugcugaccguggugaagaagcuggaccgcgagaaggaggacaaguaccuguucaccauccucgccaaggacaacggggucccgccccugacguccaacgugaccguguucgucagcaucaucgaccagaacgacaacucccccguguucacccacaacgaguacaacuucuacgugcccgagaaccugccccggcacggcaccgucggccucaucaccgugacggaccccgacuacggggacaacagcgccgugacccuguccauccuggacgagaacgacgacuucaccaucgacagccagaccggcgucauccgccccaacaucuccuucgaccgggagaagcaggagagcuacacguucuacgugaaggccgaggacgggggccgcgugucccgcagcuccagcgccaaggucaccaucaacgugguggacgucaacgacaacaagccgguguucaucgugccgcccuccaacugcagcuacgagcucguccugcccagcaccaaccccgggaccgugguguuccaggucaucgcgguggacaacgacacgggcaugaacgccgaggugcgguacuccaucgucggcgggaacacccgcgaccuguucgccaucgaccaggagaccggcaacaucacccucauggagaagugcgacgugacggaccuggggcugcaccgggugcucgucaaggccaacgaccugggccagcccgacagccuguucuccguggugaucgucaaccucuucgugaacgagagcgugaccaacgccacccugaucaacgagcugguccgcaaguccaccgaggcgcccgugacgcccaacaccgagaucgccgacgucagcuccccgaccagcgacuacgugaagauccucguggccgccgucgccgggaccaucacggugguggucgugaucuucaucaccgcggugguccggugccgccaggcgccccaccugaaggccgcccagaagaacaagcagaacuccgagugggccacccccaaccccgagaaccggcagaugaucaugaugaagaagaagaagaagaagaagaagcacagcccgaagaaccugcuccugaacuucgugaccaucgaggagacgaaggccgacgacguggacuccgacggcaaccgcgucacccuggaccuccccaucgaccuggaggagcagaccaugggcaaguacaacugggugaccacgcccaccaccuucaagcccgacagcccggaccuggcccggcacuacaaguccgccagcccccagcccgccuuccagauccagccggagacgccccucaacuccaagcaccacaucauccaggagcugccccuggacaacaccuucguggcgugcgacagcaucuccaagugcagcagcuccagcuccgaccccuacagcgucuccgacugcggguacccggugaccaccuucgaggugcccgucagcgugcacacccgcccgcccaugaaggaggugguccgguccugcacgcccaugaaggagagcaccaccauggagaucuggauccacccccagccccagcgcaaguccgagggcaagguggccggcaagagccagcggcgcgugaccuuccaccuccccgaggggucccaggagagcuccagcgacggcgggcugggcgaccacgacgccgggucccugaccagcacgucccacggccucccgcugggguacccccaggaggaguacuucgaccgggccacccccagcaaccgcaccgagggcgacggcaacuccgaccccgagagcaccgccgagaucacgguccagccgaccguggaggaggcgagcgacaacugcacccaggagugccugaucuacgggcacuccgacgccugcuggaugcccgccagccucgaccacuccagcuccagccaggcccaggccuccgcgcugugccacagcccgccccugucccaggccagcacccagcaccacagcccccgggugacgcagaccaucgcccucugccacuccccgcccgucacccagaccaucgcccugugccacagcccgccgcccauccagguguccgcgcugcaccacuccccgccccucgugcaggccacggcccugcaccacagcccgcccuccgcccaggccagcgcgcugugcuacagcccgccccucgcccaggccgccgccaucucccacagcagcccccugccccaggucaucgcgcugcaccgcucccaggcccaguccagcgugucccuccagcagggcugggugcagggggccgacggccugugcagcgucgaccagggggugcagggcuccgccaccagccaguucuacaccauguccgagcggcugcaccccagcgacgacuccaucaaggugaucccccucaccacguucacgccccgccagcaggcccgccccagccggggcgacucccccaucauggaggagcacccccuguga

SEQ ID NO: 34293 - RNA, 3114 nt, Artificial Sequence
  derived and/or modified sequence opt1 from PCDH11Y__Homo_sapiens__NP_116753
augaccgugggcuucaacagcgacaucuccagcgucgugcgcgugaacaccacgaacugccacaagugccugcucuccgggaccuacaucuucgccguccugcuggugugcguggucuuccacagcggcgcccaggagaagaacuacaccauccgggaggagauccccgagaacgugcucaucgggaaccugcugaaggaccucaaccugucccugaucccgaacaagagccucaccacgaccaugcaguucaagcugguguacaagaccggcgacgucccccugauccgcaucgaggaggacaccggggagaucuucacgaccggcgcgcggaucgaccgcgagaagcucugcgccggcaucccccgggacgagcacugcuucuacgagguggagguggccauccugcccgacgagaucuuccgccuggucaagauccgguuccucaucgaggacaucaacgacaacgccccgcuguuccccgccaccgugaucaacaucuccauccccgagaacagcgcgaucaacuccaaguacacccugcccgccgccguggacccggacgucgggaucaacggcgugcagaacuacgagcucaucaagagccagaacaucuucgggcuggacgugaucgagacgcccgagggcgacaagaugccccagcugaucguccagaaggagcucgaccgcgaggagaaggacaccuacgugaugaaggugaaggucgaggacgggggcuucccccagcgguccagcaccgccauccuccagguguccgugaccgacacgaacgacaaccacccggucuucaaggagaccgagaucgaggugagcauccccgagaacgcgcccgucggcaccuccgugacccagcugcacgccacggacgccgacaucggggagaacgccaagauccacuucagcuucuccaaccuggugagcaacaucgcccgccggcuguuccaccugaacgcgaccaccggccucaucaccaucaaggagccccuggaccgcgaggagacgccgaaccacaagcugcucguccuggccuccgacgggggccugaugcccgcccgggccauggugcucgugaacgucaccgacgugaacgacaacgugcccagcaucgacauccgcuacaucgucaaccccgugaacgacaccgugguccugagcgagaacaucccgcugaacaccaagaucgcccucaucacggugaccgacaaggacgcggaccacaacggccgggugaccugcuucaccgaccacgagauccccuuccgccugcggcccgucuucuccaaccaguuccugcucgagaacgccgccuaccuggacuacgagagcacgaaggaguacgccaucaagcugcucgccgcggacgccgggaagcccccgcugaaccaguccgccaugcuguucaucaaggugaaggacgagaacgacaacgcccccguguucacccagagcuucgucaccguguccauccccgagaacaacagccccggcauccagcucaugaagguguccgccaccgacgcggacagcgggccgaacgccgagaucaacuaccugcugggccccgacgcgcccccggaguucucccucgaccgccggacggggaugcugaccgucgugaagaagcuggaccgcgagaaggaggacaaguaccuguucaccauccucgccaaggacaacggcgugccgccccugaccagcaacgucaccguguucguguccaucaucgaccagaacgacaacagccccgucuucacgcacaacgaguacaaguucuacgugcccgagaaccugccccggcacggcaccguggggcucaucaccgucaccgaccccgacuacggcgacaacuccgccgugacgcugagcauccuggacgagaacgacgacuucaccaucgacucccagaccggggugauccgccccaacaucagcuucgaccgcgagaagcaggaguccuacaccuucuacgucaaggccgaggacggcgggcgggugagccgcuccagcagcgccaaggugacgaucaacgucguggacgugaacgacaacaagccggucuucaucgugccgcccuacaacuacuccuacgagcucgugcugcccagcaccaaccccggcaccgucguguuccaggugaucgccgucgacaacgacaccggcaugaacgccgaggugcgguacuccaucgucgggggcaacacgcgcgaccuguucgcgaucgaccaggagaccgggaacaucacccucauggagaagugcgacgugaccgaccugggccugcaccgggugcucgugaaggccaacgaccuggggcagcccgacagccuguucuccgucgugaucgucaaccucuucgugaacgagagcgugacgaacgccacccugaucaacgagcugguccgcaaguccaucgaggcccccgugacccccaacaccgagaucgccgacgugagcuccccgacgagcgacuacgucaagauccucguggcggccguggccggcaccaucaccgucgugguggucaucuucaucaccgccguggugcggugccgccaggcgccccaccugaaggccgcccagaagaacaugcagaacuccgagugggccacgcccaaccccgagaaccggcagaugaucaugaugaagaagaagaagaagaagaagaagcacagcccgaagaaccugcuccugaacgucgugaccaucgaggagaccaaggccgacgacguggacuccgacggcaaccgcgucacccuggaccuccccaucgaccuggaggagcagacgauggggaaguacaacugggugaccacccccaccacguucaagcccgacagcccggaccuggcgcggcacuacaaguccgccagcccccagcccgccuuccagauccagccggagacgccccucaaccugaagcaccacaucauccaggagcugccccucgacaacaccuucguggccugcgacuccaucagcaacugcagcuccagcuccagcgaccccuacuccgucagcgacugcggcuacccggugaccaccuucgaggugcccgucuccgugcacacccgccccaccgacagccggaccuga

SEQ ID NO: 34294 - RNA, 5889 nt, Artificial Sequence
  derived and/or modified sequence opt1 from PCDH15__Homo_sapiens__NP_001136235
auguuccgccaguucuaccuguggaccugccucgccagcggcaucauccuggggucccuguucgagaucugccucggccaguacgacgacgacuggcaguacgaggacugcaagcuggcccgggggggccccccggcgaccaucguggccaucgacgaggagagccgcaacgggacgauccuggucgacaacaugcucaucaagggcaccgccggcgggcccgaccccaccaucgagcugucccugaaggacaacguggacuacugggugcucauggaccccgucaagcagaugcuguuccugaacagcaccggccgggugcucgaccgcgacccgcccaugaacauccacuccaucgugguccaggugcagugcaucaacaagaagguggggacgaucaucuaccacgagguccggaucguggugcgcgaccggaacgacaacagccccaccuucaagcacgaguccuacuacgccaccgucaacgagcugacccccgugggcacgaccaucuucaccggguucagcggcgacaacggcgccaccgacaucgacgacgggccgaacggccagaucgaguacgugauccaguacaaccccgacgaccccacguccaacgacaccuucgagaucccccugaugcucaccgggaacaucguccugcgcaagcggcugaacuacgaggacaagacccgcuacuucgugaucauccaggcgaacgaccgggcccagaaccucaacgagcgccggacgaccaccaccacgcugaccguggacguccuggacggcgacgaccucggcccgauguuccugcccugcgugcuggugcccaacacccgcgacugccggccccucaccuaccaggccgccaucccggagcugcgcacgcccgaggagcugaaccccaucaucgucacccccccgauccaggcgaucgaccaggaccggaacauccagccccccagcgaccgccccgggauccucuacuccauccuggugggcaccccggaggacuacccccgguucuuccacaugcacccccgcaccgccgagcugagccuccuggagcccgugaaccgggacuuccaccagaaguucgaccuggucaucaaggccgagcaggacaacgggcacccgcuccccgccuucgccggccugcacaucgagauccuggacgagaacaaccagucccccuacuucacgaugccgagcuaccagggguacauccucgaguccgcgcccgugggcgccaccaucagcgacucccugaaccugaccagcccccuccgcaucgucgcccuggacaaggacaucgaggacaccaaggaccccgagcugcaccucuuccugaacgacuacacguccguguucaccgugacccagaccggcaucacgcgcuaccugacccuccugcagccggucgaccgggaggagcagcagaccuacaccuucagcaucaccgccuucgacggggugcaggagagcgagcccgugaucgucaacauccaggugauggacgccaacgacaacacgcccaccuuccccgagaucuccuacgacguguacgucuacaccgacaugcgcccgggcgacagcgugauccagcugaccgcgguggacgccgacgagggguccaacggcgagaucacguacgagauccucgucggggcccagggcgacuucaucaucaacaagaccaccggccugaucaccaucgcccccgggguggagaugaucgugggccggacguacgcccugaccguccaggcggccgacaacgccccccccgccgagcgccggaacagcaucugcaccguguacaucgaggugcugccgcccaacaaccagucccccccccgcuucccgcagcucauguacagccuggagaucuccgaggccaugcgggucggggcggugcugcucaaccugcaggccaccgaccgcgagggcgacagcaucacguacgccaucgagaacggggacccccagcggguguucaaccuguccgagaccaccggcauccucacccugggcaaggcccuggaccgcgagagcacggaccgguacauccucaucaucaccgcguccgacgggcgccccgacggcaccagcaccgccacggucaacaucguggugaccgacgucaacgacaacgcccccguguucgacccguaccugccccggaaccuguccguggucgaggaggaggccaacgccuucguggggcaggugaaggcgaccgaccccgacgccggcaucaacggccagguccacuacagccucgggaacuucaacaaccuguuccgcaucaccuccaacggcagcaucuacacggccgugaagcugaaccgggaggugcgcgacuacuacgagcucgucgugguggccaccgacggggccguccacccccggcacuccacccugacccuggcgaucaaggugcucgacaucgacgacaacagcccgguguucacgaacuccaccuacaccguccugguggaggagaaccugcccgccggcaccacgauccuccagaucgaggccaaggacguggaccugggggccaacgucagcuaccgcauccggagccccgaggugaagcacuucuucgcccugcacccguucaccggcgagcucucccugcugcgcagccucgacuacgaggcguuccccgaccaggaggccuccaucaccuuccugguggaggccuucgacaucuacggcaccaugccccccgggaucgccacggucaccgugaucgugaaggacaugaacgacuacccgcccgucuucagcaagcgcaucuacaagggcaugguggcgcccgacgccgugaaggggacccccaucaccaccgucuacgccgaggacgccgacccgcccggccugcccgccucccgggugcgcuaccgggucgacgacgugcaguuccccuacccggcgagcaucuucgagguggaggaggacuccgggcgcgucaucacgcgggugaaccucaacgaggagcccaccaccaucuucaagcugguggucguggccuucgacgacggcgagcccgugaugagcuccagcgccaccgucaagauccuggugcuccaccccggcgagaucccgcgcuucacgcaggaggaguaccggcccccccccguguccgagcuggccaccaaggggaccauggucggcgugaucagcgccgcggccaucaaccaguccaucguguacagcaucgucuccgggaacgaggaggacaccuucggcaucaacaacaucacgggggugaucuacgugaacggcccgcuggacuacgagacccgcaccagcuacguccuccgggugcaggccgacucccuggaggugguccuggccaaccuccgcgugcccagcaagagcaacaccgccaagguguacaucgagauccaggacgagaacaaccacccccccgucuuccagaagaaguucuacaucggcgggguguccgaggacgcgcggauguucacgagcgugcugcgcgucaaggccaccgacaaggacaccggcaacuacuccgugauggccuaccggcugaucaucccgcccaucaaggaggggaaggagggcuucguggucgagaccuacacggggcucaucaagaccgccaugcuguuccacaacaugcgccggagcuacuucaaguuccaggugaucgcgaccgacgacuacggcaagggccuguccgggaaggccgacgugcucgucagcguggugaaccagcuggacaugcaggucaucguguccaacgugccccccacccuggucgagaagaagaucgaggaccucacggagauccuggaccgcuacgugcaggagcagaucccgggcgccaagguggucguggagagcaucggggcccggcgccacggcgacgccuucucccuggaggacuacaccaagugcgaccucaccguguacgcgaucgacccccagaccaaccgggccaucgaccgcaacgagcuguucaaguuccuggacggcaagcuccuggacaucaacaaggacuuccagcccuacuacggggagggcgggcggauccuggagauccgcacgccggaggccgucaccagcaucaagaagcgcggcgagucccucggguacaccgagggcgcccugcuggcccucgcguucaucaucauccugugcugcauccccgccauccugguggugcucgucagcuaccggcaguucaaggugcgccaggccgagugcaccaagacggcccggauccaggccgcgcugcccgccgccaagcccgccgugccggcccccgcgcccgucgccgcccccccgcccccccccccgcccccccccggcgcccaccuguacgaggagcucggggacuccagcaugcacaaccuguuccugcucuaccacuuccagcagucccgcggcaacaacagcguguccgaggaccggaagcaccagcaggucgugaugccguucagcuccaacaccaucgaggcgcacaagagcgcccacguggacgggagccugaaguccaacaagcugaagagcgcccgcaaguucaccuuccucuccgacgaggacgaccugagcgcccacaacccccuguacaaggagaacaucucccaggucagcaccaacuccgacaucagccagcggacggacuucguggaccccuucucccccaagauccaggccaagagcaagucccuccgcggcccgcgggagaagauccagcgccuguggagccaguccgugagccugccccggcgccucaugcggaagguccccaaccgccccgagaucaucgaccugcagcaguggcaggggacccggcagaaggcggagaacgagaacaccggcaucugcaccaacaagcgcggcuccagcaacccgcugcucacgaccgaggaggccaaccugaccgagaaggaggagauccggcagggggagacccugaugaucgagggcaccgagcagcucaagucccugagcuccgacagcagcuucugcuucccccgcccccacuucuccuucagcacgcugcccaccgugucccggaccguggagcucaagagcgagccgaacgucaucuccagccccgccgagugcucccuggagcugagccccucccgcccgugcgugcuccacagcucccugagccgccgggagacccccaucugcaugcugcccaucgagacggagcgcaacaucuucgagaacuucgcccaccccccgaacaucucccccagcgccugcccccuccccccgcccccccccaucuccccgcccagcccccccccggcgcccgccccccuggcccccccgcccgacaucucccccuucagccuguucugccccccgcccucccccccgagcaucccccugccccuccccccgcccaccuucuucccccugagcguguccaccagcgggcccccgacccccccccugcuccccccguuccccacgccccugcccccgcccccccccuccaucccgugccccccccccccgagcgccuccuuccugagcaccgagugcgucugcaucaccggcgugaagugcaccacgaaccucaugcccgccgagaagaucaaguccagcaugacccagcuguccaccaccacggugugcaagaccgacccccagcgggagcccaaggggauccugcgccacgucaagaaccucgcggagcuggagaagagcguggccaacauguacucccagaucgagaagaacuaccugcggaccaacgugagcgagcuccagaccaugugcccguccgaggucacgaacauggagaucaccagcgagcagaacaagggcucccugaacaacaucguggagggcaccgagaagcagagccacucccagagcaccucccuguga

SEQ ID NO: 34295 - RNA, 3480 nt, Artificial Sequence
  derived and/or modified sequence opt1 from PCDH17__Homo_sapiens__XP_005266414
auguaccugagcaucugcugcugcuuccuccugugggcccccgcccugacccucaagaaccugaacuacuccgugccggaggagcagggcgcggggaccgucaucggcaacaucgggcgcgacgcccggcugcagcccggccucccgcccgccgagcgcgggggcggcgggcggagcaaguccggcagcuaccgcgugcuggagaacuccgcgccccaccuccuggacguggacgccgacagcgggcugcuguacacgaagcagcggaucgaccgcgagucccucugccggcacaacgccaagugccagcugagccuggaggucuucgccaacgacaaggagaucugcaugaucaagguggagauccaggacaucaacgacaacgcccccuccuucagcuccgaccagaucgagauggacaucagcgagaacgccgcgcccggcacccgcuucccccucaccuccgcccacgacccggacgccggggagaacggccugcggaccuaccugcucacgcgcgacgaccacggccuguucgggcuggacgucaagagccggggcgacgggaccaaguuccccgagcucgugauccagaaggcccuggaccgcgagcagcagaaccaccacacccuggugcucaccgcccuggacggcggcgagccgccccgguccgcgacggugcagaucaacgucaaggugaucgacagcaacgacaacucccccguguucgaggcccccagcuaccuggucgagcuccccgagaacgcgccccuggggaccguggugaucgaccugaacgccaccgacgccgacgagggcccgaacggggagguccucuacuccuucagcagcuacgugcccgaccgcgugcgggagcuguucuccaucgaccccaagaccggccugauccgcgucaaggggaaccucgacuacgaggagaacggcaugcuggagaucgacgugcaggcccgggaccugggccccaacccgauccccgcccacugcaaggugacggucaagcucaucgaccgcaacgacaacgcccccagcaucggguucguguccgugcggcagggcgcccugagcgaggccgcgcccccggggaccgucaucgcccuggugcgcgucaccgaccgggacuccggcaagaacgggcagcuccagugccgcgugcugggcggcgggggcaccgggggcgggggcggccucgggggccccgggggcagcgugcccuucaagcuggaggagaacuacgacaacuucuacacggucgugaccgaccgcccccuggaccgggagacccaggacgaguacaacgugaccaucgucgcccgcgacggcggguccccgccccugaacagcacgaaguccuucgccaucaagauccucgacgagaacgacaacccgccccgguucaccaagggccuguacgugcuccaggugcacgagaacaacauccccggggaguaccugggcagcguccuggcccaggaccccgaccuggggcagaacggcaccguguccuacagcauccugcccucccacaucggcgacgugagcaucuacaccuacgucuccgugaacccgacgaacggggcgaucuacgcccuccgcagcuucaacuucgagcagaccaaggccuucgaguucaaggugcuggccaaggacuccggcgcgcccgcccaccuggagagcaacgccaccguccgggugaccgugcucgacgucaacgacaacgcccccgugaucgugcugcccacgcugcagaacgacaccgccgagcuccaggucccgcgcaacgcggggcugggcuaccugguguccaccgugcgggcccucgacagcgacuucggggagagcggccgccugaccuacgagaucgucgacggcaacgacgaccaccuguucgagaucgaccccuccagcggggagauccggacgcuccaccccuucugggaggacgugacccccguggucgagcugguggugaaggucaccgaccacggcaagccgacccuguccgccguggccaagcucaucauccgcagcguguccgggagccugcccgagggcgucccccgggugaacggggagcagcaccacugggacaugucccugccccucaucgugacgcugagcaccaucuccaucauccugcucgccgcgaugaucaccaucgccgucaagugcaagcgcgagaacaaggagauccggaccuacaacugccgcaucgccgaguacagccacccgcagcugggcggcgggaagggcaagaagaagaagaucaacaagaacgacaucaugcuggugcaguccgagguggaggagcggaacgccaugaacgucaugaacguggugagcucccccagccucgccaccucccccauguacuucgacuaccagacgcgccugccccugagcuccccgcggagcgaggucauguaccucaagcccgcgagcaacaaccugaccgugccccaggggcacgccggcugccacaccuccuucaccgggcagggcacgaacgccagcgagacccccgccacccgcauguccaucauccagaccgacaacuucccggcggagcccaacuacaugggcagccggcagcaguucgugcaguccagcuccacguucaaggaccccgagcgcgccagccugcgcgacuccgggcacggcgacagcgaccaggccgacuccgaccaggacaccaacaaggggagcugcugcgacauguccguccgggaggcccucaagaugaagaccaccagcacgaagucccagccgcuggagcaggagcccgaggagugcgugaacugcaccgacgagugccgcgugcugggccacagcgaccggugcuggaugccccaguuccccgccgcgaaccaggccgagaacgccgacuaccgcaccaaccucuucgucccgaccguggaggccaacguggagacggagaccuacgagaccgucaaccccaccggcaagaagacguucugcaccuucgggaaggacaagcgggagcacaccauccugaucgccaacgugaagcccuaccugaaggcgaagcgcgcccucagcccccugcugcaggaggucccguccgccuccagcagccccaccaaggccugcaucgagcccugcacguccaccaagggcagccucgacgggugcgaggccaagcccggcgcgcuggccgaggccuccagccaguaccugccgaccgacucccaguaccucagccccuccaagcagccccgggacccgcccuucauggccagcgaccagauggcgcgcguguucgccgacgugcacucccgggccagccgcgacuccagcgagaugggggccguccuggagcagcuggaccaccccaaccgggaccucggccgcgaguccguggacgccgaggaggugguccgggagaucgacaagcugcugcaggacugccgcggcaacgaccccguggcggugcggaaguga

SEQ ID NO: 34296 - RNA, 3405 nt, Artificial Sequence
  derived and/or modified sequence opt1 from PCDH18__Homo_sapiens__NP_001287757
augcaccagaugaacgccaagaugcacuuccgcuucguguucgcccugcucaucgucagcuucaaccacgacgugcugggcaagaaccugaaguaccggaucuacgaggagcagcgcgugggguccgucaucgcgcggcucagcgaggacguggccgacgugcugcugaagcuccccaacccguccaccguccgcuuccgggccaugcagcgcggcaacagcccccugcugguggugaacgaggacaacggggagaucuccaucggcgccaccaucgaccgggagcagcucugccagaagaaccugaacugcagcaucgaguucgacgucaucacgcugcccaccgagcaccuccagcuguuccacaucgagguggaggugcuggacaucaacgacaacagcccccaguucucccgcucccucaucccgaucgagaucagcgaguccgccgcggucgggacccggaucccccuggacagcgccuucgaccccgacgugggcgagaacucccugcacaccuacagccucuccgccaacgacuucuucaacaucgaggugcgcacgcggaccgacggcgccaaguacgcggagcugaucgucgugcgcgagcuggaccgggagcucaagagcuccuacgagcugcagcugaccgccagcgacaugggggugccccagcgcuccggcagcagcauccucaagaucuccaucagcgacuccaacgacaacagcccggccuucgagcagcaguccuacaucauccagcugcuggagaacagccccgucgggacccuccugcuggaccucaacgccacggaccccgacgagggcgccaacgggaagaucguguacuccuucagcucccacgugagccccaagaucauggagaccuucaagaucgacuccgagcggggccaccugacccuguucaagcaggucgacuacgagaucaccaagagcuacgagaucgacgugcaggcgcaggaccucggcccgaacuccauccccgcccacugcaagaucaucaucaagguggucgacgugaacgacaacaagcccgagaucaacaucaaccugaugagccccgggaaggaggagaucuccuacaucuucgagggcgacccgaucgacacguucgucgcccuggugcgcgugcaggacaaggacagcgggcucaacggcgagaucgucugcaagcugcacggccacgggcacuucaagcugcagaagaccuacgagaacaacuaccucauccugaccaacgccacccuggaccgggagaagcgcuccgaguacagccucacggugaucgccgaggaccggggcacccccucccugagcaccgugaagcacuucaccguccagaucaacgacaucaacgacaacccgccccacuuccagcgcagccgguacgaguucgugaucuccgagaacaacagccccggggcguacaucacgaccgugaccgccaccgaccccgaccugggcgagaacgggcaggucacguacaccauccucgaguccuucauccugggcagcuccaucaccaccuacgugacgaucgaccccagcaacggcgccaucuacgcccugcgcaucuucgaccacgaggaggugucccagaucaccuucgucguggaggcccgcgacgggggcagccccaagcagcucguguccaacaccaccgucgugcugacgaucaucgacgagaacgacaacgugccggucgugaucgggcccgcgcugcggaacaacaccgccgagaucaccauccccaagggcgccgagagcggguuccacgugacccgcauccgggccaucgaccgcgacuccggcgucaacgccgagcugagcugcgcgaucguggccggcaacgaggagaacaucuucaucaucgacccccgguccugcgacauccacacgaacgugagcauggacuccgucccguacaccgagugggagcucagcgugaucauccaggacaaggggaacccccagcugcacaccaaggugcugcucaagugcaugaucuucgaguacgccgaguccgucaccagcaccgccaugacgagcgugucccaggcgagccuggacguguccaugaucaucaucaucagccugggcgccaucugcgccguccuccuggugaucauggugcuguucgccacccgcugcaaccgggagaagaaggacacccgcuccuacaacugccgggucgccgagagcaccuaccagcaccaccccaagcgcccgucccggcagauccacaagggggacaucacgcucgugcccaccaucaacggcacccugcccauccgcagccaccaccgguccagccccuccagcuccccgacccuggagcgcgggcagaugggcagccggcagucccacaacagccaccagucccucaacagccuggugacgaucuccagcaaccacguccccgagaacuucagccuggagcucacccacgcgacccccgccguggaggugucccagcugcugagcaugcuccaccagggccaguaccagccccgcccguccuuccgggggaacaaguacagccgcuccuaccgguacgcccugcaggacauggacaaguucagccugaaggacuccggccgcggggacagcgaggccggcgacuccgacuacgaccucggccgcgacagccccaucgaccggcugcugggggagggcuucuccgaccucuuccugaccgacgggcgcauccccgccgcgaugcggcugugcacggaggagugccgcguccucggccacagcgaccagugcuggaugcccccgcugcccucccccagcuccgacuaccggagcaacauguucauccccggggaggaguucccgacccagccccagcagcagcacccccaccagucccuggaggacgacgcccagcccgccgacagcggcgagaagaagaaguccuucagcaccuucggcaaggacagcccgaacgacgaggacaccggggacacguccaccagcucccuccugagcgagauguccagcguguuccagcgccugcucccgcccucccuggacaccuacagcgagugcuccgagguggaccggagcaacucccuggagcgccggaagggcccccuccccgccaagaccgucggguacccccagggcguggccgcgugggccgccagcacgcacuuccagaaccccaccaccaacugcgggccgccccugggcacccacuccagcgugcagcccuccagcaaguggcugcccgccauggaggagaucccggagaacuacgaggaggacgacuucgacaacguccucaaccaccugaacgacggcaagcacgagcugauggacgcguccgagcucguggccgagaucaacaagcugcugcaggacgugcgccagagcuga

SEQ ID NO: 34297 - RNA, 3306 nt, Artificial Sequence
  derived and/or modified sequence opt1 from PCDH19__Homo_sapiens__NP_001098713
auggagagccugcuccugcccgugcugcuccugcuggccauccucuggacccaggccgcggcccugaucaaccugaaguacuccgucgaggaggagcagcgcgccggcaccgugaucgccaacguggccaaggacgcgcgggaggccggguucgcccucgacccgcgccaggccagcgcguuccgggucguguccaacagcgcgccccaccugguggacaucaaccccuccagcggccugcucgucacgaagcagaagaucgaccgcgaccugcugugccggcagucccccaagugcaucaucagccucgaggugauguccagcuccauggagaucugcgugaucaaggucgagaucaaggaccugaacgacaacgccccgagcuuccccgccgcccagaucgagcuggagaucuccgaggccgccagccccgggacccgcaucccccucgacuccgccuacgacccggacagcggcuccuucggggugcagaccuacgagcugacccccaacgagcuguucggccucgagaucaagacgcggggcgacgggagccgcuucgccgagcugguggucgagaagucccuggaccgggagacccagagccacuacagcuuccgcaucaccgcccucgacggcggggacccgccccggcugggcaccguggggcuguccaucaaggugacggacagcaacgacaacaaccccgucuucuccgagagcaccuacgcgguguccgugcccgagaacagcccgcccaacacccccgucauccgccucaacgccuccgaccccgacgagggcaccaacggccaggugguguacagcuucuacggguacgucaacgaccggacgcgcgagcuguuccagaucgacccccacuccggccuggugaccgugaccggggcccucgacuacgaggagggccacgucuacgagcuggacgugcaggccaaggaccugggccccaacagcaucccggcccacugcaaggucaccguguccgugcucgacacgaacgacaacccgcccgucaucaaccugcugagcgugaacuccgagcucguggaggucagcgaguccgcgccgcccggguacgugaucgcccuggugcgggucagcgaccgcgacuccggccugaacgggcgggugcagugccgccuccugggcaacgugcccuuccggcugcaggaguacgagagcuucuccaccauccucgucgacgggcgccuggaccgggagcagcacgaccaguacaaccugaccauccaggcccgcgacggcggcgugcccaugcuccagagcgccaagagcuucaccgugcugaucacggacgagaacgacaaccacccccacuucuccaagcccuacuaccaggucaucgugcaggagaacaacacccccggggccuaccugcucagcguguccgcgcgcgaccccgaccugggccugaacgggagcgucuccuaccagaucgugccgagccaggugcgggacaugcccgucuucaccuacguguccaucaaccccaacagcggcgacaucuacgcccugcgcuccuucaaccacgagcagaccaaggccuucgaguucaaggugcucgccaaggacgggggccugcccagccugcaguccaacgcgacgguccgggugaucauccucgacgugaacgacaacaccccggucaucaccgccccgccccugaucaacggcaccgccgagguguacaucccccgcaacagcgggaucggcuaccuggugacggucgugaaggccgaggacuacgacgagggggagaacggccgggugaccuacgacaugaccgagggggaccgcggcuucuucgagaucgaccaggucaacggcgaggugcggaccacgcgcaccuucggggaguccagcaaguccagcuacgagcucaucguggucgcccacgaccacggcaagaccucccugagcgcgagcgcccuggugcucaucuaccugucccccgcccuggacgcccaggagagcaugggguccgugaaccucagccugaucuucaucaucgcccugggcuccaucgcgggcauccucuucgucaccaugaucuucguggccaucaagugcaagcgggacaacaaggagauccgcacguacaacugccggaucgccgaguacagcuacgggcaccagaagaaguccagcaagaagaagaagaucuccaagaacgacauccgccuggugccccgggacgucgaggagaccgacaagaugaacguggugagcugcuccagccugaccuccagccucaacuacuucgacuaccaccagcagacccugccccugggcugccgccgguccgagagcaccuuccucaacgucgagaaccagaacacgcgcaacaccuccgccaaccacaucuaccaccacagcuucaacucccaggggccccagcagccggaccugaucaucaacggcgugccccugcccgagaccgagaacuacagcuucgacagcaacuacgugaacucccgggcccaccucaucaagagcuccagcaccuucaaggaccuggaggggaacucccugaaggacagcggccacgaggaguccgaccagacggacagcgagcacgacguccagcgcucccucuacugcgacaccgcggugaacgacgugcugaacaccagcgucaccuccaugggcagccagaugcccgaccacgaccagaacgagggguuccacugccgggaggagugccgcauccugggccacuccgaccgcugcuggaugccgcggaaccccaugcccauccgcagcaagucccccgagcacgugcggaacaucaucgcccucagcaucgaggccacggccgcggacgucgaggccuacgacgacugcgggccgaccaagcgcaccuucgccaccuucggcaaggacguguccgaccaccccgccgaggagcggcccacgcugaaggggaagcgcaccguggacgucaccaucugcagccccaaggugaacuccgugauccgggaggccggcaacggcugcgaggcgaucagcccggucaccagcccccugcaccucaaguccagccugcccacgaagccguccgugagcuacaccaucgcccuggccccgcccgcccgcgaccucgagcaguacgugaacaacgucaacaacgggcccacccggcccuccgaggccgagccccgcggcgcggacagcgagaaggugaugcacgaggugucccccauccugaaggaggggcggaacaaggagagccccggcgucaagcgccugaaggacaucgugcucuga

SEQ ID NO: 34298 - RNA, 3231 nt, Artificial Sequence
  derived and/or modified sequence opt1 from PCDH1__Homo_sapiens__NP_001265542
augcgcuuccgggaccugagcuucuggaaccgcggcuccgugcucgggcugaccgcccuggucgagaaccgggugagcgugggcgaggcccuccugauccuggggcccccgcgcauggagcaccuccggcacucccccggccccgggggccagcgccugcugcuccccagcaugcugcuggcgcuccugcugcuccuggccccgucccccggccacgccacccgggucguguacaaggugcccgaggagcagcccccgaacacgcugaucgggagccucgccgccgacuacggcuuccccgacgucgggcaccuguacaagcuggaggugggcgcgcccuaccuccgcguggacgggaagaccggcgacaucuucaccaccgagacguccaucgaccgggagggccugcgcgagugccagaaccagcugcccggggacccgugcauccucgaguucgaggucagcaucaccgaccuggugcagaacggcagcccccggcugcucgaggggcagaucgaggugcaggacaucaacgacaacacccccaacuucgccucccccgucaucacccuggccaucccggagaacacgaacaucggcucccuguuccccaucccccucgccagcgaccgcgacgcgggccccaacgggguggccuccuacgagcugcaggccggcccggaggcccaggagcuguucgggcuccagguggccgaggaccaggaggagaagcagccccagcugaucgucaugggcaaccuggaccgggagcgcugggacagcuacgaccucaccaucaaggugcaggacgggggcuccccgccccgggcgagcuccgcccugcugcgcgugaccguccucgacaccaacgacaacgcccccaaguucgagcggcccagcuacgaggccgagcuguccgagaacagccccaucggccacagcgugauccaggugaaggccaacgacuccgaccagggggcgaacgccgagaucgaguacacguuccaccaggcccccgaggucgugcgccggcugcuccgccuggaccggaacaccggccugaucaccgugcaggggccgguggaccgcgaggaccucagcacccugcgcuucuccgugcuggccaaggaccggggcacgaaccccaagagcgcccgcgcgcaggucguggugaccgucaaggacaugaacgacaacgcccccaccaucgagauccgggggaucggccucgugacccaccaggacggcauggccaacaucuccgaggacguggccgaggagacggccgucgcgcugguccaggugagcgaccgcgacgagggggagaacgccgccgugacgugcgugguggccggcgacgucccguuccagcugcggcaggcguccgagaccgggagcgacuccaagaagaaguacuuccugcagaccaccacgccccucgacuacgagaaggugaaggacuacaccaucgagaucguggccgucgacagcggcaacccgccccuguccagcaccaacucccugaagguccaggugguggacgugaacgacaacgcccccguguucacccagagcgucaccgagguggccuuccccgagaacaacaagcccggggaggugaucgccgagaucaccgcguccgacgccgacagcggcuccaacgccgagcucgucuacagccuggagcccgagccggccgccaagggccuguucaccaucucccccgagacgggggagauccaggugaagaccagccucgaccgcgagcagcgggagagcuacgagcugaagguggucgcggccgaccgcggcucccccagccugcaggggaccgccaccgugcucgugaacguccuggacugcaacgacaacgaccccaaguucaugcuguccggcuacaacuucagcgugauggagaacaugccggcccucucccccgugggcauggucacggugaucgacggggacaagggcgagaacgcccaggugcagcugagcgucgagcaggacaacggggacuucgugauccagaacggcaccgggaccauccuguccagccucuccuucgaccgggagcagcagagcaccuacaccuuccagcugaaggcgguggacggcggcgucccgccccgcuccgccuacgugggggugacgaucaacguccuggacgagaacgacaacgcccccuacaucaccgcccccagcaacaccucccacaagcuccugacgccccagacccggcugggcgagaccgugagccagguggcggccgaggacuucgacuccggggucaacgccgagcucaucuacagcaucgccggcgggaaccccuacggccuguuccagaucggcucccacagcggggccaucacccuggagaaggagaucgagcgccggcaccacggccuccaccgccugguggugaaggucagcgaccgggggaagccgccccgcuacggcaccgcgcuggugcaccucuacgugaacgagacgcuggccaaccggacccugcucgagacccugcuggggcacucccucgacacgccccuggacaucgacaucgccggcgaccccgaguacgagcgcagcaagcagcggggcaacauccuguucggggucguggccggcgucguggccguggcgcuccugaucgcccuggccguccucgugcgcuacugccgccagcgggaggccaaguccggguaccaggccggcaagaaggagaccaaggaccuguacgcgccgaagcccagcgggaaggccuccaagggcaacaagagcaagggcaagaaguccaagagccccaagccggugaagcccgucgaggacgaggacgaggccgggcugcagaagucccucaaguucaaccugaugagcgacgcccccggcgacagcccccgcauccaccucccgcugaacuacccgcccgggucccccgaccugggccggcacuaccgcuccaacagcccccugcccuccauccagcuccagccccagagccccuccgcgagcaagaagcaccagguggugcaggaccugccgcccgccaacaccuucgucggcaccggggacaccacguccaccggcagcgagcaguacagcgacuacuccuaccggaccaacccgcccaaguaccccagcaagcaggucgggcagcccuuccagcuguccacgccccagccccucccgcaccccuaccacggcgccaucuggaccgaggugugggaguga

SEQ ID NO: 34299 - RNA, 2856 nt, Artificial Sequence
  derived and/or modified sequence opt1 from PCDH20__Homo_sapiens__NP_073754
augcgcggccgggggaacgcccgcagcucccaggcccugggcgugagcuggugccccgcgaccuggcacccgcggcucgacauggggcgccugcaccggccccgcuccagcaccuccuaccggaaccugccccaccucuuccuguucuuccuguucgucggccccuucagcugccucggguccuacagccgcgccacggagcugcuguacucccucaacgagggccugccggccggcgugcugaucgggagccucgccgaggaccugcggcugcucccccgcuccgccggccggcccgacccccagagccagcugccggagcgcaccggggcggaguggaacccgccccuguccuucagccucgccucccggggccugagcgggcaguacgugacccuggacaaccgcuccggcgagcuccacaccagcgcccaggagaucgaccgggaggcccugugcgucgagggcgggggcgggacggcgugguccggcagcgugagcaucuccagcucccccagcgacuccugccugcuccugcuggacgugcucguccugccccaggaguacuuccgcuucgugaaggugaagaucgccauccgggacaucaacgacaacgcgccccaguuccccgucagccagaucuccgugugggugcccgagaacgccccggucaacacccgccuggccaucgagcaccccgccguggaccccgacgugggcaucaacgggguccagaccuaccggcuccuggacuaccacggcauguucacccuggacguggaggagaacgagaacggggagcgcacgcccuaccucaucgugaugggcgcccuggaccgggagacccaggaccaguacgucagcaucaucaucgccgaggacgggggcuccccgccccugcucggcagcgccacccugaccaucgggaucuccgacaucaacgacaacugcccccuguucacggacagccagaucaacgugaccguguacggcaacgccaccgucgggacccccaucgcggccgugcaggccguggacaaggaccucggcacgaacgcccagaucaccuacuccuacagccagaaggucccgcaggccuccaaggaccuguuccaccuggacgagaacaccggggugaucaagcuguucagcaagaucggcggcuccguccucgagagccacaagcugaccauccucgcgaacgggcccggcugcauccccgccgugaucacggcccugguguccaucaucaaggucaucuuccggcccccggagaucgugccccgcuacaucgccaacgagaucgacgggguggucuaccugaaggagcucgagcccgugaacaccccgaucgccuucuucaccauccgcgaccccgagggcaaguacaaggugaacugcuaccuggacggggagggccccuuccgccugagccccuacaagccguacaacaacgaguaccugcucgagaccacgaagcccauggacuacgagcugcagcaguucuacgaggucgcggugguggccuggaacagcgagggcuuccacgucaagcgggugaucaaggugcagcugcucgacgacaacgacaacgcccccaucuuccugcagccccugaucgagcucaccaucgaggagaacaacuccccgaacgccuuccugaccaagcuguacgcgaccgacgccgacagcgaggagcgcgggcaggucuccuacuuccucggccccgacgcccccagcuacuucucccuggacagcgugacggggauccugaccguguccacccagcucgaccgggaggagaaggagaaguaccgcuacaccguccgggccguggacugcggcaagcccccgcgcgagagcguggccacggucgcgcugaccgugcuggacaagaacgacaacagcccccgguucaucaacaaggacuucuccuucuucgugcccgagaacuuccccggcuacggggagaucggcgucaucuccgugaccgacgccgacgccgggcgcaacggcuggguggcccucagcgucgugaaccaguccgacaucuucgugaucgacaccgggaagggcaugcugcgggccaaggucagccuggaccgcgagcagcaguccagcuacacgcucuggguggaggcgguggacggcggggagccggcccuguccagcaccgccaagaucaccauccugcuccuggacaucaacgacaacccgccccugguccucuucccccagagcaacauguccuaccugcuggugcuccccagcacccugcccggcucccccgugaccgaggucuacgccguggacaaggacacggggaugaacgccgugaucgcguacagcaucaucggccggcgcgggccccggccggaguccuuccgcaucgaccccaagaccggcaacaucacccuggaggaggcccuccugcagaccgacuacggccugcaccggcuccuggucaaggugagcgaccacggguaccccgagccgcugcacuccacggugauggucaaccucuucgugaacgacaccgugagcaacgaguccuacaucgagagccugcugcgcaaggagcccgagaucaacaucgaggagaaggagccccagaucuccaucgagcccacccaccggaaggucgagagcguguccugcaugccgacccucguggcccugagcgucaucucccugggcagcaucacgcucgugaccgggaugggcaucuacaucugccugcgcaagggggagaagcacccccgcgaggacgagaaccuggaggugcagaucccccucaagggcaagaucgaccugcacaugcgggagcgcaagcccauggacaucuccaacaucuga

SEQ ID NO: 34300 - RNA, 3768 nt, Artificial Sequence
  derived and/or modified sequence opt1 from PCDH7__Homo_sapiens__NP_001166994
augcugcgcaugcggaccgccggcugggcccgcggguggugccucggcugcugccugcugcucccccugagccugucccucgcggccgccaagcagcugcugcgguaccgccucgccgaggaggggccggccgacgugcggaucggcaacgucgcgagcgaccuggggaucgugaccggcuccggcgaggugacguucagccuggaguccgggagcgaguaccucaagaucgacaaccugaccggcgagcuguccaccagcgagcgccggaucgaccgcgagaagcucccccagugccagaugaucuucgacgagaacgagugcuuccuggacuucgaggucuccgugaucgggcccagccaguccuggguggaccuguucgagggccaggucaucgugcucgacaucaacgacaacacccccacguucccgagccccgugcugacccugaccgucgaggagaaccggcccguggggacccucuaccugcugcccacggccaccgaccgcgacuucggccggaacggcaucgagcgcuacgagcuccugcaggagcccgggggcgggggcuccggcggggagagccggcgcgccggcgccgcggacuccgcccccuaccccgggggcgggggcaacggcgccagcgggggcggguccggcgggagcaagcggcgccuggacgccuccgagggcggcgggggcaccaaccccgggggccggagcagcguguucgagcuccaggucgccgacaccccggacggggagaagcagccccagcugaucgugaagggcgcgcuggaccgcgagcagcgggacuccuacgagcucacgcugcgcgugcgggacggcggggacccgccccgcagcucccaggccauccugcgcguccucaucaccgacgugaacgacaacagcccgcgguucgagaaguccguguacgaggccgaccuggccgagaacagcgcccccggcacccccauccugcagcuccgcgcggccgaccuggacgucggggugaacggccagaucgaguacguguucggcgccgccaccgaguccguccggcgccugcuccggcuggacgagacgagcggguggcuguccgugcuccaccgcaucgaccgggaggaggugaaccagcugcgcuucaccgucauggcccgggaccgcggccagcccccgaagaccgacaaggcgaccgugguccugaacaucaaggacgagaacgacaacgugcccagcaucgagauccggaagaucgggcgcaucccccucaaggacggcguggccaacgucgccgaggacgugcugguggacacgcccaucgcccugguccagguguccgaccgggaccagggggagaacggcguggugaccugcaccguggugggcgacgucccguuccagcucaagcccgccagcgacaccgagggggaccagaacaagaagaaguacuuccugcacacguccacgccccuggacuacgaggcgacccgcgaguucaacguggugaucgucgccguggacagcggcucccccagccuguccagcaacaacucccucaucgugaaggucggggacaccaacgacaacccgcccauguucggccagagcgugguggaggucuacuuccccgagaacaacaucccgggggagcggguggccaccgugcuggccaccgacgcggacagcggcaagaacgccgagaucgccuacucccuggacagcuccgucaugggcaucuucgccaucgaccccgacagcggggacauccucgugaacaccgugcuggaccgcgagcagaccgaccgguacgaguucaaggucaacgccaaggacaagggcauccccgugcugcagggguccacgaccgugaucguccagguggcggacaagaacgacaacgaccccaaguucaugcaggacguguucaccuucuacgucaaggagaaccuccagccgaacagccccgugggcauggugaccgucauggacgccgacaaggggcgcaacgccgagaugucccuguacaucgaggagaacaacaacaucuucagcaucgagaacgacacgggcaccaucuacuccaccaugagcuucgaccgggagcaccagaccaccuacacguuccgcgugaaggccguggacggcggggacccgccccgcuccgccaccgcgaccgucagccuguucgugauggacgagaacgacaacgcccccaccgugacgcuccccaagaacaucuccuacacccugcugccgcccagcuccaacguccggaccgugguggccaccguccucgccacggacagcgacgacggcaucaacgccgaccugaacuacuccaucgucgggggcaaccccuucaagcuguucgagaucgaccccaccagcgggguggucagccucgugggcaagcugacccagaagcacuacggccugcaccgccucgugguccaggugaacgacuccgggcagcccagccaguccaccacgacccugguccacguguucgugaacgagagcgucuccaacgcgaccgccaucgacagccagaucgcccggucccugcacaucccccucacccaggacaucgccggcgacccgagcuacgagaucuccaagcagcgccugagcaucgugaucgggguggucgcgggcaucaugacggugauccugaucauccucaucguggucauggcccgguacugccgcuccaagaacaagaacggcuacgaggccgggaagaaggaccacgaggacuucuucacgccccagcagcacgacaagagcaagaagcccaagaaggacaagaagaacaagaaguccaagcagccccuguacagcuccaucgugaccguggaggccagcaagccgaacggccagcgguacgacuccgucaacgagaagcugagcgacucccccagcauggggcgcuaccggagcgugaacggcgggcccggcucccccgaccucgcccgccacuacaagagcuccagcccgcugcccaccgugcagcugcacccccaguccccgaccgcgggcaagaagcaccaggccguccaggaccucccgcccgccaacaccuucgugggggccggcgacaacaucagcaucggguccgaccacugcagcgaguacuccugccagaccaacaacaaguacagcaagcagcccuuccggcgcgugaccuucuccgucgugagccagccccaggacccccaccagggcucccugcagagcugcuacgacuccgggcuggaggagagcgagacgcccuccagcaaguccagcagcggcccccggcucggcgcccugccgcugcccgaggacaacuacgagcgcaccacccccgacggguccgugggcgaggcggagcacauggagaacgacagccggccccucccggacgucgcccugaccgggaagugcacgcgcgagugcgacgaguacggccacuccgacagcugcuggaugcccgugcggaccucccccgagcgcaagaagucccagcccaagcugagcaccuucaugccgguggacgagcgggggagccaggagaagcucgccaacggcgaggccgccaucaugggcgaccgcaaccggaaccugcugaacaagaagcucaccuccagcuacgagacguucuccgcggccagcuucuccaagaacgaggaggccaaccccgaggacaucccccugaccaagaccggggaguacaagcccagcccggucaacacccugacgcgccgcgagguguaccucuga

SEQ ID NO: 34301 - RNA, 3213 nt, Artificial Sequence
  derived and/or modified sequence opt1 from PCDH8__Homo_sapiens__NP_002581
augagccccgugcgccgguggggcuccccgugccuguucccccuccagcuguucagccugugcuggguccucuccguggcccagagcaagaccgugcgcuacuccaccuucgaggaggacgcccccgggacggucaucggcacccuggcggaggaccugcacaugaaggugagcggggacaccuccuuccggcucaugaagcaguucaacagcucccugcugcgcgugcgggagggcgacgggcagcucaccgucggcgacgccggccuggaccgcgagcggcugugcgggcaggccccccagugcgugcucgccuucgacguggucagcuucucccaggagcaguuccgccuggugcacguggaggucgaggugcgggacgugaacgaccacgccccgcgcuucccccgggcgcagauccccgucgaggugagcgagggcgccgccguggggacgcgcaucccccuggaggucccgguggacgaggacgugggcgccaacgggcuccagaccguccggcuggcggagccccacucccccuuccgcguggagcugcagacccgggccgacggcgcccagugcgccgaccucgugcugcugcaggagcucgaccgcgagagccaggccgcguacucccuggagcuggucgcccaggacggcgggcggcccccgcgcagcgccaccgccgcccucuccgugcggguccuggacgcgaacgaccacagccccgccuucccccagggcgccguggccgagguggagcuggccgaggacgcgcccgucgggucccuccugcuggaccucgacgccgccgacccggacgagggccccaacggcgacgugguguucgccuucggggcccgcacgccccccgaggcgcggcgccuguuccgccuggacccgcggagcggccgccucacccuggccgggcccgucgacuacgagcggcaggacaccuacgagcuggacgugcgcgcccaggaccggggccccgggccccgcgccgcgaccugcaaggugaucguccggauccgcgacgugaacgacaacgccccggacaucgccaucacgccccucgccgcccccggcgcgcccgccaccagcccguucgccgccgccgcggccgccgccgcccugggcggggcggacgccuccagccccgccggcgccgggacccccgaggcgggcgccaccucccuggugccggagggggccgcccgggagagccucgucgcccugguguccacgagcgaccgcgacuccggcgcgaacggccaggugcggugcgcccuguacgggcacgagcacuuccgccuccagcccgccuacgccggcagcuaccuggucgugaccgccgcgucccuggaccgggagcgcaucgccgaguacaaccucacccugguggccgaggaccggggggcccccccccugcgcaccguccggccguacacggugcgcgugggcgacgagaacgacaacgccccccucuucacccggcccgucuacgaggugagcgugcgcgagaacaaccccccgggggcguaccuggccaccgucgccgcccgcgaccgggaccugggccgcaacggccaggugaccuaccggcugcucgaggcggagguggggcgcgccggcggggccgucuccacguacgugagcguggaccccgccaccggcgccaucuacgcgcugcgguccuucgacuacgagacccugcgccagcucgacguccggauccaggccagcgacggcggguccccccagcugagcuccagcgcccuggugcaggugcgcguccucgaccagaacgaccacgcccccgugcuggugcacccggcccccgcgaacggcucccuggaggucgccgugcccgggcggaccgccaaggacacgguggucgcccgcgugcaggcccgggacgcggacgagggcgccaacggggagcucgccuucgagcugcagcagcaggagccccgcgaggccuucgccaucggccggcgcaccggcgagauccugcucaccggggaccugagccaggagccgcccggccggguguuccgcgcgcugcucgucaucagcgacgggggccggcccccccugaccacgaccgccaccguguccuucguggucaccgccgggggcggccgcgggccggccgcgcccgccagcgccggcucccccgagcggagccgccccccggggucccggcugggcgugagcggguccgugcuccagugggacacgccccugaucgucaucaucgugcuggccggcagcugcacccuccugcuggccgcgaucaucgccaucgccaccaccugcaaccgccgcaagaaggaggugcggaagggcggggcccuccgcgaggagcggcccggcgccgcggggggcggggccuccgccccgggcagccccgaggaggccgcccgcggcgcggggccccggcccaacauguucgacguccugaccuucccgggcacggggaaggcccccuucggcucccccgccgccgacgcgcccccgcccgccguggccgccgccgagguccccggcagcgaggggggcuccgcgaccggggagagcgccugccacuucgagggccagcagcgccugcggggggcccacgccgagcccuacggcgccuccccgggcuucgggaaggagcccgcgccccccguggccguguggaagggccacagcuucaacaccaucuccgggcgcgaggccgagaaguucagcggcaaggacagcgggaagggcgacuccgacuucaacgacagcgacuccgacaucagcggcgacgcccucaagaaggaccugaucaaccacaugcaguccgggcugugggccugcaccgcggagugcaagauccucggccacagcgaccggugcugguccccgagcugcuccgggcccaacgcccaccccagcccccacccgcccgcccagauguccacguucugcaagagcaccucccugccccgcgacccccugcggcgcgacaacuacuaccaggcccagcucccgaagaccgucggccugcagagcguguacgagaaggugcugcaccgggacuacgaccgcaccgucacgcuccugucccccccccggcccgggcgccugccggaccuccaggagaucggcgugccccuguaccagagccccccgggccgguaccugucccccaagaagggggcgaacgagaacguguga

SEQ ID NO: 34302 - RNA, 3612 nt, Artificial Sequence
  derived and/or modified sequence opt1 from PCDH9__Homo_sapiens__NP_065136
auggaccugcgcgacuucuaccuccuggccgcccugaucgcgugccuccggcuggacagcgccaucgcccaggagcugaucuacaccauccgcgaggagcuccccgagaacgugccgaucggcaacauccccaaggaccugaacaucucccacaucaacgccgccaccgggacgagcgcgucccuggucuaccggcucgugagcaaggccggcgacgccccccuggugaaggucuccagcuccaccggggagaucuucaccaccagcaaccgcaucgaccgggagaagcugugcgccggcgcguccuacgccgaggagaacgagugcuucuucgagcucgagguggugauccugcccaacgacuucuuccgccugaucaagaucaagaucaucgucaaggacacgaacgacaacgccccgauguuccccagccccgugaucaacaucuccauccccgagaacacccucaucaacagccgguucccgauccccuccgccaccgaccccgacaccggguucaacggcgugcagcacuacgagcugcugaacggccagagcgucuucgggcucgacaucguggagacgcccgagggcgagaaguggccgcagcugaucgugcagcagaaccuggaccgcgagcagaaggacaccuacgucaugaagaucaagguggaggacgggggcaccccccagaaguccagcaccgccauccuccaggugacggucuccgacgugaacgacaaccggcccguguucaaggaggggcaggucgaggugcacauccccgagaacgcgccggugggcaccagcgucauccagcugcacgccaccgacgccgacaucggcuccaacgccgagauccgcuacaucuucggggcccagguggcgcccgccaccaagcggcuguucgcccucaacaacacgaccggccugaucaccgugcagcgcagccuggaccgggaggagaccgccauccacaaggucacggugcucgccagcgacggguccagcacccccgcgcgcgccaccgucaccaucaacgugacggacgugaacgacaaccccccgaacaucgaccugcgguacaucaucucccccaucaacggcaccgucuaccugagcgagaaggaccccgugaacaccaagaucgcccucaucaccguguccgacaaggacacggacgucaacggcaaggugaucugcuucaucgagcgcgaggugcccuuccaccugaaggccgucuacgacaaccaguaccugcucgagaccagcucccugcuggacuacgaggggaccaaggaguucagcuucaagaucguggccuccgacagcggcaagccgucccucaaccagaccgcgcuggugcgggucaagcuggaggacgagaacgacaacccccccaucuucaaccagcccgugaucgagcucagcguguccgagaacaaccgccgggggcuguaccugacgaccaucagcgccaccgacgaggacuccggcaagaacgccgacaucgucuaccagcucgggccgaacgccagcuucuucgaccuggaccgcaagaccggcgugcugacggcgucccggguguucgaccgcgaggagcaggagcgcuucaucuucaccgucaccgcccgggacaacggcacccccccccuccagagccaggccgccgugaucgugaccguccuggacgagaacgacaacuccccgaaguucacgcacaaccacuuccaguucuucgugagcgagaaccugcccaaguacagcaccgugggggucaucaccgugaccgacgccgacgcgggcgagaacaaggccgugacgcucuccauccugaacgacaacgacaacuucguccuggaccccuacagcggggugaucaaguccaacgugagcuucgaccgcgagcagcaguccagcuacaccuucgacgucaaggccaccgacggcgggcagcccccgcgguccagcaccgccaaggugacgaucaacgugauggacgucaacgacaacucccccguggugaucagcccccccuccaacaccagcuucaagcuggucccgcucuccgccauccccggcagcgugguggcggaggucuucgccguggacguggacaccggcaugaacgccgagcugaaguacaccaucgucuccgggaacaacaagggccuguuccgcaucgaccccgugacggggaacaucacccucgaggagaagcccgccccgaccgacgugggccugcaccggcuggucgugaacaucagcgaccucggguaccccaagucccugcacacccuggugcucgucuuccuguacgugaacgacacggccggcaacgcgagcuacaucuacgaccugauccgccggaccauggagaccccccucgaccgcaacaucggcgacagcucccagcccuaccagaacgaggacuaccugaccaucaugaucgccaucaucgccggggccaugguggucaucguggucaucuucgugacggugcugguccggugccgccacgcgagccgguucaaggccgcccagcgcuccaagcagggcgccgaguggaugagcccgaaccaggagaacaagcagaacaagaagaagaagcggaagaagcgcaagucccccaagagcucccuccugaacuucgugaccaucgaggagagcaagcccgacgacgccgugcacgagcccaucaacgggaccaucucccugccggcggagcucgaggagcagagcaucggccgguucgacuggggccccgccccccccaccacguucaagccgaacucccccgaccuggccaagcacuacaagagcgccuccccccagccggccuuccaccugaagcccgacacccccgucagcgugaagaagcaccacgugauccaggagcucccccuggacaacaccuucgucgggggcugcgacacccuguccaagcgcagcuccacgagcuccgaccacuucagcgcgagcgagugcuccagccaggggggcuucaagaccaaggggccgcuccacacccggcagucccagcgccgggugaccuuccaccugcccgacggcagccaggaguccugcagcgacuccggccugggggaccacgagcccgugggcagcgggacgcucaucucccacccccugccgcugguccagccccaggacgaguucuacgaccaggccagccccgacaagcgcaccgaggccgacggcaacuccgaccccaacagcgacgggccgcucggcccccgcggccuggccgaggccaccgagaugugcacccaggagugccuggugcucgggcacuccgacaacugcuggaugccccccggccuggggccguaccagcaccccaagagcccccuguccacguucgcgccccagaaggagugggugaagaaggacaagcucgucaacggccacacccugacccgggccuggaaggaggacagcaaccgcaaccaguucaacgaccggaagcaguacggguccaacgagggccacuucaacaacggcagccacaugaccgacaucccgcuggccaaccucaaguccuacaagcaggccgggggcgcgaccgagagccccaaggagcaccagcuguga

SEQ ID NO: 34303 - RNA, 2853 nt, Artificial Sequence
  derived and/or modified sequence opt1 from PCDHA1__Homo_sapiens__NP_061723
augguguucagccgccggggcgggcugggcgcccgcgaccuccugcuguggcuccugcugcucgccgcgugggaggucggguccggccagcugcacuacagcauccccgaggaggccaagcacgggaccuucgugggccggguggcccaggaccugggccucgagcuggccgagcuggucccgcgccucuuccggguggccuccaagacccaccgcgaccugcuggaggugaaccuccagaacgggauccuguucgucaacagccggaucgaccgcgaggagcugugccagugguccgcggagugcagcauccaccucgagcugaucgccgaccggccccuccagguguuccacguggaggucaaggugaaggacaucaacgacaacccgcccguguuccgcggccgggagcagaucaucuucauccccgagucccgccugcugaacagccgguuccccaucgagggggccgccgacgcggacaucggcgccaacgcccugcucacguacacccugucccccagcgacuacuucucccuggacgucgaggccagcgacgagcucuccaagagccuguggcuggagcuccgcaaguaccuggaccgggaggagacccccgagcugcaccuccugcugaccgccacggacgggggcaagccggagcuccagggcaccguggagcugcugaucaccgugcucgacgucaacgacaacgcgccccuguucgaccaggccguguaccgcgugcaccuccuggagaccacggccaacgggacccuggucaccacccugaacgccuccgacgccgacgagggcgugaacggggagguggucuucagcuucgacuccggcaucagccgggacauccaggagaaguucaagguggacuccagcagcggcgagauccgccucaucgacaagcuggacuacgaggagacgaaguccuacgagauccaggugaaggcggucgacaaggggagcccgcccauguccaaccacugcaaggugcuggucaaggugcucgacgugaacgacaacgcccccgagcuggccgucaccagccuguaccugcccauccgggaggacgcgccccucuccaccgugaucgcccugaucaccgugagcgaccgcgacuccggcgcgaacgggcaggucacgugcagccugaugccccacgugccguucaagcucguguccaccuucaagaacuacuacagccugguccuggacuccgcccucgaccgggagagccuguccguguacgagcugguggucaccgcccgcgacggcgggagccccucccucugggccaccgcccgcgugagcguggaggucgcggacgugaacgacaacgcccccgccuucgcccagcccgaguacacgguguucgucaaggagaacaacccgcccggcugccacaucuucaccguguccgcgcgggacgccgacgcccaggagaacgcccuggugagcuacucccuggucgagcgccgggugggcgagcgcgcccucagcaacuacgugagcguccacgcggaguccgggaagguguacgcccugcagccccuggaccacgaggagcucgagcugcugcaguuccaggugagcgcccgggacgccggcgugcccccgcucggguccaacgucacccuccagguguucguccuggacgagaacgacaacgcccccgcgcugcuggcgccccgcgugggcgggaccaucggcgccgugagcgagcuggucccccggcucgugggcgccgggcacguggucgccaaggugcgcgccguggacgccgacuccggcuacaacgccuggcugagcuacgagcugcagccggccgccgggggcgcccggauccccuuccgcgucgggcucuacacgggcgagaucuccaccacccgggugcuggacgaggccgaccugagccgcuaccggcuccuggugcuggucaaggaccacggcgagcccgcccucaccgccacggcgaccgugcuggugucccuggucgagagcgggcaggccccgaaggccuccagccgcgccuccgugggcguggccgggcccgaggcggcccucgucgacgugaacguguaccugaucaucgccaucugcgccgucagcucccugcucgugcugacccugcuccuguacaccgcccugcggugcagcgucccgcccacggagggcgcguacgugcccggcaagcccacccucgugugcuccagcgcccuggggagcugguccaacagccagcagcgccggcagcgcgucugcuccagcgagggcccgcccaagaccgaccugauggccuucucccccgggcucagccccucccugaacaccagcgagcggaacgagcagcccgaggccaaccuggaccucuccggcaacccccgccagccgaaccccgacuggcgcuacagcgcgucccugcgggccgggaugcacagcuccgugcaccuggaggaggccggcauccuccgcgccggccccgggggccccgaccagcaguggccgacggugagcuccgccacccccgagcccgaggcgggggaggucagcccgcccgugggcgccggggugaacuccaacagcuggaccuucaaguacggccccggcaaccccaagcaguccgggcccggcgagcugccggacaaguucaucauccccgggagccccgccaucaucagcauccggcaggagccgaccaacucccagaucgacaagagcgacuucaucaccuucggcaagaaggaggagacgaagaagaagaagaagaagaagaaggggaacaagacccaggagaagaaggagaagggcaacuccaccaccgacaacagcgaccaguga

SEQ ID NO: 34304 - RNA, 2844 nt, Artificial Sequence
  derived and/or modified sequence opt1 from PCDHA4__Homo_sapiens__NP_061730
auggaguucagcuggggcuccgggcaggagagccgccggcugcuccugcugcuccugcugcucgccgccugggaggcgggcaacgggcagcugcacuacuccgugagcgaggaggccaagcacggcaccuucgucgggcgcaucgcccaggaccugggccucgagcuggccgagcuggugccccgccucuuccggguggccuccaagggccgcgggggccugcuggaggucaaccuccagaacgggauccuguucgugaacagccggaucgaccgggaggagcugugccgccgguccgcggagugcagcauccaccucgaggugaucgucgaccgcccgcuccagguguuccacguggacgucgaggugcgggacaucaacgacaacccgcccguguuccccgccacccagaagaaccuguccaucgccgagagccgcccccuggacucccgguucccccuggagggcgccagcgacgcggacaucggggagaacgcccugcucacguaccgccugucccccaacgaguacuucagccuggagaagcccccggacgacgagcucgucaagggccugggccugauccuccggaagucccuggaccgcgaggaggcccccgagaucuuccuggugcucaccgccaccgacgggggcaagcccgagcugaccgggacggugcagcugcucaucaccguccuggacgccaacgacaacgcgcccgccuucgaccggaccaucuacaaggugcgccugcucgagaacgugccgaacggcacccuggucaucaagcugaacgccagcgaccucgacgagggccugaacggggacaucguguacuccuucagcaacgacaucucccccaacgucaagagcaaguuccacaucgaccccaucacgggccagaucaucgugaagggguacaucgacuucgaggagagcaaguccuacgagaucaucguggagggcaucgacaaggggcagcugccccucagcggccacugccgggugaucgucgagguggaggacaacaacgacaacgucccggaccuggaguucaagucccugagccuccccauccgcgaggacgcgccccugggcaccgugaucgcccugaucuccgugagcgacaaggacaugggggucaacggccuggugaccugcucccucaccagccacgugcccuucaagcuggucuccacguucaagaacuacuacagccuggugcucgacuccgcccuggaccgggagagcguguccgccuacgagcuggucgugaccgcccgcgacgggggcagcccgucccucugggccaccgccagcguguccgucgagguggcggacgugaacgacaacgcccccgccuucgcccagcccgaguacaccgucuucgugaaggagaacaacccgcccgggugccacaucuucacggugagcgccugggacgcggacgcccaggagaacgcccuggucuccuacagccugguggagcgccgggugggcgagcgcgcccucagcuccuacgucagcgugcacgcggaguccggcaagguguacgcccugcagccccuggaccacgaggagcucgagcugcugcaguuccaggucaccgcccgggacgccggggugccgccccucggcagcaacgugacccugcaggucuucgugcuggacgagaacgacaacgcccccgcgcuccuggcgccccgcgccgggggcaccgggggcgccguguccgagcugguccccuggagcgugggcguggggcacgucguggccaaggugcgggccgucgacgccgacuccggcuacaacgccuggcucagcuacgagcugcagccggggacgggcggcgcccgcauccccuuccggguggggcuguacaccggcgagaucuccaccacccgcgcccucgacgagacggacgcgccccggcaccgccugcuggugcucgucaaggaccacggggagcccgcccugaccgccaccgccaccgugcuggugagccucgucgaguccggccaggcgccgaaggccagcucccgggcccuggugggggccgugggccccgacgccgcgcuggucgacgugaacguguaccucaucaucgccaucugcgccgucagcucccugcuggugcucacgcugcugcucuacaccgcccugcgcugcagcgcccugcccaccgagggcgcgugcgcccccgggaagccgacccucgugugcuccagcgccgucggcagcugguccuacagccagcagcggcgcccccgggugugcuccggggagggcccgcccaagacggaccugauggccuucagccccucccugcccgacagccgcgaccgggaggaccagcuccagaccaccgaggaguccuucgccaagccccgccagcccaacccggacuggcgguacagcgcgucccugcgcgccgggaugcacagcuccguccaccuggaggaggccggcauccuccgcgccggccccgggggccccgaccagcaguggcccaccgugagcuccgcgacgccggagcccgaggccggggaggugagcccgcccgucggcgccggggugaacuccaacagcuggaccuucaaguacggccccggcaaccccaagcaguccgggcccggcgagcugccggacaaguucaucauccccgggagccccgccaucaucuccauccggcaggagcccaccaacagccagaucgacaagagcgacuucaucaccuucggcaagaaggaggagaccaagaagaagaagaagaagaagaaggggaacaagacgcaggagaagaaggagaagggcaacuccaccaccgacaacagcgaccaguga

SEQ ID NO: 34305 - RNA, 2853 nt, Artificial Sequence
  derived and/or modified sequence opt1 from PCDHA6__Homo_sapiens__NP_061732
augguguucacccccgaggaccgccugggcaagcagugccuccugcugccgcuccugcugcucgccgccuggaaggucgggagcggccagcugcacuacuccgugcccgaggaggcgaagcacgggaccuucgugggccggaucgcccaggaccuggggcucgagcuggccgagcuggucccccgccucuuccggauggccagcaaggaccgcgaggaccugcuggaggugaaccuccagaacggcauccuguucgugaacucccggaucgaccgcgaggagcugugcggccggagcgccgagugcuccauccaccucgaggucaucguggaccgcccccuccagguguuccacgucgacguggaggugcgggacaucaacgacaacccgccccuguuccccgucgaggagcagcgcgugcugaucuacgagagccggcugcccgacuccguguucccgcuggagggggcgagcgacgccgacgucggcuccaacagcauccucacguacaagcuguccagcuccgaguacuucgggcuggacgugaagaucaacagcgacgacaacaagcagaucggccuccugcugaagaagucccucgaccgcgaggaggcccccgcccacaaccuguuccugaccgcgaccgacgggggcaagcccgagcucaccggcacggugcagcugcuggucaccgugcucgacgugaacgacaacgcccccaccuucgagcagagcgaguacgagguccggaucuucgagaacgccgacaacgggaccacggugauccgccugaacgccuccgaccgggacgagggcgccaacggggcgaucagcuacuccuucaacagccugguggccgccauggucaucgaccacuucagcaucgaccgcaacaccggcgagaucgugauccggggcaaccucgacuucgagcaggagaaccuguacaagauccugaucgacgccaccgacaaggggcacccgcccauggccggccacugcaccguccucgugcgcauccuggacaagaacgacaacgugcccgagaucgcgcugacgucccucagccugcccguccgggaggacgcccaguucgggaccgugaucgcccugaucuccgugaacgaccucgacagcggcgccaacgggcaggucaacugcucccugaccccgcacgugcccuucaagcuggugagcaccuucaagaacuacuacucccugguccucgacagcgcccuggaccgcgaguccgugagcgcguacgagcugguggucacggcccgggacggcggcucccccagccucugggccaccgccucccugagcguggagguggccgacaugaacgacaacgcgcccgccuucgcccagccggaguacaccgucuucgugaaggagaacaacccgcccgggugccacaucuucaccguguccgcccgcgacgcggacgcccaggagaacgcccuggucagcuacucccucguggagcgccgggugggcgagcgcgcccugagcuccuacaucagcguccacgccgagagcgggaagguguacgcgcugcagccccucgaccacgaggagcuggagcugcuccaguuccagguguccgcccgggacgccggcgucccgccccuggggagcaacgugacgcuccagguguucguccuggacgagaacgacaacgcccccgcccugcuggcgccccgcgugggcggcaccgggggcgccguguccgagcucgucccgcggagccugggggccggccaggugguggccaagguccgcgccguggacgcggacuccggguacaacgccuggcugagcuacgagcuccagccgcccgccuccagcgcccgguuccccuuccgcgugggccuguacaccggcgagaucuccaccacgcggguccuggacgaggcggacagcccccgccaccggcuccuggugcuggugaaggaccacggggagcccgcccucaccgccaccgccaccguccuggugucccugguggagagcggccaggcccccaaggcguccagccgcgccuccgucggggccgccggcccggaggccgcgcucguggacgugaacgucuaccugaucaucgccaucugcgccgugagcucccugcucgugcugacgcugcuccuguacaccgcccugcggugcagcgccccgcccaccgagggcgcgugcaccgccgacaagcccacgcucgucugcagcuccgccguggggagcugguccuacagccagcagcgccggcagcgcgugugcuccggcgaggggccgcccaagauggaccugauggccuucagccccucccugagccccugccccaucaugaugggcaaggcggagaaccaggaccucaacgaggaccacgacgccaagccccggcagcccaaccccgacuggcgcuacuccgccagccugcgggccgggaugcacuccagcguccaccuggaggaggccggcauccuccgcgcgggccccgggggccccgaccagcaguggcccaccguguccagcgccacccccgagccggaggccggggaggucuccccgcccgugggcgccggggugaacagcaacuccuggaccuucaaguacggccccggcaaccccaagcagagcgggcccggcgagcugcccgacaaguucaucaucccggggucccccgccaucaucagcauccgccaggagcccacgaacagccagaucgacaaguccgacuucaucaccuucggcaagaaggaggagaccaagaagaagaagaagaagaagaaggggaacaagacccaggagaagaaggagaagggcaacagcaccacggacaacuccgaccaguga

SEQ ID NO: 34306 - RNA, 2457 nt, Artificial Sequence
  derived and/or modified sequence opt1 from PCDHB1__Homo_sapiens__NP_037472
auggccggcacccgccggaagucccugcagaaccgccagguggggucccuccugaucuuccugugcaucagcgucggcgacgccaccacgauccgguacuccguggcggaggagauggagagcggguccuucguggccaacgucgccaaggaccucggccuggagguggggaagcuggccgcccgcggcgcgcggcucgugagcgagggcaacaagaugcacuuccgccugcaccggaagaccggggaccuguucgucaaggagaagcucgaccgcgagucccugugcggcaaggccgaccccugcgugcugcacuucgaggugguccucguggagccccugcagagcuuccgggccgaggugcgcgucuucgacaucaacgacaacgcccccguguuccugaacaaggagccccuccugaagauccccgaguccaccccgcuggggagccgguucccccuccaguccgcgcaggaccuggacgugggccugaacgggcuccagaacuacacccugagcgccaacggcuacuuccaccuccacacgcgcuucugcucccacggccccaaguacgccgagcugguccugaacaagccccuggaccgggaggagcagccggaggugaaccucaccaucaccgccguggacgggggcagcccgcccaaguccgggaccgcccacauccacgucguggugcuggacgucaacgaccacgugccccaguucagccgccugguguaccgggcgcaggucuccgagaacagccccaacggcucccucguggccacggucaccgccguggaccuggacgagggcaccaacaaggccaucaccuacagccuggcccagaaccccgaggcgauccucaagacguuccagaucgacccccagaacggggaggugcgccugcggggcccccuggacuucgaggccaucgagaccuacgacaucgacauccaggccaccgacgggggcgggcucagcgcccacuccaagguccugguggagguggucgacgugaacgacaacccgcccgaggugauggucagcuccgugagcagcccccugcccgaggacagcccgccccagaccguggucgcccucuucacgauccgcgaccgggacauccgcgugggcggcaaggugaccugcuuccugcgggaggaccugcccuucgucaucaagcccaccuucgggaacuccuacagccucgugaccgaccgcucccuggaccgcgaggaggugagcggcuacaacaucacgaucgucgcgauggacaccgggccgcccucccugagcgccgagaccaugaucgaggugcucaucuccgacgugaacgacaacccgcccaucuuccgggaggacagcuacauccugaccguccgcgagaacaacucccccgccguguucaucggcaaggugcacgccgaggaccuggaccucggggagaacgcccagaucacguacagccugcugccgcccaagaacggcgaccuguccgucuucgcguacaucagcaucaacuccggcaacgggaagcucuacgcccugcggaccauggacuacgaggccauccaggacuuccaguucguggugaaggccaccgacggcggguuccugagccucagcucccaggucaccgugcgcguggucgugcuggacgacaacgacaaccggcccaugauccuguacccccuccagaacggcacgcugcccugcaacgaccuggugccccgcagcgcggaggccggguaccucgucaccaaggugguggccgucgacggcgacuccggccagaacagcuggcuguccuaccaccuccugaaggccaccgaccuggggcuguucagcgugcagcggcagaacggcgagauccacacccuccgccagaucuccgagcgggacccgaugaugcagaagcugaucauccuggugcaggaccacgggcagcccgcccucagcacgaccgucucccugaacauccugcucguggacggcuucagcgagcccuaccugcaguuccaggaccccaccaagcacucccgcaaggugaacccgagcaccaaguaccuggucaucucccucgugauccugagcuuccuguuccuccuguccgugaucgucaucuucaucauccacguguaccagaagaucaaguaccgggagaaguucacgauccaggagcacuucuacgacgacugcaacuucagcaacaaccuggugcagggccaggggaacggcucccucagccgccccugccccuacgagaugugcagcgcgaccgggaccggcaacuccgaguuccgguuccugaagcgcuucaugcccaacuucccguucccccacgccaccggggagaucaagauggaggccggcagcucccugccgcccaacagcgaccggaacaagucccagcgccucgagggccacgaccaggucagcgacgacuacauguga

SEQ ID NO: 34307 - RNA, 2397 nt, Artificial Sequence
  derived and/or modified sequence opt1 from PCDHB2__Homo_sapiens__NP_061759
auggaggccggcgaggggaaggagcgcgugcccaagcagcggcagguccugaucuucuucgugcuccugggcaucgcccaggcgagcugccagccgcgccacuacuccguggccgaggagaccgagagcggguccuucgucgccaaccugcucaaggaccugggccuggagaucggggagcucgccgugcggggcgcccgcguggucagcaagggcaagaagaugcaccuccaguucgaccggcagaccggggaccugcugcugaacgagaagcuggaccgcgaggagcucugcggccccacggagcccugcgugcugcccuuccaggugcugcucgagaacccgcugcaguucuuccaggcggagcugcggauccgcgacgucaacgaccacucccccguguuccucgacaaggagauccugcugaagauccccgagagcaucacccccgggaccaccuuccucaucgagcgggcccaggaccuggacgugggcacgaacucccugcagaacuacaccaucagcccgaacuuccacuuccaccucaaccugcaggacucccuggacgggaucauccucccccagcugguccugaaccgcgcccucgaccgggaggagcagcccgagauccgccugacccugaccgcccucgacggcggcagcccgccccgguccgggacggcgcuggugcgcaucgagguggucgacaucaacgacaacgugcccgaguucgccaagcugcucuacgaggugcagauccccgaggacagccccgucggcucccagguggccaucgugagcgcccgggaccuggacaucgggaccaacggcgagaucuccuacgccuucagccaggcguccgaggacauccgcaagaccuuccggcugagcgccaaguccggcgagcuccugcugcgccagaagcucgacuucgagagcauccagaccuacacggucaacauccaggccaccgacgggggcgggcugagcgggaccugcgugguguucguccaggugauggaccugaacgacaacccgcccgagcucaccauguccacgcugaucaaccagauccccgagaaccugcaggacacccucaucgccgucuucagcguguccgaccccgacagcggcgacaacggccggauggugugcuccauccaggacgaccugccguucuuccugaagcccagcgucgagaacuucuacacccuggugaucuccaccgcccucgaccgcgagacgcggagcgaguacaacaucaccaucaccgugaccgacuucggcacgccccgccugaagaccgagcacaacaucaccguccugguguccgacgugaacgacaacgcgcccgccuucacccagacgagcuacacccucuucguccgcgagaacaacuccccggcccugcacaucgggagcguguccgccaccgaccgggacagcggcaccaacgcccaggugacguacucccugcucccgccccaggacccccaccucccccuggcgagccuggucuccaucaacgccgacaacgggcaccuguucgcccugcagagccucgacuacgaggcccugcaggccuucgaguuccgcgugggcgcggccgaccgggggucccccgcccugagcagcgaggcccucgugcgcguccuggugcuggacgcgaacgacaacucccccuucgugcucuacccgcugcagaacggcagcgcccccugcaccgagcuggucccccgggccgccgagcccggcuaccucgugaccaagguggucgccguggacggggacuccggccagaacgcguggcugagcuaccagcugcucaaggccaccgagccggggcuguucggcgugugggcccacaacggggagguccgcacggcccggcugcuccgcgagcgggacgccgcgaagcagcgccugguggugcuggucaaggacaacggcgagccgccccgguccgccaccgccacccuccacgugcugcugguggacggcuucagccagcccuaccuccugcugcccgaggccgcccccgcgcaggcccaggccgaccuccugaccgucuaccuggugguggcccucgcguccgucagcucccuguuccuguucagcgugcuccuguucguggccguccgccugugccggcgcucccgggccgccagcguggggcgcugcuccgugcccgagggccccuucccggggcagauggucgacgugagcggcaccggcacgcucucccagagcuaccaguacgaggugugccugaccgggggcuccgggaccaacgaguucaaguuccugaagcccaucauccccaacuucgucgcccagggcgcggagcgggugagcgaggccaaccccagcuuccgcaaguccuucgaguucaccuga

SEQ ID NO: 34308 - RNA, 2391 nt, Artificial Sequence
  derived and/or modified sequence opt1 from PCDHB3__Homo_sapiens__NP_061760
auggaggccggcggggagcgcuuccugcggcagcgccaggugcuccugcuguucgucuuccucggcgggagccuggccggcuccgagagccggcgcuacuccguggcggaggagaaggagaagggguuccugaucgccaaccucgccaaggaccugggccugcggguggaggagcucgccgcccgcggcgcgcaggucgugagcaaggggaacaagcagcacuuccagcugucccaccagaccggcgaccugcuccugaacgagaagcuggaccgggaggagcucugcgggcccaccgagccgugcauccugcacuuccagauccugcuccagaacccccugcaguucgugacgaacgagcugcgcaucaucgacgucaacgaccacagccccguguucuucgagaacgagaugcaccucaagauccuggaguccacccugcccggcaccgugaucccgcucgggaacgccgaggaccuggacgucggccggaacagccugcagaacuacaccaucacgcccaacucccacuuccacgugcucacccgcagccggcgcgacggccggaaguaccccgagcuggugcuggacaaggcccucgaccgcgaggagcagcccgagcugucccugacccucaccgcccuggacgggggcagcccgccccgguccgggacggcgcagaucaacauccagguccuggacaucaacgacaacgcccccgaguucgcccagccccucuacgagguggccgugcuggagaacaccccggucaacagcgugaucgugaccgucuccgccagcgaccuggacaccggcuccuucggcacgaucagcuacgcguucuuccacgccuccgaggagauccgcaagaccuuccagcucaaccccaucaccggggacaugcagcuggugaaguaccugaacuucgaggccaucaacagcuacgagguggacaucgaggccaaggacggcgggggccucagcgggaaguccaccgucaucguccaggugguggacgugaacgacaacccgcccgagcugacgcugagcuccgucaacagccccauccccgagaacuccggcgagaccgugcucgccguguucagcgucuccgaccuggacagcggcgacaacgggcgggugaugugcuccaucgagaacaaccugcccuucuuccucaagcccagcguggagaacuucuacacccuggucuccgagggcgcgcuggaccgcgagacccggagcgaguacaacaucacgaucaccaucaccgaccuggggaccccgcgccucaagacgaaguacaacaucaccgugcugguguccgacgucaacgacaacgcccccgccuucacccagaucagcuacacccuguucgugcgggagaacaacucccccgcccuccacaucggcagcguguccgccacggaccgcgacagcgggaccaacgcgcaggucaccuacucccugcugcccccgcaggacccccaccucccccugagcagccugguguccaucaacgccgacaacggccaccucuucgcccugcgcagccuggacuacgaggcccuccaggccuucgaguuccgggugggcgcgaccgaccgcgggucccccgcccugagcuccgaggcccugguccgggugcucgugcuggacgccaacgacaacagcccguucguccuguacccccuccagaacggcuccgcgcccugcacggagcuggugccgcgcgccgccgagcccggguaccuggugaccaaggucguggccguggacggcgacagcgggcagaacgccuggcucuccuaccagcugcugaaggcgaccgagcccggccucuucggcgucugggcccacaacggggaggugcggaccgcccgccugcugagcgagcgggacgccgccaagcaccgccucgugguccuggugaaggacaacggcgagcccccgcgguccgcgacggccacccugcacgugcuccuggucgacggguucagccagcccuaccugccccuccccgaggccgccccggcccaggcgcaggccgaccugcugaccguguaccucguggucgcccuggccuccgugagcucccuguuccucuucagcgugcugcuguucgucgcggugcgccucugccggcgcucccgggccgccagcgugggccgcugcagcguccccgagggccccuuccccgggcagaugguggacguguccggcaccgggacccugagccaguccuaccaguacgaggucugccugacgggcgggagcggcaccaacgaguucaaguuccucaagccgaucauccccaacuucguggcccagggcgccgagcggguguccgaggcgaaccccagcuuccgcaaguccuucgaguucagcuga

SEQ ID NO: 34309 - RNA, 2406 nt, Artificial Sequence
  derived and/or modified sequence opt1 from PCDHB8__Homo_sapiens__NP_061993
auggaggccagcggcaagcugaucugccgccagcggcagguccucuucuccuuccugcugcucgggcugagccuggccggcgcggccgagccccgcuccuacagcgugguggaggagaccgagggguccagcuucgugaccaaccucgccaaggaccugggccuggagcagcgggaguucucccgccgcgggguccggguggugagccggggcaacaagcuccaccuccagcugaaccaggagacggccgaccugcugcugaacgagaagcucgaccgcgaggaccugugcggccacaccgagccgugcguccugcgguuccaggugcuccuggagucccccuucgaguucuuccaggccgagcuccaggugaucgacaucaacgaccacagccccgucuuccuggacaagcagaugcuggugaagguguccgagagcuccccgcccgggaccgcguucccccugaagaacgccgaggaccucgacaucggccagaacaacaucgagaacuacaucaucagccccaacuccuacuuccgcguccugacccggaagcgcagcgacgggcggaaguaccccgagcuggugcucgacaaggcccuggaccgcgaggaggaggccgagcugcggcucacgcugaccgcgcuggacggcggguccccgccccgcagcggcaccgcccagguguacaucgaggucguggacgugaacgacaacgcccccgaguucgagcagcccuucuaccggguccagaucuccgaggacagcccgaucagcuuccucguggugaaggucuccgccaccgacguggacacgggcgugaacggggagaucagcuacucccuguuccaggccagcgacgagaucuccaagaccuucaaggucgacuuccugaccggcgagauccgccucaagaagcagcuggacuucgagaaguuccagagcuacgaggugaacaucgaggcgcgggacgccgggggcuucuccggcaagugcaccguccugauccaggugaucgacgugaacgaccacgcccccgaggucacgaugagcgccuucaccucccccauccccgagaacgccccggagaccgugguggcccucuucagcgucuccgaccuggacagcggggagaacggcaagaucuccugcagcauccaggaggaccugcccuuccuccugaaguccagcguggggaacuucuacacccugcucacggagacgccccuggaccgcgagucccgggcggaguacaacgugaccaucaccgucaccgaccugggcacgccccgccucaccacccaccugaacaugaccgugcuggugagcgacgucaacgacaacgccccggccuucacccagaccuccuacacccuguucgugcgcgagaacaacagccccgcccuccacaucgggagcguguccgcgacggaccgggacagcggcaccaacgcccaggucaccuacucccugcugccgccccaggacccccaccucccccuggccagccugguguccaucaacaccgacaacggccaccucuucgcccugcgcagccuggacuacgaggcccuccaggcguucgaguuccgggugggggccuccgaccgcggcagccccgcccuguccagcgaggcccugguccgggugcucgugcuggacgcgaacgacaacucccccuucguccuguacccgcuccagaacgggagcgcccccugcacggagcuggugccccgcgccgccgagccgggcuaccuggugaccaaggucguggccguggacggggacuccggccagaacgcguggcucagcuaccagcugcugaaggccaccgagcccggccucuucggggucugggcccacaacggcgaggugcggaccgcccgccugcuguccgagcgggacgccgcgaagcagcgccucgugguccuggugaaggacaacggggagccgcccugcagcgccacggccacccugcacgugcuccuggucgacggcuucucccagcccuaccugccccuccccgaggccgcccccgcgcaggggcaggccgacagccugaccguguaccugguggucgcccucgccagcguguccagccuguuccuguucuccgugcuccuguucgucgcggugcugcucugccggcgcagccgggccgccuccgugggccgcugcagcgucccggagggccccuuccccgggcaccugguggacgugcggggcaccgggucccugagccagaacuaccaguacgaggucugccucgccggcggcuccgggaccaacgaguuccagcugcugaagcccgugcucccgaacauccagggccacagcuucgggcccgagauggagcagaacuccaacuuccgcaacggcuucggguucagccugcagcugaaguga

SEQ ID NO: 34310 - RNA, 2808 nt, Artificial Sequence
  derived and/or modified sequence opt1 from PCDHGA11__Homo_sapiens__NP_061737
auggccaaccgccugcagcggggcgaccgcagccggcuccugcugcuccugugcaucuuccuggggacccuccgcggcuuccgggcccgccagauccgguacuccgugcccgaggagaccgagaaggggagcuucgucggcaacaucuccaaggaccuggggcuggagccgcgcgagcucgcgaagcggggcgugcgcaucgugagccggggcaagacgcagcuguucgccgucaacccccgcuccgggagccugaucaccgccggccggaucgaccgcgaggagcucugcgagaccguguccagcugcuuccugaacauggagcugcucguggaggacacccugaagaucuacggggucgagguggagaucaucgacaucaacgacaacgcccccuccuuccaggaggacgagguggagaucaaggucagcgagcacgccauccccggcgcgcgguucgcccugccgaacgcccgcgaccccgacgugggggugaacucccuccagagcuaccagcugucccccaacaacuacuucagccugcagcuccggggccgcacggacggcgccaagaaccccgagcugguccuggaggggucccucgaccgggagaaggaggcggcccaccuccugcugcugaccgcccuggacggcggggacccgauccgcaagggcgccgugcccauccggguggucgugcucgacgugaacgaccacauccccauguucacccagagcgucuaccgcguguccgugcccgagaacaucagcuccggcacccgcguccugauggugaacgccacggacccggacgaggggaucaacggcgaggugauguacagcuuccggaacauggagagcaaggcguccgagaucuuccagcuggacagccagaccggggagguccaggugcgcggcucccucgacuucgagaaguaccgguucuacgagauggagauccaggggcaggacggcggcgggcuguucaccaccacgaccaugcugaucaccgucguggacgugaacgacaacgcccccgagaucaccaucacgagcuccaucaacagcauccucgagaacuccccgcccggcaccgucaucgcccugcugaacgugcaggaccaggacagcggggagaacggccagguguccugcuucauccccaaccaccuccccuucaagcuggagaagaccuacgggaacuacuacaagcugaucaccagccgcguccucgaccgggagcuggugcaguccuacaacaucacgcugaccgccaccgaccagggcagcccgccccucuccgccgagacccacguguggcugaacgucgcggacgacaacgacaacccgcccguguucccccacagcuccuacagcgccuacauccccgagaacaacccccgcggcgccuccaucuucagcgugacggcccuggaccccgacuccaagcagaacgcccucgucaccuacagccugaccgacgacaccgugcagggggugccccugagcuccuacgucagcaucaacuccaacacgggcgugcuguacgcgcuccagagcuucgacuacgagcaguuccgggaccuggagcugcgcgugaucgcccgggacuccggggacccgccccucagcuccaacgucagccugucccuguucgugcucgaccagaacgacaacgcccccgagauccuguaccccgcccugccgaccgacggcagcaccgggguggagcucgcgccccgcuccgccgagcccggcuaccuggucaccaaggugguggccgucgacaaggacagcggccagaacgccuggcuguccuaccggcuccugaaggccagcgagcccgggcuguucgcggugggcgagcacacgggggaggugcgcaccgcccgggcccuccuggaccgcgacgcccugaagcagucccucgucguggccgugcaggaccacggccagccgccccugagcgcgaccgucacccugacgguggccguggccgacuccauccccgagguccucgccgaccugggcagccuggagagccucgccaacuccgagaccagcgaccugucccuguaccucgugguggcggucgccgccgugagcugcaucuuccugguguucgucaucgugcugcucgcccugcggcuguggcgcuggcacaagucccggcuccugcaggccagcgagggcgggcuggcggggaugcccaccucccacuucgugggcgucgacggggugcaggccuuccuccagaccuacagccacgaggugucccugaucgccgacagccagaagucccaccugaucuucccgcagcccaacuacggcgacacccucaucagccaggaguccugcgagaaguccgagccccugcugaucgccgaggacagcgcgaucauccucggcaagugcgaccccacgagcaaccagcaggccccgcccaacaccgacuggcgcuucucccaggcccagcggcccgggaccagcggcucccagaacggggacgacaccggcacguggcccaacaaccaguucgacaccgagaugcugcaggccaugauccuggccagcgcgagcgaggccgccgacggguccagcacccucggcggcggggccggcaccauggggcuguccgcccgcuacggcccgcaguucacgcugcagcacguccccgacuaccgccagaacguguacauccccgggagcaacgcgacccucaccaacgccgccggcaagcgggacggcaaggcccccgccgggggcaacgggaacaagaagaaguccggcaagaaggagaagaaguga

SEQ ID NO: 34311 - RNA, 2799 nt, Artificial Sequence
  derived and/or modified sequence opt1 from PCDHGA3__Homo_sapiens__NP_061739
augaccaacugccugagcuuccgcaacggccgggggcucgcccugcugugcgcccuccugggcacccugugcgagacgggguccggccagauccgcuacagcguguccgaggagcucgacaaggggagcuucgucggcaacaucgcgaacgaccugggccuggagccccgggagcucgccgagcgcggggugcggaucgugucccgcggccggacccagcuguucagccugaacccgcaguccgggagccucgucaccgccgagcgcaucgaccgggaggagcugugcgcccagaucccccugugccucgugaagaucaacauccugguggaggacaagcugaagaucuucgaggucgagaucgagaucaaggacaucaacgacaacgcccccaacuuccccaccgaggagcucgagaucaagaucggcgagcugacggugccggggacccgcuuccccaucaagaccgcguucgaccccgacgugggcaucaacucccugcagaacuacaagcucagccccaacgacuacuucucccuggccgucaacagcguguccgagggcgccaaguacccggagcuggugcucgagcgggcccuggaccgcgagaagaaggagauccaccagcugguccucguggcgagcgacgggggcgaccccgugcacuccgggaaccugcacauccaggucaucgugcuggacgccaacgacaacccgcccauguucacccagcccgaguaccgggugagcgucugggagaacgugcccgugggcacgcgccuccugaccgucaacgccaccgaccccgacgagggcuucaacgcccagguguccuacauccuggacaagaugcccgggaagaucgccgagaucuuccaccucaacagcguguccggcgaggucagcauccucaagagccuggacuacgaggacgcgauguucuacgagaucaagaucgaggcccaggacgggccgggccugcugagccgggccaagauccuggugaccguccucgacgugaacgacaacgcccccgagaucacgaucaccagccugaccuccagcgugcccgaggaggggaccgucggccgcgagaucgcccugaucgacgugcacgaccgggacuccggccagaacggccagguggaggucuucgugcucgggaaccugcccuucaagcuggagaaguccaucgaccaguacuaccgccucgugacggcgaccagccuggaccgggagcagaucagcgaguacaacaucucccugcgcgccagcgacgggggcuccccgccccucagcaccgagacccacaucacgcugcacgucaucgacaucaacgacaacccgcccaccuucccccaccuguccuacagcgccuacauccccgagaacaacccccgcggggccuccaucuucagcgugaccgcccaggaccccgacuccaacaacaacgcgcggaucaccuacgcccugacggaggacacccuccagggcgccccgcugagcuccuucgugagcaucaacagcaacaccggcguccuguacgcccuccgcuccuucgacuacgagcaguuccgggaccugaagcugcucgugaccgccagcgacuccgggaacccgccccugagcuccaacgugagccugaaccucuucguccuggaccagaacgacaacgcgcccgagauccuguaccccgcccuccccacggacggcuccaccgggguggagcuggcgccccgcagcgccgagccgggcuaccuggugaccaaggucguggccguggaccgggacuccgggcagaacgccuggcucagcuaccgccugcugaaggccuccgagcccggccucuucagcgucggccugcacaccggggaggugcggacggcccgcgcccugcucgaccgggacgcgcugaagcagucccugguggucgccgugcaggaccacggccagccgccccucagcgccaccgugacccugaccgucgccguggccgaccgcauccccgacauccuggcggaccucgggucccuggagcccagcgccaagcccaacgacuccgaccugacgcucuaccugguggucgccguggccgccgugagcugcgucuuccuggcguucgugaucgugcuccuggcccugcggcuccgccgguggcacaagagccgccugcugcaggccuccggcggcgggcucgccagcacccccggcucccacuucgucggggcggacggcgugcgggccuuccugcagaccuacagccacgaggugucccugaccgccgacagccgcaagucccaccucaucuucccgcagcccaacuacgccgacacccugaucagccaggaguccugcgagaaguccgagccccugcucaucacgcaggaccugcuggagaugaagggggacagcaaccuccugcagcaggcgcccccgaacaccgacuggcgguucagccaggcccagcgccccggcaccuccggcagccagaacggggacgacaccggcacguggcccaacaaccaguucgacaccgagaugcugcaggccaugauccucgccuccgccagcgaggccgcggacggguccagcacccugggcgggggcgccggcaccauggggcuguccgcccgguacggcccccaguucacgcuccagcacgucccggacuaccgccagaacguguacauccccgggagcaacgccacccugaccaacgccgcgggcaagcgggacgggaaggcccccgccggcggcaacgggaacaagaagaaguccggcaagaaggagaagaaguga

SEQ ID NO: 34312 - RNA, 2772 nt, Artificial Sequence
  derived and/or modified sequence opt1 from PCDHGB4__Homo_sapiens__NP_003727
augggcagcggggccggcgagcuggggcgcgccgagcggcuccccgugcuguuccuguuccuccugucccuguucugcccggcgcucugcgagcagauccgcuaccggauccccgaggagaugcccaagggcagcgucguggggaaccuggccaccgaccugggcuucuccgugcaggagcuccccacccgcaagcugcgggucagcuccgagaagccguacuucacggugagcgccgaguccggcgagcugcucgugagcucccgccuggaccgggaggagaucugcgggaagaagcccgccugcgcccuggaguucgaggcggucgccgagaacccccucaacuucuaccacgugaacguggagaucgaggacaucaacgaccacacccccaaguucacccagaacagcuucgagcugcagaucuccgagagcgcccagccgggcacccgcuucauccugggguccgcccacgacgcggacaucggcagcaacacgcuccagaacuaccagcugucccccagcgaccacuucucccugaucaacaaggagaaguccgacgggagcaaguaccccgagaugguccucaagacgccccuggaccgggagaagcagaaguccuaccaccugacccucaccgcccuggacuucggcgccccgccccugagcagcaccgcccagauccacgugcucgugaccgacgccaacgacaacgcgcccgucuucagccaggacguguaccgcgugucccugagcgagaacgucuaccccggcaccaccgugcuccaggugacggccaccgaccaggacgagggggucaacgccgagaucaccuucuccuucagcgaggccucccagaucacccaguucgaccugaacagcaacacgggcgagaucaccgugcugaacacccuggacuucgaggaggugaaggaguacuccaucguccucgaggcccgggacgggggcggcaugaucgcgcagugcaccguggagguggaggucaucgacgagaacgacaacgccccggaggugaucuuccagagccugcccaaccugaucauggaggacgccgagcucgggacgcacaucgcccugcugaagguccgcgacaaggacucccggcacaacggcgaggugaccugcaagcucgagggggacgugcccuucaagauccugaccagcucccgcaacaccuacaagcuggucacggacgccgugcucgaccgggagcagaaccccgaguacaacaucaccgugaccgcgaccgaccgcggcaagccgccccugagcuccagcuccagcaucacgcugcacaucggggacgucaacgacaacgcccccguguucucccagagcagcuacaucgugcacgucgccgagaacaacccgcccggcgccuccaucagccaggugcgggccuccgaccccgaccucggccccaacggccaggugagcuacugcaucauggcguccgaccuggagcagcgcgagcugagcuccuacgucagcaucuccgccgagagcggggugguguucgcccagcgggccuucgaccacgagcagcuccgcgcguucgagcugacccugcaggcccgggaccaggggucccccgcccugagcgccaacgucucccuccgcgugcugguggacgaccgcaacgacaacgccccgcggguccuguaccccgcgcucggccccgacgggagcgcccuguucgacauggugccgcacgccgccgagcccggcuaccuggugaccaaggucguggccguggacgcggacuccggccacaacgccuggcucagcuaccacguccugcaggccuccgagcccgggcuguucagccucggccugcgcaccggggaggugcggacggcccgcgcccugggcgaccgggacgcggugcgccagcggcuccuggucgccgugcgcgacgggggccagcccccgcugagcgccaccgccacccuccaccugguguucgcggacucccugcaggagguccuccccgacaucaccgaccggcccgaccccagcgaccugcaggccgagcugcaguucuaccucgugguggcccuggcccugaucuccguccucuuccugguggccaugauccuggcgaucgcccuccgccugcggcgcagcuccagcccggccuccuggagcugcuuccagcccggccugugcgugaaguccgagagcgucgugccgcccaacuacuccgaggggacgcuccccuacagcuacaaccugugcguggcccacaccggcaagaccgaguucaacuuccugaagugcuccgagcagcucagcuccgggcaggacauccugugcggcgacagcuccggcgcccuguucccccucugcaacagcuccgagcugaccagccaccagcaggcgccgcccaacaccgacuggcgguucagccaggcccagcgccccgggacguccggcagccagaacggggacgacaccggcaccuggcccaacaaccaguucgacaccgagaugcugcaggccaugauccucgccuccgccagcgaggcggccgacggguccagcacgcugggcggcggggccggcaccauggggcuguccgcccgguacggcccccaguucacccuccagcacguccccgacuaccgccagaacguguacaucccggggagcaacgcgacccugacgaacgccgccggcaagcgggacggcaaggcccccgccgggggcaacgggaacaagaagaaguccggcaagaaggagaagaaguga

SEQ ID NO: 34313 - RNA, 2793 nt, Artificial Sequence
  derived and/or modified sequence opt1 from PCDHGB6__Homo_sapiens__NP_061749
augggcgggagcugcgcccagcgccggcgcgccggcccccgccaggugcuguucccgcuccugcugccccucuucuaccccacccuguccgagcccauccgcuacagcaucccggaggagcuggcgaagggguccgucgugggcaaccucgccaaggaccuggggcugagcgugcucgacgucuccgcccggaagcugcgcgugagcgccgagaagcugcacuucuccguggacgccgagagcggcgaccuccuggucaagaaccggaucgaccgcgagcagaucugcaaggagcggcgccggugcgagcugcagcucgaggcggugguggagaacccccugaacaucuuccacgucaucguggugaucgaggacgucaacgaccacgcgccccaguucgacaagaaggagauccaccuggagaucuucgaguccgccagcgccggcacccgccucucccuggaccccgccacggacccggacaucaacaucaacagcaucaaggacuacaagaucaacuccaaccccuacuucagccugauggugcgggugaacuccgacgggggcaaguaccccgagcucagccuggagaagcugcucgaccgcgaggagcagcggucccacagccugauccugaccgcccucgacgggggcgacccgccccgcuccgccaccgcccacaucgagaucagcgucaaggacaccaacgacaacccgcccguguucagccgggacgaguaccgcaucucccugagcgagaaccugccgcccgggucccccgugcuccaggucacggccaccgaccaggacgagggcgugaacgcggagaucaacuacuacuuccggagcaccgcccaguccaccaagcacauguucagccuggacgagaagacgggcaugaucaagaacaaccaguccuucgacuucgaggacguggagcgguacaccauggaggucgaggccaaggacgggggcgggcugagcacccagugcaaggugaucaucgagauccucgacgagaacgacaacagccccgagaucaucaucaccagccuguccgaccagauccuggagaacagcccgcccggcaugguggucgcccucuucaagacgcgggaccuggacuucggcgggaacggcgaggugcgcugcaacaucgagaccgacauccccuucaagaucuacuccagcuccaacaacuacuacaagcuggucaccgacggggcccucgaccgcgagcagacccccgaguacaacgugacgaucguggcgaccgaccggggcaagccgccccugagcuccagccgcuccaucacccuguacgucgccgacaucaacgacaacgcccccguguucgaccagaccagcuacgugguccacguggccgagaacaacccgcccggggccagcaucgcccagguguccgcgagcgaccccgaccucggccugaacggccacaucuccuacagcaucgucgccuccgaccuggagccccucgccgugagcuccuacgugagcgucuccgcccagagcggggugguguucgcgcagcgggccuucgaccacgagcagcugcgcgccuucgcccugacgcuccaggcgcgggaccacggcucccccacccugagcgccaacgucucccugcgcgugcuggugggggaccggaacgacaacgcgccccgcguccucuaccccgcccugggccccgacgggagcgccuucuucgacauggugccccgguccgccgagccgggcuaccuggugaccaaggucguggccguggacgccgacagcggccacaacgccuggcucuccuaccacguccugcaggccagcgagcccgggcuguucagccucggccugcgcaccggggaggugcggacggcgcgcgcccugggcgaccgggacgccgcccgccagcggcuccugguggccguccgcgacgggggccagccgccccuguccgcgaccgccacccuccaccugguguucgccgacaaccugcaggagauccuccccgaccugagcgaccggcccgugcuguccgacccccaggccgagcuccaguucuaccuggucguggcgcuggcccucaucagcgugcuguuccugcucgccgucauccuggccaucgcccugcgccuccggcgcucccugagccccgcgaccugggacugcuuccacccgggccugugcgugaaguccgggcccguggucccgcccaacuacagcgagggcacgcuccccuacuccuacaaccugugcaucgcccacaccgggaccaaggaguucaacuuccugaagugcagcgugccccuccacuccaacgaggacauggugugcagcgucucccccggcgcccugaucccgccccacggcggggaggaccugaccagccaccccgagacgcucaccucccaggccccgcccaacaccgacuggcgcuucagccaggcccagcggcccggcaccuccgggagccagaacggcgacgacacggggaccuggcccaacaaccaguucgacaccgagaugcugcaggcgaugauccuggccuccgccagcgaggccgccgacggcagcuccacccucggcgggggcgcggggaccaugggccugagcgcccgcuacgggccccaguucacgcugcagcacgugccggacuaccggcagaacguguacauccccggcuccaacgccacccucaccaacgccgcgggcaagcgcgacgggaaggcccccgccggcgggaacggcaacaagaagaaguccgggaagaaggagaagaaguga

SEQ ID NO: 34314 - RNA, 2805 nt, Artificial Sequence
  derived and/or modified sequence opt1 from PCDHGC3__Homo_sapiens__NP_002579
auggugcccgaggccuggcgcagcggccuggucuccaccgggcggguggugggcguccuccugcugcucggggcccugaacaaggcgagcaccgugauccacuacgagaucccggaggagcgcgagaagggcuucgccguggggaacgucguggccaaccugggccucgaccugggcucccugagcgcccggcgcuuccggguggucuccggggccagccgccgguucuucgaggugaaccgcgagacgggcgagauguucgugaacgaccggcucgaccgcgaggagcugugcgggacccugcccuccugcaccgucacccucgagcuggugguggagaacccccuggagcuguucagcgucgagguggugauccaggacaucaacgacaacaaccccgcguucccgacgcaggagaugaagcucgagaucuccgaggccgucgcccccggcacccgguucccccuggagagcgcccacgaccccgacgugggguccaacagccuccagaccuacgagcugucccgcaacgaguacuucgcgcugcgggugcagacccgcgaggacagcacgaaguacgccgagcucguccuggagcgggcccuggaccgcgagcgggagccgucccuccagcuggugcugaccgcccucgacggcggcacccccgcccugagcgcgucccugcccauccacaucaaggugcucgacgccaacgacaacgcccccgucuucaaccagagccuguaccgcgcccgggugcuggaggacgccccguccgggacccgcgucguccaggugcucgcgacggaccuggacgagggccccaacggggagaucaucuacagcuucggcagccacaaccgggccggcgugcgccagcuguucgcccucgaccuggugaccgggaugcugaccaucaagggccgccucgacuucgaggacaccaagcugcacgagaucuacauccaggccaaggacaagggggccaaccccgagggcgcgcacugcaaggugcuggucgaggugguggacgucaacgacaacgcccccgagaucacggugaccuccguguacagcccgguccccgaggacgcgccccucgggaccgugaucgcccugcuguccgugaccgaccucgacgccggcgagaacggccuggucacgugcgaggugcccccggggcugcccuucagccucaccuccagccugaagaacuacuucacccugaagaccuccgcggaccuggaccgggagacggugcccgaguacaaccucagcaucaccgcccgcgacgccggcacccccucccugagcgcccugaccaucguccggguccagguguccgacaucaacgacaacccgccccagagcucccagagcuccuacgacguguacaucgaggagaacaaccuccccggggcgcccauccugaaccugagcgugugggacccggacgcgccccagaacgcccgccucuccuucuuccugcuggagcagggcgccgagacggggcucgugggccgguacuucaccaucaaccgcgacaacggcaucgucagcucccuggugccccuggacuacgaggaccggcgcgaguucgagcucaccgcccacaucagcgacgggggcaccccggugcuggccacgaacaucagcgucaacaucuucgugaccgaccggaacgacaacgcgccccaggugcuguacccccgccccgggggcuccagcgucgagaugcucccgcgggggaccuccgccggccaccuggugagccgcguggucggcugggacgccgacgccgggcacaacgccuggcuguccuacagccuccugggcucccccaaccagagccuguucgccaucgggcuccacaccggccagaucuccacggcccggcccgugcaggacaccgacagcccccgccagacccugaccgugcugaucaaggacaacggcgagccgucccucagcaccacggccacccugaccgucuccgugaccgaggacagccccgaggcccgggcggaguuccccuccgggagcgcgccccgcgagcagaagaagaaccugacguucuaccuccugcugucccucauccuggugagcgucggcuucguggugaccgucuucggggugaucaucuucaagguguacaaguggaagcagagccgggaccuguaccgcgccccggucuccagccucuaccggacccccggccccucccugcacgccgacgccgugcgcgggggccugaugagcccccaccucuaccaccagguguaccugaccacggacucccgccggagcgacccgcugcucaagaagcccggcgccgccagcccccuggccagccgccagaacacccugcgguccugcgaccccgucuucuaccgccaggugcucggggccgagagcgcgccgcccggccagcaggccccgcccaacaccgacuggcgguucucccaggcccagcgccccgggaccagcggcucccagaacggggacgacacgggcaccuggcccaacaaccaguucgacaccgagaugcugcaggccaugauccuggccagcgcguccgaggccgccgacggcagcuccacccucgggggcggggccggcacgauggggcugagcgcccgguacggcccccaguucacccugcagcacgugccggacuaccgccagaacgucuacauccccggcuccaacgcgacccucaccaacgccgccgggaagcgggacggcaaggcccccgccgggggcaacgggaacaagaagaaguccggcaagaaggagaagaaguga

SEQ ID NO: 34315 - RNA, 1299 nt, Artificial Sequence
  derived and/or modified sequence opt1 from PCED1B__Homo_sapiens__NP_001268358
augauccugcuccgcgccagcgaggugcggcagcugcugcacaacaaguucgucgugauccucggcgacuccgugcaccgcgccgucuacaaggaccuggugcugcuccugcagaaggaccggcugcucacccccgggcagcugcgcgcgcggggcgagcugaacuucgagcaggacgagcucguggacgggggccagcgcgggcacaugcacaacggccugaacuaccgggagguccgcgaguuccggagcgaccaccaccuggugcgcuucuacuuccucacccggguguacuccgacuaccugcagacgauccugaaggagcuccagagcggcgagcacgccccggaccuggucaucaugaacuccugccugugggacaucagccgcuacgggcccaacuccuggcggagcuaccucgagaaccuggagaaccuguuccagugccucggccaggugcugcccgaguccugccugcucguguggaacaccgccaugcccgucggggaggaggugaccggcggguuccugccgcccaagcugcgccggcagaaggccaccuuccucaagaacgagguggucaaggccaacuuccacagcgcgacggaggcccgcaagcacaacuucgacgugcuggaccugcacuuccacuuccggcacgcccgcgagaaccuccacugggacggcgugcacuggaacggccggguccaccgcugccugucccagcugcuccuggcccacguggcggacgccuggggcguggagcugccccaccggcaccccgucggcgaguggaucaagaagaagaagccggggccccgcguggagggcccgccccaggccaaccgcaaccaccccgcccucccccugagcccgccccugcccucccccaccuaccggccccuccugggcuucccgccccagcgccugccccuccugccccugcucagcccccagccgcccccgcccauccugcaccaccaggggaugccccgguucccccaggggcccccggacgccugcuucuccagcgaccacaccuuccaguccgaccaguucuacugccacagcgacgugcccuccagcgcgcacgccggguucuucgucgaggacaacuucauggugggcccccagcugcccaugccguucuuccccacgccccgcuaccagcggcccgccccggucgugcaccgcggguucggccgguaccgcccccggggccccuacacccccugggggcagcgcccgcggcccagcaagcgccgggcccccgccaaccccgagccgcgcccccaguga

SEQ ID NO: 34316 - RNA, 4668 nt, Artificial Sequence
  derived and/or modified sequence opt1 from PCF11__Homo_sapiens__NP_056969
augagcgagcagacccccgccgaggccggcgcggccggggcccgcgaggacgccugccgggacuaccaguccagccuggaggaccucaccuucaacuccaagccgcacaucaacaugcugacgauccuggccgaggagaaccuccccuucgcgaaggagaucgugagccugaucgaggcccagaccgccaaggcccccuccagcgagaagcugcccgucauguaccucauggacuccaucgugaagaacgugggccgcgaguaccugaccgcguucaccaagaaccuggucgccacguucaucugcguguucgagaagguggacgagaacacccggaagagccucuucaagcugcgcuccaccugggacgagaucuucccgcugaagaagcucuacgcccuggacguccgggugaacagccuggaccccgccuggcccaucaagccccucccgcccaacgugaacaccuccagcauccacgucaaccccaaguuccugaacaagucccccgaggagccgagcacgcccgggaccgugguguccagccccuccaucagcacccccccgaucguccccgacauccagaagaaccugacccaggagcagcucauccgccagcagcugcuggccaagcagaagcagcuccuggagcugcagcagaagaagcucgagcuggagcuggagcaggcgaaggcccagcucgccgugucccugagcgugcagcaggagacgagcaaccugggccccggguccgcccccagcaagcuccacgucucccagaucccgcccauggccgugaaggcgccccaccaggugcccguccagagcgagaagucccggccgggccccagccugcagauccaggaccugaagggcaccaaccgcgacccccggcucaaccgcaucucccagcacagccacgggaaggaccagucccaccggaaggaguuccugaugaacacccugaaccagagcgacaccaagacguccaagaccauccccagcgagaagcucaacuccagcaagcaggagaaguccaagagcggcgagaagaucaccaagaaggagcuggaccagcuggacuccaagagcaaguccaagagcaagagcccguccccccucaagaacaagcugagccacaccaaggaccugaagaaccaggaguccgagagcaugcgccucuccgacaugaacaagcgggacccccgccugaagaagcaccugcaggacaagacggacgggaaggacgacgacgugaaggagaagcggaagaccgccgagaagaaggacaaggacgagcacaugaagagcuccgagcaccgccucgccggcagccggaacaagaucaucaacgggaucgugcagaagcaggacaccaucaccgaggaguccgagaagcagggcacgaagccgggccgcagcuccacccggaagcgcagccggucccgcagccccaagucccgcagccccaucauccacucccccaagcggcgcgaccggcgcagcccgaagcggcgccagcggagcaugucccccaccagcacccccaaggccgggaagauccgccaguccggcgccaagcagagccacauggaggaguucacgcccccgucccgggaggaccgcaacgcgaagcggagcaccaagcaggacauccgcgacccccggcgcaugaagaagaccgaggaggagcggccccaggagaccacgaaccagcacuccaccaagagcgggaccgagcccaaggagaacgucgagaacuggcaguccagcaaguccgccaagcgcuggaagagcggcugggaggagaacaagucccugcagcagguggacgagcacagcaagccgccccaccugcggcaccgcgaguccuggagcuccaccaagggcauccucagcccccgggcccccaagcagcagcagcaccgccuguccguggacgccaaccugcagaucccgaaggagcugacgcucgccagcaagcgcgagcugcugcagaagaccagcgagcggcucgcguccggggagaucacccaggacgacuuccuggucgugguccaccagauccgccagcuguuccaguaccaggagggcgugcgggaggagcagcgcagccccuucaacgaccgguucccccucaagcgcccccgguacgaggacuccgacaagccguucguggacagccccgccucccgcuucgccgggcuggacaccaaccagcggcugaccgcccucgcggaggaccgcccccuguucgacggccccagccggccguccgucgcccgcgacgggcccacgaagaugaucuucgagggccccaacaagcugagcccgcggaucgacggcccccccacccccgccucccuccgcuucgacgggagcccgggccagauggggggcgggggcccccugcgguucgagggcccccaggggcagcugggcgggggcugcccccuccgcuucgaggggccgcccggccccgugggcaccccccugcgguucgaggggccgaucggccaggccgggggcggcggguuccgcuucgagggcucccccgggcugcgguucgagggcagccccgggggccuccgcuucgagggccccgggggccagccgguggggggccugcgguucgaggggcaccgcggccagcccgucggcgggcugcgcuucgagggcccccacgggcagcccgugggcgggcuccgguucgacaacccgcgcggccagcccgugggcgggcugcgguucgagggcgggcacggccccuccggggccgcgauccgcuucgacggcccccacggccagccggggggcgggauccgguucgagggcccccugcuccagcagggcgucgggaugcgcuucgagggcccccacgggcagagcguggccggccugcgguucgaggggcagcacaaccagcugggcggcaaccuccgcuucgaggggccccacggccagccgggggugggcauccgguucgaggggccccugguccagcagggcggcgggaugcgcuucgagggccccuccgugccggggggcgggcugcggaucgagggcccccucggccaggggggcccccgcuucgaggggugccacgcccugcgguucgacggccagcccggccagccgagccugcucccccgcuucgacgggcugcacggccagcccgggccccgguucgagcgcaccccgggccagcccgggccccagcgguucgacggccccccgggccagcaggugcagccccgcuucgacggggucccccagcgguucgacggcccccagcaccagcaggccucccgcuucgacaucccgcuggggcuccagggcacgcgcuucgacaaccaccccagccagcggcuggaguccgugagcuucaaccagaccgggcccuacaacgaccccccgggcaacgccuucaacgcgcccagccagggccugcaguuccagcgccacgagcagaucuucgacuccccccaggggcccaacuucaacggcccgcacgggcccggcaaccagagcuucuccaacccccucaaccgggccagcgggcacuacuucgacgagaagaaccugcaguccagccaguucggcaacuucggcaacauccccgccccgaugaccguggggaacauccaggccucccagcagguccugagcggcguggcccagcccguggcguucgggcagggccagcaguuccuccccguccacccgcagaaccccggguucgugcagaaccccuccggcgcccugcccaaggccuacccggacaaccaccugagccagguggacgucaacgagcucuucuccaagcugcugaagaccggcauccucaagcugagccagacggacuccgccaccacccaggugagcgaggugaccgcgcagcccccccccgaggaggaggaggaccagaacgaggaccaggacgucccggaccugacgaacuucaccguggaggagcucaagcagcgcuacgacuccgugaucaaccggcuguacaccgggauccagugcuacagcugcggcaugcgcuucaccacgucccagaccgacgucuacgccgaccaccuggacuggcacuaccggcagaaccgcaccgagaaggacgugagccggaaggugacccaccgccggugguacuacucccucacggacuggaucgaguucgaggagaucgccgaccuggaggagcgcgccaagagccaguucuucgagaagguccacgaggagguggugcugaagacccaggaggccgcgaaggagaaggaguuccagagcguccccgccgggcccgccggcgccguggaguccugcgagaucugccaggagcaguucgagcaguacugggacgaggaggaggaggaguggcaccucaagaacgccauccggguggacggcaagaucuaccaccccagcugcuacgaggacuaccagaacaccuccagcuucgacugcaccccgucccccagcaagacgcccgucgagaacccccugaacaucaugcugaacaucgugaagaacgagcuccaggagccgugcgacucccccaaggugaaggaggagcgcaucgacaccccccccgcgugcaccgaggagagcaucgccaccccguccgagaucaagacggagaacgacaccgucgagagcguguga

SEQ ID NO: 34317 - RNA, 780 nt, Artificial Sequence
  derived and/or modified sequence opt1 from PCGF1__Homo_sapiens__NP_116062
auggccagcccccagggcgggcagaucgccaucgcgaugcgccugcggaaccagcuccaguccguguacaagauggacccgcugcgcaacgaggaggagguccgggugaagaucaaggaccugaacgagcacaucgugugcugccucugcgccggcuacuucgucgacgccaccaccaucacggagugccugcacaccuucugcaagagcugcaucgugaaguaccugcagaccuccaaguacugccccaugugcaacaucaagauccacgagacccagccccuccugaaccugaagcucgaccgcgugaugcaggacaucgucuacaagcuggugcccgggcugcaggacagcgaggagaagcggauccgcgaguucuaccagucccggggccucgaccgcgugacgcagccgaccggggaggagcccgcccugagcaaccugggccuccccuucuccagcuucgaccacuccaaggcccacuacuaccgguacgacgagcagcugaaccugugccucgagcgccugagcuccggcaaggacaagaacaagagcguccugcagaacaaguacgugcggugcuccgugcgcgcggagguccggcaccuccgccgggugcugugccaccgccugaugcucaacccccagcacgugcagcugcuguucgacaacgagguccucccggaccacaugaccaugaagcagaucuggcugagccggugguucgggaagcccagcccccugcuccugcaguacuccgugaaggagaagcgccgguga

SEQ ID NO: 34318 - RNA, 1035 nt, Artificial Sequence
  derived and/or modified sequence opt1 from PCGF2__Homo_sapiens__XP_005257698
augcaccgcaccacccggaucaagaucacggagcugaacccccaccucaugugcgcccugugcggcggguacuucaucgacgccaccaccaucguggagugccugcacagcuucugcaagaccugcaucguccgcuaccucgagacgaacaaguacugcccgaugugcgacguccaggugcacaagacccggccccugcuguccauccgcagcgacaagacccuccaggacaucguguacaagcuggugcccggccuguucaaggacgagaugaagcggcgccgggacuucuacgcggccuacccccucaccgaggugccgaacggguccaacgaggaccgcggcgagguccuggagcaggagaagggggcccugagcgacgacgagaucgugucccucagcaucgaguucuacgagggcgcccgggaccgcgacgagaagaagggcccccuggagaacggggacggcgacaaggagaagacgggggugcgguuccugcgcugccccgccgcgaugaccgucaugcaccucgccaaguuccugcggaacaagauggacgugcccuccaaguacaagguggagguccuguacgaggacgagccgcucaaggaguacuacacccugauggacaucgccuacaucuaccccuggcgccggaacggcccccugccccucaaguaccgcgugcagccggccugcaagcggcugacccuggcgacggugcccacccccagcgaggggaccaacaccuccggcgccagcgagugcgaguccgucagcgacaaggcccccuccccggccacgcuccccgccaccagcuccagccugcccucccccgcgaccccgagccacggcucccccagcagccacgggccgcccgccacccaccccacgucccccaccccgcccagcaccgccuccggcgccaccacggccgcgaacgggggcagccugaacugccuccagacccccuccagcaccucccgcggccggaagaugaccgugaacggggcccccgugcccccgcugacguga

SEQ ID NO: 34319 - RNA, 627 nt, Artificial Sequence
  derived and/or modified sequence opt1 from PCGF3__Homo_sapiens__XP_006713915
augaccgugugccgcagcugccuggucaaguaccucgaggagaacaacacgugcccgaccugccggaucgugauccaccagucccacccccugcaguacaucggccacgaccgcaccaugcaggacaucguguacaagcugguccccgggcuccaggaggccgagaugcggaagcagcgcgaguucuaccacaagcugggcauggaggugcccggggacaucaagggcgagaccugcagcgccaagcagcaccuggacucccaccggaacggggagaccaaggcggacgacagcuccaacaaggaggccgccgaggagaagcccgaggaggacaacgacuaccaccgcagcgacgagcaggucuccaucugccucgagugcaacagcuccaagcugcggggccugaagcgcaaguggauccggugcagcgcccaggccacggugcuccaccugaagaaguucaucgcgaagaagcugaaccucuccagcuucaacgagcuggacauccugugcaacgaggagauccucggcaaggaccacacccugaaguucgugguggucacccgcuggcgguucaagaaggccccgcugcuccugcacuaccgccccaagauggaccugcucuga

SEQ ID NO: 34320 - RNA, 1053 nt, Artificial Sequence
  derived and/or modified sequence opt1 from PCGF6__Homo_sapiens__NP_001011663
auggagggcguggccgucgugaccgccggguccgugggcgcggccaagaccgagggggccgccgcccugcccccgcccccgcccgucuccccgcccgcgcucacgcccgcccccgccgccggcgaggaggggccggcgccccugagcgagaccggcgcccccggcugcuccgggagccgcccgcccgagcuggagcccgagcggucccucggccgcuuccgggggcgcuucgaggacgaggacgaggagcuggaggaggaggaggagcuggaggaggaggaggaggaggaggaggaggacaugagccacuucucccuccggcuggagggcgggcgccaggacagcgaggacgaggaggagcggcugaucaaccucuccgagcugacccccuacauccugugcagcaucugcaagggcuaccucaucgacgccaccacgaucaccgagugccugcacaccuucugcaaguccugcaucgugcgccacuucuacuacagcaaccggugccccaagugcaacaucgugguccaccagacccagccccuguacaacauccgccucgaccggcagcugcaggacaucguguacaagcuggugaucaaccucgaggagcgcgagaagaagcagaugcacgacuucuacaaggagcggggccuggagguccccaagcccgccgugccccagccggugcccuccagcaaggggcgcuccaagaagguccuggagagcguguuccggaucccgcccgagcucgacaugucccugcugcucgaguucaucggcgccaacgaggggacgggccacuucaagccccuggagaagaaguucgugcgcgucagcggcgaggcgaccaucgggcacguggagaaguuccugcggcgcaagaugggccucgaccccgccugccagguggacaucaucugcggggaccaccuccuggagcaguaccagacccugcgggagauccgccgggccaucggcgacgccgccaugcaggacgggcugcugguccuccacuacggccugguggugagcccccugaagaucaccuga

SEQ ID NO: 34321 - RNA, 3537 nt, Artificial Sequence
  derived and/or modified sequence opt1 from PC__Homo_sapiens__XP_011543388
augcugaaguuccgcaccgugcacggcgggcuccggcugcugggcauccgccggaccagcacggcccccgccgcguccccgaacguccgccggcucgaguacaagcccaucaagaaggugaugguggccaaccgcggggagaucgccauccgggucuuccgcgccugcaccgagcugggcauccggaccguggccaucuacagcgagcaggacaccgggcagaugcaccgccagaaggcggacgaggccuaccugaucggccggggccucgcccccgugcaggccuaccugcacauccccgacaucaucaaggucgcgaaggagaacaacguggacgccgugcacccgggguacggcuuccuguccgagcgcgccgacuucgcccaggccugccaggacgcggggguccgguucaucggccccagccccgagguggugcgcaagaugggggacaaggucgaggcccgggccaucgccaucgccgcgggcgugcccguggucccgggcacggacgcccccaucaccucccuccacgaggcccacgaguucagcaacaccuacggguuccccaucaucuucaaggccgccuacggcgggggcggccgcgggaugcggguggugcacuccuacgaggagcuggaggagaacuacacccgcgcguacagcgaggcccuggccgccuucggcaacggggcccucuucgucgagaaguucaucgagaagccccggcacaucgaggugcagauccugggcgaccaguacgggaacauccugcaccucuacgagcgcgacugcuccauccagcggcgccaccagaagguggucgagaucgcgccggccgcccaccuggacccccagcugcgcacgcggcucaccagcgacuccgugaagcuggccaagcaggucggcuacgagaacgcgggcaccguggaguuccugguggaccgccacgggaagcacuacuucaucgaggucaacagccggcuccagguggagcacaccgugacggaggagaucaccgacgucgaccuggugcacgcccagauccacguggccgagggccgcucccugcccgaccucgggcugcggcaggagaacauccgcaucaacggcugcgccauccagugccgggucaccaccgaggaccccgcccgcagcuuccagccggacacggggcggaucgagguguuccgcuccggcgagggcauggggauccggcuggacaacgcgagcgccuuccagggcgccgugaucagcccccacuacgacucccuccuggucaaggugaucgcccacgggaaggaccaccccaccgccgcgaccaagaugucccgcgcccuggccgaguuccgggugcgcggcgucaagaccaacaucgccuuccuccagaacgugcugaacaaccagcaguuccuggccgggacgguggacacccaguucaucgacgagaaccccgagcuguuccagcuccggccggcgcagaaccgcgcccagaagcugcuccacuaccugggccacgucauggugaacggccccaccacccccauccccgugaaggccagcccgagccccacggaccccgucgugcccgccgugccgaucgggcccccgcccgcgggcuuccgggacauccugcuccgcgaggggcccgagggcuucgcccgggccguccgcaaccaccccggccugcugcucauggacaccaccuuccgcgacgcccaccagucccugcuggccacccgggugcgcacgcacgaccucaagaagaucgcgcccuacguggcccacaacuucagcaagcuguucuccauggagaacuggggcggggccaccuucgacgucgccaugcgguuccuguacgagugcccguggcgccggcuccaggagcugcgcgagcugauccccaacauccccuuccagaugcugcuccgcggggccaacgcggugggcuacaccaacuaccccgacaacguggucuucaaguucugcgagguggccaaggagaacgggauggacguguuccgggucuucgacagccugaacuaccugccgaacaugcuccugggcauggaggccgccggcuccgccgggggcgugguggaggcggccaucagcuacaccggggacgucgccgaccccucccggacgaaguacagccugcaguacuacaugggccucgccgaggagcuggugcgcgcggggacccacauccugugcaucaaggacauggccggccuccugaagcccaccgccugcaccaugcugguguccagccuccgggaccgcuuccccgaccugccgcugcacauccacacgcacgacaccuccggcgccggggucgccgcgaugcucgccugcgcccaggccggcgccgacgugguggacgucgcggccgacagcauguccgggaugaccagccagcccuccaugggcgcccugguggccugcacccgggggacgccccuggacaccgaggugcccauggagcgcgucuucgacuacagcgaguacugggagggcgcccggggccucuacgcggccuucgacugcaccgccaccaugaaguccgggaacagcgacguguacgagaacgagaucccgggcgggcaguacaccaaccugcacuuccaggcccacuccaugggccuggggagcaaguucaaggaggugaagaaggccuacgucgaggcgaaccagaugcucggcgaccugaucaaggugacgcccagcuccaagaucgugggcgaccuggcccaguucaugguccagaacgggcucagccgcgccgaggccgaggcgcaggccgaggagcuguccuucccccggagcgugguggaguuccugcagggcuacaucggggucccccacggcggcuucccggagcccuuccgcuccaaggugcucaaggaccugccccgggucgaggggcgccccggcgccagccugccgccccucgaccugcaggcccuggagaaggagcucguggaccggcacggggaggaggugacccccgaggacguccuguccgccgcgauguacccggacguguucgcccacuucaaggacuucaccgccaccuucggcccccuggacagccucaacacgcgccuguuccugcaggggcccaagaucgccgaggaguucgagguggagcucgagcgcggcaagacccugcacaucaaggcccuggcggucuccgaccucaaccgggccggccagcgccagguguucuucgagcugaacgggcagcugcggagcauccucgugaaggacacccaggccaugaaggagaugcacuuccaccccaaggcccugaaggacgucaagggccagaucggggccccgaugcccggcaaggugaucgacaucaagguggucgcgggggccaagguggccaagggccagccccugugcgugcucuccgccaugaagauggagaccgucgugacgagccccauggagggcaccgugcgcaagguccacgugaccaaggacaugacccuggagggggacgaccugauccucgagaucgaguga

SEQ ID NO: 34322 - RNA, 1200 nt, Artificial Sequence
  derived and/or modified sequence opt1 from PCID2__Homo_sapiens__NP_001120675
auggcccacaucaccaucaaccaguaccugcagcaggucuacgaggccaucgacagccgcgacggcgcguccugcgccgagcucgugagcuucaagcacccccacguggccaacccccggcugcagauggccucccccgaggagaagugccagcagguccuggagccgcccuacgacgagauguucgccgcgcaccuccgcugcaccuacgccguggggaaccacgacuucaucgaggccuacaagugccagacggugaucgugcagagcuuccugcgggccuuccaggcgcacaaggaggagaacugggcccugcccgucauguacgccguggcccucgaccugcgcguguucgccaacaacgcggaccagcagcuggucaagaagggcaaguccaaggugggggacaugcucgagaaggccgccgagcugcugaugagcugcuuccgggugugcgccuccgacacccgcgccggcaucgaggacagcaagaagugggggaugcuguuccucgucaaccagcuguucaagaucuacuucaagaucaacaagcuccaccugugcaagccccugauccgggcgaucgacuccagcaaccucaaggacgacuacuccaccgcccagcgcgugaccuacaaguacuacgugggccggaaggccauguucgacagcgacuucaagcaggccgaggaguaccuguccuucgccuucgagcacugccaccgcagcucccagaagaacaagcggaugauccugaucuaccuccugcccgucaagaugcugcucggccacaugcccacgguggagcugcugaagaaguaccaccucaugcaguucgcggaggugacccgcgccgucagcgaggggaaccugcugcuccugcacgaggcccuggccaagcacgaggccuucuucauccggugcggcaucuuccucauccuggagaagcugaagaucaucaccuaccgcaaccucuucaagaagguguaccugcugcucaagacccaccagcugucccuggacgcguuccucguggcccugaaguucaugcaggucgaggacguggacaucgacgaggugcagugcauccuggccaaccucaucuacauggggcacgucaagggcuacaucagccaccagcaccagaagcugguggucuccaagcagaacccguucccgccccugagcacggugugcuga

SEQ ID NO: 34323 - RNA, 1869 nt, Artificial Sequence
  derived and/or modified sequence opt1 from PCK1__Homo_sapiens__NP_002582
augcccccgcagcugcagaacggccucaaccugagcgccaaggugguccaggggucccuggacagccucccccaggccgugcgcgaguuccuggagaacaacgcggagcugugccagcccgaccacauccacaucugcgacggcuccgaggaggagaacgggcggcuccugggccagauggaggaggaggggauccugcgccggcucaagaaguacgacaacugcuggcuggcccugaccgacccccgcgacguggcccggaucgagagcaagaccgucaucgugacgcaggagcagcgcgacaccgugccgauccccaagaccggccucucccagcugggccgguggaugagcgaggaggacuucgagaaggccuucaacgcccgcuuccccgggugcaugaagggccggaccauguacgucauccccuucuccauggggccgcugggcagcccccucuccaagaucgggaucgagcugacggacagccccuacgugguggcguccaugcgcaucaugacccggaugggcacccccguccuggaggccgugggcgacggggaguucgugaagugccuccacagcgucggcugcccgcugccccugcagaagccccucgugaacaacuggcccugcaacccggagcugacccugaucgcccaccuccccgaccgccgggagaucaucuccuucgggagcggcuacggcgggaacucccugcugggcaagaagugcuucgcccuccgcauggcgagccggcuggccaaggaggagggguggcuggccgagcacaugcucauccugggcaucacgaaccccgagggggagaagaaguaccuggccgccgcguuccccuccgccugcggcaagaccaaccucgccaugaugaacccgagccugcccggcuggaagguggagugcgucggggacgacaucgccuggaugaaguucgacgcccagggccaccuccgcgcgaucaaccccgagaacggguucuucggcguggcccccgggaccuccgugaagaccaacccgaacgccaucaagacgauccagaagaacaccaucuucaccaacgucgccgagaccagcgacggcggcguguacugggaggggaucgacgagccccucgccagcggcgugacgaucaccuccuggaagaacaaggaguggagcuccgaggacggggagcccugcgcgcaccccaacagccgguucugcaccccggccucccagugccccaucaucgacgccgccugggagagccccgagggcgucccgaucgaggggaucaucuucggcggccgccggcccgccggggugccccugguguacgaggcgcuguccuggcagcacggcgucuucgugggggccgccaugcgcagcgaggccaccgcggccgccgagcacaagggcaagaucaucaugcacgaccccuucgccaugcggccguucuucggcuacaacuucgggaaguaccucgcccacuggcuguccauggcgcagcaccccgccgccaagcugcccaagaucuuccacgucaacugguuccgcaaggacaaggagggcaaguuccucuggcccggguucggcgagaacagccgcgugcuggaguggauguucaaccggaucgacgggaaggccuccacgaagcugaccccgaucggcuacauccccaaggaggacgcccucaaccugaagggccuggggcacaucaacaugauggagcuguucagcaucuccaaggaguucugggagaaggagguggaggacaucgagaaguaccuggaggaccaggucaacgcggaccugcccugcgagaucgagcgcgagauccuggcccucaagcagcggaucagccagauguga

SEQ ID NO: 34324 - RNA, 1326 nt, Artificial Sequence
  derived and/or modified sequence opt1 from PCK2__Homo_sapiens__NP_001018083
auggccgcccuguaccgccccggccuccggcugaacuggcacgggcugagcccccucggcuggcccuccugccgcagcauccagacccugcgggugcuguccggggaccucggccagcugcccaccgggauccgcgacuucgucgagcacagcgcgcggcugugccagcccgagggcauccacaucugcgacggcacggaggccgagaacaccgccacccucacccugcuggagcagcaggggcucauccgcaagcugccgaaguacaacaacugcuggcuggcccggacggaccccaaggacguggcccgcguggaguccaagaccgucaucgugacccccagccagcgggacaccgugccccucccgcccggcggggcgcgcggccagcuggggaacuggaugucccccgccgacuuccagcgggccgucgacgagcgcuuccccggcugcaugcagggccggacgauguacgugcugccguucagcauggggcccgugggcagcccccucucccgcaucgggguccagcugaccgacuccgccuacgugguggcgagcaugcggaucaugacccgccugggcacccccguccuccaggcccugggcgacggggacuucgugaagugccugcacuccgugggccagccgcucacggggcagggcgagcccgucagccaguggcccugcaaccccgagaagacccugaucgggcacgugccggaccagcgggagaucaucuccuucggcagcggcuacgggggcaacucccugcucgggaagaagugcuucgcccugcgcaucgccagccggcuggcccgcgacgagggcuggcucgcggagcacaugcugauccuggggaucaccucccccgccggcaagaagcgguacguggccgccgccuuccccagcgcgugcggcaagaccaaccucgccaugaugcgccccgcccugccgggguggaaggucgagugcgugggcgacgacaucgccuggaugcgcuucgacagcgaggggcggcugcgcgccaucaaccccgagaacggcuucuucgggguggcgcccggcacguccgccaccaccaaccccaacgccauggccaccauccagagcaacacgaucuucaccaacgucgccgagaccuccgacggcgggguguacugggagggcaucgaccagccgcucccgcccggggugaccgucacgagcuggcugggcaagcccuggaagcccggcaugugcgggggcgaggggguggcgcagccgcccggccuguccacccucauggucgagaagcugagcccccagccgcccaccaucuucuga

SEQ ID NO: 34325 - RNA, 14808 nt, Artificial Sequence
  derived and/or modified sequence opt1 from PCLO__Homo_sapiens__NP_055325
augggcaacgaggccagccuggagggggagggccuccccgaggggcuggccgcggccgccgccgccggcgggggcgcguccggcgccgggagcccgucccacaccgccauccccgccggcauggaggcggaccugagccagcucuccgaggaggagcgccggcagaucgccgccgugaugagccgcgcccaggggcugcccaagggcuccguccccccggccgcggccgagagccccuccaugcaccggaagcaggagcuggacagcucccacccccccaagcagagcgggcgcccgcccgaccccggccggcccgcccagccgggccucuccaagagccgcaccacggacaccuuccgguccgagcagaagcugcccgggcgcagccccuccaccaucagccugaaggaguccaagagccggaccgaccucaaggaggagcacaagagcuccaugaugcccggcuuccugagcgaggugaacgcccuguccgccgugagcuccgucgugaacaaguucaacccguucgaccucaucagcgacuccgaggcgagccaggaggagacgaccaagaagcagaaggugguccagaaggagcaggggaagcccgagggcaucaucaagcccccccugcagcagcagccgcccaagcccauccccaagcagcagggcccggggcgcgacccccugcagcaggacggcacccccaaguccaucagcucccagcagcccgagaagaucaagagccagccgcccgggaccggcaagcccauccaggggccgacgcagaccccccagaccgaccacgccaagcucccccugcagcgggacgccucccgcccccagaccaagcaggccgacaucgugcggggcgagagcgugaagccgucccugcccagccccuccaagcccccgauccagcagcccacgcccggcaagcccccggcccagcagcccgggcacgagaagagccagcccggccccgcgaagccgcccgcccagcccuccgggcucaccaagccccuggcccagcagccgggcaccgucaagccccccgugcagcccccggggaccacgaagccccccgcccagccgcugggccccgccaagccccccgcgcagcagaccggcagcgagaagccgagcuccgagcagcccgggcccaaggcccucgcccagcccccgggcguggggaagacccccgcccagcagcccggccccgcgaagccgcccacccagcaggucgggacgcccaagccccuggcccagcagccgggccugcagagccccgccaaggcccccggccccaccaagaccccggugcagcagcccgggcccggcaagauccccgcccagcaggcggggccgggcaagaccuccgcccagcagacgggccccaccaagccccccagccagcucccggggcccgccaagcccccgccccagcagcccggccccgccaagccgcccccccagcagcccggguccgccaagccgcccagccagcagcccggcuccaccaagcccccgccccagcagcccgggcccgcgaagccgagcccccagcagcccggcuccaccaagcccccgagccagcagcccggcuccgccaagcccagcgcccagcagcccuccccggccaagcccagcgcccagcaguccacgaagcccgugagccagaccggguccggcaagccccugcagccgcccaccgucagccccagcgcgaagcagccgcccucccaggggcugcccaagaccaucugcccccucugcaacacgaccgagcugcugcuccacgugccggagaaggccaacuucaacaccugcaccgagugccagacgaccgugugcagccugugcggcuucaaccccaacccccaccugaccgaggucaaggaguggcucugccugaacugccagaugaagcgcgcccuggggggcgaccucgcccccgugccguccagcccccagcccaagcugaagaccgcgcccgugaccacgaccuccgccgucagcaaguccagcccgcagccccagcagaccucccccaagaaggacgccgcccccaagcaggaccugagcaaggccccggagcccaagaagccccccccgcucgugaagcagcccacccugcacggcucccccagcgcgaaggccaagcagcccccggaggccgacucccugagcaagcccgcccccccgaaggagcccuccgugcccagcgagcaggacaaggcccccgucgcggacgacaagccgaagcagcccaagauggugaagcccacgaccgaccucgucuccagcuccagcgccaccaccaagcccgacaucccgagcuccaaggugcagagccaggccgaggagaagacgacccccccccugaagaccgacuccgccaagcccagccaguccuucccgcccaccggggagaaggugagccccuucgacuccaaggccaucccccggccggcgagcgacuccaagaucaucagccaccccggccccuccagcgaguccaaggggcagaagcaggucgaccccgugcagaagaaggaggagccgaagaaggcccagacgaagaugagccccaagcccgacgccaagcccaugccgaagggcucccccaccccccccgggccgcgccccaccgccggccagaccgugcccacgccgcagcagagccccaagccccaggagcagucccggcgcuucagccugaaccucggcuccaucaccgacgcgcccaagagccagccgaccaccccccaggagacggucaccgggaagcuguucggcuucggggccagcaucuucucccaggccagcaaccugaucuccaccgccggccagcccgggccccacagccaguccggcccgggcgcccccaugaagcaggcgcccgcccccagccagccgcccaccucccaggggccccccaagagcacgggccaggccccgcccgcccccgccaaguccauccccgugaagaaggagaccaaggcgccggccgccgagaagcucgagcccaaggccgagcaggcccccaccgugaagcggaccgagacggagaagaagcccccgcccaucaaggacagcaagucccugaccgcggagccccagaaggccguccugcccaccaagcuggagaagagcccgaagcccgaguccaccugcccccucugcaagacggagcugaacaucgggagcaaggacccgcccaacuucaacaccugcaccgagugcaagaaccaggugugcaaccugugcggcuucaaccccaccccccaccucacggagauccaggaguggcugugccugaacugccagacccagcgcgccaucuccggccagcucggggacauccggaagaugccgcccgcccccagcggccccaaggccuccccgaugcccgugcccaccgagagcuccagccagaagaccgcgguccccccgcaggugaagcuggugaagaagcaggagcaggaggucaagaccgaggccgagaaggugauccuggagaaggugaaggagacgcucagcauggagaagaucccccccauggucaccaccgaccagaagcaggaggaguccaagcuggagaaggacaaggccagcgcccugcaggagaagaagccccucccggaggagaagaagcugauccccgaggaggagaagauccgcuccgaggagaagaagccccugcucgaggagaagaagcccaccccggaggacaagaagcugcugcccgaggcgaagacgagcgcccccgaggagcagaagcacgaccuccugaagucccaggugcagaucgccgaggagaagcuggaggggcgcguggcccccaagaccguccaggagggcaagcagccgcagaccaagauggaggggcuccccagcggcaccccccagucccugcccaaggaggacgacaagacgaccaagaccaucaaggagcagccgcagccccccugcaccgccaagccggaccagguggagcccggcaaggagaagacggagaaggaggacgacaagagcgacaccuccagcucccagcagcccaagagcccccaggggcuguccgacaccggcuacagcuccgacgggaucagcuccagccucggcgagaucccgucccugauccccaccgacgagaaggacauccugaaggggcucaagaaggacagcuucagccaggaguccagccccuccagccccuccgaccuggcgaagcuggagagcacggugcucuccauccuggaggcccaggccagcacccuggccgacgagaaguccgagaagaagacccagccgcacgaggucagccccgagcagcccaaggaccaggagaagacccagucccucagcgagacgcuggagaucaccaucuccgaggaggagaucaaggagagccaggaggagcggaaggacaccuucaagaaggacucccagcaggacauccccagcuccaaggaccacaaggagaagagcgaguucguggacgacaucaccacgcgccgggagccguacgacuccguggaggagagcagcgaguccgagaacagccccgucccccagcgcaagcggcgcaccuccgugggcagcuccagcuccgacgaguacaagcaggaggacagccagggcuccggggaggaggaggacuucauccggaagcagaucaucgagaugagcgccgacgaggacgcguccggcagcgaggacgacgaguucauccgcaaccagcugaaggagaucuccagcuccaccgagagccagaagaaggaggagaccaaggggaagggcaagaucacggccgggaagcaccggcgccucacccggaaguccagcaccagcaucgacgaggacgccggccgccggcacuccuggcacgacgaggacgacgaggccuucgacgagagccccgagcugaaguaccgcgagaccaagucccaggagagcgaggagcugguggucacgggcgggggcgggcuccggcgcuucaagaccaucgagcugaacuccaccaucgccgacaaguacagcgcggaguccagccagaagaagaccucccuguacuucgacgaggagccggagcucgagauggagagccugacggacucccccgaggaccggagccgcggcgagggcuccagcucccugcacgccagcuccuucacccccgggaccagccccaccuccgugagcagccucgacgaggacuccgacagcuccccgagccacaagaagggcgaguccaagcagcagcggaaggcccgccaccgcccccacgggccccugcugcccaccaucgaggacagcuccgaggaggaggagcuccgggaggaggaggagcugcugaaggagcaggagaagcagcgcgagaucgagcagcagcagcggaagagcuccagcaagaaguccaagaaggacaaggacgagcuccgcgcccagcggcgccgggagcgcccgaagacgccccccagcaaccuguccccgaucgaggacgcgagccccaccgaggagcugcggcaggccgccgagauggaggagcuccaccgcuccagcugcuccgaguacagccccuccaucgagagcgaccccgagggcuucgagaucagcccggagaagaucaucgaggugcagaaggucuacaagcugcccaccgccgugucccuguacagccccaccgacgagcaguccaucaugcagaaggaggggagccagaaggcccucaaguccgcggaggagauguacgaggagaugaugcacaagacgcacaaguacaaggccuuccccgccgccaacgagcgggacgagguguucgagaaggagccgcuguacggcggcaugcugaucgaggacuacaucuacgagagccucgucgaggacaccuacaacggguccguggacggcagccugcugacccgccaggaggaggagaacggguucaugcagcagaagggccgggagcagaagauccgccucuccgagcagaucuacgaggaccccaugcagaagaucaccgaccugcagaaggaguucuacgagcuggagagccuccacuccguggucccccaggaggacaucgugagcuccagcuucaucauccccgagucccacgagaucguggaccuggggacgauggucaccagcaccgaggaggagcggaagcugcucgacgccgacgcggccuacgaggagcugaugaagcgccagcagaugcagcugaccccgggcuccagccccacgcaggcccccaucggcgaggacaugaccgaguccaccauggacuucgaccggaugcccgacgccagccucaccagcuccgugcugagcggggccucccugacggacagcaccuccagcgcgacccucuccaucccggacgugaagaucacccagcacuucagcacggaggagaucgaggacgaguacgucaccgacuacacccgcgagauccaggagaucaucgcccacgagucccugauccugaccuacagcgagcccuccgagagcgccacguccgugccccccagcgacaccccgucccucaccagcuccgugagcuccgucugcaccacggacagcagcucccccaucaccacccuggacagcaucaccacgguguacaccgagcccguggacaugaucaccaaguucgaggacuccgaggagaucagcuccagcaccuacuuccccggcuccaucaucgacuacccggaggagaucagcgucucccuggaccggacggccccccccgacgggcgcgcgagcgccgaccacaucgugaucucccucagcgacauggccuccagcaucaucgaguccgucgugcccaagccggagggccccguggccgacaccgucagcaccgaccugcugaucuccgagaaggaccccgugaagaaggccaagaaggagaccgggaacggcaucauccucgaggugcuggaggcguaccgggacaagaaggagcuggaggccgagcgcacgaagagcucccucagcgagaccgucuucgaccacccgcccagcuccgugaucgcccugcccaugaaggagcagcugagcaccaccuacuucaccuccggcgagacguucgggcaggagaagcccgccagccagcucccguccggcagccccuccgugagcucccugcccgccaagccccgcccguucuuccggagcuccagccuggacaucuccgcgcagcccccccccccgcccccccccccgcccccccccccgcccccccccccgcccccccccccgcccccccucccgccccccaccagccccaagccgaccauccugcccaagaagaagcugaccgucgccucccccgugacgaccgccaccccccuguucgacgccgugaccacgcucgagaccaccgccguccugcgcagcaacgggcugccggugacccggaucugcacgaccgcgcccccccccgugccgcccaagcccuccagcauccccagcggccucgucuucacccaccgcccggagcccuccaagccccccaucgccccgaagcccgugaucccccagcugcccaccacgacccagaagccgaccgacauccaccccaagcccaccgggcugagccucacguccagcaugacccugaaccuggugaccuccgccgacuacaagcucccgagccccaccuccccccugagcccccacuccaacaagagcuccccgcgguucagcaagucccugacggagaccuacgucgugaucacccuccccagcgagcccggcacccccacggacuccagcgccucccaggccaucaccagcuggccgcugggcucccccagcaaggaccuggugagcgucgagcccguguucuccgugguccccccggugaccgcgguggagauccccaucagcuccgagcagaccuucuacaucagcggggcccuccagacguucuccgccacccccgucaccgcccccagcuccuuccaggcggccccgaccagcgugacgcaguuccugaccaccgagguguccaagaccgaggucagcgccacccgcuccacggcccccagcgugggccuguccagcaucuccaucaccaucccccccgagccgcucgcccuggacaacauccaccuggagaagccccaguacaaggaggacgggaagcuccagcuggugggcgacgucaucgaccugcggaccgugcccaagguggaggucaagaccacggacaagugcaucgaccucagcgcguccaccauggacgugaagcgccagaucaccgccaacgagguguacggcaagcagaucagcgccguccagcccuccaucaucaaccugagcgugaccagcuccaucgugacgccggucagccuggccaccgagaccgugaccuucgugacgugcaccgccuccgcgagcuacaccaccgggacggagucccucgucggcgccgagcacgccaugaccaccccccugcagcugaccacgagcaagcacgccgagccccccuaccggaucccguccgaccagguguuccccaucgcccgcgaggaggcgcccaucaaccucagccuggggaccccggcccacgccgugacccuggccaucaccaagcccgucacggugccccccgugggcgucaccaacggguggaccgacuccaccgugagccagggcaucacggacggcgaggucguggaccucuccaccaccaagagccaccggaccguggucacgauggacgaguccaccagcuccgugaugaccaagaucaucgaggacgagaagccgguggaccugaccgcggggcgccgggccgucugcugcgacgugguguacaagcugcccuucggccgcagcugcacggcccagcagcccgccaccacccuccccgaggaccgguucggguaccgcgacgaccacuaccaguacgaccgguccggcccguacggguaccgcggcaucggcgggaugaagcccagcauguccgacaccaaccuggccgaggcgggccacuucuucuacaagagcaagaacgccuucgacuacagcgaggggaccgacacggccgucgaccugaccuccggccgggugaccaccggggaggugauggacuacagcuccaagacgaccggccccuaccccgagacccgccaggucaucagcggcgccgggaucuccaccccgcaguacagcacggcccgcaugacccccccccccggcccgcaguacugcgugggguccgugcuccggagcuccaacggcgucguguacagcuccguggcgacccccacccccagcacguucgccaucaccacccagcccggguccaucuucagcaccacgguccgcgaccuguccggcauccacaccgccgacgccgugaccagccugccggccaugcaccacucccagcccaugccccggagcuacuucaucaccacgggcgcguccgagaccgacaucgccgugaccgggaucgacaucagcgccagccuccagaccaucacgauggagucccugaccgccgagaccaucgacagcguccccacccugacgaccgcguccgagguguucccggagguggucggcgacgagagcgcccuccugaucgugcccgaggaggacaagcagcagcagcagcuggaccucgagcgcgagcugcuggagcucgagaagaucaagcagcagcgguucgccgaggagcuggagugggagcgccaggagauccagcgguuccgcgagcaggagaagaucauggugcagaagaagcuggaggagcuccaguccaugaagcagcaccugcuguuccagcaggaggaggagcggcaggcccaguucaugaugcgccaggagacccucgcccagcagcagcugcagcuggagcagauccagcagcuccagcagcagcugcaccagcagcuggaggagcagaagauccggcagaucuaccaguacaacuacgaccccagcgggaccgcguccccccagacgaccaccgagcaggccauccucgagggccaguacgccgcccuggagggcagccaguucugggccaccgaggacgcgacgaccaccgccuccgccgucguggccaucgagaucccgcagagccaggggugguacaccgugcaguccgacggcgucacccaguacaucgccccccccgggauccugagcacgguguccgagaucccgcucaccgacguggucgugaaggaggagaagcagcccaagaagcgcagcuccggcgcgaaggugcgggggcaguacgacgacaugggcgagaacaugaccgacgacccccgcagcuucaagaagaucgucgacuccggcgugcagaccgacgacgaggacgccacggaccggagcuacgugucccgccggcgccggaccaagaagagcgucgacaccagcgugcagaccgacgacgaggaccaggacgagugggacaugcccacgcgcucccggcgcaaggcccgcguggggaaguacggcgacagcaugaccgaggccgacaagaccaagccgcuguccaaggucagcuccaucgccgugcagaccguggcggagaucagcguccagacggagcccguggggaccauccggacccccuccauccgcgcccggguggacgccaaggucgagaucaucaagcacaucagcgcccccgagaagaccuacaagggcgggucccugggcugccagacggaggcggacagcgacacccaguccccgcaguaccucagcgccaccuccccccccaaggacaagaagcgccccaccccgcuggagaucggcuacagcucccaccugcgggccgacagcacggugcagcucgcccccuccccccccaagagcccgaaggugcuguacagccccaucuccccccugagccccgggaaggcccucgaguccgcguucgucccguacgagaagccccugcccgacgacaucagcccccagaaggugcugcacccggacauggccaaggucccccccgccuccccgaagaccgccaagaugaugcagcgcagcauguccgaccccaagccccucagccccaccgccgacgaguccagccgggcgccguuccaguacaccgagggcuacacgaccaaggggucccagaccaugaccagcuccggcgcccagaagaaggugaagcgcacgcugcccaacccccccccggaggagaucagcaccgggacccaguccaccuucagcacgaugggcaccgugucccggcgccggaucugccgcaccaacaccauggcccgggccaagauccugcaggacaucgaccgcgagcucgaccuggucgagcgggagagcgccaagcugcgcaagaagcaggcggagcucgacgaggaggagaaggagaucgacgccaagcugcgguaccuggagaugggcaucaaccgccggaaggaggcccuccugaaggagcgcgagaagcgcgagcgggccuaccugcaggggguggcggaggaccgcgacuacauguccgacagcgaggugagcuccacgcggcccacccgcaucgagagccagcacggcaucgagcggccccgcaccgccccccagaccgaguucucccaguucaucccgccccagacccagacggagagccagcucgucccccccaccuccccguacacccaguaccaguacagcucccccgcccugcccacccaggcccccacgagcuacacccagcagucccacuucgagcagcagacccuguaccaccagcaggugagcccguaccagacccagcccacguuccaggccguggcgaccauguccuucaccccccagguccagcccaccccgacgccccagcccagcuaccagcuccccucccagaugauggugauccagcagaagccgcggcagaccacccuguaccuggagcccaagaucaccagcaacuacgaggugauccgcaaccagccccucaugaucgccccggucuccacggacaacaccuucgccgugagccaccugggguccaaguacaacagccuggaccuccggaucggccuggaggagcgcuccagcauggccagcucccccaucagcuccaucagcgccgacuccuucuacgcggacaucgaccaccacaccccccggaacuacgugcugaucgacgacaucggcgagaucaccaaggggacggccgcccugagcaccgccuucucccuccacgagaaggaccugagcaagaccgaccgccugcuccggaccacggagacccgccggucccaggaggucaccgacuuccuggccccccugcagagcuccagccgccuccacuccuacgugaaggcggaggaggacccgauggaggaccccuacgagcugaagcugcucaagcaccagaucaagcaggaguuccggcgcggcaccgagagccuggaccaccuggccgggcucucccacuacuaccacgccgacacgagcuaccggcacuuccccaaguccgagaaguacagcaucucccgccugacccuggagaagcaggccgccaagcagcuccccgcggccauccuguaccagaagcagagcaagcacaagaagagccugaucgacccgaagauguccaaguucagccccauccaggagucccgggaccucgagcccgacuacagcuccuacaugaccagcuccaccagcuccaucggcgggaucagcucccgcgcccgccugcugcaggacgacaucacguucggccuccggaagaacaucaccgaccagcagaaguucaugggcagcucccuggggaccggccuggggacccucggcaacacgauccgcagcgcccugcaggacgaggcggacaagcccuacuccagcgggucccggagccgcccguccagccggcccagcuccguguacggccuggaccucagcaucaagcgcgacuccagcuccagcucccugcggcugaaggcccaggaggccgaggcccucgacgucagcuucucccacgccagcuccagcgcgcgcaccaagcccaccucccugcccaucagccagucccggggccgcaucccgaucguggcccagaacagcgaggaggaguccccccugagccccguggggcagcccaugggcauggcccgggccgccgcggggccgcucccccccaucuccgccgacacccgcgaccaguucggcagcagccacucccugcccgagguccagcagcacaugcgggaggagagccgcacgcggggguacgaccgcgacaucgccuucaucauggacgacuuccagcacgccauguccgacagcgaggccuaccaccugcggcgcgaggagaccgacugguucgacaagccgcgggagucccgccucgagaacggccacggccuggaccgcaagcugcccgagcggcucgugcacagccgcccccugucccagcaccaggagcagaucauccagaugaacgggaagaccaugcacuacaucuucccccacgcgcggaucaagaucacccgcgacagcaaggaccacaccguguccggcaacgggcugggcauccggaucgucgggggcaaggagaucccgggccacagcggggagaucggcgccuacaucgccaagauccuccccgggggcuccgccgagcagacgggcaagcugauggaggggaugcaggugcuggaguggaacggcaucccccucaccagcaagaccuacgaggaggugcaguccaucaucagccagcaguccggggaggcggagaucugcguccgccuggaccugaacaugcucagcgacuccgagaacagccagcaccuggagcugcacgagccgcccaaggccguggacaaggccaagagccccggcguggaccccaagcagcucgccgccgagcugcagaaggucucccugcagcagagcccgcucgugcuguccagcguggucgagaaggggucccacgugcacagcggccccaccuccgcgggcagcuccagcgugcccucccccgggcagccgggcagccccuccgucagcaagaagaagcacggguccagcaagcccacggacggcaccaagguggugucccaccccaucaccggggagauccagcugcagaucaacuacgaccucggcaaccugaucauccacauccugcaggcccggaaccucgucccgcgcgacaacaacggcuacagcgaccccuucgugaagguguaccugcugcccgggcggggccaggucaugguggugcagaacgccuccgccgaguacaagcgccggaccaagcacguccagaagagccucaaccccgaguggaaccagacggugaucuacaagagcaucuccauggagcagcugaagaagaagacccuggaggugaccgucugggacuacgaccgcuucagcuccaacgacuuccucggggaggugcugaucgaccugagcuccaccagccaccucgacaacacgccgcggugguacccccugaaggagcagaccgaguccaucgaccacggcaagagccacuccagccaguccagccagcagucccccaagcccagcgugaucaagucccgcagccacgggaucuucccggaccccuccaaggacaugcagguccccaccaucgagaagagccacuccagccccggcagcuccaagagcuccagcgagggccaccugcggucccacgggccgagccgcucccagagcaagaccuccgugacgcagacccaccucgaggacgccggcgcggccaucgccgccgccgaggcggccguccagcagcugcggauccagcccagcaagcgccggaaguga

SEQ ID NO: 34326 - RNA, 6075 nt, Artificial Sequence
  derived and/or modified sequence opt1 from PCM1__Homo_sapiens__NP_006188
auggccaccgggggcgggcccuucgaggacgggaugaacgaccaggaccuccccaacugguccaacgagaacguggacgaccggcucaacaacauggacuggggcgcccagcagaagaaggcgaaccgguccagcgagaagaacaagaagaaguucggggucgaguccgacaagcgcgugaccaacgacaucagccccgaguccagccccggcgugggccggcgccggaccaagacgccccacaccuucccgcacucccgcuacaugagccagauguccguccccgagcaggccgagcucgagaagcugaagcagcggaucaacuucagcgaccucgaccagcgcuccaucgggagcgacucccagggccgggccaccgccgccaacaacaagcgccagcugagcgagaaccggaagcccuucaacuuccugcccaugcagaucaacaccaacaaguccaaggacgcgagcaccuccccgcccaaccgcgagaccaucgggagcgcccagugcaaggagcuguucgccuccgcccugagcaacgaccugcuccagaacugccaggugagcgaggaggacggccgcggggagcccgcgauggaguccagccagaucgugucccgccugguccagauccgggacuacaucaccaaggccagcuccaugcgcgaggaccugguggagaagaacgagcggagcgccaacguggagcgccucacgcaccugaucgaccaccugaaggagcaggagaaguccuacaugaaguuccucaagaagauccuggcccgggacccccagcaggagccgauggaggagaucgagaaccugaagaagcagcacgaccuccugaagcgcaugcugcagcagcaggagcagcuccgggcccugcagggccgccaggcggcccugcucgcccugcagcacaaggccgagcaggccaucgcggucauggacgacagcgugguggccgagaccgccggcucccugagcggggucuccaucaccagcgagcucaacgaggagcugaacgaccugauccagcgcuuccacaaccagcuccgggacucccagccgcccgccgugcccgacaaccgccggcaggccgagagccugucccugacccgcgaggugagccagucccggaagccgagcgcguccgagcgccuccccgacgagaaggucgagcuguucagcaagaugcgggugcugcaggagaagaagcagaagauggacaagcuccugggcgagcugcacacccuccgcgaccagcaccugaacaacagcuccagcagcccccagcggagcguggaccagcgcuccaccagcgcccccuccgccagcgucgggcuggccccgguggugaacggcgaguccaacagccucaccuccagcguccccuaccccaccgccucccuggugagccagaacgaguccgagaacgagggccaccugaaccccagcgagaagcuccagaagcugaacgaggugcggaagcgccugaacgagcuccgggagcugguccacuacuacgagcagacguccgacaugaugaccgacgcggugaacgagaaccgcaaggacgaggagaccgaggagagcgaguacgacagcgagcacgagaacuccgagccggucaccaacauccggaacccccagguggccagcacguggaacgaggugaacucccacagcaacgcccagugcgucuccaacaaccgcgacgggcggaccgugaacagcaacugcgagaucaacaaccgcuccgccgcgaacauccgggcccugaacaugccgcccagccuggacugccgcuacaaccgcgagggcgagcaggagauccacguggcccagggggaggacgacgaggaggaggaggaggaggccgaggaggagggcgucuccggggccagccucuccagccaccgguccagccugguggacgagcacccggaggacgcggaguucgagcagaagaucaaccgccugauggccgccaagcagaagcuccggcagcugcaggaccugguggccaugguccaggacgacgacgccgcgcagggcgugaucuccgccagcgccuccaaccucgacgacuucuaccccgccgaggaggacaccaagcagaacagcaacaacacccgcggcaacgccaacaagacgcagaaggacaccggggugaacgagaaggcgcgggagaaguucuacgaggccaagcugcagcagcagcagcgcgagcugaagcagcuccaggaggagcggaagaagcugaucgacauccaggagaagauccaggcccugcagaccgccugccccgaccuccagcuguccgcggccagcgucggcaacugcccgaccaagaaguacaugcccgccgugacgagcacccccaccgugaaccagcacgagaccuccacgagcaaguccgucuucgagcccgaggacagcuccaucguggacaacgagcuguggagcgagaugcgccggcacgagaugcuccgcgaggagcugcggcagcgccggaagcagcuggaggcccucauggccgagcaccagcgccggcaggggcuggcggagaccgccuccccgguggccgucagccugcgcuccgacggcagcgagaaccucugcacgccccagcagucccggaccgagaagacgauggccaccuggggcggcagcacccagugcgcccuggacgaggagggcgacgaggacggguaccuguccgagggcaucgugcgcaccgacgaggaggaggaggaggagcaggacgcgagcuccaacgacaacuucagcgugugccccuccaacagcgucaaccacaacuccuacaacgggaaggagaccaagaaccgguggaagaacaacugccccuucagcgccgacgagaacuaccgcccgcucgccaagacgcggcagcagaacaucagcaugcagcgccaggagaaccugcgcuggguguccgagcugagcuacguggaggagaaggagcaguggcaggagcagaucaaccagcucaagaagcagcuggacuucuccgucagcaucugccagacccugaugcaggaccagcagacccucuccugccugcugcagacccuccugacgggccccuacagcgugaugcccuccaacguggccagcccccagguccacuucaucaugcaccagcugaaccagugcuacacccagcucaccuggcagcagaacaacgugcagcggcugaagcagaugcugaacgagcucaugcgccagcagaaccagcacccggagaagcccgggggcaaggagcggggcuccagcgccucccacccgcccagcccgucccuguucugccccuucagcuuccccacccagcccgugaaccuguucaacaucccgggguucacgaacuucuccagcuucgcgcccggcaugaacuucagcccccucuuccccagcaacuucggggacuucucccagaacaucagcaccccgagcgagcagcagcagccccuggcccagaacuccagcggcaagaccgaguacauggccuuccccaagccguucgaguccagcuccagcaucggcgccgagaagccccgcaacaagaagcugcccgaggaggaggucgaguccagccggacccccuggcucuacgagcaggagggggagguggagaagccguucaucaagacgggcuucuccgugagcgucgagaaguccaccagcuccaaccgcaagaaccagcuggacaccaacgggcggcgccggcaguucgacgaggagagccuggaguccuucagcuccaugcccgaccccguggaccccaccacggugaccaagaccuucaagacccgcaaggcgagcgcccaggccucccucgccagcaaggacaagacgcccaagagcaaguccaagaagcggaacagcacccagcugaagucccgcgucaagaacauccgguacgagagcgccuccaugagcagcacgugcgagcccugcaagagccgcaaccggcacuccgcgcagaccgaggagcccgugcaggccaagguguucagccgcaagaaccacgagcagcuggagaagaucaucaagugcaaccgguccaccgagaucagcuccgagaccggcagcgacuucuccauguucgaggcccuccgcgacaccaucuacagcgaggucgccacccugaucucccagaacgagagccggccccacuuccugaucgagcuguuccacgagcugcagcugcucaacacggacuaccugcgccagcgcgcccuguacgcgcuccaggacaucgugucccggcacaucagcgagagccacgagaagggggagaacgugaaguccgucaacagcggcaccuggaucgccuccaacagcgagcugaccccguccgagagccuggccaccacggacgacgagaccuucgagaagaacuucgagcgcgagacccacaagaucuccgagcagaacgacgccgacaacgccagcgugcucuccgugagcuccaacuucgagcccuucgcgaccgacgaccugggcaacacggucauccaccuggaccaggcccucgcccggaugcgcgaguacgagcggaugaagaccgaggccgagagcaacuccaacaugcgcugcacgugccggaucaucgaggacggggacggcgccggggcgggcaccaccgugaacaaccuggaggagacgcccgugaucgagaaccgcagcucccagcagcccgucagcgagguguccaccaucccgugcccccggaucgacacccagcagcuggaccgccagaucaaggccaucaugaaggaggugauccccuuccucaaggagcacauggacgaggucugcagcagccagcugcugaccuccgugcggcgcaugguccucacgcugacccagcagaacgacgagagcaaggaguucgugaaguucuuccacaagcagcugggguccauccuccaggacagccuggccaaguucgccggccggaagcugaaggacugcggcgaggaccuccugguggagaucuccgagguccuguucaacgagcucgcguucuucaagcugaugcaggaccuggacaacaacagcaucaccgugaagcagcgcugcaagcggaagaucgaggccaccggggugauccaguccugcgccaaggaggccaagcgcauccucgaggaccacggcagccccgccggggagaucgacgacgaggacaaggacaaggacgagacggagaccgucaagcagacccagaccuccgagguguacgacggcccgaagaacgugcggagcgacaucuccgaccaggaggaggacgaggagagcgaggggugccccgucuccaucaaccugagcaaggcggagacgcaggcccugaccaacuacggcuccggcgaggacgagaacgaggacgaggagauggaggaguucgaggaggggcccguggacgugcagaccagccuccaggccaacaccgaggccacggaggagaacgagcacgacgagcagguccugcagcgcgacuucaagaagaccgccgaguccaagaacgugccccuggagcgggaggcgaccagcaagaacgaccagaacaacugcccggugaagcccugcuaccucaacauccuggaggacgagcagccccugaacuccgccgcccacaaggaguccccgcccaccgucgacagcacgcagcagcccaacccccucccccugcgccugcccgagauggagccccuggugccccgggugaaggaggucaaguccgcccaggagaccccggagagcucccucgccggcagccccgacaccgagucccccgugcuggugaacgacuacgaggcggagagcgggaacaucucccagaaguccgacgaggaggacuucgucaagguggaggaccugccccucaagcugaccaucuacuccgaggccgaccugcgcaagaagaugguggaggaggagcagaagaaccaccucagcggcgagaucugcgagaugcagacggaggagcuggccgggaacuccgagacccugaaggagccggagaccgucggcgcccagagcaucuga

SEQ ID NO: 34327 - RNA, 861 nt, Artificial Sequence
  derived and/or modified sequence opt1 from PCMT1__Homo_sapiens__NP_001238978
augcccggcgcccgcagcgggggcuccgggggcgacgggagcaacuccggcagcuacuccggcgacgccagcggggcggugaccgucugggagguggugucccugcucggcaagcugcuggggaccgucguggcccucaaggugguccuguaccugcuccgggugugccuggccauggccuggaaguccggcggggccagccacagcgagcugauccacaaccuccgcaagaacggcaucaucaagacggacaagguguucgaggucaugcuggcgaccgaccggucccacuacgccaagugcaacccguacauggacagcccccaguccaucggcuuccaggccaccaucagcgcgccccacaugcacgccuacgcccuggagcuccuguucgaccagcugcacgagggggccaaggcccucgacgugggcuccgggagcggcauccugaccgccugcuucgcgcgcauggugggcugcacggggaaggucaucggcaucgaccacaucaaggagcugguggacgacuccgugaacaacguccggaaggacgaccccacccuccugagcuccgggcgcgugcagcugguggucggcgacgggcggaugggcuacgccgaggaggccccguacgacgccauccacgugggcgccgcggcccccguggucccccaggcccucaucgaccagcugaagcccgggggccgccugauccucccgguggggcccgccggcgggaaccagaugcuggagcaguacgacaagcugcaggacggcagcaucaagaugaagccccucaugggcgugaucuacgucccccugaccgacaaggagaagcaguggagccgggacgagcuguga

SEQ ID NO: 34328 - RNA, 846 nt, Artificial Sequence
  derived and/or modified sequence opt1 from PCMTD1__Homo_sapiens__NP_001273711
augcccggcccgcgccggcugcgcagccccgggggcuccgggugcagcucccggggcagcgggccccgccucuccacccggcgcuggcggcccugcugcuacugcggcggcagcgggguguggcugcugcgcaccccgcccucccccagcgccuggcccgcccggcgcugcccgcggcaccgcuucgaguucugcgagcccgcguucgucgugggcaacugccuccagaucgccuccgacagccaccaguacgaccggaucuacugcggggccggcgugcagaaggaccacgagaacuacaugaagauccugcugaaggucgggggcauccucgugaugcccaucgaggaccagcugacgcagaucaugcgcaccggccagaacaccugggaguccaagaacauccuggccgugagcuucgcgccccucguccagccguccaagaacgacaacgggaagcccgacagcgugggccugccgcccugcgccgugcggaaccugcaggaccucgcccgcaucuacauccggcgcacccugcggaacuucaucaacgacgagaugcaggccaaggggaucccccagcgcgccccgcccaagcggaagcgcaagcgcgucaagcagcggaucaacacguacguguucgugggcaaccagcugaucccccagccccucgacuccgaggaggacgagaagauggaggaggacaacaaggaggaggaggagaaggaccacaacgaggcgaugaagcccgaggagccgccccagaaccugcugcgcgagaagaucaugaagcucccccugcccgagagccugaaggccuaccucaccuacuuccgggacaaguga

SEQ ID NO: 34329 - RNA, 786 nt, Artificial Sequence
  derived and/or modified sequence opt1 from PCNA__Homo_sapiens__NP_872590
auguucgaggcccgccuggugcagggcagcauccucaagaagguccuggaggcccugaaggaccucaucaacgaggcgugcugggacaucuccagcuccggggugaaccugcagagcauggacuccagccacgugucccugguccagcucacccugcggagcgagggcuucgacaccuaccgcugcgaccggaaccuggccaugggggugaaccucacguccaugagcaagauccugaagugcgccggcaacgaggacaucaucacccugcgcgccgaggacaacgccgacacccucgcgcugguguucgaggcccccaaccaggagaaggucuccgacuacgagaugaagcugauggaccucgacguggagcagcuggggaucccggagcaggaguacagcugcguggucaagaugcccuccggcgaguucgcccggaucugccgcgaccugagccacaucggcgacgccguggugaucuccugcgcgaaggacggggucaaguucagcgccuccggcgagcucgggaacggcaacaucaagcugagccagaccuccaacguggacaaggaggaggaggccgugacgaucgagaugaacgagcccguccagcugaccuucgcccuccgguaccugaacuucuucaccaaggccacgccccugagcagcaccgugacccucuccaugagcgcggacgugccgcuggucguggaguacaagaucgccgacauggggcaccugaaguacuaccucgcccccaagaucgaggacgaggagggcuccuga

SEQ ID NO: 34330 - RNA, 10011 nt, Artificial Sequence
  derived and/or modified sequence opt1 from PCNT__Homo_sapiens__NP_006022
auggagguggagcaggagcagcgccggcgcaagguggaggccggccggaccaagcuggcccacuuccgccagcggaagaccaagggggacagcagccacagcgagaagaagaccgccaagcgcaagggcuccgccguggacgccagcgugcaggaggagucccccgugaccaaggaggacagcgcccugugcgggggcggggacaucugcaaguccaccagcugcgacgacacccccgacggcgccggcggggccuucgccgcccagcccgaggacugcgacggcgagaagcgggaggaccuggagcagcugcagcagaagcaggucaacgaccacccgcccgagcagugcgggauguucacgguguccgaccacccgcccgagcagcacggcauguucaccgucggggaccacccgcccgagcagcgcggcauguucaccgugagcgaccacccgcccgagcagcacggcauguucaccguguccgaccacccgcccgagcagcgggggauguucacgaucagcgaccaccagcccgagcagcgcggcauguucaccgucuccgaccacacccccgagcagcgggggaucuucaccaucagcgaccaccccgccgagcagcgcggcauguucacgaaggagugcgagcaggagugcgagcuggccaucaccgaccuggaguccggccgggaggacgaggccgggcugcaccagagccaggccgugcacggccuggagcuggaggcccugcgccugucccugagcaacaugcacaccgcccagcuggagcugacccaggcgaaccugcagaaggagaaggagacggcccugaccgagcugcgggagaugcugaacucccgccgggcccaggagcuggcccugcugcagagccgccagcagcacgagcuggagcugcugcgggagcagcacgcccgcgagaaggaggaggugguccugcggugcgggcaggaggcggccgagcucaaggagaagcugcagagcgagauggagaagaacgcccagaucgugaagacccugaaggaggacugggaguccgagaaggaccugugccuggagaaccugcgcaaggagcugagcgccaagcaccaguccgagauggaggaccugcagaaccaguuccagaaggagcuggccgagcagcgcgcggagcuggagaagaucuuccaggacaagaaccaggccgagcgggcccugcgcaaccuggagagccaccaccaggccgccaucgagaagcuccgggaggaccugcaguccgagcacggccgcugccuggaggaccuggaguucaaguucaaggagagcgagaaggagaagcagcuggagcuggagaaccuccaggcguccuacgaggaccugaaggcccagagccaggaggagauccggcgccuguggucccagcucgacagcgcccggaccucccgccaggagcugagcgagcugcacgagcagcuccuggcccggacgucccgcguggaggaccuggagcagcugaagcagcgggagaagacccagcacgagagcgagcucgagcagcugcgcaucuacuucgagaagaagcugcgggacgcggagaagaccuaccaggaggaccucacccugcugcagcagcgccuccagggggcccgggaggacgcccugcuggacuccgucgaggugggccucagcugcgugggccuggaggagaagcccgagaaggggcgcaaggaccacgucgacgagcuggagcccgagcggcacaaggagucccucccccgcuuccaggccgagcuggaggagagccaccggcaccagcuggaggcccucgagagcccccugugcauccagcacgagggccacgugagcgaccgcugcugcguggagacgagcgcgcuggggcacgaguggcgccucgagcccuccgagggccacagccaggagcugcccuggguccaccuccagggggugcaggacggcgaccucgaggccgacaccgagcgggccgcccgcgugcugggccuggagaccgagcacaagguccagcucucccugcugcagaccgagcucaaggaggagaucgagcugcugaagaucgagaaccggaaccucuacgggaagcugcagcacgagacgcgccugaaggacgaccucgagaaggugaagcacaaccugaucgaggaccaccagaaggagcugaacaacgccaagcagaagaccgagcucaugaagcaggaguuccagcggaaggagaccgacuggaaggucaugaaggaggagcugcagcgcgaggcggaggagaagcugacccucaugcugcuggagcuccgggagaaggccgagagcgagaagcagacgaucaucaacaaguucgagcugcgcgaggccgagaugcggcagcugcaggaccagcaggccgcccagauccucgaccuggagcgcucccugaccgagcagcagggccggcuccagcagcuggagcaggaccugaccagcgacgacgcgcuccacugcucccagugcgggcgcgagccgcccaccgcccaggacggcgagcuggccgcccugcacgugaaggaggacugcgcgcuccagcugaugcuggcccggagccgcuuccucgaggagcggaaggagaucacggagaaguucuccgccgagcaggacgccuuccugcaggaggcccaggagcagcacgcgcgcgagcugcagcuccugcaggagcggcaccagcagcagcugcucagcgugaccgccgagcuggaggcccgccaccaggccgcccugggggagcucaccgcgucccuggagagcaagcagggcgcccugcucgccgcccgggucgccgagcugcagaccaagcacgcggccgaccugggcgcccucgagacccgccaccuguccagccuggacucccucgagagcugcuaccuguccgaguuccagacgauccgggaggagcaccgccaggcccuggagcuccugcgcgcggacuucgaggagcagcuguggaagaaggacagccuccaccagaccauccugacccaggagcuggagaagcucaagcggaagcacgagggggagcugcagagcgugcgcgaccaccuccggaccgagguguccacggagcucgccggcaccgucgcccacgagcugcagggggugcaccagggcgaguucggcagcgagaagaagaccgcccugcacgagaaggaggagacccuccgccugcaguccgcccaggcgcagcccuuccaccaggaggagaaggagagccugucccuccagcugcagaagaagaaccaccaggugcagcagcugaaggaccagguccugagccucucccacgagaucgaggagugccggagcgagcuggaggugcugcagcagcgccgggagcgcgagaaccgggagggggccaaccuccuguccaugcugaaggccgacgugaaccucagccacuccgagcgcggcgcccugcaggacgcccugcggcgccuccuggggcuguucggcgagacgcuccgggcggccgucacccugcgcagccggaucggggagcgcgugggccugugccucgacgacgccggcgccgggcuggcccuguccaccgcgcccgcccucgaggagaccuggagcgacguggcccugcccgagcuggaccggacgcucuccgagugcgccgagaugagcuccgucgccgagaucagcucccacaugcgcgagagcuuccugaugagccccgaguccgugcgggagugcgagcagcccauccgccgcguguuccagagccugucccucgcggucgacggccugauggagauggcccuggacagcucccggcagcucgaggaggcccgccagauccacagccgguucgagaaggaguucuccuucaagaacgaggagaccgcccagguggugcgcaagcaccaggagcugcuggagugccucaaggaggagagcgcggccaaggccgagcuggcccuggagcuccacaagacccaggggacccuggagggcuucaaggucgagacggccgaccugaaggaggugcucgcggggaaggaggacuccgagcaccggcuggugcuggagcucgagagccugcgccggcagcugcagcaggccgcccaggagcaggccgcccuccgcgaggagugcacccggcuguggucccgcggcgaggcgaccgccaccgacgccgaggcccgggaggccgcgcugcgcaaggaggucgaggaccucacgaaggagcagagcgagacccggaagcaggccgagaaggaccgcuccgcccugcugagccagaugaagauccucgaguccgagcuggaggagcagcugagccagcaccggggcugcgccaagcaggcggaggccgugaccgcccucgagcagcaggucgccucccuggacaagcaccuccggaaccagcggcaguucauggacgagcaggccgcggagcgcgagcacgagcgggaggaguuccagcaggagauccagcgccucgaggggcagcugcggcaggccgccaagccgcagcccuggggcccccgcgacagccagcaggccccgcuggacggggaggucgagcuccugcagcagaagcugcgcgagaagcucgacgaguucaacgagcuggccauccagaaggaguccgcggaccgccaggugcugaugcaggaggaggagaucaagcgccucgaggagaugaacaucaacauccggaagaagguggcccagcugcaggaggaggucgagaagcagaagaacaucgugaagggccuggagcaggacaaggaggugcucaagaagcagcagaugagcagccugcugcucgccuccacccugcagagcacgcuggacgccgggcgcugccccgagccgcccuccggcagcccgcccgagggccccgagauccagcucgaggucacccagcgggcccugcugcgccgggaguccgaggugcucgaccugaaggagcagcuggagaagaugaagggggaccucgagagcaagaacgaggagauccugcaccugaaccucaagcuggacaugcagaacucccagaccgcggugagccugcgcgagcucgaggaggagaacaccucccugaaggucaucuacacgcggagcuccgagaucgaggagcugaaggccaccaucgagaaccuccaggagaaccagaagcgccugcagaaggagaaggccgaggagaucgagcagcugcacgaggugaucgagaagcuccagcacgagcugagccugaugggccccgugguccacgagguguccgacagccaggccgggucccuccagagcgagcugcugugcucccaggcgggcgggccgcggggccaggcccuccagggcgagcuggaggccgcccuggaggccaaggaggcgcucagccgccugcuggccgaccaggagcggcgccacucccaggcccuggaggcccuccagcagcggcugcagggggccgaggaggcggccgagcugcagcucgccgagcuggagcgcaacguggcccugcgggaggccgaggucgaggacauggcgagccgcauccaggaguucgaggccgcccucaaggccaaggaggccaccaucgcggagcggaaccuggagaucgacgcccugaaccagcgcaaggccgcccacagcgcggagcucgaggccgugcugcuggcccucgcccgcauccggcgcgcccuggagcagcagccccuggcggccggcgccgcgccgcccgagcuccaguggcugcgggcccagugcgcgcgccugucccggcagcuccaggugcugcaccagcgcuuccugcggugccaggucgagcucgaccgccggcaggcccgccgggccaccgcccacacgcgcgugccgggggcccacccccagccccggauggacggcggcgcgaaggcccaggugaccggggacgucgaggccagccacgacgccgcgcuggagcccguggugccggacccccagggcgaccugcagcccguccucgugacccugaaggacgcgccccugugcaagcaggagggggucauguccgugcucaccgugugccagcgccagcugcagagcgagcugcuccuggucaagaacgagaugcggcugucccucgaggacggcgggaagggcaaggagaaggugcuggaggacugccagcugccgaagguggaccucgucgcccaggugaagcagcugcaggagaagcugaaccgccuccuguacagcaugacguuccagaacguggacgccgccgacaccaagucccuguggcccauggcgagcgcccaccuccuggaguccagcugguccgacgacagcugcgacggcgaggagcccgacaucagcccccacaucgacacgugcgacgccaacaccgccaccgggggcgucacggacgugaucaagaaccaggccaucgacgcgugcgacgccaacaccacccccgggggcgugaccgacgucaucaagaacugggacagccugauccccgacgagaugcccgacuccccgauccaggagaaguccgagugccaggacaugucccucagcucccccacgagcgugcucgggggcagccggcaccagucccacaccgccgaggccggcccccgcaagagccccguggggaugcuggaccucuccagcugguccagcccggagguccugcggaaggacuggacccuggagcccuggcccucccuccccgugaccccgcacagcggcgcccugucccugugcagcgcggacacgucccucggggaccgcgccgacaccagccugccccagacccagggccccgggcugcucugcucccccggcgugagcgccgccgcgcuggcccugcagugggccgaguccccgcccgccgacgaccaccacguccagcggaccgccguggagaaggacguggaggacuucaucacgaccagcuucgacucccaggagacccucagcagcccgccgcccggccuggaggggaaggcggaccgcagcgagaaguccgacggcuccggguucggcgcccgccugagccccggcuccgggggccccgaggcccagaccgccgggcccgucacgcccgccagcaucuccggccgguuccagccccuccccgaggcgaugaaggagaaggaggugcgccccaagcacgugaaggcccugcugcagaugguccgggacgagagccaccagauccucgcccuguccgaggggcuggccccgcccagcggcgagccccacccgccccgcaaggaggacgagauccaggacaucucccuccacggcgggaagacccaggaggugcccaccgccugccccgacuggcggggcgaccugcuccaggugguccaggaggcguucgagaaggagcaggagaugcaggggguggagcuccagccccgccugagcggcuccgaccucgggggccacagcucccuccuggagcggcuggagaagaucauccgcgagcagggcgaccuccaggagaagucccuggagcaccuccggcuccccgaccgcuccagccugcuguccgagauccaggcccuccgggcccagcugcgcaugacccaccuccagaaccaggagaagcugcagcaccuccggacggcccugaccagcgccgaggcgcgcgggagccagcaggagcaccagcuccggcgccagguggagcugcuggccuacaaggucgagcaggagaagugcaucgccggcgaccuccagaagacccuguccgaggagcaggagaaggccaacagcgugcagaagcugcucgcggccgagcagaccgugguccgggaccugaaguccgaccugugcgagagccgccagaaguccgagcagcugagccggucccucugcgaggugcagcaggaggugcugcagcugcgcagcaugcucuccagcaaggagaacgagcugaaggccgcccugcaggagcucgaguccgagcaggggaagggccgcgcccugcagagccagcuggaggaggagcagcuccggcaccuccagcgcgagucccagagcgcgaaggcccuggaggagcuccgggccucccuggagacgcagcgcgcccagagcucccggcugugcgucgcccucaagcacgagcagaccgcgaaggacaaccugcagaaggagcugcgcaucgagcacagccggugcgaggcccuccuggcccaggagcgcucccagcugagcgagcuccagaaggaccuggccgccgagaagucccggacccuggagcucuccgaggcgcugcgccacgagcggcugcucaccgagcagcugagccagcgcacgcaggaggccugcgugcaccaggacacccaggcccaccacgcccugcuccagaagcugaaggaggagaagucccggguggucgaccugcaggcgaugcucgagaaggugcagcagcaggcccugcacagccagcagcagcuggaggccgaggcccagaagcacugcgaggcccuccgccgggagaaggagguguccgcgacccugaaguccaccgucgaggcccugcacacgcagaagcgcgagcuccggugcucccuggagcgcgagcgggagaagcccgccuggcugcaggccgagcucgagcagagccacccccgccugaaggagcaggaggggcggaaggccgcgcgccgcuccgccgaggcccggcagagcccggccgccgcggagcaguggcgcaaguggcagcgggacaaggagaagcugcgcgagcucgagcugcagcggcagcgcgaccugcacaagaucaagcagcuccagcagaccgugcgggaccuggaguccaaggacgaggugcccggcagccgccugcaccucggcuccgcccggcgcgccgccgggagcgacgccgaccaccuccgggagcagcagcgcgagcuggaggcgaugcggcagcgccuccuguccgccgcccggcugcucaccagcuucaccucccaggccgucgaccgcacggugaacgacuggaccagcuccaacgagaaggcggugaugagccugcugcacacccucgaggagcucaagagcgaccugucccggcccaccagcucccagaagaagauggccgccgagcuccaguuccaguucgucgacgugcugcugaaggacaacgugagccucaccaaggcccuguccacggucacccaggagaagcuggagcucagccgcgccguguccaagcuggagaagcugcucaagcaccaccuccagaagggcugcagccccucccggagcgagcgcuccgcguggaagccggacgagaccgcgccccagagcucccugcgccggcccgaccccgggcgccucccgcccgccgccagcgaggaggcccacaccuccaacgucaagauggagaagcuguaccugcacuaccuccgggcggagagcuuccgcaaggcccugaucuaccagaagaaguaccugcuccugcugaucggcggguuccaggacuccgagcaggagacgcucagcaugaucgcccaccugggcguguuccccuccaaggccgagcggaagaucaccagccgccccuucacccgguuccgcaccgccgugcgggucgugaucgcgauccugcgccuccgguuccuggugaagaaguggcaggaggucgaccgcaagggcgcccuggcccaggggaaggccccgcggcccggcccccgcgcgcggcagccccagagcccgccccgcacgcgggagagcccgcccacccgcgacgugccgagcgggcacacccgggaccccgcccgcggccggcgccucgccgccgccgcgagcccccacagcggcgggcgcgccacccccuccccgaacagccggcuggagcgcucccugacggccagccaggaccccgagcacucccucaccgaguacauccaccaccuggaggugauccagcagcggcugggcgggguccugcccgacagcaccuccaagaaguccugccacccgaugaucaagcaguga

SEQ ID NO: 34331 - RNA, 6414 nt, Artificial Sequence
  derived and/or modified sequence opt1 from PCNXL2__Homo_sapiens__NP_055616
auggugucccaggugcugcagcugcugcgccagggcgugugggccgcccugaccgggggcugguaccacgaccccgagcaguccaaguucaccaacagcugccaccuguaccuguggcuguuccuccugcugcucccccuggcgcugcaccucgccuucccgcccaacgccaucaucguguucuucuacugcuccgccgucaccaucuucuucaccaucaucaagcuggugagcuaccggcugcaccucauguucgacaagggggaggugauccagcagaagcccucccgcaaggaggagaagcccaacaaggacaaggaggccaagggcgagcacaucaccaaccaccggaaccccagcaacaaccgccagauccacaacgggaagaaggaggaggcgucccggaaccugagcacgccgccccuccgcugcuccagccggggccaguccaucacgagccaccacuccagcggcccgcucgagcuguccgcccaggagaccgucgaggaccugaagggggugauccuccuggaggaccaccccaucgcccccgugagcuccaccagccccggcaucaaggucgagucccugcccgccagccaggcgcacaugcucgagaccaccaccaagagcgugauccccgugaagcccgucgccaccgagacccugaucaacgggaagggcaaggagcgcgggggcaagggccagccgccccugcggcaccgcuccgagggcgggcucguggacaaggggccccugaagaagcugccccaccucagccugucccaguacgaccugcucgagaccgacgugagcuuccagcccuggggcuccgagaacagcguccugauccccgagcccguguccugcccccggggcagcauccgcgagcgggugcaguccaagagcccccaggacucccugagcuccagcugcccccagugcgacaccaucgucgccaagcccguggaggagcccgccgacaccuccugccagguggacaccagcugccagggggaccucccccugcaccaggaggucgacuccagcgacuccgagguggccgugacgcugaucgacaccagccagccgggcgacccccucagccugcacgagcccaucaagaucgucaucaccauguccagcaccccgaacuccaugacggaccuggagagcucccuccaccuccgcguggucgggaccgagaagaccagcgugaaguccgacgcggagcccaccaaccccggcgccgccgggagccccaacgccgagcagaucuccaucccggugaucacgcuggaccuccccgagggcggcgggggcgggguccccugccccgagggcaacgggagcgagcggaccccggagcgccugaagacccggguguccaccaaccagugcagcggcuacggcuccggggagggcgggaacgccaucaaggaccacagcuccagcucccgcgagcccugggagagcgugagccggcugacgcccgacaccggcuccgagagcaaggucgggaaggagggccagaccaaccucgaccccuccagcugcaaguccagccacgagaagcgccacgcgcgggugcuguccguggacagcggcaccgacgucuuccuguccaagagcuccgccgagaucgugaacgacacggagaagaccaugccgaccagcaaguccgaccuggaggccaaggaggggcagaugcccaacgagagcaacuuccucgaguucgugucccugcuggagagcaucaacaccuccaagaugacggccagcucccagcucaacggcagcgccgagcagaacgaggagagcgggcugcugcgcgacaacugcucccaggagaagaaggaggagauccucgagaacgagaagcccagcggccacuccagcaagcagggcaagcccgaccugcagucccaggaccacaccagcaccgggccggcgugcacccagcccgccaagaccacggccuucuuccagggcaaccgccagcggcagaucaucuaccgcgucaccucccagcaggacagcuccgugcuccaggugaucagcgggcccgagaccuccguccaggaggagaucagcguggacgccaugcacguguucaucgacgagcacggcgagauccgguccugcuaccucaagagcgggaaccagaaggagggcccccugcagccgcugcccuccaacaacgacugccucagccaggcccgcgagaugcaggucuccagcuccagcaccacgaccagcgagucccaggaccccagcuccggcgaccccgcggugagcgcccugcagcagcagcugcuccugaugguggcccggcgcacccaguccgagaccccgcggcacgucagccaggaccuggaggccuccagcugcuccagcacgcaggggaaguucaaccgcgagcaguucuacaaguucaucaucuuccccggcaaguggaucaaggugugguacgaccggcucacccugcuggcgcuccuggaccgcaccgaggacaucaaggagaacgugcuggccauccuccugaucguccuggugucccuccugggguuccugacccucagccagggcuucugcaaggacaugugggugcugcuguucugccucgucauggccuccugccaguacagccugcugaaguccgugcagcccgacccggccagccccauccacgggcacaaccagaucaucacguacucccggcccaucuacuucugcgugcucugcggccugauccugcuccuggacaccggcgccaaggcgcgccacccgcccagcuacgucguguacgggcugaagcuguucucccccguguuccugcagagcgcccgggacuaccugaucgucuuccucuacugcuuccccgccaucagccugcugggccucuucccccagaucaacaccuucugcaccuaccugcuggagcagaucgacaugcuguucuucgggggcuccgccgugagcgggaucacguccgccguguacagcgucgcgcgcuccgugcuggccgccgcccugcuccacgccgugugcuucagcgcggucaaggagcccugguccaugcagcacauccccgcccuguucagcgccuucugcggccugcucguggcccuguccuaccaccugagccggcaguccagcgaccccuccgugcucaugagcuucauccagugccgccuguuccccaaguuccugcaccagaaccucgcggaguccgccgccgacccgcugcccaagaagaugaaggacagcgucaccgacgugcugaagugggaccucaucgugugcgccgucguggccgugcuguccuucgcggucagcgccuccaccguguuccugagccuccggcccuuccugagcaucgugcuguucgcccucgccggcgccgucggguucgugacccacuacguccugccccagcugcgcaagcaccacccguggauguggaucucccaccccauccucaagaacaaggaguaccaccagcgggaggugcgcgacguggcgcaccugaugugguucgagcgccuguacgucuggcuccagugcuucgagaaguacauccuguaccccgcccugauccucaacgcccugacgaucgacgccuuccugaucagcaaccaccggcgccucggcacccacugggacaucuuccugaugaucaucgccgggaugaagcugcuccggaccuccuucugcaaccccguguaccaguucaucaaccugagcuucaccgugaucuucuuccacuucgacuacaaggacaucuccgagagcuuccugcucgacuucuucauggucuccauccuguucagcaagcugggcgaccuccugcacaagcugcaguucgugcugacguacguggcgccguggcagauggccuggggguccagcuuccacgucuucgcccagcuguucgccaucccccacuccgcgaugcuguucuuccagaccaucgccaccagcaucuucuccacgccccugagccccuuccucggcuccgugaucuucaucacgagcuacgugcgcccggucaaguucugggagaagaacuacaacacccggcgcguggacaacuccaacacccggcuggccgugcagaucgagcgcgaccccggcaacgacgacaacaaccugaacagcaucuucuacgagcaccucacccggacgcugcaggagucccugugcggggaccucguccugggccgcugggggaacuacagcagcggcgacugcuucauccuggccuccgacgaccucaacgccuucgugcaccugaucgagaucggcaacgggcuggugaccuuccagcuccggggccuggaguuccgcgggaccuacugccagcagcgggaggucgaggcgaucauggagggcgacgaggaggaccgcgggugcugcugcugcaagcccggccaccucccccaccuccugagcugcaacgccgccuuccaccuccgguggcucaccugggagaucacgcagacccaguacauccuggagggcuacuccauccuggacaacaacgccgccaccaugcuccagguguucgaccugcgccggauccugauccgcuacuacaucaagagcaucaucuacuacauggugaccuccccgaagcuccugagcuggaucaagaacgagucccugcucaagagccugcagcccuucgcgaaguggcacuacaucgagcgggaccuggccauguucaacaucaacaucgacgacgacuacguccccugccuccaggggaucacccgcgccuccuucugcaacguguaccuggaguggauccagcacugcgcccggaagcgccaggagccgagcacgacccuggacuccgacgaggacagcccccucgugacccuguccuucgcccugugcacccucggccgccgggcgcuggggacggccgcccacaacauggccaucagccuggacuccuuccucuacggccugcacguccuguucaagggggacuuccgcaucaccgcccgggacgaguggguguucgcggacauggaccuccugcacaagguggucgcccccgccauccgcaugagccugaagcuccaccaggaccaguucacgugccccgacgaguacgaggacccggccgugcuguacgaggcgauccaguccuucgagaagaagguggucaucugccacgagggcgaccccgccuggcggggcgccgugcugagcaacaaggaggagcuccugacccugcgccacguggucgacgagggggccgacgaguacaaggugaucaugcuccaccggagcuuccuguccuucaaggugaucaaggucaacaaggagugcgugcgcggccugugggccgggcagcagcaggagcucaucuuccugcggaaccgcaaccccgagcggggcagcauccagaacaacaagcagguccugcgcaaccucaucaacuccagcugcgaccagccccugggguacccgauguacgucagcccccugacgaccagcuaccucggcacccaccggcagcugaagaacaucuggggcgggcccaucacccuggaccgcauccggacgugguucuggaccaagugggugcgcaugcggaaggacugcaacgcgcgccagcacuccggcgggaacaucgaggacguggacggcggcggggcccccaccaccggcgggaacaacgccccgagcggcgggucccaggagagcuccgccgagcagccccggaagggcggcgcccagcacggggucagcuccugcgagggcacgcagcgcaccgggcgccggaagggccgcagccaguccgugcaggcgcacagcgcccucucccagcggccgcccaugcugagcuccagcgggccgauccuggagagccgccagaccuuccuccagaccuccacgagcgugcacgagcuggcccagcggcuguccggcagccgccucucccugcacgccagcgccaccucccugcacagccagccgccgcccgucaccaccacgggccaccucuccgugcgggagcgcgcggaggcccugauccggagcucccuggggagcuccaccagcuccacccucagcuuccuguucggcaagcgcuccuucagcuccgcccuggugaucagcgggcucagcgccgcggagggcgggaacaccuccgacacgcagagcuccagcuccgucaacaucgugaugggcccgagcgcccgggccgccucccaggccacccgccaccugagcgagcccugcgagccgcccgacgcgaccgagcagggccagcugcacgaccggugccucgccgaggccguggccgacacccugggggucgugugccgccgggccucccaggaggacaugggccuggacgacacggcgagccagcaguccgucagcgacgagcaguga

SEQ ID NO: 34332 - RNA, 2817 nt, Artificial Sequence
  derived and/or modified sequence opt1 from PCNXL4__Homo_sapiens__NP_071940
augcccgcccuggagcacaugaaccagauccuccacauccuguucguguuccugccguuccucugggcccugggcacccugcccccgcccgacgcgcuccugcugugggccauggagcagguccucgaguucgggcugggcgggagcuccaugagcacccaccuccgccuccuggugauguucaucauguccgccggcacggccaucgccagcuacuucauccccuccaccgugggggucgugcuguucaugaccggcuucggcuuccuccugagccugaaccucuccgacauggggcacaagaucggcaccaagagcaaggaccugcccuccgggcccgagaagcacuucagcuggaaggagugccuguucuacaucaucauccucgugcuggcgcugcucgagacgucccugcugcaccacuucgccggcuucagccagaucuccaagagcaacucccaggccaucgucggguacggccucaugauccugcugaucauccucuggauccugcgggagauccagagcguguacaucaucggcaucuuccgcaaccccuucuacccgaaggacgugcagaccgucaccguguucuucgagaagcagacccggcugaugaagaucgggaucgugcgccggauccuccugacgcuggucucccccuucgccaugaucgcguuccucagccuggacuccagccugcagggccuccacagcguguccgugugcaucggguucacccgcgccuuccggauggucuggcagaacaccgagaacgcccugcuggagaccgugaucgugagcacgguccaccucaucuccagcaccgacaucugguggaaccgcucccuggacaccggccugcggcuccugcuggugggcaucauccgcgaccggcucauccaguucaucagcaagcugcaguucgccgugaccguccugcugacguccuggaccgagaagaagcagcgccggaagaccaccgccacgcucugcauccugaacaucguguucagccccuucgugcuggucaucaucguguucuccacccuccugagcagcccccugcucccgcuguucacccugcccgucuuccucgugggguucccccgccccauccaguccuggccgggcgcggccgggaccacggccugcgugugcgccgacaccgucuacuacuaccagauggugccccggcugaccgccgugcugcagaccgcgauggccgccggcucccucgggcugcugcuccccggcagccacuaccugggccgcuuccaggaccggcugauguggaucaugauccucgagugcggguacacguacugcuccaucaacaucaagggccuggagcugcaggagaccagcugccacaccgccgaggcccgccgggucgacgagguguucgaggacgcguucgagcaggaguacacccgcgugugcucccucaacgagcacuucgggaacguccugacgcccugcaccgugcugccggugaagcucuacagcgacgcccggaacguccuguccggcaucaucgacagccacgagaaccugaaggaguucaagggggaccucaucaaggugcugguguggauccugguccaguacugcagcaagcgccccggcaugaaggagaacgugcacaacaccgagaacaagggcaaggcgccccucaugcugcccgcccugaacacccucccgccgcccaagucccccgaggacaucgacagccugaacuccgagacguucaacgacuggagcgacgacaacaucuucgacgacgagcccaccaucaagaaggugaucgaggagaagcaccagcugaaggaccuccccgggaccaaccuguucauccccggcuccgucgagagccagcgcgugggggaccacuccaccggcaccgugccggagaacgaccuguacaaggccguccuccugggguaccccgccguggacaagggcaagcaggaggacaugcccuacaucccccugauggaguucagcugcucccacagccaccucgugugccugccggccgaguggcggacguccugcaugcccagcuccaagaugaaggagaugagcucccuguuccccgaggacugguaccaguucguccuccgccagcuggagugcuaccacagcgaggagaaggccuccaacgugcuggaggagaucgccaaggacaaggugcucaaggacuucuacguccacaccgugaugaccugcuacuucagccuguucggcaucgacaacauggcgcccagcccggggcacauccugcggguguacggcgggguccuccccugguccguggcccuggacuggcugaccgagaagcccgagcuguuccagcuggcccugaaggccuuccgcuacacgcucaagcugaugaucgacaaggccagccugggccccaucgaggacuuccgggagcucaucaaguaccuggaggaguacgagcgcgacugguacaucggccugguguccgacgagaaguggaaggaggcgauccuccaggagaagccguaccuguucagccugggguacgacuccaacaugggcaucuacaccgggcggguccucagccugcaggagcugcucauccaggugggcaagcugaaccccgaggccgugcgcgggcagugggccaaccuguccugggagcuccuguacgccaccaacgacgacgaggagcgguacagcauccaggcccacccccugcuccugcgcaaccugaccguccaggcggccgagcccccgcucggcuaccccaucuacuccagcaagccccugcacauccaccuguacuga

SEQ ID NO: 34333 - RNA, 1248 nt, Artificial Sequence
  derived and/or modified sequence opt1 from PCOLCE2__Homo_sapiens__NP_037495
augcgcggcgccaacgccugggcgccccugugccuccugcuggccgccgccacccagcucagccggcagcaguccccggagcgccccguguucacgugcgggggcauccugaccggggagagcggcuucaucggguccgagggcuuccccggcgucuacccgcccaacagcaagugcaccuggaagaucaccgugcccgaggggaagguggucgugcugaacuuccgguucaucgaccucgaguccgacaaccugugccgcuacgacuucguggacgucuacaacggccacgccaacgggcagcggaucggccgcuucugcgggaccuuccggcccggcgcgcuggugagcuccggcaacaagaugauggugcagaugaucagcgacgccaacacggccgggaacggcuucauggccauguucuccgcggccgagcccaacgagcgcggggaccaguacugcggcggccuccuggaccggccgagcggguccuucaagacccccaacuggcccgaccgcgacuaccccgccggcgugaccugcguguggcacaucguggccccgaagaaccagcugaucgagcucaaguucgagaaguucgacgucgagcgggacaacuacugccgcuacgacuacguggccguguucaacgggggcgaggucaacgacgcgcggcgcaucgggaaguacugcggcgacagcccgcccgcccccaucguguccgagcggaacgagcugcugauccaguuccucagcgaccugucccugaccgccgacggcuucaucgggcacuacaucuuccgccccaagaagcuccccacgaccaccgagcagcccgugaccacgaccuuccccgucaccaccggccugaagccgacgguggcccugugccagcagaagugccggcgcaccgggacccucgagggcaacuacugcagcuccgacuucgugcuggccgggaccgucaucacgaccaucacccgggacggcagccugcacgcgaccguguccaucaucaacaucuacaaggagggcaaccucgccauccagcaggccgggaagaacaugagcgcccgccugacgguggucugcaagcagugcccccugcuccggcgcggccugaacuacaucaucauggggcaggucggcgaggacgggcgcggcaagaucaugcccaacagcuucaucaugauguucaagaccaagaaccagaagcugcucgacgcccugaagaacaagcagugcuga

SEQ ID NO: 34334 - RNA, 1350 nt, Artificial Sequence
  derived and/or modified sequence opt1 from PCOLCE__Homo_sapiens__NP_002584
augcugcccgccgccaccgcgagccuccugggcccgcugcucaccgccugcgcccugcugcccuucgcccaggggcagacgcccaacuacacccgccccguguuccucugcggcggggacgucaagggcgaguccggguacguggccagcgagggcuucccgaaccuguacccgcccaacaaggagugcaucuggaccaucaccgugcccgagggccagacggucucccugagcuuccggguguucgaccucgagcugcaccccgcgugccgcuacgacgcccuggagguguucgccggguccggcaccagcgggcagcggcucggccgcuucugcgggaccuuccggcccgcgccccuggucgcccccggcaaccaggugacccugcgcaugacgaccgacgagggcaccgggggccggggguuccuccugugguacuccggccgcgccaccagcggcacggagcaccaguucugcgggggccggcuggagaaggcccaggggacccucaccaccccgaacuggcccgaguccgacuacccgcccggcaucagcugcuccuggcacaucaucgccccgcccgaccaggugaucgcccugacguucgagaaguucgaccuggagcccgacaccuacugccgcuacgacagcgucuccguguucaacggggcggugagcgacgacucccggcgccucggcaaguucugcggcgacgccguccccgggagcaucuccagcgagggcaacgagcugcuggugcaguucguguccgaccucagcgucaccgccgacggguucagcgccuccuacaagacccugccccggggcacggccaaggaggggcagggccccggccccaagcgcgggaccgagcccaaggugaagcugccgcccaagagccagccgcccgagaagaccgaggagucccccagcgcgcccgacgccccgaccugccccaagcagugccggcgcacgggcacccuccaguccaacuucugcgccagcucccugguggucaccgccaccgucaagagcauggugcgggagcccggggagggccuggccgugacggugucccucaucggggcguacaagaccggcggccuggaccugcccagcccgcccaccggggccucccucaaguucuacgugcccugcaagcagugcccgcccaugaagaagggcgucagcuaccugcugaugggccagguggaggagaaccgcgggcccguccucccgcccgaguccuucguggugcugcaccggcccaaccaggaccagauccugaccaaccucagcaagcgcaagugccccucccagcccguccgggccgccgccagccaggacuga

SEQ ID NO: 34335 - RNA, 411 nt, Artificial Sequence
  derived and/or modified sequence opt1 from PCP2__Homo_sapiens__NP_777555
augauggaccaggaggagaagaccgaggagggcuccgggcccugcgccgaggccggcuccccggaccaggagggguucuucaaccugcucagccacgugcagggcgaccgcauggaggggcagcggugcucccugcaggcgggccccggccagaccacgaagucccaguccgaccccacccccgagauggacagccugauggacaugcucgccuccacccaggggcgccggauggacgaccagcgcgucaccgugagcucccugccgggcuuccagcccguggggagcaaggacggcgcccagaagcgggccgggacgcugagcccccagccccuccugaccccgcaggaccccaccgcccugggcuuccgccggaacagcagcccccagcccccgacccaggcgcccuga

SEQ ID NO: 34336 - RNA, 189 nt, Artificial Sequence
  derived and/or modified sequence opt1 from PCP4__Homo_sapiens__NP_006189
augagcgagcgccagggcgccggggccaccaacggcaaggacaagaccuccggggagaacgacggccagaagaaggugcaggaggaguucgacaucgacauggacgcgcccgagacggagcgggccgccgucgccauccagagccaguuccgcaaguuccagaagaagaaggccgggucccagagcuga

SEQ ID NO: 34337 - RNA, 2262 nt, Artificial Sequence
  derived and/or modified sequence opt1 from PCSK1__Homo_sapiens__NP_000430
auggagcgccgggccuggagccugcagugcaccgccuucguccucuucugcgcguggugcgcccugaacuccgccaaggccaagcgccaguucgugaacgagugggccgcggagauccccggcgggccggaggccgccagcgccaucgcggaggagcugggcuacgaccuccuggggcagaucggcucccuggagaaccacuaccucuucaagcacaagaaccacccccggcgcagccggcgcuccgccuuccacaucaccaagcggcugagcgacgacgaccgcgugaucugggccgagcagcaguacgagaaggagcgguccaagcgcagcgcccugcgggacuccgcccucaaccuguucaacgaccccauguggaaccagcagugguaccugcaggacacgcgcaugaccgcggcccuccccaagcuggaccugcacgugaucccggucuggcagaaggggaucaccggcaagggcguggugaucaccguccucgacgacgggcuggaguggaaccacacggacaucuacgccaacuacgaccccgaggccagcuacgacuucaacgacaacgaccacgaccccuucccccgguacgacccgaccaacgagaacaagcacggcacccgcugcgccggggagaucgcgaugcaggccaacaaccacaagugcggcguggggguggccuacaacuccaaggucggcggcauccggaugcuggacgggaucgugaccgacgccaucgaggccagcuccaucggcuucaaccccgggcacguggacaucuacagcgcguccuggggccccaacgacgacggcaagacggucgaggggcccggccgccucgcccagaaggccuucgaguacggggugaagcagggccggcaggggaagggcagcaucuucgugugggccuccggcaacgggggccgccagggggacaacugcgacugcgacggcuacaccgacagcaucuacaccaucuccaucagcagcgccucccagcaggggcugagcccgugguacgcggagaagugcuccagcacccuggccacguccuacagcuccggcgacuacaccgaccagcggaucaccagcgccgaccuccacaacgacugcaccgagacgcacaccggcaccuccgccagcgcgccccuggccgccgggaucuucgcccuggcccucgaggcgaaccccaaccugaccuggcgcgacaugcagcaccuggucguguggacguccgaguacgacccccucgccaacaacccgggcuggaagaagaacggggccggccugauggugaacagccgguucggguucggccugcucaacgccaaggcccuggucgaccuggcggacccccgcaccuggcgcuccgugcccgagaagaaggagugcguggucaaggacaacgacuucgagccccgggcccucaaggccaacggcgaggugaucaucgagaucccgacccgcgccugcgaggggcaggagaacgccaucaagagccuggagcacgugcaguucgaggcgaccaucgaguacucccggcgcggcgaccugcacgucacgcucaccagcgccgccgggaccuccaccgugcugcuggccgagcgggagcgcgacacgagccccaacggcuucaagaacugggacuucauguccguccacaccuggggcgagaaccccaucgggaccuggacccuccggaucacggacaugagcggccgcauccagaacgaggggcggaucgugaacuggaagcugauccugcacggcaccagcucccagcccgagcacaugaagcagccgcgcguguacaccagcuacaacaccguccagaacgaccggcgcgggguggagaagaugguggaccccggcgaggagcagcccacgcaggagaaccccaaggagaacacccucgucuccaagagcccguccagcuccagcgugggcgggcggcgcgacgagcuggaggagggcgcgcccucccaggccaugcugcggcuccugcagagcgccuucuccaagaacagcccgcccaagcagucccccaagaagucccccagcgccaagcugaacauccccuacgagaacuucuacgaggcccucgagaagcugaacaagccgagccagcugaaggacuccgaggacagccuguacaacgacuacguggacgucuucuacaacaccaagcccuacaagcaccgcgacgaccggcuccugcaggcgcugguggacauccucaacgaggagaacuga

SEQ ID NO: 34338 - RNA, 783 nt, Artificial Sequence
  derived and/or modified sequence opt1 from PCSK1N__Homo_sapiens__NP_037403
auggccggcagcccccugcucugggggccgcgcgccggcggggugggccugcugguccuccugcugcucgggcuguuccggcccccgcccgcccugugcgcccgccccgugaaggagccccggggccucuccgccgccagcccgccccuggccgagaccggcgcgccccgccgguuccgccgguccgugccccgcggggaggccgccggcgccguccaggagcuggcgcgggcccucgcccaccuccuggaggccgagcgccaggagcgggcccgcgcggaggcccaggaggccgaggaccagcaggcccgggugcuggcccagcugcugcgcguguggggcgcgccccggaacagcgaccccgcccucgggcuggacgacgacccggacgcccccgccgcccagcuggcgcgcgcccuccugcgggcccgccuggaccccgccgcccucgcggcccagcugguccccgccccggugcccgccgcggcccugcggccccggcccccgguguacgacgacgggcccgccggccccgacgccgaggaggccggcgacgagacccccgacgucgacccggagcuccugcgcuaccugcucgggcgcauccuggcgggcuccgccgacagcgaggggguggccgcgccccgccggcugcgccgggccgccgaccacgacgugggcuccgagcucccgcccgagggcguccugggggcccugcuccgcgugaagcggcuggagacgcccgcgccccaggugcccgcccgccggcugcucccgcccuga

SEQ ID NO: 34339 - RNA, 1860 nt, Artificial Sequence
  derived and/or modified sequence opt1 from PCSK2__Homo_sapiens__NP_001188457
augguguucgccagcgccgagcgccccgucuucaccaaccacuuccugguggagcuccacaagggcggggaggacaaggcgcgccagguggccgccgagcacggcuucgggguccggaagcugccguucgccgagggccuguaccacuucuaccacaacgggcucgccaaggcgaagcggcgccggucccugcaccacaagcagcagcuggagcgcgacccccgggugaagauggcccuccagcaggagggcuucgaccgcaagaagcggggcuaccgcgacaucaacgagaucgacaucaacaugaacgacccccuguucaccaagcagugguaccugaucaacacggggcaggccgacggcacccccgggcucgaccugaacguggccgaggcgugggagcugggcuacaccgggaagggcgucaccaucggcaucauggacgacgggaucgacuaccuccacccggaccuggccagcaacuacaacgccgaggccuccuacgacuucagcuccaacgaccccuaccccuacccccgguacacggacgacugguucaacagccacggcacccgcugcgccggggagguguccgcggccgccaacaacaacaucugcggcgugggcgucgccuacaacagcaagguggccgggauccggaugcuggaccagccguucaugaccgacaucaucgaggcguccagcaucucccacaugccccagcucaucgacaucuacagcgccuccuggggccccaccgacaacgggaagacgguggacggcccccgcgagcugacccugcaggccauggccgacggggucaacaagggccggggcgggaagggcagcaucuacgugugggccuccggggacggcgggagcuacgacgacugcaacugcgacggcuacgcguccagcauguggaccaucuccaucaacagcgccaucaacgacggccgcaccgcccucuacgacgagagcugcuccagcacgcuggccuccaccuucagcaacgggcggaagcgcaacccggaggccggcguggcgaccaccgaccuguacgggaacugcacgcuccggcacuccggcaccagcgccgccgcccccgaggcggccggggucuucgcccuggcccuggaggccaaccucggccugaccuggcgcgacaugcagcaccugaccgugcucacguccaagcggaaccagcugcacgacgaggugcaccaguggcgccgcaacggcgucgggcuggaguucaaccaccucuucggcuacggggugcuggacgcgggcgccauggugaagauggccaaggacuggaagaccguccccgagcgguuccacugcgugggcgggagcgugcaggaccccgagaagaucccguccaccggcaagcugguccucacccugacgaccgacgccugcgaggggaaggagaacuucgugcgcuaccuggagcacguccaggccgugaucaccgugaacgcgacccggcgcggcgaccucaacaucaacaugacgagccccauggggaccaaguccauccugcugagccggcgcccccgggacgacgacuccaaggucggcuucgacaaguggcccuucaugaccacccacacguggggcgaggacgcccgcgggaccuggacccucgagcugggcuucguggggagcgccccgcagaagggcgugcugaaggaguggacccucaugcugcacgggacgcaguccgcccccuacaucgaccaggucgugcgggacuaccagagcaagcuggccauguccaagaaggaggagcucgaggaggagcuggacgaggcgguggagcgcagccugaaguccauccucaacaagaacuga

SEQ ID NO: 34340 - RNA, 2268 nt, Artificial Sequence
  derived and/or modified sequence opt1 from PCSK4__Homo_sapiens__NP_060043
augcgccccgccccgaucgcccuguggcuccggcuggugcuggcgcucgcccugguccgcccccgggccgugggcugggcccccgugcgcgcccccaucuacgucagcuccugggcgguccaggugagccaggggaaccgggagguggagcgccuggcccggaaguucggcuucgugaaccucgggccgaucuuccccgacggccaguacuuccaccuccgccaccgcggggugguccagcagucccugacgccccacuggggccaccggcugcaccugaagaagaaccccaaggugcagugguuccagcagcagacccugcagcggcgcgugaagcggagcgucguggugccgaccgaccccugguucuccaagcagugguacaugaacagcgaggcccagcccgaccucuccauccugcaggccuggagccagggccuguccgggcagggcaucgucgugagcgugcucgacgacgggaucgagaaggaccaccccgaccugugggcgaacuacgacccgcuggccuccuacgacuucaacgacuacgaccccgacccccagccccgcuacaccccgagcaaggagaaccggcacggcacccgcugcgccggggaggucgccgccauggcgaacaacggcuucugcggcguggggguggccuucaacgcccggaucggcgggguccgcaugcucgacggcaccaucacggacgugaucgaggcccagucccugagccugcagccccagcacauccacaucuacuccgccagcuggggccccgaggacgacgggcggaccguggacggccccgggauccucacccgcgaggcguuccggcgcggcgucaccaaggggcgcggcggccuggggacgcuguucaucugggccuccggcaacgggggccuccacuacgacaacugcaacugcgacggguacaccaacagcauccacacccuguccgugggcagcaccacgcagcagggccgggucccgugguacagcgaggccugcgccuccacccugaccaccacguacagcuccgggguggccaccgacccccagaucgugaccaccgaccuccaccacggcugcacggaccagcacaccgggaccagcgcguccgcgccccuggccgccggcaugaucgcccuggcccucgaggccaaccccuuccugaccuggcgcgacaugcagcaccuggucgugcgggccagcaagccggcccaccuccaggcggaggacuggcgcacgaacggggugggccggcaggucucccaccacuacggcuacgggcugcuggacgccggccuccugguggacaccgcccgcaccuggcugcccacccagccccagcggaagugcgccgugcgcguccagagccggcccacgccgauccucccccugaucuacauccgcgagaacguguccgccugcgcggggcugcacaacagcauccggucccucgagcacgugcaggcccagcugacccugagcuacucccgccggggcgaccucgagaucagccugaccucccccaugggcacccgcagcacgcuggucgccauccggccgcucgacguguccaccgagggguacaacaacuggguguucaugagcacccacuucugggacgagaacccccagggcgucuggacccuggggcuggagaacaagggcuacuacuucaacacggggacccuguaccgcuacacccuccugcuguacggcaccgccgaggacaugaccgcccggcccacgggcccccaggugaccuccagcgcgugcgugcagcgcgacaccgaggggcucugccaggccugcgacggcccggccuacauccuggggcagcugugccucgccuacugcccgccccgguucuucaaccacacccgccuggucacggccggccccgggcacaccgcggccccggcccugcgcgugugcagcuccugccacgccagcugcuacacgugccggggcggcagcccccgcgacugcaccuccugcccgcccuccagcacccucgaccagcagcagggguccugcaugggccccaccacccccgacagccggccccgccugcgggcggccgccugcccccaccaccgcugcccggccuccgccauggugcugagccuccuggcggucacccucgggggccccgugcugugcgggauguccauggaccugccccuguacgccuggcucagccgggcccgcgccacgcccaccaagccccagguguggcugcccgccggcaccuga

SEQ ID NO: 34341 - RNA, 5583 nt, Artificial Sequence
  derived and/or modified sequence opt1 from PCSK5__Homo_sapiens__NP_001177411
augggcugggggagccgcugcugcugccccggccggcuggaccuccugugcgugcuggcccuccuggggggcugccugcucccggucugccgcacccggguguacaccaaccacugggccgugaagaucgcggggggcuuccccgaggccaaccgcaucgccuccaaguacggcuucaucaacaucgggcagaucggcgcccugaaggacuacuaccacuucuaccacagccggacgaucaagcgcuccgucaucagcucccgggggacccacagcuucaucuccauggagcccaagguggaguggauccagcagcagguggucaagaagcgcaccaagcgggacuacgacuucagccgcgcccaguccaccuacuucaacgaccccaaguggccgagcaugugguacaugcacugcuccgacaacacgcaccccugccagagcgacaugaacaucgagggcgcguggaagcggggguacaccggcaagaacaucguggugaccauccuggacgacggcaucgagcgcacccaccccgaccucaugcagaacuacgacgcccuggccuccugcgacgucaacgggaacgaccuggaccccaugccgcgguacgacgccagcaacgagaacaagcacggcacgcgcugcgcgggggagguggccgccgccgccaacaacucccacugcaccgugggcaucgcguucaacgccaagaucggcgggguccggaugcucgacggcgacgugaccgacaugguggaggccaagagcgucuccuucaacccccagcacgugcacaucuacagcgccuccugggggcccgacgacgacggcaagaccguggacgggcccgccccgcugacgcgccaggcguucgagaacggcguccggaugggccgccgggggcugggcagcguguucgugugggccagcgggaacggcgggcgcuccaaggaccacugcagcugcgacggcuacaccaacuccaucuacaccaucagcaucuccagcaccgccgaguccggcaagaagcccugguaccucgaggagugcagcuccacgcuggccaccaccuacagcuccggggagagcuacgacaagaagaucaucaccacggaccugcggcagcgcugcaccgacaaccacaccggcaccuccgccagcgcgcccauggccgccgggaucaucgcccucgcccuggaggcgaaccccuuccugacguggcgcgacguccagcacgugaucgugcggaccucccgcgccggccaccucaacgccaacgacuggaagaccaacgccgcgggguucaaggucagccaccuguacggcuucggccugauggacgccgaggccauggugauggaggccgagaaguggaccacggucccgcggcagcacgugugcguggaguccaccgaccgccagaucaagaccauccggcccaacagcgccguccgcuccaucuacaaggcgagcgggugcagcgacaaccccaaccggcacgugaacuaccucgagcacguggucgugcgcaucaccaucacgcacccccggcgcggcgaccuggccaucuaccugaccuccccgagcgggacccggucccagcuccuggccaaccgccuguucgaccacagcauggagggcuucaagaacugggaguucaugaccauccacugcuggggcgagcgggccgccggggacugggugcucgaggucuacgacacgcccucccagcugcgcaacuucaagacccccggcaagcugaaggaguggagccucgugcuguacgggaccuccgugcagcccuacagcccgaccaacgaguuccccaaggucgagcgguuccgcuacucccggguggaggaccccaccgacgacuacggcacggaggacuacgcggggcccugcgacccggagugcagcgaggugggcugcgacggccccgggcccgaccacugcaacgacugccugcacuacuacuacaagcucaagaacaacacccgcaucugcgucuccagcugcccgcccggccacuaccacgccgacaagaagcggugccgcaagugcgcccccaacugcgaguccugcuucgggagccacggcgaccagugcauguccugcaaguacggguacuuccugaacgaggagaccaacagcugcgugacccacugccccgacggcuccuaccaggacacgaagaagaaccugugccgcaagugcagcgagaacugcaagaccugcaccgaguuccacaacugcaccgagugccgggacggccucagccugcaggggucccgcugcagcguguccugcgaggacggccgguacuucaacgggcaggacugccagccgugccaccgcuucugcgccacgugcgccggcgcgggggccgacggcugcaucaacugcaccgagggcuacuucauggaggacgggcggugcguccagagcugcuccaucagcuacuacuucgaccacuccagcgagaacggcuacaaguccugcaagaagugcgacaucagcugccugaccugcaacgggcccggcuucaagaacugcaccuccugccccagcggguaccuccuggaccugggcaugugccagaugggcgccaucugcaaggacggggaguacguggacgagcacggccacugccagacgugcgaggccuccugcgcgaagugccaggggcccacccaggaggacugcaccaccugcccgaugacgcgcaucuucgacgacggccggugcgugagcaacugccccuccuggaaguucgaguucgagaaccagugccaccccugccaccacaccugccagcgcugccagggcagcgggcccacccacugcaccuccugcggcgccgacaacuacgggcgggagcacuuccucuaccagggcgagugcggggacagcugcccggagggccacuacgccacggagggcaacaccugccugcccugccccgacaacugcgagcugugccacuccguccacgugugcacccgcugcaugaagggguacuucaucgcccccaccaaccacacgugccagaagcucgagugcggccagggggaggugcaggacccggacuacgaggagugcguccccugcgaggagggcugccuggggugcagccuggacgaccccggcaccugcaccagcugcgccaugggcuacuaccgguucgaccaccacugcuacaagaccugccccgagaagacguacuccgaggagguggagugcaaggcgugcgacagcaacugcggguccugcgaccagaacggcugcuacuggugcgaggagggguucuuccugcucggcgggagcugcgugcgcaagugcggcccgggcuucuacggggaccaggagaugggcgagugcgaguccugccaccgggccugcgagaccugcaccgggcccggccacgacgagugcagcuccugccaggagggccugcagcugcuccgcgggaugugcguccacgccaccaagacgcaggaggagggcaaguucuggaacgacauccugcggaagcugcagcccugccacagcuccugcaagaccugcaacgggagcgccacccucugcaccuccugccccaagggcgccuaccugcuggcgcaggccugcgugagcuccugcccgcaggggacguggcccagcgugcgcuccggcagcugcgagaacugcaccgaggccugcgccaucugcuccggcgccgaccucugcaagaagugccagaugcagcccgggcacccgcuguuccugcacgagggccggugcuacagcaagugccccgagggguccuacgcggaggacggcaucugcgagcgcugcagcagccccugccggaccugcgaggggaacgccaccaacugccacuccugcgagggcggccacguccuccaccacggggugugccaggagaacugccccgagcgccacguggccgucaagggcgugugcaagcacugcccggagaugugccaggacugcauccacgagaagaccugcaaggagugcacgcccgaguucuuccugcacgacgacaugugccaccagagcugcccccggggguucuacgccgacucccgccacugcgugcccugccacaaggacugccuggagugcagcggcccgaaggcggacgacugcgagcucugccuggaguccagcuggguccuguacgacgggcucugccuggaggagugccccgccggcaccuacuacgagaaggagaccaaggagugccgcgacugccacaaguccugccugaccugcagcuccagcggcacgugcaccaccugccagaaggggcucaucaugaacccccggggcuccugcauggccaacgagaagugcagccccuccgaguacugggacgaggacgccccggggugcaagcccugccacgugaagugcuuccacugcaugggccccgccgaggaccagugccagaccugccccaugaacagccugcugcucaacacgaccugcgugaaggacugcccggagggguacuacgcggacgaggacuccaaccgcugcgcccacugccacagcuccugccggaccugcgagggccgccacagccggcagugccacuccugccgccccggcugguuccagcuggggaaggagugccugcuccagugccgggagggcuacuacgccgacaacagcaccgggcgcugcgagcggugcaaccgcagcugcaagggcugccagggcccccggcccacggacugccuguccugcgaccgcuucuucuuccugcuccggagcaagggggagugccaccgcuccugcccggaccacuacuacgucgagcagagcacccagaccugcgagcggugccaccccaccugcgaccagugcaagggcaagggggcccugaacugccuguccugcguguggagcuaccaccucaugggcgggaucugcacguccgacugccuggugggcgaguaccgcgucggcgagggggagaaguucaacugcgagaagugccacgagagcugcauggagugcaagggccccggggccaagaacugcacccugugccccgcgaaccucgugcugcacauggacgacucccacugccugcacugcugcaacaccagcgacccgcccuccgcccaggagugcugcgacugccaggacaccacggacgagugcauccuccggaccagcaaggugcgccccgccaccgagcacuucaagaccgcccuguucaucacguccagcaugaugcugguccuccugcugggcgccgcggugguggucuggaagaagucccgggggcgcgugcagcccgccgccaaggccggcuacgagaagcucgccgacccgaacaagagcuacuccagcuacaaguccagcuaccgcgagagcaccuccuucgaggaggaccaggugaucgaguaccgggaccgcgacuacgacgaggacgacgacgacgacaucgucuacaugggccaggacgggaccguguaccggaaguucaaguacggccugcuggacgacgacgacaucgacgagcucgaguacgacgacgagagcuacuccuacuaccaguga

SEQ ID NO: 34342 - RNA, 2910 nt, Artificial Sequence
  derived and/or modified sequence opt1 from PCSK6__Homo_sapiens__NP_002561
augcccccgcgcgccccgcccgcccccggcccccggcccccgccccgcgcggccgccgccaccgacaccgccgcgggggccggcggggccggcggggccggcggcgccgggggccccggguuccggccccuggcgccccgccccuggcgguggcuccugcugcucgcccugccggccgccugcagcgcgcccccgccccgccccguguacacgaaccacugggccguccaggugcugggcgggcccgccgaggccgaccggguggccgcggcccacggcuaccucaaccugggccagaucgggaaccuggaggacuacuaccacuucuaccacuccaagaccuucaagcgcagcacccucuccagccggggcccccacaccuuccugcgcauggacccccaggucaaguggcugcagcagcaggaggugaagcggcgcgugaagcggcagguccgcuccgacccgcaggcccucuacuucaacgaccccaucuggagcaacaugugguaccugcacugcggggacaagaacucccggugccgcagcgagaugaacgugcaggccgccuggaagcggggcuacacgggcaagaacguggucgugaccauccuggacgacgggaucgagcgcaaccaccccgaccucgcgcccaacuacgacuccuacgccagcuacgacgugaacggcaacgacuacgacccgagcccccgguacgacgccuccaacgagaacaagcacgggacccgcugcgccggcgaggucgccgcguccgccaacaacagcuacugcaucguggggaucgccuacaacgccaagaucggcggcauccggaugcuggacggggacgugaccgacgucguggaggcgaagucccugggcauccgccccaacuacaucgacaucuacagcgccuccugggggcccgacgacgacggcaagacgguggacgggccgggccgccucgccaagcaggccuucgaguacggcaucaagaaggggcggcagggccuggggagcaucuucgucugggccuccggcaacgggggccgcgagggcgacuacugcagcugcgacggguacaccaacagcaucuacaccaucuccgugagcuccgcgaccgagaacggcuacaagcccugguaccuggaggagugcgccagcacccucgccaccaccuacuccagcggggccuucuacgagcggaagaucgugaccacggaccugcgccagcggugcaccgacggccacaccggcaccuccgucagcgcccccaugguggcggggaucaucgcccuggcccucgaggccaacucccagcugacguggcgcgacgugcagcaccuccucgucaagaccagccggccggcccaccugaaggcguccgacuggaaggugaacggcgccgggcacaaggucagccacuucuacggcuucgggcugguggacgccgaggcccucguggucgaggcgaagaaguggaccgccgugcccucccagcacaugugcguggccgccagcgacaagcgcccccgguccaucccccugguccaggugcugcgcaccacggcccucaccagcgcgugcgccgagcacuccgaccagcggguggucuaccuggagcacguggugguccgcaccagcaucucccacccgcggcgcggcgaccugcagaucuaccucgugagccccagcggcaccaagucccagcugcuggccaagcggcuccuggaccugagcaacgagggguucacgaacugggaguucaugaccgugcacugcuggggcgagaaggccgaggggcaguggacccucgagauccaggaccugcccucccagguccgcaaccccgagaagcagggcaagcugaaggaguggagccucauccuguacgggaccgccgagcacccguaccacacguucuccgcgcaccagagccggucccgcaugcuggagcucagcgcccccgagcuggagccgcccaaggccgcccugucccccagccagguggaggugcccgaggacgaggaggacuacaccgcccaguccacccccggcagcgcgaacauccugcagaccuccgucugccaccccgagugcggcgacaaggggugcgacggcccgaacgccgaccagugccucaacugcgugcacuucagccugggguccgugaagacgagccggaagugcgucuccgugugcccccugggcuacuucggggacaccgccgcccgccgcugccggcgcugccacaagggcugcgagaccugcagcagccgggcggccacccagugccucuccugccgccggggcuucuaccaccaccaggagaugaacacgugcgugacccugugccccgccggguucuacgccgacgagagccagaagaacugccugaagugccaccccuccugcaagaagugcgucgacgagccggagaagugcaccgugugcaaggagggcuucagccucgcccgcggguccugcauccccgacugcgagcccggcaccuacuucgacagcgagcugauccggugcggggagugccaccacacgugcgggaccugcgugggccccggccgcgaggagugcauccacugcgcgaagaacuuccacuuccacgacuggaagugcgucccggccugcggcgagggguucuaccccgaggagaugcccggccugccgcacaaggugugccggcgcugcgacgagaacugccucuccugcgccggcagcucccggaacugcagccgcugcaagaccggguucacccagcugggcaccuccugcaucacgaaccacacgugcagcaacgccgacgagaccuucugcgagauggugaaguccaaccggcugugcgagcgcaagcuguucauccaguucugcugccggaccugccugcuggccggguga

SEQ ID NO: 34343 - RNA, 2358 nt, Artificial Sequence
  derived and/or modified sequence opt1 from PCSK7__Homo_sapiens__NP_004707
augcccaagggccgccagaaggugccgcaccuggacgcgccccucgggcugccgaccugccuguggcucgagcuggccggccuguuccuccugguccccugggugauggggcuggccggcaccgggggccccgacggccaggggacgggcgggcccagcugggccgugcaccucgagucccuggagggcgacggggaggaggagacccuggagcagcaggccgacgcccucgcccaggcggccggccuggucaacgccggccggaucggggagcugcagggccacuaccucuucgugcagcccgccgggcaccgccccgcgcuggagguggaggccauccggcagcaggucgaggccgugcuggccggccacgaggccgugcgcuggcacagcgagcagcggcuccugcgccgggcgaagcgcuccguccacuucaacgacccgaaguacccccagcaguggcaccugaacaaccggcgcagccccggccgggacaucaacgugaccggggugugggagcgcaacgucaccggccgcggggugacgguggucgugguggacgacggcgucgagcacaccauccaggacaucgcccccaacuacuccccggaggggagcuacgaccucaacuccaacgaccccgaccccaugccccacccggacguggagaacggcaaccaccacggcacccggugcgccggggagaucgccgccgugcccaacaacagcuucugcgcggucggcguggccuacgggucccggaucgccggcauccgcgugcuggacgggccccugaccgacagcauggaggccgucgccuucaacaagcacuaccagaucaacgacaucuacuccugcagcuggggccccgacgacgacggcaagacgguggacgggccgcaccagcucggcaaggcggcccugcagcacggggucaucgccggccggcagggguucggcuccaucuucgugguggccagcggcaacgggggccagcacaacgacaacugcaacuacgacggguacgccaacuccaucuacaccgucaccaucggcgcgguggacgaggagggccgcaugcccuucuacgccgaggagugcgccagcaugcuggccgugaccuucuccgggggcgacaagaugcuccggagcaucgucacgaccgacugggaccugcagaaggggaccggcugcaccgaggggcacacgggcaccuccgcggccgcgccccuggccgccggcaugaucgcccucaugcuccaggugcgccccugccugaccuggcgggacgugcagcacaucaucgucuucaccgccacgcgcuacgaggaccgccgggccgagugggugaccaacgaggccggguucagccacagccaccagcacggcuucgggcuccugaacgccuggcgccuggugaacgcggccaagaucuggaccuccgucccguaccucgccagcuacgugucccccgugcugaaggagaacaaggccaucccccagagcccccggucccuggagguccucuggaacgugagccgcauggaccuggagauguccggccugaagacccucgagcacguggccgucacggugagcaucacccacccgcggcgcgggucccuggagcugaagcuguucugccccagcggcaugaugucccugaucggcgcgccccggagcauggacuccgacccgaacggguucaacgacuggaccuucagcaccgugcgcugcuggggcgagcgggcccgcgggacguaccggcuggucauccgcgacgugggcgacgaguccuuccagguggggauccuccggcaguggcagcugacccuguacggcagcgucugguccgccguggacauccgcgaccggcagcgccugcucgagagcgccauguccggcaaguaccugcacgacgacuucgcgcugcccugcccgcccgggcucaagauccccgaggaggacggcuacaccaucacccccaacacgcugaagacccuggugcucgucgggugcuucaccguguucuggaccguguacuacaugcuggaggucuaccugagccagcggaacguggccagcaaccaggugugccgcuccggccccugccacuggccccaccggagccgcaaggccaaggaggaggggacggagcucgaguccgucccgcugugcagcuccaaggaccccgacgagguggagaccgagagccgcggcccgcccaccaccuccgaccugcucgcccccgaccugcuggagcagggcgacuggagccucucccagaacaagagcgcccuggacugcccccaccagcaccuggacgugccccacgggaaggaggagcagaucugcuga

SEQ ID NO: 34344 - RNA, 429 nt, Artificial Sequence
  derived and/or modified sequence opt1 from PCTP__Homo_sapiens__NP_001095872
auggacagcgacuaccgcaagcagugggaccaguacgugaaggagcuguacgagcaggagugcaacggcgagaccgucguguacugggaggugaaguaccccuucccgauguccaaccgggacuacgucuaccuccgccagcggcgcgaccuggacauggaggggcggaagauccacgugauccuggcccgcagcaccuccaugccccagcucggcgagcggagcggggugauccgcgucaagcaguacaagcagucccuggccaucgagagcgacggcaagaagggguccaagguguucauguacuacuucgacaaccccggcggccagauccccagcuggcugaucaacugggcggccaagaacggggugccgaacuuccucaaggacauggcccgggccugccagaacuaccugaagaagacguga

SEQ ID NO: 34345 - RNA, 1104 nt, Artificial Sequence
  derived and/or modified sequence opt1 from PCYT1A__Homo_sapiens__NP_005008
auggacgcccagugcagcgccaaggugaacgcgcgcaagcggcgcaaggaggcccccggcccgaacggggccaccgaggaggacggcguccccuccaaggugcagcggugcgccguggggcugcgccagcccgcccccuucagcgacgagaucgaggucgacuucuccaagccguacgugcgggugaccauggaggaggcgagccgcggcacgcccugcgagcggcccguccgcguguacgccgacgggaucuucgaccucuuccacuccggccacgcccgggcccugaugcaggcgaagaaccuguuccccaacaccuaccucaucgugggcgucugcagcgacgagcugacccacaacuucaagggguucaccgugaugaacgagaacgagcgcuacgacgccgugcagcacugccgguacgucgacgagguggugcgcaacgccccguggacgcugacccccgaguuccucgccgagcaccggaucgacuucgucgcccacgacgacauccccuacuccagcgcgggcuccgacgacguguacaagcacaucaaggaggccgggauguucgcccccacccagcgcaccgagggcaucagcacguccgacaucaucacccggaucgugcgcgacuacgacgucuacgcccggcgcaaccugcagcggggguacaccgccaaggagcugaacgugagcuucaucaacgagaagaaguaccaccuccaggagcgcguggacaaggucaagaagaaggugaaggacguggaggagaaguccaaggaguucguccagaagguggaggagaaguccaucgaccugauccagaagugggaggagaagucccgggaguucaucggcagcuuccuggagauguucggcccggagggggcgcucaagcacaugcugaaggagggcaaggggcgcaugcugcaggccaucucccccaagcagagccccuccagcagccccacccgcgagcgguccccgagccccuccuuccgcuggcccuucagcggcaagacgagcccgcccugcagccccgccaaccucucccggcacaaggccgccgcguacgacaucagcgaggacgaggaggacuga

SEQ ID NO: 34346 - RNA, 1056 nt, Artificial Sequence
  derived and/or modified sequence opt1 from PCYT1B__Homo_sapiens__NP_001156736
auggugggccaccaggagugcaucauggaggaggacaaccgcgcgccccagcuguggcggaagacccucaccgccccggcccccuucgccgacgagacgaacugccagugccaggcgccccacgagaagcugaccaucgcccaggcccgccuggggacccccgccgaccggccgguccgcguguacgccgacggcaucuucgaccucuuccacagcgggcacgcccgggcccugaugcaggcgaagacccuguuccccaacuccuaccuccuggugggcgucugcagcgacgaccugacgcacaaguucaagggguucaccgugaugaacgaggccgagcgcuacgaggcccuccggcacugccgcuacguggacgaggucauccgggacgcccccuggacccugacccccgaguuccuggagaagcacaagaucgacuucguggcccacgacgacaucccguacuccagcgcgggcuccgacgacguguacaagcacaucaaggaggccggcauguucguccccacgcagcgcaccgaggggaucagcaccuccgacaucaucacccggaucgugcgcgacuacgacguguacgcccggcgcaaccuccagcggggcuacacggccaaggagcugaacgucagcuucaucaacgagaagcgcuaccgguuccagaaccagguggacaagaugaaggagaaggugaagaacgucgaggagcgcuccaaggaguucgugaaccggguggaggagaagucccacgaccugauccagaagugggaggagaagucccgcgaguucaucgggaacuuccucgagcuguucggccccgacggggccuggaagcagauguuccaggagcggagcucccgcaugcugcaggcgcucagccccaagcaguccccggucagcucccccacccgcagccggucccccagccgcagccccuccccgaccuucagcuggcugccccugaagaccagcccgcccagcucccccaaggccgccagcgccuccaucagcuccaugagcgagggcgacgaggacgagaaguga

SEQ ID NO: 34347 - RNA, 546 nt, Artificial Sequence
  derived and/or modified sequence opt1 from PDAP1__Homo_sapiens__NP_055706
augcccaagggcgggcgcaagggcgggcacaagggccgggcccgccaguacaccagcccggaggagaucgacgcccagcugcaggcggagaagcagaaggcccgggaggaggaggagcagaaggagggcggggacggcgccgccggggaccccaagaaggagaagaagucccucgacagcgacgaguccgaggacgaggaggacgacuaccagcagaagcgcaagggcguggaggggcugaucgacaucgagaaccccaaccgggucgcccagaccacgaagaaggugacccagcuggaccucgacggccccaaggagcugagccgccgggagcgcgaggagaucgagaagcagaaggcgaaggagcgguacaugaagaugcaccuggccgggaagaccgagcaggccaaggccgaccucgcgcgccuggccaucauccggaagcagcgcgaggaggccgcccggaagaaggaggaggagcgcaaggccaaggacgacgcgacccuguccggcaagcggaugcagagccucucccugaacaaguga

SEQ ID NO: 34348 - RNA, 639 nt, Artificial Sequence
  derived and/or modified sequence opt1 from PDCD10__Homo_sapiens__NP_665859
augcgcaugaccauggaggagaugaagaacgaggccgagaccacgagcaugguguccaugccccuguacgccgucauguacccgguguucaacgagcucgagcgggugaaccugagcgcggcccagacccugcgcgccgccuucaucaaggccgagaaggagaaccccggccucacccaggacaucaucaugaagauccuggagaagaaguccgucgaggugaacuucaccgagagccugcuccggauggcggccgacgacguggaggaguacaugaucgagcgccccgagcccgaguuccaggaccugaacgagaaggcccgggcccugaagcagauccucuccaagaucccggacgagaucaacgaccgcguccgguuccugcagacgaucaaggacaucgcgagcgccaucaaggagcugcucgacaccgugaacaacguguucaagaaguaccaguaccagaaccgccgggcccuggagcaccagaagaaggaguucgucaaguacuccaagagcuucuccgacacccugaagaccuacuucaaggacgggaaggccaucaacguguucgugagcgccaaccgccucauccaccagacgaaccugauccugcagaccuucaagaccgucgcguga

SEQ ID NO: 34349 - RNA, 867 nt, Artificial Sequence
  derived and/or modified sequence opt1 from PDCD1__Homo_sapiens__NP_005009
augcagaucccccaggccccguggcccguggucugggccgugcugcagcucggcuggcgccccgggugguuccuggacagccccgaccggccguggaacccgcccaccuucucccccgcgcugcucguggucaccgagggcgacaacgccacguucacgugcagcuucuccaacaccagcgaguccuucgugcugaacugguaccgcaugagccccuccaaccagaccgacaagcuggccgccuuccccgaggaccggagccagcccgggcaggacugccgcuuccgggugacccagcuccccaacggccgcgacuuccacauguccgucgugcgggcccgccggaacgacagcgggaccuaccugugcggcgcgaucucccuggccccgaaggcccagaucaaggagagccuccgcgccgagcugcgggugaccgagcgccgggcggagguccccaccgcccaccccucccccagcccgcgccccgccggccaguuccagacgcugguggugggggucgugggcgggcuccugggcucccuggugcuccuggucugggugcuggccgugaucugcagccgggccgcgcgcgggaccaucggcgcccggcgcaccggccagccccucaaggaggaccccuccgccgucccgguguucagcguggacuacggggagcuggacuuccaguggcgggagaagacccccgagccgcccguccccugcgugcccgagcagacggaguacgccaccaucguguuccccuccggcauggggaccagcagccccgcccgccggggcuccgcggacggcccgcgcagcgcccagccccugcgccccgaggacgggcacugcuccuggccgcucuga

SEQ ID NO: 34350 - RNA, 822 nt, Artificial Sequence
  derived and/or modified sequence opt1 from PDCD1LG2__Homo_sapiens__NP_079515
augaucuuccugcuccugaugcugagccucgagcugcagcugcaccagaucgccgcccucuucaccgugaccguccccaaggagcuguacaucaucgagcacggcuccaacgugacgcuggagugcaacuucgacaccgggagccacgugaaccucggcgcgaucaccgccucccugcagaaggucgagaacgacaccagcccgcaccgcgagcgggccacgcugcucgaggagcagcugccccuggggaaggccuccuuccacaucccccagguccaggugcgcgacgagggccaguaccagugcaucaucaucuacgggguggccugggacuacaaguaccucacccugaaggugaaggcgagcuaccggaagaucaacacccacauccugaaggugcccgagaccgacgaggucgagcucacgugccaggccaccggcuacccgcuggccgagguguccuggcccaacgugagcguccccgccaacaccucccacagccgcacccccgagggccuguaccaggugacguccgugcuccggcugaagccgccgcccgggcgcaacuucagcugcgucuucuggaacacccacgugcgggagcugacccucgcguccaucgaccugcagagccagauggagccccgcacccaccccacguggcugcuccacaucuucauccccuucugcaucaucgccuucaucuucaucgccaccgugaucgcccugcggaagcagcugugccagaagcucuacuccagcaaggacaccaccaagcgccccgucacgaccaccaagcgggaggugaacuccgccaucuga

SEQ ID NO: 34351 - RNA, 936 nt, Artificial Sequence
  derived and/or modified sequence opt1 from PDCD2__Homo_sapiens__NP_001186391
auggccgccgcgggcgcccgccccguggagcugggguucgccgagagcgccccggccuggcggcuccgcuccgagcaguuccccagcaaggucuacgcgccccugcccggccggccggacgccuuccaccgcugcaucuuccuguucugcugccgggagcagcccugcugcgccgggcuccgcguguuccggaaccagcugccccgcaagaacgacuucuacuccuacgagcccccgagcgagaacccgccgcccgagaccggcgaguccgugugccugcagcucaagagcggggcccaccugugccgggucugcggcugccugggccccaagaccugcucccgcugccacaaggcguacuacugcagcaaggagcaccagacgcucgacuggcggcuggggcacaagcaggccugcgcccagcccgaccaccuggaccacaucauccccgaccacaacuuccucuuccccgaguucgagaucgugaucgagaccgaggacgagaucaugcccgagguggucgagaaggaggacuacuccgagaucaucggcagcaugggggaggcccuggaggaggagcuggacuccauggccaagcacgagagccgcgaggacaagaucuuccagaaguucaagacccagaucgcgcucgagcccgagcagauccugcgguacggccgcgggaucgcccccaucuggaucuccggcgagaacaucccccaggagaaggacaucccggacugccccugcggcgccaagcggauccuggaguuccaggugaugccccagcuccugaacuaccugaaggccgaccgccucggcaagagcaucgacugggggauccuggccguguucacgugcgcggaguccugcagccuggggaccggcuacaccgaggaguucgucuggaagcaggacgugaccgacacccccuga

SEQ ID NO: 34352 - RNA, 1368 nt, Artificial Sequence
  derived and/or modified sequence opt1 from PDCD4__Homo_sapiens__NP_001186421
auggacguggagaacgagcagauccugaacgucaaccccgccgagaacgccggcaccgaggagaucaagaacgagaucaacgggaacuggaucagcgcguccagcaucaacgaggcccgcaucaacgccaaggccaagcggcgccuccggaagaacuccagccgcgacuccggccgcggggacagcguguccgacagcggcuccgacgcccugcggagcgggcugaccgugccgacgucccccaagggccggcuccuggaccgccggagccgcuccggcaaggggcggggccugcccaagaagggcggggccgggggcaagggcgucugggggacccccggccagguguacgacguggaggaggucgacgugaaggacccgaacuacgacgacgaccaggagaacugcguguacgagaccgucgugcucccccuggacgagcgcgccuucgagaagacccugacgcccaucauccaggaguacuucgagcacggggacaccaacgagguggccgagaugcuccgggaccugaaccugggcgagaugaaguccggcguccccgugcucgccgugagccuggcgcuggaggggaaggccagccaccgcgagaugaccuccaagcuccugagcgaccugugcggcaccgucauguccacgaccgacguggagaaguccuucgacaagcuccugaaggaccugccggagcucgcccuggacacgccccgggcgccccagcugguggggcaguucaucgcccgcgcggucggcgacgggauccucugcaacaccuacaucgacagcuacaagggcaccguggacugcgugcaggcccgggccgcccuggacaaggccaccguccugcucagcaugagcaagggcgggaagcgcaaggacuccguguggggcagcgggggcgggcagcaguccgugaaccaccuggucaaggagaucgacaugcugcucaaggaguaccugcugagcggcgacaucuccgaggcggagcacugccucaaggagcuggaggugccccacuuccaccacgagcuggucuacgaggccaucaucauggugcucgagagcaccggcgaguccaccuucaagaugauccuggaccugcucaagagccuguggaaguccagcacgaucaccguggaccagaugaagcggggguacgagcgcaucuacaacgagaucccggacaucaaccuggacgucccccacuccuacagcgugcucgagcgguucguggaggagugcuuccaggccggcaucaucuccaagcagcugcgcgaccugugccccagccgcgggcggaagcgcuucgucuccgagggcgacgggggccggcucaagcccgagagcuacuga

SEQ ID NO: 34353 - RNA, 378 nt, Artificial Sequence
  derived and/or modified sequence opt1 from PDCD5__Homo_sapiens__NP_004699
auggccgacgaggagcuggaggcccuccgccggcagcgccuggcggagcugcaggccaagcacggcgaccccggggacgccgcccagcaggaggccaagcaccgggaggcggagaugcgcaacagcauccucgcccaggugcuggaccaguccgcccgggcccgccugagcaaccucgcgcuggucaagccggagaagaccaaggccguggagaacuaccugauccagauggcccgguacggccagcucuccgagaaggugagcgagcaggggcugaucgagauccugaagaaggucucccagcagaccgagaagacgaccaccgugaaguucaaccgccggaaggugauggacagcgacgaggacgacgacuacuga

SEQ ID NO: 34354 - RNA, 570 nt, Artificial Sequence
  derived and/or modified sequence opt1 from PDCD6__Homo_sapiens__NP_001254485
auggccgccuacagcuaccgccccggcccgggggcgggccccgggcccgccgccggcgccgcccugcccgaccaguccuuccucuggaacguguuccagcgggucgacaaggaccgcagcggggugaucuccgacaccgagcugcagcaggcgcugagcaacggcaccuggacgccguucaaccccgugaccguccgguccaucaucagcauguucgaccgcgagaacaaggccggcgugaacuucuccgaguucaccgggguguggaaguacaucaccgacuggcagaacgucuuccggacguacgaccgcgacaacagcggcaugaucgacaagaacgagcucaagcaggcccuguccggguaccggcugagcgaccaguuccacgacauccucauccgcaaguucgaccggcagggccgcgggcagaucgccuucgacgacuucauccagggcugcaucgugcugcagcggcugaccgacaucuuccgccgguacgacaccgaccaggacggcuggauccagguguccuacgagcaguaccucagcauggucuucuccaucguguga

SEQ ID NO: 34355 - RNA, 2622 nt, Artificial Sequence
  derived and/or modified sequence opt1 from PDCD6IP__Homo_sapiens__NP_001155901
auggccaccuucaucagcgugcagcugaagaagaccuccgaggucgaccucgccaagccccuggugaaguucauccagcagacguacccgagcggcggggaggagcaggcgcaguacugccgcgccgccgaggagcuguccaagcuccggcgcgccgccgugggccggccccuggacaagcacgagggggcgcuggagacccuccugcgcuacuacgaccagaucugcagcaucgagcccaaguuccccuucuccgagaaccagaucugccugaccuucaccuggaaggacgccuucgacaagggcagccucuucgggggcuccgucaagcuggcccuggccagccucggcuacgagaaguccugcgugcuguucaacugcgcggcccuggccagccagaucgccgccgagcagaaccucgacaacgacgaggggcugaagaucgcggccaagcacuaccaguucgccuccggcgccuuccugcacaucaaggagacggugcucagcgcccugucccgggagccgaccgucgacaucagccccgacaccguggggacccugucccucaucaugcuggcgcaggcccaggagguguucuuccugaaggccacgcgcgacaagaugaaggacgccaucaucgccaagcucgcgaaccaggccgccgacuacuucggcgacgccuucaagcagugccaguacaaggacacccugcccaaguacuucuacuuccaggaggucuuccccgugcuggccgcgaagcacugcaucaugcaggccaacgccgaguaccaccagagcauccucgccaagcagcagaagaaguucggggaggagaucgcgcggcugcagcacgccgccgagcugaucaagaccguggccucccgcuacgacgaguacgucaacgugaaggacuucagcgacaagaucaaccgggcccucgcggccgccaagaaggacaacgacuucaucuaccacgaccgcgugccggaccugaaggaccuggaccccaucggcaaggccacccucgucaaguccacgcccgugaacgugcccaucagccagaaguucaccgaccuguucgagaagauggucccggugagcgugcagcagucccuggccgcguacaaccagcggaaggccgaccucgucaaccgcagcaucgcccagaugcgggaggccaccacccuggccaacggcgugcuggcgucccucaaccugcccgccgccaucgaggacgugagcggggacacggucccccaguccauccugaccaagagccgcuccgugaucgagcagggcgggauccagaccgucgaccagcucaucaaggagcugcccgagcugcuccagcggaaccgcgagauccuggacgagagccugcggcuccuggacgaggaggaggccaccgacaacgaccugcgcgcgaaguucaaggagcgguggcagcgcacgccguccaacgagcuguacaagccccuccgggccgagggcaccaacuuccgcaccgugcuggacaaggccgugcaggccgacggccaggucaaggagugcuaccagagccaccgcgacaccaucgugcugcucugcaagcccgagcccgagcugaacgccgcgaucccguccgccaaccccgccaagacgaugcaggggagcgagguggucaacgugcugaagucccuccugagcaaccuggacgaggugaagaaggagcgggagggccucgagaacgaccugaaguccgucaacuucgacaugaccagcaaguuccugaccgcccucgcccaggacggggugaucaacgaggaggcgcuguccgugaccgagcuggaccgcgucuacggcgggcucacgaccaaggugcaggagagccugaagaagcaggagggccugcucaagaacauccaggugucccaccaggaguucagcaagaugaagcagagcaacaacgaggccaaccugcgggaggagguccugaagaaccucgccaccgccuacgacaacuucguggagcugguggccaaccugaaggagggcaccaaguucuacaacgagcucacggagauccugguccgcuuccagaacaagugcuccgacaucguguucgcgcggaagaccgagcgcgacgagcugcucaaggaccugcagcagagcaucgcccgggagcccuccgcccccagcaucccgacccccgccuaccaguccagccccgccgggggccacgcgcccaccccgcccacgcccgccccgcgcaccaugccgcccaccaagccccagccgcccgcccggccgccgccgcccgugcugcccgccaaccgcgcgcccuccgccaccgcccccagccccgucggggccggcaccgccgcgcccgcccccucccagacgcccgggagcgcgcccccgccccaggcccagggcccgcccuaccccaccuaccccggcuaccccggguacugccagaugcccaugcccaugggcuacaaccccuacgccuacgggcaguacaacaugcccuacccgcccguguaccaccagucccccggccaggcccccuaccccgggccccagcagccgagcuaccccuucccccagcccccgcagcaguccuacuacccccagcaguga

SEQ ID NO: 34356 - RNA, 1458 nt, Artificial Sequence
  derived and/or modified sequence opt1 from PDCD7__Homo_sapiens__NP_005698
auggcccugcccccguucuucggccaggggcgccccggcccccccccgccccagccccccccgcccgcccccuucgggugccccccgcccccccuccccagcccggcguucccccccccccugccgcagcggcccggccccuuccccggggccuccgccccguuccugcagcccccccucgcccugcagccccgcgccagcgcggaggccucccggggcggcgggggcgccggggccuucuacccggugccccccccgccccugccccccccgcccccccagugccgccccuucccgggcaccgacgcgggggagcggccccgcccccccccgcccggccccggccccccguggagcccccgguggcccgaggcccccccgccccccgccgacguccucggggacgccgcccugcagcgccugcgggaccgccaguggcucgaggcgguguucggcaccccccggcgcgccgggugcccggugccccagcggacgcacgccggccccucccugggcgagguccgcgcccggcugcuccgcgcccugcggcuggugcgccggcuccgcgggcugagccaggcgcugcgggaggccgaggccgacggcgccgccugggugcuccuguacucccagaccgcgccgcugcgcgccgagcucgccgagcgccugcagccccugacccaggccgccuacgucggggaggcgcggcgccggcucgagcgcgugcggcgccggcgccugcggcugcgcgagcgggcccgcgagcgggaggccgagcgcgaggccgaggcggcccgggccguggagcgcgagcaggagaucgaccgguggcgcgucaagugcgugcaggagguggaggagaagaagcgggagcaggagcucaaggccgccgcggacggcguccugagcgaggugcgcaagaagcaggccgacaccaagcgcaugguggacauccugcgggcccucgagaagcugcgcaagcugcggaaggaggccgccgcgcgcaagggggucugcccccccgccuccgccgacgagacguucacccaccaccuccagcggcugcgcaagcugaucaagaagcggagcgagcucuacgaggccgaggagcgcgcccugcgggugaugcuggagggcgagcaggaggaggagcgcaagcgggagcucgagaagaagcagcgcaaggagaaggagaagauccugcugcagaagcgggagaucgaguccaagcucuucggcgacccggacgaguucccccuggcgcaccugcucgagcccuuccgccaguacuaccugcaggccgagcacagccugcccgcccucauccagauccggcacgacugggaccaguaccuggugccguccgaccaccccaaggggaacuucgucccccagggcugggugcugcccccgcugcccagcaacgacaucugggccaccgcggugaagcuccacuga

SEQ ID NO: 34357 - RNA, 585 nt, Artificial Sequence
  derived and/or modified sequence opt1 from PDC__Homo_sapiens__NP_072098
augagcagcccccagucccgcaacggcaaggacuccaaggagcgggugagccgcaagauguccauccaggaguacgagcugauccacaaggagaaggaggacgagaacugccuccggaaguaccgccggcagugcaugcaggacaugcaccagaagcugagcuucgggccgcgcuacggcuucgucuacgagcuggagaccgggaagcaguuccucgagaccaucgagaaggagcugaagaucacgaccaucguggugcacaucuacgaggacggcaucaaggggugcgacgcccugaacuccagccugaccugccucgccgcggaguaccccaucgucaaguucugcaagaucaaggccuccaacaccggcgccggcgaccgguucagccuggacgugcuccccacgcugcugaucuacaagggcggggagcucaucuccaacuucaucagcguggccgagcaguucgccgaggaguucuucgcgggggacgucgaguccuuccugaacgaguacggccugcuccccgagcgcgaggugcacgugcuggagcacaccaagaucgaggaggaggacgucgaguga

SEQ ID NO: 34358 - RNA, 726 nt, Artificial Sequence
  derived and/or modified sequence opt1 from PDCL2__Homo_sapiens__NP_689614
augcaggaccccaacgaggacaccgaguggaacgacauccugcgcgacuucggcauccucccgcccaaggaggagagcaaggacgagaucgaggagauggugcugcggcugcagaaggaggccauggucaagcccuucgagaagaugacccucgcccagcugaaggaggcggaggacgaguucgacgaggaggacaugcaggccguggagacguaccgcaagaagcggcugcaggaguggaaggcccucaagaagaagcagaaguucggggagcugcgcgagaucuccggcaaccaguacgugaacgaggucaccaacgccgaggaggacgugugggugaucauccaccuguaccggagcuccauccccaugugccuccuggucaaccagcaccugagccuccuggcccgcaaguucccggagaccaaguucgugaaggcgaucgugaacuccugcauccagcacuaccacgacaacugccugcccaccaucuucgucuacaagaacgggcagaucgaggccaaguucaucggcaucaucgagugcgggggcaucaaccucaagcuggaggagcuggaguggaagcucgccgaggugggcgccauccagacggaccuggaggagaacccccggaaggacaugguggacaugauggucagcuccauccgcaacaccagcauccacgacgacuccgacagcuccaacagcgacaacgacaccaaguga

SEQ ID NO: 34359 - RNA, 720 nt, Artificial Sequence
  derived and/or modified sequence opt1 from PDCL3__Homo_sapiens__NP_076970
augcaggaccccaacgccgacaccgaguggaacgacauccugcgcaagaagggcauccucccgcccaaggagagccugaaggagcuggaggaggaggccgaggaggagcagcggauccuccagcaguccguggucaagaccuacgaggacaugacgcuggaggagcuggaggaccacgaggacgaguucaacgaggaggacgagcgcgcgaucgagauguaccggcgccggcgccucgccgaguggaaggccaccaagcugaagaacaaguucggggaggugcuggagaucagcggcaaggacuacgugcaggaggucaccaaggccggggagggccucugggugauccugcaccuguacaagcaggggaucccccucugcgcccugaucaaccagcaccuguccggccucgcgcggaaguuccccgacgugaaguucaucaaggccaucagcaccacgugcaucccgaacuaccccgaccgcaaccugcccaccaucuucgucuaccuggagggcgacaucaaggcccaguucaucgggccccucguguucggcgggaugaaccugacccgggacgagcuggaguggaagcucuccgagagcggcgccaucaugaccgaccuggaggagaacccgaagaagcccaucgaggacgugcugcucuccagcguccgccgguccgugcugaugaagcgcgacagcgacuccgagggggacuga

SEQ ID NO: 34360 - RNA, 2370 nt, Artificial Sequence
  derived and/or modified sequence opt1 from PDE10A__Homo_sapiens__NP_001124162
auggaggacggccccagcaacaacgccuccugcuuccgccggcugaccgagugcuuccucagcccgucccugaccgacgagaaggugaaggccuaccugagccuccacccccagguccuggacgaguucguguccgagagcguguccgcggagacggucgagaaguggcugaagcgcaagaacaacaagagcgaggacgaguccgcccccaaggaggugagccgguaccaggacaccaacaugcaggggguggucuacgagcucaacuccuacaucgagcagcgccuggacaccggcggggacaaccagcugcuccuguacgagcugagcuccaucaucaagaucgccaccaaggccgacggcuucgcccucuacuuccugggggagugcaacaacagccugugcaucuucacgcccccgggcaucaaggagggcaagccccggcucauccccgcggggcccaucacccagggcaccaccguguccgccuacguggccaagagccgcaagacgcugcuggucgaggacauccucggggacgagcgguucccgcgcggcaccgggcuggaguccggcacccggauccagagcgugcugugccuccccaucgugaccgccaucggcgaccugaucgggauccuggagcucuaccgccacuggggcaaggaggcguucugccugucccaccaggaggucgccacggccaaccuggccugggccagcguggcgauccaccaggugcaggucugccgggggcucgccaagcagaccgagcugaacgacuuccugcucgacgugagcaagaccuacuucgacaacaucguggccaucgacucccugcuggagcacaucaugaucuacgccaagaaccucgucaacgccgaccgcugcgcgcuguuccagguggaccacaagaacaaggagcuguacagcgaccucuucgacaucggcgaggagaaggagggcaagcccguguucaagaagaccaaggagauccgguucuccaucgagaaggggaucgccggccaggucgcccgcacgggggaggugcugaacauccccgacgccuacgccgacccgcgguucaaccgcgagguggaccuguacaccggcuacaccacccggaacauccucugcaugcccaucgucagccgcggguccgugaucggcgucgugcagauggugaacaagaucagcggcuccgcguucagcaagacggacgagaacaacuucaagauguucgccgucuucugcgcccuggcccugcacugcgccaacauguaccaccggauccgccacuccgagugcaucuaccgggugaccauggagaagcucagcuaccacuccaucugcaccagcgaggaguggcaggggcugaugcaguucacccugcccgugcgccucugcaaggagaucgagcuguuccacuucgacaucggccccuucgagaacauguggccggggaucuucgucuacauggugcaccgcuccugcggcacgagcugcuucgagcuggagaagcucugccgguucaucauguccgugaagaagaacuaccgccggguccccuaccacaacuggaagcacgcggugaccguggcccacugcauguacgccauccugcagaacaaccacacccuguucaccgaccuggagcgcaaggggcuccugaucgccugccugugccacgaccucgaccaccggggcuucagcaacuccuaccugcagaaguucgaccacccccuggcggcccucuacagcacguccaccauggagcagcaccacuucagccagaccgucagcauccugcagcuggagggccacaacaucuucuccacccucagcuccagcgaguacgagcagguccuggagaucauccgcaaggccaucaucgccacggaccuggcccucuacuucgggaaccggaagcagcuggaggagauguaccagaccggcucccugaaccucaacaaccagagccaccgcgaccgggugaucgggcugaugaugaccgcgugcgaccugugcuccgugaccaagcucuggcccgugacgaagcugaccgccaacgacaucuacgccgaguucugggccgagggcgacgagaugaagaagcuggggauccagccgauccccaugauggaccgcgacaagaaggacgaggugccccagggccagcucggcuucuacaacgccgucgcgauccccugcuacaccacccugacccagauccugccgcccacggagccccuccugaaggccugccgggacaaccugagccagugggagaaggugauccgcggggaggagaccgccaccuggaucuccagccccuccguggcccagaaggccgcggccagcgaggacuga

SEQ ID NO: 34361 - RNA, 1470 nt, Artificial Sequence
  derived and/or modified sequence opt1 from PDE11A__Homo_sapiens__NP_001070664
augagccccaagugcuccgccgacgccgagaacagcuucaaggaguccauggagaaguccagcuacagcgacuggcugaucaacaacuccaucgcggagcucguggccagcaccggccugccggucaacaucuccgacgccuaccaggacccccgcuucgacgccgaggccgaccagaucagcggguuccacauccgguccgugcugugcgugcccaucuggaacagcaaccaccagaucaucggcgucgcccaggugcucaaccgccuggacgggaagcccuucgacgacgcggaccagcggcuguucgaggccuucgugaucuucugcggccucgggaucaacaacaccaucauguacgaccaggucaagaaguccugggccaagcagagcguggcgcuggacgugcuguccuaccacgccacgugcagcaaggccgaggucgacaaguucaaggccgccaacaucccgcucguguccgagcuggcgaucgacgacauccacuucgacgacuucagccuggacguggacgccaugaucaccgccgcccuccgcauguucauggagcugggcaugguccagaaguucaagaucgacuacgagacccugugccgguggcuccugaccgugcgcaagaacuaccggauggugcuguaccacaacuggcgccacgccuucaacgucugccagcucauguucgcgaugcugacgaccgccggcuuccaggacauccugaccgagguggagauccucgccgugaucgucgggugccugugccacgaccuggaccaccggggcaccaacaacgccuuccaggccaaguccgggagcgcgcucgcccagcuguacggcacgagcgccacccuggagcaccaccacuucaaccacgccgugaugauccuccaguccgaggggcacaacaucuucgccaaccugagcuccaaggaguacagcgaccugaugcagcuccugaagcaguccauccuggcgaccgaccucacccuguacuucgagcgccggacggaguucuucgagcuggugagcaagggcgaguacgacuggaacaucaagaaccaccgcgacaucuuccgguccaugcucaugaccgccugcgaccugggcgccgucaccaagcccugggagaucagccgccagguggccgagcuggugaccuccgaguucuucgagcagggggaccgggagcgccucgagcugaagcugacgcccagcgcgaucuucgaccggaaccgcaaggacgagcucccccggcugcagcuggaguggaucgacuccaucugcaugccgcucuaccaggcccuggucaaggugaacgucaagcugaagcccaugcucgacagcguggccaccaaccgcuccaagugggaggagcugcaccagaagcggcugcuggccagcaccgccuccagcucccccgcgagcgugauggucgccaaggaggaccgcaacuga

SEQ ID NO: 34362 - RNA, 1830 nt, Artificial Sequence
  derived and/or modified sequence opt1 from PDE12__Homo_sapiens__NP_808881
auguggcgccugcccggcgcccgggccgcgcuccgcgugauccggaccgccgucgagaagcugagccgcgccgaggccgggucccagaccgccgcgggcgccauggagcgggccguggugcgcugcgucccgagcgagcccaagcugucccucagcuucgcccuggcggacgggucccacaagaacaugcagcgggaccagagcgagccccugggccgcgugcucucccggaucgccacgaacgcccugaaggggcacgccaaggccgcggccgccaagaagucccgcaagagccggcccaacgccagcggcggcgccgcgugcuccgggccgggccccgagcccgccguguucugcgagcccgucgugaagcuguacuaccgcgaggaggccguggccgaggacguccucaacguggacgccuggcaggacggggcggugcugcagaucggcgacgucaaguacaagguggagcggaacccgcccgccuucaccgagcugcagcucccccgcuacaucauggccggguuccccgugugcccgaagcugagccuggaguucggcgaccccgccuccagccucuuccggugguacaaggaggccaagcccggcgcggccgagcccgaggucggggugccguccagccugucccccagcucccccagcagcuccuggaccgagaccgacguggaggagcgcgucuacacgcccagcaacgccgacaucggccugcggcucaagcugcacugcaccccgggggacggccagcgcuucggccacucccgggagcuggagagcgugugcguggucgaggccgggcccgggaccugcaccuucgaccaccgccaccucuacacgaagaaggugaccgaggacgcgcugauccggaccguguccuacaacauccuggccgacaccuacgcccagacggaguucagccgcaccguccucuaccccuacugcgcccccuacgcccuggagcuggacuaccgccagaaccucauccagaaggagcugaccggguacaacgcggacgugaucugccugcaggaggucgaccgggccguguucuccgacagccucgugccggcccuggaggccuucggccuggagggggucuuccgcaucaagcagcacgagggccucgccaccuucuaccggaaguccaaguucagccugcugucccagcacgacaucagcuucuacgaggcgcucgaguccgacccccugcacaaggagcugcucgagaagcuggugcuguaccccagcgcccaggagaaggugcuccagcgcuccagcguccuccagguguccgugcugcagagcacgaaggacuccagcaagcggaucugcgucgccaacacccaccuguacuggcaccccaagggcggguacauccgccugauccagauggccguggcccuggcgcacauccggcacgugagcugcgaccucuacccgggcauccccgucaucuucugcggggacuucaacuccacccccagcaccggcauguaccacuucgugaucaacggguccaucccggaggaccacgaggacugggccagcaacggcgaggaggagcgcugcaacaugucccugacgcacuucuucaagcucaagagcgccugcggcgagcccgccuacaccaacuacgugggcggcuuccacgggugccuggacuacaucuucaucgaccugaacgcgcuggaggucgagcaggucaucccccugcccucccacgaggaggugaccacccaccaggcccucccgagcgugucccaccccagcgaccacaucgcccuggugugcgaccugaaguggaaguga

SEQ ID NO: 34363 - RNA, 1608 nt, Artificial Sequence
  derived and/or modified sequence opt1 from PDE1A__Homo_sapiens__NP_001003683
augggcagcuccgccaccgagaucgaggagcuggagaacaccacguucaaguaccucaccggggagcagaccgagaagauguggcagcgccugaagggcauccugcggugccucgugaagcagcuggagcgcggggacgucaacgugguggaccugaagaagaacaucgaguacgccgcgagcguccucgaggccguguacaucgacgagacccggcgccugcuggacacggaggacgagcucuccgacauccagaccgacagcgugcccuccgagguccgggacuggcuggccagcaccuucacccgcaagaugggcaugacgaagaagaagccggaggagaagcccaaguuccgguccaucgugcacgccgugcaggccgggaucuucgucgagcgcauguaccggaagaccuaccacauggugggccuggcguaccccgccgccgugaucgucacccucaaggacguggacaaguggagcuucgacguguucgcccugaacgaggcguccggcgagcacagccugaaguucaugaucuacgagcuguucacccgcuacgaccucaucaaccgguucaagauccccgucuccugccugaucacguucgccgaggcccucgaggugggguacagcaaguacaagaacccguaccacaaccugauccacgccgccgacgugacccagaccguccacuacaucaugcugcacaccggcaucaugcacuggcucacggagcuggagauccuggcgaugguguucgccgccgccauccacgacuacgagcacaccgggaccaccaacaacuuccacauccagacgcgcuccgacguggccauccucuacaacgaccggagcguccuggagaaccaccacguguccgcggccuaccgccugaugcaggaggaggagaugaacauccucaucaaccugagcaaggacgacuggcgggaccugcgcaaccucgugaucgagaugguccuguccaccgacaugagcggccacuuccagcagaucaagaacauccggaacucccugcagcagcccgaggggaucgaccgcgccaagaccaugagccucauccugcacgccgccgacaucagccaccccgcgaaguccuggaagcugcacuaccgguggaccauggcccucauggaggaguucuuccugcagggcgacaaggaggccgagcugggccuccccuucagcccgcugugcgaccgcaaguccacgaugguggcccagagccagaucggguucaucgacuucaucgucgagcccaccuucucccugcucaccgacagcaccgagaagaucgugaucccccugaucgaggaggccuccaaggcggagacgagcuccuacguggccagcuccagcaccaccaucgucggccugcacaucgccgacgcccuccggcgcuccaacaccaaggggagcauguccgacggcagcuacucccccgacuacagccuggcggccguggaccugaaguccuucaagaacaaccucguggacaucauccagcagaacaaggagcgcuggaaggagcuggccgcccaggaggcccggacgagcagccagaagugcgaguucauccaccaguga

SEQ ID NO: 34364 - RNA, 1611 nt, Artificial Sequence
  derived and/or modified sequence opt1 from PDE1B__Homo_sapiens__NP_000915
auggagcugagcccccgcuccccgcccgagaugcucgaggagagcgacugccccagcccccuggagcucaagagcgcccccuccaagaagauguggaucaagcugcggagccugcugcgcuacauggugaagcagcucgagaacggcgagaucaacaucgaggagcugaagaagaaccuggaguacaccgccucccuccuggaggcggucuacaucgacgagacccggcagauccuggacacggaggacgagcuccaggagcugcgcagcgacgccgugcccuccgaggugcgggacuggcuggccagcaccuucacccagcaggcccgcgccaaggggcggcgcgcggaggagaagcccaaguuccgguccaucguccacgccgugcaggccggcaucuucguggagcgcauguuccggcgcaccuacacgagcgucgggcccaccuacuccaccgccgugcucaacugccugaagaaccuggaccucuggugcuucgacguguucagccugaaccaggcggccgacgaccacgcccugcggaccaucgucuucgagcuccugacgcgccacaaccugaucucccgguucaagaucccgaccguguuccucaugagcuuccuggacgcccuggagaccggcuacgggaaguacaagaaccccuaccacaaccagauccacgccgcggacgugacccagacgguccacugcuuccuccugcgcaccggcauggugcacugccuguccgagaucgagcuccuggccaucaucuucgccgccgccauccacgacuacgagcacaccggcaccacgaacagcuuccacauccagaccaaguccgagugcgcgaucguguacaacgaccggagcguccuggagaaccaccacaucagcuccguguuccgccucaugcaggacgacgagaugaacaucuucaucaaccugaccaaggacgaguucguggagcugcgggcccucgucaucgagauggugcuggccaccgacaugagcugccacuuccagcaggucaagacgaugaagaccgcccugcagcagcucgagcgcaucgacaagcccaaggcccugucccugcuccugcacgcggccgacaucagccaccccaccaagcaguggcuggugcacucccgguggaccaaggcccucauggaggaguucuuccgccagggggacaaggaggccgagcugggccugccguucagcccccucugcgaccgcacguccacccugguggcccagagccagaucggguucaucgacuucaucguggagcccaccuucuccguccugaccgacguggcggagaaguccguccagccccuggccgacgaggacuccaagagcaagaaccagccguccuuccaguggcggcagcccagccucgacguggaggugggcgaccccaaccccgacgucguguccuuccgcagcacgugggugaagcggauccaggagaacaagcagaaguggaaggagcgcgccgccuccgggaucaccaaccagaugagcaucgacgagcuguccccgugcgaggaggaggcgccgcccagccccgccgaggacgagcacaaccagaacggcaaccuggacuga

SEQ ID NO: 34365 - RNA, 2130 nt, Artificial Sequence
  derived and/or modified sequence opt1 from PDE1C__Homo_sapiens__NP_001177986
auggagagccccaccaaggagaucgaggaguucgaguccaacagccugaaguaccuccagccggagcagaucgagaagaucuggcugcgccugcggggccuccgcaaguacaagaagaccucccagcggcugcgcagccuggugaagcagcucgagcgcggggaggccuccgucguggaccugaagaagaaccuggaguacgccgcgaccgugcucgagagcgucuacaucgacgagacccggcggcugcuggacaccgaggacgagcucuccgacauccagagcgacgccgugcccuccgaggugcgcgacuggcuggccagcaccuucacgcggcagaugggcaugaugcugcgccgguccgacgagaagccccgcuucaagagcaucguccacgccgugcaggccgggaucuucguggagcggauguaccgccggaccuccaacauggucggccucagcuacccgcccgcggugaucgaggcccugaaggacguggacaagugguccuucgacgucuucagccugaacgaggccuccggggaccacgcccucaaguucaucuucuacgagcugcugacccgcuacgaccucaucagccgguucaagauccccaucuccgcgcuggugagcuucguggaggcccuggaggucggcuacagcaagcacaagaaccccuaccacaaccucaugcacgccgccgacgugacccagacggugcacuaccugcuguacaagaccggcgucgccaacuggcucaccgagcuggagaucuucgcgaucaucuucuccgccgccauccacgacuacgagcacaccgggacgaccaacaacuuccacauccagacccgcagcgaccccgccauccuguacaacgaccgguccgugcucgagaaccaccaccugagcgccgcguaccgccugcuccaggacgacgaggagaugaacauccugaucaaccuguccaaggacgacuggcgggaguuccgcacccucgugaucgagauggucauggccacggacaugagcugccacuuccagcagaucaaggccaugaagaccgcccugcagcagccggaggccaucgagaagcccaaggcgcugucccucaugcugcacaccgccgacaucagccaccccgccaaggccugggaccugcaccaccgcuggaccaugucccuccuggaggaguucuuccggcagggcgaccgcgaggccgagcuggggcuccccuucagcccgcugugcgaccggaaguccacgaugguggcgcagagccaggugggcuucaucgacuucaucgucgagcccaccuucaccgugcugaccgacaugacggagaagaucgucagcccccucaucgacgagaccagccagaccgggggcaccggccagcgccgguccagccugaacuccaucagcuccagcgacgccaagcgcagcggggugaagacguccggcagcgagggguccgcccccaucaacaacagcgugaucuccgucgacuacaagagcuucaaggccaccuggaccgagguggugcacaucaaccgggagcgcuggcgggcgaaggucccgaaggaggagaaggccaagaaggaggccgaggagaaggcccgccuggccgcggaggagcagcagaaggagauggaggccaagucccaggccgaggagggcgccagcggcaaggccgagaagaagaccuccggggagacgaagaaccaggugaacggcacccgggcgaacaagagcgacaacccccgcgggaagaacuccaaggccgagaaguccuccggcgagcagcagcagaacggggacuucaaggacggcaagaacaagaccgacaagaaggaccacagcaacaucggcaacgacuccaagaagaccgacgggacgaagcagcggagccacggcucccccgcccccagcaccagcuccacgugccgccugacccucccggugaucaagccgccccugcggcacuucaagcgccccgccuacgccagcuccagcuacgcgcccuccgucagcaagaagaccgacgagcaccccgcccgguacaagaugcuggaccagcgcaucaagaugaagaagauccagaacaucucccacaacuggaaccggaaguga

SEQ ID NO: 34366 - RNA, 2805 nt, Artificial Sequence
  derived and/or modified sequence opt1 from PDE2A__Homo_sapiens__NP_001137311
auggugcugguccuccaccacauccugaucgccguggugcaguuccugcgccggggccagcaggucuuccucaagcccgacgagccgcccccgccgccccagcccugcgccgacagccugcaggacgcgcugcucucccuggggagcgugaucgacaucuccggccugcagcgcgccgugaaggaggcccucagcgccguccugccccggguggagaccguguacaccuaccugcucgacggggagucccagcuggucugcgaggacccgccccacgagcugccccaggagggcaaggugcgcgaggccaucaucagccagaagcggcucgggugcaacggccugggcuucuccgaccugcccgggaagccccucgcgcgccugguggcgccccuggcccccgacacgcagguccucgugaugccccuggccgacaaggaggccggcgccguggccgccgucauccuggugcacugcgggcagcucagcgacaacgaggaguggucccugcaggccguggagaagcacacccuggucgcgcuccggcgcguccaggugcugcagcagcggggcccccgcgaggccccgcgggccgugcagaacccgcccgaggggaccgccgaggaccagaagggcggcgccgcguacaccgaccgcgaccggaagauccugcagcucugcggggagcuguacgaccuggacgccagcucccuccagcugaaggugcugcaguaccuccagcaggagacgcgcgccagccggugcugccugcugcucguguccgaggacaaccugcagcugagcugcaaggucaucggcgacaaggugcucggggaggaggucuccuucccccugaccggcugccugggccaggugguggaggacaagaaguccauccagcucaaggaccugaccagcgaggacguccagcagcugcagagcaugcucgggugcgagcugcaggccaugcugugcgugcccgugaucucccgcgccaccgaccaggucguggcgcuggccugcgccuucaacaagcucgagggcgaccuguucacggacgaggacgagcacgugauccagcacugcuuccacuacaccagcaccguccugaccagcacgcucgccuuccagaaggagcagaagcugaagugcgagugccaggcccugcuccagguggcgaagaaccuguucacccaccuggacgacguguccguccuccugcaggagaucaucaccgaggcccggaaccugagcaacgccgagaucugcuccguguuccuccuggaccagaacgagcugguggccaaggucuucgacgggggcgugguggacgacgagagcuacgagauccgcauccccgcggaccaggggaucgccggccacgucgccaccacgggccagauccucaacauccccgacgccuacgcccacccccuguucuaccgcgggguggacgacuccaccggcuuccggacccggaacauccugugcuucccgaucaagaacgagaaccaggaggugaucggggucgcggagcucgugaacaagaucaacggccccugguucagcaaguucgacgaggaccuggccaccgccuucuccaucuacugcgggaucagcaucgcccacucccugcucuacaagaaggugaacgaggcccaguaccgcagccaccuggcgaacgagaugaugauguaccacaugaaggucuccgacgacgaguacacgaagcugcuccacgacggcauccagcccguggccgccaucgacagcaacuucgccuccuucaccuacacgccccgcagccugccggaggacgacaccuccauggccauccugagcaugcuccaggacaugaacuucaucaacaacuacaagaucgacugccccacccuggcgcgguucugccugauggugaagaagggcuaccgcgacccgcccuaccacaacuggaugcacgccuucuccgucagccacuucugcuaccuccuguacaagaaccuggagcucaccaacuaccuggaggacaucgagaucuucgcccuguucaucuccugcaugugccacgaccucgaccaccgggggaccaacaacagcuuccagguggccagcaaguccgugcuggcggcccuguacagcuccgagggcagcgucauggagcgccaccacuucgcccaggccaucgccauccucaacacccacgggugcaacaucuucgaccacuucucccggaaggacuaccagcgcaugcuggaccugaugcgggacaucauccucgcgacggaccuggcccaccaccuccgcaucuucaaggaccugcagaagauggccgaggugggcuacgaccggaacaacaagcagcaccaccgccugcugcucugccugcugaugaccagcugcgaccucuccgaccagaccaagggguggaagaccacgcggaagaucgccgagcugaucuacaaggaguucuucagccagggcgaccuggagaaggccaugggcaaccgccccauggagaugauggaccgggagaaggcguacauccccgagcuccagaucuccuucauggagcacaucgccaugcccaucuacaagcugcugcaggaccucuucccgaaggccgccgagcuguacgagcgcguggccagcaaccgggagcacuggaccaaggucucccacaaguucaccauccgcgggcugcccagcaacaacucccucgacuuccuggacgaggaguacgaggugcccgaccuggacggcacccgggcgcccaucaacgggugcugcagccucgacgccgaguga

SEQ ID NO: 34367 - RNA, 3426 nt, Artificial Sequence
  derived and/or modified sequence opt1 from PDE3A__Homo_sapiens__NP_000912
auggccgugcccggcgacgccgcgcgcguccgggacaagccggugcacagcggggugucccaggcccccaccgccggccgcgacugccaccaccgggccgaccccgccagcccccgcgacuccgggugccggggcugcuggggcgaccugguccuccagccgcugcgcagcucccggaagcugagcuccgcgcucugcgccgggagccuguccuuccugcucgcccugcuggugcgccucgugcggggcgaggucgggugcgaccuggagcagugcaaggaggccgcggccgccgaggaggaggaggccgcccccggcgcggagggcgggguguuccccgggccccgcggcggcgcccccgggggcggggcccggcugagccccuggcuccagcccuccgcccugcuguucagccuccugugcgccuucuucuggaugggccuguaccuccugcgcgcgggcgugcggcugccccucgccgucgcccugcuggccgccugcugcgggggcgaggcgcucgugcagaucgggcugggcgugggggaggaccaccuccucucccugccggccgccggcgucgugcugagcugccucgccgccgcgaccuggcuggugcugcgccuccggcugggcguccugaugaucgcccucacguccgccgugcgcaccgugagccugaucucccuggagcgguucaaggucgccuggcgccccuaccucgcguaccuggccggggugcugggcauccuccuggcccgguacguggagcagauccugccccagagcgccgaggccgcgccccgcgagcaccucgggucccagcugaucgccggcaccaaggaggacaucccggucuucaagcggcgccgccggagcagcuccguggugagcgccgagauguccgggugcagcuccaagagccaccgccggaccucccugcccugcaucccccgcgagcagcucaugggccacagcgagugggaccacaagcggggcccccgcgggucccagagcuccggcacgagcaucaccgucgacaucgccgugaugggggaggcccacggccugaucaccgaccugcuggcggacccgucccucccgcccaacgucugcaccagccugcgggccguguccaaccugcucagcacgcagcugaccuuccaggccauccacaagccccgcgugaacccggucaccucccugagcgagaacuacacgugcuccgacagcgaggagagcuccgagaaggacaagcucgccauccccaagcggcugcgccggagccugccgcccgggcuccugcgccggguguccagcaccuggaccaccaccacguccgccaccggccugcccacccucgagcccgcgcccgugcgccgggaccgcagcaccuccaucaagcugcaggaggccccgagcuccagccccgacuccuggaacaaccccgucaugaugacgcugaccaagagccgguccuucaccagcuccuacgccaucagcgccgcgaaccacgugaaggccaagaagcagucccgccccggcgcccucgccaagaucagcccgcugagcucccccugcagcagcccccugcaggggacccccgccuccucccucgugagcaagaucuccgcgguccaguucccggagagcgccgacacgaccgccaagcagucccugggcagccaccgggcccugaccuacacccaguccgcccccgaccucagcccccagauccugacgcccccggugaucugcuccagcugcgggcgccccuacucccagggcaaccccgcggacgagccccuggagcgcagcggcguggccacccggaccccgucccgcaccgacgacacggcccaggucaccagcgacuacgagaccaacaacaacuccgacagcagcgacaucgugcagaacgaggacgagaccgagugccuccgggagccccugcgcaaggccuccgccugcagcacguacgcgcccgagaccaugauguuccuggacaagcccauccucgccccggagccccuggugauggacaaccuggacuccaucauggagcagcucaacaccuggaacuuccccaucuucgaccuggucgagaacaucgggcggaagugcggccgcauccugagccagguguccuaccggcuguucgaggacauggggcuguucgaggccuucaagauccccauccgcgaguucaugaacuacuuccacgcccuggagaucggcuaccgggacaucccguaccacaaccgcauccacgcgaccgacgugcuccacgccgucugguaccugaccacgcagcccauccccgggcugagcaccgugaucaacgaccacggcuccaccagcgacuccgacagcgacuccggcuucacccacgggcacaugggcuacguguucagcaagacguacaacgucaccgacgacaaguacgggugccucuccggcaacaucccggcccuggagcugauggcccucuacguggccgcggccaugcacgacuacgaccaccccgggcggaccaacgccuuccugguggccaccagcgcgccccaggccguccuguacaacgaccgcuccgugcucgagaaccaccacgccgccgccgccuggaaccuguucaugagccggcccgaguacaacuuccugaucaaccucgaccacguggaguucaagcacuuccgcuuccuggucaucgaggcgauccuggccacggaccucaagaagcacuucgacuucguggccaaguucaacggcaaggugaacgacgacgucggcaucgacuggaccaacgagaacgaccggcugcuggugugccagaugugcaucaagcucgccgacaucaacgggccggccaagugcaaggagcugcaccuccaguggaccgacggcaucgugaacgaguucuacgagcagggggacgaggaggcgucccugggccugcccaucagccccuucauggaccgcuccgcgccccagcuggccaaccuccaggagagcuucaucagccacaucgucgggccgcugugcaacuccuacgacagcgccggccugaugcccggcaaguggguggaggacuccgacgagagcggggacaccgacgaccccgaggaggaggaggaggaggcccccgccccgaacgaggaggagacgugcgagaacaacgagucccccaagaagaagaccuucaagcggcgcaagaucuacugccagaucacccagcaccuccugcagaaccacaagauguggaagaaggugaucgaggaggagcagcggcuggccggcaucgagaaccagagccucgaccagacgccccagucccacagcuccgagcagauccaggccaucaaggaggaggaggaggagaaggggaagccccgcggcgaggagaucccgacccagaagcccgaccaguga

SEQ ID NO: 34368 - RNA, 3339 nt, Artificial Sequence
  derived and/or modified sequence opt1 from PDE3B__Homo_sapiens__NP_000913
augcgccgggacgagcgcgacgccaaggccaugcggagccugcagcccccggacggcgcgggguccccgcccgagagccuccgcaacggcuacgugaaguccugcgucagcccccugcggcaggacccgccccgcggguucuucuuccaccugugccgguucugcaacguggagcuccgcccgccgcccgccagcccccagcagccccggcgcugcucccccuucugccgggcccgccugucccugggcgcccucgccgcguucgugcuggcccugcuccugggggccgagcccgagagcugggccgcgggcgccgccuggcugcggacccuccuguccgucugcagccacucccugagcccccucuucuccaucgccugcgccuucuucuuccugaccugcuuccugacgcgcaccaagcggggccccgggcccggccgcagcugcggguccugguggcuccuggcgcugcccgccugcugcuaccucggcgacuuccugguguggcagugguggagcuggcccuggggcgacggggacgccggcuccgccgcgccccacacgcccccggaggccgccgccgggcggcugcuccuggugcugagcugcgucggccuccugcugacccucgcccacccccugcgccugcggcacugcgugcucgugcugcugcucgccuccuucgucuggugggugagcuucaccagccuggggucccugcccagcgcgcuccgcccccugcuguccggccucgugggcggggccggcugccugcuggcccucgggcuggaccacuucuuccagauccgggaggccccgcugcacccccgccucagcuccgccgcggaggagaagguccccgugauccgcccccggcgccggagcuccugcgugagccugggcgagaccgccgccuccuacuacgggagcugcaagaucuuccgccggccgucccugcccugcaucagccgcgagcagaugauccugugggacugggaccucaagcagugguacaagccccacuaccagaacuccggcggcgggaacggcgucgaccugagcgugcugaacgaggcccggaacaugguguccgaccuccugaccgacccgagccugccgccccaggucaucuccagccuccgcuccaucagcagccugaugggggcguucuccggcagcugccggcccaagaucaacccccugacccccuuccccggguucuaccccugcuccgagaucgaggacccggccgagaagggcgaccgcaagcucaacaagggccugaaccggaacagccugcccacgccccagcuccgccgguccagcgggaccuccggccugcugcccguggagcagagcucccgcugggaccggaacaacgggaagcgcccgcaccaggaguucggcaucagcucccaggggugcuaccucaacggccccuucaacagcaaccugcugaccauccccaagcagcgguccagcuccgugagccucacccaccacgucggccugcgccgggccggggugcuguccagccucagccccgugaacuccagcaaccacggcccggucuccacggggagccugaccaaccgcucccccaucgaguuccccgacaccgccgacuuccugaacaagcccagcgugauccuccagcgcucccugggcaacgccccgaacacccccgacuucuaccagcagcugcggaacagcgacuccaaccucugcaacagcugcggccaccagaugcugaaguacgucuccacgagcgaguccgacgggaccgacugcugcagcggcaaguccggggaggaggagaacaucuucagcaaggaguccuucaagcugauggagacccagcaggaggaggagaccgagaagaaggacagccgcaagcuguuccaggagggcgacaaguggcucacggaggaggcgcaguccgagcagcagaccaacaucgagcaggaggugagccuggaccucauccugguggaggaguacgacagccugaucgagaagauguccaacuggaacuuccccaucuucgagcucgucgagaagaugggggagaaguccggccggauccugagccaggugauguacacccuguuccaggacaccggccuccuggagaucuucaagauccccacgcagcaguucaugaacuacuuccgcgcccuggagaacggguaccgggacaucccguaccacaaccgcauccacgccaccgacgugcuccacgccgucugguaccugaccacccggcccgugcccggccugcagcagauccacaacgggugcggcacggggaacgagaccgacagcgacggccgcaucaaccacggccggaucgccuacaucuccagcaaguccugcagcaacccggacgaguccuacgggugccucagcuccaacauccccgcgcuggagcugauggcccucuacguggccgccgccaugcacgacuacgaccaccccggccgcaccaacgcguuccuggucgccaccaacgcgccccaggccgugcuguacaacgaccggagcgugcucgagaaccaccacgccgccuccgccuggaaccuguaccugagccgcccggaguacaacuuccuccugcaccuggaccacgucgaguucaagcgguuccgcuuccucgugaucgaggccauccuggccacggaccugaagaagcacuucgacuuccucgcggaguucaacgccaaggccaacgacgugaacuccaacgggaucgaguggagcaacgagaacgaccggcugcuggucugccaggugugcaucaagcucgccgacaucaacggccccgccaaggugcgcgaccugcaccugaaguggaccgaggggaucgucaacgaguucuacgagcagggcgacgaggaggcgaaccucggccugcccaucucccccuucauggaccggagcuccccgcagcuggccaagcuccaggagagcuucaucacccacaucguggggccccugugcaacagcuacgacgccgccggccugcuccccgggcaguggcuggaggccgaggaggacaacgacaccgaguccggcgacgacgaggacggggaggagcuggacacggaggacgaggagauggagaacaaccucaaccccaagccgccccgccgcaagagccggcggcgcaucuucugccagcugaugcaccaccugaccgagaaccacaagaucuggaaggagaucguggaggaggaggagaagugcaaggcggacggcaacaagcuccaggucgagaacuccagccugccccaggccgacgagauccaggugaucgaggaggccgacgaggaggaguga

SEQ ID NO: 34369 - RNA, 2661 nt, Artificial Sequence
  derived and/or modified sequence opt1 from PDE4A__Homo_sapiens__NP_001104777
auggagcccccgaccgugcccagcgagcgcucccugagccucucccugcccggcccccgggaggggcaggccacccugaagccgccgccccagcaccucuggcgccagccccggacgcccauccgcauccagcagcggggcuacagcgacuccgccgagcgcgcggagcgggagcgccagccccaccggcccaucgagcgcgccgacgccauggacaccagcgaccggcccgggcugcgcaccacccggauguccuggccgagcuccuuccacggcacggggaccggcagcggcggggccggcgggggcuccagccgccgguucgaggccgagaacgggcccacccccucccccggccgcagcccgcuggacucccaggcgagccccggccucguccugcacgccggggccgccaccucccagcggcgcgagagcuuccuguaccgguccgacagcgacuacgacaugagccccaagacgaugucccgcaacagcuccgugaccagcgaggcgcacgccgaggaccucaucgugacccccuucgcccagguccuggccucccugcggagcgugcgcuccaacuucagccuccugaccaacgugccgguccccuccaacaagcgcagcccccugggcgggcccacgccggugugcaaggccacccucuccgaggagaccugccagcagcuggcgcgggagacccuggaggagcucgacuggugccuggagcagcuggagacgaugcagaccuaccgcagcguguccgagauggccagccacaaguucaagcggaugcucaaccgcgagcugacccaccuguccgagaugagccgguccggcaaccaggucagcgaguacaucuccaccacguuccucgacaagcagaacgagguggagauccccagccccaccaugaaggagcgcgagaagcagcaggcgccccggccgcgccccagccagcccccgcccccgcccgugccccaccuccagcccaugucccagaucaccggccugaagaagcugaugcacagcaacucccugaacaacagcaacaucccccgguucggggucaagaccgaccaggaggagcugcucgcccaggagcuggagaaccugaacaaguggggccucaacaucuucugcguguccgacuacgccgggggccgcagccugacgugcaucauguacaugaucuuccaggagcgggaccugcucaagaaguuccgcauccccguggacaccauggucaccuacaugcugacccuggaggaccacuaccacgccgacguggccuaccacaacucccuccacgccgccgacgugcugcagagcacgcacguccugcucgccaccccggcgcuggacgccguguucaccgaccuggagauccucgccgcccuguucgccgcggccauccacgacguggaccaccccggggucuccaaccaguuccugaucaacaccaacagcgagcucgcccugauguacaacgacgaguccgugcuggagaaccaccaccuggccgugggcuucaagcuccugcaggaggacaacugcgacaucuuccagaaccugagcaagcggcagcgccagucccuccggaagauggucaucgacauggugcuggcgacggacaugagcaagcacaugacccugcucgccgaccugaagaccauggucgagaccaagaaggugacguccagcggcgugcugcuccuggacaacuacuccgaccgcauccagguccugcggaacauggugcacugcgccgaccucagcaaccccaccaagccccuggagcuguaccgccaguggaccgaccggaucauggccgaguucuuccagcagggggaccgcgagcgcgagcggggcauggagaucagcccgaugugcgacaagcacaccgccuccguggagaagucccaggucggguucaucgacuacaucgugcacccccucugggagaccugggcggaccuggugcaccccgacgcccaggagauccuggacacgcucgaggacaaccgcgacugguacuacagcgccauccggcagagccccuccccgccgcccgaggaggagagccgcggccccgggcacccgccccugcccgacaaguuccaguucgagcugacccucgaggaggaggaggaggaggagaucuccauggcccagauccccugcaccgcccaggaggcgcugaccgcccagggccugagcggcgucgaggaggcccucgacgccacgaucgccugggaggcgucccccgcccaggagagccuggaggugauggcccaggaggccucccuggaggcggagcucgaggccguguaccugacccagcaggcccagagcaccggguccgcccccgucgcccccgacgaguucagcucccgggaggaguucgugguggcggucagccacuccagcccguccgcccuggcccuccagagcccccugcugcccgccuggcgcacccucagcguguccgagcacgcccccggccugccggggcugcccagcacggcggccgagguggaggcccagcgggagcaccaggccgccaagcgcgcgugcuccgccugcgccggcaccuucggggaggacaccagcgcccuccccgcgcccggcggcgggggcuccgggggcgacccgaccuga

SEQ ID NO: 34370 - RNA, 2430 nt, Artificial Sequence
  derived and/or modified sequence opt1 from PDE4D__Homo_sapiens__NP_001098101
auggaggccgagggcagcuccgcccccgcgcgcgccgggagcggcgagggguccgacagcgccggcggggccacccugaaggccccgaagcaccucuggcggcacgagcagcaccaccaguacccccugcgccagccccaguuccggcugcuccacccccaccaccaccucccgcccccgcccccgcccagcccccagccccagccgcagugcccccugcagccgccgcccccgccgccccugcccccgccgccgcccccgcccggcgcggcccgcggccgguacgccuccuccggggccaccggccgcgugcggcaccgcggguacagcgacacggagcgguaccuguacugccgcgcgauggaccggaccuccuacgccgucgagaccggccaccgccccgggcugaagaagucccggauguccuggcccagcuccuuccagggccuccgccgguucgacguggacaacggcaccagcgccgggcgcagcccccuggaccccaugacgucccccggcuccgggcugauccuccaggccaacuucgugcacagccagcggcgcgaguccuuccuguaccggagcgacagcgacuacgaccugucccccaagagcaugucccgcaacagcuccaucgccagcgacauccacggcgacgaccucaucgucacccccuucgcccaggugcuggccucccugcggaccgugcgcaacaacuucgccgcccucaccaaccugcaggaccgcgcccccagcaagcggucccccaugugcaaccagcccagcaucaacaaggcgacgaucaccgaggaggcguaccagaagcucgccagcgagacccuggaggagcuggacuggugccuggaccagcucgagacccugcagacgcgccacagcgucuccgagauggccagcaacaaguucaagcggaugcugaaccgcgagcucacccaccuguccgagaugagccgguccggcaaccaggugagcgaguucaucuccaacaccuuccuggacaagcagcacgagguggagauccccagccccacccagaaggagaaggagaagaagaagcgccccaugagccagaucuccggggucaagaagcucaugcacagcuccagccugacgaacuccagcaucccccgguucggcgugaagaccgagcaggaggacgugcuggccaaggagcucgaggacgucaacaagugggggcugcacguguuccgcaucgcggagcuguccggcaaccggccccucaccgugaucaugcacaccaucuuccaggagcgcgaccugcugaagacguucaagauccccgucgacacccucaucaccuaccugaugacccuggaggaccacuaccacgccgacguggccuaccacaacaacauccacgccgccgacgugguccagagcacgcacgugcuccuguccacccccgcgcuggaggccguguucaccgaccucgagauccuggccgccaucuucgcgagcgccauccacgacgucgaccaccccgggguguccaaccaguuccugaucaacaccaacagcgagcucgcccugauguacaacgacuccagcgugcuggagaaccaccaccuggccgucggcuucaagcuccugcaggaggagaacugcgacaucuuccagaaccugacgaagaagcagcggcagucccuccgcaagauggugaucgacaucguccuggccaccgacaugagcaagcacaugaaccugcucgcggaccugaagaccaugguggagaccaagaaggugacguccagcggcguccugcuccuggacaacuacagcgaccggauccaggugcugcagaacauggugcacugcgccgaccucuccaaccccaccaagccccugcagcuguaccgccaguggaccgaccggaucauggaggaguucuuccgccagggggaccgggagcgcgagcggggcauggagaucagccccaugugcgacaagcacaacgccuccgucgagaagucccaggugggguucaucgacuacaucgugcacccccucugggagaccugggccgaccugguccaccccgacgcccaggacauccuggacacgcucgaggacaaccgcgagugguaccagagcaccaucccccagagcccgucccccgcgcccgacgaccccgaggagggccgccaggggcagaccgagaaguuccaguucgagcugacccuggaggaggacggcgagagcgacaccgagaaggacuccggcagccagguggaggaggacacguccugcagcgacuccaagacccucugcacccaggacagcgaguccaccgagaucccgcuggacgagcaggucgaggaggaggccgugggggaggaggaggagagccagcccgaggccugcgugaucgacgaccggucccccgacacguga

SEQ ID NO: 34371 - RNA, 2628 nt, Artificial Sequence
  derived and/or modified sequence opt1 from PDE5A__Homo_sapiens__NP_001074
auggagcgcgccggccccagcuucgggcagcagcggcagcagcagcagccgcagcagcagaagcagcagcagcgcgaccaggacuccguggaggccuggcuggacgaccacugggacuucaccuucagcuacuucguccggaaggcgacccgcgagauggugaacgccugguucgccgagcgggugcacacgauccccgucugcaaggagggcauccgcgggcacaccgaguccugcagcugcccccuccagcagagcccccgggccgacaacagcgccccgggcacccccacccgcaagaucuccgcgagcgaguucgaccggccccugcgccccaucguggugaaggacuccgaggggacggucagcuuccuguccgacagcgagaagaaggagcagaugccgcucaccccgccccgguucgaccacgacgagggcgaccagugcucccgccugcuggagcucgugaaggacaucagcucccaccuggacgugaccgcccugugccacaagaucuuccuccacauccacggccugaucagcgccgaccgguacucccuguuccucgucugcgaggacagcuccaacgacaaguuccugaucagccgccuguucgacguggccgaggggagcacccucgaggagguguccaacaacugcauccggcuggaguggaacaagggcaucgucgggcacguggcggcccugggcgagccccucaacaucaaggacgccuacgaggacccccgcuucaacgccgagguggaccagaucacgggguacaagacccagagcauccugugcaugcccaucaagaaccaccgggaggaggucgugggcguggcccaggcgaucaacaagaaguccggcaacgggggcaccuucaccgagaaggacgagaaggacuucgccgccuaccuggccuucugcgggaucguccuccacaacgcccagcuguacgagacgagccugcucgagaacaagcgcaaccaggugcugcuggaccucgcgucccugaucuucgaggagcagcagagccuggaggugauccucaagaagaucgccgccaccaucaucuccuucaugcagguccagaagugcaccaucuucaucguggacgaggacugcagcgacuccuucagcuccguguuccacauggagugcgaggagcuggagaaguccuccgacacccugacgcgggagcacgacgccaacaagaucaacuacauguacgcccaguacgucaagaacaccauggagccccucaacauccccgacgugagcaaggacaagcgcuucccguggaccaccgagaacacgggcaacgucaaccagcagugcauccggucccugcugugcacccccaucaagaacggcaagaagaacaaggugaucggggugugccagcucgucaacaagauggaggagaacaccggcaaggugaagcccuucaaccgcaacgacgagcaguuccuggaggcguucgugaucuucugcgggcugggcauccagaacacccagauguacgaggccgucgagcgcgccauggccaagcagauggugacgcucgaggugcugagcuaccacgccuccgcggccgaggaggagacccgggagcugcagagccucgccgccgcggucgugcccuccgcccagacccugaagaucaccgacuucagcuucagcgacuucgagcuguccgaccucgagacggcccugugcaccauccgcauguucaccgaccugaaccucgugcagaacuuccagaugaagcacgagguccugugccgguggauccugagcgugaagaagaacuaccgcaagaacguggccuaccacaacuggcggcacgccuucaacaccgcgcagugcauguucgccgcccugaaggccgggaagauccagaacaagcucacggaccuggagauccuggcccuccugaucgcggcccugucccacgaccucgaccaccgcggcgucaacaacagcuacauccagcgguccgagcacccgcuggcccagcuguacugccacagcaucauggagcaccaccacuucgaccagugccucaugauccugaacucccccggcaaccagauccugagcgggcucuccaucgaggaguacaagaccacccugaagaucaucaagcaggccauccuggccaccgaccucgcgcuguacaucaagcgccggggcgaguucuucgagcugauccgcaagaaccaguucaaccucgaggacccccaccagaaggagcuguuccuggccaugcucaugacggccugcgaccugagcgccaucaccaagcccuggccgauccagcagcggaucgcggagcugguggccaccgaguucuucgaccagggggaccgcgagcggaaggagcucaacaucgagcccaccgaccugaugaaccgcgagaagaagaacaagauccccuccaugcaggucggcuucaucgacgccaucugccugcagcucuacgaggcccugacccacgugagcgaggacugcuucccccugcucgacgggugccggaagaaccgccagaaguggcaggcccuggcggagcagcaggagaagaugcugaucaacggcgaguccggccaggccaagcggaacuga

SEQ ID NO: 34372 - RNA, 2583 nt, Artificial Sequence
  derived and/or modified sequence opt1 from PDE6A__Homo_sapiens__NP_000431
augggcgaggugaccgccgaggaggucgagaaguuccuggacagcaacaucggguucgccaagcaguacuacaaccuccacuaccgcgcgaagcugaucuccgaccugcucggcgccaaggaggccgccguggacuucagcaacuaccacucccccagcuccauggaggagagcgagaucaucuucgaccugcugcgggacuuccaggagaaccuccagaccgagaagugcaucuucaacgugaugaagaagcugugcuuccugcuccaggccgaccgcaugucccuguucauguaccggacgcgcaacgggaucgcggagcuggccacccgccucuucaacguccacaaggacgccgugcuggaggacugccuggugaugccggaccaggagaucgucuucccccucgacaugggcaucguggggcacguggcccacagcaagaagaucgcgaacguccccaacaccgaggaggacgagcacuucugcgacuucguggacauccugaccgaguacaagacgaagaacauccuggccucccccaucaugaacggcaaggacguggucgccaucaucauggccgugaacaagguggacggcagccacuucaccaagcgggacgaggagauccuccugaaguaccugaacuucgccaaccucaucaugaaggucuaccaccuguccuaccugcacaacugcgagacccggcgcgggcagauccuccuguggagcggcuccaagguguucgaggagcugaccgacaucgagcggcaguuccacaaggcgcucuacacggugcgcgccuuccugaacugcgaccgguacagcgucgggcugcucgacaugaccaagcagaaggaguucuucgacguguggccggugcugaugggcgaggucccgcccuacuccgggccccgcaccccggacggccgggagaucaacuucuacaaggugaucgacuacauccugcacggcaaggaggacaucaaggugauccccaacccgccgcccgaccacugggcccucgucagcgggcugcccgccuacguggcccagaacggccugaucugcaacaucaugaacgcgcccgccgaggacuucuucgccuuccagaaggagccccucgacgaguccggguggaugaucaagaacguccugagcaugcccaucgugaacaagaaggaggagaucgugggcgucgccaccuucuacaaccgcaaggacggcaagcccuucgacgagauggacgagacgcugauggagucccucacccaguuccugggguggagcgugcugaaccccgacaccuacgagagcaugaacaagcucgagaaccggaaggacaucuuccaggacaucgugaaguaccacgucaagugcgacaacgaggagauccagaagauccugaagacccgcgagguguacggcaaggagcccugggagugcgaggaggaggagcuggccgagauccuccaggcggagcugccggacgccgacaaguacgagaucaacaaguuccacuucuccgaccugccccucacggagcuggagcuggugaagugcgggauccagauguacuacgagcugaaggucguggacaaguuccacaucccccaggaggcccucgugcgguucauguacagccuguccaagggcuaccgcaagaucaccuaccacaacuggcggcacggguucaacgucggccagaccauguucagccugcucgugaccggcaagcugaagcgcuacuucacggaccuggaggcccucgccauggugaccgcggccuucugccacgacaucgaccaccgggggaccaacaaccuguaccagaugaagucccagaacccccuggccaagcuccacggcagcuccauccuggagcgccaccaccuggaguucgggaagacccuccugcgcgacgagagccugaacaucuuccagaaccucaaccggcgccagcacgagcacgccauccacaugauggacaucgcgaucaucgccacggaccuggcccuguacuucaagaagcggaccauguuccagaagaucgucgaccaguccaagaccuacgagagcgagcaggaguggacccaguacaugaugcucgagcagacgcgcaaggagaucgugauggccaugaugaugaccgccugcgaccuguccgcgaucaccaagccgugggaggugcagagccaggucgcccugcucguggccgccgaguucugggagcagggcgaccuggagcggaccgugcugcagcagaaccccauccccaugauggaccgcaacaaggccgacgagcuccccaagcugcaggucggguucaucgacuucgugugcacguucguguacaaggaguucucccgguuccacgaggagaucaccccgaugcuggacggcaucaccaacaaccgcaaggaguggaaggcgcucgccgacgaguacgacgccaagaugaagguccaggaggagaagaagcagaagcagcagagcgccaaguccgccgcggccggcaaccagcccgggggcaaccccagccccgggggcgccaccacguccaagagcugcugcauccaguga

SEQ ID NO: 34373 - RNA, 2565 nt, Artificial Sequence
  derived and/or modified sequence opt1 from PDE6B__Homo_sapiens__NP_000274
augagccuguccgaggagcaggcccgcagcuuccucgaccagaaccccgacuucgcccggcaguacuucggcaagaagcuguccccggagaacguggcggccgccugcgaggacgggugcccgcccgacugcgacagccugcgcgaccucugccaggucgaggaguccaccgcccugcuggagcucgugcaggacaugcaggagagcaucaacauggagcggguggucuucaaggugcugcgccggcugugcacccuccugcaggccgaccgcugcucccuguucauguaccggcagcgcaacggcguggcggagcucgccacccggcuguucagcguccagcccgacuccgugcuggaggacugccucgugccgcccgacagcgagaucgucuucccccuggacaucgggguggugggccacgucgcccagaccaagaagauggugaacguggaggacgucgccgagugcccccacuucuccagcuucgcggacgagcugaccgacuacaagaccaagaacaugcucgccacgcccaucaugaacgggaaggacgugguggccgucaucauggccgugaacaagcugaacggccccuucuucaccuccgaggacgaggacguguuccugaaguaccucaacuucgccacccuguaccugaagaucuaccaccucagcuaccugcacaacugcgagacccgccggggccagguccugcucugguccgcgaacaagguguucgaggagcugacggacaucgagcgccaguuccacaaggccuucuacaccgugcgggccuaccugaacugcgagcgcuacagcgucgggcuccuggacaugaccaaggagaaggaguucuucgacgugugguccguccugaugggcgagagccagcccuacuccgggccccggaccccggacggccgcgagaucguguucuacaaggugaucgacuacauccuccacgggaaggaggagaucaaggucauccccacgcccagcgccgaccacugggcccuggcgagcggccugcccuccuacguggccgagagcggcuucaucugcaacaucaugaacgccuccgccgacgagauguucaaguuccaggagggggcccucgacgacagcggcuggcugaucaagaacgugcuguccaugccgaucgucaacaagaaggaggagaucguggggguggcgaccuucuacaaccggaaggacggcaagcccuucgacgagcaggacgagguccucauggagagccugacccaguuccugggcugguccgugaugaacaccgacacguacgacaagaugaacaagcucgagaaccgcaaggacaucgcccaggacauggugcuguaccacgucaagugcgaccgggacgagauccagcugauccuccccacccgcgcccggcuggggaaggagcccgccgacugcgacgaggacgagcugggcgagauccucaaggaggagcugccggggcccaccaccuucgacaucuacgaguuccacuucagcgaccuggagugcacggagcuggaccucgugaagugcggcauccagauguacuacgagcugggggugguccgcaaguuccagaucccccaggaggugcuggugcgcuuccucuucuccaucagcaagggcuaccggcgcaucaccuaccacaacuggcggcacggcuucaacgucgcccagaccauguucacccugcugaugacggggaagcucaaguccuacuacaccgaccuggaggcguucgccauggugaccgccggccugugccacgacaucgaccaccgcgggaccaacaaccucuaccagaugaagucccagaacccccuggccaagcugcacggcagcagcauccucgagcggcaccaccuggaguucgggaaguuccugcucuccgaggagacgcugaacaucuaccagaaccugaaccgccggcagcacgagcacgugauccaccucauggacaucgcgaucaucgccaccgaccuggcccuguacuucaagaagcgcgccauguuccagaagaucgucgacgagagcaagaacuaccaggacaagaaguccuggguggaguaccucagccuggagaccacccggaaggagaucgugauggccaugaugaugacggcgugcgaccuguccgccaucaccaagccgugggagguccagagcaagguggcccuccugguggccgccgaguucugggagcagggcgaccuggagcgcaccguccucgaccagcagcccauccccaugauggaccggaacaaggcggccgagcugcccaagcuccaggugggcuucaucgacuucgugugcaccuucgucuacaaggaguucagccgcuuccacgaggagauccugccgauguucgaccggcugcagaacaaccgcaaggaguggaaggcccuggccgacgaguacgaggccaaggugaaggcgcucgaggagaaggaggaggaggagcggguggccgccaagaaggucgggacggagaucugcaacggcgggcccgcccccaaguccagcacgugcugcauccuguga

SEQ ID NO: 34374 - RNA, 2577 nt, Artificial Sequence
  derived and/or modified sequence opt1 from PDE6C__Homo_sapiens__NP_006195
augggcgagaucaaccagguggccgucgagaaguaccuggaggagaacccccaguucgccaaggaguacuucgaccgcaagcuccggguggaggugcugggggagaucuucaagaacagccaggucccggugcaguccagcauguccuucagcgagcugacccagguggaggaguccgcgcucugccuggagcugcucuggaccguccaggaggagggcgggacgcccgagcagggcgugcaccgcgcccugcagcggcuggcccaccuccugcaggccgaccgcugcagcauguuccugugccggucccgcaacgggauccccgagguggccagccggcuccuggacgucacccccaccuccaaguucgaggacaaccuggugggcccggacaaggagguggucuucccccucgacaucggcaucguggggugggcggcccacaccaagaagacgcacaacgugcccgacgucaagaagaacagccacuucuccgacuucauggacaagcagaccggcuacgugaccaagaaccugcuggccacccccaucguggucgggaaggaggugcucgccgugaucauggcggucaacaaggugaacgccagcgaguucuccaagcaggacgaggagguguucagcaaguaccugaacuucgucuccaucauccugcgccuccaccacacgagcuacauguacaacaucgagucccggcgcagccagauccugaugugguccgccaacaagguguucgaggagcugaccgacgucgagcggcaguuccacaaggcccucuacaccgugcgcagcuaccugaacugcgagcgguacagcaucggccugcucgacaugaccaaggagaaggaguucuacgacgaguggccgaucaagcugggggagguggagcccuacaagggccccaagacgcccgacggccgcgaggucaacuucuacaagaucaucgacuacauccugcacgggaaggaggagaucaaggugaucccgaccccgcccgccgaccacuggacccucaucuccggccugcccaccuacguggcggagaacggguucaucugcaacaugaugaacgcccccgccgacgaguacuucacguuccagaagggccccgucgacgagaccggcugggugaucaagaacgugcugagccuccccaucgucaacaagaaggaggacaucguggggguggccaccuucuacaaccggaaggacggcaagcccuucgacgagcacgacgaguacaucaccgagacgcugacccaguuccugggguggucccuccugaacaccgacaccuacgacaagaugaacaagcuggagaaccgcaaggacaucgcccaggagaugcucaugaaccagacgaaggcgaccccggaggagaucaagagcauccugaaguuccaggagaagcugaacgucgacgugaucgacgacugcgaggagaagcagcucguggccauccugaaggaggaccugcccgacccccgguccgccgagcucuacgaguuccgcuucagcgacuucccccugaccgagcacggccugaucaagugcgggauccggcuguucuucgagaucaacgucguggagaaguucaaggugccggucgaggugcugacccgcuggauguacacggugcggaagggcuaccgcgccgucaccuaccacaacuggcgccacggcuucaacguggggcagaccauguucacccugcugaugacgggccggcucaagaaguacuacaccgaccuggaggccuucgcgaugcuggccgccgccuucugccacgacaucgaccaccgcgggaccaacaaccucuaccagaugaaguccaccagcccccuggcccggcugcacggcuccagcauccucgagcgccaccaccuggaguacuccaagacgcugcuccaggacgagagccugaacaucuuccagaaccugaacaagcggcaguucgagaccgugauccaccucuucgaggucgcgaucaucgccaccgaccuggcccuguacuucaagaagcgcaccauguuccagaagaucguggacgccugcgagcagaugcagaccgaggaggaggcgaucaaguacgugacggucgaccccaccaagaaggagaucaucauggccaugaugaugaccgccugcgaccucuccgccaucaccaagcccugggaggugcagagccagguggcccugauggucgcgaacgaguucugggagcagggggaccuggagcggacggugcuccagcagcagccgauccccaugauggaccgcaacaagcgggacgagcugcccaagcuccaggugggcuucaucgacuucgucugcaccuucguguacaaggaguucucccgcuuccacaaggagaucaccccgaugcucagcggccugcagaacaaccggguggaguggaagucccuggccgacgaguacgacgccaagaugaaggucaucgaggaggaggccaagaagcaggagggcggggccgagaaggcggccgaggacagcgggggcggggacgacaagaaguccaagaccugccucaugcuguga

SEQ ID NO: 34375 - RNA, 453 nt, Artificial Sequence
  derived and/or modified sequence opt1 from PDE6D__Homo_sapiens__NP_002592
augagcgccaaggacgagcgcgcccgggagauccugcgcggcuucaagcucaacuggaugaaccugcgggacgcggagaccgggaagauccuguggcagggcaccgaggaccucuccgugcccggggucgagcacgaggcccgcgugccgaagaagauccugaagugcaaggccgugagccgggagcugaacuucuccagcacggagcagauggagaaguuccgccucgagcagaaggucuacuucaagggccagugccuggaggagugguucuucgaguucggguucgugauccccaacuccaccaacaccuggcagagccugaucgaggccgcccccgagucccagaugaugcccgcgagcgugcucaccggcaacgucaucaucgagacgaaguucuucgacgacgaccugcugguguccaccagccgggugcgccucuucuacgucuga

SEQ ID NO: 34376 - RNA, 264 nt, Artificial Sequence
  derived and/or modified sequence opt1 from PDE6G__Homo_sapiens__NP_002593
augaaccuggagcccccgaaggccgaguuccgcagcgccacccggguggcgggcgggcccgucacgccccgcaaggggcccccgaaguucaagcagcggcagacccgccaguucaaguccaagccgcccaagaagggcgugcagggcuucggggacgacauccccggcauggagggccucgggaccgacaucaccgugaucugccccugggaggccuucaaccaccuggagcugcacgagcucgcccaguacggcaucaucuga

SEQ ID NO: 34377 - RNA, 252 nt, Artificial Sequence
  derived and/or modified sequence opt1 from PDE6H__Homo_sapiens__NP_006196
augagcgacaacaccacccugcccgccccggccuccaaccagggccccacgacgccccgcaaggggcccccgaaguucaagcagcggcagacccgccaguucaagagcaagccgcccaagaagggcgugaagggguucggcgacgacauccccgggauggagggccucggcaccgacaucaccgucaucugccccugggaggcguucucccaccuggagcugcacgagcucgcccaguucgggaucaucuga

SEQ ID NO: 34378 - RNA, 1449 nt, Artificial Sequence
  derived and/or modified sequence opt1 from PDE7A__Homo_sapiens__NP_001229247
auggaggugugcuaccagcugcccguccucccgcuggaccgccccgugccccagcacgugcugagccggcgcggcgccaucuccuucagcuccagcuccgcccucuucgggugccccaacccgcggcagcugagccagcgccggggcgcgaucuccuacgacagcuccgaccagaccgcccuguacauccgcaugcucggggacguccgggugcgcagccgggccggcuucgaguccgagcgccgggggagccaccccuacaucgacuuccgcaucuuccacucccagagcgagaucgagguguccgucagcgcccggaacauccgccggcugcuguccuuccagcgcuaccuccggagcucccgcuucuuccggggcaccgccgugagcaacagccugaacauccuggacgacgacuacaacggccaggcgaagugcaugcucgagaagguggggaacuggaacuucgacaucuuccuguucgaccgccugacgaacggcaacucccucgucagccugaccuuccaccuguucucccuccacgggcugaucgaguacuuccaccuggacaugaugaagcuccggcgcuuccuggugaugauccaggaggacuaccacagccagaaccccuaccacaacgccgugcacgccgccgacgucacccaggcgaugcacugcuaccugaaggagcccaagcucgccaacuccgugaccccgugggacauccugcugagccucaucgccgccgccacgcacgaccuggaccaccccggcgugaaccagcccuuccugaucaagaccaaccacuaccucgcgacccuguacaagaacaccuccguccuggagaaccaccacuggcgcagcgccguggggcuccugcgggaguccggccuguucagccaccucccccuggagucccgccagcagauggagacgcagaucggcgcccugauccucgccaccgacaucagccggcagaacgaguaccugucccuguuccgcagccaccucgaccgcggggaccugugccuggaggacacccggcaccggcaccucgugcugcagauggcccugaagugcgcggacaucugcaacccgugccgcaccugggagcucuccaagcaguggagcgagaaggucacggaggaguucuuccaccagggcgacaucgagaagaaguaccaccugggggugagcccccugugcgaccggcacaccgaguccaucgccaacauccagaucggcuucaugaccuaccugguggagccccucuucaccgagugggcccgcuucuccaacacgcggcugagccagaccaugcugggccacgucgggcucaacaaggccagcuggaagggccugcagcgcgagcaguccagcuccgaggacaccgacgccgcguucgagcugaacagccagcuccugccccaggagaaccggcuguccuga

SEQ ID NO: 34379 - RNA, 1353 nt, Artificial Sequence
  derived and/or modified sequence opt1 from PDE7B__Homo_sapiens__NP_061818
augagcugccugaugguggagcgcugcggcgagauccucuucgagaaccccgaccagaacgccaagugcgucugcaugcugggggacauccggcugcgcggccagaccggggugcgggccgagcgccggggcuccuacccguucaucgacuuccgccuccugaacagcaccacguacuccggggagaucggcaccaagaagaaggugaagcggcugcucagcuuccagcgcuacuuccacgcgucccggcugcugcgcggcaucaucccccaggccccgcuccaccuccuggacgaggacuaccuggggcaggcccggcacaugcugagcaaggucggcaugugggacuucgacaucuuccuguucgaccgccucaccaacgggaacucccuggugacccugcucugccaccuguucaacacgcacggccugauccaccacuucaagcucgacauggugacccugcaccgguuccuggucauggugcaggaggacuaccacagccagaaccccuaccacaacgccgugcacgccgcggacgucacccaggccaugcacugcuaccucaaggagccgaagcuggccuccuuccugacgccccucgacaucaugcuggggcugcucgccgcggccgcccacgacguggaccaccccggcgugaaccagcccuuccugaucaagaccaaccaccaccuggccaaccucuaccagaacaugagcguccuggagaaccaccacuggcgcuccaccaucggcaugcugcgggagagccgccuccuggcccaccucccgaaggagaugacccaggacaucgagcagcagcuggggucccugauccuggcgaccgacaucaaccggcagaacgaguuccucacgcgccugaaggcccaccuccacaacaaggaccugcggcuggaggacgcccaggaccgccacuucaugcugcagaucgcccucaagugcgccgacaucugcaaccccugccggaucugggagaugagcaagcagugguccgagcgcgugugcgaggaguucuaccgccagggcgagcuggagcagaaguucgagcuggagaucagcccccugugcaaccagcagaaggacuccauccccagcauccagaucggguucauguccuacaucguggagccccucuuccgggagugggcgcacuucaccggcaacagcacccugagcgagaacaugcugggccaccucgcccacaacaaggcccaguggaagucccugcugccccgccagcaccggagccgcggguccagcggcuccgggcccgaccacgaccacgccggccaggggaccgagagcgaggagcaggagggcgacucccccuga

SEQ ID NO: 34380 - RNA, 2490 nt, Artificial Sequence
  derived and/or modified sequence opt1 from PDE8A__Homo_sapiens__NP_002596
augggcugcgcccccagcauccacaucuccgagcgccugguggccgaggacgcgccgagccccgccgccccgccccucuccagcgggggcccccggcugccccaggggcagaagaccgccgcccugccccgcacccggggcgcggggcuccuggaguccgagcugcgcgacggcagcggcaagaaggucgccguggccgacgugcaguucgggcccaugcgguuccaccaggaccagcuccagguccugcugguguucacgaaggaggacaaccagugcaacggcuucugccgcgccugcgagaaggcgggguucaagugcaccgugaccaaggaggcccaggccguccucgccugcuuccuggacaagcaccacgacaucaucaucaucgaccaccggaacccgcgccagcuggacgccgaggcgcucugccgguccauccgcagcuccaagcugagcgagaacaccgugaucgugggcgucgugcggcgcguggaccgggaggagcuguccgucaugcccuucaucagcgccggguucacgcgccgguacguggagaaccccaacaucauggccugcuacaacgagcuccugcagcuggaguucggcgaggugcgcucccagcucaagcugcgggccugcaacagcgucuucaccgcccuggagaacuccgaggacgcgaucgagaucaccagcgaggaccgcuucauccaguacgccaaccccgccuucgagaccacgaugggcuaccaguccggggagcucaucggcaaggagcugggggaggugccgaucaacgagaagaaggccgaccugcucgacaccaucaacagcugcauccggaucggcaaggaguggcagggcaucuacuacgccaagaagaagaacggggacaacauccagcagaacgugaagaucauccccgucaucggccagggcgggaagauccgccacuacguguccaucauccgggugugcaacgggaacaacaaggcggagaagaucagcgagugcguccagagcgacacccacaccgacaaccagacgggcaagcacaaggaccgccgcaagggcucccuggacgugaaggccguggccagccgggccaccgaggucuccagccagcgccggcacuccagcauggcccgcauccacuccaugaccaucgaggcgcccaucaccaaggugaucaacaucaucaacgccgcccaggagagcucccccaugccggucacggaggcccuggaccgggugcucgagauccugcgcaccaccgagcuguacagcccccaguucggggcgaaggacgacgacccccacgccaacgaccucgugggcgggcugauguccgacggccugcggcgccucagcgggaacgaguacguccuguccaccaagaacacgcagauggugagcuccaacaucaucacccccaucagccuggacgacgugccgccccggaucgcccgcgccauggagaacgaggaguacugggacuucgacaucuucgagcucgaggccgcgacccacaaccggccccugaucuaccugggccucaagauguucgcccgcuucggcaucugcgaguuccugcacugcuccgagagcacccugcgguccuggcuccagaucaucgaggccaacuaccacagcagcaaccccuaccacaacuccacgcacagcgccgacguccugcacgccaccgcguacuuccuguccaaggagcgcaucaaggagacccucgacccgaucgacgagguggccgcccugaucgccgccaccauccacgacguggaccaccccgggcggacgaacagcuuccugugcaacgcgggcuccgagcucgccauccuguacaacgacaccgccguccuggagagccaccacgccgcgcuggccuuccagcucaccaccggggacgacaagugcaacaucuucaagaacauggagcgcaacgacuaccggacgcugcgccagggcaucaucgacauggugcuggccaccgagaugaccaagcacuucgagcacgugaacaaguucgucaacuccaucaacaagccccucgccacccuggaggagaacggggagacggacaagaaccaggaggugaucaacaccaugcugcggacccccgagaaccgcacccucaucaagcgcaugcugaucaagugcgccgacgugagcaacccgugccggccccugcaguacugcaucgagugggcggcccgcaucuccgaggaguacuucagccagaccgacgaggagaagcagcagggccuccccgucgugaugccgguguucgaccggaacacgugcuccauccccaagagccagaucuccuucaucgacuacuucaucaccgacauguucgacgccugggacgccuucgucgaccugcccgaccugaugcagcaccucgacaacaacuucaaguacuggaagggccuggacgagaugaagcugcgcaaccuccggcccccgcccgaguga

SEQ ID NO: 34381 - RNA, 2367 nt, Artificial Sequence
  derived and/or modified sequence opt1 from PDE8B__Homo_sapiens__NP_001025022
augggcugcgcccccagcauccacgugucccagagcggggucaucuacugccgcgacuccgacgagagcuccagcccgcggcagaccaccuccgugagccagggccccgccgcgccccugcccgggcuguucgugcagacggacgccgccgacgccaucccgcccucccgcgccagcggcccgcccuccgucgcgcgggugcgccgggcccgcaccgagcuggggagcggcuccagcgccggcuccgccgcgcccgccgccaccaccagccgggggcgccggcgccacugcugcuccagcgccgaggccgagacgcagaccugcuacaccuccgugaagcaggucagcagcgcggaggugcggaucggccccaugcgccugacccaggaccccauccaggugcuccugaucuucgccaaggaggacucccagagcgacggguucuggugggccugcgaccgggccggcuaccgcugcaacaucgcccggacgcccgaguccgcgcuggagugcuuccucgacaagcaccacgagaucaucgucaucgaccaccgccagacccagaacuucgacgccgaggccgugugccggagcauccgcgccaccaacccguccgagcacaccgugauccuggccgucgugagccggguguccgacgaccacgaggaggcgagcguccugccccuccugcacgccggguucaaccgccgguucauggagaacuccagcaucaucgccugcuacaacgagcugauccagaucgagcacggcgaggugcgcucccaguucaagcuccgcgccugcaacagcguguucacggcccuggaccacugccacgaggcgaucgagaucaccuccgacgaccacgucauccagauccacaagauccaccgggacagcggcgacaacucccagaccgagccccacagcuuccgcuacaagaaccggcgcaaggaguccaucgacgugaaguccaucuccagccgggggagcgacgcccccucccugcagaaccgccgguacccgagcauggcccgcauccacuccaugaccaucgaggcccccaucacgaaggugaucaacaucaucaacgcggcccaggagaacagccccgucaccguggccgaggcccucgaccgggugcuggagauccugcgcaccaccgagcucuacagcccccagcugggcacgaaggacgaggacccgcacaccagcgaccuggucgggggccucaugaccgacggccugcggcgccuguccgggaacgaguacguguucaccaagaacguccaccagagccacucccaccucgccaugcccaucacgaucaacgacgugccgcccugcaucagccagcugcuggacaacgaggaguccugggacuucaacaucuucgagcucgaggcgaucacccacaagcggccccugguguaccugggccucaaggucuucagccgcuucggggugugcgaguuccugaacugcuccgagaccacccugcgggccugguuccaggugaucgaggccaacuaccacagcuccaacgccuaccacaacagcacgcacgccgcggacguccuccacgccaccgccuucuuccugggcaaggagcgcgugaaggggucccuggaccagcucgacgagguggccgcccugaucgcggccaccguccacgacguggaccaccccggccggaccaacagcuuccugugcaacgccggcagcgagcucgccgugcuguacaacgacacggcgguccuggagucccaccacaccgcccucgccuuccagcugaccgugaaggacaccaagugcaacaucuucaagaacaucgaccgcaaccacuaccggacgcugcgccaggccaucaucgacauggugcucgccaccgagaugaccaagcacuucgagcacgucaacaaguucgugaacagcaucaacaagcccauggcggccgagaucgagggguccgacugcgagugcaaccccgccggcaagaacuucccggagaaccagauccugaucaagcgcaugaugaucaagugcgccgacguggccaaccccugccggccccuggaccucugcaucgagugggcggggcgcaucagcgaggaguacuucgcccagaccgacgaggagaagcggcagggccugccggucgugaugcccguguucgaccgcaacacgugcuccauccccaagagccagaucuccuucaucgacuacuucaucaccgacauguucgacgccugggacgccuucgcccaccuccccgcgcugaugcagcaccucgccgacaacuacaagcacuggaagacccuggacgaccugaagugcaagagccuccggcugccguccgacagcuga

SEQ ID NO: 34382 - RNA, 1602 nt, Artificial Sequence
  derived and/or modified sequence opt1 from PDE9A__Homo_sapiens__NP_001001567
augggcagcggguccagcuccuaccgccccaaggccaucuaccuggacaucgacggccggauccagaaggugaucuucagcaaguacugcaacuccagcgacaucauggaccucuucugcaucgccaccgggcugccgcgcaacaccacgaucucccugcucaccaccgacgacgcgauggucagcaucgaccccaccaugcccgccaacuccgagcggacgcccuacaaggugcgcccgguggccaucaagcagcugagcgagcgggaggagcugauccaguccguccucgcccagguggccgagcaguucagccgcgcguucaagaucaacgagcugaaggccgagguggccaaccaccuggccguccucgagaagcggguggagcuggagggccugaagguggucgagaucgagaagugcaaguccgacaucaagaagaugcgcgaggagcucgcggcccggagcucccgcaccaacugccccugcaaguacagcuuccuggacaaccacaagaagcugacgccccggcgcgacgugcccaccuacccgaaguaccuccugucccccgagaccaucgaggcccugcggaagcccaccuucgacguguggcucugggagcccaacgagaugcugagcugccuggagcacauguaccacgaccucgggcugguccgcgacuucuccaucaacccggugacccugcggcgcuggcuguucugcgugcacgacaacuaccggaacaaccccuuccacaacuuccgccacugcuucugcgucgcccagaugauguacagcaugguguggcucugcagccugcaggagaaguucucccagaccgacauccucauccugaugacggccgcgaucugccacgaccuggaccaccccggcuacaacaacaccuaccagaucaacgcccggaccgagcucgccgugcgcuacaacgacaucagcccccuggagaaccaccacugcgccgucgccuuccagauccuggcggagccggagugcaacaucuucuccaacaucccgcccgacggcuucaagcagauccggcaggggaugaucacccucauccuggccacggacauggcccgccacgccgagaucauggacagcuucaaggagaagauggagaacuucgacuacuccaacgaggagcacaugacccugcucaagaugauccugaucaagugcugcgacaucagcaacgaggugcgccccauggagguggccgagcccugggucgacugccugcucgaggaguacuucaugcaguccgaccgggagaaguccgagggccugcccguggcgcccuucauggaccgcgacaaggugaccaaggccaccgcccagaucggguucaucaaguucguccugauccccauguucgagacggugaccaagcuguucccgauggucgaggagaucaugcuccagccccugugggagagccgggaccgcuacgaggagcucaagcggaucgacgacgccaugaaggagcugcagaagaagaccgacagccugaccuccggcgccacggagaagucccgcgagcggagccgcgacgugaagaacagcgagggggacugcgcguga

SEQ ID NO: 34383 - RNA, 732 nt, Artificial Sequence
  derived and/or modified sequence opt1 from PDF__Homo_sapiens__NP_071736
auggcccgccuguggggcgcccugagccuguggccccugugggcggccgugccguggggcggcgccgccgccgucggggugcgggcgugcuccagcaccgccgcccccgacggcguggaggggcccgcccuccgccgguccuacuggcgccaccuccggcgccugguccuggggcccccggagccgcccuucagccacgugugccaggugggcgaccccguccugcgcgggguggcggcccccguggagcgggcccagcugggcgggcccgagcuccagcggcugacccagcgccugguccaggugaugcggcgccggcgcugcgugggccucuccgcgccccagcugggggucccccgccaggugcuggcccucgagcugccggaggcccugugccgggagugcccgccccggcagcgcgcccuccggcagauggagcccuucccccugcgcguguucgucaaccccagccugcgggugcucgacucccgccuggugacguuccccgagggcugcgagagcgucgccggcuuccuggccugcgugccccgcuuccaggccgugcagaucuccgggcucgacccgaacggcgagcaggucguguggcaggcgagcgggugggccgcccggaucauccagcacgagauggaccaccuccagggcugccuguucaucgacaagauggacucccgcaccuucaccaacguguacuggaugaaggucaacgacuga

SEQ ID NO: 34384 - RNA, 636 nt, Artificial Sequence
  derived and/or modified sequence opt1 from PDGFA__Homo_sapiens__NP_002598
augcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccuga

SEQ ID NO: 34385 - RNA, 726 nt, Artificial Sequence
  derived and/or modified sequence opt1 from PDGFB__Homo_sapiens__NP_002599
augaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccuga

SEQ ID NO: 34386 - RNA, 1038 nt, Artificial Sequence
  derived and/or modified sequence opt1 from PDGFC__Homo_sapiens__NP_057289
augagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcggguga

SEQ ID NO: 34387 - RNA, 1113 nt, Artificial Sequence
  derived and/or modified sequence opt1 from PDGFD__Homo_sapiens__NP_079484
augcaccgccugaucuucguguacacccucaucugcgccaacuucugcagcugccgggacaccuccgccacgccccagagcgcguccaucaaggcccugcgcaacgccaaccugcggcgcgacgagagcaaccaccucaccgaccuguaccggcgcgacgagaccauccaggucaagggcaacggguacgugcagagcccccgguuccccaacuccuacccccgcaaccugcuccugaccuggcggcugcacucccaggagaacacccgcauccagcucguguucgacaaccaguucggccuggaggaggccgagaacgacaucugccgguacgacuucgucgagguggaggacaucagcgagaccuccaccaucauccgcgggcgguggugcggccacaaggaggugcccccgcgcaucaagagccggaccaaccagaucaagaucaccuucaaguccgacgacuacuucgucgccaagcccggguucaagaucuacuacagccugcucgaggacuuccagcccgcggccgccuccgagaccaacugggagagcgugaccuccagcaucuccggcgugagcuacaacucccccagcgucaccgacccgacgcugaucgccgacgcgcuggacaagaagaucgccgaguucgacaccguggaggaccuccugaaguacuucaaccccgagagcuggcaggaggaccuggagaacauguaccucgacacgccccgcuaccggggccgcuccuaccacgaccgcaagagcaagguggaccuggaccggcugaacgacgacgccaagcgguacuccugcacgccccgcaacuacagcgucaacauccgcgaggagcucaagcuggccaacgugguguucuucccgcggugccugcucguccagcgcugcgggggcaacugcgggugcggcaccgugaacuggcgguccugcacgugcaacagcgggaagaccgugaagaaguaccacgagguccugcaguucgagcccggccacaucaagcgccggggccgcgccaagaccauggcgcugguggacauccagcucgaccaccacgagcggugcgacugcaucugcuccagccgcccgccccgguga

SEQ ID NO: 34388 - RNA, 3345 nt, Artificial Sequence
  derived and/or modified sequence opt1 from PDGFRA__Homo_sapiens__XP_006714102
augcugccccgccucgugcugaacagcugggcccagaugaucugccugccgcagcuccccaaguucccccgggccaugggcaccucccaccccgcguuccugguccuggggugccuccugaccggccugagccucauccugugccagcugucccucccgagcauccugcccaacgagaacgagaagguggugcagcugaacuccagcuucucccuccgcugcuucggggagagcgaggucuccuggcaguaccccaugagcgaggaggaguccagcgacguggagauccggaacgaggagaacaacuccggccuguucgugacgguccuggaggugagcuccgccagcgccgcccacaccgggcucuacacgugcuacuacaaccacacccagaccgaggagaacgagcuggagggccgccacaucuacaucuacgugcccgacccggacgucgccuucgugccccugggcaugaccgacuaccucgugaucgucgaggacgacgacuccgcgaucauccccugccggaccaccgaccccgagacgccggugacccugcacaacagcgagggggugguccccgccuccuacgacagccgccagggcuucaacgggaccuucaccgugggccccuacaucugcgaggccacggugaaggggaagaaguuccagaccauccccuucaacgucuacgcccugaaggcgaccagcgagcucgaccuggagauggaggcccugaagaccguguacaaguccggcgagacgaucguggugaccugcgccgucuucaacaacgagguggucgaccuccaguggaccuacccgggcgaggugaaggggaagggcaucaccaugcuggaggagaucaagguccccagcaucaagcugguguacacgcucaccgugcccgaggccaccgucaaggacuccggggacuacgagugcgccgcgcggcaggccacccgcgaggugaaggagaugaagaaggugacgaucagcguccacgagaagggcuucaucgagaucaagcccaccuucucccagcuggaggccgugaaccugcacgaggugaagcacuucgucguggaggugcgggccuacccgccgccccgcaucagcuggcucaagaacaaccugacccugaucgagaaccucaccgagaucacgaccgacgucgagaagauccaggagauccgguaccgcuccaagcugaagcugauccgggccaaggaggaggacagcggccacuacaccaucguggcgcagaacgaggacgccgugaaguccuacaccuucgagcuccugacgcagguccccagcuccauccuggaccucguggacgaccaccacgggagcaccggcgggcagaccgugcgcugcaccgccgagggcacgccccugcccgacaucgaguggaugaucugcaaggacaucaagaagugcaacaacgagaccuccuggaccauccuggccaacaacgucagcaacaucaucaccgagauccacucccgggaccgcagcaccguggaggggcgggugacguucgccaaggucgaggagaccaucgcggugcgcugccucgccaagaaccugcugggcgccgagaaccgggagcucaagcugguggcccccacccugcgcuccgagcugaccgucgccgcggccgugcucgugcugcuggucaucgugaucaucagccucaucgugcuggucgugaucuggaagcagaagccccgguacgagauccgcuggcgcgugaucgaguccaucagcccggacggccacgaguacaucuacgucgaccccaugcagcugcccuacgacagccggugggaguucccgcgcgacgggcucgugcugggccgggugcugggguccggcgccuucgggaaggucguggagggcacggccuacggccucagccgcucccagcccgugaugaaggucgcggugaagaugcugaagcccaccgcccggagcuccgagaagcaggcccugaugagcgagcucaagaucaugacccaccuggggccccaccugaacaucgugaaccuccugggcgccugcaccaaguccgggccgaucuacaucaucacggaguacugcuucuacggcgaccuggucaacuaccuccacaagaaccgcgacagcuuccugucccaccaccccgagaagcccaagaaggagcuggacaucuucgggcucaaccccgccgacgagagcacccgguccuacgugauccugagcuucgagaacaacggcgacuacauggacaugaagcaggcggacaccacccaguacgugccgaugcuggagcgcaaggaggucuccaaguacagcgacauccagcggucccucuacgaccgccccgccagcuacaagaagaaguccaugcuggacagcgaggugaagaaccugcucagcgacgacaacuccgagggccugacgcugcucgaccugcugagcuucaccuaccagguggcccgggggauggaguuccucgccuccaagaacugcguccaccgcgaccuggccgcgcggaacgugcugcucgcccagggcaagaucgugaagaucugcgacuucgggcuggcccgcgacaucaugcacgacagcaacuacgucuccaagggcagcaccuuccugcccgugaaguggauggcccccgaguccaucuucgacaaccucuacaccacgcugagcgacgucugguccuacggcauccugcucugggagaucuucagccucgggggcaccccguaccccgggaugaugguggacuccaccuucuacaacaagaucaagagcggcuaccggauggccaagcccgaccacgcgaccuccgagguguacgagaucauggucaagugcuggaacagcgagcccgagaagcgcccguccuucuaccaccugagcgagaucguggagaaccugcugcccgggcaguacaagaaguccuacgagaagauccaccuggacuuccucaagagcgaccaccccgccguggcccggaugcgcgucgacuccgacaacgccuacaucggcgugacguacaagaacgaggaggacaagcugaaggacugggagggcgggcuggacgagcagcggcucagcgcggacagcggcuacaucaucccccugccggacaucgaccccgugcccgaggaggaggaccuggggaagcgcaaccgccacuccagccagaccuccgaggagagcgccaucgagaccggcuccagcuccagcaccuucaucaagcgggaggacgagacgaucgaggacaucgacaugauggacgacaucgggaucgacuccagcgaccucgucgaggacuccuuccuguga

SEQ ID NO: 34389 - RNA, 3321 nt, Artificial Sequence
  derived and/or modified sequence opt1 from PDGFRB__Homo_sapiens__NP_002600
augcgccugcccggcgccaugccggcccucgcgcugaagggggagcugcuccugcugagccuccugcugcuccuggagccccagaucucccagggccugguggucaccccgcccgggcccgagcucgugcugaacgugagcuccaccuucguccugacgugcagcggcuccgcccccguggugugggagcggaugagccaggagccgccccaggagauggccaaggcccaggacgggaccuucuccagcguccucacccugaccaaccugacgggccucgacaccggcgaguacuucugcacccacaacgacucccgcgggcuggagaccgacgagcggaagcgccuguacaucuucgugcccgaccccacggugggcuuccuccccaacgacgccgaggagcuguucaucuuccugaccgagaucaccgagaucaccauccccugccgggucacggacccgcagcucguggugacccugcacgagaagaagggggacgucgcgcugcccgugcccuacgaccaccagcgcggcuucagcgggaucuucgaggaccgguccuacaucugcaagaccaccaucggcgaccgcgagguggacagcgacgccuacuacgucuaccggcuccagguguccagcaucaacguguccgucaacgccgugcagacggugguccgccagggcgagaacaucacccugaugugcaucgugaucgggaacgagguggucaacuucgaguggaccuacccccggaaggagagcggccgccugguggagccggucaccgacuuccuccuggacaugcccuaccacauccgguccauccugcacauccccagcgccgagcucgaggacuccgggacguacacgugcaacgugaccgagagcgugaacgaccaccaggacgagaaggcgaucaacaucaccgucguggagagcggcuacgugcgccugcugggcgaggucgggacccuccaguucgccgagcugcaccggucccgcacccuccaggugguguucgaggccuacccgccgcccaccguccugugguucaaggacaaccggacccugggcgacagcuccgccggggagaucgcccugagcacgcgcaacguguccgagacccgguacgugagcgagcucacccugguccgcgugaagguggcggaggccggccacuacaccaugcgggccuuccacgaggacgccgagguccagcuguccuuccagcuccagaucaacgugcccgugcgcguccuggagcugagcgagucccaccccgacagcggggagcagacggugcgcugccggggccgcggcaugccccagcccaacaucaucugguccgccugccgggaccucaagcgcugcccccgggagcugcccccgacccugcuggggaacagcuccgaggaggagagccagcucgagaccaacgugaccuacugggaggaggagcaggaguucgaggucguguccacgcugcgccugcagcacguggaccggccccucagcguccgcugcacccugcggaacgcggugggccaggacacccaggaggugaucgucgugccccacucccugccguucaagguggucgugaucagcgccauccucgcccuggugguccugaccaucaucucccucaucauccugaucaugcuguggcagaagaagccccgcuacgagauccgguggaaggugaucgagagcgugagcuccgacgggcacgaguacaucuacgucgaccccaugcagcuccccuacgacagcaccugggagcugccgcgcgaccagcuggugcucggccggacgcugggguccggcgccuucggccagguggucgaggccaccgcgcacgggcugagccacucccaggccaccaugaagguggccgugaagaugcucaagagcaccgcccgcuccagcgagaagcaggcccugauguccgagcugaagaucaugagccaccucggcccccaccugaacgucgugaaccugcucggggcgugcacgaagggcgggcccaucuacaucaucaccgaguacugccgguacggcgaccugguggacuaccugcaccgcaacaagcacaccuuccuccagcaccacuccgacaagcggcggcccccgagcgccgagcuguacuccaacgcccugcccgucggccucccccugcccagccacgugucccugaccggggagagcgacggcggguacauggacauguccaaggacgagagcguggacuacgucccgaugcucgacaugaagggcgacgugaaguacgccgacaucgagagcuccaacuacauggcgcccuacgacaacuacgugcccagcgcccccgagcgcacgugccgcgccacccugaucaacgaguccccgguccugagcuacauggaccucgugggcuucuccuaccaggucgccaacgggauggaguuccuggccagcaagaacugcgugcaccgcgaccuggcggcccggaacgugcucaucugcgagggcaagcuggucaagaucugcgacuucgggcuggcccgcgacaucaugcgggacuccaacuacaucagcaagggcuccaccuuccucccccugaaguggauggcccccgagagcaucuucaacucccuguacaccacgcucagcgacgugugguccuucgggauccugcugugggagaucuucacccucggcggcacccccuacccggagcugcccaugaacgagcaguucuacaacgccaucaagcgcggguaccggauggcgcagcccgcccacgccagcgacgagaucuacgagaucaugcagaagugcugggaggagaaguucgagauccggcccccguucucccagcuggugcuccugcuggagcgccuccugggcgagggguacaagaagaaguaccagcaggucgacgaggaguuccugcgcagcgaccaccccgccauccuccggucccaggcccgccugcccggcuuccacgggcugcggagcccgcucgacaccuccagcgugcuguacacggcggugcagcccaacgagggcgacaacgacuacaucaucccccugcccgacccgaagcccgaggucgccgacgagggcccccucgaggggagccccucccuggccagcuccacccugaacgaggugaacaccagcuccaccaucagcugcgacuccccgcucgagccccaggacgagcccgagcccgagccgcagcuggagcuccagguggagcccgagcccgagcuggagcagcugcccgacagcggcugcccggcgccccgcgccgaggccgaggacuccuuccuguga

SEQ ID NO: 34390 - RNA, 1128 nt, Artificial Sequence
  derived and/or modified sequence opt1 from PDGFRL__Homo_sapiens__XP_011542860
augaagguguggcugcuccugggccugcuccugguccacgaggcccuggaggacgugaccgggcagcaccuccccaagaacaagcgcccgaaggagcccggcgagaaccggaucaagcccaccaacaagaaggugaagcccaagaucccgaagaugaaggaccgcgacagcgccaacuccgcgcccaagacgcagagcaucaugaugcagguccuggacaaggggcgguuccagaagcccgccgccacccugucccuccuggccggccagaccguggagcugcgcugcaaggggagccggaucggcugguccuaccccgccuaccucgacaccuucaaggacagccgccuguccgugaagcagaacgagcgguacggccagcugacgcucgucaacagcaccuccgcggacaccggggaguucagcugcugggugcagcugugcuccggcuacaucugccgcaaggacgaggccaagaccgggagcacguacaucuucuucaccgagaagggcgagcuguucgugccgucccccagcuacuucgacgucguguaccucaaccccgaccggcaggccgugguccccugccgcgugaccgugcuguccgccaaggucacccugcaccgggaguucccggcgaaggagauccccgccaacgggacggacaucguguacgacaugaagcgcggcuucguguaccuccagccccacagcgagcaccagggcgucguguacugccgggccgaggccgggggccgcucccagaucagcgugaaguaccagcugcuguacgucgccgugcccuccgggccgcccagcaccaccauccucgcgagcuccaacaaggucaagagcggcgacgacaucuccgugcugugcaccgugcugggcgagcccgacgucgagguggaguucacguggaucuuccccgggcagaaggacgagcggccggugaccauccaggacaccuggcgccucauccaccggggccuggggcacaccacgcgcaucagccaguccgucaucaccguggaggacuucgagaccaucgacgccggcuacuacaucugcaccgcccagaaccugcaggggcagacgaccguggccaccaccgucgaguucagcuga

SEQ ID NO: 34391 - RNA, 1173 nt, Artificial Sequence
  derived and/or modified sequence opt1 from PDHA1__Homo_sapiens__NP_000275
augcgcaagaugcuggccgccgugagccggguccucuccggcgcgagccagaagcccgccucccgcgugcugguggccagccggaacuucgccaacgacgccaccuucgagaucaagaagugcgaccugcaccgccucgaggaggggccgcccgucaccacggugcugacccgggaggacggccugaaguacuaccgcaugaugcagaccgugcggcgcauggagcucaaggcggaccagcuguacaagcagaagaucauccggggguucugccaccugugcgacggccaggaggccugcugcgucgggcucgaggccggcaucaaccccaccgaccaccugaucacggccuaccgcgcgcacggcuucaccuucacccgggggcuguccgugcgcgagauccucgccgagcugaccggccggaagggcgggugcgccaaggggaagggcggcagcaugcacauguacgccaagaacuucuacgggggcaacgggaucgugggcgcccaggucccccugggcgcggggaucgcccucgccugcaaguacaacggcaaggacgaggugugccugacgcuguacggggacggcgccgccaaccaggggcagaucuucgaggcguacaacauggccgcccucuggaagcugcccugcaucuucaucugcgagaacaaccgcuacggcaugggcaccuccguggagcgggccgccgcgagcaccgacuacuacaagcgcggggacuucauccccggccugcgggucgacgggauggacauccucugcgugcgcgaggccacccgguucgccgccgccuacugccgcuccggcaaggggcccauccugauggagcugcagacguaccgguaccacggccacagcauguccgaccccggcgugagcuaccgcacccgcgaggagauccaggagguccgguccaagagcgacccgaucaugcuccugaaggaccgcauggugaacuccaaccuggcgagcguggaggagcucaaggagaucgacgucgaggugcggaaggagaucgaggacgccgcccaguucgccaccgcggaccccgagccgccccuggaggagcugggguaccacaucuacuccagcgacccgcccuucgaggugcgcggcgccaaccaguggaucaaguucaaguccgucagcuga

SEQ ID NO: 34392 - RNA, 1080 nt, Artificial Sequence
  derived and/or modified sequence opt1 from PDHB__Homo_sapiens__NP_000916
auggccgccgugagcggccugguccgccggccccuccgcgagguguccgggcugcugaagcggcgcuuccacuggaccgcgccggccgcccuccaggugaccguccgggacgccaucaaccagggcauggacgaggagcuggagcgcgacgagaagguguuccugcucggggaggagguggcccaguacgacggcgcguacaaggucagccgggggcuguggaagaaguacggcgacaagcgcaucaucgacacgcccaucuccgagaugggcuucgccgggaucgccgugggcgccgcgauggccgggcugcggcccaucugcgaguucaugaccuucaacuucagcaugcaggccaucgaccaggugaucaacuccgccgccaagaccuacuacaugagcggcgggcuccagcccgucccgaucguguuccgcggccccaacggcgcguccgccgggguggccgcccagcacagccagugcuucgccgcgugguacggccacugccccgggcugaaggucgugucccccuggaacagcgaggacgccaagggccugaucaaguccgccauccgggacaacaacccgguggucgugcucgagaacgagcugauguacggcgugcccuucgaguucccgcccgaggcccagagcaaggacuuccugaucccgaucgggaaggccaagaucgagcgccagggcacccacaucacggucgugucccacagccggcccguggggcacugccucgaggcggccgccguccuguccaaggagggcguggagugcgaggugaucaacaugcgcaccauccggcccauggacauggagaccaucgaggccagcgucaugaagaccaaccaccuggugacggucgagggcggguggccccaguucggcgugggggccgagaucugcgcgcgcaucauggagggcccggccuucaacuuccucgacgcccccgccgugcgggucaccggggcggacgugcccaugcccuacgccaagauccuggaggacaacuccaucccccaggugaaggacaucaucuucgccaucaagaagacccugaacaucuga

SEQ ID NO: 34393 - RNA, 1461 nt, Artificial Sequence
  derived and/or modified sequence opt1 from PDHX__Homo_sapiens__NP_001128496
augcagagcggcggggccgagggcucccccggggccggccgcaccgggcggggcccgggcagcgggaaggcgccgcccgccgagaucuccagcggcgcccccgacuuccccgggggcgaccccaucaagauccugaugcccucccucagccccaccauggaggaggggaacaucgugaaguggcugaagaaggagggcgaggccgucuccgccggcgacgcgcugugcgagaucgagacggacaaggccguggugacccucgacgccagcgacgacgggauccuggccaagaucgucguggaggagggcuccaagaacauccgccuggggagccucaucggccugaucguggaggagggcgaggacuggaagcacgucgagaucccgaaggacguggggcccccgccgcccguguccaagcccagcgagccccggcccucccccgagccccagaucagcauccccgucaagaaggagcacauccccggcacccugcgcuuccggcucuccccggcggcccgcaacauccuggagaagcacagccuggacgccucccaggggaccgccacgggcccccgggggaucuucaccaaggaggacgcccucaagcuggugcagcugaagcagaccggcaagaucaccgagagccgccccacgcccgcgccgaccgccacccccaccgcccccagcccccuccaggccacggccggcccguccuacccccggcccgugaucccgcccgucagcacccccgggcagcccaacgcggugggcaccuucaccgagaucccggccuccaacauccgccgggugaucgccaagcgccugacggagagcaaguccaccgucccccacgccuacgccaccgcggacugcgaccugggggccgugcucaaggugcggcaggaccuggucaaggacgacaucaaggugagcgugaacgacuucaucaucaaggccgccgccgucacccugaagcagaugcccgacgugaacguguccugggacggcgaggggcccaagcagcucccguucaucgacaucagcgucgcgguggccacggacaagggccugcugacccccaucaucaaggacgccgccgcgaagggcauccaggagaucgccgacuccgucaaggcccucagcaagaaggcccgcgacgggaagcugcugcccgaggaguaccagggcggguccuucagcaucuccaaccucggcauguucgggaucgacgaguucaccgccgugaucaacccgccccaggcgugcauccuggccgugggccgguuccgccccguccugaagcucaccgaggacgaggagggcaacgccaagcugcagcagcggcagcugaucacggugaccaugagcuccgacagccgcguggucgacgacgagcucgccacccgguuccugaaguccuucaaggccaaccuggagaaccccauccgccucgcguga

SEQ ID NO: 34394 - RNA, 1578 nt, Artificial Sequence
  derived and/or modified sequence opt1 from PDIA2__Homo_sapiens__NP_006840
augagccgccagcugcuccccgugcugcugcuccugcugcuccgggccuccugcccguggggccaggagcagggggcccgcagccccuccgaggagccgcccgaggaggagauccccaaggaggacggcauccugguccugagccggcacacccucgggcuggcgcugcgcgagcaccccgcccuccugguggaguucuacgcccccuggugcggccacugccaggcccuggcccccgaguacuccaaggcggccgccgugcucgccgcggagagcauggucgugacccuggccaagguggacgggccggcccagcgggagcuggccgaggaguucggcgucacggaguaccccacccucaaguucuuccgcaacggcaaccggacccaccccgaggaguacaccgggccccgcgacgccgagggcaucgcggaguggcugcggcgccggguggggccguccgccaugcgccuggaggacgaggccgccgcccaggcgcucaucggcgggcgggaccugguggucaucggcuucuuccaggaccugcaggacgaggacguggccacguuccucgcccuggcccaggacgcccuggacaugaccuucggccucaccgaccgcccccggcuguuccagcaguucgggcugaccaaggacacggugguccucuucaagaaguucgacgagggccgcgcggacuuccccguggacgaggagcuggggcuggaccucggcgaccugagccgguuccuggugacccacuccaugcgccucgucaccgaguucaacagccagaccuccgccaagaucuucgccgcccggauccugaaccaccuccugcuguucgugaaccagacgcuggccgcgcaccgcgagcuccuggccggcuucggggaggccgcgccccgguuccgcggccaggugcuguucgucgugguggacgucgccgccgacaacgagcacgugcuccaguacuucgggcugaaggccgaggccgccccgacccugcgccucgugaaccuggagaccaccaagaaguacgcgcccgucgacggcgggcccgugacggccgccagcaucaccgccuucugccacgccguccugaacggccaggugaagcccuaccugcucucccaggagaucccgcccgacugggaccagcggcccgugaagacccuggucggcaagaacuucgagcaggucgcguucgacgagaccaagaacguguucgugaaguucuacgcccccuggugcacgcacugcaaggagauggccccggccugggaggcccuggcggagaaguaccaggaccacgaggacaucaucaucgccgagcucgacgccaccgccaacgagcuggacgcguucgccgugcacggguuccccacccugaaguacuuccccgccggccccgggcgcaaggugaucgaguacaagagcacccgggaccucgagacguucuccaaguuccuggacaacggcgggguccugccgaccgaggagccgcccgaggagcccgccgcccccuuccccgagcccccggcgaacagcaccaugggcuccaaggaggagcucuga

SEQ ID NO: 34395 - RNA, 1518 nt, Artificial Sequence
  derived and/or modified sequence opt1 from PDIA3__Homo_sapiens__NP_005304
augcgccugcggcgccucgcccuguuccccggcguggcccugcuccuggcggccgcccggcuggccgccgcgagcgacguccucgagcugaccgacgacaacuucgagucccgcaucagcgacaccggguccgccggccugaugcucguggaguucuucgcccccuggugcgggcacugcaagcggcuggcccccgaguacgaggcggccgccacgcgccugaagggcaucgugccccucgccaaggucgacugcaccgccaacaccaacacgugcaacaaguacggggugagcggcuaccccacccugaagaucuuccgggacggcgaggaggcgggggccuacgacggcccgcgcaccgccgacgggaucgugucccaccugaagaagcaggccggccccgccagcgucccccuccggaccgaggaggaguucaagaaguucaucuccgacaaggacgcgagcaucgugggguucuucgacgacuccuucagcgaggcccacuccgaguuccugaaggccgccagcaaccugcgcgacaacuaccgguucgcccacaccaacguggagucccucgucaacgaguacgacgacaacggcgagggcaucauccuguuccgccccagccaccugacgaacaaguucgaggacaagaccguggcguacaccgagcagaagaugaccuccgggaagaucaagaaguucauccaggagaacaucuucggcaucugcccgcacaugacggaggacaacaaggaccucauccaggggaaggaccugcugaucgccuacuacgacguggacuacgagaagaacgccaagggcagcaacuacuggcggaaccgcgucaugaugguggccaagaaguuccucgacgccggccacaagcugaacuucgcgguggccucccggaagaccuucagccacgagcuguccgacuucgggcucgagagcaccgccggcgagauccccgucguggccauccgcaccgcgaagggggagaaguucgugaugcaggaggaguucagccgggacggcaaggcccuggagcgcuuccugcaggacuacuucgacgggaaccucaagcgguaccugaaguccgagcccauccccgagagcaacgacggcccggucaaggugguggucgccgagaacuucgacgagaucgugaacaacgagaacaaggacgugcugaucgaguucuacgcccccuggugcggccacugcaagaaccucgagcccaaguacaaggagcugggggagaagcuguccaaggaccccaacaucgucaucgccaagauggacgcgacggccaacgacgugccgagccccuacgagguccgcggcuuccccaccaucuacuucucccccgccaacaagaagcucaacccgaagaaguacgagggcgggcgggagcugagcgacuucaucuccuaccugcagcgcgaggccaccaacccgcccgugauccaggaggagaagcccaagaagaagaagaaggcccaggaggaccucuga

SEQ ID NO: 34396 - RNA, 1938 nt, Artificial Sequence
  derived and/or modified sequence opt1 from PDIA4__Homo_sapiens__NP_004902
augcgcccccggaaggccuuccugcuccugcugcuccugggccuggugcagcuccuggccgucgcgggggccgagggcccggacgaggacagcuccaaccgcgagaacgccaucgaggacgaggaggaggaggaggaggaggacgacgacgaggaggaggacgaccuggaggugaaggaggagaacggggugcucguccugaacgacgccaacuucgacaacuucguggccgacaaggacaccgugcugcucgaguucuacgcgcccuggugcggccacugcaagcaguucgcccccgaguacgagaagaucgccaacauccugaaggacaaggacccgcccauccccgucgccaagaucgacgcgaccagcgccuccgugcuggccagccgguucgacguguccggguaccccacgaucaagauccucaagaagggccaggccgucgacuacgagggcagccgcacccaggaggagaucguggccaaggugcgggaggucucccagcccgacuggaccccgccgcccgaggugacccuggugcugacgaaggagaacuucgacgaggucgugaacgacgcggacaucauccucguggaguucuacgcccccuggugcgggcacugcaagaagcuggcccccgaguacgagaaggccgccaaggagcugagcaagcgcuccccgcccaucccccucgcgaaggucgacgccaccgccgagaccgaccuggccaagcgguucgacgugagcggcuaccccacccugaagaucuuccgcaaggggcggcccuacgacuacaacggcccccgcgagaaguacgggaucguggacuacaugaucgagcaguccgggcccccgagcaaggagauccucacgcugaagcagguccaggaguuccugaaggacggcgacgacgugaucaucaucggcguguucaagggcgaguccgaccccgccuaccagcaguaccaggacgcggccaacaaccuccgggaggacuacaaguuccaccacaccuucagcaccgagaucgccaaguuccugaaggucucccaggggcagcugguggucaugcagcccgagaaguuccagagcaaguacgagccccgcucccacaugauggacgugcagggcagcacccaggacuccgccaucaaggacuucgugcucaaguacgcccugccgcuggucggccaccggaaggugagcaacgacgcgaagcgcuacacgcggcgcccccucguggucguguacuacagcguggacuucuccuucgacuaccgggccgccacccaguucuggcgcagcaagguccuggagguggccaaggacuuccccgaguacaccuucgcgaucgccgacgaggaggacuacgccggggaggugaaggaccugggccucuccgagagcggggaggacgucaacgccgccauccuggacgaguccggcaagaaguucgcgauggagcccgaggaguucgacagcgacacccugcgggaguucgugacggccuucaagaaggggaagcucaagccggugaucaagucccagcccguccccaagaacaacaagggcccggugaagguggucgugggcaagaccuucgacagcaucgugauggaccccaagaaggacguccugaucgaguucuacgcccccuggugcgggcacugcaagcagcuggagcccguguacaacucccucgccaagaaguacaagggccagaaggggcuggugaucgccaagauggacgcgaccgccaacgacgucccgagcgaccgcuacaagguggagggcuuccccaccaucuacuucgcccccuccggggacaagaagaaccccgugaaguucgagggcggcgaccgggaccuggagcaccucagcaaguucaucgaggagcacgccacgaagcugucccgcaccaaggaggagcuguga

SEQ ID NO: 34397 - RNA, 1560 nt, Artificial Sequence
  derived and/or modified sequence opt1 from PDIA5__Homo_sapiens__NP_006801
auggcccgcgccggccccgcguggcugcuccuggccaucugggugguccugcccagcuggcucuccagcgccaagguguccagccugaucgagcggaucuccgaccccaaggaccugaagaagcuccugcgcacccggaacaacgugcugguccucuacagcaaguccgagguggccgccgagaaccaccuccgccugcucagcaccguggcgcaggccgucaaggggcagggcacgaucugcuggguggacugcggggacgccgagucccggaagcugugcaagaagaugaagguggaccugagccccaaggacaagaaggucgagcuguuccacuaccaggacggcgccuuccacaccgaguacaaccgcgcggugaccuucaaguccaucguggccuuccugaaggaccccaaggggccgccccugugggaggaggaccccggcgccaaggacgucgugcaccucgacagcgagaaggacuuccggcgccugcugaagaaggaggagaagccccuccugaucauguucuacgccccguggugcuccaugugcaagcggaugaugccccacuuccagaaggccgcgacccagcugcgcggccacgccgugcucgccgggaugaacgucuacagcuccgaguucgagaacaucaaggaggaguacagcgugcggggcuuccccacgaucugcuacuucgagaaggggcgcuuccuguuccaguacgacaacuacggcuccaccgccgaggacaucguggaguggcugaagaacccccagccgccccagccccagguccccgagaccccgugggccgacgagggcgggagcguguaccaccucaccgacgaggacuucgaccaguucgugaaggagcacuccagcguccuggugauguuccacgcgcccuggugcggccacugcaagaagaugaagcccgaguucgagaaggccgccgaggcccugcacggggaggccgacagcuccggcgugcucgcggccgucgacgccacggugaacaaggcccuggccgagcgguuccacaucagcgaguuccccacccugaaguacuucaagaacggggagaaguacgcggucccggugcuccgcaccaagaagaaguuccuggaguggaugcagaaccccgaggccccgccgccgcccgagcccaccugggaggagcagcagacguccgugcugcaccucgucggcgacaacuuccgggagacccugaagaagaagaagcacacccuggugauguucuacgcccccuggugcccccacugcaagaaggugaucccccacuucaccgccacggcggacgccuucaaggacgaccgcaagaucgccugcgccgccgucgacugcgugaaggacaagaaccaggaccucugccagcaggaggcggugaagggcuaccccaccuuccacuacuaccacuacgggaaguucgccgagaaguacgacagcgaccggaccgagcugggcuucaccaacuacauccgcgcccugcgggagggggaccacgagcgccucggcaagaagaaggaggagcuguga

SEQ ID NO: 34398 - RNA, 1479 nt, Artificial Sequence
  derived and/or modified sequence opt1 from PDIA6__Homo_sapiens__NP_001269633
augcgccgggaccugcgcgagaagcucgugugggucugccggccccuggccccgguggaggugcccgccaacaucagcuccgacuuccagcccugcagccccaccuccccggcgcacagccugucccgcaagagccccaucauguaccccuccaccacgauggccaacgcccccggccucgucagcugcaccuucuuccuggccgugaacgggcuguacuccagcuccgacgacgugaucgagcucaccccgagcaacuucaaccgggaggucauccaguccgacagccuguggcugguggaguucuacgcccccuggugcggccacugccagcgccucacccccgaguggaagaaggcggccacggcccugaaggacguggucaaggugggggccguggacgcggacaagcaccacucccugggcgggcaguacggcguccagggcuuccccaccaucaagaucuucgggagcaacaagaaccggccggaggacuaccagggcgggcgcaccggcgaggccaucguggacgccgcccucuccgcccugcggcagcuggugaaggaccgccucgggggccggagcggcggguacuccagcggcaagcaggggcgcagcgacuccagcuccaagaaggacgucaucgagcugaccgacgacagcuucgacaagaacgugcuggacuccgaggacguguggauggucgaguucuacgcgcccuggugcggccacugcaagaaccucgagcccgagugggccgccgccgccagcgaggugaaggagcagacgaagggcaaggugaagcuggcggccgucgacgccaccgugaaccaggugcuggccucccgguacgggauccgcggcuuccccaccaucaagaucuuccagaagggggagagcccggucgacuacgacggcgggcggacccgcuccgacaucgugagccgggcccucgaccuguucuccgacaacgcgcccccgcccgagcugcucgagaucaucaacgaggacaucgccaagcgcacgugcgaggagcaccagcugugcgucguggccgugcugccccacauccucgacaccggcgccgccggccggaacagcuaccuggagguccugcucaagcuggcggacaaguacaagaagaagauguggggguggcuguggaccgaggccggcgcccaguccgagcucgagaccgcccuggggaucggcggguucggcuaccccgcgauggccgccaucaacgcccgcaagaugaaguucgcccugcucaagggcagcuucuccgagcaggggaucaacgaguuccugcgggagcugagcuucggccgcggguccacggcgcccgugggcgggggcgccuuccccaccaucguggagcgcgagccgugggacggccgggacggggagcuccccgucgaggacgacaucgaccugagcgacguggagcuggacgaccucggcaaggacgagcuguga

SEQ ID NO: 34399 - RNA, 1371 nt, Artificial Sequence
  derived and/or modified sequence opt1 from PDK1__Homo_sapiens__NP_001265478
augcgccuggcccggcuccugcgcggcgccgcgcuggccgggcccggcccggggcuccgggccgccggcuucagccgcuccuucagcuccgacagcggguccagccccgccuccgagcggggcgugcccggccaggucgacuucuacgcgcgcuucagccccuccccgcugagcaugaagcaguuccuggacuucggguccgugaacgccugcgagaagaccagcuucauguuccuccggcaggagcugcccgugcgccuggccaacaucaugaaggagaucucccuccugcccgacaaccugcuccggacccccagcguccagcuggugcaguccugguacauccagagccugcaggagcuccuggacuucaaggacaaguccgccgaggacgcgaaggccaucuacgagcgcccgcggcgcacguggcuccaggugagcucccugugcugcauggccugcaagaugaucuucaccgacaccgucauccggauccgcaaccggcacaacgacgugauccccaccauggcccagggcgugaucgaguacaaggagagcuucggggucgaccccgugacgagccagaacgugcaguacuuccuggaccgcuucuacaugucccggaucagcauccgcaugcugcucaaccagcacucccugcuguucggcgggaagggcaagggcagccccucccaccggaagcacaucgggagcaucaacccgaacugcaacguccucgaggugaucaaggacggcuacgagaacgcccgccggcugugcgaccuguacuacaucaacucccccgagcucgagcuggaggagcugaacgccaagagccccgggcagcccauccagguggucuacgugccgucccaccucuaccacaugguguucgagcuguucaagaacgcgaugcgcgccaccauggagcaccacgccaaccgcggcgucuacccgcccauccaggugcacgugacccugggcaacgaggaccucaccgucaagaugagcgaccgcgggggcggggugccccugcggaagaucgaccggcuguucaacuacauguacuccacggcgccccgcccccggguggagaccagccgcgccgucccccucgccggcuucggguacggccugcccaucucccggcuguacgcccaguacuuccagggcgaccucaagcuguacagccuggagggguacggcaccgacgccgugaucuacaucaaggcccucuccaccgacagcaucgagcgccugccggucuacaacaaggcggccuggaagcacuacaacacgaaccacgaggccgacgacuggugcgugcccucccgggagcccaaggacaugaccaccuuccgcagcgccuga

SEQ ID NO: 34400 - RNA, 1032 nt, Artificial Sequence
  derived and/or modified sequence opt1 from PDK2__Homo_sapiens__NP_001186828
augaaggagaucaaccugcuccccgaccgcgugcugagcaccccguccguccagcuggugcagagcugguacgugcagucccuccuggacaucauggaguuccuggacaaggaccccgaggaccaccggacccucagccaguucacggacgcccuggucaccauccgcaaccggcacaacgacguggugcccaccauggcccagggcguccuggaguacaaggacaccuacggggacgaccccguguccaaccagaacauccaguacuuccucgaccgcuucuaccugagccggaucuccauccgcaugcugaucaaccagcacacgcucaucuucgacggcagcaccaacccggcgcaccccaagcacaucggguccaucgaccccaacugcaacgugagcgaggucgugaaggacgccuacgacauggccaagcugcugugcgacaaguacuacauggccucccccgaccucgagauccaggagaucaacgccgcgaacagcaagcagccgauccacaugguguacguccccucccaccuguaccacaugcuguucgagcuguucaagaacgccaugcgggccaccguggagagccacgaguccagccucauccugccgcccaucaaggugauggucgcccucggcgaggaggaccuguccaucaagaugagcgaccgcgggggcggcgugccccugcggaagaucgagcgccucuucuccuacauguacagcaccgcgcccacgccccagcccgggaccggcgggaccccgcuggccggcuucggguacggccugcccaucagccggcucuacgccaaguacuuccagggcgaccugcagcuguucuccauggagggguucggcaccgacgccgugaucuaccucaaggcccugagcacggacuccgucgagcgccugcccguguacaacaagagcgcguggcggcacuaccagaccauccaggaggccggggacuggugcgugcccuccaccgagccgaagaacaccagcacguaccgcgucuccuga

SEQ ID NO: 34401 - RNA, 1248 nt, Artificial Sequence
  derived and/or modified sequence opt1 from PDK3__Homo_sapiens__NP_001135858
augcgccuguuccgguggcuccugaagcagcccgugccgaagcagaucgagcgcuacagccgguucucccccagcccccuguccaucaagcaguuccucgacuucggccgcgacaacgccugcgagaagaccagcuacauguuccugcggaaggagcugcccguccgccucgccaacaccaugcgggaggugaaccugcugccggacaaccuccugaaccgccccuccguggggcugguccagagcugguacaugcaguccuuccucgagcugcuggaguacgagaacaagagccccgaggacccccaggugcucgacaacuuccuccaggugcugaucaagguccggaaccgccacaacgacguggugccgacgauggcgcagggcgucaucgaguacaaggagaaguucggguucgaccccuucaucuccaccaacauccaguacuuccucgaccgguucuacaccaaccgcaucagcuuccggaugcugaucaaccagcacacccuccuguucggcggggacacgaaccccgugcaccccaagcacaucggcuccaucgacccgaccugcaacguggccgacgucgugaaggacgccuacgagaccgccaagaugcugugcgagcaguacuaccugguggcccccgagcucgaggucgaggaguucaacgcgaaggcccccgacaagcccauccaggugguguacgucccgagccaccuguuccacaugcuguucgagcuguucaagaacuccaugcgcgccaccguggagcuguacgaggaccggaaggagggcuaccccgccgugaagacgcuggucacccucgggaaggaggaccugagcaucaagaucuccgaccugggcgggggcgugccccuccgcaagaucgaccggcuguucaacuacauguacagcaccgcgccccgcccgucccuggagcccacccgggccgcgccccucgccggguucggcuacggccugcccaucagccgccuguacgcccgguacuuccagggggaccucaagcuguacuccauggagggcguggggacggacgccgucaucuaccugaaggcccucagcagcgaguccuucgagcgccugccgguguucaacaagagcgccuggcgccacuacaagaccacccccgaggccgacgacugguccaaccccagcuccgagccccgggacgccagcaaguacaaggcgaagcaggacaagaucaagaccaaccgcacguucuga

SEQ ID NO: 34402 - RNA, 1236 nt, Artificial Sequence
  derived and/or modified sequence opt1 from PDK4__Homo_sapiens__NP_002603
augaaggccgcccgcuucgugcugcggagcgcgggcucccucaacggggccggccuggucccccgcgagguggagcacuucagccgguacuccccgagcccccuguccaugaagcagcuccuggacuucgggagcgagaacgccugcgagcgcaccuccuucgccuuccugcggcaggagcuccccgugcgccuggccaacauccugaaggagaucgacauccuccccacccagcuggucaacacgagcuccgugcagcuggucaagagcugguacauccagucccucauggaccugguggaguuccacgagaaguccccggacgaccagaaggcgcugagcgacuucguggacacccucaucaaggugcggaaccgccaccacaacgucgugcccaccauggcccagggcaucaucgaguacaaggacgccugcaccguggaccccgucacgaaccagaaccugcaguacuuccuggaccgguucuacaugaaccgcaucagcacccggaugcucaugaaccagcacauccugaucuucuccgacagccagaccgggaaccccucccacaucggcagcaucgacccgaacugcgacgugguggccgucgugcaggacgcguucgagugcucccgcaugcugugcgaccaguacuaccucagcagccccgagcugaagcugacccaggugaacggcaaguuccccgaccagcccauccacaucgucuacgugccgucccaccuccaccacaugcuguucgagcuguucaagaacgccaugcgggccacgguggagcaccaggagaaccagcccagccucacccccaucgaggucaucguggugcuggggaaggaggaccugaccaucaagaucuccgaccgcggcgggggcgucccccuccggaucaucgaccgccuguucagcuacaccuacuccacggccccgacccccgugauggacaacagccggaacgcgccccuggccggguucggcuacggccuccccaucucccgccuguacgccaaguacuuccagggggaccugaaccucuacagccuguccggcuacgggaccgacgccaucaucuaccugaaggcccucagcuccgagagcaucgagaagcugccggucuucaacaaguccgccuucaagcacuaccagaugagcuccgaggcggacgacuggugcauccccagccgggagcccaagaaccuggccaaggagguggccauguga

SEQ ID NO: 34403 - RNA, 990 nt, Artificial Sequence
  derived and/or modified sequence opt1 from PDLIM1__Homo_sapiens__NP_066272
augaccacccagcagaucgaccugcagggccccgggcccuggggcuuccgccucgucgggggcaaggacuucgagcagccccuggccaucagccgggugacgcccggguccaaggccgcgcuggccaaccucugcaucggcgacgugaucaccgccaucgacggcgagaacaccagcaacaugacccaccuggaggcccagaaccgcaucaaggggugcacggacaaccugacccucaccguggcccgguccgagcacaaggucuggagcccccuggugaccgaggagggcaagcgccacccguacaagaugaaccuggcguccgagccccaggaggugcuccacaucgggagcgcccacaaccgguccgccaugcccuucacggccagccccgcguccagcaccaccgcccgcgucaucaccaaccaguacaacaacccggccggccuguacuccagcgagaacaucuccaacuucaacaacgcccuggagagcaagacggccgcguccgggguggaggccaacagccggccccucgaccacgcccagccgcccuccagccuggugaucgacaaggaguccgaggucuacaagaugcugcaggagaagcaggagcucaacgagccgcccaagcagagcaccagcuuccuggugcugcaggagauccucgaguccgaggagaagggcgaccccaacaagcccagcggcuuccgcuccgugaaggccccggucaccaagguggccgcgagcaucgggaacgcccagaagcugcccaugugcgacaagugcggcaccgggaucgugggcgucuucgugaagcugcgggaccgccaccggcaccccgagugcuacgugugcacggacugcggcaccaaccucaagcagaaggggcacuucuucgucgaggaccagaucuacugcgagaagcacgcccgcgagcgggugaccccgcccgagggcuacgagguggucaccguguuccccaaguga

SEQ ID NO: 34404 - RNA, 1809 nt, Artificial Sequence
  derived and/or modified sequence opt1 from PDLIM2__Homo_sapiens__NP_067643
augcgcggcgggcgggcccgccccgccugggagagcuucaugggccugccgccccgguccagcgcgaaguggggcgccgggcagucccucgaccgccugugcugcgcccccgggagccggggccuggccggcgcccccgggcgcaugcgggcgccgcccgccggccgcucccagcccgccgggggccccggggacagccucccgcacccgcccggcggccuggggcccggcggguccgccugggcgcggcgcgccgaggccgccgccagccgggcgcgcggcggcgggcggggcgggcccggcaucaccugggccgaggccgggcccggcgcccccggcgggcugucccccgagagcggccgccggcagcgcgagcgguggcgccucccggccuucccgcccucccgggcgugggcccccagccgcaccggggagcggcagcccggcgagcgcgcccaccuccgccuguccgcccggcccgcccuccccggggcgggccugcugagcgcgccccucuccgcccgcaacccgggccuggugcgggggcccgcccccuggagccuggccuccgccggcgcgcccccgcgcgccgcccucagccccgccggggcccugcugcugcagcccccggcccggcgcguccugugcccccgguccgagggcgggagccgcaccggccgggccggccccagcgggugggcgcccccgcgcggcgcccgguccgccgagagcaccgaccgccugaaggggauggcccucaccguggacguggccggccccgcccccuggggcuuccggaucaccgggggccgcgacuuccacacgcccaucauggucaccaagguggcggagcgggggaaggccaaggacgccgaccugcgcccgggcgacaucaucguggccaucaacggggaguccgccgagggcaugcugcacgcggaggcccagagcaagauccggcagucccccagcccccuccgccugcagcuggaccggucccaggccaccagccccggccagaccaacggggacuccagccucgagguccuggccacgcgcuuccagggcuccgugcgcaccuacaccgagagccaguccagccugcgguccagcuacuccagcccgaccucccucagcccccgcgcggggagccccuucagcccgccgcccuccuccagcucccugacgggcgaggccgccaucagccgguccuuccagagccuggccugcucccccgggcuccccgccgcggaccgccugagcuacuccggccggcccggcagccgccaggccgggcugggccgggccggggacuccgccgugcucguccugccgcccagccccggcccccgcuccagccggcccuccauggacagcgagggcgggagccugcuccuggacgaggacuccgagguguucaagaugcugcaggagaaccgcgagggccgggccgcgccccgccagagcuccagcuuccggcuccugcaggaggcccuggaggccgaggagcgcgggggcaccccggccuuccuccccuccagccugagcccccaguccucccugcccgccagccgggcgcucgccaccccgcccaagcugcacacgugcgagaagugcuccaccagcaucgccaaccaggccgugcgcauccaggaggggcgguaccgccaccccggcugcuacacgugcgcggacugcgggcugaaccugaagaugcggggccacuucugggucggcgacgagcucuacugcgagaagcacgcccgccagcgguacuccgcccccgccacccugagcucccgcgccuga

SEQ ID NO: 34405 - RNA, 951 nt, Artificial Sequence
  derived and/or modified sequence opt1 from PDLIM3__Homo_sapiens__NP_001107579
augccccagaccgugauccugccgggccccgcccccuggggguuccgccucagcggcgggaucgacuucaaccagccccuggucaucacccggaucacgccgggcuccaaggccgcggccgccaaccugugccccggggacgugauccucgccaucgacggcuucggcaccgagagcaugacccacgccgacgcgcaggaccgcaucaaggccgccgcccaccagcugugccugaagaucgaccgcggggagacccaccucuggagcccccagguguccgaggacggcaaggcgcaccccuucaagaucaaccuggaguccgagccgcaggaguucaagcccaucgggacggcccacaaccggcgggcccagcccuucgucgccgccgcgaacaucgacgacaagcgccagguggugagcgccuccuacaacagccccaucggccuguacuccaccagcaacauccaggacgcccuccacgggcagcugcggggccugaucccguccagcccccagaacgagcccaccgccuccgugcccccggagagcgacgucuaccgcaugcuccacgacaaccggaacgagcccacccagccccgccaguccggcagcuuccgggugcugcaggggauggucgacgacggcuccgacgaccgccccgccgggacgcggagcgugcgcgcgccggugaccaagguccacggcggcuccgggggcgcccagcggaugccccugugcgacaagugcgggagcggcaucgugggggccguggucaaggcccgcgacaaguaccggcaccccgagugcuucgugugcgccgacugcaaccucaaccugaagcagaagggcuacuucuucaucgagggcgagcuguacugcgagacccacgcgcgcgcccggaccaagcccccggagggguacgacacggugacccucuaccccaaggccuga

SEQ ID NO: 34406 - RNA, 741 nt, Artificial Sequence
  derived and/or modified sequence opt1 from PDLIM4__Homo_sapiens__NP_001124499
augccccacagcgugacccugcgcggcccgucccccuggggguuccggcucgucggcgggcgcgacuucagcgcgccccugaccaucucccgggugcacgccggcagcaaggccgcccuggccgcccucugccccggggaccugauccaggccaucaacggcgaguccacggagcugaugacccaccucgaggcgcagaaccgcaucaagggcugccacgaccaccugacccugagcgugucccggccggaggggcgcagcuggcccuccgcccccgacgacagcaaggcccaggcccaccggauccacaucgaccccgagauccaggacggcuccccgaccacgagccgccggcccuccgggaccggcaccgggcccgaggacggccgccccagccucggcuccccguacgggcagccgccccgguuccccgucccccacaacggcagcuccgaggcgacccugcccgcccagaugagcacgcugcacguguccccgccgcccagcgccgaccccgcccgcgggcucccccggagccgcgacugccggguggaccugggcuccgaggucuaccgcaugcugcgggagcccgccgagcccguggcggccgagcccaagcagagcggcuccuuccgcuaccuccaggggaugcuggaggccggcgagggcggggcccccagcucccggcacgggaccagcuccaccauccccagcgccuccugcgcggugaccgccgccuga

SEQ ID NO: 34407 - RNA, 1464 nt, Artificial Sequence
  derived and/or modified sequence opt1 from PDLIM5__Homo_sapiens__NP_001011513
augagcaacuacuccgugagccuggucggccccgccccguggggguuccgccuccagggcgggaaggacuucaacaugccccugaccaucuccagccugaaggacggcgggaaggccgcgcaggccaacgugcggaucggcgacgugguccucuccaucgacggcaucaacgcccaggggaugacccaccuggaggcccagaacaagaucaagggcugcaccgggagccugaacaugacccuccagcgcgccuccgcggcccccaagcccgagccggugcccgugcagaagcccaccgucaccagcgugugcuccgagacgagccaggagcuggccgagggccagcggcgcgggucccagggcgacagcaagcagcagaacgggcccccgcggaagcacaucguggagcgcuacaccgaguucuaccacguccccacccacuccgacgccagcaagaagcggcugaucgaggacaccgaggacuggcgcccccggacgggcaccacccagucccgcagcuuccggauccucgcgcagaucaccggcacggagcaccugaaggaguccgaggccgacaacaccaagaaggccaacaacagccaggagcccuccccgcagcuggccagcagcguggccuccacccgcagcaugcccgagucccucgacagccccaccuccgggcggcccggcgugacgagccugaccaccgcggccgccuucaagccggucggcuccaccggggugaucaagagccccuccuggcagcgccccaaccagggcgugcccagcacggggcggaucuccaacagcgccaccuacuccggcagcgucgccccggcgaacuccgcccuggggcagacccagcccagcgaccaggacacccucgugcagcgcgccgagcacauccccgccggcaagcggacgcccaugugcgcccacugcaaccaggugauccgcggcccguuccuggucgcgcuggggaaguccuggcaccccgaggaguucaacugcgcccacugcaagaacaccauggccuacaucggcuucguggaggagaagggggcccucuacugcgagcugugcuacgagaaguucuucgcccccgagugcggccggugccagcgcaagauccugggggaggugaucagcgcgcucaagcagaccuggcacgucuccugcuucgugugcguggccugcggcaagcccauccggaacaacgucuuccaccuggaggacggcgagccguacugcgagaccgacuacuacgcccuguucgggacgaucugccacggcugcgaguuccccaucgaggccggggacauguuccucgaggcgcugggcuacaccuggcacgacacgugcuucgugugcagcgucugcugcgagagccuggaggggcagaccuucuucuccaagaaggacaagccccucugcaagaagcacgcccacagcgugaacuucuga

SEQ ID NO: 34408 - RNA, 1374 nt, Artificial Sequence
  derived and/or modified sequence opt1 from PDLIM7__Homo_sapiens__NP_005442
auggacagcuucaaggugguccuggagggccccgccccguggggguuccgccuccagggcgggaaggacuucaacgugccccuguccaucagccggcugacccccggcgggaaggccgcgcaggccggcguggccgucggcgacugggugcucuccaucgacggggagaacgccggcagccugacccacaucgaggcccagaacaagauccgcgcgugcggggagcggcugucccucggccugagccgcgcccagcccgugcaguccaagccgcagaaggccagcgcccccgcggccgacccgccccgguacacguucgcccccuccgucagccugaacaagaccgcccgccccuucggggccccgccgcccgcggacuccgcgccccagcagaacggccagccccuccggccccuggugcccgacgccagcaagcagcgccugauggagaacaccgaggacuggcggccccgccccggcaccgggcagucccggagcuuccgcauccucgcccaccugaccggcaccgaguucaugcaggaccccgacgaggagcaccugaagaaguccagccaggugccgcggaccgaggcccccgcccccgccuccagcacgccccaggagccguggcccgggcccaccgcccccuccccgaccagccgcccgcccugggccgucgaccccgccuucgcggagcgguacgcccccgacaagaccagcaccgugcucacgcgccacucccagcccgccacccccaccccgcugcagagccggaccuccaucgugcaggccgccgcgggcggcguccccgggggcgggagcaacaacggcaagacgcccgugugccaccagugccacaaggugauccgcgggcgguaccuggucgcccucggccacgccuaccaccccgaggaguucgugugcucccagugcggcaaggugcuggaggagggcggguucuucgaggagaagggggccaucuucugcccgcccugcuacgacguccgcuacgcgcccagcugcgccaagugcaagaagaagaucaccggcgagaucaugcacgcccugaagaugaccuggcacgugcacugcuucacgugcgccgccugcaagacccccauccggaaccgcgcguucuacauggaggagggggugccguacugcgagcgcgacuacgagaagauguucggcaccaagugccacggcugcgacuucaagaucgacgccggggaccgguuccucgaggcccugggcuucuccuggcacgacacgugcuucgucugcgccaucugccagaucaaccuggaggggaagaccuucuacagcaagaaggaccgcccccucugcaagucccacgccuucagccacguguga

SEQ ID NO: 34409 - RNA, 1689 nt, Artificial Sequence
  derived and/or modified sequence opt1 from PDP1__Homo_sapiens__NP_001155251
augugcgugugccccggcccgcgccggaucgggauccccguccgcagcuccagccugccccucuucuccgacgccaugcccgccccgacccagcuguucuucccccugauccggaacugcgagcucagccgcaucuacggcaccgcgugcuacugccaccacaagcaccugugcugcuccagcuccuacaucccccagagccggcugcgcuacacgccccacccggccuacgccaccuucugccggcccaaggagaacugguggcaguacacccaggggcgccgguacgccuccaccccgcagaaguucuaccucacgcccccgcaggucaacagcauccugaaggccaacgaguacuccuucaaggugcccgaguucgacggcaagaacgugagcuccauccugggguucgacagcaaccagcuccccgcgaacgcccccaucgaggaccgccgguccgccgcgaccugccugcagacccgcggcaugcugcucggcguguucgacgggcacgccggcugcgccugcagccaggccguguccgagcggcuguucuacuacaucgccgucagccugcucccgcacgagacccugcuggagaucgagaacgccguggaguccgggcgcgcgcuccugcccauccugcaguggcacaagcaccccaacgacuacuucagcaaggaggccagcaagcucuacuucaacucccugcggacguacuggcaggagcugaucgaccucaacaccggcgagagcaccgacaucgacgugaaggaggcccugaucaacgccuucaagcgccuggacaacgacaucucccucgaggcccaggucggggaccccaacagcuuccugaacuaccuggugcuccggguggcguucuccggcgccaccgccugcgucgcccacguggacggcguggaccugcacgucgccaacacgggggacagccgcgcgaugcugggcgugcaggaggaggacggguccuggagcgccgugacccucuccaacgaccacaacgcccagaacgagcgggagcuggagcgccugaagcucgagcaccccaagagcgaggccaaguccgucgugaagcaggaccggcugcugggccuccugaugcccuuccgcgccuucggcgacgugaaguucaaguggagcaucgaccugcagaagcgcgucaucgaguccgggcccgaccagcucaacgacaacgaguacaccaaguucaucccgcccaacuaccacaccccgcccuaccugacggcggagcccgaggugaccuaccaccggcugcgcccccaggacaaguuccucgugcuggccaccgacggccugugggagaccaugcaccggcaggacgucgugcgcaucgucggggaguaccucacgggcaugcaccaccagcagcccaucgccgucgggggcuacaaggugacccugggccagaugcacgggcugcugaccgagcggcgcaccaagaugagcuccguguucgaggaccagaacgccgcgacgcaccucauccggcacgccgugggcaacaacgaguucgggaccguggaccacgagcgccugagcaagaugcugucccuccccgaggagcuggcccggauguaccgcgacgacaucaccaucaucgucgugcaguucaacagccacguggucggcgccuaccagaaccaggaguga

SEQ ID NO: 34410 - RNA, 1590 nt, Artificial Sequence
  derived and/or modified sequence opt1 from PDP2__Homo_sapiens__NP_065837
augagcuccaccgugagcuacuggauccugaacuccacccgcaacagcaucgccacgcuccagggcgggcggcgccuguacucccgguacgucagcaaccgcaacaagcugaaguggcggcuguucucccgcgugcccccgacccugaacagcucccccugcggcggguucacccugugcaaggccuaccggcacaccagcacggaggaggacgacuuccaccuccagcugucccccgagcagaucaacgaggugcugcgcgcgggcgagaccacccacaagauccucgaccuggagagccggguccccaacuccgugcugcgcuucgagagcaaccagcucgccgccaacuccccgguggaggaccggcgcggggucgccagcugccugcagaccaacggccugauguucggcaucuucgacgggcacggcgggcacgccugcgcgcaggccguguccgagcggcuguucuacuacguggccgucagccugaugucccaccagacgcuggagcacauggagggcgccauggagagcaugaagccccuccugcccauccugcacuggcucaagcaccccggggacagcaucuacaaggacgugaccuccgugcaccuggaccaccuccgcgucuacuggcaggagcuccuggaccugcacauggagaugggccucagcaucgaggaggcgcugauguacuccuuccagcggcuggacagcgacaucucccucgagauccaggccccgcuggaggacgaggugacccgcaaccugagccuccagguggccuucuccggcgccaccgccugcauggcgcacgucgacgggauccaccuccacguggccaacgccggcgacugccgggccauccugggggugcaggaggacaacggcauguggagcugccucccccugacgcgcgaccacaacgccuggaaccaggcggagcugucccggcucaagcgcgagcaccccgagagcgaggaccggaccaucaucauggaggaccgccugcugggcguccucauccccugccgcgccuucggggacgugcagcugaagugguccaaggagcugcagcggagcauccucgagcgcggcuucaacaccgaggcccugaacaucuaccaguucaccccgccccacuacuacacgccgcccuaccugaccgccgagcccgaggugaccuaccaccggcuccgcccccaggacaaguuccugguccuggccuccgacgggcugugggacaugcucagcaacgaggacguggugcggcuggucgugggccaccuggcggaggccgacuggcacaagaccgaccucgcccagcgccccgccaaccuggggcugaugcagucccuccugcugcagcggaaggccagcggccuccacgaggcggaccagaacgccgccacgcgccugauccggcacgccaucggcaacaacgaguacggggagauggaggcggagcgccuggccgccaugcucacccugcccgaggaccuggcccggauguaccgcgacgacaucaccgucaccgugguguacuucaacuccgagagcaucggcgccuacuacaagggcggguga

SEQ ID NO: 34411 - RNA, 1365 nt, Artificial Sequence
  derived and/or modified sequence opt1 from PDPK1__Homo_sapiens__NP_001248745
auggcccgcaccaccagccagcuguacgacgccgugcccauccaguccagcguggugcucugcuccugcccgagccccuccauggugcggacgcagaccgagagcuccaccccgcccggcauccccgggggcagccgccaggggcccgcgauggacggcaccgccgccgagccccggcccggggccggcucccugcagcacgcccagccgccgccccagccccgcaagaagcggcccgaggacuucaaguucggcaagauccugggggagggcagcuucuccacggucgugcucgcgcgcgagcuggccaccagccgggaguacgccaucaagauccuggagaagcgccacaucaucaaggagaacaaggugcccuacgucacccgggagcgcgacgugaugucccggcucgaccaccccuucuucgugaagcuguacuucaccuuccaggacgacgagaagcuguacuucgggcucagcuacgccaagaacggcgagcugcugaaguacauccgcaagaucggguccuucgacgagacgugcacccgguucuacaccgcggagaucgucagcgcccucgaguaccugcacggcaagggcaucauccaccgcgaccugaagcccgagaacauccuccugaacgaggacaugcacauccagaucaccgacuucgggacggccaaggugcuguccccggagagcaagcaggcccgggccaacuccuucgugggcaccgcgcaguacgucagccccgagcuccugaccgagaaguccgccugcaagagcagcgaccugugggcccucgggugcaucaucuaccagcugguggccggccugccgcccuuccgcgccggcaacgaguaccucaucuuccagaagaucaucaagcuggaguacgacuuccccgagaaguucuuccccaaggcgcgggaccugguggagaagcuccugguccuggacgccaccaagcgccucgggugcgaggagauggagggcuacgggccccugaaggcccaccccuucuucgaguccgugacgugggagaaccugcaccagcagaccccgcccaagcucaccgccuaccugcccgccaugagcgaggacgacgaggacugcuacggcaacuacgacaaccugcucucccaguucgggugcaugcaggucagcuccagcuccagcucccacagccuguccgcgagcgacaccggccugccccagcgguccggcagcaacaucgagcaguacauccacgaccucgacuccaacagcuucgagcuggaccugcaguucuccgaggacgagaagcgccuccugcuggagaagcaggccgggggcaacccgugccucacggggcggaucaucuga

SEQ ID NO: 34412 - RNA, 2640 nt, Artificial Sequence
  derived and/or modified sequence opt1 from PDPR__Homo_sapiens__NP_060460
augauguucuaccgccugcucagcaucgugggccggcagcgcgccucccccggguggcagaacuggagcuccgcccggaacagcaccuccgcggccgaggcccgcagcauggcccugccgacccaggcccaggucgugaucugcggcgggggcaucacggggaccuccguggcguaccaccugagcaagaugggcuggaaggacaucguccuccuggagcagggccggcuggccgccggguccacccgcuucugcgccggcauccucagcaccgcgcggcaccugacgaucgagcagaagauggccgacuacuccaacaagcuguacuaccagcucgagcaggagaccgggauccagaccggcuacacccgcacggggagcaucuuccuggcccagacccaggaccggcugaucucccucaagcgcaucaacgccggccugaacgugaucggcauccccagcgagaucaucucccccaagaagguggccgagcugcaccaccuccugaacguccacgaccuggugggggcgaugcacgugcccgaggacgccgucgugagcuccgccgacguggcccucgcccuggcgagcgccgccucccagaacggcguccagaucuacgaccggaccagcgugcugcacgugauggucaagaagggccaggugaccgggguggagacggacaagggccagaucgagugccaguacuucgucaacugcgccgggcagugggccuacgagcucggccugagcaacgaggagccgguguccaucccccugcacgcgugcgagcacuucuaccuccugacccgcccccuggagacgccccuccagagcuccaccccgaccaucguggacgccgacgggcggaucuacauccgcaacuggcagggcgggauccugagcggcggcuucgagaagaaccccaagcccaucuucaccgaggggaagaaccagcuggagauccagaaccuccaggaggacugggaccacuucgagccccugcuguccagccuccugcggcgcaugccggagcuggagacccucgagaucaugaagcuggucaacugccccgagaccuucacgcccgacaugcggugcaucaugggcgagucccccgccgugcagggguacuucgugcuggccggcaugaacagcgccgggcucuccuucggcggcggggcgggcaaguaccuggccgaguggaugguccacggguacccgagcgagaacgugugggagcuggaccucaagcgcuucggcgcccugcaguccagccggaccuuccugcgccaccgggucauggaggugaugccccucauguacgaccugaaggugccccgcugggacuuccagaccgggcgccagcugcggaccagcccccucuacgaccgccuggacgcccagggcgcgcgguggauggagaagcacggcuucgagcgcccgaaguacuucgucccgcccgacaaggaccugcuggcccucgagcaguccaagacguucuacaagcccgacugguucgacaucguggaguccgaggugaagugcugcaaggaggccgucugcgugaucgacaugagcuccuucaccaaguucgagaucaccagcaccggggaccaggcccuggaggugcugcaguaccucuucuccaacgaccuggacguccccgugggccacaucgugcacacggggaugcugaacgagggcggcggguacgagaacgacugcagcaucgcccggcucaacaagcgcagcuucuucaugaucucccccaccgaccagcagguccacugcugggcguggcugaagaagcacaugcccaaggacagcaaccugcuccuggaggacgugaccuggaaguacaccgcccugaaccucaucggcccccgggccguggacguccuguccgagcugagcuacgccccgaugacgcccgaccacuuccccucccucuucugcaaggagaugagcgugggguacgccaacggcauccgcgugauguccaugacccacaccggggagccgggcuucaugcuguacauccccaucgaguacgcgcugcacgucuacaacgaggugaugagcgugggccagaaguacgggauccggaacgccggcuacuacgcccuccgcucccugcggaucgagaaguucuucgccuucugggggcaggacaucaacaaccugaccacgccccucgagugcggccgcgagagccgggucaagcuggagaaggggauggacuucaucggccgcgacgcccugcuccagcagaagcagaacggcguguacaagcggcugaccauguucauccuggacgaccacgacuccgaccucgaccuguggcccugguggggcgagccgaucuaccgcaacgggcaguacguggggaagaccaccagcuccgcguacagcuacucccuggagcggcacgucugccucggcuucgugcacaacuucagcgaggacaccggggaggagcaggucgugacggccgacuucaucaaccgcggcgaguacgagaucgacaucgccggcuaccgguuccaggccaaggcgaagcuguaccccguggccucccuguucacccagaagcgccgcaaggacgacauggagcucagcgaccugcacgggaaguga

SEQ ID NO: 34413 - RNA, 402 nt, Artificial Sequence
  derived and/or modified sequence opt1 from PDRG1__Homo_sapiens__NP_110442
augcugagccccgaggccgagcgggugcuccgguaccuggucgagguggaggagcuggccgaggaggugcucgcggacaagcgccagaucgucgaccuggacaccaagcggaaccagaaccgcgagggccugcgggcccuccagaaggaccugucccugagcgaggacgugauggugugcuucgggaacauguucaucaagaugccgcaccccgagaccaaggagaugaucgagaaggaccaggaccaccucgacaaggagaucgagaagcugcgcaagcagcugaaggucaaggugaaccgccucuucgaggcccagggcaagcccgagcugaagggguucaaccugaacccccucaaccaggacgagcugaaggcccugaaggugauccucaagggcuga

SEQ ID NO: 34414 - RNA, 4014 nt, Artificial Sequence
  derived and/or modified sequence opt1 from PDS5A__Homo_sapiens__NP_001093869
auggacuucaccgcccagcccaagccggccaccgcgcugugcggcguggucagcgccgacgggaagaucgccuacccgcccggcgugaaggagaucacggacaagaucaccaccgacgagaugaucaagcgccucaagaugguggucaagaccuucauggacauggaccaggacuccgaggacgagaagcagcaguaccugccccuggcccuccaccuggccagcgaguucuuccugcggaacccgaacaaggacgugcgccuccugguggcgugcugccuggccgacaucuuccggaucuacgcccccgaggcccccuacacgucccacgacaagcucaaggacaucuuccuguucaucacccgccagcugaaggggcucgaggacaccaagagcccccaguucaaccgguacuucuaccugcuggagaaccucgcgugggucaaguccuacaacaucugcuucgagcuggaggacugcaacgagaucuucauccagcuguuccgcacccucuucagcgugaucaacaacucccacaacaagaaggugcagaugcacaugcuggaccugaugagcuccaucaucauggagggcgacggggucacgcaggagcuccuggacagcauccugaucaaccucaucccggcccacaagaaccugaacaagcaguccuucgaccuggccaaggugcuccugaagcggaccgugcagaccaucgaggccugcaucgccaacuucuucaaccagguccuggugcucggccgcagcuccgugagcgaccuguccgagcacgucuucgaccugauccaggagcuguucgcgaucgacccccaccuccugcucagcgugaugccccagcuggaguucaagcugaaguccaacgacggcgaggagcggcucgccgugguccgccugcuggccaagcuguucgggagcaaggacuccgaccuggccacccagaaccggccccuguggcagugcuuccucggccgcuucaacgacauccacgugccggugcggcuggagagcgucaaguucgccagccacugccugaugaaccaccccgaccucgcgaaggaccugacggaguaccugaaggugcgcucccacgaccccgaggaggccauccggcacgacgugaucgucaccaucaucaccgccgccaagcgcgaccuggcccucgugaacgaccagcugcugggguucguccgggagcgcacccucgacaagcgguggcgcgugcggaaggaggcgaugaugggccuggcccagcuguacaagaaguacugccuccacggggaggccggcaaggaggccgccgagaaggugagcuggaucaaggacaagcugcugcacaucuacuaccagaacuccaucgacgacaagcuccuggucgagaagaucuucgcgcaguaccuggugccccacaaccucgagacggaggagcgcaugaagugccuguacuaccuguacgccagccucgacccgaacgccgugaaggcccugaacgagauguggaagugccagaacaugcugcgcucccacguccgggagcuccuggaccugcacaagcagcccaccagcgaggcgaacugcuccgccauguucggcaagcucaugaccaucgccaagaaccugcccgaccccgggaaggcccaggacuucgugaagaaguucaaccaggugcugggcgacgacgagaagcuccgcagccagcuggagcugcucaucuccccgaccugcagcugcaagcaggccgacaucugcguccgggagaucgcgcgcaagcuggccaaccccaagcagcccacgaaccccuuccuggagauggugaaguuccuccuggagcggaucgccccggugcacaucgacuccgaggccaucagcgcccuggucaagcucaugaacaaguccaucgaggggaccgcggacgacgaggaggagggcgugagccccgacaccgccauccgcuccggccuggagcugcucaaggugcugagcuucacccaccccacguccuuccacagcgccgagaccuacgagucccugcuccagugccugcggauggaggacgacaaggucgccgaggccgcgauccagaucuuccgcaacaccgggcacaagaucgagaccgaccugccccagauccggagcacgcucaucccgauccugcaccagaaggccaagcgcggcacgccccaccaggccaagcaggccgugcacugcauccacgcgaucuucaccaacaaggaggugcagcuggcccagaucuucgagccccucagccggucccugaacgccgacgucccggagcagcugaucacgccccucgugagccuggggcacaucuccaugcuggcccccgaccaguucgccagccccaugaaguccguggucgcgaacuucaucgugaaggaccuccugaugaacgaccgcagcaccggcgagaagaacgggaagcugugguccccggacgaggaggugagccccgagguccucgccaaggugcaggccaucaagcugcuggugcgguggcuccugggcaugaagaacaaccaguccaagagcgccaacuccacccugcgccuccugagcgccaugcuggucuccgagggcgaccucaccgagcagaagcggaucagcaaguccgacaugagccgccugcggcuggcggccggguccgccaucaugaagcucgcccaggagcccugcuaccacgagaucaucacccccgagcaguuccagcugugcgcccuggugaucaacgacgagugcuaccaggugcgccagaucuucgcgcagaagcuccacaaggcccuggucaagcugcuccugccgcuggaguacauggccaucuucgcccucugcgcgaaggaccccgugaaggagcggcgcgcccacgcccgccagugccugcugaagaacaucagcauccggcgcgaguacaucaagcagaaccccauggccaccgagaagcuccugagccugcuccccgaguacguggucccguacaugauccaccuccuggcccacgaccccgacuucacccggucccaggacguggaccagcuccgcgacaucaaggagugccugugguucaugcuggaggugcucaugaccaagaacgagaacaacagccacgcguucaugaagaagauggccgagaacaucaagcugacccgggacgcccagucccccgacgagagcaagaccaacgagaagcuguacacggucugcgacguggcccucugcgugaucaacuccaagagcgcccugugcaacgcggacucccccaaggacccgguccugcccaugaaguucuucacccagcccgagaaggacuucugcaacgacaagagcuacaucuccgaggagacccgcgugcuccugcugaccggcaagcccaagccggccggggugcugggcgccgucaacaagccccucagcgccacggggcggaagcccuacgugcgcuccaccggcaccgagaccggcagcaacaucaacgugaacuccgagcugaaccccagcacggggaaccggucccgcgagcagagcuccgaggccgcggagaccggcgucagcgagaacgaggagaacccggugcggaucaucuccgugacccccgucaagaacaucgaccccgugaagaacaaggagaucaacagcgaccaggccacccaggggaacaucagcuccgaccgcggcaagaagcggacggugaccgccgccggggccgagaacauccagcagaagaccgacgagaaggucgacgagagcggcccgcccgcgcccuccaagccccgccggggccgccggcccaagagcgagucccaggggaacgccaccaagaacgacgaccugaacaagcccaucaacaagggccgcaagcgggccgccguggggcaggagagccccggcggccucgaggcggggaacgccaaggcccccaagcugcaggaccuggccaagaaggccgcgccggccgagcgccagaucgaccuccagcgguga

SEQ ID NO: 34415 - RNA, 4344 nt, Artificial Sequence
  derived and/or modified sequence opt1 from PDS5B__Homo_sapiens__NP_055847
auggcccacagcaagacccgcaccaacgacggcaagaucacguaccccccgggggugaaggagaucuccgacaagaucagcaaggaggagaugguccggcgccugaagaugguggugaagaccuucauggacauggaccaggacuccgaggaggagaaggagcucuaccugaaccuggcccuccaccuggcgagcgacuucuuccugaagcaccccgacaaggacguccggcuccugguggccugcugccuggccgacaucuuccgcaucuacgcccccgaggcccccuacaccuccccggacaagcucaaggacaucuucauguucaucacccggcagcugaagggccuggaggacacgaagagcccccaguucaaccgcuacuucuaccuccuggagaacaucgcgugggugaaguccuacaacaucugcuucgagcuggaggacagcaacgagaucuucacccagcucuaccggacccuguucuccgucaucaacaacgggcacaaccagaaggugcacaugcacaugguggaccugaugagcuccaucaucugcgagggcgacaccgucagccaggagcuccuggacacggugcuggugaaccucguccccgcccacaagaaccugaacaagcaggccuacgaccuggccaaggcgcuccugaagcgcaccgcccaggccaucgagcccuacaucaccaacuucuucaaccaggugcugaugcucgggaagaccuccaucagcgaccuguccgagcacguguucgaccugauccucgagcuguacaacaucgacagccaccugcuccuguccguccugccgcagcucgaguucaagcugaagagcaacgacaacgaggagcggcugcagguggugaagcuccuggccaagauguucggcgccaaggacuccgagcuggcgagccagaacaagccccucuggcagugcuaccugggccgcuucaacgacauccacguccccauccggcuggagugcgugaaguucgccagccacugccucaugaaccaccccgaccuggccaaggaccugacggaguaccucaaggugcgcucccacgacccggaggaggccauccggcacgacgucaucgugagcaucgugaccgccgcgaagaaggacauccugcuggucaacgaccaccugcucaacuucgugcgcgagcggacccuggacaagcgcuggcggguccgcaaggaggccaugauggggcuggcccagaucuacaagaaguacgcccuccaguccgccgcgggcaaggacgccgccaagcagaucgccuggaucaaggacaagcugcugcacaucuacuaccagaacagcaucgacgaccggcuccugguggagcgcaucuucgcccaguacauggugccccacaaccuggagaccacggagcggaugaagugccucuacuaccuguacgcgacccuggaccucaacgccgucaaggcccugaacgagauguggaagugccagaaccugcuccgccaccaggugaaggaccugcuggaccucaucaagcagcccaagaccgacgccuccgugaaggcgaucuucagcaaggucauggugaucacccgcaaccugcccgacccggggaaggcccaggacuucaugaagaaguucacgcaggugcuggaggacgacgagaagauccggaagcagcucgagguccuggugucccccaccugcagcugcaagcaggccgagggcugcgugcgcgagaucaccaagaagcuggggaaccccaagcagcccaccaacccguuccucgagaugaucaaguuccugcuggagcggaucgcccccguccacaucgacacggaguccaucagcgcccucaucaagcaggugaacaaguccaucgacggcaccgcggacgacgaggacgagggcgugcccaccgaccaggccauccgcgccgggcuggagcugcucaagguccugagcuucacccaccccaucuccuuccacagcgccgagacguucgagucccugcucgccugccugaagauggacgacgagaagguggcggaggccgcccugcagaucuucaagaacaccggcagcaagaucgaggaggacuucccgcacauccgguccgcccuccugcccgugcugcaccacaagagcaagaaggggcccccccgccaggccaaguacgcgauccacugcauccacgccaucuucuccagcaaggagacccaguucgcccagaucuucgagccgcuccacaagagccuggaccccuccaaccuggagcaccucaucaccccccuggucacgaucggccacaucgcccugcucgcgccggaccaguucgccgccccccugaagagccugguggccaccuucaucgugaaggaccuccugaugaacgaccggcugcccggcaagaagaccaccaagcucuggguccccgacgaggagguguccccggagacgauggugaagauccaggccaucaagaugaugguccgcuggcugcuggggaugaagaacaaccacagcaaguccggcaccagcacccuccggcugcugaccaccauccuccacuccgacggggaccugacggagcagggcaagaucagcaagcccgacaugucccgccugcggcucgcggccgggagcgccaucgugaagcuggcccaggagcccugcuaccacgagaucaucacccuggagcaguaccagcucugcgcccuggcgaucaacgacgagugcuaccaggugcgccaggucuucgcccagaagcugcacaagggccucucccggcugcgccugccccucgaguacauggccaucugcgcccugugcgccaaggacccggugaaggagcggcgcgcgcacgcccggcagugccuggugaagaacaucaacguccgccgggaguaccucaagcagcacgccgccgugagcgagaagcugcugucccuccugcccgaguacgugguccccuacaccauccaccugcucgcgcacgaccccgacuacgugaaggugcaggacaucgagcagcugaaggacgucaaggagugccugugguucgugcucgagauccugauggccaagaacgagaacaacagccacgccuucauccgcaagaugguggagaacaucaagcagaccaaggacgcccagggcccggacgacgccaagaugaacgagaagcuguacacggucugcgacguggcgaugaacaucaucauguccaagagcaccaccuacucccucgagagccccaaggaccccgugcugcccgcccgcuucuucacccagccggacaagaacuucagcaacacgaagaacuaccugccccccgagaugaaguccuucuucacccccgggaagccgaagaccaccaacguccucggcgccgugaacaagccccugagcuccgccgggaagcagagccagacgaaguccagccggauggagaccguguccaacgccagcuccagcuccaaccccagcucccccggccgcaucaaggggcggcuggacagcuccgagauggaccacagcgagaacgaggacuacaccauguccagcccgcuccccggcaagaaguccgacaagcgcgacgacagcgaccugguccggagcgagcuggagaagccccgcggccggaagaagaccccggugacggagcaggaggagaagcucgggauggacgaccugaccaagcuggugcaggagcagaagcccaagggcucccagcgcagccggaagcgcgggcacaccgcguccgagagcgacgagcagcaguggcccgaggagaagcggcugaaggaggacauccucgagaacgaggacgagcagaacucccccccgaagaagggcaagcgcgggcggccccccaagccccugggcggcgggaccccgaaggaggagcccacgaugaagaccagcaagaagggcuccaagaagaagagcgggccccccgccccggaggaggaggaggaggaggagcgccaguccggcaacaccgagcagaagagcaaguccaagcagcaccgggucagccgccgggcccagcagcgcgccgagucccccgagagcuccgccaucgagagcacccaguccacgccccagaagggccgggggcgccccagcaagaccccgucccccagccagcccaagaagaacgugcgggugggccgcagcaagcaggcggccaccaaggagaacgacuccagcgaggaggucgacguguuccagggguccagccccgucgacgacaucccgcaggaggagaccgaggaggaggagguguccacggugaacguccgccggcgcagcgccaagcgggagcgccgguga

SEQ ID NO: 34416 - RNA, 1248 nt, Artificial Sequence
  derived and/or modified sequence opt1 from PDSS1__Homo_sapiens__NP_055132
auggccagccgcugguggcgguggcgccggggcugcuccuggaagcccgccgcgcgcagcccggggcccggcucccccgggcgggccggcccccuggggccgagcgccgccgccgaggugcgcgcgcagguccaccggcgcaagggccucgaccugucccagauccccuacaucaaccuggugaagcaccucaccagcgccugccccaacgugugccggaucucccgcuuccaccacaccacgcccgacagcaagacccacuccggcgagaaguacaccgacccguucaagcugggguggcgggaccugaagggccucuacgaggacauccgcaaggagcugcugaucagcaccuccgagcucaaggagaugagcgaguacuacuucgacgggaagggcaaggccuuccggcccaucaucgucgcccugauggcgcgcgccugcaacauccaccacaacaacucccggcacgugcaggccagccagcgcgccaucgcccugaucgcggagaugauccacacggccucccucgugcacgacgacgucaucgacgacgccagcucccggcgcgggaagcacaccgugaacaagaucuggggcgagaagaaggccgugcuggccggcgaccugauccucagcgcggccuccaucgcccuggcccggaucgggaacaccaccgucaucagcauccugacccaggugaucgaggaccucgugcgcggcgaguuccugcagcuggggagcaaggagaacgagaacgagcgguucgcccacuaccucgagaagacguucaagaagaccgcgucccugaucgccaacagcugcaaggccgucuccgugcugggcugccccgaccccgugguccacgagaucgccuaccaguacggcaagaacguggggaucgccuuccagcucaucgacgacgugcuggacuucaccagcugcuccgaccagaugggcaagccgacgagcgcggaccugaagcucgggcuggccaccggccccguccuguucgccugccagcaguuccccgagaugaacgccaugaucaugcgccgcuucucccuccccggggacguggaccgggcgcgccaguacgugcugcagagcgacggcguccagcagaccaccuaccuggcccagcaguacugccacgaggccauccgggagaucuccaagcuccgcccgagccccgagcgggacgcccugauccagcuguccgagaucgugcucacgcgcgacaaguga

SEQ ID NO: 34417 - RNA, 1200 nt, Artificial Sequence
  derived and/or modified sequence opt1 from PDSS2__Homo_sapiens__NP_065114
augaacuuccgccagcugcuccugcaccucccccgguaccugggcgccagcgggagcccccgccggcugugguggucccccucccuggacaccaucagcuccgugggcagcuggcgcgggcgguccagcaagucccccgcccacuggaaccaggucgugagcgaggcggagaagaucgugggcuaccccaccuccuucaugagccuccgcugccugcuguccgacgagcucagcaacaucgccaugcagguccggaagcugguggggacgcagcacccgcugcucaccaccgcccgcggccuggugcacgacuccuggaacagccugcagcuccggggccuggucgugcugcucaucuccaaggccgccgggcccagcuccgugaacaccagcugccagaacuacgacauggucagcggcaucuacuccugccagcgcagccuggcggagaucacggagcugauccacaucgcccuccuggugcaccgggggaucgugaaccugaacgagcuccaguccagcgacggcccccugaaggacaugcaguucgggaacaagaucgccauccuguccggcgacuuccuccuggccaacgcgugcaacggccuggcccuccugcagaacaccaaggucguggagcugcucgccagcgcccugauggaccuggugcagggggucuaccacgagaacuccaccagcaaggaguccuacaucaccgacgacaucggcaucagcacguggaaggagcagaccuuccucucccacggggcccugcuggccaagagcugccaggcggccauggagcucgccaagcacgacgccgaggugcagaacauggcguuccaguacggcaagcacauggccaugucccacaagaucaacagcgacgugcagcccuucaucaaggagaagaccuccgacagcaugaccuucaaccugaacuccgccccggucgugcugcaccaggaguuccucggccgcgaccuguggaucaagcagaucggggaggcccaggagaagggccggcuggacuacgccaagcuccgcgagcggaucaaggcggggaagggcgugacgagcgccaucgaccugugccgcuaccacgggaacaaggcccuggaggcccucgaguccuucccgcccagcgaggcccggagcgcgcuggagaacaucgucuucgccgugacccgcuucuccuga

SEQ ID NO: 34418 - RNA, 852 nt, Artificial Sequence
  derived and/or modified sequence opt1 from PDX1__Homo_sapiens__NP_000200
augaacggcgaggagcaguacuacgccgccacccagcuguacaaggaccccugcgcguuccagcgcgggccggcccccgaguucagcgccuccccccccgccugccucuacaugggccggcagccgcccccccccccgccccaccccuuccccggggcccugggcgcgcuggagcaggggagcccgcccgacaucucccccuacgaggugcccccgcucgccgacgaccccgccgucgcccaccugcaccaccaccugcccgcgcagcucgcccugccccacccgcccgccggccccuuccccgagggcgccgagccgggggugcuggaggagcccaaccgcgugcagcuccccuuccccuggaugaagagcaccaaggcccacgcguggaagggccagugggccgggggcgccuacgccgccgagccggaggagaacaagcggacgcgcaccgcguacacccgggcccagcugcuggagcucgagaaggaguuccuguucaacaaguacaucucccgcccccggcgcgucgagcuggccgugaugcucaaccugaccgagcggcacaucaagaucugguuccagaaccgccggaugaaguggaagaaggaggaggacaagaagcgcgggggcggcacggccguggggggcgggggcgucgccgagcccgagcaggacugcgcggugaccagcggcgaggagcugcucgcccugccgcccccccccccgcccgggggcgccgugccccccgccgccccggucgcggcccgggaggggcgccugccccccggccucuccgccagcccccagccguccagcguggccccccggcgcccccaggagccccgguga

SEQ ID NO: 34419 - RNA, 2283 nt, Artificial Sequence
  derived and/or modified sequence opt1 from PDXDC1__Homo_sapiens__NP_001272374
auggacgccagccuggagaagaucgccgaccccacccucgcggagaugggcaagaaccugaaggaggccgugaagaugcuggaggacucccagcgcaccgaggaggagaacgggaagaagcucaucagcggcgacaucccggggccccugcagggccggauccagaacaucggggagcagggccacauggcccugcucggccacucccugggggccuacaucagcacgcuggacaaggagaagcuccgcaagcugaccacccggauccuguccgacaccacgcucuggcugugccgcaucuuccgguacgagaacggcugcgccuacuuccacgaggaggagcgcgaggggcuggcgaagaucugccggcucgccauccacagccgcuacgaggacuucgucguggacggcuucaacgugcuguacaacaagaagcccgucaucuaccuguccgccgccgcgcggcccgggcucggccaguaccugugcaaccagcugggccucccguuccccugccugugccgcgugcccugcaacaccguguucgggagccagcaccagauggacgucgccuuccuggagaagcucaucaaggacgacaucgagcggggccgccugccccugcuccugguggccaacgccgggaccgccgcggugggccacaccgacaagaucggccggcugaaggagcucugcgagcaguacgggaucuggcugcacgucgagggcgugaaccuggccacgcucgcccugggguacguguccagcuccguccuggccgccgcgaagugcgacagcaugaccaugaccccgggccccuggcucgggcugcccgccgugcccgccgugacccuguacaagcacgacgacccggcccucacgcuggucgccggccugaccuccaacaagcccaccgacaagcuccgcgcgcugccccuguggcucagccugcaguaccugggccucgacggguucguggagcggaucaagcacgccugccagcugucccagcgccugcaggagagccugaagaaggugaacuacaucaagauccucgucgaggacgagcuguccagccccgugguggucuuccgguucuuccaggagcugccgggcuccgaccccguguucaaggccgugcccguccccaacaugaccccgagcggggugggccgcgagcggcacagcugcgacgcccucaaccgcuggcugggggagcagcugaagcagcucguccccgccuccggccugacggugauggaccuggaggcggaggggaccugccuccgguucagcccccugaugaccgccgccgugcugggcacccgcggcgaggacgucgaccagcucguggccugcaucgaguccaagcugcccgugcugugcugcacgcuccagcugcgcgaggaguucaagcaggaggucgaggcgaccgccgggcugcucuacguggacgacccgaacuggagcggcaucggggugguccgguacgagcacgccaacgacgacaaguccagccugaaguccgaccccgagggcgagaacauccacgccggccugcucaagaagcugaacgagcuggagagcgaccucaccuucaagaucgggcccgaguacaaguccaugaaguccugccuguacgugggcauggccuccgacaacguggacgcggccgagcuggucgagaccaucgccgccacggcccgcgagaucgaggagaacagccggcuccuggagaacaugaccgagguggugcgcaaggggauccaggaggcgcaggucgagcugcagaaggccuccgaggagcggcuccuggaggagggcgugcugcgccagauccccguggucggcagcgugcucaacugguucuccccggugcaggcccugcagaaggggcggaccuucaaccugaccgccggcagccucgaguccacggagcccaucuacgucuacaaggcccagggggcgggcgugacccugcccccgacccccagcgggucccgcaccaagcagcggcugcccggccagaagcccuucaagcgcagccuccggggcagcgacgcccuguccgagacgagcuccgugagccacaucgaggaccuggagaaggucgagcgccucuccagcgggccggagcagaucacccuggaggccuccagcaccgagggccaccccggggcccccagcccccagcacaccgaccagacggaggcguuccagaagggcgugccgcaccccgaggacgaccacagccagguggaggggcccgagucccugcgguga

SEQ ID NO: 34420 - RNA, 939 nt, Artificial Sequence
  derived and/or modified sequence opt1 from PDXK__Homo_sapiens__NP_003672
auggaggaggagugccgcgugcugagcauccagucccacgucauccggggcuacguggggaaccgcgccgccaccuucccccuccaggugcugggcuucgagaucgacgcggucaacagcgugcaguucuccaaccacaccggguacgcccacuggaagggccaggugcugaacagcgacgagcuccaggagcuguacgaggggcugcggcucaacaacaugaacaaguacgacuacguccugacgggcuacacccgcgacaaguccuuccuggccauggugguggacaucguccaggagcucaagcagcagaacccgcggcugguguacgugugcgaccccguccugggcgacaagugggacggggagggcagcauguacgugcccgaggaccuccugcccguguacaaggagaaggucgugccgcuggccgacaucaucacccccaaccaguucgaggccgagcuccuguccgggcgcaagauccacagccaggaggaggcgcugcgggugauggacaugcuccacuccaugggccccgacaccgucgugaucacgagcuccgaccugcccagcccgcagggguccaacuaccugaucgugcucggcagccagcgccggcgcaaccccgccggcuccgucgugauggagcggauccgcauggacauccggaagguggacgccgucuucguggggaccggcgaccuguucgccgcgaugcugcucgccuggacccacaagcaccccaacaaccugaaggucgccugcgagaagaccgugagcacgcugcaccacgugcuccagcgcaccauccagugcgccaaggcccaggcgggggagggcguccggcccuccccgaugcagcuggagcugcgcauggugcagagcaagcgggacaucgaggaccccgagaucgugguccaggccaccgugcucuga

SEQ ID NO: 34421 - RNA, 891 nt, Artificial Sequence
  derived and/or modified sequence opt1 from PDXP__Homo_sapiens__NP_064711
auggcccgcugcgagcggcugcgcggcgccgcgcuccgggacgugcuggggcgcgcccagggcguccuguucgacugcgacggggugcucuggaacggcgagcgggccgugcccggggccccggagcugcuggagcgccucgcccgggcgggcaaggccgcccuguucgucagcaacaacucccgccgggcccgccccgagcuggcgcuccgguucgcccgccugggcuucgggggccugcgggccgagcagcuguucagcuccgcccugugcgccgcgcgccugcuccggcagcgccugcccgggcccccggacgcccccggcgccguguucgugcucgggggcgagggccuccgggccgagcugcgcgccgcggggcugcggcucgccggcgaccccagcgccggggacggcgccgcgccccgcguccgggccgugcuggugggcuacgacgagcacuucuccuucgccaagcugcgcgaggccugcgcccaccuccgcgacccggagugccugcuggucgccaccgaccgggaccccuggcacccccucagcgacgggucccgcacccccggcacggggagccuggcggccgccguggagaccgccuccggccggcaggcgcugguggucgggaagccgagccccuacauguucgagugcaucaccgagaacuucuccaucgaccccgcccgcacccucauggugggcgaccggcuggagacggacauccuguucggccaccgcugcgggaugaccaccgugcucacccugacgggcgucagccggcuggaggaggcccaggccuaccucgccgcggggcagcacgaccuggugccccacuacuacguggaguccaucgccgaccugaccgagggccucgaggacuga

SEQ ID NO: 34422 - RNA, 765 nt, Artificial Sequence
  derived and/or modified sequence opt1 from PDYN__Homo_sapiens__XP_011527552
auggccuggcagggccuggugcucgccgcgugccugcugauguuccccagcaccaccgccgacugccucucccgcugcagccugugcgccgucaagacgcaggacgggccgaagcccaucaacccccugaucugcucccuccagugccaggccgcccugcugcccagcgaggagugggagcggugccaguccuuccucagcuucuucaccccguccacccugggccugaacgacaaggaggaccucgggagcaaguccgugggcgaggggcccuacagcgagcuggcgaagcuguccggcagcuuccucaaggagcuggagaaguccaaguuccugcccagcaucuccaccaaggagaacacgcucagcaagucccuggaggagaagcugcgcggccucagcgacggguuccgggagggcgccgaguccgagcugaugcgcgacgcccagcugaacgacggggccauggagaccggcacccucuaccuggcggaggaggaccccaaggagcaggucaagcgguacgggggcuuccugcgcaaguacccgaagcggagcagcgagguggccggcgagggggacggcgacuccauggggcacgaggaccucuacaagcgcuacggcggcuuccugcggcgcauccggcccaagcugaagugggacaaccagaagcgcuacgggggcuuccuccggcgccaguucaagguggugacccggagccaggaggaccccaacgccuacuccggggagcuguucgacgccuga

SEQ ID NO: 34423 - RNA, 8520 nt, Artificial Sequence
  derived and/or modified sequence opt1 from PDZD2__Homo_sapiens__NP_835260
augcccaucacccaggacaacgccgugcugcaccucccccugcuguaccaguggcuccagaacucccugcaggagggcggggacggccccgagcagcgccugugccaggccgccauccagaagcuccaggaguacauccagcugaacuucgccgucgacgaguccaccgugccgcccgaccacuccccgcccgagauggagaucugcaccguguaccugaccaaggagcucggggacaccgagaccgucggccuguccuucgggaacauccccguguucggcgacuacggcgagaagcggcgcgggggcaagaagcggaagacccaccaggggcccgugcuggacgucggcugcaucugggugaccgagcuccgcaagaacuccccggccgggaaguccggcaaggugcggcugcgcgacgagauccugagccucaacggccagcugauggucgggguggacguguccggcgccagcuaccuggccgagcagugcuggaacgggggcuucaucuaccucaucaugcugcggcgcuucaagcacaaggcccacuccaccuacaacggcaacagcuccaacagcuccgagcccggggagacccccacccuggagcucggcgaccggaccgccaagaaggggaagcgcacccggaaguucggcgucaucagccggccgcccgccaacaaggcccccgaggaguccaaggggagcgccggcugcgagguguccagcgaccccuccaccgagcuggagaacggccccgaccccgagcuggggaacggccacguguuccagcucgagaacgggcccgacagccugaaggaggucgccggcccccaccuggagcggagcgagguggaccgcgggaccgagcaccggauccccaagaccgacgccccgcucaccaccuccaacgacaagcgccgguucagcaagggcggcaagacggacuuccaguccagcgacugccuggcccgcgaggagguggggcggaucuggaagauggagcugcucaaggaguccgacggccuggggauccaggucagcggcgggcgcggcuccaagcggagcccccacgccaucguggugacccaggucaaggagggcggggccgcccaccgcgacggccgccugucccucggggacgagcugcuggugaucaacggccaccuccuggugggccugagccacgaggaggccgucgccauccuccgguccgccaccgggauggugcagcuggucguggcgagcaaggagaacuccgccgaggaccugcuccgccugaccagcaagucccugcccgaccucacgagcuccguggaggacgucagcuccuggaccgacaacgaggaccaggaggccgacggcgaggaggacgaggggaccagcagcuccgugcagcgggccaugcccggcaccgacgagccgcaggacgugugcggggccgaggagagcaagggcaaccuggagucccccaagcagggcagcaacaagaucaagcugaagucccgccucagcgggggcguccaccggcuggaguccguggaggaguacaacgagcugauggugcgcaacggggacccccggauccgcaugcuggaggucagccgggacggccgcaagcacucccucccccagcugcuggacagcuccagcgcgucccaggaguaccacaucgugaagaaguccacgcggucccucagcaccacccagguggaguccccguggcgccugauccggcccagcgucaucagcaucaucgggcuguacaaggagaagggcaagggccucggguucuccaucgccggcgggcgcgacugcauccggggccagauggggaucuucgugaagaccaucuuccccaacggcagcgccgccgaggacggccgccugaaggagggggacgagauccuggacgugaacggcaucccgaucaaggggcucacguuccaggaggccauccacaccuucaagcagauccgguccggccuguucguccugaccgugcgcaccaagcucgugagccccucccugacgcccugcagcacccccacccacaugucccggagcgcguccccgaacuucaacaccagcgggggcgccuccgccggcgggagcgacgagggcuccagcuccagccuggggcgcaagacgcccggccccaaggaccgcaucgucauggaggugacccucaacaaggagccccgggugggccuggggaucggcgccugcugccuggcgcucgagaacuccccgcccgggaucuacauccacagccuggcccccggcuccgucgccaagauggagagcaaccugagccgcggggaccagauccucgaggugaacuccgugaacguccggcacgccgcccugagcaaggugcacgcgauccuguccaagugcccgcccggccccgugcgccucgucaucggccggcaccccaaccccaaggugagcgagcaggagauggacgaggugaucgcccgcuccaccuaccaggagagcaaggaggccaacuccagcccggggcugggcacgccccugaagucccccagccucgccaagaaggacucccugaucagcgaguccgagcugagccaguacuucgcccacgacguccccgggccgcucuccgacuucaugguggcgggcagcgaggacgaggaccaccccggguccggcugcagcaccuccgaggagggcagccugccgcccagcacguccacccacaaggagccggggaagccccgggccaacagccuggugacccucggcucccaccgcgccagcgggcuguuccacaagcaggucaccguggcccggcaggccucccugcccggcagcccgcaggcgcuccgcaacccccugcugcggcagcgcaagguggggugcuacgacgccaacgacgccuccgacgaggaggaguucgaccgggagggcgacugcaucagccuccccggcgcccugcccgggccgauccgcccccuguccgaggacgacccccggcgcgucagcaucuccagcuccaagggcauggacgugcacaaccaggaggagcggccccgcaagacgcucgugagcaaggcgaucuccgccccgcugcuggggagcuccgucgaccucgaggagagcauccccgagggcaugguggacgccgccuccuacgccgcgaaccugaccgacagcgccgaggcccccaagggcagccccggguccugguggaagaaggagcugagcggcuccagcuccgccccgaagcucgaguacaccgugcggaccgacacgcagagccccaccaacaccgggucccccagcagcccccagcagaaguccgagggccuggggucccgccaccggccggucgcccgcgugagcccccacugcaagcgcuccgaggcggaggccaagcccagcggcucccagaccgugaaccugacgggccgggccaacgaccccugcgaccucgacagccgcguccaggccaccuccgugaaggugaccgucgccggguuccagccgggcggggcgguggagaaggagagccugggcaagcugaccacgggggacgccugcguguccaccagcugcgagcucgccagcgcccugucccaccuggacgcgagccaccucaccgagaaccugcccaaggccgccuccgagcugggccagcagcccaugaccgagcucgacagcuccagcgaccugaucuccagccccggcaagaagggggccgcccacccggaccccuccaagacgagcgucgacaccggccaggugucccggcccgagaaccccagccagccggcgagcccccgcgucaccaagugcaaggcccggagccccgugcgccugccgcacgaggggucccccagccccggcgagaaggccgccgcgccgcccgacuacuccaagacccggagcgcguccgagacgagcacgccccacaacacccgccggguggccgcccuccgcggggccggccccggcgccgaggggaugacccccgcgggcgccguccugcccggggacccccugacgagccaggagcagcggcagggcgcccccgggaaccacuccaaggcccucgagaugaccggcauccacgcccccgagagcucccaggagccgagccugcuggagggcgcggacuccgugagcucccgcgcgccccaggccagccucuccaugcugcccagcaccgacaacaccaaggaggccugcgggcacguguccggccacugcugccccgggggcagccgggaguccccggucacggacaucgacagcuucaucaaggagcuggacgcguccgccgcccgcagccccuccagccagaccggcgacagcgggucccaggagggcagcgcccaggggcacccgcccgccggcgccggcggcggcuccagcugccgggccgagccggugcccgggggccagaccuccagcccccgccgggccugggccgccggggcgcccgccuacccgcagugggccucccagcccagcgugcucgacuccaucaaccccgacaagcacuucaccgucaacaagaacuuccugagcaacuacucccgcaacuucagcuccuuccacgaggacagcacgucccugagcggccucggggacuccaccgagcccagccuguccagcauguacggcgacgccgaggacagcuccagcgacccggagucccugaccgaggcgccccgggcgagcgcccgcgacggcuggagcccgccccgcagccgggugucccuccacaaggaggaccccagcgaguccgaggaggagcagaucgagaucugcagcacccgcgggugccccaacccgcccuccagccccgcccaccuccccacccaggccgcgaucugccccgccuccgccaaggugcugagccucaaguacuccacgccccgggagagcgucgccagcccccgcgagaaggccgcgugccugcccggcagcuacaccuccgggcccgacagcagccagcccuccagccugcucgagauguccagccaggagcacgagacccacgccgacaucuccaccagccagaaccaccggcccuccugcgccgaggagacgaccgaggugaccagcgccuccagcgccauggagaacagcccccugagcaagguggcgcgccacuuccacagcccgcccaucauccugagcucccccaacauggucaacggccucgagcacgaccugcuggacgacgagacccucaaccaguacgagacgagcaucaacgccgccgccucccugagcuccuucagcguggacgugcccaagaacggggagagcguccuggagaaccuccacaucuccgagagccaggaccuggacgaccugcugcagaagcccaagaugaucgcccggcgccccaucauggcgugguucaaggagaucaacaagcacaaccagggcacccaccuccgguccaagaccgagaaggagcagccccugaugcccgcccgcagccccgacuccaagauccagauggugagcuccagccagaagaagggcgugaccgucccgcacagcccgccccagccgaagacgaaccuggagaacaaggaccucagcaagaagucccccgccgagaugcugcugaccaacgggcagaaggccaagugcggccccaagcucaagcggcugagccugaaggggaaggcgaaggugaacuccgaggcccccgccgccaacgccgugaaggcgggcgggaccgaccaccgcaagccgcucaucagcccccagaccucccacaagacgcugagcaaggccgucucccagcggcugcacguggccgaccacgaggaccccgaccgcaacaccaccgccgcgccccggagcccgcagugcgugcucgaguccaagccgccccuggcgaccagcggcccccugaagccgagcgucuccgacacgagcauccgcaccuucgugagcccccugaccagccccaagcccgugccggagcagggcauguggucccgguuccacauggccguccugagcgagcccgaccgcgggugccccaccacgcccaaguccccgaagugccgggccgagggccgcgcgccccgggccgacagcgggcccgugucccccgcggccagccgcaacggcauguccguggccggcaaccgccagagcgagccgcggcuggccucccacgucgccgcggacaccgcccagccccgccccaccggggagaagggcgggaacaucauggccagcgaccggcucgagcgcaccaaccagcugaagaucguggagaucuccgccgaggcggugagcgagacggucugcggcaacaagcccgccgaguccgaccggcgcgggggcugccuggcccagggcaacugccaggagaaguccgagauccggcucuaccgccagguggccgaguccagcaccagccacccguccagccugcccucccacgccagccaggcggagcaggagaugucccggagcuucuccauggccaagcuggccagcuccagcuccagccuccagaccgccauccgcaaggccgaguacucccaggggaaguccucccugaugagcgacucccggggcgugccccgcaacagcauccccgggggccccagcggggaggaccaccuguacuucacgccccggcccgcgacgcgcaccuacuccaugccggcccaguucagcucccacuucggccgggagggccacccgccccacagccucgggcgcucccgggacagccagguccccgugaccuccagcguggucccggaggccaaggccucccgcggcgggcugcccagccuggccaacggccaggggaucuacuccgugaagccccuccuggacaccagccggaaccugcccgcgacggacgagggcgacaucaucuccgugcaggagaccagcugccucgucaccgacaagaucaaggugacccgccgccacuacugcuacgagcagaacuggccgcacgaguccaccagcuucuucuccgugaagcagcggaucaagagcuucgagaaccuggccaacgccgaccgccccgucgccaaguccggcgcgagccccuuccugagcguguccagcaagcccccgaucgggcggcgcuccagcggcuccaucgugagcgggucccucggccaccccggcgacgccgccgcccggcugcugcgccggagccucuccagcugcuccgagaaccagagcgaggccgggacgcugcugccccagauggcgaagucccccagcaucaugacccucaccaucucccgccagaacccgcccgagaccagcuccaagggcagcgacuccgagcugaagaagucccuggggccccucggcauccccacgccgaccaugacccuggccagccccgucaagcggaacaaguccagcgugcgccacacccagcccucccccgucagccgguccaagcugcaggagcuccgcgcccugagcaugccggaccuggacaagcucugcuccgaggacuacagcgccgggcccuccgccgugcuguucaagacggagcuggagaucacgccccggcgcagcccggggccgcccgcgggcgggguguccugccccgagaagggcgggaaccgggccugcccgggcgggagcggccccaagaccuccgccgccgagacccccagcuccgccagcgacacgggcgaggcggcccaggaccuccccuuccgccgguccuggagcgucaaccuggaccagcugcucguguccgccggggaccagcagcgccugcagagcgugcugagcuccgucggcagcaaguccaccauccucacccugauccaggaggccaaggcgcagagcgagaacgaggaggacgugugcuucaucgugcugaaccggaaggagggguccggccucggguucagcgucgccggcggcaccgacguggagccgaaguccaucacggugcaccgcgucuucagccagggggccgccucccaggagggcaccaugaaccgcggggacuuccugcugagcgugaacggcgccucccucgcggggcuggcccacggcaacgugcugaagguccuccaccaggcccagcugcacaaggacgcccugguggugaucaagaagggcauggaccagccccgccccagcgcccgccaggagcccccgaccgcgaacgggaagggccuccugucccggaagaccaucccccuggagcccgggaucggccgcagcgucgccgugcacgacgcccucugcguggagguccugaagacguccgccggccuggggcucagccuggacggcgggaaguccagcgugaccggcgacgggccccuggugaucaagcgggucuacaagggcggcgccgcggagcaggccgggaucaucgaggccggcgacgagauccucgccaucaacgggaagccgcuggugggccugaugcacuucgacgccuggaacaucaugaaguccgugcccgaggggcccguccagcuccugauccgcaagcaccggaacagcagcuga

SEQ ID NO: 34424 - RNA, 2328 nt, Artificial Sequence
  derived and/or modified sequence opt1 from PDZD4__Homo_sapiens__NP_001290441
augggcugcaacaugugcgugguccagaagcccgaggagcaguacaaggugaugcuccaggugaacgggaaggagcugagcaagcugucccaggagcagacccugcaggcccuccgcagcuccaaggagccgcuggucauccaggugcugcggcgcagcccccggcuccgcggcgacuccagcugccacgaccugcagcugguggacuccgggacccagacggacaucaccuucgagcacaucauggcccucggcaagcugcggccgcccaccccgcccauggucauccuggagcccuacgugcucagcgagcugcccccgaucucccacgaguacuacgaccccgcggaguucauggagggcgggccccaggaggccgaccgccuggacgagcucgaguacgaggagguggagcuguacaagagcucccaccgggacaagcugggccucauggucugcuaccgcaccgacgacgaggaggaccuggggaucuacgugggcgaggugaaccccaacagcaucgccgccaaggacgggcggauccgcgagggcgaccggaucauccagaucaacggggucgacgugcagaaccgcgaggaggccguggcgauccugucccaggaggagaacacgaacaucagccuccuggucgcccggccggagucccagcuggccaagcgcuggaaggacagcgaccgggacgacuuccucgacgacuucggcuccgagaacgagggcgagcugcgcgcccggaagcugaaguccccgcccgcgcagcagcccgggaacgaggaggagaagggcgcccccgacgccgggcccggccucagcaacagccaggagcuggacagcggcguggggcgcaccgacgaguccacccggaacgaggagagcuccgagcacgaccugcucggcgacgagccgcccagcuccaccaacacgcccgggagccugcgcaaguucggccugcagggggacgcccuccagucccgggacuuccacuucagcauggacucccugcuggccgagggcgcgggccucgggggcggggacgugcccggccugaccgacgaggaguacgagcgcuaccgcgagcugcucgagaucaagugccaccuggagaacgggaaccagcugggccuccuguucccccgggccagcggcgggaacuccgcccuggacgucaaccgcaacgagagccucggccacgagauggccaugcuggaggaggagcugcggcaccucgaguucaagugccgcaacauccugcgggcccagaagaugcagcagcugcgcgagcggugcaugaaggcguggcugcucgaggaggagucccuguacgaccuggccgccagcgagcccaagaagcacgagcucuccgacaucagcgagcugccggagaaguccgacaaggacagcaccuccgccuacaacaccggggagagcugccgcagcacgccccugcucguggagccccugcccgaguccccgcugcggcgcgccauggcgggcaacagcaaccucaaccggaccccgcccgggcccgccguggccacccccgccaaggccgcgcccccgcccggcucccccgccaaguuccgcagccugucccgggaccccgaggccggccgccggcagcacgccgaggagcgcgggcggcgcaaccccaagaccggccugacgcucgagcgggucgggcccgagagcucccccuaccugagccgccgccaccggggccagggccaggagggggagcacuaccacuccugcgugcagcuggcgcccacccgcggccucgaggagcuggggcacggcccccugagccucgccgggggcccgcgggugggcggggucgccgccgccgcgaccgaggcgccccgcauggaguggaaggugaagguccgguccgacggcacccgcuacguggccaagcggcccgugcgcgaccggcugcugaaggcccgcgcccucaagauccgggaggagcgcagcgggaugacgaccgacgacgacgccgucuccgagaugaagaugggccgguacuggagcaaggaggagcgcaagcagcaccugauccgggcccgcgagcagcggaagcgccgggaguucaugaugcagucccgccuggagugccuccgggagcagcagaacggggacagcaagcccgagcugaacaucaucgcccugucccaccgcaagaccaugaagaagcgcaacaagaagauccucgacaacuggaucaccauccaggagaugcuggcccacggcgcccggagcgcggacggcaagcgcguguacaacccgcugcucagcgugacgaccgucuga

SEQ ID NO: 34425 - RNA, 3102 nt, Artificial Sequence
  derived and/or modified sequence opt1 from PDZD7__Homo_sapiens__NP_001182192
auggcccagggcuucgccgugggguucgacccccugggccucggggaccugagcuccggcagccuguccagccucuccagccgcgggcaccugggcuccgacagcggcuccaccgcgacccgguaccugcuccgcaagcagcagcggcugcugaacgggccgccccgcggcauccgggccagcucccccauggggcgcgucauccucaucaacagccccaucgaggccaacuccgacgagagcgacaucauccacuccgugcggguggagaagagcccggccggccgccugggguucuccguccggggcggcagcgagcacgggcugggcaucuucguguccaagguggaggaggggagcagcgccgagcgcgcgggccucugcgucggcgacaagaucacggaggugaacgggcugucccuggagagcaccaccaugggcuccgccgugaagguccucaccagcuccagccggcugcacaugauggugcgccggauggggcgcgugcccggcaucaaguucuccaaggagaagacgaccugggucgacguggugaaccggcgccuggucguggagaagugcgggagcacccccuccgacaccagcuccgaggacggcgugcggcgcaucguccaccucuacacgaccagcgacgacuucugccugggcuucaacauccgggggggcaaggaguucgggcugggcaucuacguguccaagguggaccacgggggccucgccgaggagaacggcaucaaggucggggaccaggugcuggccgcgaacggcgugcgcuucgacgacaucagccacucccaggccgucgaggugcugaaggggcagacccacaucaugcucaccaucaaggagacgggccgguaccccgccuacaaggagauggucagcgaguacugcuggcuggaccgccuguccaacggggugcuccagcagcugagcccggccuccgagagcagcuccagcguguccagcugcgccuccagcgcgcccuacuccagcggcucccugcccagcgaccgcauggacaucugccucggccaggaggagcccgggucccggggcccgggguggggccgcgccgacaccgccaugcagaccgagcccgacgccggcgggcgggucgagaccuggugcagcgugcgccccacggugauccugcgggacaccgccauccgcuccgacggcccccacccggggcggcgccuggacagcgcgcucuccgagagccccaagaccgcccugcugcucgcccugucccggccccgccccccgaucacccggagccagagcuaccugacgcucugggaggagaagcagcagcgcaagaaggagaaguccggcagccccggggagaagggcgcccugcagcgguccaagacccugaugaaccucuucuucaagggcgggcgccagggccggcuggcccgcgacgggcggcgcgaggcguggacccuggacagcggcucccucgccaagaccuacccccggcuggacaucgagaaggccgggggcgucggccccgugcagaaguucgugacguggcgccugcgccgggaccaggagcgcgggcgggcccuccugagcgcccgcuccggcagcccguccagccagcugcccaacgucgacgagcaggugcaggcgugggagucccggcgcccccugauccaggaccucgcccagcggcugcugaccgacgacgaggugcucgccgucacccgccacugcagccgguacgugcacgaggggggcaucgaggaccuggugcgcccccugcucgccauccuggaccggccggagaagcugcuccugcugcaggacauccgcuccgucguggcgcccaccgaccucgggcgguucgacagcauggugaugcuggucgagcuggaggccuucgaggcccucaagucccgcgccgugcggcccccggcccugcgccccgcgcggcaggacacgccccccaagcgccaccugaucaccccggugcccgacagccggggcggcuucuaccuccugcccgucaacggguuccccgaggaggaggacaacggcgagcugcgcgagcggcucggggcccugaagguguccccgagcgccuccgccccccgccacccccacaagggcauccccccgcugcaggacgugcccgucgacgccuucaccccccuccgcaucgcgugcacccccccgccccagcugccccccguggccccgcggccccugcgccccaacuggcuccugacggagccccugagccgggagcacccgccccagagccagauccgcgggcgggcccagucccgcagccggucccgcagccggucccgcagccgguccagccgcggccagggcaagucccccgggcggcgcagcccgucccccgugcccacccccgccccgagcaugaccaacggccgguaccacaagccccgcaaggcccggcccccccucccgcgcccccuggacggggaggcggccaaggucggcgccaagcagggccccuccgagagcgggaccgagggcacggccaaggaggcggccaugaagaaccccuccggggagcugaagaccgugacccucagcaagaugaagcagucccugggcaucagcaucuccgggggcaucgagagcaaggugcagccgauggucaagaucgagaagaucuuccccggcggggccgccuuccugagcggcgcccuccaggcgggguucgagcugguggccguggacggcgagaaccuggagcaggucacccaccagcgggccguggacaccauccgccgcgccuaccggaacaaggcccgcgagcccauggagcucgugguccgggugcccgggccguccccccgccccagccccuccgacagcuccgcgcugacggacggcggccugccggccgaccaccuccccgcccaccagccccuggacgccgcccccgugccggcgcacuggcugcccgagccccccaccaacccgcagaccccccccaccgacgcccggcuccugcagccgacgcccagccccgcccccuccccggcccugcagacccccgacagcaagcccgcgcccuccccgcgcauccccuga

SEQ ID NO: 34426 - RNA, 3465 nt, Artificial Sequence
  derived and/or modified sequence opt1 from PDZD8__Homo_sapiens__NP_776152
augggccugcuccugaugauccuggccagcgccgugcucggguccuuccugacccugcucgcgcaguucuuccugcuguaccgccggcagcccgagccgcccgccgacgaggccgcccgcgccggcgagggguuccgguacaucaagcccguccccggccuccugcugcgcgaguaccucuacgggggcggccgggacgaggagccgagcggggcggcccccgagggcggggccacccccacggccgcgcccgagaccccggccccgcccacccgcgagaccugcuacuuccugaacgccacgauccuguuccucuuccgggagcugcgcgacaccgcccugacccggcgcugggugaccaagaagaucaagguggaguucgaggagcuccugcagacgaagaccgccggccggcugcucgaggggcugucccugcgcgacgucuuccucggcgagaccgugcccuucaucaagaccauccggcuggugcgccccgucgugcccagcgcgacgggcgagcccgacgggcccgagggcgaggcccugccggccgccugccccgaggagcucgccuucgaggcggagguggaguacaacgggggcuuccaccuggccaucgacgucgaccugguguucggcaaguccgccuaccucuucgugaagcugagccgggucguggggcgccugcggcucguguucacccgcguccccuucacccacugguucuucuccuucguggaggacccccugaucgacuucgaggugcggagccaguucgagggccgcccgaugccccagcugaccuccaucaucgucaaccagcucaagaagaucaucaagcggaagcacacgcugcccaacuacaagauccgcuucaagcccuucuucccguaccagacccugcagggguucgaggaggacgaggagcacauccacauccagcagugggcccucaccgagggccgccugaaggugacccugcucgagugcagccggcugcugaucuucggguccuacgaccgcgaggccaacgugcacugcacgcucgagcugagcuccagcgucugggaggagaagcagcgguccagcaucaagaccguggagcugaucaagggcaaccuccaguccgugggccugacccugcgccugguccagagcaccgacggguacgcgggccacgugaucaucgagacggucgcccccaacucccccgccgccaucgccgaccuccagcgcggggaccggcugaucgcgaucggcggggugaagaucaccagcacccuccaggugcugaagcugaucaagcaggccggcgaccggguccugguguacuacgagcgccccgugggccagagcaaccagggggccguccuccaggacaacuucggccagcuggaggagaacuuccuguccagcuccugccagagcggguacgaggaggaggccgcgggccucaccguggacacggagucccgggagcuggacagcgaguucgaggaccuggccuccgacgugcgcgcccagaacgaguucaaggacgaggcccagagccucucccacagcccgaagcggguccccaccacccuguccaucaagccccugggggccaucagcccggugcucaaccgcaagcuggcggugggcucccacccccugccgcccaagauccagagcaaggacggcaacaagcccccgccccucaagaccuccgagaucacggaccccgcccaggucagcaagcccacccagggguccgccuucaagccgcccgugccgccccggccccaggccaaggugccccugcccagcgccgacgcgcccaaccaggccgagcccgacguccugguggagaagcccgagaagguggugcccccgccccucgucgacaaguccgccgagaagcaggccaagaacguggacgccaucgacgacgcggccgcccccaagcaguuccuggccaagcaggaggucgcgaaggacgugaccagcgagaccagcugccccacgaaggacuccagcgacgaccgccagaccugggaguccagcgagauccuguaccggaacaagcucggcaaguggacccgcacccgggccuccugccuguucgacaucgaggccugccaccgcuaccugaacaucgcccucuggugccgggacccguucaagcucgggggccugaucugccugggccacgugagccugaagcuggaggacgucgcccucgggugccuggcgaccuccaacacggaguaccugagcaagcuccgccuggaggcccccucccccaaggccaucgugacccgcaccgcccugcggaaccucagcaugcagaagggcuucaacgacaaguucugcuacggggacaucaccauccacuucaaguaccugaaggagggcgaguccgaccaccacguggucacgaacguggagaaggagaaggagccgcaccugguggaggaggucagcgugcuccccaaggaggagcaguucguggggcagaugggccugaccgagaacaagcacuccuuccaggacacccaguuccagaaccccaccuggugcgacuacugcaagaagaaggucuggacgaaggccgcgagccagugcauguucugcgccuacgugugccacaagaagugccaggagaagugccuggccgagaccuccgugugcggcgccaccgaccgccggaucgaccgcacccucaagaaccugcggcuggaggggcaggagacgcuccugggccugcccccgcgcgucgacgccgaggcgagcaaguccgugaacaagaccaccgggcucacccggcacaucaucaacacgagcagccgccugcugaaccuccgccagguguccaagacccggcugagcgagcccggcaccgaccuggucgagcccucccccaagcacaccccgaacacgagcgacaacgagggguccgacaccgaggugugcggccccaacagccccuccaagcggggcaacagcaccgggaucaagcucgugcgcaaggagggcgggcuggacgacuccgucuucaucgccgugaaggagaucggccgggaccuguaccgcgggcuccccaccgaggagcggauccagaagcuggaguucaugcuggacaagcuccagaacgagaucgaccaggagcuggagcacaacaacagccuggugcgcgaggagaaggagacgaccgacacccggaagaagucccuccugagcgccgcccuggcgaaguccggcgagcgccuccaggcccugacccugcucaugauccacuaccgggccggcaucgaggacaucgagacgcuggagagccugucccucgaccagcacagcaagaagaucuccaaguacaccgacgacaccgaggaggaccuggacaacgagaucagccagcugaucgacucccagccguucagcagcaucuccgacgaccucuucgggcccagcgaguccgucuga

SEQ ID NO: 34427 - RNA, 1539 nt, Artificial Sequence
  derived and/or modified sequence opt1 from PDZK1__Homo_sapiens__XP_011507918
augaccagcaccuucaacccccgcgagugcaagcuguccaagcaggagggccagaacuacggguucuuccuccggaucgagaaggacacggagggccaccuggugcgcgucguggagaagugcagcccggccgagaaggccgggcugcaggacggcgaccgggugcuccgcaucaacggggucuucguggacaaggaggagcacaugcaggucguggaccuggugcggaaguccggcaacagcgugacccugcucguccuggacggcgacuccuacgagaaggcggugaagacccgcguggaccugaaggagcucgggcagagccagaaggagcagggccuguccgacaacauccugagccccgucaugaacgggggcgugcagaccuggacgcagccccggcucugcuaccuggugaaggagggcggguccuacggcuucagccugaagaccguccaggggaagaagggcguguacaugaccgacaucacgccccaggggguggccaugcgcgccggcguccucgccgacgaccaccugaucgaggugaacggcgagaacguggaggacgccucccacgaggaggucguggagaaggugaagaaguccgggagccgggucauguuccugcucguggacaaggagaccgacaagcgccacgucgagcagaagauccaguucaagcgggagaccgcgagccugaagcugcucccgcaccagccccgcaucguggagaugaagaagggcuccaacggguacggcuucuaccugcgggccgggagcgagcagaagggccagaucaucaaggacaucgacuccggcagccccgccgaggaggccgggcugaagaacaacgaccucguggucgcggugaacggcgaguccguggagacccuggaccacgacagcgucguggagaugauccgcaagggcggggaccagaccagccugcucguggucgacaaggagacggacaacauguaccggcuggcccacuucucccccuuccuguacuaccagagccaggagcucccgaacggguccgugaaggaggcccccgcccccacccccaccagccuggagguguccagcccgcccgacaccacggaggaggucgaccacaagcccaagcugugccgccucgccaagggcgagaacggcuacggguuccaccugaacgcgauccggggccugcccggguccuucaucaaggaggugcagaagggcgggccggccgaccucgccggccuggaggacgaggacgugaucaucgaggucaacggcgugaacgugcuggacgagcccuacgagaaggucguggaccgcauccagagcuccgggaagaacgugacccuccuggucugcggcaagaaggccuacgacuacuuccaggccaagaagauccccaucgugagcucccuggcggacccccucgacaccccgcccgacagcaaggaggggaucguggucgaguccaaccacgacagccacauggccaaggagcggcuguacaccaucgccgugaacugcaugcuguga

SEQ ID NO: 34428 - RNA, 2367 nt, Artificial Sequence
  derived and/or modified sequence opt1 from PDZRN3__Homo_sapiens__NP_001290070
augaagauggagcacaagcgcaugauccuccuguucagcaaguucacccugauccacaagccccacggcgggcggugguaccuggugaacggccgcgaccucucccgggccacccacgaccaggccgucgaggcguucaagacggccaaggagccgaucguggugcagguccugcgccggacgccccgcaccaagauguucaccccgcccagcgagucccagcugguggacaccgggacccagaccgacaucaccuucgagcacaucauggcccucacgaagaugagcucccccagcccgcccgugcuggaccccuaccugcuccccgaggagcaccccuccgcccacgaguacuacgaccccaacgacuacaucggcgacauccaccaggagauggaccgggaggagcuggagcuggaggaggucgaccucuaccgcaugaacagccaggacaagcuggggcugaccgugugcuaccggaccgacgacgaggacgacaucggcaucuacaucuccgagaucgaccccaacagcaucgccgcgaaggacggccgcauccgggagggggaccgcaucauccagaucaacggcaucgaggugcagaaccgggaggaggccgucgcccuccugaccuccgaggagaacaagaacuucagccugcucaucgcccgcccggagcugcagcuggacgagggguggauggacgacgaccggaacgacuuccucgacgaccugcacauggacaugcuggaggagcagcaccaccaggcgaugcaguucacggccuccgugcuccagcagaagaagcacgacgaggacggcgggaccaccgacaccgccacgauccugagcaaccagcacgagaaggacuccggcgugggccgcaccgacgagagcacccggaacgacgaguccagcgagcaggagaacaacggggacgacgccaccgccuccagcaacccccuggcgggccagcgcaagcucacgugcagccaggacacccugggguccggcgaccugcccuucagcaacgaguccuucaucagcgccgacugcaccgacgccgacuaccucggcauccccgucgacgagugcgagcgguuccgcgagcugcuggagcucaagugccaggugaaguccgccaccccguacgggcuguacuaccccagcggcccccuggacgccgggaaguccgaccccgagagcguggacaaggagcucgagcugcugaacgaggagcuccgguccaucgagcuggagugccugagcaucguccgcgcgcacaagaugcagcagcucaaggagcaguaccgcgaguccuggaugcugcacaacagcggcuuccggaacuacaacacguccaucgacgugcgccggcacgagcugagcgacaucaccgagcucccggagaaguccgacaaggacagcuccagcgccuacaacaccggggaguccugccgcagcacgccccugacccuggagaucagccccgacaacucccuccggcgcgccgccgagggcaucagcugccccuccagcgagggcgccguggggaccaccgaggcguacggcccggccuccaagaaccugcugagcaucaccgaggaccccgaggucgggacgcccaccuacucccccagccugaaggagcucgacccgaaccagccccuggaguccaaggagcggcgcgccagcgacggcucccggagccccaccccgucccagaagcuggggagcgccuaccuccccuccuaccaccacagccccuacaagcacgcccacauccccgcgcacgcccagcacuaccaguccuacaugcagcugauccagcagaaguccgccguggaguacgcccagagccagaugagccuggugagcaugugcaaggaccucuccagcccgacccccuccgagccccgcauggaguggaaggucaagauccggagcgacggcacgcgcuacaucaccaagcggcccgugcgcgaccggcugcugcgcgagcgggcgcucaagauccgcgaggagcgguccggcaugaccaccgacgacgacgccgugagcgagaugaagauggggcgcuacugguccaaggaggagcgcaagcagcaccuggucaaggccaaggagcagcggcgccggcgcgaguucaugaugcagagccggcuggacugccucaaggagcagcaggccgccgacgaccgcaaggagaugaacauccuggagcugucccacaagaagaugaugaagaagcggaacaagaagaucuucgacaacuggaugaccauccaggagcuccugacgcacggcaccaagagcccggacgggacccgcguguacaacuccuuccugagcgucaccacgguguga

SEQ ID NO: 34429 - RNA, 3111 nt, Artificial Sequence
  derived and/or modified sequence opt1 from PDZRN4__Homo_sapiens__NP_001158067
augggcuucgcccuggagcgcuucgccgaggcgguggaccccgcccucgagugcaagcugugcgggcagguccuggaggagccgcucugcacccccugcggccacguguucugcgccagcugccugcugcccugggccgugcggcgccggcgcugcccccuccagugccagccgcuggcccccggggagcuguaccggguccucccccugcgcucccugauccagaagcuccgggugcagugcgacuaccgcgcgcggggcugcgggcacagcgugcgccugcacgagcuggaggcccacgucgagcacugcgacuucggccccgcccggcgccuccggucccgcggcgggugcgccagcggccucgggggcggggaggugccggcgcggggcggcugcgggcccacgccccgcgccggccggggcgggggcgcccgcgggggcccgcccgggggccggugggggcgcggccggggccccgggccccgcgugcuggccuggcgccggcgcgagaaggcccugcuggcgcagcugugggcccuccagggcgagguccagcugaccgcccggcgcuaccaggagaaguucacccaguacauggcccacgugcggaacuucgugggggaccugggcgggggccaccgccgggacggcgagcacaagcccuucaccaucguccucgagcgcgagaacgacacccugggguucaacaucaucggcgggcggccgaaccagaacaaccaggagggcacguccaccgaggggaucuacgugagcaagauccuggagaacggccccgccgaccgcgcggacggccucgagauccacgacaagaucauggaggugaacgggaaggaccuguccaaggccacccacgaggaggccgucgaggccuuccggaacgccaaggagcccaucguggugcagguccugcgccggacgccccucagccgcccggcguacggcauggccuccgaggugcagcugaugaacgccagcacccagaccgacaucaccuucgagcacaucauggcccuggccaagcuccggccgcccaccccgcccgugcccgacaucugccccuuccugcuguccgacagcugccacucccuccaccccauggagcacgaguucuacgaggacaacgaguacaucagcucccugcccgcggacgccgaccgcacggaggacuucgaguacgaggaggucgagcugugccgggugagcucccaggagaagcucgggcugaccgugugcuaccgcaccgacgacgaggaggacaccggcaucuacgucagcgagguggaccccaacuccaucgccgccaaggacggccggauccgcgagggggaccgcauccugcagaucaacggcgaggacguccagaaccgggaggaggcgguggcccuccugagcaacgacgagugcaagcgcaucgugcugcucgucgcccggcccgagauccagcuggacgagggguggcuggaggacgagcgcaacgaguuccucgaggagcugaaccuggagaugcuggaggaggagcacaacgaggccaugcagccgacggccaacgagguggagcagcccaagaagcaggaggaggaggagggcaccaccgacaccgcgacgagcuccagcaacaaccacgagaaggacuccggggugggccggaccgacgagagccuccgcaacgacgaguccagcgagcaggagaacgccgccgaggaccccaacuccaccagccugaaguccaagcgggaccugggccagagccaggacacccucggguccgucgagcugcaguacaacgagagccugguguccggcgaguacaucgacagcgacugcaucgggaaccccgacgaggacugcgagcgcuuccggcagcuccuggagcugaagugcaagauccgcaaccacggcgaguacgaccucuacuacuccagcuccacgaucgagugcaaccagggggagcaggagggcguggagcacgagcugcagcugcucaacgaggagcugcggaacaucgagcuggagugccagaacaucaugcaggcccaccgccuccagaaggucaccgaccaguacggcgacaucuggacccugcacgacgggggcuuccggaacuacaacaccagcaucgacaugcagcgcgggaagcuggacgacaucauggagcacccggagaaguccgacaaggacagcagcuccgccuacaacacggcggagagcugccgguccacgccccucaccguggaccgcagccccgacuccagccugccccgggugaucaaccugaccaacaagaagaaccuccgcuccaccauggccgccacccagagcuccagcggccaguccagcaaggaguccaccagcaccaaggccaagacgaccgagcaggggugcuccgccgagagcaaggagaagguccuggagggcuccaagcugccggaccaggagaaggcggugagcgagcacauccccuaccucagccccuaccacuccagcuccuaccgguacgccaacauccccgcccacgcccgccacuaccagagcuacaugcagcugauccagcagaaguccgcgguggaguacgcccagagccagcugucccucgucagcaugugcaaggagucccagaagugcagcgagccgaagauggaguggaaggugaagauccgguccgacggcacccgcuacaucaccaagcgccccgugcgggaccgcauccugaaggagcgggcccugaagaucaaggaggagcgcagcgggaugaccacggacgacgacaccauguccgagaugaagaugggccgguacuggagcaaggaggagcgcaagcagcaccucguccgggccaaggagcagcgccggcgccgggaguucaugaugcgcucccggcuggagugccugaaggagagcccccaguccgggagcgagggcaagaaggagaucaacaucaucgagcucucccacaagaagaugaugaagaagcgcaacaagaagauccuggacaacuggaugaccauccaggagcugaugacccacggggccaagagccccgacggcacgcgggugcacaacgcguuccucagcgugaccaccgucuga

SEQ ID NO: 34430 - RNA, 456 nt, Artificial Sequence
  derived and/or modified sequence opt1 from PEA15__Homo_sapiens__NP_001284505
auggaggacgagggcaacaagcugugccaggccccgcccuggcccgggcagaccagccccgugauggccgaguacggcacccuccugcaggaccugacgaacaacaucacccucgaggaccuggagcagcugaaguccgccugcaaggaggacauccccagcgagaaguccgaggagaucaccaccgggagcgccugguucuccuuccucgagagccacaacaagcuggacaaggacaaccuguccuacaucgagcacaucuucgagaucagccgccggccggaccuccugacgauggucguggacuaccgcacccgggugcugaagaucuccgaggaggacgagcucgacaccaagcugacccgcauccccagcgccaagaaguacaaggacaucauccggcagcccuccgaggaggagaucaucaagcuggcgcccccgcccaagaaggccuga

SEQ ID NO: 34431 - RNA, 5241 nt, Artificial Sequence
  derived and/or modified sequence opt1 from PEAK1__Homo_sapiens__NP_079052
augagcgccugcaacaccuucaccgagcacguguggaagcccggcgagugcaagaacugcuucaagcccaagagccuccaccagcugccgcccgaccccgagaaggcccccaucacgcacgggaacgucaagaccaacgccaaccacagcaacaaccaccgcauccggaacaccggcaacuuccggccgcccguggccaagaagcccaccaucgccgugaagcccaccaugaucgucgccgacgggcaguccaucugcggcgagcugagcauccaggagcacugcgagaacaagcccgugaucaucggguggaaccggaaccgcgccgcgcugagccagaagccccucaacaacaacaacgaggacgacgagggcaucagccacgugcccaagcccuacggcaacaacgacagcgccaagaagaugagcgacaacaacaacgggcugaccgagguccugaaggagaucgccggccucgacaccgcgccccagauccgggggaacgagaccaacucccgcgagacguuccugggccggaucaacgacugcuacaagcgcagccuggagcggaagcugcccccguccugcaugaucgggggcaucaaggagacccagggcaagcacgugauccucagcggguccaccgaggugaucagcaacgagggcgggcgcuucugcuacccggaguucuccagcggcgaggaguccgaggaggacguccuguucagcaacauggaggaggagcacgaguccugggacgagagcgacgaggagcuccuggcgauggagauccggaugcgcggccagccccgguucgccaacuuccgcgccaacacccugagccccgugcgguucuucguggacaagaaguggaacacgaucccccuccgcaacaagucccugcagcggaucugcgccgucgacuacgacgacagcuacgacgagauccugaacggguacgaggagaacuccguggugagcuacggccagggguccauccagagcauggucuccagcgacuccaccagccccgacuccagccucaccgaggagucccgcagcgagaccgccuccagccugucccagaagaucugcaacggcgggcugagccccggcaaccccggcgacuccaaggacaugaaggagaucgagcccaacuacgagagccccagcuccaacaaccaggacaaggacagcucccaggcgagcaaguccagcaucaaggugcccgagacgcacaaggccgugcucgcccugcggcuggaggagaaggacgggaagaucgccguccagaccgagaaggaggaguccaaggccagcaccgacguggcgggccaggccgugaccaucaaccucguccccacggaggagcaggccaagcccuaccgcguggugaaccuggagcagccgcugugcaagcccuacaccgucguggacgucuccgccgccauggcgagcgagcaccucgaggggcccgugaacuccccgaagaccaagagcuccagcuccacccccaacagccccgugacguccagcagccugacccccggccagaucuccgcccacuuccagaaguccuccgccauccgguaccaggaggucuggaccagcuccaccagcccgcgccagaagauccccaagguggagcugaucacguccgggaccggccccaacgugcccccgcgcaagaacugccacaagagcgcccccaccucccccaccgccacgaacaucagcuccaagaccauccccgucaagagcccgaaccucuccgagaucaaguucaacagcuacaacaacgcgggcaugccgcccuuccccaucaucauccacgacgagccgaccuacgcccgguccagcaagaacgccaucaaggugcccaucgugaucaaccccaacgccuacgacaaccuggcgaucuacaaguccuuccuggggaccagcggcgagcucuccgucaaggagaagacgaccagcgugaucagccacaccuacgaggagaucgagaccgaguccaaggugcccgacaacaccacgagcaagaccaccgacugccugcagaccaagggguucuccaacagcacggagcacaagcgcggcuccgucgcccagaaggugcaggaguucaacaacugccugaaccgggggcagagcuccccgcagcgcagcuacuccagcucccacagcucccccgccaagauccagcgggccacccaggagcccguggccaagaucgagggcacccaggagagccagauggucggcuccagcuccacccgcgagaaggcgagcacggugcucucccagaucguggccagcauccagcccccgcaguccccgcccgagaccccgcaguccgggcccaaggccugcagcgucgaggagcuguacgccaucccgcccgacgccgacguggcgaaguccacccccaagagcacccccgugcggcccaagucccuguucacgagccagcccuccggcgaggccgaggccccgcagaccaccgacagccccaccacgaagguccagaaggaccccuccaucaagcccgugaccccgagccccuccaagcucgugaccagcccccaguccgagcccccggcccccuucccgccgccccgcagcaccuccagccccuaccacgccgggaaccugcugcagcggcacuucacgaacuggaccaagcccaccucccccacccgcagcacggaggcggaguccguccuccacagcgagggcagccggcgcgccgccgacgccaagcccaagcgguggaucuccuucaagagcuucuuccgccggcgcaagaccgacgaggaggacgacaaggagaaggagcgggagaagggcaagcugguggggcuggacggcaccgugauccacaugcugccgccgccgcccguccagcgccaccacugguucaccgaggcgaagggggaguccagcgagaagcccgccaucguguucauguaccggugcgaccccgcccagggccagcuguccguggaccagagcaaggcccgcacggaccaggccgcggucauggagaaggggcgcgccgagaacgcccugcuccaggacuccgagaagaagcggagccacuccagccccucccagauccccaagaagauccugagccacaugacccacgaggugaccgaggacuucagcccccgcgacccccggaccguggucggcaagcaggacggccgcgggugcacgagcgugaccaccgcccugucccugccggagcucgagcgggaggacggcaaggaggacaucagcgaccccauggaccccaaccccugcuccgccaccuacagcaaccuggggcagucccgcgcggccaugaucccgcccaagcagccccggcagcccaagggcgccguggacgacgccaucgccuucgggggcaagacggaccaggaggcgccgaacgccagccagcccacgccgccgccccugcccaagaagaugaucauccgcgccaacaccgagcccaucagcaaggaccuccagaaguccauggagagcucccugugcgucauggccaaccccaccuacgacaucgaccccaacugggacgcgagcuccgccggcagcuccaucagcuacgagcugaaggggcucgacaucgaguccuacgacagccuggagcggccccugcgcaaggagcggcccgugcccuccgccgccaacagcaucuccagccucaccacgcuguccaucaaggaccgcuucagcaacuccauggagagccuguccagccggcgcggcccgagcugccggcaggggcgcggcauccagaagccccagcggcaggcccucuaccgcgggcuggagaaccgggaggagguggucggcaagauccgcucccugcacaccgacgcgcucaagaagcuggccgugaagugcgaggaccuguucauggccggccagaaggaccagcuccgguucgggguggacagcugguccgacuuccgccugaccagcgacaagcccugcugcgaggccggcgacgccgucuacuacaccgcguccuacgccaaggacccccugaacaacuacgccgugaagaucugcaagagcaaggccaaggagucccagcaguacuaccacagccucgccgugcgccagucccuggcgguccacuucaacauccagcaggacugcgggcacuuccuggccgaggugccgaaccggcuccugcccugggaggaccccgacgacccggagaaggacgaggacgacauggaggagacggaggaggacgccaagggcgagaccgacgggaagaaccccaagcccugcagcgaggccgccuccagccagaaggagaaccagggcgugauguccaagaagcagcgcagccacgucguggugaucacccgggagguccccugccugaccguggcggacuucguccgcgacucccucgcccagcacggcaagagcccggaccuguacgagcgccaggugugccugcuccugcugcagcucugcuccgggcuggagcaccugaagcccuaccacgugacgcacugcgaccuccgccuggagaaccugcuccugguccacuaccagcccggcgggaccgcccagggcuucggccccgccgagccgagccccaccagcuccuaccccacccggcugaucgugagcaacuucucccaggcgaagcagaagucccaccucguggaccccgagauccugcgcgaccagucccggcuggccccggagaucaucacggccacccaguacaagaagugcgacgaguuccagaccgggauccucaucuacgagaugcugcaccuccccaaccccuucgacgagaaccccgagcucaaggagcgcgaguacacccgggccgaccugccgcgcauccccuuccggagccccuacucccgcggccugcagcagcucgccagcugccugcugaaccccaacccguccgagcggauccucaucagcgacgcgaaggggauccugcagugccugcucuggggcccccgcgaggaccuguuccagacguucaccgccugccccucccugguccagcggaacacccuccugcagaacuggcuggacaucaagcgcacccuccugaugaucaaguucgccgagaagucccuggaccgggagggcgggaucucccucgaggacuggcugugcgcccaguaccuggccuucgcgacgaccgacagccucuccugcaucgugaagauccugcagcaccgcuga

SEQ ID NO: 34432 - RNA, 3114 nt, Artificial Sequence
  derived and/or modified sequence opt1 from PEAR1__Homo_sapiens__NP_001073940
augagccccccgcugugcccccuccugcugcucgccgugggccugcgccuggccgggacccucaaccccuccgaccccaacaccugcagcuucugggaguccuucacgaccaccaccaaggagagccacucccggccguucagccugcugcccuccgagcccugcgagcgccccugggagggcccgcacacgugcccccagcccaccgucguguaccggaccguguaccgccaggucgugaagaccgaccaccggcagcgccuccagugcugccacggguucuacgagagccggggcuucugcgugccccugugcgcgcaggagugcguccacgggcgcugcguggccccgaaccagugccagugcgugcccggcuggcggggcgacgacugcuccagcgagugcgcccccgggauguggggcccccagugcgacaagccgugcuccugcgggaacaacagcuccugcgaccccaagagcggcgucugcuccugccccagcgggcugcagcccccgaacugccuccagcccugcacgcccggcuacuacggccccgccugccaguuccgcugccagugccacggggccccgugcgacccccagaccggcgcgugcuucugccccgccgagcggaccgggcccuccugcgacgugagcugcucccagggcaccagcggcuucuucugcccgagcacgcacuccugccagaacgggggcguguuccagaccccccaggggagcugcuccugccccccgggcuggauggggaccaucugcagccugcccugccccgagggcuuccacggccccaacugcucccaggagugccgcugccacaacgggggccugugcgaccgguucaccgggcagugccgcugcgccccgggcuacacgggggaccggugccgcgaggagugccccgucggccgguucggccaggacugcgccgagaccugcgacugcgcgcccgacgcccgcugcuuccccgccaacggggccugccucugcgagcacggcuucaccggggaccggugcaccgaccgccugugcccggacggcuucuacgggcugagcugccaggcccccugcacgugcgaccgggagcacucccucagcugccaccccaugaacggcgagugcuccugccugcccggcugggcggggcugcacugcaacgagagcugcccgcaggacacccacggccccgggugccaggagcacugccucugccugcacggcggcgugugccaggccaccuccgggcugugccagugcgcccccggcuacaccgggccccacugcgccagccucugcccgcccgacacguacggcgugaacugcuccgcccgcugcagcugcgagaacgcgaucgccugcucccccaucgacggggagugcgucugcaaggagggcuggcagcgcggcaacugcagcgugcccugcccgcccgggaccuggggcuucuccugcaacgccagcugccagugcgcccacgaggccgugugcuccccccagaccggggcgugcaccugcacgcccggcuggcacggggcccacugccagcugccgugccccaagggccaguucggcgaggggugcgccagccggugcgacugcgaccacagcgacggcugcgaccccguccacgggcgcugccagugccaggccggcuggaugggggcccggugccaccuguccugcccggagggccucuggggcgugaacugcagcaacaccugcaccugcaagaacgggggcaccugccugcccgagaacgggaacugcgugugcgcgcccggcuuccgcgggcccuccugccagcggagcugccagccgggccgcuacggcaagcggugcguccccugcaagugcgccaaccacuccuucugccaccccagcaacgggacgugcuacugccuggccggcuggaccgggcccgacugcucccagccgugcccccccggccacuggggcgagaacugcgcccagaccugccagugccaccacgggggcaccugccacccccaggacgggagcugcaucugcccgcucggcuggacggggcaccacugccuggagggcugcccccugggcaccuucggggcgaacugcucccagcccugccagugcggccccggggagaagugccacccggagaccggcgccugcgugugcccccccgggcacagcggcgcccccugccgcaucggcauccaggagccguucaccgugaugcccaccacgcccgucgccuacaacucccucggggccgugaucggcaucgcgguccuggggagccuggugguggcccucgucgcccuguucaucggcuaccggcacuggcagaaggggaaggagcaccaccaccuggccguggccuacuccagcggccgccucgacggcuccgaguacgugaugcccgacgucccgcccagcuacucccacuacuacagcaaccccagcuaccacacccugucccagugcagccccaacccgccccccccgaacaaggugcccgggccccuguucgcgucccuccagaaccccgagcggccgggcggggcccagggccacgacaaccacaccacccugcccgccgacuggaagcaccgccgggagccccccccgggcccccuggaccgcgggagcucccggcucgaccgcagcuacuccuacagcuacuccaacggccccgggcccuucuacaacaagggccugaucagcgaggaggagcugggggccuccguggccagccucuccagcgagaacccguacgcgacgauccgggaccugcccucccugcccggcggcccccgcgagagcuccuacauggagaugaaggggccgcccagcggcucccccccccggcagccgccccaguucugggacagccagcgccgccggcagccccagccccagcgcgacagcgggaccuacgagcagccguccccccugauccacgaccgggacagcgucggcucccagcccccccucccgcccgggcugcccccgggccacuacgacagccccaagaacucccacauccccggccacuacgaccugcccccggugcgccacccccccagccccccgcuccggcgccaggaccgguga

SEQ ID NO: 34433 - RNA, 564 nt, Artificial Sequence
  derived and/or modified sequence opt1 from PEBP1__Homo_sapiens__NP_002558
augcccguggaccugagcaagugguccggcccgcucagccugcaggaggucgacgagcagccccagcacccccugcacgugaccuacgccggggccgcgguggacgagcucggcaagguccugacccccacccaggugaagaaccgcccgaccuccaucagcugggacgggcuggacuccggcaagcucuacacccuggugcugaccgaccccgacgcccccagccggaaggaccccaaguaccgcgaguggcaccacuuccucgucgugaacaugaaggggaacgacaucuccagcggcacggugcuguccgacuacgucggcagcgggccgcccaagggcaccgggcugcaccgguacguguggcucguguacgagcaggaccgcccccugaagugcgacgagcccauccuguccaaccggagcggcgaccaccgcgggaaguucaaggucgccuccuuccggaagaaguacgagcuccgcgccccgguggccggcacgugcuaccaggcggagugggacgacuacgugcccaagcuguacgagcagcugagcggcaaguga

SEQ ID NO: 34434 - RNA, 684 nt, Artificial Sequence
  derived and/or modified sequence opt1 from PEBP4__Homo_sapiens__NP_659399
augggcuggaccaugcgccuggugaccgccgcccuccugcuggggcucaugauggucgugacgggcgacgaggacgagaacagccccugcgcgcacgaggcccugcuggacgaggacacccucuucugccaggggcuggagguguucuacccggagcugggcaacaucgggugcaaggucgugcccgacugcaacaacuaccggcagaagaucaccuccuggauggagcccaucgugaaguuccccggcgccgucgacggcgccaccuacauccucgugaugguggacccggacgcccccagccgcgcggagccccggcagcgcuucuggcggcacuggcuggucacggacaucaagggggccgaccugaagaagggcaagauccaggggcaggagcucuccgccuaccaggcccccagcccgcccgcgcacuccggcuuccaccgcuaccaguucuucguguaccugcaggaggggaaggugaucagccugcuccccaaggagaacaagacccggggcuccuggaagauggaccgcuuccugaaccgguuccaccugggcgagcccgaggccagcacccaguucaugacccagaacuaccaggacuccccgacgcuccaggcgccccgcgagcgggccagcgagcccaagcacaagaaccaggccgagaucgccgccugcuga

SEQ ID NO: 34435 - RNA, 2160 nt, Artificial Sequence
  derived and/or modified sequence opt1 from PECAM1__Homo_sapiens__XP_005276938
augcagccccgcugggcccagggcgccaccauguggcugggggugcuccugacccugcuccugugcagcucccuggagggccaggagaacagcuucacgaucaacuccgucgacaugaagucccucccggacuggaccgugcagaacgggaagaaccugacccugcagugcuucgcggacgugagcaccacgagccacgucaagccccagcaccagaugcuguucuacaaggacgacguccucuucuacaacaucuccagcaugaaguccaccgagagcuacuucauccccgaggugcggaucuacgacuccggcaccuacaagugcaccgugaucgugaacaacaaggagaagacgaccgccgaguaccaggugcuggucgagggggugcccagcccgcgcgugacccucgacaagaaggaggccauccagggcggcaucguccgggugaacugcuccgugcccgaggagaaggcccccauccacuucaccaucgagaagcuggagcugaacgagaagauggucaagcucaagcgcgagaagaacagccgggaccagaacuucgugauccuggaguuccccguggaggagcaggaccgcguccuguccuuccggugccaggcccgcaucaucagcgggauccacaugcagacguccgagagcaccaaguccgagcucgugaccgugaccgagagcuucagcacgccgaaguuccacaucucccccaccggcaugaucauggagggggcgcagcugcacaucaagugcaccauccaggucacccaccuggcccaggaguuccccgagaucaucauccagaaggacaaggccaucguggcccacaaccggcacggcaacaaggcgguguacagcgucauggccaugguggagcacuccgggaacuacacgugcaaggucgagagcucccgcaucagcaagguguccagcaucguggucaacaucaccgagcuguucuccaagcccgagcucgagagcuccuucacccaccuggaccagggcgagcggcucaaccugagcugcuccaucccgggcgccccgcccgccaacuucaccauccagaaggaggacacgaucgugagccagacccaggacuucaccaagaucgccuccaagagcgacuccgggaccuacaucugcacggcgggcaucgacaagguggucaagaaguccaacaccgugcagaucguggucugcgagaugcugagccagccccgcaucagcuacgacgcccaguucgaggugaucaaggggcagaccaucgaggugcggugcgagagcaucuccggcacccuccccaucagcuaccagcugcugaagacguccaagguccucgagaacagcaccaagaacuccaacgaccccgccguguucaaggacaaccccaccgaggacguggaguaccagugcgucgccgacaacugccacagccacgccaagaugcuguccgaggugcugcgcgugaaggucaucgcgcccguggacgaggugcagaucagcauccucuccagcaaggucguggaguccggcgaggacaucgugcugcagugcgccgucaacgaggggagcggcccgaucaccuacaaguucuaccgggagaaggaggggaagcccuucuaccagaugacguccaacgccacccaggccuucuggaccaagcagaaggccagcaaggagcaggagggcgaguacuacugcaccgcguucaaccgcgccaaccacgccuccagcgugccccgguccaagauccugaccgugcgcgucauccucgcccccuggaagaaggggcugaucgccguggugaucaucggcgucaucaucgcgcugcucaucaucgccgccaagugcuacuuccugcggaaggccaaggcgaagcagaugccgguggagaugagccgccccgccgugccccugcucaacagcaacaacgagaagauguccgaccccaacauggaggccaacagccacuacggccacaacgacgacguccggaaccacgccaugaagccgaucaacgacaacaaggagccccugaacuccgacgugcaguacacggaggugcaggucagcuccgccgagagccacaaggacgcgguggagucccgcuacagccgcaccgaggggucccuggacggcaccuga

SEQ ID NO: 34436 - RNA, 912 nt, Artificial Sequence
  derived and/or modified sequence opt1 from PECR__Homo_sapiens__NP_060911
auggccagcugggccaagggccgcuccuaccuggcgcccgggcuccugcagggccagguggccaucgucaccgggggcgccaccgggaucggcaaggccaucgugaaggagcugcucgagcugggcagcaacguggucaucgccucccggaagcuggagcgccucaagagcgcggccgacgagcugcaggccaaccugccgcccacgaagcaggcccgggugauccccauccagugcaacauccgcaacgaggaggaggugaacaaccucgucaaguccacccuggacaccuucgggaagaucaacuuccuggugaacaacggcgggggccaguuccucagccccgcggagcacaucuccagcaagggguggcacgccgugcuggagaccaaccugacgggcaccuucuacaugugcaaggccgucuacuccagcuggaugaaggagcacggcggguccaucgugaacaucaucgugccgaccaaggccggcuucccccucgccguccacagcggggcggcccgggccggcguguacaaccugaccaagucccuggcccucgagugggccugcagcggcauccgcaucaacugcguggcgcccggggucaucuacucccagacggccguggagaacuacggcagcugggggcaguccuucuucgagggcagcuuccagaagauccccgccaagcggaucggggugccggaggaggucuccagcguggugugcuuccugcugagccccgccgccuccuucaucaccggccagagcgucgacguggacggcgggcgcucccucuacacccacagcuacgaggugcccgaccacgacaacuggcccaagggcgcgggggaccuguccgucgugaagaagaugaaggagaccuucaaggagaaggccaagcuguga

SEQ ID NO: 34437 - RNA, 978 nt, Artificial Sequence
  derived and/or modified sequence opt1 from PEG10__Homo_sapiens__NP_001035242
augacggagcgccggcgcgacgagcugagcgaggagaucaacaaccuccgggagaaggugaugaagcaguccgaggagaacaacaaccugcagagccagguccagaagcugaccgaggagaacacgacccuccgcgagcaggucgagcccaccccggaggacgaggacgacgacaucgagcugcggggcgccgccgcggccgccgccccgcccccgcccaucgaggaggagugccccgaggaccugcccgagaaguucgacgggaaccccgacaugcucgcccccuucauggcgcagugccagaucuucauggagaaguccacccgcgacuucagcguggaccgggugcgcgugugcuucgugacguccaugaugaccggccgggccgcccgcugggccagcgcgaagcuggagcggucccacuaccugaugcacaacuaccccgccuucaugauggagaugaagcacgucuucgaggacccccagcgccgggagguggccaagcgcaagauccggcgccuccggcaggggaugggcagcgugaucgacuacuccaacgccuuccagaugaucgcccaggaccuggacuggaacgagcccgcgcugaucgaccaguaccacgaggggcucagcgaccacauccaggaggagcugucccaccuggaggucgccaagagccucuccgcccugaucggccagugcauccacaucgagcgccggcuggcccgcgccgcggccgcccggaagccgcgcagcccgccccgcgcccucgugcugccccacaucgccucccaccaccagguggaccccaccgagcccgucggcggggcgcggaugcgccugacccaggaggagaaggagcggcgccggaagcucaaccugugccuguacugcggcaccgggggccacuacgccgacaacugccccgccaaggccagcaaguccagccccgccgggaacuccccggcgccccucuga

SEQ ID NO: 34438 - RNA, 4389 nt, Artificial Sequence
  derived and/or modified sequence opt1 from PEG3__Homo_sapiens__NP_001139657
auguaccagcccgaggacgacaacaacagcgacgugaccuccgacgacgacaugacccgcaaccggcgcgagagcuccccgccccacagcguccacuccuucagcgaccgggacugggaccgccggggccgcucccgggacauggagccccgcgaccgguggagccacacgcgcaacccccggucccgcaugccgccccgggaccugagccuccccgugguggccaagaccuccuucgagauggaccgcgaggacgaccgggacagccgcgccuacgagucccggagccaggacgcggaguccuaccagaacgucguggaccuggccgaggaccgcaagccccacaacaccauccaggacaacauggagaacuaccggaagcugcucagccuggugcagcuggccgaggacgacgggcacucccacaugacccagggccacagcucccgcagcaagcggagcgccuacccguccacgagccgcgggcucaagaccaugcccgaggccaagaaguccacccaccgccggggcaucugcgaggacgagagcucccacggggucaucauggagaaguucaucaaggacgugagccgcuccagcaaguccggccgggcgcgcgagagcuccgaccggagccagcgcuucccccggauguccgacgacaacuggaaggacaucagccugaacaagcgcgaguccgugauccagcagcgggucuacgagggcaacgccuuccgcgggggcuuccgguucaacagcacccuggugucccgcaagcgggugcucgagcgcaagcggcgcuaccacuucgacacggacgggaagggcagcauccacgaccagaaggggugcccccggaagaagccguucgagugcggcuccgagaugcgcaaggccaugagcgucagcucccugagcucccugagcucccccagcuucaccgagucccagcccaucgacuucggcgccaugcccuacgugugcgacgagugcgggcggagcuucuccgugaucagcgaguucgucgagcaccagaucaugcacacccgcgagaaccucuacgaguacggcgaguccuucauccacagcguggcgguguccgagguccagaagucccaggucgggggcaagcgcuucgagugcaaggacugcggcgagaccuucaacaagagcgccgcccuggccgagcaccggaagauccacgcccgcggguaccugguggagugcaagaaccaggagugcgaggaggcguucaugccgagccccacguucuccgagcuccagaagaucuacggcaaggacaaguucuacgagugccgggugugcaaggagaccuuccugcacagcagcgcccugaucgagcaccagaagauccacuucggggacgacaaggacaacgagcgcgagcacgagcgggagcgcgagcgggagcgcggcgagaccuuccggcccucccccgcccucaacgaguuccagaagauguacgggaaggagaagauguacgagugcaaggugugcggcgagaccuuccugcacagcuccagccugaaggagcaccagaagauccacacgcgcggcaacccguucgagaacaaggggaaggugugcgaggagaccuucauccccggccagucccucaagcggcgccagaagaccuacaacaaggagaagcugugcgacuucaccgacgggcgggacgccuucaugcagagcuccgagcugagcgagcaccagaagauccacucccgcaagaaccucuucgagggccggggguacgagaaguccgucauccacagcggccccuucacggagagccagaagucccacaccaucacccgcccccuggagagcgacgaggacgagaaggccuucaccaucuccagcaacccguacgagaaccagaagauccccacgaaggagaacguguacgaggcgaaguccuacgagcggagcgucauccacucccuggccagcguggaggcccagaagucccacagcguggccggccccagcaagcccaaggucauggccgaguccaccauccagagcuucgacgcgaucaaccaccagcgcgugcgggccgggggcaacaccuccgaggggcgcgaguacagccgguccgugauccacagccucgucgccuccaagccgccccgcagccacaacggcaacgagcugguggaguccaacgagaagggggagagcuccaucuacaucagcgaccugaacgacaagcgccagaagauccccgcccgggagaacccgugcgagggcggcuccaagaaccgcaacuacgaggacagcgugauccaguccgucuuccgggccaagccccagaaguccgugcccggggagggcagcggggaguucaagaaggacggcgaguucagcgugcccagcuccaacguccgcgaguaccagaaggcgcgggccaagaagaaguacaucgagcaccgcagcaacgagaccuccgugauccacagccucccguucggcgagcagacguuccggccccgcgggaugcuguacgagugccaggagugcggcgagugcuucgcccacuccagcgaccugaccgagcaccagaagauccacgaccgggagaagcccuccgggagccgcaacuacgagugguccgugauccggagccucgcccccaccgacccgcagaccuccuacgcgcaggagcaguacgccaaggagcaggcccgcaacaagugcaaggacuuccggcaguucuucgccacgagcgaggaccugaacaccaaccagaagaucuacgaccaggagaagucccacggcgaggagagccagggggagaacaccgacggcgaggagacccacuccgaggagacgcacggccaggagaccaucgaggaccccgucauccaggggagcgacauggaggacccccagaaggacgaccccgacgacaagaucuacgagugcgaggacugcggccugggguucguggaccucaccgaccugaccgaccaccagaaggugcacucccgcaagugccuggucgacagccgggaguacacccacuccgugauccacacgcacagcaucagcgaguaccagcgcgacuacaccggcgagcagcucuacgagugcccgaagugcggggaguccuucauccacagcuccuuccuguucgagcaccagcggauccacgagcaggaccagcuguacagcaugaagggcugcgacgacggcuucaucgcccuccugcccaugaagccccgccggaaccgcgcggccgagcgcaaccccgcccuggccggguccgccauccggugccuccugugcggccagggguucauccacagcuccgcgcugaacgagcacaugcgccuccaccgggaggacgaccugcuggagcagagccagauggccgaggaggccaucaucccgggccuggcccucaccgaguuccagcgcucccagaccgaggagcggcuguucgagugcgccgugugcggggagagcuucgucaaccccgcggagcuggccgaccacgugacggugcacaagaacgagcccuacgaguacggcuccagcuacacccacaccuccuuccucaccgagccccugaagggcgccaucccguucuacgagugcaaggacugcggcaagagcuucauccacuccacgguccugaccaagcacaaggagcuccaccuggaggaggaggaggaggacgaggccgcggccgccgccgccgcggccgcccaggagguggaggccaacgugcacgucccccagguggugcugcgcauccaggggcucaacgucgaggccgcggagcccgagguggaggccgccgagcccgagguggaggccgccgagccggaggucgaggcggccgagcccaacggggaggccgagggccccgacggggaggccgcggagccgaucggcgaggccggccagcccaacggggaggccgagcagcccaacggcgacgccgacgagcccgacggggccggcaucgaggacccggaggagcgggcggaggagcccgagggcaaggccgaggagcccgagggggacgccgacgagcccgacggcguggggaucgaggacccggaggagggcgaggaccaggagauccagguggaggagcccuacuacgacugccacgagugcaccgagaccuucacgagcuccaccgccuucagcgagcaccugaagacccacgccuccaugaucaucuucgagcccgcgaacgccuucggggagugcagcggcuacaucgagcgcgccagcaccuccacgggcggggccaaccaggccgacgagaaguacuucaagugcgacgucugcggccagcuguucaacgaccggcucagccuggcgcgccaccagaacacccacaccggguga

SEQ ID NO: 34439 - RNA, 1257 nt, Artificial Sequence
  derived and/or modified sequence opt1 from PELI1__Homo_sapiens__XP_011531296
auguucagccccgaccaggagaaccacccguccaaggcccccgugaaguacggcgagcugaucguccucggguacaacggcagccugcccaacggggaccgcggccggcgcaagucccgguucgcccuguucaagcgccccaaggcgaacggggugaagccgagcaccgugcacaucgccugcacgccccaggccgccaaggccaucuccaacaaggaccagcacagcaucuccuacacccucagccgggcgcagaccgucgugguggaguacacccacgacuccaacaccgacauguuccagaucggccgcagcacggagucccccaucgacuucgucgugaccgacaccgugcccggcagccaguccaacagcgacacccaguccguccagagcacgaucucccgguucgccugccgcaucaucugcgagcggaacccgcccuucaccgcccgcaucuacgccgcgggguucgacagcuccaagaacaucuuccugggcgagaaggccgccaaguggaagaccagcgacgggcagauggacggccugaccacgaacggggugcucgugaugcacccccggaacggcuucaccgaggacagcaagcccggcaucuggcgcgagaucuccgucugcgggaacguguucagccugcgggagacccgcuccgcccagcagcggggcaagaugguggagaucgagaccaaccagcugcaggacgggagccucaucgaccugugcggcgccacgcugcucuggcgcaccgcggagggccugucccacaccccgaccgucaagcaccuggaggcccuccggcaggagaucaacgccgcccgcccccagugccccgugggguucaacacgcuggccuuccccagcaugaagcggaaggacguggucgacgagaagcagccguggguguaccugaacugcggccacgugcacggguaccacaacuggggcaacaaggaggagcgcgacgggaaggaccgggagugccccaugugccgcuccgucggccccuacgugccccucuggcugggcugcgaggcgggguucuacguggacgccggcccgcccacccacgccuucagccccugcgggcacgucugcuccgagaagaccaccgccuacuggagccagaucccccugccgcacggcacgcacaccuuccacgccgcgugccccuucugcgcccaccagcucgccggggagcagggcuacauccgccugaucuuccagggcccccuggacuga

SEQ ID NO: 34440 - RNA, 1263 nt, Artificial Sequence
  derived and/or modified sequence opt1 from PELI2__Homo_sapiens__NP_067078
auguucagccccggccaggaggagcacugcgccccgaacaaggagcccgugaaguacggggagcuggucgugcucggcuacaacggggcccugcccaacggcgaccgcgggcggcgcaagucccgguucgcgcuguacaagcgccccaaggccaacggcgugaagccgagcaccguccacgugaucuccacgccccaggccagcaaggccaucuccugcaagggccagcacagcaucuccuacacccucagccggaaccagaccguggucguggaguacacccacgacaaggacaccgacauguuccagguggggcgcuccacggagagccccaucgacuucgucgugaccgacaccaucuccggcagccagaacaccgacgaggcccagaucacgcaguccaccaucagccgguucgcgugccgcaucgugugcgaccggaacgagcccuacaccgcccgcaucuucgccgccggguucgacuccagcaagaacaucuuccugggcgagaaggcggccaaguggaagaacccggacgggcacauggacggccugaccacgaacggcguccucgugaugcacccccggggcggcuucaccgaggagucccagcccgggguguggcgcgagaucagcgucugcggcgacguguacacccugcgggagacccgcuccgcccagcagcggggcaagcugguggagagcgagacgaacguccuccaggacgggagccugaucgaccugugcggcgccacccuccuguggcgcaccgccgacgggcuguuccacacccccacgcagaagcacaucgaggcgcuccggcaggagaucaacgccgcccgcccgcagugccccgugggccugaacacccuggccuuccccuccaucaaccggaaggagguggucgaggagaagcagcccugggccuaccucagcugcgggcacgugcacggcuaccacaacuggggccaccgcuccgacaccgaggcgaacgagcgggagugcccgaugugccgcaccguggggcccuacgucccccuguggcugggcugcgaggccggguucuacguggacgccgggcccccgacgcacgccuucacccccugcgggcacgucugcagcgagaaguccgccaaguacuggagccagaucccccucccccacggcacccacgcguuccacgccgccugcccguucugcgccacccagcuggugggcgagcagaacugcaucaagcugaucuuccaggggcccaucgacuga

SEQ ID NO: 34441 - RNA, 2721 nt, Artificial Sequence
  derived and/or modified sequence opt1 from PELP1__Homo_sapiens__NP_001265170
auggagcuggccguggccguccuccgcgaccugcugcgguacgcggcccagcuccccgcccuguuccgcgacaucagcaugaaccaccugccgggccuccugaccucccugcucgggcugcggcccgagugcgagcagagcgcccuggagggcaugaaggccugcaugaccuacuucccccgcgcgugcgggucccucaagggcaagcuggccagcuucuuccugucccggguggacgcccucagcccccagcugcagcagcuggccugcgagugcuacucccgccucccgagccugggggcgggcuucucccagggccugaagcacacggagagcugggagcaggagcuccacucccugcuggccagccuccacacccugcugggggcccucuacgagggcgccgagaccgcccccgugcagaacgaggggcccggcgucgagaugcugcuguccagcgaggacggggacgcgcacgugcuccugcagcugcggcagcgcuucuccggccucgcccggugccugggccugaugcucagcuccgaguucggggcccccgugagcgucccggugcaggagauccuggacuucaucugccgcacccuguccgugagcagcaagaacaucucccuccacggcgacgggccccugcggcugcuccugcugcccagcauccaccucgaggcccuggaccugcucuccgcccugauccuggcgugcggcagccgccugcuccgguucggcauccugaucgggcgccugcucccccagguccugaacuccuggagcaucggccgggacucccugagcccggggcaggagcgccccuacuccacggugcggaccaagguguacgccauccucgagcuguggguccaggugugcggcgccagcgccgggaugcugcagggcggcgccuccggggaggcgcuccugacccaccugcucagcgacaucuccccccccgccgacgcccugaagcugcgcagcccgcggggcucccccgacgggagccuccagaccggcaagcccuccgcccccaagaagcugaagcuggacgugggggaggccauggcgccgcccagccaccgcaagggcgacuccaacgccaacagcgacgucugcgccgccgcgcuccggggccugagccgcacgauccugaugugcgggccccucaucaaggaggagacccaccgccggcugcacgaccuggugcucccccuggugaugggcguccagcagggggaggugcugggcuccagcccguacaccuccagccgcugccggcgcgagcucuacugccugcugcucgcccugcugcucgcccccuccccccggugccccccgccccuggccugcgcccugcaggcguucagccucgggcagcgcgaggacucccuggaggugagcuccuucugcagcgaggcccuggucaccugcgccgcccucacgcacccccgggugccgccccugcagcccaugggccccaccugcccgacccccgcccccgugcccccgcccgaggcgcccucccccuuccgcgccccgcccuuccacccccccggcccgaugcccagcgucggguccaugcccagcgccggccccaugccguccgccgggcccaugcccagcgccggccccgugccguccgcgcggcccggccccccgaccacggccaaccaccuggggcucagcguccccggccuggugagcgugcccccccgccugcucccggggcccgagaaccaccgggccggcuccaacgaggaccccauccuggcccccagcgggaccccgccccccaccauccccccggacgagaccuucggcggccgcgucccccggcccgcguucgugcacuacgacaaggaggaggccuccgacguggagaucagccuggaguccgacagcgacgacuccgucgugaucgugcccgaggggcucccgccccugccccccccgccccccagcggcgccacgcccccgcccaucgcccccaccgggcccccgaccgccuccccccccgucccggcgaaggaggagcccgaggagcugcccgccgcccccggcccgcuccccccccccccgcccccccccccgcccgugcccgggcccgugacccugccgcccccccagcugguccccgagggcacgccgggcgggggcgggccccccgcccucgaggaggaccugaccgugaucaacaucaacagcuccgacgaggaggaggaggaggaggaggaggaggaggaggaggaggaggaggaggaggaggaggaggaggacuucgaggaggaggaggaggacgaggaggaguacuucgaggaggaggaggaggaggaggaggaguucgaggaggaguucgaggaggaggagggcgagcuggaggaggaggaggaggaggaggacgaggaggaggaggaggagcucgaggagguggagcgcgagggggagagccccgccgcgggcccgcccccccaggagcuggucgaggaggagcccuccgccccgcccacccugcucgaggaggagaccgaggacggcagcgacaaggugcagcccccgcccgagacgcccgccgaggaggagauggagaccgagaccgaggccgaggcccugcaggagaaggagcaggacgacaccgcggccaugcuggccgacuucaucgacugccccccggacgacgagaagcccccccccccgacggagcccgacuccuga

SEQ ID NO: 34442 - RNA, 645 nt, Artificial Sequence
  derived and/or modified sequence opt1 from PEMT__Homo_sapiens__NP_001254480
augaagcgcagcggcaaccccggggccgaggccgacuucugcgugaugacccggcugcucggcuacgucgacccgcuggaccccuccuucguggcggccgugaucaccaucacguucaacccccuguacuggaacgucguggcccgcugggagcacaagacccggaagcucagccgcgccuucgggucccccuaccuggccugcuacagccuguccgugaccauccuccugcugaacuuccuccggagccacugcuucacccaggcgaugcugucccagccgcgcauggagagccuggacacgcccgccgccuacucccucggccuggcccugcucgggcugggcgucgugcuggugcucagcuccuucuucgcgcugggcuucgccgggaccuuccugggcgacuacuucgggauccucaaggaggcccgggucaccguguuccccuucaacauccuggacaaccccauguacuggggcagcaccgccaacuaccuggggugggccaucaugcacgcguccccgacgggccuccugcugaccgugcucgucgcccugaccuacaucguggcccugcucuacgaggagcccuucaccgccgagaucuaccgccagaaggccagcggcucccacaagcggagcuga

SEQ ID NO: 34443 - RNA, 804 nt, Artificial Sequence
  derived and/or modified sequence opt1 from PENK__Homo_sapiens__NP_001129162
auggcccgcuuccugacccucugcaccuggcugcugcuccugggccccgggcugcucgccacggugcgggcggagugcagccaggacugcgcgaccugcuccuaccgccugguccggccggccgacaucaacuuccuggccugcgugauggagugcgagggcaagcuccccagccugaagaucugggagaccugcaaggagcugcuccagcuguccaagcccgagcugccccaggacgggaccagcacgcuccgcgagaacuccaagccggaggagagccaccuccuggccaagcgguacggcggguucaugaagcgcuacggcggcuucaugaagaagauggacgagcuguaccccauggagcccgaggaggaggccaacggguccgagauccuggccaagcgguacggcggguucaugaagaaggacgccgaggaggacgacagccuggccaacuccagcgaccuccugaaggagcugcucgagaccggcgacaaccgcgagcggucccaccaccaggacgggagcgacaacgaggaggagguguccaagcgcuacggcggcuucaugcgggggcugaagcgcagcccccagcuggaggacgaggcgaaggagcuccagaagcgguacggcggguucaugcgccgggucggccgcccggagugguggauggacuaccagaagcgguacggcggguuccugaagcgcuucgccgaggcccugcccuccgacgaggagggcgagagcuacuccaaggaggugcccgagauggagaagcgguacgggggcuucaugcgcuucuga

SEQ ID NO: 34444 - RNA, 1482 nt, Artificial Sequence
  derived and/or modified sequence opt1 from PEPD__Homo_sapiens__NP_000276
auggccgccgcgaccggccccagcuucuggcuggggaacgagacccucaaggugccgcuggcccuguucgcccucaaccgccagcggcugugcgagcgccugcggaagaaccccgccguccaggccggcuccaucguggugcuccagggcggggaggagacgcagcgcuacugcaccgacaccgggguccuguuccggcaggagagcuucuuccacugggcguucggcgugaccgagcccggcugcuacggggugaucgacgucgacacgggcaaguccacccuguucgugccccgccucccggccagccacgccaccuggauggggaagauccacuccaaggagcacuucaaggagaaguacgccguggacgacguccaguacguggacgagaucgcgagcgugcugaccucccagaagcccagcguccugcucacgcugcggggcgugaacaccgacuccgggagcgugugccgcgaggccuccuucgacggcaucagcaaguucgaggucaacaacaccauccugcaccccgagaucguggagugccggguguucaagaccgacauggagcucgagguccugcgcuacacgaacaagaucuccagcgaggcccaccgggaggugaugaaggccgugaaggucggcaugaaggaguacgagcuggagucccucuucgagcacuacugcuacagccgcgggggcaugcggcacuccagcuacacgugcaucugcggguccggcgagaacagcgccgugcugcacuacggccacgcgggggcccccaacgaccgcaccauccagaacggcgacaugugccuguucgacaugggcggggaguacuacugcuucgccagcgacaucacgugcuccuucccggccaacgggaaguucaccgccgaccagaaggcgguguacgaggccguccuccggagcucccgcgccgugaugggcgccaugaagcccggcgucugguggcccgacaugcaccggcuggccgaccgcauccaccuggaggagcucgcgcacauggggauccugagcggcuccguggacgccauggugcaggcccaccugggggccgucuucaugccccacggccucgggcacuuccugggcaucgacgugcacgacgugggcggguacccggagggcgucgagcggaucgacgagcccgggcugcgcagccuccggaccgcccgccaccuccagcccggcauggugcugaccguggagcccgggaucuacuucaucgaccaccuccuggacgaggcgcuggccgacccggcccgcgccuccuuccucaaccgggagguccugcagcgcuuccggggcuucggcggggugcgcaucgaggaggacguggucgugaccgacagcggcaucgagcugcugaccugcgugccccggaccgucgaggagaucgaggcgugcauggccgggugcgacaaggccuucacccccuucuccggccccaaguga

SEQ ID NO: 34445 - RNA, 3873 nt, Artificial Sequence
  derived and/or modified sequence opt1 from PER1__Homo_sapiens__NP_002607
auguccggcccccuggagggggccgacggcgggggcgacccccgccccggggaguccuucugccccggcggcgugcccucccccgggccgccccagcaccggcccugccccggccccucccucgccgacgacaccgacgccaacagcaacggguccuccggcaacgaguccaacgggcacgagagccgcggcgccucccagcggagcucccacagcuccagcuccggcaacgggaaggacagcgcccugcuggagaccacggaguccagcaaguccaccaacagccagagccccagcccgcccagcuccagcaucgccuacucccuccugagcgccuccagcgagcaggacaaccccuccaccagcggcugcuccagcgagcaguccgcccgcgcccggacccagaaggagcugaugaccgcccuccgcgagcugaagcugcggcugccgcccgagcgccgggggaagggccgcagcggcacccuggccacccugcaguacgcgcucgccugcgucaagcagguccaggccaaccaggaguacuaccagcaguggucccuggaggagggggagcccugcagcauggacauguccaccuacacccuggaggagcucgagcacaucaccagcgaguacacccugcagaaccaggacaccuucuccguggccgucagcuuccugaccggccggaucguguacaucagcgagcaggccgcggugcuccugcgcugcaagcgggacgucuuccgcgggacccgguucuccgagcugcucgcgccccaggacgugggcguguucuacgggagcaccgcccccucccgccugcccaccuggggcacgggcgccagcgccggguccggccugcgggacuucacccaggagaaguccgucuucugccgcauccggggcgggcccgaccgcgaccccgggccccgguaccagcccuuccgccucaccccguacgugaccaagauccgcguguccgacggggcgcccgcccagcccugcugccugcugaucgccgagcggauccacagcggcuacgaggcgccccggaucccgcccgacaagcggaucuucacgacccgccacacccccuccugccucuuccaggacgucgacgagcgggccgcgccgcugcugggguaccucccccaggaccugcugggcgcccccgugcuccuguuccugcaccccgaggaccgcccgcucaugcuggccauccacaagaagauccugcagcucgccgggcagcccuucgaccacagccccauccgguucugcgcccgcaacggcgaguacgugaccauggacacguccugggcgggguucguccaccccuggagccggaagguggccuucgugcugggccgccacaagguccggaccgccccgcugaacgaggacguguucacgccgcccgcccccuccccggcgcccagccucgacaccgacauccaggagcuguccgagcagauccaccgccugcuccugcagcccgugcacagccccuccccgacgggccugugcggggucggcgccgugaccagccccgggccccuccacagccccggcuccagcuccgacagcaacggcggggacgccgagggcccggggccgcccgcccccgugaccuuccagcagaucugcaaggacguccaccuggugaagcaccagggccagcagcuguucaucgagucccgggcccgcccgcagagccggccccgccugcccgcgaccgggacguucaaggccaaggcccucccgugccagucccccgaccccgagcuggaggccggcagcgcccccguccaggcgccgcuggcccucgugcccgaggaggccgagcggaaggaggccuccagcugcuccuaccagcagaucaacugccuggacagcauccugcgcuaccucgaguccugcaaccugcccagcaccaccaagcggaagugcgccuccagcuccagcuacaccacguccagcgcgagcgacgacgaccgccagcgcaccggccccguguccgucgggaccaagaaggacccgcccagcgccgcccuguccggcgagggggccacgccccggaaggagcccguggugggcgggacccucagcccgcuggcgcuggccaacaaggccgaguccgucgugagcgugacgucccagugcagcuucuccagcaccaucguccacgugggcgacaagaagccgcccgaguccgacaucaucaugauggaggaccuccccggccuggccccggggcccgcccccagccccgcgccgucccccaccguggcccccgaccccgccccggacgccuaccgccccgucggccugaccaaggccgugcucagccugcacacgcagaaggaggagcaggcguuccugucccgguuccgcgaccucgggcggcugcgcggccuggacagcuccagcaccgcccccuccgcccucggggagcggggcugccaccacggccccgccccgcccagccgccggcaccacugccgcagcaaggccaagcggucccgccaccaccagaacccccgggcggaggccccgugcuacgugagccaccccucccccgugccgcccagcacccccuggcccacgccgcccgccacgacccccuuccccgccguggugcagcccuacccccugcccgucuucagcccccgcgggggcccccagccccugccgcccgcgcccaccagcgugccgcccgccgccuuccccgcgccccucgugaccccgauggucgcccuggugcugcccaacuaccucuuccccacgcccuccagcuacccguacggggcccugcagacccccgccgagggcccgcccacccccgccucccacagccccucccccagccugcccgcccucgcccccagcccgccccaccggccggacagcccccuguucaacucccgcugcagcagcccccuccagcucaaccugcugcagcucgaggagcugccccgggcggagggggccgccguggccggcggcccggggagcuccgccgggccgccgccgcccagcgcggaggccgccgagcccgaggcccgccuggccgaggucaccgagagcuccaaccaggacgcgcucagcggguccagcgaccugcuggagcuccugcugcaggaggacucccggagcggcacgggcuccgccgccagcgggucccucggcagcgggcugggcuccgggagcggcuccggcagccacgagggcggcuccaccagcgccuccaucacccgcagcucccagagcagccacaccuccaaguacuucgggagcaucgacuccagcgaggcggaggccggcgccgcccgcgggggcgccgagcccggcgaccaggugaucaaguacgugcugcaggaccccaucuggcuccugauggcgaacgccgaccagcgcgucaugaugacguaccaggugcccucccgcgacaugaccagcgugcugaagcaggaccgggagcgccuccgggccaugcagaagcagcagccccgcuucuccgaggaccagcggcgcgagcugggggccguccacagcugggugcggaagggccagcugccccgcgcccucgacgugauggcgugcgucgacugcggguccagcacccaggaccccggccacccggacgacccccuguucuccgagcuggacgggcucggccuggagcccauggaggagggcgggggcgagcaggggagcuccggcggcgggagcggcgagggggagggcugcgaggaggcccagggcggcgccaaggccuccagcucccaggaccuggccauggaggaggaggaggagggccggagcuccagcagcccggcgcuccccaccgccgggaacugcacguccuga

SEQ ID NO: 34446 - RNA, 3768 nt, Artificial Sequence
  derived and/or modified sequence opt1 from PER2__Homo_sapiens__NP_073728
augaacggcuacgccgaguucccgcccagccccuccaaccccaccaaggagcccguggagccgcagcccagccaggucccccugcaggaggacguggacauguccagcggguccagcggccacgagaccaacgagaacugcuccacggggcgcgacagccagggcuccgacugcgacgacagcgggaaggagcucggcaugcugguggagcccccggacgcccggcagucccccgacaccuucagccugaugauggcgaaguccgagcacaaccccagcaccuccggcugcagcuccgaccagagcuccaaggucgacacccacaaggagcucaucaagacgcugaaggagcugaaggugcaccuccccgccgacaagaaggccaaggggaaggccagcacccuggccacccugaaguacgcgcuccgcagcgugaagcaggucaaggccaacgaggaguacuaccagcugcugauguccagcgagggccacccgugcggggccgacgugcccuccuacaccguggaggagauggagagcgucacguccgagcacaucgugaagaacgccgacauguucgcgguggccgucagccucguguccggcaagauccuguacaucagcgaccagguggccuccaucuuccacugcaagcgggacgccuucagcgacgccaaguucgucgaguuccuggcgccccacgacguggggguguuccacuccuucaccagccccuacaagcucccgcugugguccaugugcagcggcgccgacuccuucacccaggagugcauggaggagaaguccuucuucugccgcgucuccgugcgcaagagccacgagaacgagauccgcuaccaccccuuccggaugacccccuaccuggugaagguccgcgaccagcagggcgccgagucccagcucugcugccugcugcucgccgagcgggugcacagcggguacgaggcgccccgcaucccgcccgagaagcggaucuucacgaccacccacacccccaacugccuguuccaggacguggacgagcgcgccgucccccugcucggcuaccugccgcaggaccugaucgagacgcccgugcucguccagcugcaccccagcgaccggccccugaugcucgccauccacaagaagauccugcaguccgggggccagccguucgacuacagccccauccgcuuccgggcccgcaacggcgaguacaucacccuggacaccuccuggagcuccuucaucaaccccuggagccggaagaucagcuucaucaucgggcggcacaaggugcgggugggcccgcucaacgaggacgucuucgccgcccaccccugcaccgaggagaaggcgcugcaccccagcauccaggagcugacggagcagauccaccgccuccugcugcagcccgugccgcacuccgggagcuccggcuacgggagccucggcuccaacggcagccacgagcaccugaugucccagaccagcuccagcgacagcaacgggcacgaggacucccggcgccgccgggccgagaucugcaagaacggcaacaagaccaagaaccgcagccacuacucccacgagagcggggagcagaagaagaaguccgugaccgagaugcagacgaacccgcccgccgagaagaaggccguccccgccauggagaaggacagccugggcguguccuuccccgaggagcucgcgugcaagaaccagccgaccugcagcuaccagcagaucuccugccuggacagcgugauccgguaccuggaguccugcaacgaggccgccacccucaagcgcaagugcgaguuccccgccaacguccccgcgcugcggagcuccgacaagcgcaaggccaccgugagccccgggccccacgccggcgaggccgagccgcccucccgggugaacagccgcacgggcgucgggacccaccugaccucccucgcccugcccggcaaggcggagagcguggccucccugaccagccagugcagcuacuccagcacgaucgugcacgucggggacaagaagccccagcccgagcuggagaugguggaggacgccgccuccggccccgagagccucgacugccuggccgggccggcgcuggccugcggccucucccaggagaaggagcccuucaagaagcugggccugaccaaggaggugcucgccgcccacacccagaaggaggagcagagcuuccugcagaaguucaaggagauccggaagcuguccaucuuccagagccacugccacuacuaccuccaggagcgcuccaaggggcagcccagcgagcggaccgcccccggccugcgcaacacguccgggaucgacagcccguggaagaagaccggcaagaaccggaagcugaaguccaagcgcgucaagccccgggacagcuccgagagcaccggcuccgggggccccgugagcgcgcgcccgccccucguggggcugaacgccaccgccuggucccccagcgacaccagccaguccagcugccccgccgucccguuccccgcgcccgugcccgccgccuacucccugccgguguuccccgcccccggcacggucgccgcgcccccggccccgccccacgccagcuucaccgugcccgccgugcccgucgaccuccagcaccaguucgccgugcagcccccgcccuuccccgcgccccuggcccccgugauggccuucaugcugcccuccuacagcuucccguccgggacccccaaccucccccaggccuucuuccccagccagccgcaguuccccucccaccccacccugacgagcgagauggccuccgcgagccagccggaguuccccucccggaccagcaucccccgccagcccugcgccugcccggccacccgggccaccccgcccuccgcgaugggccgcgccuccccgccccuguuccagucccgcagcuccagcccccuccagcugaaccugcuccagcuggaggaggcccccgagggcgggacgggcgccauggggaccaccggcgccaccgagacggcggccgucggggccgacugcaagcccggcaccagccgggaccagcagcccaaggcgccccugacccgcgacgagcccuccgacacccagaacagcgacgcccucuccacgagcuccggccugcugaaccuccugcugaacgaggaccucugcagcgccuccgggagcgccgccuccgagagccugggcuccgggagccugggcugcgacgccucccccagcggggccggcuccagcgacaccucccacaccagcaaguacuucggcuccaucgacagcagcgagaacaaccacaaggcgaagaugaacaccgggauggaggaguccgagcacuucaucaagugcgugcuccaggacccgaucuggcugcugauggccgacgccgacagcuccgugaugaugacguaccagcuccccagccggaaccuggaggccguccugaaggaggaccgcgagaagcucaagcugcugcagaagcuccagccccgguucaccgagucccagaagcaggagcugcgcgaggugcaccaguggaugcagaccggcgggcugcccgccgcgaucgacguggccgagugcgucuacugcgagaacaaggagaagggcaacaucugcaucccguacgaggaggacauccccagccucgggcuguccgaggugagcgacaccaaggaggacgagaacggcagcccccugaaccaccggaucgaggagcagacguga

SEQ ID NO: 34447 - RNA, 3576 nt, Artificial Sequence
  derived and/or modified sequence opt1 from PER3__Homo_sapiens__NP_001276790
augccccgcggcgaggccccggggcccggccggcgcggggccaaggacgaggcgcugggcgaggagagcggggagcgguggucccccgaguuccaccuccagcgcaagcuggccgacagcucccacagcgagcagcaggaccggaaccgcguguccgaggagcugaucauggucgugcaggagaugaagaaguacuuccccagcgagcggcgcaacaagccguccacccucgacgcccugaacuacgcccugcggugcgugcacagcguccaggccaacuccgaguucuuccagauccucagccagaacggcgcgccccaggccgacguguccauguacagccuggaggagcuggccaccaucgccuccgagcacacgagcaagaacaccgacaccuucguggcggucuucuccuuccucagcggccgccuggugcacaucuccgagcaggccgcccugauccucaaccggaagaaggacgugcuggccagcucccacuucgucgaccugcucgcgccccaggacaugcgcguguucuacgcccacaccgcccgggcccagcugcccuucuggaacaacuggacgcagcgcgccgccgcgcgguacgagugcgccccggugaagcccuucuucugccgcauccgcgggggcgaggaccggaagcaggagaagugccacagccccuuccggaucauccccuaccugauccacguccaccacccggcccagcccgagcucgagagcgagcccugcugccugaccgugguggagaagauccacuccggguacgaggcgccccgcaucccggucaacaagcggaucuucaccaccacgcacacccccggcugcguguuccuggagguggacgagaaggccgucccccuccugggguaccugccccaggaccucaucggcaccagcauccuguccuaccugcacccggaggaccgcagccucaugguggccauccaccagaaggugcugaaguacgccggccacccgcccuucgagcacucccccauccgcuucugcacccagaacggggacuacaucauccuggacagcuccuggagcuccuucgucaaccccuggagccggaagaucuccuucaucaucggccgccacaaggugcggacgagcccccucaacgaggacguguucgccaccaagaucaagaagaugaacgacaacgacaaggacaucaccgagcugcaggagcagaucuacaagcugcuccugcagcccguccacguguccgucagcuccggguacgggagccugggcuccagcgggucccaggagcagcucgugagcaucgccagcuccagcgaggccuccggccaccgcguggaggagaccaaggcggagcagaugacgcugcagcaggucuacgccagcgugaacaagaucaagaaccuggggcagcagcucuacaucgaguccaugaccaagagcuccuucaagcccgugaccggcacccggacggagccgaacgggggcggcgagagcgccaacgggggcggggagugcaagaccuucaccuccuuccaccagacccugaagaacaacagcgucuacacggagcccugcgaggaccugcgcaacgacgagcacucccccagcuaccagcagaucaacugcaucgacuccgugauccgguaccucaagagcuacaacaucccggcccugaagcgcaagugcaucuccugcaccaacaccaccagcuccagcagcgaggaggacaagcagaaccacaaggcggacgacgugcaggcccugcaggccggccuccagauccccgccauccccaaguccgagaugcccacgaacgggcggagcaucgacaccggcggcggggccccgcagauccuguccaccgcgaugcugagccucggcuccgggaucagccagugcggcuacuccagcaccaucguccacgugcccccgcccgagacggcccgcgacgccacccuguucugcgagcccuggacccugaacaugcagcccgcgccccugaccuccgaggaguucaagcacguggggcucacggccgccguccugagcgcccacacccagaaggaggagcagaacuacguggacaaguuccgggagaagauccuguccagccccuacuccagcuaccuccagcaggagucccgcagcaaggccaaguacuccuacuuccagggcgacagcaccuccaagcagacccggagcgccggcugccgcaaggggaagcacaagcggaagaagcugccggagccgcccgacagcuccagcuccaacaccggcagcgggccccgccggggcgcccaccagaacgcgcagcccugcugccccuccgccgccagcagcccccacacgagcucccccaccuucccgcccgccgcgauggugcccagccaggcccccuaccuggucccggccuucccccuccccgccgccaccuccccgggccgcgaguacgcggcccccgggaccgcccccgagggccugcacgggcugccccucagcgagggccugcagccguaccccgccuuccccuuccccuaccuggacacguucaugaccguguuccucccggacccgcccgugugcccccugcugucccccagcuuccuccccugccccuuccugggggccaccgcguccagcgccaucucccccagcauguccagcgccaugagcccgacccuggacccgccgcccuccgucacgagccagcggcgcgaggaggagaagugggaggcccaguccgagggccaccccuucaucaccagccgcuccagcagcccccuccagcugaaccugcuccaggaggagaugccccggcccuccgagucccccgaccagaugcgccggaacacgugcccccagaccgaguacugcgugaccggcaacaacgggagcgaguccagccccgccaccaccggcgcgcuguccaccggguccccgccccgcgagaaccccucccaccccacggccagcgcccuguccaccggcagcccgcccaugaagaaccccucccaccccaccgccagcacccucagcauggggcugccgcccucccggacgcccagccaccccaccgcgaccgugcuguccaccggcagcccgcccuccgagagccccucccgcacgggcagcgccgccuccgggagcuccgacagcuccaucuaccucaccagcuccgucuacagcuccaagaucagccagaacggccagcagucccaggacgugcagaagaaggagaccuuccccaacguggccgaggagccgaucuggcggaugauccgccagacccccgagcggauccugaugacguaccagguccccgagcgcgugaaggaggugguccugaaggaggaccucgagaagcuggagagcaugcggcagcagcagccccaguucagccacgggcagaaggaggagcuggccaagguguacaacuggauccagucccagaccgugacccaggagaucgacauccaggcgugcgugaccugcgagaacgaggacagcgccgacggcgccgccacguccugcggccagguccucguggaggacagcugcuga

SEQ ID NO: 34448 - RNA, 2091 nt, Artificial Sequence
  derived and/or modified sequence opt1 from PERM1__Homo_sapiens__NP_001278296
augcccacccaggacggccagcugcgccggccggcccgcccgcccgggccccgggccuggauggagccccgcggcgggggcagcucccaguucagcuccugccccgggcccgcgagcuccggcgaccagaugcagcggcuccugcagggccccgccccgcgcccgcccggggagccgcccggcagccccaagucccccgggcacagcaccggcucccagcggcccccggacagccccggggccccgccccgcucccccagccggaagaagcgccgggccgugggcgccaagggcgggggccacacgggggcguccgccagcgcccagaccggcagcccccugcuccccgccgcgucccccgagaccgccaagcugauggccaaggccggccaggaggagcuggggccgggccccgccggggcgcccgagcccggcccgcgcucccccguccaggaggaccggcccgggccgggccucggccugagcacccccgugcccgugacggagcaggggaccgaccagauccgcacgccccggcgcgccaagcugcacaccgucuccaccaccgugugggaggcccucccggacgugagccgggccaagagcgacauggccgucuccacccccgcgagcgagccccagcccgaccgcgacauggccguguccaccccggccagcgagccccaguccgaccgggacauggccgugagcacgcccgccuccgagccccagcccgacaccgacauggcggucagcacccccgccuccgagccccagcccgaccgcgacauggccgugagcaucccggccuccaagccccagagcgacaccgccguguccacgcccgcgagcgagccccaguccagcgucgcccuguccaccccgaucagcaagccccagcuggacaccgacguggccguguccacccccgccagcaagcacggccucgacgucgcgcugcccacggccgggccgguggccaagcuggagguggccagcuccccgcccgucagcgaggccgugccccggaugaccgaguccagcggccucguguccacccccgucccccgcgcggacgccgccgggcuggccuggcccccgacccgccgggccggccccgacgugguggagauggaggcggucgugagcgagcccuccgccggcgcccccgggugcugcagcggcgccccggcccuggggcucacgcaggucccccgcaagaagaaggugcgguucuccguggcgggccccagccccaacaagccgggguccggccaggccagcgcccgccccuccgcgccccagaccgccaccggcgcccacgggggccccggggccugggaggccgucgccgugggcccgcggccccaccagccccgcauccugaagcaccucccccggccgccgcccagcgcggugacccgcgucggccccggguccagcuucgccgugacgcugcccgaggccuacgaguucuucuucugcgacaccaucgaggagaacgaggaggccgaggccgcggccgccggccaggaccccgccggggugcaguggcccgacaugugcgaguucuucuuccccgacgucggcgcccagcggucccgccggcgcgggagcccggagccccugccccgggcggacccggugcccgcccccauccccggcgacccggugcccaucagcauccccgaggucuacgagcacuucuucuucggcgaggaccgccuggagggggugcucggccccgccgugccgcugccccugcaggcccucgagccgccccgguccgcgagcgagggggccggccccgggacgccccugaagcccgccgucguggagcgccugcaccucgcccugcggcgcgccggcgagcugcggggccccgugccguccuucgcguucagccagaacgacaugugccucgucuucguggccuucgccaccugggccgugcgcaccuccgacccccacacccccgacgccuggaagaccgcgcugcuggccaacgucgggaccaucagcgccauccgcuacuuccggcgccaggugggccaggggcggcgcucccacagccccuccccgagcuccuga

SEQ ID NO: 34449 - RNA, 582 nt, Artificial Sequence
  derived and/or modified sequence opt1 from PERP__Homo_sapiens__NP_071404
augauccgcugcggccuggccugcgagcggugccgcuggauccucccccugcugcuccugagcgccaucgcguucgacaucaucgcccuggccgggcggggcuggcuccaguccagcgaccacgggcagaccuccagccugugguggaagugcucccaggagggcgggggcagcggcuccuacgaggaggggugccagagccugauggaguacgccuggggccgcgccgcggccgccaugcuguucugcggguucaucauccucgugaucugcuucauccuguccuucuucgcccucugcggcccgcagaugcuggucuuccugcgggugaucgggggccuccuggcgcuggccgccguguuccagaucaucagccucgucaucuaccccgugaaguacacccagacguucacccugcacgccaaccccgccgugaccuacaucuacaacugggcguacggcuucgggugggccgccaccaucauccugaucggcugcgccuucuucuucugcugccuccccaacuacgaggacgaccugcuggggaacgccaagccgcgcuacuucuacacguccgcguga

SEQ ID NO: 34450 - RNA, 1752 nt, Artificial Sequence
  derived and/or modified sequence opt1 from PES1__Homo_sapiens__NP_001230154
augggcgggcuggagaagaagaaguacgagcgcggcagcgccaccaacuacaucacccggaacaaggcccgcaagaagcuccagcugucccuggcggacuuccggcgccucugcauccugaaggggaucuacccccacgagccgaagcacaagaagaaggugaacaagggcagcacggccgcccggaccuucuaccugaucaaggacauccgcuuccuccugcacgagcccaucgucaacaaguuccgggaguacaagguguucgugcgcaagcugcggaaggccuacgggaaguccgaguggaacaccgucgagcgccucaaggacaacaagcccaacuacaagcuggaccacaucaucaaggagcgguaccccaccuucaucgacgcccugcgcgaccucgacgacgcgcugagcaugugcuuccuguucuccacguucccgcggaccggcaagugccacgugcagaccauccagcucugccgccggcugaccguggaguucaugcacuacaucaucgccgcccgcgcccugcggaaggucuuccucagcaucaagggcaucuacuaccaggcggaggugcuggggcagcccaucguguggaucacgcccuacgccuucucccacgaccaccccaccgacgucgacuaccgcgugauggccaccuucaccgaguucuacacgacccugcucggcuucgugaacuuccggcuguaccagcugcucaaccugcacuacccgcccaagcuggaggggcaggcccaggccgaggcgaaggccggcgaggggaccuacgcccucgacagcgaguccugcauggagaagcuggccgcccugagcgcgucccucgcccgcgucguggugcccgccaccgaggaggaggccgaggucgacgaguuccccacggacggcgaggaggaccggcgcaaggagcuggaggcccaggagaagcacaagaagcuguucgagggccucaaguucuuccugaaccgcgaggugccgcgggaggcgcuggccuucaucauccgcagcuucgggggcgagguguccugggacaagagccucugcaucggggccaccuacgacgucaccgacucccggaucacccaccagaucguggaccgccccggccagcagacgagcgugaucggccggugcuacguccagccccaguggguguucgacuccgugaacgcccgccugcugcuccccgucgccgaguacuucagcggggugcagcugccgccccaccugucccccuucgucaccgagaaggagggcgacuacgugcccccggagaagcucaagcugcuggcgcuccagcgcggggaggaccccggcaaccugaacgagagcgaggaggaggaggaggaggacgacaacaacgagggggacggcgacgaggagggcgagaacgaggaggaggaggaggacgccgaggccgggagcgagaaggaggaggaggcccggcuggcggcccucgaggagcagcggauggagggcaagaagccccgcgugauggccgggacccugaagcuggaggacaagcagcggcuggcccaggaggaggaguccgaggccaagcgccucgcgaucaugaugaugaagaagcgggagaaguaccuguaccagaagaucauguucggcaagcgccggaagauccgcgaggccaacaagcuggccgagaagcggaaggcccacgacgaggccguccgcagcgagaagaaggcgaagaaggcccggcccgaguga

SEQ ID NO: 34451 - RNA, 222 nt, Artificial Sequence
  derived and/or modified sequence opt1 from PET100__Homo_sapiens__NP_001164626
augggcgugaagcuggagaucuuccgcaugaucaucuaccucaccuuccccgucgccauguucugggugagcaaccaggccgagugguucgaggacgacgugauccagcggaagcgcgagcuguggccgcccgagaagcugcaggagaucgaggaguucaaggagcggcuccgcaagcggcgcgaggagaagcugcugcgggacgcgcagcagaacuccuga

SEQ ID NO: 34452 - RNA, 246 nt, Artificial Sequence
  derived and/or modified sequence opt1 from PET117__Homo_sapiens__NP_001158283
augagccgcuccagcaaggugguccugggccucuccgugcugcugaccgccgccaccguggcggggguccacgugaagcagcagugggaccagcagcggcuccgcgacggcgugauccgggacaucgagcgccagauccggaagaaggagaacauccgccugcugggggagcagaucauccucacggagcagcuggaggccgagcgggagaagaugcugcucgccaagggcagccagaaguccuga

SEQ ID NO: 34453 - RNA, 744 nt, Artificial Sequence
  derived and/or modified sequence opt1 from PEX11A__Homo_sapiens__NP_003838
auggacgccuucacccgcuucaccaaccagacgcagggccgggaccgccuguuccgggccacccaguacacgugcaugcuccugcgcuaccugcucgagcccaaggcggggaaggagaagguggucaugaagcugaagaagcuggagagcuccgugagcaccggccggaagugguuccgccucgggaacgugguccacgccauccaggccaccgagcaguccauccacgccaccgaccuggugccgcggcugugccucacccuggccaaccugaaccgcgugaucuacuucaucugcgacaccauccucuggguccggagcgugggccugacguccgggaucaacaaggagaaguggcgcacccgggcggcccaccacuacuacuacagccugcuccugucccuggugcgcgaccucuacgagaucagccugcagaugaagcgggugaccugcgaccgcgccaagaaggagaaguccgccagccaggacccccugugguucuccgucgcggaggaggagaccgaguggcuccagagcuuccugcugcuccuguuccggucccugaagcagcacccgccccuccugcuggacacggugaagaaccucugcgacauccugaacccccuggaccagcucggcaucuacaagagcaaccccggcaucaucgggcugggcgggcuggucuccagcaucgccggcaugaucaccguggccuacccccagaugaagcucaagacccgcuga

SEQ ID NO: 34454 - RNA, 1080 nt, Artificial Sequence
  derived and/or modified sequence opt1 from PEX12__Homo_sapiens__NP_000277
auggccgagcacggcgcccacuucaccgcggccagcguggccgacgaccagcccuccaucuucgaggucguggcccaggacagccugaugaccgccgugcgcccggcgcuccagcacgucgugaaggugcuggccgaguccaaccccacgcacuacggguuccuguggcggugguucgacgagaucuucacccuccuggaccugcuccugcagcagcacuaccugagccgcaccuccgccagcuucuccgagaacuucuacggccucaagcggaucgucaugggggacacccacaagagccagcgccuggccuccgcgggccugcccaagcagcagcucuggaaguccaucauguuccuggugcugcuccccuaccugaaggugaagcuggagaagcucgucuccagccugcgggaggaggacgaguacuccauccacccgcccagcucccgcuggaagcgguucuaccgcgccuuccuggccgccuaccccuucgugaacauggccugggaggggugguuccucgugcagcagcugcgguacauccugggcaaggcgcagcaccacagcccccuccugcgccuggccggcguccagcucgggcggcugacggugcaggacauccaggcccuggagcacaagccggccaaggccuccaugaugcagcagcccgcgcgcagcguguccgagaagaucaacagcgcccucaagaaggccgucggcgggguggcccugagccuguccaccggccucagcgugggggucuucuuccugcaguuccuggacuggugguacuccagcgagaaccaggagaccaucaagucccucaccgcccugcccacgcccccgccgcccgugcaccuggacuacaacagcgacagcccccuccugcccaagaugaagaccgugugcccccugugccggaagacccgcgucaacgacaccgugcucgcgacgagcggcuacguguucugcuaccggugcgucuuccacuacgugcgcucccaccaggccugccccaucaccggcuaccccaccgagguccagcaccugaucaagcuguacagcccggagaacuga

SEQ ID NO: 34455 - RNA, 1212 nt, Artificial Sequence
  derived and/or modified sequence opt1 from PEX13__Homo_sapiens__NP_002609
auggccagccagcccccgcccccgcccaagcccugggagacccgccggauccccggcgccgggcccggccccgggccgggccccaccuuccaguccgcggaccuggggcccacgcucaugacccgccccggccagccggcccugacccgggugcccccgcccauccugccccgccccagccagcagaccggcuccagcuccgucaacacguuccggcccgccuacagcuccuucagcuccggguacggcgccuacgggaacagcuucuacggcggguacucccccuacagcuacggcuacaacggccucggguacaaccgccugcggguggacgaccugccgcccucccgcuucgugcagcaggccgaggagagcucccggggcgcguuccagagcaucgaguccaucguccacgccuucgccagcguguccaugaugauggacgccaccuucagcgcgguguacaacagcuuccgcgccguccucgacguggccaaccacuucucccggcugaagauccacuucaccaagguguucagcgccuucgcccugguccgcaccauccgguaccucuaccgccggcugcagcgcaugcuggggcuccggcgcggcuccgagaacgaggaccugugggcggagagcgagggcacgguggccugccugggggccgaggaccgggccgccaccuccgccaagagcuggcccaucuuccucuucuucgcggugauccugggcgggcccuaccugaucuggaagcuccuguccacccacagcgacgaggucaccgacuccaucaacugggccagcggcgaggacgaccacgugguggcccgcgccgaguacgacuucgcggccgucuccgaggaggagaucagcuuccgggccggggacaugcugaaccucgcccugaaggagcagcagccgaaggugcgcggcuggcugcucgccucccuggacggccagacgaccgggcugauccccgcgaacuacgugaagauccucggcaagcgcaaggggcggaagaccgucgagagcuccaaggugagcaagcagcagcaguccuucaccaaccccacgcugaccaagggcgccaccguggccgacagccuggacgagcaggaggccgcguucgaguccgucuucguggagaccaacaaggugcccgucgccccggacagcaucgggaaggacggcgagaagcaggaccucuga

SEQ ID NO: 34456 - RNA, 1077 nt, Artificial Sequence
  derived and/or modified sequence opt1 from PEX14__Homo_sapiens__XP_011539880
augcugaacaagcucaucugccugaugaucgccaccgccgugaaguuccugcagaacagccgcgugcggcagagcccccucgcgacccgccgggccuuccugaagaagaagggccugacggacgaggagaucgacauggccuuccagcaguccgggaccgccgccgacgagccguccagccucggccccgcgacccagguggugcccguccagcccccgcaccugaucucccagcccuacagccccgccgggucccgcuggcgggacuacggcgcccuggccaucaucauggcggggaucgccuucggcuuccaccagcucuacaagaaguaccugcugccccucauccugggcgggcgcgaggaccggaagcagcuggagcgcauggaggccggccucagcgagcuguccgggagcguggcccagaccgugacgcagcugcagaccacccucgccuccguccaggagcugcugauccagcagcagcagaagauccaggagcucgcgcacgagcuggccgccgccaaggccaccacgagcaccaacuggauccuggagucccagaacaucaacgagcucaagagcgagaucaacucccugaagggccugcuccugaaccggcgccaguucccgcccagccccuccgcgcccaagaucccgagcuggcagauccccgugaagucccccagccccagcuccccggccgccgugaaccaccacagcuccagcgacaucucccccgucagcaacgaguccaccagcuccagccccgggaaggagggccacucccccgagggcagcaccgugacguaccaccuccuggggccgcaggaggagggcgaggggguggucgacgugaagggccaggugcggauggagguccagggcgaggaggagaagcgcgaggacaaggaggacgaggaggacgaggaggacgacgacgugucccacguggacgaggaggacugccuggggguccagcgggaggaccgccggggcggggacggccagaucaacgagcaggucgagaagcugcgccggcccgagggggccagcaacgaguccgagcgcgacuga

SEQ ID NO: 34457 - RNA, 1011 nt, Artificial Sequence
  derived and/or modified sequence opt1 from PEX16__Homo_sapiens__NP_004804
auggagaagcugcgccuccugggccugcgguaccaggaguacgugacccgccaccccgccgccaccgcgcagcucgagacggccguccggggguucagcuaccugcuggccggccgcuucgccgacucccacgagcucagcgagcugguguacuccgccagcaaccugcucgugcugcugaacgacgggauccuccggaaggagcugcgcaagaagcugccggucucccucagccagcagaagcugcugaccuggcucuccgugcuggagugcguggaggucuucauggagaugggcgcggccaagguguggggcgagguggggcgguggcuggucaucgcccucauccagcuggccaaggcggugcugcgcaugcuccugcugcucugguucaaggccggccugcagaccagcccgcccaucgugccccuggaccgggagacccaggcccagccgcccgacggggaccacucccccggcaaccacgagcagagcuacgucgggaagcgcuccaaccggguggugcgcacgcuccagaacacccccagccugcacucccggcacuggggcgcgccccagcagcgcgaggggcggcagcagcagcaccacgaggagcugagcgccacccccacgccccucggccugcaggagaccaucgccgaguuccuguacaucgcccgcccccuccugcaccuccugucccugggccugugggggcagcggagcuggaagccguggcuccuggccggcgucguggacgugaccucccugagccuccuguccgaccgcaaggggcugacccggcgcgagcggcgcgagcuccgccggcgcaccauccugcugcuguacuaccuccugcggagccccuucuacgaccgcuucagcgaggcccggauccuguuccuccugcagcugcucgccgaccacguccccggcgugggccuggugacgcgcccccugauggacuaccucccgaccuggcagaagaucuacuucuacuccuggggguga

SEQ ID NO: 34458 - RNA, 840 nt, Artificial Sequence
  derived and/or modified sequence opt1 from PEX19__Homo_sapiens__NP_001180573
auggccgccgcggaggagggcugcagcgugggggccgaggccgaccgcgagcuggaggagcuccuggaguccgcccuggacgacuucgacaaggccaagcccagccccgcgccgcccuccaccaccacggcccccgacgccagcggcccccagaagcggucccccggggacaccgccaaggacgcccucuucgcgagccaggagaaguucuuccaggagcuguucgacuccgagcuggccagccaggccaccgccgaguucgagaaggcgaugaaggagcucgccgaggaggagccccaccuggucgagcaguuccagaagcuguccgaggccgccggccgcguggggagcgacaugaccucccagcaggaguucacgagcugccucaaggagacccuguccggccuggccaagaacgcgaccgaccuccagaacagcuccaugagcgaggaggagcugaccaaggccauggagggccuggggauggacgagggcgacggggagggcaacauccuccccaucaugcaguccaucaugcagaaccugcugagcaaggacgugcucuacccgucccugaaggagaucacggagaaguaccccgaguggcugcagagccaccgggagagccucccgcccgagcaguucgagaaguaccaggagcagcacuccgucaugugcaagaucugcgagcaguucgaggccgagacccccaccgacagcgagaccacgcagaaggcccgcuucgagauggugcuggaccugaugcagcagcuccaggaccuggggcacccgcccaaggagcuggccggcgagauggugcccgucgugaacuccguguga

SEQ ID NO: 34459 - RNA, 3852 nt, Artificial Sequence
  derived and/or modified sequence opt1 from PEX1__Homo_sapiens__NP_000457
auguggggcagcgaccgccuggccggggccggcgggggcggggcggccgugaccgucgccuucaccaacgcccgggacugcuuccuccaccucccccgccggcugguggcccagcugcaccuccugcagaaccaggcgaucgagguggucuggucccaccagccggccuuccugagcuggguggagggccgccacuucuccgaccagggcgagaacguggccgagaucaaccggcaggucgggcagaagcugggccugagcaacgggggccagguguuccucaagcccugcucccacguggucagcugccagcaggucgagguggagccccuguccgccgacgacugggagauccuggagcuccacgcggugagccuggagcagcaccuccuggaccagauccgcaucguguuccccaaggccaucuucccggugugggucgaccagcagacguacaucuucauccagaucguggcccugauccccgccgccuccuacgggcggcuggagaccgacaccaagcuccugauccagcccaagacccgccgggcgaaggagaacacguucagcaaggccgacgccgaguacaagaagcugcacuccuacggccgcgaccagaagggcaugaugaaggagcuccagaccaagcagcugcagagcaacaccguggggaucaccgaguccaacgagaacgagagcgagauccccgucgacuccagcuccguggccagccuguggacgaugaucggcuccaucuucagcuuccagagcgagaagaagcaggagaccuccugggggcucaccgagaucaacgccuucaagaacaugcagagcaagguggucccgcuggacaacaucuuccgggugugcaagucccagccgcccagcaucuacaacgcguccgccaccagcguguuccacaagcacugcgccauccacgucuuccccugggaccaggaguacuucgacguggagcccuccuucacggucaccuacggcaagcuggugaagcuccugagccccaagcagcagcaguccaagaccaagcagaacgugcugagccccgagaaggagaagcagauguccgagccccucgaccagaagaagauccgcagcgaccacaacgaggaggacgagaaggccugcguccuccaggugguguggaacggccuggaggagcugaacaacgccaucaaguacaccaagaacgucgaggugcugcaccuggggaagguguggaucccggacgaccuccggaagcgccugaacaucgagaugcacgcggucgugcggaucacgcccguggaggucacccccaagaucccccgcucccugaagcuccagccgcgggagaaccugcccaaggacaucagcgaggaggacaucaagaccguguucuacuccuggcugcagcagagcaccacgaccaugcucccccuggugaucuccgaggaggaguucaucaagcuggagaccaaggacggccucaaggaguucagccuguccaucguccacagcugggagaaggagaaggacaagaacaucuuccugcucagccccaaccugcugcagaagaccacgauccaggugcugcucgacccgauggugaaggaggagaacuccgaggagaucgacuucauccugcccuuccugaagcucagcucccucgggggcgucaacagccuggggguguccagccuggagcacaucacccacucccugcugggccgcccccucagccggcagcugaugucccugguggccggccuccgcaacggggcccugcugcucaccggcgggaagggcagcgggaaguccacccuggccaaggccaucugcaaggaggcguucgacaagcuggacgcccacgucgagcggguggacugcaaggcccuccgcggcaagcgccuggagaacauccagaagacgcuggagguggccuucagcgaggcggucuggaugcagcccuccguggugcuccuggacgaccuggaccucaucgccggccugccggccguccccgagcacgagcacagccccgacgccgugcagucccagcggcuggcccacgcgcucaacgacaugaucaaggaguucaucagcauggggucccugguggcccugaucgccaccagccagagccagcagucccuccacccgcugcuggucagcgcccagggcgugcacaucuuccagugcgugcagcacauccagccgcccaaccaggagcagcgcugcgagauccucugcaacgucaucaagaacaagcuggacugcgacaucaacaaguucaccgaccuggaccuccagcacguggccaaggagaccgggggcuucguggcgcgggacuucacgguccugguggaccgcgccauccacucccggcugagccgccaguccaucagcacccgggagaagcucgugcugaccacccuggacuuccagaaggcccuccgcggguuccugcccgccucccugcggagcgucaaccuccacaagccccgcgaccugggcugggacaagaucggcgggcugcacgaggugcggcagauccucauggacacgauccagcugcccgccaaguaccccgagcuguucgcgaaccuccccauccgccagcggaccggcauccugcuguacgggccgcccggcaccggcaagacccuccuggccggggugaucgcccgcgagucccggaugaacuucaucagcgucaagggccccgagcugcucuccaaguacaucggggccagcgagcaggcggugcgcgacaucuucauccgggcccaggccgccaagcccugcauccuguucuucgacgaguucgaguccaucgccccgcgccggggccacgacaacaccggggugacggaccgcgucgugaaccagcugcucacccagcuggacggcguggagggccugcagggggucuacgugcucgcggccaccagccgccccgaccugaucgaccccgcccugcuccggcccggccgccuggacaagugcguguacugcccgccgcccgaccaggucucccggcuggagauccucaacgugcugagcgacucccugccccucgccgacgacgucgaccugcagcacguggccagcgugaccgacuccuucacgggggcggaccugaaggcccuccuguacaacgcccagcuggaggcccuccacggcaugcugcugagcagcgggcuccaggacggcuccagcuccagcgacuccgaccugagccuguccagcauggucuuccucaaccacuccagcggcuccgacgacagcgccggggacggcgagugcgggcuggaccagucccuggugagccucgagauguccgagauccugcccgacgagagcaaguucaacauguaccgccuguacuucggcuccagcuacgaguccgagcucgggaacggcaccagcagcgaccuguccagccagugccuguccgcgcccagcuccaugacccaggaccuccccggcgugcccgggaaggaccagcuguucagccagccgcccguccugcggaccgccucccaggagggcugccaggagcugacgcaggagcagcgcgaccagcuccgggccgacaucagcaucaucaaggggcgcuaccggucccagagcggcgaggacgaguccaugaaccagcccgggccgaucaagacccgccuggccaucagccagucccaccugaugaccgcgcucggccacacccggcccagcaucuccgaggacgacuggaagaacuucgccgagcuguacgagagcuuccagaaccccaagcgccggaagaaccaguccggcacgauguuccgccccgggcagaaggugacccuggccuga

SEQ ID NO: 34460 - RNA, 918 nt, Artificial Sequence
  derived and/or modified sequence opt1 from PEX26__Homo_sapiens__NP_001121121
augaaguccgacagcagcaccuccgccgcgccccugcgcggccucgggggcccgcugcggagcuccgagcccgugcgcgccguccccgcccgggcccccgccguggaccugcucgaggaggccgcggaccugcuggugguccaccucgacuuccgcgccgcccuggagaccugcgagcgggccuggcagagccuggcgaaccacgccguggccgaggagccggccgggacgucccucgaggugaagugcagccugugcgucgugggcauccaggcccuggcggagauggaccgcuggcaggaggugcucuccuggguccugcaguacuaccaggugcccgagaagcugccgcccaaggugcucgagcugugcauccugcucuacagcaagaugcaggagcccggggccguccuggacguggugggcgccuggcugcaggaccccgccaaccagaaccuccccgaguacggcgcccuggcggaguuccacguccagcgggugcugcucccccuggggugccuguccgaggccgaggagcucguggucggcagcgccgccuucggggaggagcgccggcuggacgugcugcaggccauccacaccgcgcgccagcagcagaagcaggagcacuccggcagcgaggaggcccagaagccgaaccucgagggguccgugagccacaaguuccugucccugcccaugcucguccggcagcugugggacagcgccgugucccacuucuucagccugcccuucaagaagucccuccuggccgcccugauccucugccugcuggugguccgcuucgaccccgcgagcccgagcucccuccacuuccuguacaagcuggcccagcuguuccgguggauccgcaaggccgccuucagccggcucuaccagcugcgcauccgggacuga

SEQ ID NO: 34461 - RNA, 918 nt, Artificial Sequence
  derived and/or modified sequence opt1 from PEX2__Homo_sapiens__NP_001165558
auggccagccgcaaggagaacgccaaguccgcgaaccgggugcugcgcaucagccagcucgacgcccuggagcugaacaaggcccucgagcagcuggucuggucccaguucacccagugcuuccacggcuucaagcccgggcugcucgcccgguucgagccggaggugaaggccugccuguggguguuccuguggcgcuucaccaucuacagcaagaacgcgaccgucggccaguccgugcucaacaucaaguacaagaacgacuucagccccaaccugcgguaccagccgcccuccaagaaccagaagaucugguacgccgugugcaccaucgggggccgcuggcuggaggagcggugcuacgaccucuuccgcaaccaccaccuggccagcuucgggaaggucaagcagugcgugaacuucgugaucggccugcucaagcugggcgggcugaucaacuuccucaucuuccugcagcggggcaaguucgccacccugaccgagcgccuccuggggauccacuccgucuucugcaagccccagaacauccgggaggugggcuucgaguacaugaaccgcgagcugcucuggcacggguucgcggaguuccugaucuuccugcucccccugaucaacgugcagaagcugaaggccaagcucagcuccuggugcaucccccugacgggcgcccccaacagcgacaacacccuggccaccuccggcaaggagugcgcccucugcggggaguggccgaccaugccccacacgaucggcugcgagcacaucuucugcuacuucugcgccaagagcuccuuccuguucgacgucuacuucacgugccccaagugcgggaccgaggugcacagccugcagccccucaaguccggcaucgagaugagcgaggugaacgcgcuguga

SEQ ID NO: 34462 - RNA, 1122 nt, Artificial Sequence
  derived and/or modified sequence opt1 from PEX3__Homo_sapiens__NP_003621
augcugcgcagcguguggaacuuccucaagcggcacaagaagaagugcaucuuccugggcaccguccucgggggcguguacauccuggggaaguacggccagaagaagauccgcgagauccaggagcgggaggccgccgaguacaucgcgcaggcccgccggcaguaccacuucgaguccaaccagcggaccugcaacaugacggugcugagcaugcugcccacccuccgcgaggcccugaugcagcagcugaacuccgagagccucaccgcccugcugaagaaccgcccguccaacaagcucgagaucugggaggaccugaagaucaucagcuucacccgguccacggucgccguguacagcacgugcaugcuggugguccuccugcgcgugcagcugaacaucaucgggggcuacaucuaccucgacaacgcggccgugggcaagaacgggaccaccauccuggccccgcccgacguccagcagcaguaccuguccagcauccagcaccuccugggcgacgggcugaccgagcucaucaccgugaucaagcaggccgugcagaagguccugggcuccgugagccugaagcacucccucagccugcuggaccucgagcagaagcugaaggagauccggaaccugguggagcagcacaaguccagcuccuggaucaacaaggacgggagcaagccccuccugugccacuacaugaugcccgacgaggagacgccccuggcgguccaggccugcggccucagcccccgcgacaucaccaccaucaagcugcugaacgagacccgggacaugcucgagucccccgacuucagcaccgugcugaacacgugccugaaccgcggcuucucccggcuccuggacaacauggccgaguucuuccgcccgaccgagcaggaccugcagcacgggaacagcaugaacucccucagcuccgugagccugccccuggccaagaucauccccaucgucaacggccagauccacuccgugugcagcgagacccccucccacuucgugcaggaccuccugaccauggagcaggucaaggacuucgccgcgaacguguacgaggccuucagcaccccgcagcagcuggagaaguga

SEQ ID NO: 34463 - RNA, 1896 nt, Artificial Sequence
  derived and/or modified sequence opt1 from PEX5__Homo_sapiens__NP_000310
auggccaugcgcgagcugguggaggccgagugcggcggggcgaacccccucaugaagcuggccggccacuucacccaggacaaggcccugcggcaggaggggcuccgcccgggccccuggccgcccggggcccccgccagcgaggcggccuccaagccccugggcgucgccagcgaggacgagcugguggccgaguuccuccaggaccagaacgcgccccuggugucccgggcgccccagaccuucaagauggacgaccugcucgccgagaugcagcagaucgagcagagcaacuuccgccaggccccgcagcgggcccccggcgucgcggaccuggcccuguccgagaacugggcccaggaguuccucgccgccggggacgcgguggacgugacgcaggacuacaacgagaccgacuggagccaggaguucaucuccgaggucaccgacccccugagcgugucccccgcccgcugggccgaggaguaccuggagcagagcgaggagaagcucuggcugggcgagccggaggggaccgccacggaccggugguacgacgaguaccaccccgaggaggaccugcagcacaccgccuccgacuucguggcgaaggucgacgaccccaagcucgccaacagcgaguuccugaaguucgugcgccagaucggcgagggccaggugucccuggagagcggggccggcuccgggcgggcccaggccgagcagugggcggccgaguucauccagcagcagggcaccagcgacgccugggucgaccaguucacccgccccgugaacacguccgcccucgacauggaguucgagcgggccaagagcgccaucgagcugcaggccgagcuggaggagauggccaagcgcgacgccgaggcgcacccguggcucuccgacuacgacgaccugaccagcgccaccuacgacaagggguaccaguucgaggaggagaacccccugcgggaccacccccagcccuucgaggagggccuccgccggcugcaggagggcgaccugccgaacgccgugcuccuguucgaggccgccguccagcaggaccccaagcacauggaggcguggcaguaccuggggaccacgcaggccgagaacgagcaggagcuccuggccaucagcgcccugcgccggugccucgagcugaagcccgacaaccagaccgcccugauggcgcucgccguguccuucaccaacgagagccugcagcgccaggccugcgagacccugcgggacuggcuccgcuacacgcccgccuacgcgcaccuggugaccccggccgaggagggcgccgggggcgccgggcugggccccuccaagcggauccucggcagccugcuguccgacagccucuuccuggaggucaaggagcuguuccuggccgcggugcgccucgaccccaccuccaucgaccccgacgugcagugcgggcugggcguccuguucaaccucagcggggaguacgacaaggccguggacugcuucaccgccgcccuguccgugcgcccgaacgacuaccugcucuggaacaagcugggcgccacgcuggcgaacgggaaccagagcgaggaggccgucgccgccuaccggcgcgcccucgagcugcagcccggcuacauccggucccgcuacaaccugggcaucagcugcaucaaccucggggcgcaccgggaggccguggagcacuuccuggaggcccugaacaugcagcgcaagucccggggcccccgcggggagggcggggccaugagcgagaacaucugguccacccuccggcuggcgcugagcaugcucggccaguccgacgccuacggcgccgccgacgcccgcgaccugagcacccugcucaccauguucgggcugccgcaguga

SEQ ID NO: 34464 - RNA, 1875 nt, Artificial Sequence
  derived and/or modified sequence opt1 from PEX5L__Homo_sapiens__NP_001243679
auguaccagggccacaugcaggucgugggggugacccugaagaagaaguggcacugccuccagaaguccgaccugacccuggcccucggcaaggggagccgcgccgcggacaaggccguggccauggucaugaaggagaucccccgggaggagagcgccgaggagaagccgcugcugacgaugaccucccagcucgugaacgagcagcaggagagccgcccccugcugucccccagcaucgacgacuuccucugcgagaccaaguccgaggccaucgcgcggcccgugaccagcaacacggccguccugaccaccggccuggaccuccuggaccuguccgagccggugagccagacccagacgaaggccaagaaguccgagcccagcuccaagaccagcucccucaagaagaaggccgacgggagcgaccugaucuccaccgacgcggagcagcgcggccagccccugcgggugcccgagaccagcucccucgaccuggacauccagacgcagcuggagaagugggacgacgucaaguuccacggcgaccgcaacaccaaggggcacccgauggccgagcgcaagagcagcuccagccggaccggcuccaaggagcuccuguggagcuccgagcaccggagccagcccgagcuguccgggggcaagagcgcccucaacuccgagagcgccuccgagcuggagcugguggcccccacccaggcgcgccucacgaaggagcaccggugggggagcgcccugcugucccgcaaccacagccucgaggaggaguucgagcgggccaaggccgccguggaguccgacaccgaguucugggacaagaugcaggcggagugggaggagauggcccgccggaacuggaucagcgagaaccaggaggcccagaaccaggucaccaucuccgccagcgagaagggcuacuacuuccacaccgagaaccccuucaaggacuggccgggcgccuucgaggaggggcugaagcgccugaaggagggcgaccuccccgugacgauccuguucauggaggcggccauccugcaggaccccggggacgccgaggccuggcaguuccucggcaucacccaggccgagaacgagaacgagcaggcggccaucguggcccugcagcggugccuggagcuccagcccaacaaccugaaggcccugauggcgcucgccgucuccuacaccaacaccggccaccagcaggacgccugcgacgcccugaagaacuggaucaagcagaacccgaaguacaaguaccuggucaagagcaagaaggggagccccggccucacgcgccggauguccaagagccccguggacuccagcgugcuggagggggugaaggagcuguaccucgaggccgcgcaccagaacggcgacaugaucgaccccgaccugcagaccgggcugggcgugcuguuccaccucuccggcgaguucaaccgcgccaucgacgccuucaacgccgcccugaccguccggccggaggacuacagccuguggaaccgccucggggcgacccuggccaacggcgaccgcuccgaggaggccguggaggccuacacgcgggcccuggagauccagcccggguucauccgcagccgguacaaccucggcaucuccugcaucaaccugggggcguaccgcgaggccgugagcaacuuccugaccgcccucucccugcagcgcaagagccggaaccagcagcaggucccccaccccgccaucuccggcaacaucugggcggcccugcggaucgcccucagccugauggaccagccggagcuguuccaggccgccaaccucggcgaccuggacgugcugcuccgcgcguucaaccuggaccccuga

SEQ ID NO: 34465 - RNA, 2943 nt, Artificial Sequence
  derived and/or modified sequence opt1 from PEX6__Homo_sapiens__NP_000278
auggcccuggccgugcuccgcguccuggagcccuucccgaccgagaccccgccccuggcggugcuccugcccccgggcgggcccuggcccgccgccgagcugggccucgugcuggcccugcggcccgccggggagagcccggcgggccccgcccuccuggucgccgcccuggaggggcccgacgcgggcacggaggagcagggccccgggccgccccagcuccuggugucccgcgcccugcuccggcugcuggcccucggcagcggggccugggugcgcgcccgggcgguccgccggccgcccgcccugggcugggcccugcucgggaccucccugggccccggccuggggccccgcgugggcccccuccuggugcggcgcggggagacccugcccgucccgggcccccgggugcucgagacccgccccgcccugcagggccugcucgggcccggcacgcggcuggccgugaccgagcugcgcgggcgggcgcgccucugcccggagagcggcgacuccagccggcccccgccgccgcccgucguguccagcuucgccguguccgggaccguccgccggcugcagggcgugcugggcgggaccggcgacagccucggggugucccgcagcugccugcggggccugggccucuuccagggcgagugggucuggguggcccaggcccgcgaguccagcaacacgucccagccccaccuggcccgcgugcagguccuggagccccggugggaccucagcgaccgccugggccccggguccggcccccugggggagccccucgcggacggccuggcccuggugcccgccacccucgccuucaaccuggggugcgacccccuggagaugggcgagcugcggauccagcgcuaccucgagggcagcaucgcccccgaggacaagggguccugcagccugcugcccggcccgcccuucgcgcgggagcuccacaucgagaucgugagcagcccccacuacuccaccaacgggaacuacgacgggguccuguaccgccacuuccagaucccccgggugguccaggagggcgacgugcugugcgugcccaccaucgggcaggucgagauccucgagggcucccccgagaagcugccccgcuggcgggagauguucuucaaggugaagaagacggugggggaggcccccgacggcccggccagcgccuaccuggcggacaccacccacaccucccucuacauggucgggagcacgcugucccccgugcccuggcugcccagcgaggaguccacccucuggagcucccugagcccgcccggccuggaggcccucguguccgagcugugcgccguccugaagccccgccuccagcccggcggggcccugcugaccggcaccagcuccgugcuccugcgggggccgcccggcugcgggaagacgaccguggucgccgcggccugcagccaccugggccuccaccuccugaaggugcccugcuccagccugugcgccgaguccagcggcgccguggagaccaagcugcaggccaucuucagccgcgcgcggcgcugccggccggccguccugcuccugaccgccguggaccugcucgggcgcgaccgggacggccugggggaggacgcccgcgugauggccguccugcggcaccuccugcugaacgaggacccccucaacuccugcccgccccugauggugguggcgacgaccagccgcgcccaggaccugcccgccgacguccagaccgccuucccccacgagcucgaggugcccgcgcuguccgagggccagcgccugagcauccuccgggcccugaccgcccaccucccccuggggcaggaggugaaccuggcccagcuggcccgccggugcgcgggcuucgucgugggcgaccucuacgcccugcugacgcacuccagccgcgccgccugcacccggaucaagaacuccgggcucgccggcgggcugaccgaggaggacgagggcgagcugugcgcggccggguucccgcuccuggccgaggacuucggccaggcccuggagcagcuccagaccgcccacagccaggcggugggcgcccccaagauccccuccgucagcuggcacgacgucgggggccugcaggaggugaagaaggagauccuggagacgauccagcucccccuggagcacccggagcugcucucccuggggcugcgccggagcggccuccugcugcacggcccgcccgggaccggcaagacccuccuggccaaggccguggcgaccgagugcucccugacguuccucagcgugaaggggcccgagcugaucaacauguacgugggccaguccgaggagaacguccgcgagguguucgcccgggcccgcgccgccgcgcccugcaucaucuucuucgacgagcuggacagccucgcccccucccgggggcgcagcggcgacagcggcggggugauggaccgggucgugucccagcugcuggccgagcucgacggccugcacagcacccaggacguguucgucaucggggccaccaaccgccccgaccugcucgaccccgcccugcugcggccgggccgcuucgacaagcucguguucgugggggcgaacgaggaccgggccucccagcugcgcguccugagcgccaucacccggaaguucaagcucgagcccuccgugagccuggugaacguccuggacugcugcccgccccagcucaccggcgccgaccuguacucccugugcagcgacgccaugacggcggcccugaagcgccgggugcacgaccucgaggagggccuggagcccggguccagcgcccugaugcucaccauggaggaccugcugcaggccgccgcgcgccuccagcccuccgugagcgagcaggagcugcugcgcuacaagcggauccagcgcaaguucgccgccugcuga

SEQ ID NO: 34466 - RNA, 972 nt, Artificial Sequence
  derived and/or modified sequence opt1 from PEX7__Homo_sapiens__NP_000279
augagcgccgugugcggcggggccgcgcgcaugcugcggacccccggccgccacggguacgccgccgaguucuccccguaccuccccggccggcuggccugcgccaccgcgcagcacuacgggaucgccggcugcggcacccugcucauccuggaccccgacgaggccgggcugcgccucuuccggagcuucgacuggaacgacggccuguucgacgucaccugguccgagaacaacgagcacgugcugaucacgugcagcggggacggcucccuccagcugugggacaccgccaaggcggccgggccccuccagguguacaaggagcacgcccaggaggucuacagcguggacuggucccagacgcgcggcgagcagcugguggucagcggcuccugggaccagaccgugaagcugugggacccgaccguggggaagucccugugcaccuuccggggccacgaguccaucaucuacagcacgaucuggagcccccacauccccgggugcuucgccagcgccuccggcgaccagacccuccgcaucugggacgucaaggcggccggcgugcggaucgugauccccgcccaccaggccgagauccugagcugcgacuggugcaaguacaacgagaaccugcucgucaccggggccguggacugcucccugcgcggcugggaccugcggaacgugcgccagccggucuucgagcuccuggggcacaccuacgcgauccggcgcgugaaguucagccccuuccacgccuccgugcuggccagcugcagcuacgacuucacgguccgguucuggaacuucuccaagcccgacagccuccuggagaccguggagcaccacaccgaguucacgugcggccuggacuucucccuccagagccccacccagguggccgacugcuccugggacgagaccaucaagaucuacgacccggccugccugaccauccccgcguga

SEQ ID NO: 34467 - RNA, 306 nt, Artificial Sequence
  derived and/or modified sequence opt1 from PF4__Homo_sapiens__NP_002610
augagcuccgccgccggcuucugcgcgagccgccccgggcuccuguuccugggccugcuccugcugccgcucguggucgccuucgccuccgccgaggccgaggaggacggggaccugcagugccugugcgugaagaccaccagccaggugcggccccgccacaucacgucccucgaggucaucaaggcgggcccccacugccccaccgcccagcugaucgccacccugaagaacgggcggaagaucugccucgaccugcaggccccgcuguacaagaagaucaucaagaagcuccuggagagcuga

SEQ ID NO: 34468 - RNA, 315 nt, Artificial Sequence
  derived and/or modified sequence opt1 from PF4V1__Homo_sapiens__NP_002611
augagcuccgccgcccgcagccggcugacccgcgcgacccggcaggagaugcuguuccucgcccugcuccugcugcccguggucguggccuucgcccgcgccgaggcggaggaggacggcgaccuccagugccugugcgugaagacgaccucccagguccggccgcgccacaucaccagccuggaggugaucaaggccgggccccacugccccaccgcccagcucaucgccacgcugaagaacggccggaagaucugccuggaccuccaggcgcugcuguacaagaagaucaucaaggagcaccucgaguccuga

SEQ ID NO: 34469 - RNA, 405 nt, Artificial Sequence
  derived and/or modified sequence opt1 from PFDN4__Homo_sapiens__NP_002614
auggccgccaccaugaagaaggcggccgccgaggacgugaacgucaccuucgaggaccagcagaagaucaacaaguucgcccgcaacacgagccggaucaccgagcugaaggaggagaucgaggugaagaagaagcagcuccagaaccuggaggacgccugcgacgacaucaugcuggcggacgacgacugccucaugauccccuaccagaucggcgacguguucaucucccacagccaggaggagacccaggagaugcuggaggaggccaagaagaaccugcaggaggagaucgacgcccucgagucccgcgucgagagcauccagcgggugcuggccgaccugaaggugcagcucuacgcgaaguucggguccaacaucaaccuggaggccgacgagagcuga

SEQ ID NO: 34470 - RNA, 465 nt, Artificial Sequence
  derived and/or modified sequence opt1 from PFDN5__Homo_sapiens__NP_002615
auggcccagagcaucaacaucaccgagcugaaccucccccagcuggagaugcugaagaaccagcucgaccaggagguggaguuccuguccaccagcaucgcccagcugaaggucgugcagacgaaguacguggaggcgaaggacugccucaacguccugaacaaguccaacgagggcaaggagcugcucgugccgcugaccagcuccauguacgugcccgggaagcugcacgacgucgagcacgugcucaucgacgugggcaccggguacuacgucgagaagaccgccgaggacgccaaggacuucuucaagcgcaagaucgacuuccugacgaagcagauggagaagauccagcccgcccugcaggagaagcacgccaugaagcaggcggugauggagaugaugagccagaagauccagcagcucaccgcccugggcgccgcccaggcgaccgccaaggccuga

SEQ ID NO: 34471 - RNA, 390 nt, Artificial Sequence
  derived and/or modified sequence opt1 from PFDN6__Homo_sapiens__NP_001252525
auggccgagcugauccagaagaagcuccagggcgagguggagaaguaccagcagcugcagaaggaccugagcaaguccaugagcgggcgccagaagcucgaggcccagcugaccgagaacaacaucgucaaggaggagcuggcgcuccuggacggcuccaacgugguguucaagcugcucgggcccguccuggugaagcaggagcugggcgaggcccgggccaccguggggaagcgccucgacuacaucacggccgagaucaagcgguacgagagccagcugcgcgaccuggagcggcaguccgagcagcagcgcgagacccucgcccagcugcagcaggaguuccagcgggcgcaggccgccaaggccggcgcgccgggcaaggccuga

SEQ ID NO: 34472 - RNA, 1350 nt, Artificial Sequence
  derived and/or modified sequence opt1 from PFKFB1__Homo_sapiens__NP_001258733
augagccccgagaugggcgagcugacccagacccgccuccagaagaucuggaucccgcacuccagcggguccagccggcugcagcgccggcgcggcuccagcaucccccaguucacgaacucccccaccauggugaucauggucgggcugcccgcccggggcaagaccuacaucagcaccaagcucacgcgcuaccugaacuggaucgggaccccgaccaaggacaacauggaggcccugcagauccggaagcagugcgcgcucgccgcccugaaggacgugcacaacuaccugucccacgaggagggccacguggccgucuucgacgccaccaacacgacccgcgagcggcgcagccucauccugcaguucgcgaaggagcacggcuacaagguguucuucaucgaguccaucugcaacgaccccgggaucaucgccgagaacauccgccaggugaagcugggcagccccgacuacaucgacugcgaccgggagaagguccucgaggacuuccugaagcggaucgagugcuacgaggugaacuaccagccccuggacgaggagcucgacucccaccugagcuacaucaagaucuucgacguggggacccgcuacauggucaaccgggugcaggaccacauccagucccgcaccguguacuaccugaugaacauccacgucacgccgcggagcaucuaccucugccgccacggcgaguccgagcugaacauccgggggcgcaucggcggcgacagcgggcuguccgugcggggcaagcaguacgccuacgcccucgcgaacuucauccagagccaggggaucagcucccugaagguguggaccagccacaugaagcgcaccauccagaccgccgaggcccugggcguccccuacgagcaguggaaggcccucaacgagaucgacgccggcgugugcgaggagaugacguacgaggagauccaggagcacuaccccgaggaguucgcgcugcgcgaccaggacaaguaccgguaccgcuaccccaagggggaguccuacgaggaccuggugcagcggcucgagccggucaucauggagcuggagcgccaggagaacgugcuggugaucugccaccaggccgucaugcggugccuccuggccuacuuccuggacaagagcuccgacgagcuccccuaccugaagugcccccugcacaccgugcucaagcugacccccguggccuacggcugcaaggucgagagcaucuaccugaacguggaggccgucaacacccaccgcgagaagccggagaacguggacaucacgcgggagcccgaggaggcgcucgacaccgugcccgcccacuacuga

SEQ ID NO: 34473 - RNA, 1416 nt, Artificial Sequence
  derived and/or modified sequence opt1 from PFKFB2__Homo_sapiens__NP_001018063
augagcggcgccuccagcuccgagcagaacaacaacagcuacgagaccaagacccccaaccugcgcauguccgagaagaagugcagcugggccuccuacaugacgaacagcccgacccucaucgugaugaucgggcugcccgcgcggggcaagaccuacgucuccaagaagcugacccgcuaccucaacuggaucggggugcccacgaagguguucaaccugggcgucuaccggcgcgaggccgucaagagcuacaaguccuacgacuucuuccggcacgacaacgaggaggccaugaagauccgcaagcagugcgcccugguggcccucgaggacgugaaggcguaccugaccgaggagaacgggcagaucgccguguucgacgccaccaacaccacgcgggagcgccgggacaugauccugaacuucgccgagcagaacagcuucaagguguucuucgucgaguccgugugcgacgaccccgacgugaucgcggccaacauccucgaggucaaggugagcuccccggacuaccccgagcgcaaccgggagaacgugauggaggacuuccugaagcgcaucgagugcuacaaggucaccuaccggccccuggaccccgacaacuacgacaaggaccucagcuucaucaaggugaucaacgugggccagcgcuuccuggucaaccgggugcaggacuacauccaguccaagaucguguacuaccugaugaacauccacguccagccgcgcaccaucuaccucugccggcacggcgagagcgaguucaaccugcuggggaagaucggcggggacuccggccucagcgugcgcgggaagcaguucgcccaggcccugcggaaguuccuggaggagcaggagaucaccgaccucaagguguggacgagccagcugaagcgcaccauccagaccgccgagucccugggcguccccuacgagcaguggaagauccucaacgagaucgacgcgggcgugugcgaggagaugaccuacgccgagaucgagaagcgguaccccgaggaguucgcccugcgcgaccaggagaaguaccuguaccgcuaccccgggggcgagagcuaccaggaccucguccagcggcuggagccggugaucauggagcuggagcgccaggggaacgugcucgucaucucccaccaggccgugaugcggugccugcuggccuacuuccucgacaagggcgcggacgagcugcccuaccugcgcugcccccuccacacgaucuucaagcugacccccguggccuacggcugcaaggucgagaccaucaagcugaacguggaggccgugaacacccaccgggacaagccgacggccgccgagaccacccucgcgguccgccggcgccccagcgccgccucccugaugcugcccugcuga

SEQ ID NO: 34474 - RNA, 1503 nt, Artificial Sequence
  derived and/or modified sequence opt1 from PFKFB3__Homo_sapiens__NP_001138915
augcccuuccgcaaggccugcggcccgaagcugaccaacagccccaccgugaucgucaugguggggcuccccgcccggggcaagacguacaucuccaagaagcugacccgcuaccugaacuggaucggggugcccaccaaggucuucaacgugggcgaguaccggcgcgaggcggugaagcaguacagcuccuacaacuucuuccggccggacaacgaggaggccaugaagguccgcaagcagugcgcccucgccgcccugcgggacgucaagagcuaccuggcgaaggagggcgggcagaucgccguguucgacgccaccaacacgacccgcgagcggcgccacaugauccuccacuucgccaaggagaacgacuucaaggcguucuucaucgaguccgugugcgacgaccccaccgugguggccagcaacaucauggaggucaagaucuccagccccgacuacaaggacugcaacuccgccgaggccauggacgacuucaugaagcggaucagcugcuacgaggccuccuaccagccccuggacccggacaagugcgaccgcgaccugagccucaucaaggugaucgacgugggccggcgcuuccuggucaaccgggugcaggaccacauccagucccgcaucguguacuaccugaugaacauccacguccagccccggaccaucuaccucugccgccacggggagaacgagcacaaccugcagggccggaucgggggcgacagcgggcuguccagccgcggcaagaaguucgcguccgcccucagcaaguucguggaggagcagaaccugaaggaccugcggguguggacgucccagcucaagagcaccauccagaccgccgaggcccugcgccugcccuacgagcaguggaaggcccucaacgagaucgacgcgggcgucugcgaggagcugaccuacgaggagauccgcgacacguaccccgaggaguacgcccugcgggagcaggacaaguacuacuaccgcuacccgaccggggagagcuaccaggaccucgugcagcggcuggagcccgugaucauggagcuggagcgccaggagaacguccucgugaucugccaccaggccguccugcggugccugcucgccuacuuccuggacaaguccgccgaggagaugcccuaccugaagugcccccuccacaccgugcugaagcugaccccgguggcguacggcugccgcgucgagagcaucuaccucaacguggaguccgugugcacgcaccgggagcgcagcgaggacgccaagaaggggcccaacccccugaugcggcgcaacuccgucacgccccuggccagcccggagcccaccaagaagccccggaucaacuccuucgaggagcacguggccagcaccuccgccgcgcuccccagcugccugccgcccgaggugcccacccagcugcccggccagaacaugaagggcucccgcagcuccgccgacagcucccggaagcacuga

SEQ ID NO: 34475 - RNA, 1410 nt, Artificial Sequence
  derived and/or modified sequence opt1 from PFKFB4__Homo_sapiens__NP_004558
auggccagcccccgcgagcugacccagaacccgcucaagaagaucuggaugcccuacuccaacggccggcccgcccugcacgcgugccagcgcggggugugcaugaccaacugccccacgcugaucgucauggugggccucccggcccgggggaagaccuacaucagcaagaagcugacccgcuaccugaacuggaucggcgugcccacccgggaguucaacgucgggcaguaccgccgggacguggugaagacguacaaguccuucgaguucuuccuccccgacaacgaggagggccugaagauccgcaagcagugcgcccuggccgcccuccgggacguccgccgguuccugagcgaggagggcgggcacguggcgguguucgacgccaccaacaccacccgcgagcggcgcgccacgaucuucaacuucggcgagcagaacggguacaagaccuucuucgucgaguccaucugcguggaccccgaggugaucgccgcgaacaucguccaggugaagcugggcagcccggacuacgugaaccgggacuccgacgaggccaccgaggacuucaugcgccggaucgagugcuacgagaacagcuacgagucccucgacgaggaccuggaccgcgaccugagcuacaucaagaucauggacgucgggcaguccuacguggugaaccgggucgccgaccacauccagagccgcaucguguacuaccucaugaacauccacgugacgccccgguccaucuaccugugccgccacggcgagagcgagcugaaccucaagggccgcaucgggggcgaccccgggcugagcccccggggccgcgaguucgccaagucccuggcccaguucaucuccgaccagaacaucaaggaccucaaggucuggaccagccagaugaagcggaccauccagaccgcggaggcccugggcgugccguacgagcaguggaaggugcugaacgagaucgacgccggggucugcgaggagaugaccuacgaggagauccaggacaacuacccccucgaguucgcccugcgcgaccaggacaaguaccgguaccgcuaccccaagggcgaguccuacgaggaccuggugcagcggcucgagcccgucaucauggagcuggagcgccaggagaacgugcuggugaucugccaccaggccgucaugcggugccuccuggcguacuuccuggacaaggccgccgagcagcucccguaccugaagugcccccugcacacggugcucaagcugacccccguggccuacgggugcaaggucgagagcaucuuccugaacguggccgcggugaacacccaccgcgaccggccccagaacgucgacaucagccgcccgcccgaggaggcccucgugaccgugcccgcccaccaguga

SEQ ID NO: 34476 - RNA, 2343 nt, Artificial Sequence
  derived and/or modified sequence opt1 from PFKL__Homo_sapiens__NP_002617
auggccgccguggaccuggagaagcuccgcgcgagcggcgccgggaaggccaucggcguccugaccuccgggggcgacgcccaggggaugaacgccgcggugcgggccgugacccgcaugggcaucuacgucggcgccaagguguuccugaucuacgagggguacgagggccucguggagggcggggagaacaucaagcaggccaacuggcugagcgucuccaacaucauccagcucgggggcacgaucaucggcagcgcgcggugcaaggccuucaccacccgcgaggggcggcgcgccgccgccuacaaccuggugcagcacggcaucaccaaccugugcgugaucgggggcgacggcucccugacgggggcgaacaucuuccggagcgaguggggcucccuccuggaggagcuggucgccgaggggaagaucagcgagaccaccgcccgcaccuacucccaccucaacaucgccggccugguggggagcaucgacaacgacuucugcggcacggacaugaccaucggcaccgacuccgcccugcaccggaucauggaggugaucgacgcgaucaccacgaccgcccagagccaccagcgcaccuucguccucgaggugauggggcggcacugcggcuaccuggcccugguguccgcccucgccagcggggcggacuggcuguucauccccgaggccccgcccgaggacggcugggagaacuucaugugcgagcgccugggggagacccggucccgcggcagccggcucaacaucaucaucaucgccgagggcgccaucgaccgcaacgggaagcccaucuccagcuccuacgucaaggaccugguggugcagcggcugggcuucgacacgcgcgucaccgugcucgggcacgugcagcggggcgggacccccagcgccuucgaccgcauccugagcuccaagaugggcauggaggcggucauggcccugcucgaggccaccccggacacgcccgccugcguggugacccugagcggcaaccaguccguccggcugccccucauggagugcgugcagaugaccaaggagguccagaaggcgauggacgacaagcgcuucgacgaggccacccagcugcgcgggggcagcuucgagaacaacuggaacaucuacaagcugcucgcccaccagaagcccccgaaggagaaguccaacuucagccuggccauccugaacgugggggcccccgcggccggcaugaacgccgccgugcgguccgccguccgcacgggcaucagccacgggcacaccguguacgugguccacgacggcuucgaggggcucgcgaagggccaggugcaggaggugggguggcacgacgucgccggcuggcugggccgcgggggcuccaugcuggggaccaagcggacccuccccaagggccagcuggagagcaucguggagaacauccggaucuacgggauccacgcccugcucguggucggcggcuucgaggccuacgagggggugcugcagcugguggaggcccgcggccgguacgaggagcucugcaucgucaugugcgugauccccgcgacgaucuccaacaacgugccggggaccgacuucagccugggcuccgacaccgccgucaacgccgccauggagagcugcgaccgcaucaagcaguccgcgagcgggaccaagcggcgcguguucaucguggagacgaugggcggcuacugcggguaccuggccaccgucaccggcaucgccgugggggccgacgccgcguacguguucgaggaccccuucaacauccacgaccucaaggucaacguggagcacaugaccgagaagaugaagacggacauccagcggggccuggugcugcgcaacgagaagugccacgacuacuacaccaccgaguuccuguacaaccucuacuccagcgaggggaagggcgucuucgacugccggaccaacgugcugggccaccuccagcagggcggggcccccacccccuucgaccgcaacuacgggacgaagcugggcgugaaggccaugcuguggcuguccgagaagcuccgggaggucuaccgcaagggccggguguucgccaacgccccggacagcgcgugcgugaucgggcugaagaagaaggccgucgccuucagccccgugaccgagcugaagaaggacaccgacuucgagcaccgcaugccccgggagcagugguggcucucccugcgccugaugcucaagaugcuggcccaguaccgcaucagcauggccgcguacguguccggcgagcuggagcacgucacccggcgcacgcucagcauggacaagggguucuga

SEQ ID NO: 34477 - RNA, 2556 nt, Artificial Sequence
  derived and/or modified sequence opt1 from PFKM__Homo_sapiens__NP_001160158
augcacaaggacgaguuccaccugaaguucuucaugugcgugauccagagccgccagcucguccggacgccccagcgcaccgccggcgaggccuccaccagcuccaugcugaucccgaagcccccgcccaagaccgacauccucaagagccuggacaccauggacgaccccgacaccgugggguccauccccguguucaagacggaguggaucaugacccacgaggagcaccacgcggccaagacccugggcaucgggaaggccaucgccguccugaccagcggcggggacgcccagggcaugaacgcggccgugcgggccgugguccgcgugggcaucuucacgggggcccggguguucuucguccacgagggcuaccaggggcucguggacggcggggaccacaucaaggaggcgaccugggaguccgugagcaugaugcugcagcugggcggcaccgucaucggguccgcccgcugcaaggacuuccgggagcgcgagggccggcuccgcgccgccuacaaccuggugaagcgggggaucaccaaccugugcgugaucggcggcgacgggagccucacgggcgccgacaccuuccgcuccgaguggagcgaccugcuguccgaccuccagaaggcggggaagaucaccgacgaggaggccaccaagagcuccuaccugaacaucgucggccugguggggagcaucgacaacgacuucugcggcacggacaugaccaucggcaccgacuccgcccuccaccggaucauggagaucguggacgccaucaccacgaccgcccagagccaccagcgcaccuucguccuggaggugauggggcggcacugcggcuaccuggcgcucgugaccucccugagcugcggggccgacugggucuucauccccgagugcccgcccgacgacgacugggaggagcaccugugccgccggcucagcgagacgcgcacccggggcucccgccugaacaucaucaucguggccgagggggccaucgacaagaacggcaagcccaucaccagcgaggacaucaagaaccugguggucaagcggcucggcuacgacacccgcgugacgguccuggggcacgugcagcgcggcgggacccccuccgccuucgaccggauccugggcagccgcauggggguggaggcggucauggcccuccuggagggcacccccgacaccccggccugcguggugucccugagcggcaaccaggccguccggcucccccugauggagugcguccaggugacgaaggacgugaccaaggccauggacgagaagaaguucgacgaggcgcugaagcuccgcgggcgguccuucaugaacaacugggagguguacaagcugcuggcccacgugcgcccgcccgucagcaaguccggcagccacaccguggccgugaugaacgucggggcccccgcggccggcaugaacgccgccgugcgguccaccgugcgcaucggccucauccaggggaaccggguccugguggugcacgacggcuucgaggggcuggccaagggccagaucgaggaggcgggguggagcuacgucggcggcuggacggggcagggcggguccaagcucggcaccaagcgcacccugcccaagaaguccuucgagcagaucagcgccaacaucaccaaguucaacauccaggggcuggugaucaucggcggcuucgaggccuacaccgggggccucgagcugauggaggggcggaagcaguucgacgagcugugcauccccuucguggucauccccgccacggugagcaacaacgugccgggcuccgacuucagcgucggggccgacaccgcgcucaacaccaucugcaccacgugcgaccgcaucaagcaguccgccgccggcaccaagcggcgcguguucaucaucgagaccaugggcggguacugcggcuaccuggccaccauggccgggcuggcggccggcgccgacgccgcguacaucuucgaggagcccuucacgauccgggaccugcaggccaacguggagcaccucguccagaagaugaagaccaccgugaagcgcgggcuggugcugcggaacgagaagugcaacgagaacuacaccacggacuucaucuucaaccucuacagcgaggagggcaagggcaucuucgacagccgcaagaacguccuggggcacaugcagcagggcgggucccccacccccuucgaccggaacuucgccaccaagaugggcgccaaggccaugaacuggaugagcggcaagaucaaggaguccuaccgcaacgggcgcaucuucgcgaacaccccggacagcggcugcgugcuggggaugcggaagcgcgcccucguguuccagcccgucgccgagcugaaggaccagacggacuucgagcaccggauccccaaggagcagugguggcugaagcuccgccccauccugaagauccuggccaaguacgagaucgaccucgacaccuccgaccacgcccaccuggagcacaucacccggaagcgcagcggcgaggcggccguguga

SEQ ID NO: 34478 - RNA, 2331 nt, Artificial Sequence
  derived and/or modified sequence opt1 from PFKP__Homo_sapiens__NP_001229268
augugcggcuacgagcgcugccggcccugccgcggggcccacggcuaccugcgcgggggccagggggugcuccaccuccggggccugccgggccacgggggccggcgccugaagcaccggcgcgggcggcugggcgagugccugcagcaccccgccagcggggcgguccgcggcgacuggcgggagaagcccggcugcuggucccaccgcuuccccugcccggggcggcacgcccucgugggcgggaccaucaucggcagcgcccgcugccaggccuuccggacccgcgagggccggcugaaggccgcgugcaaccugcuccagcgcgggaucacgaaccugugcgugaucggcggggacggcucccugaccggggccaaccucuuccggaaggaguggagcggccugcuggaggagcucgcccgcaacggccagaucgacaaggaggccguccagaaguacgcguaccugaacgugguggggauggucggcuccaucgacaacgacuucugcgggaccgacaugaccaucggcacggacagcgcccugcaccggaucaucgaggugguggacgccaucaugaccaccgcccagucccaccagcgcaccuucguccucgaggugauggggcgccacugcggcuaccuggcccuggugagcgcgcucgccugcggcgccgacugggucuuccugcccgaguccccgcccgaggaggggugggaggagcagaugugcgugaagcugagcgagaaccgggcccgcaagaagcggcucaacaucaucaucguggccgagggcgcgaucgacacgcagaacaagcccaucaccuccgagaagaucaaggagcuggucgugacccagcugggguacgacacccgcgugacgauccucggccacguccagcgcgggggcacccccagcgccuucgaccggauccuggccucccggaugggcguggaggccgugaucgcccugcucgaggcgacccccgacacccccgccugcgucgugagccugaacgggaaccacgccgugcgccugccgcucauggagugcguccagaugacgcaggacgugcagaaggccauggacgagcggcgcuuccaggacgccguccggcugcgcggccgguccuucgcggggaaccugaacaccuacaagcgccucgccaucaagcugcccgacgaccagauccccaagaccaacugcaacguggccgugaucaacgucggcgcccccgcggccggcaugaacgccgccgugcggagcgccgugcgcgucgggaucgcggacggccaccggaugcuggccaucuacgacggguucgacggcuucgccaaggggcagaucaaggagaucggcuggaccgacgugggcggguggacgggccagggcggguccauccucgggaccaagcgcgugcugccgggcaaguaccuggaggagaucgccacccagaugcggacccacagcaucaacgcccuccugaucaucggcggguucgaggcguaccugggccuccuggagcuguccgccgcccgcgagaagcacgaggaguucugcguccccauggugauggugcccgccacggucagcaacaacgugcccgggagcgacuucuccaucggcgccgacaccgcgcucaacaccaucaccgacacgugcgaccgcaucaagcagagcgccuccgggaccaagcggcgcguguucaucaucgagaccaugggcggcuacugcggguaccuggccaacaugggcgggcuggccgcgggcgccgacgccgccuacaucuucgaggagccguucgacauccgggaccugcagagcaacgucgagcaccucaccgagaagaugaagacgaccauccagcgcgggcuggugcugcggaacgaguccugcagcgagaacuacaccaccgacuucaucuaccagcucuacuccgaggagggcaagggcguguucgacugccgcaagaacguccuggggcacaugcagcagggcggggcccccagccccuucgaccggaacuucggcacgaagaucuccgcgcgcgccauggaguggaucaccgccaagcugaaggaggcccggggccgcgggaagaaguucaccaccgacgacagcaucugcgugcucggcaucuccaagcggaacgugaucuuccagcccgucgccgagcugaagaagcagaccgacuucgagcaccgcaucccgaaggagcagugguggcugaagcuccggccccugaugaagauccuggcgaaguacaaggccagcuacgacguguccgacagcgggcagcucgagcacgugcagcccugguccgucuga

SEQ ID NO: 34479 - RNA, 423 nt, Artificial Sequence
  derived and/or modified sequence opt1 from PFN1__Homo_sapiens__NP_005013
auggccggcuggaacgccuacaucgacaaccugauggcggacgggaccugccaggacgccgccaucgugggcuacaaggacagccccuccgucugggccgccgugccggggaagaccuucgugaacaucacgcccgcggaggucggcgugcugguggggaaggaccgcagcuccuucuacgucaacggccugacccugggcgggcagaagugcagcgugauccgggacucccuccugcaggacggcgaguucagcauggaccugcgcaccaaguccaccgggggcgcccccacguucaacgugaccgucaccaagaccgacaagacgcucgugcugcugauggggaaggagggcgugcacggcgggcucaucaacaagaagugcuacgagauggccagccaccuccggcgcucccaguacuga

SEQ ID NO: 34480 - RNA, 423 nt, Artificial Sequence
  derived and/or modified sequence opt1 from PFN2__Homo_sapiens__NP_002619
auggccggcuggcagagcuacguggacaaccugaugugcgacgggugcugccaggaggccgcgaucgucggcuacugcgacgccaaguacgugugggccgccaccgccgggggcguguuccaguccaucacccccaucgagaucgacaugaucgucgggaaggaccgcgagggcuucuucacgaacggccucacccugggggcgaagaagugcagcgugauccgggacucccuguacguggacggcgacugcaccauggacauccgcaccaagagccagggcggggagccgacguacaacgucgccguggggcgggccggccgcgcccucgugaucgucaugggcaaggagggggugcacggcgggacccugaacaagaaggcguacgagcuggcccucuaccugcggcgcuccgacguguga

SEQ ID NO: 34481 - RNA, 1167 nt, Artificial Sequence
  derived and/or modified sequence opt1 from PGA3__Homo_sapiens__NP_001073275
augaaguggcugcuccugcugggccucguggcccugagcgagugcaucauguacaaggucccccugauccgcaagaagucccuccggcgcacccugagcgagcgggggcugcucaaggacuuccugaagaagcacaaccugaacccggcccgcaaguacuucccccaguggaaggcgcccacccucguggacgagcagccccuggagaacuaccuggacauggaguacuucggcacgaucgggaucggcaccccggcccaggacuucaccguggucuucgacaccggguccagcaaccucugggugcccuccguguacugcagcucccuggccugcacgaaccacaaccgguucaaccccgaggacagcuccaccuaccagagcaccuccgagaccgucagcaucacguacggcaccggcuccaugaccgggauccugggcuacgacaccgugcaggucgggggcaucagcgacacgaaccagaucuucgggcucuccgagaccgagcccggcagcuuccuguacuacgccccguucgacggcauccuggggcucgccuaccccuccaucagcuccagcggcgcgacccccguguucgacaacaucuggaaccaggggcuggugagccaggaccuguucuccguguaccucagcgccgacgaccaguccggcagcgucgugaucuucggcgggaucgacuccagcuacuacaccggcucccugaacugggugcccgucacgguggagggguacuggcagaucaccguggacagcaucaccaugaacggcgaggccaucgccugcgcggaggggugccaggccaucgucgacaccggcacgucccugcucaccggcccgaccagccccaucgccaacauccaguccgacaucggggccagcgagaacuccgacggcgacaugguggugagcugcuccgccaucagcucccugcccgacaucgucuucaccaucaacggggugcaguaccccgugccgcccagcgcguacauccugcaguccgagggcagcugcaucagcggguuccagggcaugaaccuccccacggaguccggcgagcuguggauccugggggacgucuucauccgccaguacuucaccguguucgaccgggccaacaaccaggucggccucgcccccguggccuga

SEQ ID NO: 34482 - RNA, 1167 nt, Artificial Sequence
  derived and/or modified sequence opt1 from PGA4__Homo_sapiens__NP_001073276
augaaguggcugcuccugcugggccucguggcccugagcgagugcaucauguacaaggucccccugauccgcaagaagucccuccggcgcacccugagcgagcgggggcugcucaaggacuuccugaagaagcacaaccugaacccggcccgcaaguacuucccccagugggaggcgcccacccucguggacgagcagccccuggagaacuaccuggacauggaguacuucggcacgaucgggaucggcaccccggcccaggacuucaccguggucuucgacaccggguccagcaaccucugggugcccuccguguacugcagcucccuggccugcacgaaccacaaccgguucaaccccgaggacagcuccaccuaccagagcaccuccgagaccgucagcaucacguacggcaccggcuccaugaccgggauccugggcuacgacaccgugcaggucgggggcaucagcgacacgaaccagaucuucgggcucuccgagaccgagcccggcagcuuccuguacuacgccccguucgacggcauccuggggcucgccuaccccuccaucagcuccagcggcgcgacccccguguucgacaacaucuggaaccaggggcuggugagccaggaccuguucuccguguaccucagcgccgacgaccaguccggcagcgucgugaucuucggcgggaucgacuccagcuacuacaccggcucccugaacugggugcccgucacgguggagggguacuggcagaucaccguggacagcaucaccaugaacggcgaggccaucgccugcgcggaggggugccaggccaucgucgacaccggcacgucccugcucaccggcccgaccagccccaucgccaacauccaguccgacaucggggccagcgagaacuccgacggcgacaugguggugagcugcuccgccaucagcucccugcccgacaucgucuucaccaucaacggggugcaguaccccgugccgcccagcgcguacauccugcaguccgagggcagcugcaucagcggguuccagggcaugaaccuccccacggaguccggcgagcuguggauccugggggacgucuucauccgccaguacuucaccguguucgaccgggccaacaaccaggucggccucgcccccguggccuga

SEQ ID NO: 34483 - RNA, 1167 nt, Artificial Sequence
  derived and/or modified sequence opt1 from PGA5__Homo_sapiens__NP_055039
augaaguggcugcuccugcugggccucguggcccugagcgagugcaucauguacaaggucccccugauccgcaagaagucccuccggcgcacccugagcgagcgggggcugcucaaggacuuccugaagaagcacaaccugaacccggcccgcaaguacuucccccagugggaggcgcccacccucguggacgagcagccccuggagaacuaccuggacauggaguacuucggcacgaucgggaucggcaccccggcccaggacuucaccguggucuucgacaccggguccagcaaccucugggugcccuccguguacugcagcucccuggccugcacgaaccacaaccgguucaaccccgaggacagcuccaccuaccagagcaccuccgagaccgucagcaucacguacggcaccggcuccaugaccgggauccugggcuacgacaccgugcaggucgggggcaucagcgacacgaaccagaucuucgggcucuccgagaccgagcccggcagcuuccuguacuacgccccguucgacggcauccuggggcucgccuaccccuccaucagcuccagcggcgcgacccccguguucgacaacaucuggaaccaggggcuggugagccaggaccuguucuccguguaccucagcgccgacgacaaguccggcagcgucgugaucuucggcgggaucgacuccagcuacuacaccggcucccugaacugggugcccgucacgguggagggguacuggcagaucaccguggacagcaucaccaugaacggcgagaccaucgccugcgccgaggggugccaggcgaucgucgacacgggcaccucccugcucaccggcccgaccagccccaucgccaacauccaguccgacaucggggccagcgagaacuccgacggcgacaugguggugagcugcuccgccaucagcucccugcccgacaucgucuucacgaucaacggggugcaguaccccgugccgcccagcgccuacauccugcaguccgagggcagcugcaucagcggguuccagggcaugaacguccccaccgaguccggcgagcucuggauccugggggacguguucauccgccaguacuucaccgucuucgaccgggcgaacaaccaggugggccuggcccccguggccuga

SEQ ID NO: 34484 - RNA, 765 nt, Artificial Sequence
  derived and/or modified sequence opt1 from PGAM1__Homo_sapiens__NP_002620
auggccgccuacaagcuggugcucauccgccacggcgagagcgcguggaaccuggagaaccgguucuccgggugguacgacgccgaccugagccccgccggccacgaggaggccaagcgcgggggccaggcccuccgggacgcgggguacgaguucgacaucugcuucaccuccguccagaagcgcgccauccggacccuguggacggugcuggacgccaucgaccagauguggcucccggugguccgcaccuggcggcugaacgagcgccacuacggcggccugaccgggcucaacaaggccgagaccgcggccaagcacggcgaggcccaggugaagaucuggcggcgcagcuacgacgugcccccgccgcccauggagcccgaccaccccuucuacuccaacaucagcaaggaccggcgcuacgccgaccugacggaggaccagcugcccuccugcgagagccucaaggacaccaucgcccgggcgcugcccuucuggaacgaggagaucgucccccagaucaaggaggggaagcgcgugcugaucgccgcccacggcaacucccuccgggggaucgugaagcaccuggagggccugagcgaggaggccaucauggagcucaaccugcccaccggcauccccaucgucuacgagcuggacaagaaccucaagccgaucaagcccaugcaguuccugggggacgaggagaccgugcgcaaggccauggaggcgguggccgcccagggcaaggccaagaaguga

SEQ ID NO: 34485 - RNA, 762 nt, Artificial Sequence
  derived and/or modified sequence opt1 from PGAM2__Homo_sapiens__NP_000281
auggccacccaccgccuggugaugguccggcacggcgagagcaccuggaaccaggagaaccgcuucugcgggugguucgacgccgagcucuccgagaagggcacggaggaggcgaagcgcggggccaaggccaucaaggacgccaagauggaguucgacaucugcuacaccagcgugcugaagcgggccauccggacccugugggcgauccucgacggcaccgaccagauguggcugcccgugguccgcacguggcggcugaacgagcgccacuacgggggccucaccggccugaacaaggccgagaccgccgccaagcacggggaggagcaggucaagaucuggcggcgcuccuucgacaucccgcccccgcccauggacgagaagcaccccuacuacaacagcaucuccaaggagcggcgcuacgcgggccugaagcccggggagcucccgaccugcgagagccugaaggacacgaucgcccgggcccugcccuucuggaacgaggagaucgugccccagaucaaggccggcaagcgcgugcucaucgccgcgcacgggaacucccugcggggcaucgugaagcaccuggagggcaugagcgaccaggccaucauggagcucaaccugcccaccgggauccccaucguguacgagcugaacaaggagcucaagcccaccaagccgaugcaguuccugggcgacgaggagaccguccgcaaggccauggaggccguggccgcgcaggggaaggccaaguga

SEQ ID NO: 34486 - RNA, 765 nt, Artificial Sequence
  derived and/or modified sequence opt1 from PGAM4__Homo_sapiens__NP_001025062
auggccgccuacaagcuggugcucauccgccacggcgagagcaccuggaaccuggagaaccgguucuccugcugguacgacgcggaccugagccccgccgggcacgaggaggccaagcgcggcgggcaggcccuccgggacgccggcuacgaguucgacaucugccugaccuccguccagaagcgcgugauccggacgcuguggaccgugcucgacgcgaucgaccagauguggcugccggucgugcgcaccuggcggcugaacgagcgccacuacgggggccucaccggccugaacaaggccgagacggccgccaagcacggggaggcccaggugaagaucuggcggcgcagcuacgacgucccgcccccgcccauggagcccgaccaccccuucuacuccaacaucagcaaggaccggcgcuacgcggaccugaccgaggaccagcuccccuccuacgagagccccaaggacaccaucgcccgggcccugcccuucuggaacgaggagaucgugccccagaucaaggagggcaagcgcgugcugaucgccgcgcacgggaacucccuccagggcaucgccaagcacgucgaggggcugagcgaggaggccaucauggagcugaaccuccccaccggcaucccgaucguguacgagcuggacaagaaccugaagcccaucaagcccaugcaguuccucggcgacgaggagacggugugcaaggccaucgaggccgucgcggcccaggggaaggccaagaaguga

SEQ ID NO: 34487 - RNA, 2769 nt, Artificial Sequence
  derived and/or modified sequence opt1 from PGAP1__Homo_sapiens__NP_079265
auguuccugcacagcgugaaccucuggaaccuggccuucuacgucuucaugguguuccuggccacccucggccugugggacguguucuucggguucgaggagaacaagugcuccaugagcuacauguucgaguaccccgaguaccagaagaucgagcugccgaagaagcucgcgaagcgcuaccccgccuacgagcuguaccuguacggcgagggguccuacgccgaggagcacaagauccucccccugaccggcauccccguccuguuccucccggggaacgccggcagcuacaagcagguccgguccaucggcagcaucgcccugcgcaaggcggaggacaucgacuucaaguaccacuucgacuucuucuccgugaacuucaacgaggagcugguggcccucuacgggggcagccugcagaagcagacgaaguucgugcacgagugcaucaagaccauccugaagcucuacaaggggcaggaguucgcccccaaguccguggccaucaucggccacagcaugggcgggcuggucgcgcgggcccugcucacccugaagaacuucaagcacgaccugaucaaccuccugaucacccaggccacgccccacguggcccccgugaugccgcuggaccgcuucaucaccgacuucuacaccaccgucaacaacuacuggauccucaacgcccggcacaucaaccugacgacccuguccguggcgggcggguuccgcgacuaccaggugcggagcggccucaccuuccugcccaagcugucccaccacaccagcgcccucuccgucgugagcuccgccgugcccaagacgugggucagcaccgaccaccuguccaucguguggugcaagcagcugcagcucaccaccgugcgcgccuucuucgaccugaucgacgccgacacgaagcagaucacccagaacagcaagaagaagcugagcguccucuaccaccacuucauccggcaccccuccaagcacuucgaggagaacccggcgaucaucagcgaccugaccgggaccuccaugugggugcuggugaaggucagcaaguggacguacguggccuacaacgaguccgagaagaucuacuucaccuucccccucgagaaccaccgcaagaucuacacccacgucuacugccagagcaccaugcuggacacgaacuccuggaucuucgccugcaucaacagcaccuccaugugccugcagggcguggaccucagcuggaaggccgagcugcugcccaccaucaaguaccucacccugcggcugcaggacuaccccucccugagccaccucguggucuacgugccguccgugcgcggcagcaaguucgucguggacugcgaguucuucaagaaggagaagcgguacauccagcugcccgugacgcaccuguucuccuucgggcucagcucccgcaaggucgugcugaacaccaacggccuguacuacaaccucgagcugcugaacuucgggcagaucuaccaggccuucaagaucaacguggucagcaagugcuccgcggugaaggaggagaucaccagcaucuaccggcuccacauccccuggagcuacgaggacucccugaccaucgcccaggcccccagcuccacggagaucagccugaagcuccacaucgcccagccggagaacaacacccacguggcccuguucaagauguacaccuccagcgacugccgcuacgaggucaccgugaagacguccuucagccagauccugggccaggugguccgguuccacgggggcgcgcuccccgccuacgugguguccaacauccugcuggccuaccgcggccagcucuacagccuguucuccaccgggugcugccuggaguacgccaccaugcucgacaaggaggcgaagcccuacaaggucgaccccuucgugaucaucaucaaguuccugcugggcuacaagugguucaaggagcucugggacgugcugcugcucccggagcuggacgccgucauccugaccugccagagcaugugcuucccccucaucucccugauccuguuccucuucgggaccugcacggccuacuggagcggccugcuguccagcgccuccgugcggcuccugagcagccuguggcucgcccugaagcgccccuccgagcugcccaaggacaucaagaugaucagcccggaccuccccuuccugaccaucgugcugaucaucgucuccuggacgaccugcggggcgcucgccauccugcugagcuaccucuacuacguguucaaggugguccaccuccaggccucccugaccaccuucaagaacagccagcccgugaacccgaagcacucccggcgcagcgagaagaaguccaaccaccacaaggacagcuccauccaccaccuccgccugagcgccaacgacgccgaggacucccugcggaugcacagcaccgugaucaaccugcugaccuggaucguccugcucuccaugcccagccugaucuacuggcugaagaaccuccgcuacuacuucaagcugaaccccgaccccugcaagccgcuggcguucauccucauccccacgauggccauccugggcaacaccuacaccguguccaucaagagcuccaagcugcucaagaccacgagccaguucccccugccccuggccgugggcgucaucgccuucgggagcgcccaccucuaccggcugccgugcuucguguucaucccccugcuccugcacgcgcugugcaacuucauguga

SEQ ID NO: 34488 - RNA, 924 nt, Artificial Sequence
  derived and/or modified sequence opt1 from PGAP2__Homo_sapiens__NP_001138910
auggcccgccugggcagcaccgggggcguguccgggcgggucgugacccagcaccgcgacagcgcccccuuccucggcgcgccgcggcuggggcugcgcgagcucggccccauccggggcacggcccccgaguggcacgggcgcuggaacgccgccgagcgguccgacaagauguaccaggugccccugccgcuggaccgcgacggcacccucguccggcugcgcuucaccaugguggcccuggugaccgucugcugcccccucguggcguuccuguucugcauccuguggagccuccuguuccacuucaaggagacgaccgccacccacugcggggugcccaacuaccugcccuccgucagcuccgccaucggcggggaggugccgcagcgguacguguggcgcuucugcaucggccuccacagcgcgccccgguuccuggucgccuucgccuacuggaaccacuaccuguccugcaccagccccugcuccugcuaccgcccccucugccggcugaacuucggccugaacgugguggagaaccucgcccugcugguccucacguacgugagcuccagcgaggacuucaccauccacgagaacgccuucaucguguucaucgccuccagccuggggcacaugcugcugaccugcauccucuggcgccugaccaagaagcacacggaccggaaguccuacagcuggaagcagcgccucuucaucaucaacuucaucuccuucuucagcgcgcuggccgucuacuuccggcacaacauguacugcgaggccggcguguacaccaucuucgccauccuggaguacaccgugguccucaccaacauggccuuccacaugacggcguggugggacuucgggaacaaggagcugcugaucaccagccagccggaggagaagcgcuucuga

SEQ ID NO: 34489 - RNA, 810 nt, Artificial Sequence
  derived and/or modified sequence opt1 from PGAP3__Homo_sapiens__NP_001278655
auggccggccuggccgcgcgccucgugcugcuggccggggccgccgcccucgcgagcggcucccagggggaccgggagcccgucuaccgcgacugcgugcugcagugcgaggagcagaacugcagcggcggggcccugaaccacuuccggucccgccagccgaucuacaugagccucgccggcuggaccugccgggacgacugcaaguacgagugcaugugggugaccgucggccuguaccugcaggaggggcacaaggugccccaguuccacggcaaggugucccucaacgccugguucuggagcacggucuuccacacccgcgacaccgaccugaccgagaagauggacuacuucugcgcguccacggugauccugcacagcaucuaccucugcugcgugcggaccgucgggcugcagcaccccgccgugguguccgccuuccgcgcccugcuccugcugaugcucaccguccacgugagcuaccugucccugauccgguucgacuacggcuacaaccucguggccaacgucgcgaucgggcuggugaacguggucugguggcuggccuggugccucuggaaccagcgccggcugccccacgugcgcaagugcguggucguggugcugcuccugcagggccugagccuccuggagcugcucgacuucccgccccuguucuggguccuggacgcccacgccaucuggcacaucuccaccauccccgugcacguccucuucuucagcuuccuggaggacgacucccuguaccuccugaaggagagcgaggacaaguucaagcuggacuga

SEQ ID NO: 34490 - RNA, 2430 nt, Artificial Sequence
  derived and/or modified sequence opt1 from PGBD1__Homo_sapiens__NP_001171672
auguacgaggcccugcccggcccggcccccgagaacgaggacgggcucgugaaggucaaggaggaggaccccaccugggagcaggucugcaacagccaggagggcuccagccacacccaggagaucugccgccugcgguuccgccacuucugcuaccaggaggcgcacgggccccaggaggcccuggcccagcuccgggagcugugccaccaguggcugcgcccggagaugcacacgaaggagcagaucauggagcuccuggugcuggagcaguuccucaccauccugcccaaggagcugcagcccugcgugaagaccuacccccucgaguccggcgaggaggccgugaccgugcuggagaaccuggagacggggagcggcgacaccggccagcaggccuccgucuacauccaggggcaggacaugcacccgaugguggcggaguaccagggcgugagccucgagugccagucccugcagcugcuccccgggaucaccacccugaagugcgagccgccccagcggccccagggcaacccccaggaggucagcgggcccgugccccacggcuccgcccaccuccaggagaagaacccgcgcgacaaggccgugguccccguguucaaccccgugcggagccagacgcuggucaagaccgaggaggagaccgcccaggcgguggccgccgagaaguggucccaccugagccugacccgccggaaccucugcggcaacuccgcccaggagacggugaugagccugucccccaugaccgaggagaucgucaccaaggaccgccuguucaaggccaagcaggagaccagcgaggagauggagcaguccggggaggcgagcggcaagccgaaccgggagugcgcgccccagauccccugcuccacgcccaucgccaccgagcgcaccguggcccaccucaacacccugaaggaccggcacccgggggaccugugggcccgcaugcacaucagcagccucgaguacgccgccggcgacaucacgcggaagggccgcaagaaggacaaggcccggguguccgagcugcugcaggggcucagcuucuccggcgacagcgacgucgagaaggacaacgagcccgagauccagcccgcccagaagaagcugaagguguccugcuuccccgagaaguccuggaccaagcgcgacaucaagccgaacuuccccagcuggagcgcccuggacuccgggcuccugaaccucaagagcgagaagcugaaccccguggagcuguucgagcuguucuucgacgacgagaccuucaaccucaucgucaacgagaccaacaacuacgcgucccagaagaacgugagccuggaggucacggugcaggagaugcggugcguguucggcguccugcuccuguccggguucaugcgccacccgcggcgcgagauguacugggaggugagcgacaccgaccagaaccuggugcgcgacgccauccggcgcgaccgguucgagcucaucuucuccaaccugcacuucgccgacaacggccaccuggaccagaaggacaaguucaccaagcugcgcccccucaucaagcagaugaacaagaacuuccugcuguacgcgccccucgaggaguacuacugcuucgacaagagcaugugcgagugcuucgacuccgaccaguuccugaacggcaagcccauccggaucggguacaagaucuggugcggcaccacgacccagggguaccuggucugguucgagccguaccaggaggagagcaccaugaagguggacgaggaccccgaccucggccucgggggcaaccuggugaugaacuucgccgacguccugcuggagcgcggccaguaccccuaccaccugugcuucgacuccuucuucaccagcgugaagcuccugagcgcccugaagaagaagggggugcgggccacgggcaccauccgcgagaaccggaccgagaagugcccccucaugaacgucgagcacaugaagaagaugaagcgcggguacuucgacuuccggaucgaggagaacaacgagaucauccugugccgcugguacggcgacgggaucaucucccugugcagcaacgccgugggcaucgagccggugaacgaggucuccugcugcgacgccgacaacgaggagaucccccagaucagccagcccuccaucgugaagguguacgacgagugcaaggagggcgucgcgaagauggaccagaucaucagcaaguaccgggugcgcauccgguccaagaagugguacagcauccucguguccuacaugaucgacgucgccaugaacaacgccuggcagcugcaccgcgccugcaaccccggggccagccuggacccgcucgacuuccggcgcuucguggcgcacuucuaccuggagcacaacgcccaccuguccgacuga

SEQ ID NO: 34491 - RNA, 1575 nt, Artificial Sequence
  derived and/or modified sequence opt1 from PGBD5__Homo_sapiens__NP_001245240
auggccgagggcgggggcggggcccgccggcgcgcgcccgcccugcucgaggccgcccgggcccgcuacgagagccugcacaucuccgacgacguguucggcgagagcgggccggacuccggcggcaaccccuucuacagcaccuccgcggccagccgguccagcuccgccgccagcuccgacgacgagcgcgagccgcccgggccgcccggcgcggccccgccgccgccccgggcccccgacgcccaggagcccgaggaggacgaggccggggcgggcuggagcgccgcccugcgcgaccggcccccgccccgcuucgaggacaccgggggccccacgcggaagaugccgcccuccgccagcgccgucgacuucuuccagcuguucgugcccgacaacgugcucaagaacauggucgugcagaccaacauguacgcgaagaaguuccaggagcgcuucggcuccgacggggccuggguggaggucacccugaccgagaugaaggccuuccucggcuacaugaucagcacguccaucagccacugcgaguccgugcugagcaucuggagcgggggcuucuacuccaaccggagccuggcccucgugaugucccaggcccgcuucgagaagauccugaaguacuuccacgucguggcguuccggagcucccagaccacccacggccuguacaaggugcagcccuuccucgacagccugcagaacuccuucgacagcgccuuccgccccucccagacccagguccugcacgagccccucaucgacgaggaccccguguucaucgccacgugcaccgagcgggagcugcgcaagcggaagaagcgcaaguucagccugugggugcggcagugcuccagcaccggguucaucauccagaucuacguccaccucaaggagggcgggggccccgacgggcuggacgcccugaagaacaagccccagcuccacuccaugguggcccgcagccugugccgcaacgcggccggcaagaacuacaucaucuucaccggccccuccaucacgagccugacccucuucgaggaguucgagaagcaggggaucuacugcugcggccugcugcgggcccgcaaguccgacugcaccgggcucccccugagcaugcugaccaaccccgccacgccgcccgcgcggggccaguaccagaucaagaugaaggggaacaugucccucaucugcugguacaacaagggccacuuccgcuuccugaccaacgccuacagccccgugcagcagggcgucaucaucaagcgcaagagcggggagauccccugcccccuggccguggaggccuucgccgcgcaccucuccuacaucugccgguacgacgacaaguacagcaaguacuucaucucccacaagcccaacaagaccuggcagcaggucuucugguucgccaucagcaucgccaucaacaacgccuacauccuguacaagauguccgacgccuaccacgugaagcgguacagccgcgcgcaguucggcgagcggcuggugcgcgagcuccuggggcuggaggacgccucccccacccacuga

SEQ ID NO: 34492 - RNA, 948 nt, Artificial Sequence
  derived and/or modified sequence opt1 from PGC__Homo_sapiens__NP_001159896
augaaguggaugguggucgugcuggugugccuccagcugcuggaggccgccgucgugaaggugccccucaagaaguucaagagcauccgcgagaccaugaaggagaagggccugcugggggaguuccuccggacccacaaguacgaccccgcguggaaguaccgcuucggcgaccuguccgucacguacgagcccauggccuacauggacgccgccuacuucggggagaucagcaucggcaccccgccccagaacuuccugguccucuucgacaccggguccagcaaccugugggugcccuccgucuacugccagagccaggccugcaccucccacagccgguucaaccccuccgagagcuccacguacagcaccaacggccagaccuucucccugcaguacggcagcgggucccucaccggcuucuucggguacgacacgcugaccgugcagagcauccaggugcccaaccaggaguucggccuguccgagaacgagcccgggaccaacuucgucuacgcgcaguucgacggcaucaugggccucgccuacccggcccugagcguggacgaggccaccacggcgaugcaggggauggugcaggagggcgcccugaccucccccgucuucagcguguaccucagcaaccuggugcuggaguccagcgggcucggcccccugcugacccccucccgcgccgccccgcccagcuccacccuccagcugcccgagaagccccuggagcagacguggaacauccucaccccguucaccaagacccugcccgucagcaaccugucccggaaggugacgagcugggccggcguggggauccccgugaccugccuccccgaggcgggcuccgggggcgagcgccgggccgagugcgggcugggcgugccgaccacccgcggcccgccccggagccagcaccacuccggggccuga

SEQ ID NO: 34493 - RNA, 1386 nt, Artificial Sequence
  derived and/or modified sequence opt1 from PGD__Homo_sapiens__NP_001291380
auggcccaggccgacaucgcgcugaucggccucgccgugauggggcagaaccugauccugaacaugaacgaccacggcuucgucgugugcgccuucaaccgcaccgugagcaaggucgacgacuuccucgccaacgaggccaaggggaccaagguggugggcgcgcagucccugaaggagauggucagcaagcugaagaagccccggcgcaucauccuccuggugaaggccgggcaggccguggacgacuucaucgagaagcugcggcgcugccgggaccucaaggccaagggcauccuguucgucggcuccggggugagcggcggggaggagggcgcgcgcuacgggccgucccugaugcccggcggcaacaaggaggccuggccccacaucaagacgaucuuccaggggaucgccgccaaggugggcaccggggagcccugcugcgacugggucggcgacgagggcgccgggcacuucgugaagauggugcacaacggcaucgaguacggggacaugcagcucaucugcgaggcguaccaccugaugaaggacguccugggcauggcccaggacgagauggcccaggccuucgaggacuggaacaagaccgagcucgacagcuuccugaucgagaucaccgccaacauccugaaguuccaggacacggacgggaagcaccuccugccgaagauccgggacuccgcgggccagaagggcaccgggaaguggaccgccaucagcgcccuggaguacggcgugcccgugacccucaucggggaggccgucuucgcccgcugccuguccagccugaaggacgagcggauccaggcguccaagaagcucaagggcccccagaaguuccaguucgacggggacaagaaguccuuccuggaggacauccgcaaggcccuguacgccagcaagaucaucagcuacgcccagggcuucaugcuccugcggcaggccgcgacggaguucggcuggacccugaacuacgggggcaucgcccucauguggcgcgggggcugcaucauccgguccguguuccuggggaagaucaaggacgccuucgaccgcaaccccgagcugcagaaccuccugcuggacgacuucuucaagagcgccguggagaacugccaggacuccuggcggcgcgcggucagcaccggcgugcaggccggcaucccgaugcccugcuucaccacggcccucuccuucuacgacggguaccggcacgagaugcugcccgccagccugauccaggcccagcgcgacuacuucggcgcgcacaccuacgagcuccuggccaagcccgggcaguucauccacaccaacuggaccggccacggcgggacggugagcuccagcuccuacaacgccuga

SEQ ID NO: 34494 - RNA, 450 nt, Artificial Sequence
  derived and/or modified sequence opt1 from PGF__Homo_sapiens__NP_001193941
augcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgcugcggcgacgcggucccccggcgcuga

SEQ ID NO: 34495 - RNA, 1134 nt, Artificial Sequence
  derived and/or modified sequence opt1 from PGGT1B__Homo_sapiens__NP_005014
auggccgccaccgaggacgagcgccuggcgggcagcggggagggcgagcggcucgacuuccugcgcgaccggcacgugcgcuucuuccagcggugccugcagguccuccccgagcgcuacuccagccuggagaccucccggcugacgaucgccuucuucgcccucagcgggcuggacaugcuggacucccucgacguggugaacaaggacgacaucaucgaguggaucuacagccugcagguccugccgaccgaggaccgcuccaaccucaaccggugcggcuuccgcgggagcuccuaccugggcauccccuucaaccccagcaaggcccccggcaccgcccacccguacgacuccgggcacaucgcgaugaccuacacgggccugagcugccucgugauccugggggacgaccugucccgggugaacaaggaggccugccucgccggccugcgcgcccugcagcucgaggacgggagcuucugcgcgguccccgagggcuccgagaacgacaugcgguucguguacugcgccagcugcaucugcuacaugcugaacaacugguccggcauggacaugaagaaggccaucaccuacauccgccggagcauguccuacgacaacgggcuggcccagggcgccgggcucgagagccacggcggcagcaccuucugcgggaucgcgucccugugccugaugggcaagcucgaggagguguucagcgagaaggagcugaaccgcaucaagcgguggugcaucaugcgccagcagaacggguaccacggccggcccaacaagcccgucgacacgugcuacuccuucugggugggggccacccugaagcuccugaagaucuuccaguacaccaacuucgagaagaaccgcaacuacauccugagcacccaggaccggcucgugggcggcuucgccaaguggccggacucccaccccgacgcccugcacgccuacuucgggaucugcggccugagccucauggaggaguccgggaucugcaagguccaccccgcgcugaacgugagcacccgcacguccgagcgccugcucgaccugcaccagagcuggaagaccaaggacuccaagcagugcagcgagaacgugcacaucuccaccuga

SEQ ID NO: 34496 - RNA, 1254 nt, Artificial Sequence
  derived and/or modified sequence opt1 from PGK1__Homo_sapiens__NP_000282
augagccuguccaacaagcucacccuggacaagcuggacgugaagggcaagcgcgucgugaugcggguggacuucaacguccccaugaagaacaaccagaucaccaacaaccagcgcaucaaggccgccgugccgagcaucaaguucugccucgacaacggggcgaaguccgugguccugaugagccaccugggccggcccgacggggugcccaugcccgacaaguacucccucgagccgguggccgucgagcucaagagccugcugggcaaggacgugcuguuccugaaggacugcguggggcccgaggucgagaaggccugcgccaaccccgccgcgggcuccgugauccuccuggagaaccugcgcuuccacguggaggaggagggcaaggggaaggacgccagcggcaacaaggucaaggccgagcccgccaagaucgaggcguuccgggccucccucagcaagcugggggacguguacgugaacgacgccuucggcacggcccaccgcgcccacuccagcauggucggggugaaccugccgcagaaggcgggcggcuuccucaugaagaaggagcugaacuacuucgccaaggcccuggagucccccgagcggcccuuccucgccauccucgggggcgccaagguggcggacaagauccagcugaucaacaacaugcuggacaaggucaacgagaugaucaucgggggcggcauggccuucaccuuccugaaggugcugaacaacauggagaucgggaccagccucuucgacgaggagggcgccaagaucgugaaggaccugauguccaaggccgagaagaacggggucaagaucacccugcccguggacuucgucacggccgacaaguucgacgagaacgcgaagaccggccaggccaccguggccagcgggaucccggccggcuggaugggccucgacugcgggcccgaguccagcaagaaguacgccgaggcggugacccgcgccaagcagaucgucuggaacggccccguggggguguucgagugggaggccuucgcccggggcacgaaggcgcugauggacgaggucgugaaggccaccucccgcgggugcaucaccaucaucggcggcggggacaccgccacgugcugcgccaaguggaacaccgaggacaaggugagccacgucagcaccggcgggggcgccucccuggagcuccuggaggggaaggugcugcccggcguggacgcgcucagcaacaucuga

SEQ ID NO: 34497 - RNA, 1254 nt, Artificial Sequence
  derived and/or modified sequence opt1 from PGK2__Homo_sapiens__NP_620061
augagccuguccaagaagcucacccuggacaagcuggacgugcgcggcaagcgggucaucaugcgcguggacuucaacgugcccaugaagaagaaccagaucaccaacaaccagcggaucaaggccagcaucccguccaucaaguacugccucgacaacggggccaaggcggucgugcugaugagccaccugggccgccccgacggggugcccaugcccgacaaguacucccucgccccggucgccguggagcucaagagccugcugggcaaggacgugcuguuccugaaggacugcgucggggccgagguggagaaggccugcgcgaaccccgcccccggcuccgugauccuccuggagaaccugcgguuccacgucgaggaggagggcaaggggcaggaccccagcggcaagaagaucaaggccgagccggacaagaucgaggccuuccgcgcgucccucagcaagcugggggacguguacgugaacgacgccuucggcacggcccaccgggcccacuccagcauggucggggugaaccugccccacaaggccuccggcuuccucaugaagaaggagcuggacuacuucgcgaaggcccuggagaaccccgugcgccccuuccucgccauccugggcggggccaaggucgccgacaagauccagcugaucaagaacaugcucgacaaggugaacgagaugaucaucggcgggggcauggcguacaccuuccugaaggugcugaacaacauggagaucggcgccagccucuucgacgaggagggggccaagaucgucaaggacaucauggccaaggcccagaagaacggcgugcggaucaccuucccgguggacuucgucaccggggacaaguucgacgagaacgcccaggugggcaaggccacggucgccuccgggaucagccccggcuggaugggccuggacugcgggcccgaguccaacaagaaccacgcccaggugguggcccaggcgcgccugaucgucuggaacggcccccucgggguguucgagugggacgccuucgccaagggcaccaaggcccugauggacgagaucgugaaggcgaccagcaaggggugcaucaccgucaucggcggcggggacacggcgaccugcugcgccaaguggaacaccgaggacaaggugucccacgugagcaccggcgggggcgccagccuggagcuccuggaggggaagauccugccgggcgucgaggcccucuccaacauguga

SEQ ID NO: 34498 - RNA, 777 nt, Artificial Sequence
  derived and/or modified sequence opt1 from PGLS__Homo_sapiens__NP_036220
auggccgcccccgcgccgggccugaucagcguguucuccagcucccaggagcucggggccgcccuggcccagcuggucgcccagcgcgcggccugcugccucgccggcgcccgggcgcgcuucgcccuggggcugagcggcgggucccucgugagcaugcuggcccgggagcugcccgccgccguggcgcccgccggccccgccucccucgcccgcuggacccugggcuucugcgacgagcggcuggucccguucgaccacgccgagagcaccuacgggcucuaccgcacgcaccuccugucccggcugcccauccccgagagccaggugaucaccaucaaccccgagcugccgguggaggaggcggccgaggacuacgccaagaagcugcgccaggccuuccagggcgacuccauccccgucuucgaccuccugauccugggggugggccccgacgggcacacgugcagccucuuccccgaccacccgcugcugcaggagcgggagaagaucguggcccccaucuccgacagccccaagcccccgccccagcgcgucacccucacccugcccgugcugaacgcggcccggaccgugaucuucgucgccaccggcgagggcaaggccgccgugcucaagcgcauccuggaggaccaggaggagaacccccugccggcggcccucgugcagccccacaccgggaagcugugcugguuccuggacgaggccgccgcgcggcuccugacgguccccuucgagaagcacuccacccuguga

SEQ ID NO: 34499 - RNA, 591 nt, Artificial Sequence
  derived and/or modified sequence opt1 from PGLYRP1__Homo_sapiens__NP_005082
augagccgccgguccaugcugcucgccugggcccugcccagccugcuccgccugggcgcggcccaggagaccgaggacccggccugcugcucccccaucgugccccggaacgaguggaaggcccuggccagcgagugcgcgcagcaccucucccugccccugcgcuacgucguggugagccacaccgccggguccagcugcaacacgccggccuccugccagcagcaggcccggaacguccagcacuaccacaugaagacccucggcuggugcgacgugggguacaacuuccugaucggcgaggacgggcugguguacgagggccgcggcuggaacuucaccggggcgcacagcggccaccucuggaaccccauguccaucgggaucagcuucaugggcaacuacauggaccggguccccacgccccaggccauccgcgccgcccaggggcugcuggccugcggcguggcgcagggcgcccuccgguccaacuacgugcugaaggggcaccgcgacguccagcggacccugagcccgggcaaccagcucuaccaccugauccagaacuggccccacuaccgcucccccuga

SEQ ID NO: 34500 - RNA, 1731 nt, Artificial Sequence
  derived and/or modified sequence opt1 from PGLYRP2__Homo_sapiens__NP_443122
auggcccagggcgugcuguggauccuccuggggcugcuccuguggagcgaccccggcaccgccucccugccccuccugauggacagcgucauccaggcgcuggccgagcucgagcagaaggugcccgccgccaagacccgccacacggccuccgcguggcugaugagcgcccccaacuccgggccccacaaccggcuguaccacuuccuccugggcgccuggagccugaacgccaccgagcucgacccgugcccccugucccccgagcugcucgggcugaccaaggagguggcgcgccacgacguccgggagggcaaggaguacggcguggugcuggcccccgacgggagcaccgucgccguggagccgcuccuggccggccuggaggccgggcuccagggccgccgggugaucaaccugccccuggacuccauggcggcccccugggagacgggggacaccuuccccgacgucguggccaucgccccggacgugcgcgccaccagcucccccggccuccgggacggcagccccgacgucaccacggcggacaucggggccaacacccccgacgccaccaagggcugcccggacgugcaggccucccugcccgacgccaaggccaagagcccgcccaccaugguggacucccugcucgccgucacgcuggccgggaaccugggccucaccuuccugcgcggcagccagacccagucccaccccgaccuggggaccgagggcugcugggaccagcucagcgcgccccggacguucacccugcuggaccccaaggccucccuccugaccauggcguuccugaacggggcccucgacggcgugauccugggggacuaccugagccgcacccccgagccgcggcccagccucucccaccuccugagccaguacuacggcgccggcguggcccgcgaccccggguuccgguccaacuuccgccggcagaacggcgcggcccugacgagcgccuccauccuggcccagcaggucugggggacccuggugcugcuccagcgccuggagcccgugcaccuccagcugcagugcaugagccaggagcagcuggcccaggucgcggccaacgccaccaaggaguucaccgaggccuuccugggcugcccggccauccacccccggugccgcuggggcgcggcccccuaccgggggcgcccgaagcuccugcagcugccccucggcuuccuguacgugcaccacacguacgugcccgcgcccccgugcaccgacuucacccggugcgccgccaacaugcgcuccaugcagcgcuaccaccaggacacccagggguggggcgacaucggguacagcuucgucgugggcuccgacggguacgucuacgagggccggggcuggcacugggugggggcccacacgcugggccacaacagccgcggguucggcguggccaucgucggcaacuacaccgccgcccuccccaccgaggcggcccugcggaccgugcgcgacacgcugcccuccugcgccgugcgggccgggcuccugcgccccgacuacgcccugcucggccaccggcagcugguccgcaccgacugcccgggggacgcgcuguucgaccuccugcggaccuggccccacuucaccgccacggugaagccccgccccgcccggagcguguccaagcgcagccggcgcgagccgccgccccggacccugcccgccaccgaccuccaguga

SEQ ID NO: 34501 - RNA, 1026 nt, Artificial Sequence
  derived and/or modified sequence opt1 from PGLYRP3__Homo_sapiens__XP_011507421
augggcacccugcccuggcuccuggccuucuucauccuggggcuccaggccugggacaccccgacgaucgugagccgcaaggaguggggcgcgcggccccuggccugccgcgcccugcucacccugcccgucgccuacaucaucaccgaccagcugcccgggaugcagugccagcagcaguccgugugcagccagaugcuccggggccugcagucccacagcguguacaccaucggguggugcgacgucgccuacaacuuccuggugggcgacgacggccgcguguacgagggggucggcuggaacauccaggggcuccacacgcagggcuacaacaacaucucccuggggaucgcguucuucggcaacaagaucggcagcuccccgagccccgccgcccuguccgccgcggaggggcucaucagcuacgccauccagaagggccaccugagcccccgguacauccagccccugcuccugaaggaggagaccugccuggacccgcagcaccccgugaugccccgcaaggugugccccaacaucaucaagcgguccgccugggaggcccgcgagacccacugcccgaagaugaaccuccccgccaaguacgucaucaucauccacaccgcggggacguccugcaccgugagcaccgacugccagaccgugguccggaacauccaguccuuccacauggacacgcgcaacuucugcgacaucggcuaccacuuccuggugggccaggacgggggcguguacgagggggucggcuggcacauccaggggagccacaccuacggcuucaacgacaucgcccugggcaucgccuucaucggguacuucguggagaagccgcccaacgccgccgcgcucgaggccgcccaggaccugauccagugcgccguggucgagggcuaccugacccccaacuaccuccugauggggcacuccgacguggugaacauccugagccccggccaggcccucuacaacaucaucuccaccuggccccacuucaagcacuga

SEQ ID NO: 34502 - RNA, 1122 nt, Artificial Sequence
  derived and/or modified sequence opt1 from PGLYRP4__Homo_sapiens__NP_065126
augcugcccuggcuccugguguucagcgcccugggcauccaggccuggggcgacuccagcuggaacaagacccaggcgaagcaggucuccgaggggcuccaguaccuguucgagaacaucagccagcugaccgagaaggggcucccgacggacguguccaccaccgugagccgcaaggccuggggcgccgaggccgucgggugcuccauccagcugaccacgcccgugaacgugcuggucauccaccacgugcccggccucgagugccacgaccagaccgugugcagccagcggcugcgcgagcugcaggcccaccacguccacaacaacuccggcugcgacguggcguacaacuuccucgugggggacgacggccgggucuacgagggggugggcuggaacauccagggggugcacacccagggcuacaacaacaucagccugggcuucgccuucuucgggaccaagaagggccacucccccagcccggccgcccuguccgcgauggagaaccucaucacguacgccguccagaaggggcaccugagcuccagcuacgugcagccccugcucggcaagggcgagaacugccuggcgccccgccagaagaccucccugaagaaggccugccccgggguggucccgcggagcguguggggcgcccgcgagacccacugcccccggaugacccuccccgccaaguacgggaucaucauccacacggccggccggaccugcaacaucuccgacgagugccgccugcuggugcgcgacauccagagcuucuacaucgaccggcucaagagcugcgacaucggguacaacuuccuggucggccaggacggcgccaucuacgagggggugggcuggaacgugcagggguccagcacccccggcuacgacgacaucgcccuggggaucaccuucaugggcacguucaccggcaucccgcccaacgccgcggcccucgaggccgcccaggaccugauccagugcgccauggucaagggguaccugacccccaacuaccuccuggugggccacuccgacgucgcgcgcacccugagccccgggcaggcccucuacaacaucaucuccacguggccgcacuucaagcacuga

SEQ ID NO: 34503 - RNA, 1701 nt, Artificial Sequence
  derived and/or modified sequence opt1 from PGM3__Homo_sapiens__NP_001186848
auggaccugggcgccaucaccaaguacagcgcccuccacgcgaagcccaacgggcugauccugcaguacggcaccgccggguuccgcacgaaggccgagcaccucgaccacgugauguuccggaugggccugcuggccguccuccgcuccaagcagaccaagagcaccaucggggugauggugaccgccucccacaacccggaggaggacaacggcgucaagcugguggacccccugggcgagaugcucgcgcccagcugggaggagcacgccacgugccuggccaacgccgaggagcaggacaugcagcgggugcugaucgacaucuccgagaaggaggcggucaaccuccagcaggacgccuucguggugaucgggcgcgacacccggcccagcuccgagaagcugagccaguccgucaucgacggcgugaccgugcucgggggccaguuccacgacuacgggcuccugaccacgccgcagcugcacuacauggucuacugccgcaacaccggcggccgguacgggaaggccaccaucgagggcuacuaccagaagcucagcaaggccuucguggagcugaccaagcaggccuccugcagcggggacgaguaccgcucccugaagguggacugcgcgaacggcaucggcgcccucaagcugcgggagauggagcacuacuucagccaggggcuguccguccagcuguucaacgacggcagcaaggggaagcugaaccaccugugcggcgccgacuucgugaagucccaccagaagccgccccaggggauggagaucaagagcaacgagcgcugcugcuccuucgacggcgacgccgaccggaucguguacuacuaccacgacgccgacggccacuuccaccucaucgacggggacaagaucgcgacgcugaucagcagcuuccugaaggagcuccuggucgagaucggcgagucccugaacaucgggguggugcagaccgccuacgccaacggcagcuccacccgcuaccucgaggaggucaugaaggugcccguguacugcaccaagacgggggucaagcaccuccaccacaaggcccaggaguucgacaucggcguguacuucgaggccaacggccacgggaccgcgcuguucagcaccgccgucgagaugaagaucaagcaguccgccgagcagcuggaggacaagaagcggaaggccgccaagaugcuggagaacaucaucgaccuguucaaccaggcggccggcgacgccaucagcgacaugcucgugaucgaggccauccuggcgcugaaggggcucaccgugcagcagugggacgcccuguacacggaccugcccaaccgccagcucaagguccagguggccgaccggcgcgugaucuccaccaccgacgccgagcggcaggccgucaccccgcccggccugcaggaggcgaucaacgaccuggugaagaaguacaagcucagccgcgccuucgugcggcccuccgggacggaggacgucgugcgcguguacgccgaggccgacagccaggaguccgccgaccaccuggcgcacgaggucagccuggccguguuccagcuggccggcggcaucggggagcggccccagcccggcuacaaggccgccgagaccacccacaacaucaacaacgcguucgggcccggcaccgccaacgagcacacggugcccuga

SEQ ID NO: 34504 - RNA, 630 nt, Artificial Sequence
  derived and/or modified sequence opt1 from PGPEP1__Homo_sapiens__NP_060182
auggagcagccccgcaaggccguggucgugaccggcuucgggccguucggcgagcacaccgugaacgccagcuggaucgcgguccaggagcuggagaagcucgggcugggcgacuccguggaccugcacguguacgagauccccgucgaguaccagacggugcagcggcucauccccgcccugugggagaagcacagcccccagcuggugguccacguggggguguccggcauggccaccaccgucacccucgagaagugcggccacaacaagggguacaagggccuggacaacugccgcuucugcccggggagccagugcugcguggaggacggccccgaguccaucgacagcaucaucgacauggacgccgugugcaagcgggucacgacccuggggcucgacguguccgugaccaucagccaggacgccggccgcuaccugugcgacuucaccuacuacacgucccuguaccagagccacggccgguccgcguucguccacgugccgccccucgggaagcccuacaacgccgaccagcugggccgcgcccugcgggccaucaucgaggagaugcucgaccugcuggagcagagcgaggggaagaucaacuacugccacaagcacuga

SEQ ID NO: 34505 - RNA, 966 nt, Artificial Sequence
  derived and/or modified sequence opt1 from PGP__Homo_sapiens__NP_001035830
auggccgccgcggaggccggcggggacgacgcccgcugcgugcggcugagcgccgagcgcgcccaggcgcuccuggccgacgucgacacccuccuguucgacugcgacggcgugcuguggcgcggggagaccgccgugcccggcgccccggaggcgcugcgggcccuccgggcccgcgggaagcggcugggcuucaucacgaacaacuccagcaagacccgcgccgccuacgcggagaagcugcggcgccucggcuucgggggccccgccgggcccggcgccucccuggaggucuucgggaccgccuacugcaccgcccuguaccuccggcagcgccuggcgggcgcccccgccccgaaggccuacgugcugggcagccccgcccucgcggccgagcuggaggccgugggggucgccuccgugggcguggggcccgagccccugcagggcgagggcccgggggacuggcuccacgcgccccuggagcccgacguccgggccgugguggucggcuucgacccccacuucagcuacaugaagcugacgaaggcccuccgcuaccugcagcagccggggugccugcucgugggcaccaacauggacaaccggcugccccuggagaacgggcgcuucaucgccggcaccggcugccucgugcgggccgucgagauggcggcccagcgccaggccgacaucaucgggaagcccucccgguucaucuucgacugcgugagccaggaguacggcaucaaccccgagcgcaccgugauggucggggaccggcuggacacggacauccugcucggcgcgaccugcgggcugaagaccauccugacccucacgggcguguccacccugggcgacgugaagaacaaccaggagagcgacugcgucuccaagaagaagauggugccggacuucuacguggacagcaucgccgaccugcuccccgcccugcagggguga

SEQ ID NO: 34506 - RNA, 2802 nt, Artificial Sequence
  derived and/or modified sequence opt1 from PGR__Homo_sapiens__NP_000917
augaccgagcugaaggccaagggcccccgcgcgccccacguggccggcgggccgcccucccccgaggucgggagcccccuccugugccggcccgccgccggccccuuccccgggucccagaccuccgacacgcugccggaggugagcgccauccccaucucccucgacggccugcuguucccccgccccugccagggccaggaccccuccgacgagaagacccaggaccagcagucccucuccgacguggagggggccuacucccgggccgaggccacccgcggcgccgggggcuccuccagcagcccgcccgagaaggacagcgggcugcuggacuccguccucgacacccugcuggcccccagcggccccggccagucccagcccuccccgcccgccugcgaggugacguccagcuggugccucuucgggcccgagcugcccgaggacccgcccgccgcccccgccacccagcgggugcugagcccccucaugucccgcagcggcugcaaggucggggacuccagcggcaccgccgccgcccacaaggugcugccccggggccugucccccgcccgccagcuccugcugcccgccagcgagagcccccacuggagcggggcccccgugaagcccagcccccaggccgccgccgucgagguggaggaggaggacggcagcgaguccgaggagagcgccgggccccuccugaagggcaagccccgggcccugggcggcgcggccgccggcgggggcgccgccgcggugccgcccggggccgccgccggcggggucgcgcucgugcccaaggaggacucccgcuucagcgcgccccggguggcccuggucgagcaggacgcccccauggcccccggccgcagcccccuggcgaccacggugauggacuucauccacgugcccauccucccccugaaccacgcccugcucgccgcccggacccgccagcugcuggaggacgagagcuacgacggcggggccggcgcggccuccgccuucgcgccgccccggagcucccccugcgccagcagcacccccgucgcggugggggacuuccccgacugcgccuacccgcccgacgccgagccgaaggacgacgccuacccccucuacuccgacuuccagccgcccgcgcugaagaucaaggaggaggaggagggcgccgaggccagcgcccgcagcccccgguccuaccugguggccggggcgaaccccgccgccuuccccgacuucccgcucgggccgccgccgccccugccgccccgcgccacccccucccggcccggcgaggccgcggucacggccgcccccgccagcgccuccgugagcuccgcgagcuccagcggguccacccuggagugcauccucuacaaggccgagggcgcgccgccccagcaggggccguucgcgccgccgcccugcaaggcgccgggcgccagcggcugccugcugccccgcgacgggcuccccuccaccagcgccuccgccgccgcggccggcgccgcccccgcccuguacccggcgcuggggcucaacggccugccccagcugggguaccaggccgccgugcucaaggagggccugccccaggucuacccgcccuaccugaacuaccugcggcccgacagcgaggccagccagagcccccaguacagcuucgagucccucccccagaagaucugccugaucugcggcgacgaggccagcgggugccacuacggcgugcugaccugcggguccugcaaggucuucuucaagcgcgcgauggagggccagcacaacuaccucugcgccgggcgcaacgacugcaucguggacaagauccggcgcaagaacugccccgccugccggcugcgcaagugcugccaggccggcauggugcugggcgggcggaaguucaagaaguucaacaagguccgcguggugcgggcccucgacgcggucgcccugccccagcccgugggcgugccgaacgagagccaggcccugucccagcgcuucacguucagccccgggcaggacauccagcucaucccgccccugaucaaccugcucauguccaucgagccggacgucaucuacgccggccacgacaacaccaagcccgacaccagcuccagccugcugaccucccucaaccagcugggggagcggcagcugcucagcguggugaagugguccaagagccugcccggcuuccgcaaccugcacaucgacgaccagaucacgcucauccaguacuccuggaugagccugauggucuucggccugggguggcgguccuacaagcacgugagcggccagaugcucuacuucgcgcccgaccugauccugaacgagcagcgcaugaaggagagcuccuucuacagccucugccugaccauguggcagaucccgcaggaguucgugaagcugcaggucucccaggaggaguuccucugcaugaaggugcugcugcuccugaacaccaucccccuggaggggcuccggagccagacccaguucgaggagaugcgcuccagcuacauccgggagcugaucaaggccaucggccugcgccagaaggggguggucuccagcucccagcgguucuaccagcucacgaagcugcuggacaaccuccacgaccuggugaagcagcugcaccucuacugccugaacaccuucauccagagccgcgcccuguccguggaguuccccgagaugaugagcgaggucaucgccgcccagcuccccaagauccuggcgggcauggugaagccgcuccuguuccacaagaaguga

SEQ ID NO: 34507 - RNA, 432 nt, Artificial Sequence
  derived and/or modified sequence opt1 from PGRMC1__Homo_sapiens__NP_001269550
auggccgccgaggacguggucgcgaccggcgccgaccccagcgaccuggaguccgggggccuccugcacgagaucuucaccagcccgcugaaccuccugcugcucgggcugugcaucuuccugcucuacaagaucgugcgcggcgaccagcccgccgccuccggggacagcgacgacgacgagcccccgccccugccccggcugaagcgccgggacuucacgcccgccgagcuccgccgguucgacggcgugcaggacccccgcauccugauggcgaucaacggcaaggucuucgacgugaccaaggggcggaaguucuacggcccggugaaguaccaccacgucgggaagcugcucaaggagggcgaggagcccaccguguacuccgacgaggaggagcccaaggacgagagcgcccgcaagaacgacuga

SEQ ID NO: 34508 - RNA, 744 nt, Artificial Sequence
  derived and/or modified sequence opt1 from PGRMC2__Homo_sapiens__NP_006311
augggcggggccggccgcggggugggcgaggggcggggccgcggcgggggcgggcggcgcuggcgggccgucauggcggccggcgacggggacgugaagcugggcacccucggcagcggguccgagagcuccaacgacggcgggagcgagucccccggcgacgccggcgccgccgcggagggcggcgggugggccgccgccgcgcuggcccugcucaccggcgggggcgagaugcugcugaacguggcccucgucgcccuggugcugcucggggccuaccgccugugggugcggugggggcgccggggccugggggcgggcgccggggccggcgaggagagcccggccacgucccucccccgcaugaagaagcgggacuucagccuggagcagcugcgccaguacgacggcucccggaacccccgcauccuccuggccgucaacgggaagguguucgacgugaccaagggcagcaaguucuacgggcccgcgggcccguacgggaucuucgccggccgggacgccucccgcggccuggccaccuucugccucgacaaggacgcccugcgggacgaguacgacgaccugagcgaccucaacgcgguccagauggaguccgugcgcgagugggagaugcaguucaaggagaaguacgacuacguggggcggcugcugaagcccggcgaggagcccagcgaguacaccgacgaggaggacacgaaggaccacaacaagcaggacuga

SEQ ID NO: 34509 - RNA, 1743 nt, Artificial Sequence
  derived and/or modified sequence opt1 from PHACTR1__Homo_sapiens__NP_001229577
auggacuaccccaagauggacuacuuccuggacguggagagcgcccaccgccuccuggacgucgaguccgcccagcgguucuucuacagccagggcgcgcaggcccgccgggccacccugcuccugccgcccacccugauggccgccuccagcgaggacgacaucgaccgccggcccauccgccgggugcgcuccaagagcgacacgcccuaccucgcggaggcccggaucuccuucaaccugggggccgccgaggagguggagcgccuggcggccaugcggagcgacucccucgucccgggcacccacaccccgcccauccgccggcgcagcaaguucgccaaccuggggcggaucuucaagcccuggaaguggcgcaagaagaaguccgagaaguucaagcacaccagcgccgcccuggagcggaagaucuccaugcgccagagccgggaggagcucaucaagcgcggcgugcugaaggagaucuacgacaaggacggggagcuguccaucagcaacgaggaggacucccucgagaacggccagagccuguccagcagccagcugucccuccccgcgcugagcgagauggagcccgugcccaugccccgggacccgugcuccuacgagguccugcagcccagcgacaucauggacggccccgaccccggggccccggugaagcuccccugccugcccgugaagcugagcccgccccucccgcccaagaaggucaugaucugcaugcccgugggcgggcccgaccugagccugguguccuacacggcccagaaguccggccagcagggggucgcccagcaccaccacaccgugcuccccucccagauccagcaccagcugcaguacggcagccacggccagcaccuccccuccaccaccgggagccugcccaugcacccguccggcugccgcaugaucgacgagcugaacaagacgcuggccaugaccaugcagcgccucgagagcuccgagcagcgggugcccugcagcaccuccuaccacagcuccgggcugcacagcggcgacggcgucaccaaggcggggcccaugggccugccggagauccgccaggugcccacgguggucaucgagugcgacgacaacaaggagaacgugccccacgagagcgacuacgaggacuccagcugccucuacacccgggaggaggaggaggaggaggaggacgaggacgacgacuccagccuguacaccuccagccuggccaugaaggugugccgcaaggacucccucgccaucaagcugagcaaccggcccuccaagcgcgagcuggaggagaagaacauccucccgcggcagaccgacgaggagcgccuggagcugcggcagcagaucgggacgaagcucacccgccggcugagccagcgccccaccgccgaggagcuggagcagcggaacauccucaagccccgcaacgagcaggaggagcaggaggagaagcgggagaucaagcgccggcugacccgcaagcugucccagcggcccacggucgaggagcugcgcgagcgcaagauccucauccgguucagcgacuacguggagguggccgacgcgcaggacuacgaccgccgggccgacaagccguggacccgccugaccgccgccgacaaggccgcgauccggaaggagcugaacgaguucaaguccaccgagauggagguccacgagcucagccgccaccugacgcgguuccaccgccccuga

SEQ ID NO: 34510 - RNA, 1938 nt, Artificial Sequence
  derived and/or modified sequence opt1 from PHACTR2__Homo_sapiens__NP_001093634
augggccagaccagcguguccacccugagcccccagccgggguccgucgacggccucgacaaggccagcaucgccaacuccgacgggcccacggcgggcagccagaccccgcccuucaagcgcaaggggaagcuguccaccaucggcaagaucuucaagcccuggaaguggcggaagaagaagaccagcgacaaguuccgcgagacguccgccgugcuggagcggaagaucagcacccgccagucccgggaggagcucauccgccggggcgugcugaaggagcugcccgaccaggacggggacgucaccgugaacuucgagaacagcaacggccacaugauccccaucggggaggaguccacccgcgaggagaacguggucaagagcgaggagggcaacggguccgugagcgagaagacgcccccgcucgaggagcaggccgaggacaagaaggagaacaccgagaaccacuccgagacccccgccgcccccgcgcugcccccgagcgccccgcccaagccccggcccaagcccaagcccaagaagucccccgugccgcccaagggcgccaccgccggcgcgagccacaagggggacgaggucccgcccaucaagaagaacacgaaggcccccggcaagcaggcccccgugcccccgcccaagcccgccagccgcaacaccacccgggaggccgcgggguccagccacuccaagaagaccacgggcagcaaggccuccgccagccccuccaccagcuccaccagcucccgcccgaaggccagcaaggagaccguguccagcaaggccggcacggucgggaccaccaagggcaagcggaagaccgacaagcagcccaucacgucccaccugagcuccgacaccaccaccagcgggacguccgaccucaagggcgagcccgcggagacccgcguggagagcuucaagcuggagcagaccgugcccggggccgaggagcagaacaccggcaaguucaagagcauggucccgcccccgcccguggcccccgcccccagcccccuggcgcccccgcucccccuggaggaccagugcaucacggccuccgacacccccgugguccugguguccgugggcgccgaccuccccgucagcgcccuggacccgucccagcugcucugggccgaggagcccaccaaccggaccacgcuguacagcgggaccggccuguccgugaaccgcgagaacgccaagugcuucaccaccaaggaggagcucgggaagaccgugccccagcugcugacgcccggccucaugggggagagcuccgagagcuucuccgcgagcgaggacgagggccaccgggaguaccaggccaacgacuccgacagcgacggcccgauccuguacaccgacgacgaggacgaggacgaggacgaggacggguccggcgagagcgcccuggccuccaagauccgccggcgcgacacccucgcgaucaagcuggggaaccggcccagcaagaaggagcuggaggacaagaacauccuccagcgcaccagcgaggaggagcgccaggagauccggcagcagaucggcacgaagcugguccgccggcugucccagcgccccaccaccgaggagcucgagcagcggaacauccugaagcagaagaacgaggaggaggagcaggaggccaagauggagcugaagcgccggcucagccgcaagcugucccugcggcccaccguggccgagcuccaggcccgccggauccugcgcuucaacgaguacgucgaggugacggacagcccggacuacgaccggcgcgccgacaagcccugggcgcggcugacccccgccgacaaggccgccauccgcaaggagcucaacgaguucaaguccaccgagauggaggugcacgaggagagccggcaguucacccgcuuccaccggccguga

SEQ ID NO: 34511 - RNA, 1671 nt, Artificial Sequence
  derived and/or modified sequence opt1 from PHACTR3__Homo_sapiens__NP_001186434
augcgcggccgcgggggcgggcgggcccggugccccgccccgcugcgcagccuccugggcgcguucggggcccgggacgccgccgccgcggcccgcgaccccgcccaggacgagauggaccagaccccgcccgcccggcccgaguaccugguguccggcauccgcaccccgcccguccggcgcaacagcaagcucgcgacgcugggccggaucuucaagcccuggaaguggcgcaagaagaagaacgagaagcugaagcagaccaccuccgcccucgagaagaagauggccgggcggcagggccgcgaggagcugaucaagaaggggcugcucgagaugauggagcaggacgccgagagcaagaccugcaaccccgacggcgggccccgguccgugcagagcgagccgcccacgcccaaguccgagacccugaccagcgaggacgcccagcccggcagcccccuggcgaccggcacggaccaggugucccucgacaagccccuguccagcgccgcccaccuggacgacgccgccaagaugccguccgcgagcuccggggaggaggccgacgccggcagccuccugcccaccaccaacgagcugucccaggcccucgccggggcggacagccuggacuccccgccccgcccccuggagcggagcgucggccagcuccccagcccgccccugcugcccaccccgccgcccaaggccuccagcaagacgaccaagaacgugaccggccaggccacccucuuccaggccuccagcaugaaguccgccgaccccagccugcgcgggcagcuguccacgcccaccggcagcccccaccucaccaccgugcaccggccccugccgcccucccgcgucaucgaggagcugcaccgggcgcucgccacgaagcaccgccaggacagcuuccaggggcgcgaguccaagggcagccccaagaagcggcuggacgugcgccugucccggaccagcuccguggagcgcgggaaggagcgggaggaggccuggagcuucgacggcgcccucgagaacaagcgcaccgcggccaaggaguccgaggagaacaaggagaaccugaucaucaacagcgagcugaaggacgaccuccugcuguaccaggacgaggaggcccucaacgacuccaucaucagcggcacccugccccggaagugcaagaaggagcugcucgccgucaagcugcgcaaccggcccagcaagcaggagcuggaggaccgcaacaucuucccccggcgcacggacgaggagcggcaggagauccgccagcagaucgagaugaagcucuccaagcggcugagccagcgccccgccguggaggagcuggagcggcgcaacauccucaagcagcggaacgaccagaccgagcaggaggagcgccgcgagaucaagcagcggcugacccgcaagcugaaccagcggccgaccguggacgagcugcgcgaccggaagauccucauccgcuucuccgacuacgucgagguggcgaaggcccaggacuacgaccggcgcgccgacaagcccuggacgcggcugagcgccgccgacaaggcggccauccgcaaggagcugaacgaguacaaguccaacgagauggaggugcacgccagcuccaagcaccucacccgguuccaccgccccuga

SEQ ID NO: 34512 - RNA, 900 nt, Artificial Sequence
  derived and/or modified sequence opt1 from PHB2__Homo_sapiens__NP_001138303
auggcccagaaccugaaggaccucgccggccgccugcccgcggggccgcggggcauggggaccgcccugaagcuccugcugggcgccggggccguggccuacggcguccgcgagagcguguucaccguggagggcgggcaccgggcgaucuucuucaaccgcaucggcgggguccagcaggacacgauccucgccgagggccugcacuuccggauccccugguuccaguaccccaucaucuacgacauccgcgcccggccccgcaagaucuccagcccgaccggguccaaggaccugcagauggugaacaucagccuccgggugcugucccgccccaacgcccaggagcugcccagcauguaccagcggcucggccuggacuacgaggagcgcguccugcccuccaucgugaacgaggugcucaagagcgucguggcgaaguucaacgccucccagcugaucacccagcgggcccaggugagccugcucauccgccgggagcugaccgagcgcgccaaggacuucucccugauccucgacgacgucgccaucacggagcugagcuucucccgggaguacaccgcggccguggaggccaagcaggucgcccagcaggaggcccagcgcgcgcaguuccugguggagaaggccaagcaggagcagcggcagaagaucgugcaggccgagggcgaggccgaggccgcgaagaugcucggggaggcccugagcaagaacccgggcuacaucaagcugcgcaagauccgggccgcccagaacaucuccaagaccaucgccaccagccagaaccgcaucuaccucacggcggacaaccuggugcugaaccuccaggacgaguccuucacccgcgggagcgacucccugaucaagggcaagaaguga

SEQ ID NO: 34513 - RNA, 468 nt, Artificial Sequence
  derived and/or modified sequence opt1 from PHB__Homo_sapiens__NP_001268426
auggccgccaagguguucgagagcaucggcaaguucgggcuggcgcucgccgucgccggcgggguggugaacuccgcccuguacaacgucgacgccggccaccgcgcggugaucuucgaccgguuccgcggggugcaggacaucgucgugggcgagggcacccacuuccugauccccugggugcagaagccgaucaucuucgacugccggagccgcccccggaacguccccgugaucaccggguccaaggaccuccagaacgugaacaucacgcugcgcauccuguuccggcccgucgccagccagcucccgcgcaucuucaccuccaucggcgaggacuacgacgagcgggugcugcccagcaucaccaccgagauccugaaguccguggucgcccgcuucgacgccggggagcucaucacguaccugcccgcgggccagagcgugcugcuccagcugccccaguga

SEQ ID NO: 34514 - RNA, 3015 nt, Artificial Sequence
  derived and/or modified sequence opt1 from PHC1__Homo_sapiens__NP_004417
auggagaccgagagcgagcagaacuccaacagcaccaacggcuccagcuccagcgggggcuccagccgcccccagaucgcccagaugucccuguacgagcggcaggccgugcaggcgcuccaggcccugcagcgccagccgaacgccgcccaguacuuccaccaguucaugcugcagcagcagcucagcaacgcccagcugcacucccuggcggccguccagcaggccacgaucgccgcgagccggcaggccuccagccccaacaccuccaccacccagcagcagacgaccaccacccaggccagcaucaaccucgccacgaccuccgccgcgcagcugaucagccgcucccagagcgugagcucccccagcgccaccacccugacgcaguccgugcuccuggggaacaccaccagccccccgcugaaccagucccaggcccagauguaccuccggccccagcugggcaaccugcuccaggucaaccgcacccuggggcggaacgugccccuggccagccagcucauccugaugcccaacggcgccguggcggccguccagcaggaggugccguccgcccagagccccggcgugcacgccgacgccgaccagguccagaaccuggcggugcgcaaccagcaggccuccgcccaggggccccagaugcagggcagcacgcagaaggccauccccccgggggccucccccgugagcucccucagccaggcguccagccaggcccuggccgucgcccaggcguccagcggcgccaccaaccagucccugaaccucagccaggccgggggcggcagcgggaacuccauccccggcagcauggggcccggcggcgggggccaggcccacgggggccuggggcagcugccguccagcggcaugggcgggggcuccugcccccggaaggggaccggcguggugcagccccuccccgccgcgcagaccgucacggugagccaggggucccagaccgaggccgagagcgccgccgccaagaaggcggaggccgacggcuccggccagcagaacguggggaugaaccugacccgcaccgccacgccggcccccagccagacccugaucuccagcgccaccuacacccagauccagccccacucccucauccagcagcagcagcagauccaccugcagcagaagcaggucgugauccagcagcagaucgcgauccaccaccagcagcaguuccagcaccggcagagccagcugcuccacacggccacccaccugcagcuggcccagcagcagcagcagcagcagcagcagcagcagcagcagcagcagccccaggccaccacccucacggcgccgcagcccccccaggugcccccgacccagcaggucccccccucccagagccagcagcaggcccagacccugguggugcagccgaugcugcaguccagcccccucagccugccccccgacgccgccccgaagccccccauccccauccaguccaagccgcccgucgcccccaucaagcccccgcagcugggcgcggccaagaugagcgccgcccagcagccccccccccacaucccggugcaggucguggggacccgccagcccggcacggcccaggcgcaggcccucgggcuggcccagcuggccgccgcggugcccaccucccggggcaugcccggcaccguccagagcgggcaggcccaccucgccuccagcccgcccuccagccaggcccccggcgcgcugcaggagugccccccgacccuggcccccgggaugacccucgcccccgugcagggcacggcccacguggucaagggcggggccaccaccuccagcccggugguggcgcagguccccgccgccuucuacaugcaguccgugcaccugcccggcaagccccagacccuggccgugaagcgcaaggccgacagcgaggaggagcgggacgacgucuccacgcuggggagcaugcucccggcgaaggccucccccguggccgagagccccaaggugauggacgagaaguccagccugggcgagaaggccgaguccgucgccaacgugaacgcgaacacccccagcagcgagcugguggcccucaccccggcccccuccgucccccccccgacccuggccauggugagccgccagaugggggacuccaagcccccccaggccaucgugaagccccagauccugacgcacaucaucgagggcuucgucauccaggagggcgcggagccguuccccguggggugcagccagcuccugaaggaguccgagaagccccugcagaccggccuccccaccgggcugaccgagaaccagagcggcgggccgcugggcguggacucccccagcgccgagcucgacaagaaggccaaccugcugaagugcgaguacugcggcaaguacgcccccgcggagcaguuccggggguccaagcgcuucugcagcaugacgugcgccaagcgguacaacgucuccugcagccaccaguuccgccucaagcggaagaagaugaaggaguuccaggaggccaacuacgcccgcgugcgccggcgcggcccccggcgcuccagcuccgacaucgcccgggcgaagauccaggggaagugccaccgcggccaggaggacagcucccgggggagcgacaacuccagcuacgacgaggcccugagcccgaccucccccggcccccugagcgugcgcgccggccacggggagcgggaccucggcaaccccaacaccgccccgcccacccccgagcugcacgggaucaacccggucuuccuguccagcaaccccucccgcuggagcguggaggagguguacgaguucaucgccucccuccagggcugccaggagaucgcggaggaguuccggagccaggagaucgacgggcaggcccugcugcuccugaaggaggagcaccugauguccgccaugaacaucaagcucggccccgcccugaagaucugcgccaagaucaacguccugaaggagacguga

SEQ ID NO: 34515 - RNA, 861 nt, Artificial Sequence
  derived and/or modified sequence opt1 from PHC2__Homo_sapiens__XP_011539177
augaccagcggcaacgggaacuccgccagcuccaucgccggcaccgcgccccagaacggggagaacaagccgccccaggccaucgugaagccccagauccugacgcacgucaucgagggcuucgugauccaggagggggccgagcccuucccggugggccgcagcucccuccuggucggcaaccugaagaagaaguacgcccagggguuccuccccgagaagcugccccagcaggaccacaccaccaccacggacagcgagauggaggagcccuaccugcaggaguccaaggaggagggcgccccgcucaagcugaagugcgagcugugcgggcggguggacuucgcguacaaguucaagcgcagcaagcgguucugcuccauggccugcgccaagcgcuacaacgugggcugcaccaagcgggucggccucuuccacagcgaccgcuccaagcugcagaaggccggggcggccacccacaaccggcgccgggccagcaaggccucccugccgccccucaccaaggacacgaagaagcagcccaccggcaccgugccccugagcgugaccgccgcgcugcagcucacgcacucccaggaggacagcucccgcugcagcgacaacuccagcuacgaggagccccugagccccaucuccgccagcuccagcaccucccggcgccggcaggggcagcgcgaccuggagcuccccgacaugcacaugcgggaccuggucggcauggggcaccacuuccugccgagcgagcccaccaaguggaacguggaggacguguacgaguucauccgcucccuccccgaguacccccaccggcaccagaucccggacagccugguccccuga

SEQ ID NO: 34516 - RNA, 2988 nt, Artificial Sequence
  derived and/or modified sequence opt1 from PHC3__Homo_sapiens__NP_079223
auggccgaggccgaguucaaggaccacagcaccgcgauggacaccgagcccaacccgggcacguccagcguguccaccaccaccagcuccacgaccaccaccacgaucaccaccagcuccagccgcaugcagcagccccagaucuccgucuacagcggguccgaccggcacgccguccaggugauccagcaggcccugcaccgcccgcccagcuccgccgcccaguaccuccagcagauguacgcggcccagcagcagcaccugaugcugcacaccgccgcccuccagcagcagcaccugagcuccagccagcugcagucccucgcggccguccaggccagccuguccagcggccggcccagcacgucccccaccgggagcgugacccagcaguccagcaugucccagaccagcaucaaccuguccacgagccccacccccgcccagcucaucucccgcagccaggccuccagcuccaccagcggcuccaucacccagcagacgaugcugcuggggagcaccuccccgacccucaccgcgagccaggcccagauguaccugcgggcccagaugcugaucuucacgcccgccaccaccguggccgcgguccaguccgacauccccguggugagcagcuccagcuccagcuccugccagagcgccgccacccagguccagaaccucacgcugcgcucccagaagcugggcgugcucagcuccagccagaacgggcccccgaaguccaccagccagacccagucccugaccaucugccacaacaagacgaccgugaccagcuccaagaucagccagcgggaccccucccccgagagcaacaagaagggcgagagccccucccuggagagccgcuccaccgccgucacgcggaccagcuccauccaccagcucaucgccccggcgagcuacucccccauccagccccacagccugaucaagcaccagcagaucccccugcacuccccgcccagcaaggugucccaccaccagcucauccugcagcagcagcagcagcagauccagcccaucacccugcagaacagcacccaggacccgccgcccucccagcacugcaucccccuccagaaccacggccugccgcccgcccccagcaacgcccagucccagcacugcagccccauccagucccaccccagcccccugaccgugucccccaaccagagccagagcgcccagcaguccgugguggugagcccgcccccgccccacucccccagccagucccccacgaucaucauccacccccaggcccucauccagccccacccccuggucagcuccgcgcugcagccggggcccaaccuccagcagagcaccgccaaccaggugcaggccaccgcccagcugaaccugcccucccaccucccccugccggcgagccccgugguccacaucggccccgugcagcaguccgcccuggugagccccgggcagcagaucgucuccccgagccaccagcaguacuccagccuccaguccagccccauccccaucgccagcccgccccagauguccaccagcccgcccgcccagaucccgccccugccccugcaguccaugcagagccuccaggugcagcccgagauccugucccagggccagguccuggugcagaacgcccucgugagcgaggaggagcugcccgcggccgaggcccugguccagcuccccuuccagacgcugcccccgccccagaccguggccgugaaccugcagguccagccgcccgcccccguggacccgcccguggucuaccagguggaggacgugugcgaggaggagaugcccgaggaguccgacgagugcguccgcauggaccggacgcccccgccgcccacccugagccccgcggccaucaccgugggccgcggggaggaccucaccuccgagcacccccugcuggagcaggucgagcuccccgccguggccagcguguccgccagcgugaucaagucccccagcgaccccucccacgucagcgugcccccgccgccccugcugcuccccgcggccaccacccgguccaacagcacguccaugcacagcuccauccccagcaucgagaacaagccgccccaggccaucgugaagccccagauccugacccacgucaucgagggcuucgugauccaggaggggcuggagcccuuccccgugagccgcuccagccuccugaucgagcagcccgucaagaagcggccccugcucgacaaccaggugaucaacuccgugugcguccagcccgagcugcagaacaacaccaagcacgccgacaacagcuccgacaccgagauggaggacaugaucgcggaggagacgcuggaggagauggacagcgagcuccugaagugcgaguucugcggcaagaugggcuacgccaacgaguuccugcgcuccaagcgguucugcaccaugagcugcgccaagcgcuacaacguguccugcagcaagaaguucgcccucucccgguggaaccgcaagcccgacaaccagagccuggggcaccggggccgccgcccguccgggcccgacggcgccgcgcgggagcacauccugcgccagcuccccaucaccuaccccagcgccgaggaggaccuggccucccacgaggacagcgugccguccgccaugaccacgcggcugcgccggcagagcgagcgcgagcgggagcgcgagcuccgggacguccgcauccggaagaugcccgagaacuccgaccugcugcccguggcccagaccgagcccagcaucuggaccguggacgacgucugggcguucauccacagccucccggggugccaggacaucgccgacgaguuccgcgcccaggagaucgacggccaggcccugcugcuccugaaggaggaccaccugauguccgccaugaacaucaagcucggccccgcgcugaagaucugcgcccggaucaacagccugaaggaguccuga

SEQ ID NO: 34517 - RNA, 2250 nt, Artificial Sequence
  derived and/or modified sequence opt1 from PHEX__Homo_sapiens__NP_000435
auggaggccgagaccggcagcuccguggagaccgggaagaaggccaaccgcggcacgcggaucgcgcuggugguguucgucgggggcacccucgugcuggggaccauccuguuccucgugagccagggccugcugucccuccaggccaagcaggaguacugccugaagcccgagugcaucgaggccgccgccgcgauccugagcaaggugaaccucuccgucgacccgugcgacaacuucuuccgcuucgccugcgacggcuggaucagcaacaaccccauccccgaggacaugcccuccuacgggguguacccguggcugcggcacaacguggaccugaagcucaaggagcugcuggagaaguccaucagccgccggcgcgacaccgaggccauccagaaggccaagauccucuacagcuccugcaugaacgagaaggcgaucgagaaggccgacgccaagccccugcugcacauccuccggcacagccccuuccgcuggcccguccuggaguccaacaucggcccggaggggguguggagcgagcggaaguucucccugcuccagacgcuggccaccuuccgcggccaguacagcaacuccguguucauccggcuguacgucagccccgacgacaaggccuccaacgagcacauccucaagcuggaccaggcgacccugagccucgccgugcgcgaggacuaccuggacaacagcaccgaggccaaguccuaccgggacgcccuguacaaguucaugguggacacggccguccuccugggggcgaacagcucccgcgccgagcacgacaugaaguccgugcugcggcucgagaucaagaucgccgagaucaugaucccccacgagaaccgcaccagcgaggccauguacaacaagaugaacaucagcgagcuguccgccaugaucccccaguucgacuggcugggcuacaucaagaaggugaucgacacccggcucuacccgcaccugaaggacaucagccccuccgagaacgucguggugcgcgucccccaguacuucaaggaccuguuccggauccucggcagcgagcgcaagaagaccaucgcgaacuaccugguguggcggaugguguacucccgcauccccaaccugagccgccgguuccaguaccgcuggcucgaguucucccgggucauccaggggacgaccacccugcugccgcagugggacaagugcgugaacuucaucgagagcgcccuccccuacgucgugggcaagauguucguggacgucuacuuccaggaggacaagaaggagaugauggaggagcugguggagggggugcgcugggccuucaucgacaugcuggagaaggagaacgaguggauggacgccggcaccaagcggaaggccaaggagaaggcgcgcgccguccucgccaaggugggcuaccccgaguucaucaugaacgacacgcacgugaacgaggaccugaaggccaucaaguucuccgaggcggacuacuucgggaacguccugcagacccggaaguaccuggcccagagcgacuucuucuggcuccgcaaggccgugcccaagaccgagugguucaccaacccgacgaccgugaacgccuucuacuccgccagcaccaaccagauccgguuccccgcgggcgagcugcagaagcccuucuucugggggaccgaguacccccgcucccugagcuacggcgccaucggggucaucgugggccacgaguucacgcacggcuucgacaacaacgggcggaaguacgacaagaacggcaaccucgacccgugguggagcaccgaguccgaggagaaguucaaggagaagaccaagugcaugaucaaccaguacagcaacuacuacuggaagaaggccgggcugaacgugaagggcaagcgcacccugggggagaacaucgccgacaacggcggccuccgggaggccuuccgcgcguaccggaaguggaucaacgaccgccggcaggggcuggaggagccccugcuccccggcaucacguucaccaacaaccagcuguucuuccuguccuacgcccacguccgcugcaacagcuaccggcccgaggccgcccgcgagcagguccagaucggggcccacuccccgccccaguuccgcgugaacggcgcgaucagcaacuucgaggaguuccagaaggccuucaacugcccgcccaacuccaccaugaaccgggggauggacagcugccgccucugguga

SEQ ID NO: 34518 - RNA, 1497 nt, Artificial Sequence
  derived and/or modified sequence opt1 from PHF10__Homo_sapiens__NP_060758
auggccgccgcggccggccccggggccgcccugagcccgcgccccugcgacuccgaccccgccacccccggcgcgcagagcccgaaggacgacaacgaggacaacuccaacgacgggacccagcccagcaagcggcgccggaugggcuccggggacagcucccgcagcugcgagaccuccagccaggaccucggcuucuccuacuaccccgccgagaaccugaucgaguacaaguggcccccggacgagaccggcgaguacuacaugcugcaggagcaggucagcgaguaccucggggugaccuccuucaagcggaaguaccccgaccuggagcgccgggaccugagccacaaggagaagcucuaccugcgcgagcugaacgugaucaccgagacgcagugcacccucggccugaccgcccugcgguccgacgaggugaucgaccucaugaucaaggaguaccccgccaagcacgcggaguacagcgucauccugcaggagaaggagcgccagcggaucaccgaccacuacaaggaguacucccagaugcagcagcagaacacgcagaagguggaggccagcaaggugcccgaguacaucaagaaggccgccaagaaggccgcggaguucaacuccaaccugaaccgcgagcggauggaggagcgccgggccuacuucgaccuccagacccacgucauccaggugccgcaggggaaguacaaggugcugcccaccgagcgcaccaaggucagcagcuaccccguggcccugauccccggccaguuccaggaguacuacaagcgguacuccccggacgagcuccgcuaccugccccugaacacggcccucuacgagccgccccuggaccccgagcugcccgcccucgacagcgacggggacuccgacgacggcgaggacggccgcggggacgagaagcggaagaacaagggcaccagcgacuccagcuccgggaacgugagcgagggcgaguccccgcccgacagccaggaggacuccuuccagggccggcagaaguccaaggacaaggcggccacgccccgcaaggacgggcccaagcgcagcguccugagcaaguccgugcccggcuacaagcccaaggugaucccgaacgccaucugcgggaucugccugaagggcaaggagagcaacaagaaggggaaggccgagucccucauccacugcagccagugcgagaacuccggccaccccagcugccuggacaugaccauggagcuggucagcaugaucaagaccuaccccuggcagugcauggagugcaagaccugcaucaucugcggccagccgcaccacgaggaggagaugauguucugcgacaugugcgaccggggguaccacaccuucugcgugggccucggggccauccccuccggccgcuggaucugcgacugcugccagcgggcgccgcccacgccccgcaagguggggcggcgcggcaagaacagcaaggagggcuga

SEQ ID NO: 34519 - RNA, 996 nt, Artificial Sequence
  derived and/or modified sequence opt1 from PHF11__Homo_sapiens__NP_001035533
auggcccaggccagcccgccccgccccgagcgggugcugggcgcguccagccccgaggcccgccccgcccaggaggcccuccugcugccgaccggggucuuccagguggccgagaagauggagaagcggaccugcgcgcucugccccaaggacguggaguacaacguccuguacuucgcccaguccgagaacaucgccgcccacgagaacugccugcucuacagcuccggccugguggagugcgaggaccaggacccccugaaccccgaccgcagcuucgacguggaguccgucaagaaggagauccagcgggggcgcaagcucaagugcaaguucugccacaagcggggcgcgacgguggggugcgaccugaagaacugcaacaagaacuaccacuucuucugcgccaagaaggacgacgccgugccgcagagcgacggcguccgcggcaucuacaagcugcucugccagcagcacgcccaguuccccaucaucgcccaguccgcgaaguucagcggggugaagcggaagcgcggccggaagaagccccuguccgggaaccacgugcagcccccggagaccaugaagugcaacaccuucauccgccaggucaaggaggagcacggccggcacaccgacgccacggugaaggugcccuuccugaagaagugcaaggaggccgggcuccugaacuaccugcucgaggagauccuggacaagguccacagcauccccgagaagcugauggacgagaccaccuccgagagcgacuacgaggagaucggcuccgcccucuucgacugccgccuguucgaggacaccuucgugaacuuccaggccgcgaucgagaagaagauccacgccagccagcagcgguggcagcagcugaaggaggagaucgagcuccugcaggaccugaagcagacgcucugcuccuuccaggagaaccgcgaccugaugagcuccagcaccagcaucuccagccuguccuacuga

SEQ ID NO: 34520 - RNA, 3015 nt, Artificial Sequence
  derived and/or modified sequence opt1 from PHF12__Homo_sapiens__NP_001028733
augugggagaagauggagaccaagaccaucguguacgaccuggacacgagcggcgggcucauggagcagauccaggcccugcuggcccccccgaagaccgacgaggcggagaagcgcucccggaagcccgagaaggagccccgccggagcggccgcgccaccaaccacgacuccugcgacagcugcaaggaggggggcgaccuccugugcugcgaccacugccccgccgccuuccaccugcagugcugcaacccgccccucuccgaggagaugcugccccccggggaguggaugugccaccggugcaccguccgccggaagaagcgcgagcagaagaaggagcugggccacgugaacggccucguggacaagagcgggaagcggacgaccuccccgagcuccgacaccgaccugcuggaccgcagcgccuccaagaccgagcucaaggcgaucgcccacgcccggauccuggagcgccgggccagccgccccggcacgcccaccuccagcgcguccaccgagacccccacgagcgagcagaacgacgucgacgaggacaucaucgacguggacgaggagccgguggccgccgagcccgacuacguccagccccagcugcggcgccccuucgagcuccugaucgccgccgcgauggagcggaacccgacccaguuccagcugcccaacgagcucaccugcaccacggcccugcccggguccagcaagcgccggcgcaaggaggagaccaccggcaagaacgugaagaagacccagcacgagcuggaccacaacgggcucgugccccugccggucaaggugugcuucacgugcaaccgguccugccgcguggccccccugauccagugcgacuacugcccccuccuguuccacauggacugccuggagcccccgcucaccgccaugccccugggccgcuggaugugccccaaccacaucgagcacgucgugcugaaccagaagaacaugacccucagcaaccggugccagguguucgaccgcuuccaggacaccgucagccagcacguggugaaggucgacuuccugaaccggauccacaagaagcaccccccgaaccgccgggugcugcaguccgugaagcgccggagccucaagguccccgacgccaucaagucccaguaccaguuccccccgccccugaucgcgcccgccgccauccgcgacggcgagcugaucugcaacgggauccccgaggagagccagaugcaccuccugaacuccgagcaccuggccacgcaggccgagcagcaggaguggcucugcagcgugguggcgcugcagugcuccauccugaagcaccucagcgccaagcagaugccgucccacugggacagcgagcagaccgagaaggccgacaucaagcccgucaucgugaccgacuccagcgucaccacgucccugcagaccgccgacaagacccccacccccagccacuacccgcuguccugccccagcggcaucuccacgcagaacagccucuccugcagccccccccaccagagcccggcccuggaggacaucgggugcuccagcugcgcggagaaguccaagaagacccccugcggcaccgccaacggccccgugaacaccgaggugaaggccaacgggccccaccuguacagcuccccgacggacagcaccgacccccggcgccuccccggcgccaacaccccccugccggggcugucccaccggcagggcuggccccgcccccugacccccccggcggccgggggccuccagaaccacaccgucggcaucaucgugaagacggagaacgccaccgggcccagcuccugcccccagcggagccuggugccgguccccucccugccccccagcaucccguccagcugcgccuccaucgagaacaccagcacccuccagcgcaagacggugcagucccagaucggccccccccugaccgacagccggccccuggggagcccgcccaacgccacccgcgugcucacccccccccaggcggccggcgacgggauccuggccacgaccgccaaccagcgguucuccagcccggcccccuccagcgacggcaaggucucccccggcacccugagcaucggguccgcgcucaccgugcccagcuucccggccaacuccacggccaugguggaccugaccaacagccugcgcgccuucauggacgucaacggcgagaucgagaucaacaugcucgacgagaagcugaucaaguuccuggcccuccagcggauccaccagcuguuccccucccgcgugcagcccagccccggguccgugggcacccaccagcuggcgagcgggggccaccacaucgagguccagcgcaaggaggugcaggcccgggccguguucuacccgcuccugggccuggggggcgccgucaacaugugcuaccgcacccucuacaucgggacgggcgcggacauggacgugugccugaccaacuacggccacugcaacuacguguccgggaagcacgccugcaucuucuacgacgagaacaccaagcacuacgagcugcucaacuacagcgagcacggcaccacggucgacaacgugcuguacuccugcgacuucagcgagaagaccccccccacccccccguccagcaucguggccaagguccagagcgugauccggcgccggcgccaccagaagcaggacgaggagcccuccgaggaggccgccaugaugagcucccaggcgcaggggccccagcggcgccccugcaacugcaaggccagcuccagcucccugaucggcgggagcggcgccggcugggaggggaccgcccuccugcaccacggcuccuacaucaagcuggggugccuccaguucguguucagcaucacggaguucgccaccaagcagccgaagggcgacgcgucccugcugcaggacgggguccucgccgagaagcugagccugaagccccaccagggccccgugcuccgguccaacagcgugccguga

SEQ ID NO: 34521 - RNA, 624 nt, Artificial Sequence
  derived and/or modified sequence opt1 from PHF19__Homo_sapiens__NP_001009936
auggagaaccgcgcccuggaccccggcacccgggacagcuacggggccaccucccaccucccgaacaagggcgcgcuggccaaggugaagaacaacuucaaggaccugaugagcaagcucacggaggggcaguacguccugugccgcuggaccgacggccuguacuaccucgggaagaucaagcggguguccagcuccaagcagagcugccuggugaccuucgaggacaacuccaaguacuggguccuguggaaggacauccagcacgccggcgugcccggcgaggagcccaagugcaacaucugccucgggaagaccagcggcccccugaacgagauccugaucugcgggaagugcggccucggguaccaccagcagugccacaucccgaucgccggcuccgccgaccagccccugcugacgcccugguucugccgccggugcaucuucgcgcucgccgugcgcgucagccugcccuccagcccggugcccgccucccccgccagcuccagcggcgcggaccagcggcugcccucccagagccucuccagcaagcagaaggggcacaccugggcccuggagaccgacagcgccuccgccaccgugcugggccaggaccucuga

SEQ ID NO: 34522 - RNA, 1374 nt, Artificial Sequence
  derived and/or modified sequence opt1 from PHF1__Homo_sapiens__NP_002627
auggcccagcccccgcgccugagccgguccggcgccagcucccucugggaccccgcgagccccgcccccaccuccgggccgcgcccccggcugugggagggccaggacgugcuggcccgcuggaccgacgggcuccuguaccugggcacgaucaagaaggucgacagcgcccgggaggugugccucgugcaguucgaggacgacucccaguuccugguccuguggaaggacaucagccccgccgcgcuccccggggaggagcugcugugcugcgugugccgcuccgagaccguggucccgggcaaccggcucgugagcugcgagaagugccgccacgccuaccaccaggacugccacgugccccgggcccccgcccccggcgagggggagggcaccuccugggucugccgccagugcguguucgcgaucgccaccaagcgcgggggcgcccugaagaaggggcccuacgcccgggccaugcugggcaugaagcucagccugcccuacggccugaaggggcucgacugggacgccggccaccuguccaaccggcagcagagcuacugcuacugcgggggccccggcgaguggaaccugaagaugcuccagugccgcuccugccugcagugguuccacgaggccugcacgcagugccugagcaagccccuccuguacggggaccgguucuacgaguucgagugcugcgugugccgcggcgggccggagaagguccggcgccugcagcuccgguggguggacguggcccaccugguccuguaccaccucuccgugugcugcaagaagaaguacuucgacuucgaccgcgagauccugcccuucaccagcgagaacugggacucccugcuccugggcgagcugagcgacacccccaagggggagcggagcuccaagcuccugagcgcccugaacucccacaaggaccgcuucaucagcggccgcgagaucaagaagcggaagugccucuucggccugcacgcccgcaugcccccgcccguggagccgcccaccggggacggcgcgcugacgcgggccgggcccuggggccgcgggcucaccucccccggcgaggcccccgaggccggcgcccgggcgcccgaggaggaggccgagggggagagcggcggggccggcgccacccuguccagcgcccaguccgcgcgcgccccgggggccgagggcgccggcagcuccgcggaggggaccgccgccgcccccagcggcugccugcuccccuccacgcugcugccggcgccccaggggccccucggcaccgucgacccccagaccggccacccguggaacuucacccuggugagcccccagacgucccugaaggugccgcccacccgguga

SEQ ID NO: 34523 - RNA, 3039 nt, Artificial Sequence
  derived and/or modified sequence opt1 from PHF20__Homo_sapiens__NP_057520
augaccaagcacccgcccaaccgccggggcaucagcuucgaggugggggcccagcuggaggcccgcgaccggcucaagaacugguaccccgcgcacaucgaggacaucgacuacgaggagggcaagguccugauccacuucaagcgcuggaaccaccgguacgacgagugguucugcugggacucccccuaccugcgcccccucgagaagauccagcugcggaaggaggggcugcacgaggaggacggcagcuccgaguuccagaucaacgagcagguccucgccugcuggagcgacugccgcuucuacccggccaaggugaccgccgugaacaaggacgggacguacaccgugaaguucuacgacggcgugguccagaccgugaagcacauccacgugaaggccuucuccaaggaccagaacaucgucggcaacgcgcggcccaaggagaccgaccacaagagccuguccagcucccccgacaagcgcgagaaguucaaggagcagcggaaggccacggugaacgugaagaaggacaaggaggacaagccccugaagaccgagaagcgcccgaagcagcccgacaaggaggggaagcucaucugcagcgagaagggcaaggucuccgagaagucccugcccaagaacgagaaggaggacaaggagaacaucagcgagaacgaccgggaguacagcggggacgcccagguggacaagaagcccgagaacgacaucgugaaguccccgcaggagaaccugcgcgagcccaagcggaagcgcggccggccgcccagcaucgcccccaccgcggucgacuccaacagccagacccuccagcccaucacgcuggagcugcgccggcgcaagaucuccaaggggugcgaggugccccucaagcggccccgccuggacaagaacagcagccaggagaaguccaagaacuacagcgagaacaccgacaaggaccugucccgccggcgcagcucccggcucagcaccaacggcacccacgagauccuggacccggaccugguggucuccgaccucguggacacggacccccugcaggacacccugagcuccaccaaggagagcgaggagggccagcucaaguccgcccuggaggccggccaggugagcuccgcccugaccugccacagcuucggggacggguccggcgccgcgggccucgagcugaacugccccagcaugggggagaacacgaugaagaccgagcccaccuccccgcuggucgagcuccaggagaucagcaccguggaggugacgaacaccuucaagaagaccgacgacuucggcuccagcaacgcccccgccgucgaccuggaccacaaguuccgcugcaagguggucgacugccugaaguucuuccggaaggccaagcuccugcacuaccacaugaaguacuuccacgggauggagaagucccuggagcccgaggagagccccggcaagcgccacgugcagacccgggggccgagcgccuccgacaagcccagccaggagacgcucacccgcaagcggguguccgcgagcucccccaccaccaaggacaaggagaagaacaaggagaagaaguucaaggaguucguccgcgugaagccgaagaagaagaagaagaagaagaagaagacgaagcccgagugccccugcagcgaggagaucuccgacaccagccaggagcccuccccgcccaaggccuucgccgugacccggugcggcagcucccacaagcccggcguccacaugagcccccagcugcacgggccggaguccggccaccacaaggggaaggugaaggcccuggaggaggacaaccucagcgaguccagcagcgaguccuuccuguggagcgacgacgaguacggccaggacguggacgucaccacgaaccccgacgaggagcuggacggggacgaccgcuacgacuucgagguggugcggugcaucugcgagguccaggaggagaacgacuucaugauccagugcgaggagugccagugcuggcagcacggcgugugcaugggccuccuggaggagaacgugcccgagaaguacacgugcuacgucugccaggacccgcccgggcagcgccccggcuucaaguacugguacgacaaggaguggcugucccgggggcacaugcacggccucgccuuccuggaggagaacuacagccaccagaacgcgaagaagaucguggccacccaccagcugcucggggacgugcagcgcgucaucgaggugcugcacggccugcagcugaagauguccauccuccagagccgggagcaccccgaccugccccuguggugccagccguggaagcagcacuccggcgaggggcgcagccacuuccggaacauccccgugaccgacacccgcuccaaggaggaggcccccagcuaccgcacccucaacggcgccgucgagaagccccggccgcuggcccugccccucccccgcuccguggaggagagcuacaucaccuccgagcacugcuaccagaagccccgggcguacuacccggccguggagcagaagcuggucguggagacccgcgggagcgcccuggacgacgccgugaacccccuccacgagaacggcgacgacucccugagcccccggcugggcuggccgcucgaccaggaccgcuccaagggggacagcgaccccaagcccggcucccccaaggucaaggaguacgugagcaagaaggcgcugccggaggaggcccccgcccggaagcugcucgaccgcgggggcgaggggcugcugagcucccagcaccaguggcaguucaaccuccugacccacguggagagccugcaggacgaggucacgcaccggauggacuccaucgagaaggagcucgacgugcuggagagcuggcuggacuacaccggcgagcucgagccgcccgagccccuggcccgccugccccagcucaagcacugcaucaagcagcugcugauggaccucggcaaggugcagcagaucgcccugugcugcuccaccuga

SEQ ID NO: 34524 - RNA, 2043 nt, Artificial Sequence
  derived and/or modified sequence opt1 from PHF21A__Homo_sapiens__NP_001095272
auggagcugcagacccuccaggaggcccugaagguggagauccagguccaccagaagcugguggcccagaugaagcaggacccccagaacgcggaccucaagaagcagcugcacgagcugcaggccaagaucaccgcccucagcgagaagcagaagcgcguggucgagcagcugcggaagaaccugaucgugaagcaggagcagccggacaaguuccagauccagccccucccccaguccgagaacaagcugcagacggcccagcagcagccccugcagcagcuccagcagcagcagcaguaccaccaccaccacgcccagcagagcgcggccgccuccccgaaccugaccgccagccagaagaccgugaccacggcguccaugaucaccaccaagacccugccccucguccugaaggccgccacggccaccaugcccgccagcguggugggccagcgccccaccaucgcgauggucaccgccaucaacucccagaaggccgugcugagcacggacgugcagaacaccccggucaaccuccagaccuccagcaaggugaccgggcccggcgccgaggccgugcagaucgucgcgaagaacacggugacccuggugcaggccaccccgccccagcccaucaaggucccccaguucaucccgccgccccggcugacgccccgccccaacuuccucccccaggugcggcccaagcccguggcccagaacaacauccccaucgcccccgccccgccgcccaugcuggcggcgccccagcugauccagcgccccgucaugcucaccaaguucacccccaccacccugcccacgucccagaacagcauccacccggugcggguggucaacgggcagaccgccaccaucgccaagaccuuccccauggcccagcugacguccaucgugaucgccacccccggcacccgccucgccgggccccagaccguccagcugagcaagccgucccuggagaagcagacggucaagagccacaccgagaccgacgagaagcagaccgagucccggacgaucaccccgcccgccgcccccaagcccaagcgcgaggagaacccccagaagcucgcguucauggugagccugggccuggugacccacgaccaccucgaggagauccaguccaagcggcaggagcgcaagcggcgcaccaccgccaaccccguguacagcggcgccguguucgagcccgagcggaagaaguccgccgucacguaccugaacagcaccaugcacccggggacccgcaagcggggccgcccgcccaaguacaacgccgugcugggguucggcgcgcucacccccacgagcccccaguccagccaccccgacucccccgagaacgagaagaccgagaccaccuucacguuccccgccccggugcagcccgucagccugcccucccccaccagcaccgacggggacauccacgaggacuucugcuccgugugccgcaagagcggccagcugcucaugugcgacacgugcucccggguguaccaccuggacugccuggacccgccccucaagaccauccccaagggcauguggaucugcccgcggugccaggaccagaugcugaagaaggaggaggccauccccuggcccgggacccuggccaucguccacagcuacaucgccuacaaggcggccaaggaggaggagaagcagaagcuccugaagugguccagcgaccugaagcaggagcgcgagcagcucgagcagaaggugaagcagcuguccaacagcaucuccaagugcauggagaugaagaacaccauccuggcccgccagaaggagaugcacagcucccuggagaaggugaagcagcucauccggcugauccacggcaucgaccugagcaagcccgucgacagcgaggccaccgugggggccaucuccaacggcccggacugcacgccgcccgcgaacgccgccaccagcacccccgcccccucccccagcucccagagcugcaccgcgaacugcaaccagggcgaggagacgaaguga

SEQ ID NO: 34525 - RNA, 1200 nt, Artificial Sequence
  derived and/or modified sequence opt1 from PHF23__Homo_sapiens__NP_001271447
augcccggcgacugccgccgggacccgccccccacccugaagcccgagacccagccgcccgagaagcgccggcgcacgaucgaggacuucaacaaguucugcagcuucgugcucgccuacgccggguacaucccccccuccaaggaggagagcgacuggccggcguccggcagcuccagcccccugcggggggaguccgccgccgacagcgacggcugggacuccgcccccagcgaccugcgcaccauccagaccuucgucaagaaggccaaguccagcaagcggcgcgcggcccaggccgggcccacccagccgggccccccccgguccacguucagccgccuccaggcccccgacuccgcgacccugcuggagaagaugaagcucaaggacagccuguucgaccuggacggcccgaagguggccuccccccucagccccaccucccugacccacacgagccggcccccggccgcccugacccccgugccccucagccagggggaccugucccaccccccgcgcaagaaggaccggaagaaccgcaagcugggccccggggccggcgcgggguucggcguccuccggcgcccccggcccaccccgggcgacggggagaagcgcagccggaucaagaaguccaagaagcgcaagcugaagaaggccgagcggggcgaccgccugccccccccggggcccccccaggcccccccgagcgacaccgacuccgaggaggaggaggaggaggaggaggaggaggaggaggaggagauggccacgguggugggcggcgaggcccccguccccgugcuccccaccccgcccgaggcgccccgccccccggccaccgugcaccccgagggggucccccccgccgacagcgaguccaaggaggugggcagcaccgagacgucccaggacggggacgccagcuccagcgagggcgagaugcgggugauggacgaggacaucauggucgaguccggggacgacagcugggaccugaucaccugcuacugccgcaagccguucgccggccggcccaugaucgagugcucccugugcggcaccuggauccaccucagcugcgcgaagaucaagaagaccaacgugcccgacuucuucuacugccagaagugcaaggagcugcgccccgaggcccggcgccuggggggcccgcccaaguccggggagcccuga

SEQ ID NO: 34526 - RNA, 3291 nt, Artificial Sequence
  derived and/or modified sequence opt1 from PHF2__Homo_sapiens__NP_005383
auggccaccgugcccgucuacugcgugugccgccugccguacgacgugacccgguucaugaucgagugcgacgccugcaaggacugguuccacggcagcugcgucgggguggaggaggaggaggcgcccgacaucgacaucuaccacugccccaacugcgagaagacgcacggcaaguccacccucaagaagaagcgcaccuggcacaagcacgggcccggccaggccccggacgugaagcccguccagaacgggagccagcuguucaucaaggagcugcggucccgcaccuuccccagcgccgaggacgugguggcccggguccccggcucccagcucacgcugggcuacauggaggagcacggguucaccgagccgauccuggugcccaagaaggacggccucgggcuggccgugcccgcgcccaccuucuacgucagcgacguggagaacuacgugggcccggagcgcuccgucgacgugaccgacgugacgaagcagaaggacugcaagaugaagcugaaggaguucgucgacuacuacuacagcaccaaccggaagcgcgugcucaacgugaccaaccuggaguucuccgacacccggaugagcuccuucgucgagccgcccgacaucgugaagaagcugagcuggguggagaacuacuggcccgacgacgcccuccuggccaagcccaaggucacgaaguacugccugaucugcgugaaggacuccuacaccgacuuccacaucgacagcgggggcgccuccgcgugguaccacguccucaagggcgagaagaccuucuaccugauccgccccgccagcgccaacaucucccuguacgagcgguggcgcagcgccuccaaccacagcgagauguucuucgccgaccagguggacaagugcuacaagugcaucgugaagcaggggcagacccucuucauccccagcggcuggaucuacgcgacgcugacccccgucgacugccuggccuucgccgggcacuuccuccacucccugagcguggagaugcagaugcgggccuacgagguggagcgccggcugaagcucggcucccugacccaguucccgaacuucgagaccgccugcugguacaugggcaagcaccuccuggaggcguucaaggggagccacaaguccggcaagcagcugccgccccaccugguccagggggccaagauccucaacggcgccuuccgcagcuggacgaagaagcaggcccuggccgagcacgaggacgagcugcccgagcacuucaagcccucccagcucaucaaggaccuggcgaaggagauccggcugagcgagaacgccuccaaggccgugcgccccgaggugaacaccgucgccagcuccgacgaggugugcgacggggaccgggagaaggaggagccgcccagccccaucgaggccaccccgccccagucccuccuggagaaggugagcaagaagaagacccccaagacggucaagaugcccaagcccuccaagauccccaagccgcccaagccgcccaagccgccccggccgcccaagacccugaagcucaaggacggcggcaagaagaaggggaagaagucccgcgagagcgcgagccccaccauccccaaccuggaccugcucgaggcccacaccaaggaggcccugacgaagauggagccgcccaagaagggcaaggccaccaaguccgugcugagcgugcccaacaaggacgucgugcacaugcagaacgacguggagcgccucgagauccgcgagcagaccaagagcaaguccgaggcgaaguggaaguacaagaacagcaagcccgacucccugcugaagauggaggaggagcagaagcucgagaaguccccgcuggccgggaacaaggacaacaaguucagcuucagcuucuccaacaagaagcugcugggcagcaaggcccuccggccgcccaccucccccggggucuucggcgcccugcagaacuucaaggaggacaagcccaagcccgugcgcgacgaguacgaguacgugagcgacgacggcgagcugaagaucgacgaguuccccauccggcgcaagaagaacgcccccaagcgggaccucuccuuccugcuggacaagaaggcgguccuccccacgcccgugaccaagcccaagcuggacagcgccgccuacaaguccgacgacagcuccgacgaggggagccugcacaucgacaccgacaccaagcccggccgcaacgcccgggugaagaaggaguccgggagcagcgccgcgggcauccucgaccugcugcaggccuccgaggaggucggggcccucgaguacaaccccagcucccagccgcccgccagccccuccacgcaggaggccauccagggcaugcugagcauggcgaaccugcaggccuccgacagcugccuccagaccaccuggggcgccgggcaggccaagggcuccagccuggcggcccacggggcccgcaagaacggcggcggguccggcaagagcgccgggaagcggcugcucaagcgcgccgcgaagaacuccguggaccuggacgacuacgaggaggagcaggaccaccuggacgccugcuucaaggacagcgacuacguguaccccucccucgagagcgacgaggacaacccgaucuucaagucccggagcaagaagcgcaagggcuccgacgacgcccccuacagccccaccgcccgggucgggcccagcgugccgcgccaggaccggcccgugcgcgagggcacccgggucgccuccaucgagacgggccuggcggccgccgccgccaagcugagccagcaggaggagcagaaguccaagaagaagaaguccgcgaagcgcaagcucacccccaacaccaccagccccagcacguccaccagcaucuccgccgggaccaccagcacguccaccaccccggccagcaccacgcccgccuccaccacccccgcgagcaccuccacggccagcucccaggccagccaggagggcuccagccccgagccgccgcccgagagccacuccagcucccuggccgaccacgaguacaccgccgcggggaccuucaccggcgcccaggccgggcggacgagccagcccauggcccccggcguguuccugacccagcgccgccccuccgccagcucccccaacaacaacaccgcggccaagggcaagcggaccaagaaggggauggccacggccaagcagcgccucggcaagauccugaagauccaccggaacgggaagcugcuccuguga

SEQ ID NO: 34527 - RNA, 2211 nt, Artificial Sequence
  derived and/or modified sequence opt1 from PHF3__Homo_sapiens__NP_001277189
auggacaucguggacaccuucaaccaccugauccccaccgagcaccucgacgacgcccuguuccugggcagcaaccucgagaacgaggucugcgaggacuucuccgccagccagaacgugcuggaggacucccugaagaacaugcucagcgacaaggacccgaugcugggguccgcgagcaaccaguucugccugcccgugcucgacuccaacgaccccaacuuccagaugcccugcagcacggucgugggccuggacgacaucauggacgaggggguggucaaggaguccggcaacgacaccaucgacgaggaggagcugauccucccgaaccgcaaccugcgggacaagguggaggagaacagcgugcgcagcccccgcaagagcccccggcugauggcccaggagcagguccggucccuccgccagagcaccaucgccaagcgguccaacgccgcgccccugagcaacaccaagaaggccuccgggaagacggugagcaccgccaaggccggcgugaagcagccggagcgcucccaggucaaggaggaggugugcaugagccugaagcccgaguaccacaaggagaaccggcgcugcagccggaacuccggccagaucgaggugguccccgaggugagcguguccagcucccacagcuccgucagcuccugccucgagaugaaggacgaggacgggcuggacagcaagcacaagugcaacaaccccggcgagaucgacgugccgucccacgagcugaacugcagccuccuguccgagaccugcgugaccaucggggagaagaagaacgaggcccugauggagugcaaggcgaagcccgucggcagcccccucuucaaguucuccgacaaggaggagcacgagcagaacgacagcaucuccgggaagacgggcgagaccgugguggaggagaugaucgccacccgcaaggucgagcaggacagcaaggagaccgugaagcugucccacgaggacgaccacauccuggaggacgccggcagcagcgacaucuccagcgacgccgccugcacgaaccccaacaagaccgagaacucccucgucgggcugccgagcugcguggacgaggugaccgagugcaaccuggagcucaaggacaccaugggcaucgcggacaagacggagaacacccuggagcggaacaagaucgagccccugggguacugcgaggacgccgaguccaaccgccagcucgagagcaccgaguucaacaaguccaaccuggaggucguggacaccagcacguucggccccgaguccaacauccuggagaacgccaucugcgacgugcccgaccagaacagcaagcagcucaacgccaucgaguccaccaagaucgagagccacgagaccgccaaccugcaggacgaccggaacucccagagcuccagcgucuccuaccuggagagcaagagcgugaaguccaagcacaccaagccggugauccacagcaagcagaacaugacgaccgacgcgcccaagaagaucgucgccgccaaguacgaggugauccacuccaagaccaaggugaacgucaagagcgugaagcgcaacaccgacgugcccgagucccagcagaacuuccaccggcccgucaaggugcgcaagaagcagaucgacaaggagccgaagauccagagcugcaacuccggcgugaaguccgucaagaaccaggcccacuccgugcucaagaagacgcugcaggaccagacccuggugcagaucuucaagccccucacccacagccuguccgacaagagccacgcccaccccgggugccugaaggagccccaccacccggcgcagaccggccacgucucccacagcucccagaagcagugccacaagccccagcagcaggcccccgccaugaagacgaacagccacgugaaggaggagcucgagcacccggggguggagcacuucaaggaggaggacaagcugaagcugaagaagcccgagaagaaccuccagccccggcagcgccgguccagcaaguccuucagccuggacgagcccccgcuguucauccccgacaacaucgccaccauccgccgcgagggcagcgaccacuccagcuccuucgagagcaaguacauguggacccccuccaagcagugcggguucugcaagaagccccacggcaaccggugcgucugcaugugcguguga

SEQ ID NO: 34528 - RNA, 333 nt, Artificial Sequence
  derived and/or modified sequence opt1 from PHF5A__Homo_sapiens__NP_116147
auggccaagcaccaccccgaccugaucuucugccgcaagcaggccggcguggcgaucgggcggcucugcgagaagugcgacggcaagugcgucaucugcgacagcuacgugcgcccgugcacccuggugcggaucugcgacgagugcaacuacggguccuaccagggccgcugcgucaucugcgggggccccggcgugagcgacgccuacuacugcaaggagugcaccauccaggagaaggaccgggacgggugccccaagaucgugaaccugggcuccagcaagacggaccucuucuacgagcgcaagaaguacggguucaagaagcgguga

SEQ ID NO: 34529 - RNA, 939 nt, Artificial Sequence
  derived and/or modified sequence opt1 from PHF6__Homo_sapiens__NP_115711
augagcuccagcguggagcagaagaagggccccacccgccagcggaagugcggguucugcaaguccaaccgcgacaaggagugcggccagcugcucaucagcgagaaccagaaggucgccgcccaccacaagugcaugcuguucuccagcgcgcugguguccagccacuccgacaacgagagccucgggggcuucuccaucgaggacgugcagaaggagaucaagcgggggaccaagcugaugugcagccugugccacugcccgggcgccacgaucggcugcgacgucaagaccugccaccgcaccuaccacuaccacugcgcccuccacgacaaggcccagauccgggagaagcccucccaggggaucuacaugguguacugccgcaagcacaagaagaccgcccacaacagcgaggcggccgaccuggaggaguccuucaacgagcacgagcuggagcccagcucccccaagagcaagaagaagucccggaagggccgcccgcggaagacgaacuucaaggggcucagcgaggacacccgcagcaccuccagccacggcaccgacgagauggaguccagcuccuaccgggaccgcagcccccaccgguccagccccuccgacacgcgccccaagugcggguucugccacgugggcgaggaggagaacgaggcccggggcaagcugcacaucuucaacgccaagaaggcggccgcccacuacaagugcaugcuguucagcuccgggaccguccagcucaccaccacgagccgcgccgaguucggcgacuucgacaucaagaccgugcugcaggagaucaagcgggggaagcgcauggugugcuccuucuacaucugcuacgccacccugcaccucaucugcugcuucaaguuccggguccacccgaaguucauccagagcuccgagaaccugaaguga

SEQ ID NO: 34530 - RNA, 3183 nt, Artificial Sequence
  derived and/or modified sequence opt1 from PHF8__Homo_sapiens__NP_001171825
augaaccgcagccgggccaucgugcagcgcggccggguccugcccccgcccgcgccccucgacaccaccaaccuggccgggcgccggacgcugcagggccgcgccaagauggccuccgugcccguguacugccucugccggcugccguacgacgucacccgcuucaugaucgagugcgacaugugccaggacugguuccacgggagcugcgugggcguggaggaggagaaggccgccgacaucgaccuguaccacugccccaacugcgagguccuccacgggcccuccaucaugaagaagcggcgcggcagcuccaagggccacgacacccacaaggggaagcccgugaagaccggcagcccgacguucgugcgggagcugcgcucccggaccuucgacagcuccgacgaggucauccugaagcccaccgggaaccagcucaccguggaguuccuggaggagaacagcuucuccgugcccauccugguccucaagaaggacggccuggggaugacgcugcccagcccguccuucaccgugcgcgacguggagcacuacgucggcagcgacaaggagaucgacgugaucgacgugacccggcaggcggacugcaagaugaagcucggcgacuucgucaaguacuacuacuccgggaagcgcgagaaggugcugaacgugaucagccuggaguucuccgacacccggcucagcaaccuggucgagacgcccaagaucgugcgcaagcuguccuggguggagaaccucuggcccgaggagugcgucuucgagcggcccaacgugcagaaguacugccugaugagcguccgcgacagcuacaccgacuuccacaucgacuucggcgggaccuccgugugguaccacgugcugaagggcgagaagaucuucuaccucauccggccgaccaacgccaaccugacgcuguucgagugcuggagcuccagcuccaaccagaacgagauguucuucggcgaccaggucgacaagugcuacaagugcagcgugaagcaggggcagacccucuucauccccaccggcuggauccacgccgugcugacccccgucgacugccuggccuucgggggcaacuuccuccacucccugaacaucgagaugcagcugaaggcguacgagaucgagaagcgccucagcacggccgaccuguuccgcuuccccaacuucgagaccaucugcugguacguggggaagcacauccuggacaucuuccggggccuccgcgagaaccggcgccacccggccuccuaccuggugcacggcgggaaggcccugaaccucgccuuccgggcguggacccgcaaggaggcccugcccgaccacgaggacgagauccccgagaccguccggacggugcagcugaucaaggaccucgcccgcgagauccggcugguggaggacaucuuccagcagaacgucggcaagaccagcaacaucuucgggcugcagcgcaucuuccccgccggcuccaucccgcucacccggcccgcccacagcaccuccgugagcaugucccgccugagccugcccuccaagaacgggagcaagaagaagggccucaagcccaaggagcuguucaagaaggcggagcggaagggcaaggaguccagcgcccuggggccggccggccagcugagcuacaaccucauggacacguacucccaccaggcccugaagaccgggagcuuccagaaggccaaguucaacaucaccggcgcgugccugaacgacuccgacgacgacagccccgaccucgaccuggacgggaacgagagcccccuggcccuccugaugagcaacggcuccaccaagcgcgugaagucccuguccaagagccggcgcacgaagaucgccaagaaggucgacaaggcccggcucauggccgagcaggucauggaggacgaguucgaccuggacuccgacgacgagcugcagaucgacgagcgccucggcaaggagaaggcgacccugaucauccggccgaaguucccccgcaagcugccccgcgccaagcccugcagcgacccgaaccgggugcgcgagcccggggagguggaguucgacaucgaggaggacuacaccaccgacgaggacaugguggagggcguggaggggaagcucggcaacggcuccggggccggcgggauccuggaccugcucaaggccagccggcaggucggcgggcccgacuacgcggcccugacggaggcccccgccuccccgagcacccaggaggccauccagggcaugcugugcauggcgaaccuccaguccagcagcuccagccccgccaccuccagccugcaggccugguggaccggcgggcaggaccgcuccagcggcuccagcuccagcgggcugggcaccguguccaacagccccgccucccagcggacgcccgggaagcgcccgaucaagcggcccgccuacuggcgcaccgagagcgaggaggaggaggagaacgcgucccucgacgagcaggacagccugggcgccugcuucaaggacgccgaguacaucuaccccucccuggagagcgacgacgacgaccccgcccucaagucccggccgaagaagaagaagaacagcgacgacgcccccuggagccccaaggcgcgcgugacccccacccugccgaagcaggaccggcccguccgcgagggcacgcggguggccuccaucgagaccgggcuggccgccgcggccgccaagcucgcccagcaggagcugcagaaggcccagaagaagaaguacaucaagaagaagccccugcucaaggagguggagcagccccgcccgcaggacagcaaccugucccugaccguccccgcgcccaccguggccgccacgccgcagcucgugaccagcuccagcccccugcccccgcccgagcccaagcaggaggcccuguccggcagccucgccgaccacgaguacaccgcgcggcccaacgccuucgggauggcccaggccaaccgcuccaccacgcccauggccccgggcgucuuccugacccagcggcgccccagcguggggucccagagcaaccaggcgggccagggcaagcggcccaagaaggggcuggccaccgccaagcagcgccucggccggauccugaagauccaccgcaacgggaagcugcuccuguga

SEQ ID NO: 34531 - RNA, 1308 nt, Artificial Sequence
  derived and/or modified sequence opt1 from PHGDH__Homo_sapiens__XP_011539533
augcugugguucaagcgcagcagcccccucuccaccgcccaccacgaccugacccaccagcggcagaucccgcaggccacggcguccaugaaggacggcaagugggagcgcaagaaguucauggggaccgagcugaacggcaagacccucgggauccugggccuggggcggaucggccgcgagguggccacccggaugcagagcuucggcaugaagacgaucggguacgaccccaucaucucccccgaggucagcgccuccuucggcgugcagcagcucccccuggaggagaucuggccgcugugcgacuucaucaccgugcacacgccccuccugcccagcaccaccgggcugcucaacgacaacaccuucgcccagugcaagaagggcguccgcguggugaacugcgcccgcgggggcaucgucgacgagggcgcgcugcugcgggcccuccaguccgggcagugcgccggcgccgcgcuggacguguucaccgaggagcccccgcgggaccgcgcccugguggaccacgagaacgucaucagcugcccccaccucggggccuccaccaaggaggcccagagccggugcggcgaggagaucgccgugcaguucguggacauggucaagggcaagucccugacggggguggugaacgcgcaggcccugaccagcgccuucagcccccacaccaagcccuggaucggccucgccgaggcccuggggacccugaugcgcgcgugggccggcuccccgaaggggacgauccaggucaucacccagggcaccucccucaagaacgccggcaacugccugagccccgccgugaucguggggcugcucaaggaggccuccaagcaggcggacgucaaccuggugaacgccaagcugcucgugaaggaggccggccugaacgucaccacgagccacagccccgccgcccccggggagcagggcuucggggagugccugcucgcgguggcccuggccggcgccccguaccaggcggugggccugguccaggggaccacccccgugcuccagggccugaacggggccgucuuccggcccgaggugccccugcgccgggaccucccgcugcuccuguuccgcacccagacguccgaccccgccaugcugcccaccaugaucggccugcucgccgaggccggggugcggcugcugagcuaccagaccucccucgucagcgacggcgagaccuggcacgugaugggcaucuccagccugcugcccucccuggaggcguggaagcagcacgugacggaggccuuccaguuccacuucuga

SEQ ID NO: 34532 - RNA, 5466 nt, Artificial Sequence
  derived and/or modified sequence opt1 from PHIP__Homo_sapiens__NP_060404
augagcugcgagcgcaagggccuguccgagcugcggagcgagcuguacuuccugaucgcccgcuuccucgaggacgggcccugccagcaggccgcccaggugcugauccgggaggucgccgagaaggagcugcucccgcgccggaccgacuggaccggcaaggagcacccccgcacguaccagaaccuggugaaguacuaccggcaccuggcccccgaccaccuccugcagaucugccaccgccuggggccccuccuggagcaggagaucccgcaguccgugcccggcguccagacccugcucggggccggccggcagagccugcugcgcaccaacaaguccugcaagcacgugguguggaagggcagcgcccucgcggcccugcacugcgggcggccgcccgagucccccgucaacuacggcuccccgcccuccaucgccgacacccuguucagccgcaagcucaacgggaaguaccggcuggagcgccuggugcccacggccguguaccagcacaugaagaugcacaagcggauccucggccaccuguccagcgucuacugcgugaccuucgaccgcaccgggcggcgcaucuucaccggcuccgacgacugccuggugaagaucugggcgacggacgacggccggcuccuggccacccugcgcgggcacgccgccgagaucagcgacauggccgucaacuacgagaacaccaugaucgcggccggcuccugcgacaagaugauccggguguggugccuccggaccugcgccccgcuggccgugcugcaggggcacagcgccuccaucacgagccuccaguucagcccccugugcagcggcagcaagcgcuaccuguccagcaccggcgcggacgggaccaucugcuucuggcucugggacgccggcacccugaagaucaacccccggcccgccaaguucacggagcgcccgcggcccgggguccagaugaucugcuccagcuucuccgccggcgggauguuccuggccaccggcagcaccgaccacaucauccgcguguacuucuucggcuccgggcagcccgagaagaucagcgagcucgaguuccacaccgacaagguggacuccauccaguucagcaacacguccaaccgguucgucagcggcucccgcgacgggaccgcgcggaucuggcaguucaagcgccgggaguggaaguccauccugcuggacauggccacccgccccgccggccagaaccuccaggggaucgaggacaagaucaccaagaugaaggugacgaugguggccugggaccggcacgacaacaccgucaucaccgccgugaacaacaugacccugaagguguggaacagcuacacgggccagcugauccacguccucaugggccacgaggacgagguguucguccuggagccgcaccccuucgacccccgcgugcuguucagcgcggggcacgacggcaacgugaucgucugggaccucgcccgcggggugaagauccgcuccuacuucaacaugaucgagggccaggggcacggcgccguguucgacugcaagugcagccccgacggccagcacuucgccugcaccgacucccacgggcaccuccugaucuucggcuucgggagcagcuccaaguacgacaagaucgcggaccagauguucuuccacagcgacuaccggccgcugauccgcgacgccaacaacuucguccucgacgagcagacccagcaggcgccccaccugaugccgccgcccuuccugguggacguggacggcaacccccaccccucccgguaccagcgccucguccccggccgggagaacugccgcgaggagcagcugaucccccagaugggggugaccagcuccggccugaaccaggugcucagccagcaggccaaccaggagaucagcccccuggacagcaugauccagcgccugcagcaggagcaggaccuccggcgcuccggggaggccggcaucagcaacacgucccggcugagccgcggguccaucagcuccaccagcgagguccacagcccgcccaacgugggccugcggcgcagcggccagaucgagggggugcggcagaugcacagcaacgcgccccgcuccgagaucgccaccgagcgggaccucgucgccuggagccgccggguggugguccccgagcuguccgccggcguggccagccgccaggaggaguggcggaccgcgaagggggaggaggagaucaagacguaccgcuccgaggagaagcggaagcaccugaccgugcccaaggagaacaagauccccaccgucagcaagaaccacgcccacgagcacuuccucgaccugggcgaguccaagaagcagcagaccaaccagcacaacuaccgcacccggagcgcccuggaggagacgccccgccccuccgaggagaucgagaacgggagcuccagcuccgacgagggcgaggugguggccgucagcggcgggaccuccgaggaggaggagcgggccuggcacagcgacggcuccagcuccgacuacagcagcgacuacuccgacuggaccgcggacgccgggaucaaccuccagcccccgaagaaggugcccaagaacaagaccaagaaggccgagagcuccagcgacgaggaggaggaguccgagaagcagaagcagaagcagaucaagaaggagaagaagaaggugaacgaggagaaggacggccccaucagccccaagaagaagaagccgaaggagcgcaagcagaagcggcuggccgucggggagcugacggagaacggccucacccuggaggaguggcugcccuccaccuggaucaccgacacgaucccccgccgcugccccuucgugccgcagaugggcgacgagguguacuacuuccggcaggggcacgaggcguacgucgagauggcccgcaagaacaagaucuacagcaucaaccccaagaagcagcccuggcacaagauggagcuccgggagcaggagcugaugaagaucgugggcaucaaguacgagguggggcugcccacccucugcugccugaagcuggccuuccucgacccggacaccggcaagcugaccgggggcuccuucacgaugaaguaccacgacaugcccgacgucaucgacuuccuggugcuccgccagcaguucgacgacgccaaguaccggcgcuggaacaucggcgaccgguuccgcagcgugaucgacgacgccuggugguucgggaccaucgagucccaggagccccugcagcuggaguacccggacagccucuuccagugcuacaacgucugcugggacaacggcgacaccgagaagaugucccccugggacauggagcugauccccaacaacgcgguguuccccgaggagcuggggaccagcgugccgcucacggacggcgagugccggucccugaucuacaagccccuggacggcgagugggggaccaacccccgcgacgaggagugcgagcggaucgucgccggcaucaaccagcucaugacccuggacaucgccagcgccuucguggcccccguggaccugcaggcguacccgauguacugcaccgucguggccuaccccacggaccucuccaccaucaagcagcgccuggagaaccgguucuaccgccgggugagcucccugaugugggagguccgcuacaucgagcacaacacccggaccuucaacgagcccgggagccccaucgugaaguccgccaaguucgugacggaccuccugcugcacuucaucaaggaccagaccugcuacaacaucaucccgcucuacaacuccaugaagaagaagguccugagcgacuccgaggacgaggagaaggacgccgacgugcccggcaccagcacccgcaagcggaaggaccaccagccccgccgccggcugcgcaaccgggcccaguccuacgacauccaggcguggaagaagcagugcgaggagcuccugaaccugaucuuccagugcgaggacagcgagcccuuccgccagccgguggaccuccuggaguaccccgacuaccgggacaucaucgacacgcccauggacuucgccaccguccgcgagacccuggaggccgggaacuacgagucccccauggagcucugcaaggacgugcggcugaucuucagcaacuccaaggccuacaccccgagcaagcgcucccggaucuacagcaugucccugcgccucagcgcguucuucgaggagcacaucuccagcguccuguccgacuacaagagcgcccugcgguuccacaagcgcaacacgaucaccaagcggcgcaagaagcggaaccgcuccagcagcguguccagcuccgccgccagcucccccgagcggaagaagcgcauccucaagccccagcugaaguccgaguccagcaccuccgccuucagcacccccacgcgguccaucccgccccgccacaacgcggcccagaucaacggcaagaccgagagcuccagcgugguccggacccgcuccaaccgcgugguggucgaccccguggugaccgagcagcccagcaccuccagcgccgccaagacguucaucaccaaggccaacgcguccgccaucccgggcaagaccauccuggagaacagcgucaagcacagcaaggcccucaacacccuguccagccccgggcaguccagcuucucccacggcacgcggaacaacagcgccaaggagaacauggagaaggagaagcccgugaagcgcaagaugaaguccagcgugcugccgaaggccuccacccucagcaaguccagcgcggucaucgagcagggggacugcaagaacaacgcccuggugcccggcaccauccaggugaacgggcacggcggccagcccuccaagcuggucaagcgggggcccggccgcaagccgaagguggaggugaacaccaacagcggggagaucauccacaagaagcggggccgcaagcccaagaagcuccaguacgccaagcccgaggaccuggagcagaacaacguccaccccauccgggacgaggugcugccguccagcacgugcaacuuccucuccgagaccaacaacgugaaggaggaccugcugcagaagaagaaccgcgggggccggaagcccaagcgcaagaugaagacccagaagcucgacgccgaccugcugguccccgccagcgugaaggugcuccggcgcuccaaccggaagaagaucgacgaccccaucgacgaggaggaggaguucgaggagcugaagggcagcgagccgcacaugcgcacccggaaccaggggcgccggacggcguucuacaacgaggacgacagcgaggaggagcagcgccagcuccuguucgaggacaccucccugaccuucggcaccagcucccgggggcgcguccgcaagcugacggagaaggccaaggccaaccucaucggcugguga

SEQ ID NO: 34533 - RNA, 3633 nt, Artificial Sequence
  derived and/or modified sequence opt1 from PHKA1__Homo_sapiens__NP_001116142
augcgcagccgguccaacagcggcgugcgccuggacggguacgcccggcucguccagcagaccauccugugccaccagaaccccgugaccggccugcucccggccuccuacgaccagaaggacgcgugggugcgcgacaacgucuacagcauccuggccgugugggggcugggccucgccuaccggaagaacgccgaccgcgacgaggacaaggccaaggcguacgagcuggagcaguccguggucaagcugaugcgggggcuccugcacugcaugauccgccagguggacaagguggagagcuucaaguacucccagagcacgaaggacucccugcacgccaaguacaacaccaagaccugcgccaccgucgugggcgacgaccaguggggccaccuccagcuggacgccacgagcguguaccugcuguuccuggcgcagaugaccgccuccgggcugcacaucauccacagccucgacgaggucaacuucauccagaaccugguguucuacaucgaggccgccuacaagaccgccgacuucggcaucugggagcgcggggacaagaccaaccagggcaucuccgagcugaacgcgagcuccguggggauggccaaggccgcccucgaggcccuggacgagcuggaccucuucggcgucaagggcgggccccagagcgugauccacgugcuggcggacgagguccagcacugccaguccauccugaacagccuccugccccgggccuccacgagcaaggagguggacgccagccugcucuccguggucagcuuccccgccuucgccguggaggacucccagcugguggagcugaccaagcaggagaucaucaccaagcuccagggccgguacgggugcugccgcuuccugcgggacggcuacaagaccccgaaggaggaccccaaccgccuguacuacgagcccgcggagcucaagcuguucgagaacaucgagugcgaguggccccuguucuggacguacuucauccucgacggcgucuucagcgggaacgccgagcagguccaggaguacaaggaggcccuggaggccgugcugaucaagggcaagaacggggugccgcuccugcccgagcuguacuccgugccgcccgaccgggucgacgaggaguaccagaacccccacaccguggaccgcgugcccaugggcaagcucccccacaugugggggcagagccuguacauccugggcucccucauggccgagggcuuccuggcgcccggggagaucgacccgcugaaccggcgcuucagcaccguccccaagcccgacguggugguccagguguccauccuggccgagaccgaggagaucaagacgauccucaaggacaagggcaucuacguggagaccaucgccgaggucuaccccauccgggugcagccggcccgcauccugagccacaucuacuccagccuggggugcaacaaccggaugaagcucuccggccgccccuaccgccacaugggggugcugggcaccagcaagcuguacgacauccggaagaccaucuucacguucacgccccaguucaucgaccagcagcaguucuaccucgcgcuggacaacaagaugaucgucgagaugcugcgcaccgaccucuccuaccugugcagccgguggcgcaugaccggccagcccaccaucaccuucccgaucucccacagcaugcuggacgaggacgggaccucccucaacagcagcauccuggccgcccugcggaagaugcaggacggcuacuucgggggcgcccgcgugcagaccgggaagcucuccgaguuccugacgaccagcugcugcacccaccuguccuucauggaccccggccccgagggcaagcucuacagcgaggacuacgacgacaacuacgacuaccuggaguccgggaacuggaugaacgacuacgacagcaccucccacgcccggugcggcgacgagguggcgcgcuaccuggaccaccuccuggcccacacggcgccccacccgaagcuggcccccaccagccagaagggcgggcucgaccgguuccaggccgccguccagacgaccugcgaccugaugucccuggugaccaaggccaaggagcuccacgugcagaacguccacauguaccugcccaccaagcuguuccaggccagccgcccguccuucaaccuccuggacagcccccacccccggcaggagaaccaggugcccuccgugcgcgucgagauccaccucccgcgggaccagagcggcgagguggacuucaaggcccucgugcugcagcugaaggagaccuccagccuccaggagcaggccgacauccuguacaugcuguacaccaugaaggggcccgacuggaacaccgagcucuacaacgagcgcuccgcgacgguccgggagcugcugaccgagcucuacggcaaggugggggagauccgccacuggggccugauccgguacaucagcgggauccugcgcaagaagguggaggcccucgacgaggccugcaccgaccugcugagccaccagaagcaccucaccgucggccugccgcccgagccccgggagaagacgaucuccgcgccccugcccuacgaggcccucacccagcugaucgacgaggccagcgagggcgacauguccaucagcauccugacccaggagaucaugguguaccucgccauguacaugcgcacccagcccgggcuguucgccgagauguuccgccugcggaucggccucaucauccaggugauggccacggagcuggcgcacucccugcgcugcagcgccgaggaggccaccgaggggcucaugaaccuguccccgagcgccaugaagaaccugcuccaccacauccuguccggcaaggaguucggggucgagcggagcgugcgccccaccgacuccaacgugagccccgccaucuccauccacgagaucggcgcggucggcgccaccaagacggagcggaccgggaucaugcagcucaagagcgagaucaagcagucccccggcaccagcaugaccccguccagcggguccuuccccagcgccuacgaccagcagagcuccaaggacagccgccagggccaguggcagcggcgccggcgccuggacggggcccugaaccgggugcccgugggcuucuaccagaaggucuggaaggugcugcagaagugccacggccucuccguggagggguucguccugcccagcuccacgacccgcgagaugaccccgggcgagaucaaguucagcgugcacguggaguccguccugaaccgggugccccagcccgaguaccgccagcuccugguggaggccauccugguccucaccaugcuggcggacaucgagauccacagcaucggguccaucaucgccguggagaagaucgugcacaucgccaacgaccuguuccuccaggagcagaagacgcugggcgccgacgacaccaugcuggcgaaggaccccgccagcgggaucugcacccuccuguacgacuccgccccgagcggccgguucggcaccaugacguaccuguccaaggccgccgcgaccuacguccaggaguuccucccccacagcaucugcgccaugcaguga

SEQ ID NO: 34534 - RNA, 3708 nt, Artificial Sequence
  derived and/or modified sequence opt1 from PHKA2__Homo_sapiens__NP_000283
augcgcagccgguccaacagcggcgugcgccuggacggguacgcccggcucguccagcagaccauccugugcuaccagaaccccgugaccggccugcucuccgccagccacgagcagaaggacgcgugggugcgcgacaacaucuacuccauccuggccgucugggggcugggcauggccuaccggaagaacgccgaccgcgacgaggacaaggccaaggcguacgagcucgagcagaacguggugaagcugaugcgggggcugcuccagugcaugaugcgccaggucgccaagguggagaaguucaagcacacgcagagcaccaaggacucccugcacgccaaguacaacaccgcgaccugcggcacgguggucggcgacgaccagugggggcaccuccagguggacgccaccagccucuuccugcuguuccucgcccagaugaccgccuccggccugcggaucaucuucacccuggacgagguggccuucauccagaaccucgucuucuacaucgaggccgcguacaagguggccgacuacgggaugugggagcgcggcgacaagacgaaccaggggaucccggagcugaacgccagcuccgugggcauggccaaggccgcgcuggaggccaucgacgagcucgaccuguucggcgcccacgggggccggaaguccgucauccacgugcugcccgacgagguggagcacugccaguccauccucuucagcaugcugccccgcgccuccaccagcaaggagaucgacgccgggcugcucuccaucaucagcuuccccgcguucgccgucgaggacgugaaccuggugaacgucaccaagaacgagaucaucuccaagcugcagggccgguacggcugcugccgcuuccuccgggacggguacaagaccccgcgcgaggaccccaaccggcugcacuacgaccccgccgagcugaagcuguucgagaacaucgagugcgaguggcccguguucuggacguacuucaucaucgacggcguguucagcggggacgccguccaggugcaggaguaccgcgaggcccuggagggcauccugauccgggggaagaacggcauccgccucgucccggagcuguacgcggugccgcccaacaagguggacgaggaguacaagaacccccacaccgucgaccgggugcccaugggcaaggugccccaccugugggggcagagccucuacauccuguccagccugcucgccgagggcuuccuggccgccggggagaucgacccccugaaccgccgcuucuccaccagcgucaagcccgacguggugguccaggugaccgugcucgcggagaacaaccacaucaaggaccugcugcggaagcacggcgucaacgugcaguccaucgccgacauccacccgauccaggugcagcccgggcgcauccucagccacaucuacgccaagcugggccggaacaagaacaugaaccuguccggccgccccuaccggcacaucgggguccugggcacgagcaagcucuacgugauccgcaaccagaucuucaccuucaccccgcaguucaccgaccagcaccacuucuaccuggcccuggacaacgagaugaucguggagaugcuccggaucgagcuggccuaccugugcacgugcuggcgcaugaccgggcggcccacccucaccuuccccaucucccgcacgaugcugaccaacgacggcagcgacauccacuccgcgguccugagcaccauccggaagcucgaggacggguacuucggcggcgcccgcgugaagcuggggaaccuguccgaguuccucaccacgagcuucuacaccuaccugaccuuccuggaccccgacugcgacgagaagcuguucgacaacgccuccgagggcaccuucagccccgacuccgacagcgaccuggugggguaccuggaggacacgugcaaccaggagucccaggacgagcucgaccacuacaucaaccaccuccugcagagcaccagccuccgguccuaccugccgccccugugcaagaacaccgaggaccgccacgucuucagcgccauccacuccacccgggacauccucagcgugauggccaaggcgaagggccuggaggugcccuucguccccaugacgcugccgaccaaggugcucuccgcccaccgcaagagccugaaccugguggacagcccccagccccuccuggagaaggucccggagagcgacuuccaguggccccgggacgaccacggcgacguggacugcgagaagcugguggagcagcucaaggacugcuccaaccugcaggaccaggccgacauccuguacauccucuacgucaucaaggggcccagcugggacaccaaccuguccggccagcacggggugaccgugcagaaccugcucggcgagcuguacgggaaggccggccugaaccaggaguggggccucauccgcuacaucagcgggcugcugcggaagaaggucgaggugcucgccgaggcgugcaccgaccugcugucccaccagaagcagcucacggugggccugcccccggagccccgcgagaagaucaucagcgcgccccugcccccggaggagcucaccaagcugaucuacgaggccuccgggcaggacaucagcaucgccguccugacccaggagaucgugguguaccucgccauguacguccgcgcccagcccucccuguucguggagaugcugcggcuccgcaucggccugaucauccaggugauggccaccgagcuggcccggagccucaacugcagcggggaggaggccuccgagagccugaugaaccugucccccuucgacaugaagaaccuccugcaccacauccugagcggcaaggaguucggcgucgagcgcuccgugcggcccauccacagcuccacgagcuccccgaccaucagcauccacgagguggggcacaccggcgucaccaagacggagcgcuccgggaucaaccggcuccgcagcgagaugaagcagaugacccggcgcuucuccgcggacgagcaguucuucagcgugggccaggccgccuccagcuccgcccacagcuccaagagcgcccggagcuccacccccagcucccccaccgggacgagcuccagcgacuccggcggccaccacaucggguggggcgagcgccaggggcaguggcugcggcgccggcgccuggacggcgcgaucaaccgggugcccgucggguucuaccagcgcguguggaagauccuccagaagugccacggccugagcaucgacggcuacgugcugccguccagcaccacccgggagaugacgccccacgagaucaaguucgccguccacguggaguccguccucaaccgcgugccccagcccgaguaccggcagcugcugguggaggccaucaugguccucacccugcugagcgacaccgagaugaccuccaucgggggcaucauccacguggaccagaucgugcagauggccagccagcuguuccuccaggaccaggucuccaucggggccauggacacccuggagaaggaccaggcgacgggcaucugccacuucuucuacgacagcgccccguccggcgccuacgggaccaugaccuaccucacccgcgccguggcgagcuaccugcaggagcugcuccccaacuccggcugccagaugcaguga

SEQ ID NO: 34535 - RNA, 3282 nt, Artificial Sequence
  derived and/or modified sequence opt1 from PHKB__Homo_sapiens__NP_000284
auggccggcgccgcgggccugaccgccgaggugagcuggaagguccucgagcgccgggcccgcaccaagcgguccggcagcguguacgagccccugaaguccaucaaccugccgcgccccgacaacgagacgcucugggacaagcuggaccacuacuaccggaucgucaagagcacccugcuccuguaccagucccccaccaccgggcuguuccccacgaagaccugcggcggggaccagaaggccaagauccaggacagccucuacugcgccgcgggcgccugggcccuggcccuggcguaccgccggaucgacgacgacaagggccgcacccacgagcucgagcacuccgccaucaagugcaugcgggggauccuguacugcuacaugcgccaggccgacaaggugcagcaguucaagcaggacccgcggcccaccacgugccugcacagcguguucaacgugcacaccggcgacgagcuccuguccuacgaggaguacgggcaccuccagaucaacgccgucagccucuaccugcuguaccucguggagaugaucuccagcggccugcagaucaucuacaacaccgacgagguguccuucauccagaaccuggucuucugcguggagcgcguguaccggguccccgacuucggggugugggagcgcggcagcaaguacaacaacggcuccaccgagcuccacagcuccagcguggggcuggccaaggcggcccuggaggccaucaacggcuucaaccucuucgggaaccagggcugcuccuggagcgucaucuucguggaccuggacgcccacaaccggaaccgccagacgcugugcagccuccugccccgggagucccgcagccacaacaccgacgccgcgcugcucccgugcaucuccuaccccgccuucgcccuggacgacgaggugcuguucagccagacccucgacaaggucgugcggaagcugaagggcaaguacggguucaagcgcuuccugcgggacggcuaccgcaccucccucgaggaccccaaccgcugcuacuacaagcccgccgagaucaagcuguucgacgggaucgagugcgaguucccgaucuucuuccuguacaugaugaucgacggcguguuccgggggaaccccaagcagguccaggaguaccaggaccuccugacgcccgugcugcaccacaccaccgagggcuaccccguggucccgaaguacuacuacgugcccgccgacuucgucgaguacgagaagaacaaccccggcagccagaagcgcuuccccuccaacugcgggcgggacggcaagcuguuccugugggggcaggcgcuguacaucaucgccaagcuccuggccgacgagcugaucagcccgaaggacaucgaccccgugcagcgcuacgugccccugaaggaccagcggaacgucuccaugcgcuucagcaaccagggcccccucgagaacgaccugguggugcacgucgcccugaucgccgagucccagcggcuccagguguuccugaacaccuacgggauccagacgcagaccccgcagcaggucgagcccauccagaucuggccccagcaggagcuggugaaggcguaccuccagcugggcaucaacgagaagcugggccucagcgggcgccccgaccggccgaucggcugccuggggaccuccaagaucuaccgcauccugggcaagaccguggugugcuaccccaucaucuucgaccucagcgacuucuacaugucccaggacgucuuccugcugaucgacgacaucaagaacgcccuccaguucaucaagcaguacuggaagaugcacgggcggccccuguuccuggugcucauccgcgaggacaacauccggggcagccgcuucaacccgauccuggacaugcuggccgcccucaagaagggcaucaucgggggcgugaagguccacguggaccggcugcagacgcugaucuccggggcgguggucgagcagcucgacuuccugcgcaucagcgacaccgaggagcugcccgaguucaaguccuucgaggagcucgagccgcccaagcacagcaaggugaagcggcagagcuccacccccagcgcccccgagcugggccagcagcccgacgugaacaucuccgaguggaaggacaagcccacccacgagauccugcagaagcucaacgacugcagcugccuggccucccaggccauccugcucggcauccugcugaagcgcgaggggccgaacuucaucacgaaggagggcaccgucagcgaccacaucgagcggguguaccgccgcgccgggucccagaagcucuggcuggcggugcgguacggcgccgccuucacccagaaguucagcuccagcaucgcgccccacaucaccacguuccugguccacgggaagcaggucacccucggcgccuucggccacgaggaggaggugaucuccaacccccugagcccccgcgugauccagaacaucaucuacuacaagugcaacacccacgacgagcgggaggccgugauccagcaggagcuggugauccacaucggguggaucaucuccaacaacccggagcuguucagcggcaugcugaagauccgcaucggguggaucauccacgccauggaguacgagcugcagauccggggcggggacaagcccgcccucgaccuguaccagcugucccccagcgaggucaagcagcuccugcuggacauccuccagccccagcagaacggccgcugcuggcugaaccggcgccagaucgacggcucccugaaccggaccccgacgggguucuacgaccgcguguggcagauccucgagcggacccccaacggcaucaucguggccgggaagcaccucccccagcagcccacccugagcgacaugaccauguacgagaugaacuucagccuccuggucgaggacacccugggcaacaucgaccagccgcaguaccgccagaucgugguggagcuccugauggucguguccaucgugcuggagcggaaccccgagcucgaguuccaggacaaggucgaccuggaccgccuggugaaggaggccuucaacgaguuccagaaggaccagagccggcucaaggagaucgagaagcaggacgacaugacguccuucuacaacaccccgccccuggggaagcgcgggaccugcagcuaccugaccaaggcggugaugaaccuccugcuggagggcgaggucaagcccaacaacgacgaccccugccucaucuccuga

SEQ ID NO: 34536 - RNA, 1260 nt, Artificial Sequence
  derived and/or modified sequence opt1 from PHKG1__Homo_sapiens__NP_001245388
augacccgcgacgaggcccugcccgacagccacuccgcccaggacuucuacgagaacuacgagccgaaggagauccucggccgcggggugagcuccgucgugcggcggugcauccacaagcccaccagccaggaguacgcggugaaggucaucgacgugacgggcgggggcuccuucagccccgaggaggugcgcgagcugcgggaggccacccugaaggaggucgacauccuccgcaagguguccgggcaccccaacaucauccagcugaaggacaccuacgagaccaacacguucuucuuccugguguucgaccucugggaggacaccgacaccauggagauggagcagaaguggugccugggcugggacagcccgaaguccaccaacuuccgggcccagggccgcgcccggaugaagcgcggggagcuguucgacuaccucacggagaaggucacccugagcgagaaggagacccggaagaucaugcgcgcccugcucgaggugaucugcacccugcacaagcugaacaucgugcaccgggaccucaagcccgagaacauccugcuggacgacaacaugaacaucaagcucacggacuucggcuucuccugccagcuggagcccggggagcgccugcgggaggucugcggcacccccagcuaccucgcgccggagaucaucgagugcuccaugaacgaggaccaccccggguacggcaaggagguggacauguggagcaccggcgugaucauguacacccugcuggccggguccccgcccuucuggcaccgcaagcagaugcucaugcugcggaugaucaugagcggcaacuaccaguucgggucccccgagugggacgacuacagcgacacggucaaggaccuggugucccgcuuccucgugguccagccccagaaccgguacaccgccgaggaggcccuggcgcaccccuucuuccagcaguaccugguggaggaggugcgccacuucagcccccggggcaaguucaaggucaucgcccucaccgugcuggccagcgugcgcaucuacuaccaguaccgccgggucaagccggugacccgcgagaucgucauccgggaccccuacgcccugcgcccccuccggcgccugaucgacgccuacgcguuccggaucuacggccacugggugaagaaggggcagcagcagaaccgcgccgcccuguucgagaacacgcccaaggccgugcuccugucccuggccgaggaggacuacuga

SEQ ID NO: 34537 - RNA, 1221 nt, Artificial Sequence
  derived and/or modified sequence opt1 from PHKG2__Homo_sapiens__NP_000285
augacccuggacgugggccccgaggacgagcucccggacugggccgccgcgaaggaguucuaccagaaguacgaccccaaggacgucaucgggcgcggcgugagcuccgugguccggcgcugcgugcaccgggccaccgggcacgaguucgccgugaagaucauggaggucacggccgagcgccugagccccgagcagcuggaggaggugcgggaggccacccgccgggagacccacauccuccgccagguggcgggccacccccacaucaucacccugaucgacuccuacgagagcuccagcuucauguuccuggucuucgaccucaugcggaagggggagcuguucgacuaccugacggagaagguggcccucuccgagaaggagacccgcagcaucaugcggucccugcuggaggccgugagcuuccuccacgccaacaacaucguccaccgcgaccugaagccggagaacauccugcucgacgacaacaugcagauccggcuguccgacuucggcuucagcugccaccuggagcccggcgagaagcuccgcgagcugugcgggacccccggcuaccuggcgcccgagauccucaagugcuccauggacgagacccacccgggguacggcaaggagguggaccugugggccugcggggugauccuguucacgcuccuggccggcagcccgcccuucuggcaccggcgccagauccugaugcuccggaugaucauggagggccaguaccaguucuccagccccgagugggacgaccgcuccagcaccgucaaggaccugaucucccggcugcuccagguggaccccgaggcccgccugaccgccgagcaggcgcugcagcaccccuucuucgagcggugcgaggggagccagcccuggaaccucacgccccgccagcgcuuccggguggccgucuggaccgugcuggccgccggccgcguggcccugagcacccaccggguccgcccgcucaccaagaacgcgcugcugcgggaccccuacgcccuccgcuccgugcggcaccugaucgacaacugcgccuuccgccuguacgggcacugggugaagaagggcgagcagcagaaccgggccgcccucuuccagcaccgcccgcccggccccuuccccaucauggggcccgaggaggagggcgacagcgcggccaucaccgaggacgaggccguccuggugcugggguga

SEQ ID NO: 34538 - RNA, 1206 nt, Artificial Sequence
  derived and/or modified sequence opt1 from PHLDA1__Homo_sapiens__NP_031376
augcgccgggcccccgccgcggagcgccugcucgagcugggcuucccgccccggugcgggcgccaggagccgcccuucccccugggcgugacccggggguggggccgcuggcccauccagaagcggcgcgagggggcccggcccgugcccuucagcgagcgcucccaggaggacggccggggcccggccgcccgcagcuccgggacccucuggcggauccgcacgcggcugagccugugccgcgaccccgagccgccgccgccccucugccugcugcgggugucccuccugugcgcccugcgcgcgggcgggcggggcagccgcuggggcgaggacggggcccggcuccugcugcucccgcccgcccgcgccgcgggcaacggggaggccgagcccuccggcgggcccagcuacgccggccgcaugcuggaguccagcggcugcaaggcccugaaggagggggugcucgagaagcgguccgacggccugcugcagcucuggaagaagaagugcugcauccugaccgaggaggggcugcuccugaucccgcccaagcagcugcagcaccagcagcagcagcagcagcagcagcagcagcagcagcagcagcagcccggccaggggcccgccgagcccagccagcccuccggccccgcggucgccagccucgagccgcccgugaagcugaaggagcugcacuucuccaacaugaagaccguggacugcgucgagcgcaagggcaaguacauguacuucaccguggugauggccgaggggaaggagaucgacuuccggugcccccaggaccagggcuggaacgccgagaucacgcuccagaugguccaguacaagaaccgccaggccauccuggcggucaagagcacccggcagaagcagcagcaccuggugcagcagcagccgcccucccagccccagccccagccccagcuccagccccagccccagccccagccccagccccagccccagccgcagagccagccccagccccagccccagccgaagccccagccccagcagcugcaccccuacccgcacccccacccccacccccacucccacccgcacagccacccccacccccacccccacccgcacccccaccagaucccccacccgcacccccagccccacagccagccccacgggcaccgccugcuccgguccaccagcaacuccgccuga

SEQ ID NO: 34539 - RNA, 459 nt, Artificial Sequence
  derived and/or modified sequence opt1 from PHLDA2__Homo_sapiens__NP_003302
augaagucccccgacgaggugcugcgcgagggcgagcucgagaagcgguccgacagccuguuccagcuguggaagaagaagcgcgggguccucaccuccgaccggcugagccuguucccggccagcccccgcgcccggcccaaggagcuccgcuuccacagcauccugaagguggacugcguggagcggaccggcaaguacgucuacuucacgaucgugaccaccgaccacaaggagaucgacuuccgcugcgcgggggaguccugcuggaacgccgccaucgcccuggcccucaucgacuuccagaaccggcgcgcgcugcaggacuuccggagccgccaggagcggaccgcccccgccgccccggcggaggacgccguggccgccgccgcggccgcccccuccgagcccagcgagcccucccgcccgagcccccagcccaagccccggacgccguga

SEQ ID NO: 34540 - RNA, 384 nt, Artificial Sequence
  derived and/or modified sequence opt1 from PHLDA3__Homo_sapiens__NP_036528
augaccgccgccgcgaccgccacggugcugaaggagggcguccucgagaagcgcagcgggggccugcugcagcucuggaagcggaagcgcugcgugcugaccgagcgggggcugcagcuguucgaggccaagggcaccgggggccgccccaaggagcucuccuucgcccggaucaaggccguggagugcgucgagagcaccggccgccacaucuacuucacgcuggugaccgagggcggcggggagaucgacuuccggugcccgcucgaggaccccggguggaacgcgcagaucacccuggggcuggugaaguucaagaaccagcaggccauccagaccguccgcgcccggcagucccucggcacgggcacccuggugagcuga

SEQ ID NO: 34541 - RNA, 3960 nt, Artificial Sequence
  derived and/or modified sequence opt1 from PHLDB1__Homo_sapiens__NP_001138231
auggacgcccugaaccgcaaccagaucggccccgggugccagacccagaccauggugcagaagggcccgcucgaccugaucgagacggggaagggccugaagguccagaccgacaagccccaccucgugagccugggguccggccggcugagcaccgccaucacccuccugccccuggaggagggccgcacggugaucggguccgcggcccgggacaucagccuccagggccccgggcuggccccggagcacugcuacaucgagaaccugcgcggcacccucacccuguaccccugcgggaacgccugcaccaucgacggccugcccguccggcagcccacgcgccucacccagggcugcaugcugugccuggggcaguccaccuuccuccgguucaaccacccggccgaggcgaaguggaugaagagcaugauccccgccggcgggcgcgcccccggccccccguacucccccgugcccgccgagagcgagucccuggugaacggcaaccacaccccccagacggcgacccgggggccgagcgccugcgccucccacagcucccuggucagcuccaucgagaaggaccuccaggagaucauggacagccuggugcuggaggagcccggcgccgccgggaagaagcccgcggccaccuccccccucagcccgauggccaacggcgggcgcuaccugcuguccccccccaccagccccggcgccaugagcgugggcuccagcuacgagaacacguccccggccuucagcccccucuccagccccgcguccagcggguccugcgccagccacucccccagcggccaggagccggggcccuccguccccccgcuggugcccgcccggagcuccagcuaccaccuggcccuccagcccccccagucccgcccgagcggcgcccgguccgagagcccccgccugagccggaaggggggccacgagcgcccccccuccccgggccugcgggggcuccugaccgacagccccgcggccaccgugcuggccgaggcccgccgggccaccgaguccccccgccucggcgggcagcugcccgucguggcgaucagccuguccgaguacccggccagcggcgcccucucccagcccacgagcauccccgggucccccaaguuccagccgcccgugcccgccccccggaacaagaucggcacccugcaggaccgcccgcccagccccuuccgcgagcccccgggcuccgagcggguccugaccaccagccccucccgccagcucguggggcggacguucagcgacggccuggcgacccgcacccugcagcccccggaguccccccggcucgggcgccggggccuggacagcaugcgcgagcugcccccccucuccccgagccugagccggcgcgcccuguccccccugcccacccggacgacccccgacccgaagcucaaccgcgagguggccgagagcccccggccccgccggugggccgcccacggcgcgucccccgaggacuucagccugacccugggggcccgcggccggcgcacccgguccccgagccccacgcucggggagucccuggccccccacaagggcagcuucuccgggcgccugagccccgccuacucccucggcagccugaccggcgccuccccgugccagagccccugcguccagcgcaagcuguccagcggggaccuccgggugcccgugacccgcgagcggaagaacuccaucaccgagaucagcgacaacgaggacgaccugcuggaguaccaccgccggcagcgccaggagcggcuccgcgagcaggagauggagcggcuggagcgccagcggcuggagacgauccucaaccugugcgcggaguacucccgcgccgacggcgggcccgaggccggcgagcugccgagcaucggggaggccaccgccgcgcucgcccuggccggccggcgccccagccggggccuggccggggcguccggccgcagcuccgaggagcccggggucgccacccagcggcucugggagagcauggagcgcuccgacgaggagaaccugaaggaggagugcagcuccaccgagagcacccagcaggagcacgaggacgcccccuccacgaagcugcagggcgaggugcucgcccuggaggaggagcgggcccaggugcuggggcacgucgagcagcucaaggugcgcgucaaggagcuggagcagcagcugcaggagagcgcgcgggaggccgagauggagcgcgcccuccugcagggcgagcgcgaggccgagcgggcccugcuccagaaggagcagaaggcgguggaccagcugcaggagaagcugguggcccucgagaccggcauccagaaggagcgcgacaaggaggccgaggcccuggagaccgagaccaagcuguucgaggaccucgaguuccagcagcuggagcgggagucccgcgucgaggaggagcgggagcuggccgggcagggccuccugcgcagcaaggcggagcugcuccgguccaucgccaagcgcaaggagcggcuggccauccuggacagccaggccgggcagauccgcgcgcaggccgugcaggaguccgagcggcucgcccgcgacaagaacgccagccugcagcugcuccagaaggagaaggagaagcugacggugcuggagcggcgcuaccacucccucaccggcgggcggccguuccccaagaccaccagcacgcugaaggaggucuaccgcuccaagauggacggcgaggccaccagcccccugccccggacccgcagcggcccgcuccccuccagcuccgggagcuccagcuccagcucccagcugagcguggcgacccugggccggucccccagcccgaaguccgcccuccugacgcagaacgggaccggcagccugccccgcaaccucgccgccacccugcaggacaucgagaccaagcgccagcuggcccuccagcagaagggccagcaggugaucgaggagcagcggcgccggcuggcggagcugaagcagaaggccgccgccgaggcccagugccagugggacgcgcuccacggggccgcccccuuccccgccggcccguccggguuccccccccugaugcaccacagcauccugcaccaccuccccgccggccgcgagcggggggaggagggcgagcacgcguacgacacgcugucccuggagagcuccgacagcauggagaccagcaucuccaccggcgggaacagcgccugcuccccggacaacaugagcuccgccagcggccucgacauggggaagaucgaggagauggagaagaugcugaaggaggcccacgcggagaagaaccgccugauggagucccgggagcgcgagauggagcuccggcgccaggcccuggaggaggagcggcgccggcgcgagcaggucgagcggcgccugcagagcgaguccgcccggcgccagcagcucguggagaaggaggugaagaugcgggagaagcaguucagccaggcccgcccccugacccgguaccugcccauccgcaaggaggacuucgaccucaagacgcacaucgaguccagcggccacggggucgacaccugccugcacguggugcuguccagcaaggucugccgcggcuaccucgugaagaugggcgggaagaucaaguccuggaagaagcggugguucguguucgaccgccugaagcggacccugagcuacuacgucgacaagcacgagaccaagcucaagggcgugaucuacuuccaggccaucgaggagguguacuacgaccaccugcgcuccgcggccaagagccccaacccggcccugacguucugcgucaagacccacgaccggcucuacuacaugguggcccccuccgccgaggcgaugcgcaucuggauggacgugaucgucaccggggccgagggcuacacccaguucaugaacuga

SEQ ID NO: 34542 - RNA, 5154 nt, Artificial Sequence
  derived and/or modified sequence opt1 from PHLPP1__Homo_sapiens__NP_919431
auggagcccgccgccgccgccaccgugcagcggcugcccgagcucggccgggaggaccgcgccagcgcccccgccgccgccgccgccgccgccgccgccgccgcggccgccgccgccgcgcuggccgccgccgccgggggcgggcggucccccgagcccgcgcugacccccgccgcccccagcggcgggaacggcuccggcagcggggcccgcgaggaggcccccggcgaggcgccgcccgggccccuccccggccgggccgggggcgccggccgccggcgccggcgcggggcgccccagcccaucgcgggcggggccgcccccgugcccggcgccggcgggggcgccaacucccugcugcuccggcgcgggcggcugaagcgcaaccugagcgcggccgccgccgccgcguccagcuccagcuccagcuccgccgccgccgccagccacucccccggcgcggccgggcuccccgccagcugcuccgccagcgcgucccugugcacccggagccuggaccgcaagacccuccugcugaagcaccggcagacccuccagcugcagcccagcgaccgcgacugggugcggcaccagcugcagcgcggcugcgugcacgucuucgaccggcacauggccuccaccuaccuccgccccgugcugugcacgcuggacaccaccgccggcgagguggccgcccgccuccugcagcuggggcacaagggcgggggcgucgugaaggugcucgggcagggccccggcgcggccgccgcccgggagcccgccgagcccccgcccgaggcggggccccgccuggcgccgcccgagccccgggacagcgaggucccgcccgcccgcuccgcccccggcgccuucgggggcccgccccgggcgccgcccgccgaccugccccuccccgucgggggccccggcggguggagccgccgggccucccccgcccccagcgacuccagccccggcgagcccuucgucgggggccccgucuccagcccccgcgcgccccggcccgugguguccgacaccgagagcuucucccugagccccuccgccgagagcgucuccgaccgccuggaccccuacagcuccggcgggggcagcagcuccagcuccgaggagcucgaggccgacgccgccagcgcgcccacgggggugcccggccagccccggcgccccgggcaccccgcccagccccugccccugccgcagaccgccuccagcccccagccccagcagaaggccccgcgggccaucgacucccccggcggcgcggugcgcgaggggagcugcgaggagaaggccgccgccgccgucgcgcccggcgggcuccaguccacccccggccggagcggggugaccgccgagaaggccccgccgccgccgccgccgcccacgcuguacgugcagcugcacggcgagaccacccgccggcucgaggccgaggagaagccccugcagauccagaacgacuaccuguuccagcucggcuucggggagcuguggcgcguccaggaggagggcauggacuccgagaucgggugccugauccgguucuacgccggcaagccccacagcaccggguccagcgagcgcauccagcucuccggcauguacaacgugcgcaagggcaagaugcagcugcccgugaaccgguggacgcgccggcaggucauccugugcgggaccugccucaucgugagcuccgucaaggacagccugaccggcaagaugcacgugcugccccucaucgggggcaagguggaggaggucaagaagcaccagcacugccuggcguucagcuccagcgggccccagucccagaccuacuacaucugcuucgacacguucaccgaguaccugcgcuggcugcgccaggugagcaagguggccucccagcgcaucagcuccgucgaccucagcugcugcucccuggagcaccuccccgccaaccuguucuacagccaggaccugacccaccugaaccucaagcagaacuuccugcggcagaaccccucccugcccgccgcgcgcggccucaacgagcugcagcgguucaccaagcucaagagccucaaccuguccaacaaccaccugggcgacuucccccucgccgugugcagcauccccacgcuggccgagcugaacguguccugcaacgcccuccgcagcguccccgccgcggugggggugaugcacaaccugcagaccuuccugcucgacggcaacuuccugcagucccugcccgccgagcucgagaacaugaagcagcugagcuaccuggggcucuccuucaacgaguucaccgacauccccgagguccuggagaagcugaccgccguggacaagcucugcaugagcggcaacugcguggagacgcugcggcugcaggcccuccgcaagaugccgcacaucaagcacgucgaccugcggcugaacgugauccgcaagcucaucgccgacgagguggacuuccugcagcacgucacccagcuggaccuccgggacaacaagcugggcgaccuggacgcgaugaucuucaacaacaucgaggugcuccacugcgagcgcaaccagcuggugacccuggacaucugcggguacuuccucaaggcccuguacgccagcuccaacgagcugguccagcucgacguguaccccgugcccaacuaccugagcuacauggacgucucccggaaccgccuggagaacgugcccgagugggugugcgagagccggaagcucgagguccuggacaucggccacaaccagaucugcgagcugccggcccgccucuucugcaacuccagccugcggaagcugcucgccgggcacaaccagcuggcgcgccugcccgagcgccucgagcggaccuccguggaggugcuggacguccagcacaaccagcugcucgagcugcccccgaaccugcucaugaaggccgacagccugcgcuuccugaacgccuccgccaacaagcucgagagccugccgcccgcgacgcuguccgaggagaccaacagcauccuccaggagcuguaccugaccaacaacucccucaccgacaagugcgugccccugcugacgggccacccgcaccucaagauccugcacauggccuacaaccggcugcagagcuuccccgccuccaagauggccaagcucgaggagcuggaggagaucgaccugagcgggaacaagcucaaggccauccccaccaccaucaugaacugccgccggaugcacaccgugaucgcgcacuccaacugcaucgaggucuuccccgaggugaugcagcugccggagaucaagugcguggaccugagcugcaacgagcucuccgaggucacccugcccgagaaccugccgcccaagcuccaggagcuggaccugacgggcaacccgcgccucgugcuggaccacaagacccuggagcugcucaacaacauccggugcuucaagaucgaccagcccagcaccggcgacgccagcggggcccccgccguguggucccacggcuacaccgaggccagcggggucaagaacaagcugugcguggcggcccuguccgugaacaacuucugcgacaaccgcgaggcccucuacggcgucuucgacggggaccggaacguggaggugcccuaccugcugcagugcacgaugagcgacauccucgccgaggagcugcagaagaccaagaacgaggaggaguacauggucaacaccuucaucgugaugcagcgcaagcugggcaccgccggccagaagcucgggggcgcggccgugcugugccacaucaagcacgacccggucgaccccgggggcuccuucacgcugaccagcgccaacguggggaagugccagaccgugcucugccggaacggcaagccccugccccugucccgcagcuacaucauguccugcgaggaggagcucaagcggaucaagcagcacaaggccaucaucaccgaggacggcaaggucaacggggugacggagagcacccgcauccugggcuacaccuuccugcacccguccgucgugccccggccccacgugcagagcguccuccugacgccccaggacgaguucuucauccugggguccaagggccucugggacagccuguccguggaggaggcgguggaggccguccgcaacgugccggacgcccuggccgccgcgaagaagcucugcacgcuggcccagagcuacggcugccacgacuccaucagcgccguggucgugcagcuguccgugaccgaggacagcuucugcugcugcgagcucagcgccgggggcgccgugccgccgcccuccccggggaucuucccgcccagcgugaacauggugaucaaggaccggccguccgacggccuggggguccccagcuccagcuccggcauggcgagcgagaucuccagcgagcuguccaccagcgagauguccagcgaggugggcuccaccgccagcgacgagccgccgcccggggcccucuccgagaacagccccgccuaccccuccgagcagcgcugcaugcugcaccccaucugccugagcaacagcuuccagcggcagcucuccagcgccacguucuccagcgcguucuccgacaacggccuggacagcgacgacgaggagcccaucgaggggguguucaccaacggcucccgcgucgagguggagguggacauccacugcagccgcgccaaggagaaggagaagcagcagcaccuccugcagguccccgccgaggccuccgacgaggggaucgugaucagcgccaacgaggacgagcccggccugccccggaaggcggacuucuccgccgugggcaccaucgggcgccggcgcgccaacggcagcgucgccccgcaggagcggucccacaacgugaucgagguggcgaccgacgcgccccugcgcaagcccgggggcuacuucgccgcccccgcccagccggaccccgacgaccaguucaucaucccgcccgagcuggaggaggaggucaaggagaucaugaagcaccaccaggagcagcagcagcagcagcagccgccgccgccgccccagcugcagccccagcugccccggcacuaccagcucgaccagcugcccgacuacuacgacacgccccuguga

SEQ ID NO: 34543 - RNA, 3771 nt, Artificial Sequence
  derived and/or modified sequence opt1 from PHLPP2__Homo_sapiens__NP_001275932
augaagcgcaacggcagccggaacugccugaaccgccggucccgcuucgggagccgggagcgcgacuggcuccgggaggacgugaagcgcggcugcgucuaccuguacggggccgacaccaccacggccaccaccaccacgaccaccuccagcuccagcuccagcuccagcuccagcuccgaccugcaccucgugcugugcaccguggagacgcccgcgagcgagaucugcgccggcgaggggcgggagucccuguaccuccagcugcacggcgaccugguccgccggcucgagcccaccgagcgcccccugcagaucguguacgacuaccugagccggcucggcuucgacgaccccgugcgcauccaggaggaggccaccaaccccgaccuggggugcaugauccgguucuacggcgagaagccgugccacauggaccgccuggaccggauccuccuguccgggaucuacaacguccgcaagggcaagacccagcugcacaagugggccgagcggcucguggugcugugcgggacgugccugaucgucagcuccgugaaggacugccagaccggcaagaugcacauccucccccuggugggcgggaagaucgaggaggucaagcgccggcaguacagccuggccuucagcuccgcgggcgcccaggcccagaccuaccacgugagcuucgagacccucgccgaguaccagcgcuggcagcgccaggcguccaagguggucagccagcggaucuccacgguggaccugagcugcuacucccuggaggaggugcccgagcaccucuucuacagccaggacaucaccuaccugaaccugcgccacaacuucaugcagcucgagcggcccgggggccuggacacccuguacaaguucucccagcucaagggccugaaccugagccacaacaagcucgggcuguucccgauccugcucugcgagaucuccacccugacggagcugaaccucagcugcaacggcuuccacgaccugcccucccagaucgggaaccugcucaaccugcagacccugugccucgacggcaacuuccugaccacccugcccgaggagcuggggaaccuccagcagcugagcucccugggcaucagcuucaacaacuucucccagauccccgaggucuacgagaagcucacgaugcuggaccgcguggugauggccggcaacugccuggagguccucaaccugggggugcugaaccggaugaaccacaucaagcacguggaccuccgcaugaaccaccugaagaccauggucaucgagaaccuggagggcaacaagcacaucacccacguggaccuccgggacaaccgccugaccgaccuggaccucagcucccugugcagccuggagcagcuccacugcgggcggaaccagcugcgcgagcugacgcucagcggcuucucccugcggacccuguacgccagcuccaaccgccucaccgccgucaacguguacccggugcccagccugcugaccuuccucgaccugucccggaaccugcucgagugcguccccgacugggccugcgaggcgaagaagaucgaggugcuggacgugagcuacaaccugcucacggagguccccgugcgcauccuguccagccugucccuccggaagcugaugcuggggcacaaccacgugcagaaccucccgacccuggucgagcacaucccccuggaggugcucgaccugcagcacaacgcccugacccgccuccccgacacccuguucagcaaggcccugaacaagcucaacaagcuggagcagcuggaggagcucaaccuguccggcaacaagcugaagacgauccccaccaccaucgccaacugcaagcggcuccacacccugguggcccacagcaacaacaucuccaucuucccggagauccugcagcucccccagauccaguucgucgaccugagcugcaacgaccugaccgagauccucauccccgaggcgcugcccgccacgcugcaggaccucgaccugaccggcaacaccaaccuggugcucgagcacaagacccuggacaucuucucccacaucacgacccugaagaucgaccagaagccgcuccccaccaccgacagcacggugaccuccaccuucuggagccacgggcuggccgagauggccggccagcgcaacaagcugugcgucagcgcccucgcgauggacuccuucgccgagggggugggcgccguguacgggauguucgacggcgaccggaacgaggagcugccccgccugcuccagugcaccauggccgacguccugcuggaggaggugcagcagagcacgaacgacaccguguucauggccaacaccuuccucgucucccaccgcaagcugggcauggcggggcagaagcugggcagcuccgcccuccugugcuacauccggcccgacaccgccgacccggccagcuccuucagccugacgguggcgaacguggggaccugccaggccguccucugccgcggcggcaagcccgugccccuguccaagguguucagccuggagcaggacccggaggaggcccagcgggucaaggaccagaaggccaucaucaccgaggacaacaaggugaacggggugaccugcugcacgcgcaugcucggcugcaccuaccuguaccccuggauccugcccaagccccacaucuccagcaccccgcucaccauccaggacgagcugcugauccucgggaacaaggcccugugggagcaccuguccuacacggaggcggucaacgccgugcggcacgugcaggacccccuggccgccgccaagaagcucugcacccuggcgcagagcuacggcugccaggacaacgucggggccauggugguguaccugaacaucggcgaggagggcugcacgugcgagaugaacgggcucacccugcccggccccgucggguucgccuccaccaccaccaucaaggacgccccgaagcccgccacccccagcuccagcuccggcaucgcgagcgaguucagcuccgagaugagcacguccgaggugagcuccgagguggggagcaccgccuccgacgagcacaacgccggcggccuggacaccgcccuccugccccgcccggagcggcgcugcagccugcaccccacccccacguccggccucuuccagcggcagcccagcuccgcgaccuucagcuccaaccagagcgacaacgggcuggacuccgacgacgaccagccggucgagggggugaucaccaacggcagcaagguggaggucgagguggacauccacugcugccgcgggcgggaccuggagaacuccccgccccucaucgagagcucccccacccugugcagcgaggagcacgcccgcggcagcugcuucggcauccggcgccagaacuccgugaacagcgggaugcugcuccccauguccaaggaccggauggagcugcagaagucccccagcaccagcugccuguacggcaagaagcucuccaacgggagcaucgucccccuggaggacucccugaaccucaucgagguggccacggaggugcccaagcgcaagaccggcuacuucgccgccccgacccagauggagcccgaggaccaguucgucgugccccacgaccuggaggaggaggugaaggagcagaugaagcagcaccaggacagccggcuggagccggagccccacgaggaggaccgcaccgagccgcccgaggaguucgacacggcgcucuga

SEQ ID NO: 34544 - RNA, 855 nt, Artificial Sequence
  derived and/or modified sequence opt1 from PHOX2A__Homo_sapiens__NP_005160
auggacuacagcuaccugaacuccuacgacagcugcguggccgccauggaggcguccgccuacggcgacuucggggccugcagccagcccggcggguuccaguacuccccgcuccgccccgccuuccccgccgcggggcccccgugccccgcccugggcagcuccaacugcgcccugggcgcccuccgggaccaccagcccgcgcccuacagcgccgucccguacaaguucuuccccgagcccuccggccugcacgagaagcgcaagcagcggcgcauccggaccaccuucacgagcgcccagcugaaggagcucgagcgcguguucgccgagacccacuaccccgacaucuacacccgggaggagcuggcccugaagaucgaccucaccgaggcgcgcgugcaggucugguuccagaaccggcgcgccaaguuccggaagcaggagcgcgccgccuccgccaagggggcggccggcgccgccggggccaagaagggcgaggcgcggugcagcuccgaggacgacgacagcaaggaguccacgugcagcccgacccccgacuccaccgccagccugccgccgccgcccgcccccgggcuggccagcccccgccucucccccagcccccugcccguggcccugggcuccggccccgggcccggccccgggccccagccccucaagggcgcgcugugggccggcguggccgggggcgggggcgggggcccgggcgccggggcggccgagcugcucaaggccuggcagcccgccgagagcggccccgggccguucuccggcguccugagcuccuuccaccggaagcccgggcccgcccugaagaccaaccucuucuga

SEQ ID NO: 34545 - RNA, 945 nt, Artificial Sequence
  derived and/or modified sequence opt1 from PHOX2B__Homo_sapiens__NP_003915
auguacaagauggaguacagcuaccugaacuccagcgccuacgaguccugcauggccggcauggacaccagcucccucgcgagcgccuacgccgacuucuccagcugcucccaggccagcggguuccaguacaaccccauccgcaccacguucggcgccaccuccgggugcccgagccugacccccggcuccugcagccuggggacccuccgggaccaccaguccagccccuacgcggccgugcccuacaagcuguucacggaccacggcggccugaacgagaagcgcaagcagcggcgcauccggaccaccuucaccuccgcccagcucaaggagcuggagcgcguguucgccgagacgcacuacccggacaucuacacccgggaggagcuggcgcucaagaucgaccugaccgaggcccgcguccaggugugguuccagaaccggcgcgccaaguuccggaagcaggagcgcgccgccgcggccgccgccgccgcggccaagaacgggagcuccggcaagaaguccgacagcagccgggacgacgagagcaaggaggccaaguccaccgaccccgacagcaccgggggccccgggcccaacccgaaccccacgcccuccugcggcgccaacggcgggggcgggggcggccccagcccggccggggcgcccggcgccgccgggcccggcgggcccggcggcgagccggggaagggcggggccgccgcggccgccgccgcggccgccgccgccgcggccgccgccgccgcggccgccgccggcgggcuggccgcggccggcggccccgggcagggcugggcccccgggcccggcccgaucaccuccauccccgacagccucgggggccccuucgccuccgugcugagcucccugcagcgccccaacggcgcgaaggccgcccucgucaagagcuccauguucuga

SEQ ID NO: 34546 - RNA, 375 nt, Artificial Sequence
  derived and/or modified sequence opt1 from PHPT1__Homo_sapiens__NP_001129333
auggccguggccgaccuggcgcucauccccgacgucgacaucgacagcgacggcguguucaaguacgugcugauccgcguccacuccgccccgcggagcggggcccccgccgccgaguccaaggagaucgugcgcggcuacaagugggcggaguaccacgccgacaucuacgacaaggugagcggggacaugcagaagcagggcugcgacugcgagugccucgggggcggccggaucucccaccagagccaggacaagaagauccacgucuacggguacuccaugaugcgcccgaccugcgugccccugggcgccagcgggccccggauccaccaccagggccugugguccugccccgcccgccacuucaacuga

SEQ ID NO: 34547 - RNA, 4950 nt, Artificial Sequence
  derived and/or modified sequence opt1 from PHRF1__Homo_sapiens__NP_001273510
auggacgacgacagccuggacgagcucguggcccgcucccccggcccggacgggcacccccaggucggccccgccgaccccgcgggggacuucgaggagagcuccgugggcagcuccggggacagcggcgacgacuccgacagcgagcacggcgacgggaccgacggcgaggacgagggggccuccgaggaggaggaccuggaggaccggagcggcuccgaggacagcgaggacgacggggagacccugcucgagguggccggcacgcagggcaagcuggaggccgccggguccuucaacagcgacgacgacgcggaguccugcccgaucugccugaacgccuuccgcgaccaggccgucggcacccccgagaacugcgcccacuacuucugccucgacugcaucguggaguggagcaagaacgcgaacuccugccccguggaccggacccuguucaagugcaucugcauccgcgcccaguucgggggcaagauccugcggaagauccccgucgagaacaccaaggccagcgaggaggaggaggacccgacguucugcgaggugugcggccgcuccgaccgggaggaccgccuccugcugugcgacgggugcgacgccggcuaccacauggagugccucgaccccccccugcaggaggugcccgucgacgagugguucugcccggagugcgccgcgcccgggguggugcuggccgccgacgccggccccgucagcgaggaggaggugagccuccugcuggccgacgugguccccaccaccucccggcuccgcccgcgggcggggcgcacccgggccaucgcccgcacgcggcagagcgagcgcgugcgggccaccgugaaccgcaaccggaucuccaccgcccgccggguccagcacacccccggccgccugggcagcucccugcucgacgaggcgaucgaggccguggccacggggcugagcaccgccguguaccagcgcccccugaccccccggaccccggcccgccggaagcgcaagacgcggcgccggaagaagguccccggccgcaagaagacccccuccgggcccagcgcgaaguccaagagcuccgccacccggagcaagaagcgccagcaccgggugaagaagcgccggggcaagaaggugaaguccgaggccaccacgcgcagccggaucgcccgcacccucgggcugcggcgcccgguccacuccagcugcauccccuccgugcugaagcccgucgagcccagccucggccugcugcgggcggacaucggcgccgccucccucagccuguucggggacccguacgagcuggaccccuucgacagcuccgaggagcucagcgccaacccccuguccccgcugagcgccaagcgccgcgcgcucucccggagcgcccugcagucccaccagcccguggcccgccccgugagcgucggccugucccggcgccggcuccccgccgccgugccggagcccgaccuggaggaggagcccgugcccgaccugcucgggagcauccuguccggccagagccugcucaugcugggguccagcgacgucaucauccaccgcgacggcucccugagcgcgaagcgggccgccccgguguccuuccagcgcaacagcggcagccucucccggggggaggagggcuucaaggggugccugcagccccgcgcccugcccagcggcucccccgcccagggcccgagcgggaaccggccccaguccaccggccugagcugccaggggcgcucccggacccccgcgcgcacggccggcgcccccgugcggcucgaccugccggccgcgcccggggccguccaggcccgcaaccugagcaacggcuccgugcccggcuuccggcagagccacucccccugguucaacgggaccaacaagcacacccucccgcuggccagcgccgcguccaagaucagcucccgcgacagcaagccccccugccgguccgugguccccggcccgccccugaagcccgccccgcgccggaccgacaucagcgagcucccccgcauccccaagauccgccgggacgacgggggcgggcgccgggacgccgcccccgcccacggccaguccaucgagaucccgagcgcgugcaucagccgccugacgggccgggaggggaccggccagcccgggcgcggcacccgggccgaguccgaggccagcucccgcgugccccgggagcccggggugcacaccggcagcucccgcccgcccgcccccagcucccacggcagccuggccccccucgggccgucccggggcaagggggucggcagcacguucgaguccuuccgcaucaacauccccgggaacauggcgcacagcucccagcugagcucccccggcuucugcaacaccuuccggcccguggacgacaaggagcagcgcaaggagaacccgagcccccuguucuccaucaagaagaccaagcagcuccggagcgagguguacgaccccuccgaccccaccggcagcgacagcuccgccccggggagcucccccgagcgcagcggccccgggcugcugcccuccgagaucacgcggaccaucagcaucaacuccccgaaggcccagaccguccaggccgugcgcugcgugaccagcuacaccgucgaguccaucuucggcacggagcccgagcccccccucggcccgagcuccgcgaugagcaagcugcggggggccguggccgccgagggcgccuccgacaccgagcgcgaggagcccaccgagagccaggggcuggcggcccgccuccggcgccccuccccgcccgagcccugggacgaggaggacggcgccagcugcuccaccuucuucgggagcgaggagcggacggugaccugcgucaccgugguggagcccgaggccccgcccucccccgacguccugcaggccgcgacccaccgcgugguggagcugcggcccccgagccgcagccgguccacgagcuccagccgcucccggaagaaggccaagcgcaagcgggucagccgcgagcacggccggacccgcuccggcacccggagcgagucccgcgaccggagcucccgcagcgccucccccagcgugggggaggagcggccccgccggcagcgcuccaaggccaagagccgccgguccagcuccgaccgcagcagcucccgggagcgcgccaagcggaagaaggcgaaggacaagagccgcgagcaccggcgcggccccugggggcacucccggcgcaccagccggucccgcagcggcuccccggggagcuccagcuacgagcacuacgagucccggaagaagaagaagcgccggagcgccucccgcccccggggccgcgagugcagccccacguccagccucgagcggcugugccgccacaagcaccagcgcgagcggucccacgagcgccccgaccggaaggagagcguggccuggccgcgcgaccggcgcaagcggcgcucccggagccccagcuccgagcaccgcgcccgggagcaccgccggccccgcagccgggagaaguggccccagacccgcucccacagcccggagcggaagggcgccguccgcgaggcgucccccgccccccuggcccagggggagcccggccgggaggaccucccgacccgccugcccgcccugggggaggcgcacgugagccccgagguggccaccgccgacaaggccccccuccaggccccgcccguccuggagguggcggccgagugcgagcccgacgaccuggaccucgacuacggcgacuccguggaggccgggcacgucuucgacgacuucagcuccgacgccguguucauccagcuggacgacaugagcuccccgcccagccccgaguccacggacagcucccccgagcgggacuucccgcugaagcccgcccucccccccgcgagccuggccguggccgccauccagcgcgaggucucccugaugcacgacgaggacccgagccagccccccccccucccggagggcacccaggagccccaccugcugcgccccgacgccgcggagaaggccgaggcccccagcuccccggacguggcccccgcgggcaaggaggacagccccuccgccagcgggcgggugcaggaggccgcccgccccgaggaggucgugucccagaccccgcuccugcggagccgcgcccuggugaagcgggucaccuggaaccuccaggaguccgagagcuccgcgcccgccgaggaccgcgccccccgggccccccugcaccgcccgcagaagccccgggagggcgccugggacauggaggacguggcgcccacgggggugcgccaggucuucagcgagcugccguuccccucccacgugcuccccgagcccggcuucccggacaccgaccccagccaggucuacucccccggccugcccccggcccccgcccagcccagcuccauccccccgugcgcccuggugagccagcccaccgugcaguucauccuccaggggucccugccccuggucggcugcggggccgcgcagacccucgcccccgugccggccgcccugacgcccgcgagcgagcccgccucccaggccaccgccgccagcaacagcgaggagaagacccccgcgccgcggcuggccgccgagaagaccaagaaggaggaguacaugaagaagcuccacaugcaggagcgcgccguggaggaggucaagcuggccaucaagcccuucuaccagaagcgggaggugacgaaggaggaguacaaggacauccugcgcaaggcggugcagaagaucugccacuccaagagcggcgagaucaaccccgucaagguggccaaccucgugaaggccuacgucgacaaguaccggcacaugcgccggcacaagaagcccgaggccggggaggagccgcccacccagggcgccgagggcuga

SEQ ID NO: 34548 - RNA, 2289 nt, Artificial Sequence
  derived and/or modified sequence opt1 from PHTF1__Homo_sapiens__XP_011538833
auggccagcaacgagcgcgacgccaucuccugguaccagaagaagaucggcgcguacgaccagcagaucugggagaaguccaucgagcagacccagaucaaggggcugaagaacaagcccaagaagaugggccacaucaagccggaccucaucgacguggaccugauccgggggagcaccuucgccaaggccaagcccgagauccccuggacgagccugacccgcaagggccucguccgggugguguucuucccccuguucuccaacugguggauccaggucaccagccugcgcaucuucguguggcuccugcugcucuacuucaugcaggucaucgccaucgugcuguaccugaugaugccgaucgugaacaucuccgaggugcucgggccccugugccugaugcuccugaugggcaccguccacugccagaucgugagcacgcagaucacccggcccuccggcaacaacgggaaccgccggcgccggaagcugcgcaagaccgugaacggcgacgggagccgggagaacggcaacaacuccagcgacaagguccgcgggaucgagacccucgaguccgugcccaucaucggcggcuucugggagacgaucuucgggaaccggaucaagcgcgugaagcugaucagcaacaagggcaccgagaccgacaacgacccguccugcguccaccccaucaucaagcggcgccagugccggcccgagauccgcauguggcagacccgggagaaggccaaguucagcgacggggagaagugccgccgggaggcguuccgccgccugggcaacggcguguccgacgaccucagcuccgaggaggacggggaggcccggacgcagaugauccugcugcgccggagcguggagggcgccagcuccgacaacgggugcgaggucaagaaccgcaagagcauccucucccggcaccugaacagccaggugaagaagaccaccacccgcuggugccacaucgugcgggacuccgacagccuggccgaguccgaguucgagagcgcggccuucucccagggcagccgcuccggggucagcggcggcucccggagccucaacaugucccgccgggacagcgaguccacgcgccacgacagcgagaccgaggacaugcugugggacgaccugcuccacgggcccgagugccgguccagcgugaccagcgacuccgagggcgcccacgugaacacccugcacagcgggacgaagcgcgacccgaaggaggacgucuuccagcagaaccaccuguucuggcuccagaacuccagccccuccagcgaccggguguccgccaucaucugggagggcaacgagugcaagaagauggacaugagcguccuggagaucuccgggaucaucaugagccgcgugaacgccuaccagcagggcgugggcuaccagaugcuggggaacgucgugaccaucggccucgcguucuuccccuuccugcaccggcuguuccgcgagaagucccucgaccagcucaagagcaucuccgccgaggagauccugacccuguucugcggggcgcccccggugacccccaucaucguccugagcaucaucaacuucuucgagcggcugugccucacguggauguucuucuucaugaugugcguggccgagcgcaccuacaagcagcgcuuccuguucgccaagcuguucucccacaucaccagcgcccggaaggcccgcaaguacgagaucccccacuuccggcucaagaagguggagaacaucaagaucuggcugucccugcgcagcuaccugaagcggcgcggcccccagcggagcgucgacgugguggucuccagcguguuccuccugacccuguccaucgccuucaucugcugcgcccaggugcuccaggggcacaagacguuccugaacgacgccuacaacugggaguuccugaucugggagaccgcgcuccugcuguuccuccugcgccuggccagccucggcuccgagaccaacaagaaguacagcaacgucuccauccugcugaccgagcagaucaaccucuaccugaagauggagaagaagccgaacaagaaggagcagcugacgcucgugaacaacgugcugaagcugagcaccaagcuccugaaggagcuggacacccccuuccggcucuacggccugaccaugaacccccugaucuacaacaucacgcgcgucgugauccucuccgccgugagcggggucaucuccgaccugcugggcuucaacauccggcucuggaagaucaagagcuga

SEQ ID NO: 34549 - RNA, 2244 nt, Artificial Sequence
  derived and/or modified sequence opt1 from PHTF2__Homo_sapiens__NP_001120830
auggccagcaaggugacggacgccaucgucugguaccagaagaagaucggcgcguacgaccagcagaucugggagaaguccguggagcagcgcgagaucaaggggcugcggaacaagcccaagaagaccgcccacgugaagccggaccucaucgacgucgaccuggugcgcggcagcgccuucgccaaggccaagcccgagucccccuggacgagccugacccggaaggggaucgugcgcgucguguucuuccccuucuucuuccggugguggcuccaggugaccuccaaggucaucuucuucuggcugcuggugcucuaccugcuccagguggcggccaucguccuguucugcagcaccuccagcccgcacuccaucccccugacggaggugaucggccccaucuggcugaugcuccugcuggggaccgugcacugccagaucgucagcacccgcacccccaagccgccccucuccacgggcggcaagcggcgccggaagcugcgcaaggccgcccaccuggaggugcaccgggagggggacggcagcuccaccaccgacaacacccaggagggggcggugcagaaccacggcacgagcaccucccacagcgucgggaccguguuccgcgaccucuggcacgccgccuucuuccuguccggcagcaagaaggccaagaacuccaucgacaagagcaccgagacggacaacggcuacgugagccuggacgggaagaagaccgucaaguccggcgaggacgggauccagaaccacgagccccagugcgagaccauccggcccgaggagaccgccuggaacacgggcacccuccgcaacggcccgagcaaggacacccagcggaccaucacgaacguguccgacgaggugagcuccgaggaggggcccgagaccggcuacagccugcgccggcacgucgaccgcaccuccgagggggugcugcggaaccgcaagagccaccacuacaagaagcacuaccccaacgaggacgcgcccaaguccggcaccagcugcuccagccggugcuccagcucccgccaggacagcgaguccgcccgcccggagagcgagacggaggacguccucugggaggaccugcugcacugcgccgagugccacuccagcugcaccagcgagaccgacguggagaaccaccagaucaaccccugcgugaagaaggaguaccgggacgaccccuuccaccagucccaccuccccuggcugcacagcucccacccggggcuggagaagaucagcgccaucgucugggagggcaacgacugcaagaaggccgacauguccgugcucgagaucagcggcaugaucaugaaccgcgugaacucccacauccccgggaucggcuaccagaucuucgggaacgcggucagccugauccugggccucacccccuucguguuccggcugucccaggccacggaccuggagcagcucaccgcccacagcgccuccgagcuguacgugaucgccuucgggagcaacgaggacgucaucgugcuguccauggugaucaucagcuucgucgugcgcgugucccucgucuggaucuucuucuuccugcugugcguggcggagcggaccuacaagcagcgccuccuguucgccaagcuguucggccaccucaccagcgcccggcgcgcccggaaguccgaggugccccacuuccgccugaagaagguccagaacaucaagauguggcugagccuccggagcuaccugaagcgccggggcccgcagcgcuccguggacgugaucgucagcuccgccuuccugcugacgaucagcgugguguucaucugcugcgcgcagcuccugcacguccacgagaucuuccuggacugccacuacaacugggagcucgugaucuggugcaucucccugacccuguuccuccugcgguucgugacccuggggagcgagaccuccaagaaguacagcaacaccuccauccuccugacggagcagaucaaccuguaccucaagauggagaagaagcccaacaagaaggaggagcugacccuggucaacaacgugcucaagcuggccaccaagcugcucaaggagcuggacagccccuuccgccuguacggccucaccaugaacccccugcuguacaacaucacccagguggucauccucuccgccgugagcggggugaucuccgaccugcugggcuucaaccucaagcuguggaagaucaagagcuga

SEQ ID NO: 34550 - RNA, 717 nt, Artificial Sequence
  derived and/or modified sequence opt1 from PHYH__Homo_sapiens__NP_001032626
augcgcgacgugaccaucagcaaguccgaguacgcccccagcgagaagaugaucaccaagguccaggacuuccaggaggacaaggagcuguuccgguacugcacgcucccggagauccugaaguacguggagugcuucaccggccccaacaucauggccaugcacaccaugcugaucaacaagccgcccgacuccgggaagaagaccagccgccacccccuccaccaggaccugcacuacuuccccuuccggcccuccgaccugaucgugugcgcguggacggccauggagcacaucagccgcaacaacggcugccucgucgugcugcccgggacccacaagggcucccugaagccgcacgacuaccccaagugggagggcggggugaacaagauguuccacggcauccaggacuacgaggagaacaaggcccggguccaccucgugauggagaagggggacaccguguucuuccacccccugcugauccacggcagcgggcagaacaagacccagggcuuccgcaaggccaucuccugccacuucgccagcgcggacugccacuacaucgacgucaaggggacgucccaggagaacaucgagaaggagguggugggcaucgcccacaaguucuucggcgccgagaacagcgucaaccucaaggacaucuggauguuccgggcccgccuggugaagggggagcggaccaaccuguga

SEQ ID NO: 34551 - RNA, 993 nt, Artificial Sequence
  derived and/or modified sequence opt1 from PHYHIP__Homo_sapiens__NP_001092805
auggagcugcucagcacgccccacuccaucgagaucaacaacaucacgugcgacagcuuccgcaucuccugggccauggaggacagcgaccuggagcgggugacccacuacuucaucgaccugaacaagaaggagaacaagaacuccaacaaguucaagcaccgcgacgucccgaccaagcucguggccaaggcggugccccugcccaugaccguccggggccacugguuccugagcccccgcaccgaguacuccguggccgugcagaccgccgucaagcagagcgacggggaguaccucguguccggcuggagcgagaccguggaguucugcaccggggacuacgccaaggagcaccuggcccagcugcaggagaaggcggagcagaucgccggccggaugcuccgcuucuccgucuucuaccggaaccaccacaaggaguacuuccagcacgcccgcacccacugcgggaacaugcugcagccguaccugaaggacaacagcggcucccacggcagccccacguccgggaugcuccacggcguguucuucagcugcaacaccgaguucaacaccgggcagccgccccaggacucccccuacggccgguggcgcuuccagauccccgcccagcggcuguucaaccccagcaccaaccuguacuucgcggacuucuacugcauguacacggccuaccacuacgccauccucgugcuggcccccaaggggucccugggcgaccgcuucugccgggaccgccucccgcugcuggacaucgccugcaacaaguuccugaccugcagcgucgaggacggcgagcucguguuccggcacgcgcaggaccugauccucgagaucaucuacaccgagcccguggaccugagccuggggacccucggcgagaucuccgggcaccagcugaugagccuguccacggccgacgccaagaaggaccccagcugcaagaccugcaacaucuccgucggccgcuga

SEQ ID NO: 34552 - RNA, 1353 nt, Artificial Sequence
  derived and/or modified sequence opt1 from PHYKPL__Homo_sapiens__NP_699204
auggccgccgaccagcgccccaaggcggacacccuggcccuccggcagcgccugaucagcuccagcugccggcuguucuucccggaggaccccgugaagaucguccgcgcccagggccaguacauguacgacgagcagggggccgaguacaucgacugcaucuccaacguggcccacgugggccacugccacccccucgucgugcaggcggcccacgagcagaaccaggugcugaacaccaacagccgguaccugcacgacaacaucgucgacuacgcccagcgccucuccgagacgcugcccgagcagcugugcguguucuacuuccucaacagcggguccgaggccaacgaccuggcgcugcggcucgcccgccacuacaccggccaccaggacguggucgugcuggaccacgccuaccacgggcaccugagcucccucaucgacaucagcccguacaaguuccggaaccuggacggccagaaggagugggugcacgucgcgccccugcccgacaccuaccgcggccccuaccgggaggaccacccgaaccccgccauggccuacgccaacgaggugaagcgcguggucuccagcgcccaggagaaggggcggaagaucgccgccuucuucgcggagucccuccccagcgugggcgggcagaucaucccgcccgccggcuacuucucccagguggccgagcacauccgcaaggccgggggcgucuucguggccgacgagauccaggugggcuucgggcgggucggcaagcacuucugggcguuccagcugcaggggaaggacuucgugcccgacaucgugaccaugggcaagagcaucggcaacgggcaccccgucgccugcguggccgccacgcagcccgucgcccgcgcguucgaggccaccggcguggaguacuucaacaccuucgggggcuccccggugagcugcgccgucgggcuggccgugcucaacgugcuggagaaggagcagcugcaggaccacgcgaccuccgucggcagcuuccucaugcagcugcugggccagcagaagaucaagcaccccaucgugggggacgugcggggcgucggccucuucaucgggguggaccugaucaaggacgaggccacgcgcacccccgccaccgaggaggccgccuaccuggugagccggcucaaggagaacuacguccugcuguccaccgacgggcccggccgcaacauccucaaguucaagccgcccaugugcuucagccuggacaacgcgcgccaggugguggccaagcuggacgccauccucacggacauggaggagaagguccgguccugcgagacccugcgccugcagcccuga

SEQ ID NO: 34553 - RNA, 777 nt, Artificial Sequence
  derived and/or modified sequence opt1 from PI15__Homo_sapiens__NP_056970
augaucgccaucagcgccguguccagcgcgcuccuguucucccugcugugcgaggccagcaccgucgugcuccugaacuccaccgacagcuccccgcccacgaacaacuucaccgacaucgaggccgcccugaaggcccagcucgacagcgcggacauccccaaggcccgccggaagcgcuacaucucccagaacgacaugaucgccauccuggacuaccacaaccaggugcggggcaaggucuucccgcccgccgcgaacauggaguacauggugugggacgagaaccuggccaagagcgccgaggccugggccgcgaccugcaucugggaccacgggcccuccuaccuccugcgcuuccugggccagaaccucagcgugcggaccgggcgcuaccgguccauccugcagcuggucaagcccugguacgacgaggugaaggacuacgccuuccccuacccccaggacugcaacccgcgcugccccaugcggugcuucggccccaugugcacgcacuacacccagauggugugggccaccagcaaccgcaucgggugcgccauccacacgugccagaacaugaacgucuggggcuccguguggcggcgcgccguguaccucgucugcaacuacgcgcccaagggcaacuggaucggggaggccccguacaaggugggcgugcccugcagcuccugcccgcccagcuacgggggcuccugcaccgacaaccugugcuuccccggggucaccagcaacuaccuguacugguucaaguga

SEQ ID NO: 34554 - RNA, 1392 nt, Artificial Sequence
  derived and/or modified sequence opt1 from PI16__Homo_sapiens__NP_001186088
augcacggcagcugcuccuuccugaugcuccugcugccccuccugcugcuccugguggccaccaccgggccggucggcgcccugacggacgaggagaagcgccucaugguggagcugcacaaccuguaccgggcccaggugagccccaccgccuccgacaugcuccacaugcgcugggacgaggagcuggccgccuucgccaaggcguacgcccggcagugcgucugggggcacaacaaggagcgcggccggcgcggggagaaccuguucgccaucaccgacgagggcauggacgugccccucgccauggaggaguggcaccacgagcgggagcacuacaaccugagcgcggcgaccugcucccccggccagaugugcgggcacuacacccagguggucugggccaagacggagcgcaucggcugcgggagccacuucugcgagaagcugcagggcguggaggagaccaacaucgagcuccuggugugcaacuacgagccgcccgggaacgucaagggcaagcggcccuaccaggagggcacccccugcucccagugcccgagcggguaccacugcaagaacucccugugcgagcccaucggcagccccgaggacgcccaggaccuccccuaccuggugacggaggccccguccuuccgcgcgaccgaggccagcgacucccggaagauggggacccccagcucccuggccaccggcauccccgccuuccucgugacggaggucagcggcucccuggccaccaaggcgcugcccgccguggagacccaggccccgaccagccucgccacgaaggacccgcccuccauggccaccgaggcgcccccgugcgugaccaccgagguccccagcauccuggccgcccacagccugcccucccucgacgaggagcccgugacguuccccaagagcacccacgugcccauccccaaguccgccgacaaggucaccgacaagaccaaggugcccagccgcuccccggagaacagccuggaccccaagaugucccugacgggggcccgggagcuccugccccacgcgcaggaggaggccgaggccgaggccgagcugccgcccagcuccgaggugcucgcgagcgucuuccccgcccaggacaagcccggcgagcugcaggccacccuggaccacaccgggcacaccuccagcaagucccucccgaacuuccccaacacgagcgccaccgccaacgcgaccggcgggcgcgcccuggcccugcaguccagccuccccggcgccgagggccccgacaagccguccguggugagcgggcugaacuccggccccgggcacgucuggggcccccugcucgggcugcugcuccugcccccgcuggugcuggccggcaucuucuga

SEQ ID NO: 34555 - RNA, 354 nt, Artificial Sequence
  derived and/or modified sequence opt1 from PI3__Homo_sapiens__NP_002629
augcgcgccagcuccuuccugaucguggucguguuccucaucgccggcacccuggugcuggaggcggccgucaccggggugcccgugaagggccaggacacggucaaggggcgggugccguucaacggccaggaccccgugaaggggcaggucagcgugaagggccaggacaaggugaaggcccaggagcccgucaagggccccguguccaccaagccggggagcugccccaucauccucauccgcugcgccaugcugaacccgcccaaccggugccugaaggacaccgacugccccggcaucaagaagugcugcgagggguccugcggcauggccugcuucgugccccaguga

SEQ ID NO: 34556 - RNA, 1440 nt, Artificial Sequence
  derived and/or modified sequence opt1 from PI4K2A__Homo_sapiens__NP_060895
auggacgagaccagcccccuggugucccccgagcgcgcccagccgcccgacuacaccuuccccagcggcuccggggcccacuucccccagguccccggcggggcggugcggguggccgccgccgccggcagcgggcccuccccgcccggcagccccggccacgaccgcgagcggcagccccuccuggaccgcgcgcgcggggccgccgcccagggccagacgcagaccgucgcggcccaggcccaggcccuggccgcgcaggccgccgccgccgcgcacgccgcccaggcccaccgggagcggaacgaguuccccgaggacccggaguucgaggccguggugcgccaggcggagcucgccaucgagcggugcaucuuccccgagcgcaucuaccagggguccagcggcuccuacuucgucaaggacccccaggggcggaucaucgccguguucaagcccaagaacgaggagccguacggccaccugaaccccaaguggaccaaguggcugcagaagcucugcugccccugcugcuucggccgcgacugccuggugcugaaccagggguaccucagcgaggccggcgccucccuggucgaccagaagcuggagcucaacaucgugccccggaccaagguggucuaccuggcgagcgagacguucaacuacuccgccaucgaccgcgucaagagccgggggaagcgccuggcccucgagaaggugccgaaggugggccagcgguucaaccgcaucggccugccgcccaaggugggguccuuccagcuguucguggagggcuacaaggacgccgacuacuggcuccggcgcuucgaggcggagccccugcccgagaacaccaaccggcagcugcuccugcaguucgagcgccuggucgugcucgacuacaucauccgcaacaccgaccgggggaacgacaacuggcugaucaaguacgacugccccauggacagcuccagcucccgcgacaccgacuggguggucgugaaggagcccgugaucaaggucgccgccaucgacaacggccuggccuucccccucaagcacccggacagcuggcgggccuaccccuucuacugggcguggcugccccaggccaaggugccguucagccaggagaucaaggaccugauccuccccaagaucuccgaccccaacuucgucaaggaccuggaggaggaccuguacgagcuguucaagaaggaccccggguucgaccgcggccaguuccacaagcagaucgccgugaugcggggccagauccucaaccugacgcaggcccucaaggacaacaagagcccgcugcaccuggugcagaugccgcccgucaucguggagaccgcccgcucccaccagcggagcuccagcgaguccuacacccagagcuuccagucccgcaagcccuucuucagcuggugguga

SEQ ID NO: 34557 - RNA, 1446 nt, Artificial Sequence
  derived and/or modified sequence opt1 from PI4K2B__Homo_sapiens__NP_060793
auggaggaccccagcgagccggaccgccuggccuccgccgacggcgggagccccgaggaggaggaggacggcgagcgggagccccuccugccccgcaucgcgugggcccacccgcggcgcggggcccccggcuccgccgugcggcugcucgacgccgcgggggaggagggcgaggccggcgacgaggagcugccccugcccccgggggacgucggcgugagccgcuccagcuccgccgagcucgaccggagccgccccgccguguccgucaccaucgggaccagcgagaugaacgcguuccuggacgaccccgaguucgccgacaucaugcugcgggccgagcaggccaucgaggugggcaucuuccccgagcgcaucucccaggggagcuccggcagcuacuucgugaaggacccgaagcggaagaucaucggcgucuucaagcccaaguccgaggagcccuacgggcagcucaaccccaaguggacgaaguacgugcacaaggugugcugcccgugcugcuucggccgcgggugccugauccccaaccagggcuaccugagcgaggccggcgcguaccucgucgacaacaagcugcaccuguccaucgugcccaagaccaagguggucuggcucgugagcgagaccuucaacuacaacgccaucgaccgggccaagucccgcgggaagaaguacgcccuggagaaggugcccaaggucggccggaaguuccaccgcaucgggcugccgcccaagaucggcagcuuccagcuguucguggagggguacaaggaggccgaguacuggcuccggaaguucgaggcggacccccugcccgagaacauccgcaagcaguuccagagccaguucgagcggcucgugauccuggacuacaucauccgcaacaccgaccggggcaacgacaacuggcugguccgcuacgagaagcagaagugcgagaaggagaucgaccacaaggaguccaaguggaucgacgacgaggaguuccucaucaagaucgccgccaucgacaacggccuggccuucccguucaagcaccccgacgaguggcgcgccuaccccuuccacugggcguggcugccccaggccaaggugccguucagcgaggagauccggaaccucauccugcccuacaucuccgacaugaacuucgugcaggaccugugcgaggaccucuacgagcuguucaagacggacaagggguucgacaaggccaccuucgagagccagauguccgucaugcgcggccagauccugaaccucacccaggcccugcgggacgggaagucccccuuccagcuggugcagaucccgugcgugaucgucgagcgcagccagggcgggagccagggccggaucgugcaccucuccaacagcuucacccagacggucaacugccgcaagcccuucuucuccagcugguga

SEQ ID NO: 34558 - RNA, 6309 nt, Artificial Sequence
  derived and/or modified sequence opt1 from PI4KA__Homo_sapiens__NP_477352
auggccgccgcgcccgcccgcggcgggggcgggggcgggggcggcgggggcgggugcuccggcuccgggagcuccgccagccggggcuucuacuucaacaccgugcugucccuggcccgcagccuggccguccagcggcccgcgucccuggagaaggugcagaagcuccugugcaugugccccguggacuuccacggcaucuuccagcuggacgagcgccggcgcgacgccgucaucgcccucgggaucuuccugaucgagagcgaccugcagcacaaggacugcguggugcccuaccuccugcggcugcucaagggccugcccaaggucuacuggguggaggaguccaccgcccgcaaggggcggggcgcgcugcccguggccgagagcuucuccuucugccucgucacgcugcugagcgacguggccuaccgcgaccccucccuccgggacgagauccuggaggugcugcuccagguccugcacgugcugcucggcaugugccaggcccuggagauccaggacaaggaguaccugugcaaguacgccauccccugccucaucgggaucagccgcgcguucggccgguacuccaacauggaggagagccugcuguccaagcuguuccccaagaucccgccccacagccugcgcgugcuggaggagcucgaggggguccggcgccgguccuucaacgacuuccgcagcauccugcccagcaaccugcucaccgugugccaggagggcacccugaagcggaagaccuccagcguguccagcaucucccaggucagccccgagcgcgggaugcccccgcccuccagccccggcggcuccgccuuccacuacuucgaggccagcugccugccggacgggacggcccucgagcccgaguacuacuucuccaccaucagcuccagcuucuccgugagcccccuguucaacggcgugaccuacaaggaguucaacaucccccuggagaugcuccgggagcugcugaaccucgucaagaagaucguggaggaggccgugcugaagucccuggacgcgaucgucgccagcgugauggaggccaacccguccgccgaccucuacuacaccagcuucagcgacccccuguaccugacgauguucaagaugcugcgcgacacccucuacuacaugaaggaccugcccaccuccuucgucaaggagauccacgacuucgugcuggagcaguucaacaccagccagggggagcuccagaagauccugcacgacgccgaccgcauccacaacgagcugagcccccugaagcugcggugccaggcgaacgccgccugcguggaccugauggucugggccgugaaggacgagcagggcgccgagaaccucugcaucaagcugagcgagaagcugcaguccaagacgagcuccaaggugaucaucgcgcaccucccgcugcugaucugcugccuccaggggcugggccgccugugcgagcgguuccccgucguggugcacagcgucacccccucccuccgcgacuuccuggugauccccagcccggugcuggucaagcucuacaaguaccacucccaguaccacaccguggccggcaacgacaucaagaucagcgugaccaacgagcacuccgagagcacgcugaacgucauguccgggaagaagucccagcccuccauguacgagcagcugcgggacaucgccaucgacaacaucugccgcugccucaaggccggccugaccguggaccccgugaucgucgaggcguuccuggccagccucagcaaccggcuguacaucucccaggagagcgacaaggacgcccaccugaucccggaccacaccauccgcgcccucgggcacaucgccguggcgcugcgggacacccccaaggugauggagcccauccugcagauccuccagcagaaguucugccagcccccgagcccccucgacguccugaucaucgaccagcucggcugccuggugaucacggggaaccaguacaucuaccaggagguguggaaccuguuccagcagaucagcgucaaggccuccagcgugguguacuccgccaccaaggacuacaaggaccacggcuaccgccacugcagccucgccgucaucaacgcccuggcgaacaucgccgccaacauccaggacgagcaccugguggacgagcuccugaugaaccugcucgagcuguucgugcagcugggccucgaggggaagcgggccuccgagcgcgccagcgagaagggccccgcgcugaaggccuccagcuccgccgggaaccugggcguccucauccccgugaucgccgugcugacccggcgccugccgcccaucaaggaggcgaagccccggcuccagaagcuguuccgcgacuucuggcuguacagcguccucaugggcuucgccguggagggguccggccuguggcccgaggagugguacgagggggugugcgagaucgccaccaagagcccgcugcucacguuccccuccaaggagccccugcggagcguccugcaguacaacuccgccaugaagaacgacaccgugacccccgccgagcucagcgagcugcgcagcaccaucaucaaccugcucgacccgccgcccgagguguccgcgcugaucaacaagcuggacuucgccaugagcacguaccuccuguccgucuaccggcuggaguacaugcgcgugcuccgcagcaccgaccccgaccgguuccaggugauguucugcuacuucgaggacaaggccauccagaaggacaaguccggcaugaugcagugcgucaucgccguggccgacaagguguucgacgcguuccugaacaugauggccgacaaggccaagaccaaggagaacgaggaggagcuggagcgccacgcccaguuccuccuggucaacuucaaccacauccacaagcggauccgccggguggccgacaaguaccugagcgggcucguggacaaguucccgcaccuccugugguccggcaccguccucaagacgaugcuggacauccugcagacccucagccugucccugagcgcggacauccacaaggaccagcccuacuacgacauccccgacgcccccuaccgcaucaccgugccggacaccuacgaggcccgggaguccaucgugaaggacuucgccgcgcgcugcggcaugauccuccaggaggccaugaagugggcccccacggucaccaagagccaccuccaggaguaccugaacaagcaccagaacuggguguccgggcucagccagcacaccggccuggccauggccaccgaguccauccugcacuucgcgggguacaacaagcagaacaccacgcucggcgccacccagcugagcgagcggcccgccugcgucaagaaggacuacuccaacuucauggccagccugaaccugcgcaaccgguacgccggggagguguacggcaugauccgcuucuccggcaccaccgggcagaugagcgaccucaacaagaugauggugcaggaccugcacagcgcgcuggaccggucccacccgcagcacuacacgcaggccauguucaagcucaccgccaugcugaucagcuccaaggacugcgacccccagcugcuccaccaccugugcuggggcccccugcgcauguucaacgagcacgggauggagaccgcccucgccugcugggaguggcugcuggcgggcaaggacggggucgaggugcccuucaugcgggagauggccggcgccuggcacaugaccguggagcagaaguucggccucuucagcgccgagaucaaggaggccgacccgcuggcggccuccgaggccagccagcccaagcccugcccgcccgaggucacgccccacuacaucuggaucgacuuccuggugcagcgcuucgagaucgccaaguacugcuccagcgaccagguggagaucuucuccagccuccugcagcgguccaugagccugaacaucgggggcgcgaagggguccaugaaccgccacgucgccgccaucggcccccgguucaagcuccugacccuggggcucagccugcugcacgccgacguggugcccaacgccaccauccgcaacguccuccgggagaagaucuacuccaccgcguucgacuacuucagcugcccgcccaaguuccccacgcagggcgagaagcgccugcgcgaggacaucuccaucaugaucaaguucuggaccgccauguucagcgacaagaaguaccugaccgccucccagcucgugcccccggacaaccaggacacccggagcaaccuggacaucacggugggcagccgccagcaggccacccagggguggaucaacaccuacccccuguccagcggcauguccaccaucagcaagaaguccgggaugagcaagaagacgaaccggggcucccagcuccacaaguacuacaugaagcgccggacccugcugcucagccugcuggccaccgagaucgagcgccucaucaccugguacaacccccuguccgcgcccgagcuggagcucgaccaggccggcgagaacagcgucgccaacuggcgguccaaguacaucagccuguccgagaagcaguggaaggacaacgugaaccuggccuggagcaucuccccguaccucgccgugcagcugcccgcgcgcuucaagaacacggaggccaucgggaacgaggucacccggcuggugcgccucgaccccggcgccgugagcgacguccccgaggccaucaaguuccuggugaccuggcacaccaucgacgcggacgccccggagcugucccacgugcucugcugggcccccacggacccgcccaccgggcugagcuacuucuccagcauguacccgccccacccccugaccgcccaguacggcgucaaggugcuccggagcuucccgcccgacgccauccuguucuacaucccccagaucgugcaggcgcugcgcuacgacaagaugggguacguccgggaguacauccucugggccgccuccaagagccagcugcuggcccaccaguucaucuggaacaugaagaccaacaucuaccucgacgaggagggccaccagaaggaccccgacaucggcgaccugcuggaccagcucguggaggagaucacggggucccugagcggcccggccaaggacuucuaccagcgcgaguucgacuucuucaacaagaucaccaacguguccgcgaucaucaagcccuaccccaagggggacgagcggaagaaggccugccugagcgcccucuccgaggucaaggugcagcccggcugcuaccugccgagcaaccccgaggccaucgugcuggacaucgacuacaaguccgggacccccaugcagagcgccgcgaaggcccccuaccucgccaaguucaaggucaagcgcugcggcguguccgagcuggagaaggagggccugcggugccgcagcgacuccgaggacgagugcagcacccaggaggccgacgggcagaagaucuccuggcaggcggccaucuucaaggugggcgacgacugccggcaggacaugcucgcccugcagaucaucgaccuguucaagaacaucuuccagcucgucgggcuggaccuguucguguucccguaccgcguggucgccacggcccccggcugcggggugaucgagugcauccccgacugcaccagccgcgaccagcucggccggcagaccgacuucggcauguacgacuacuucacccgccaguacggggacgaguccacccuggcguuccagcaggcccgguacaacuucauccgcagcauggccgccuacucccugcuccuguuccugcuccagaucaaggaccggcacaacggcaacaucaugcuggacaagaaggggcacaucauccacaucgacuucggcuucauguucgagagcagccccggcgggaaccugggcugggagccggacaucaagcucacggacgagauggugaugaucaugggcgggaagauggaggccacccccuucaagugguucauggagaugugcguccgcggguaccuggcggugcggcccuacauggacgccguggucucccuggugacccucaugcuggacaccggccugcccugcuuccgcggccagacgaucaagcuccugaagcaccgguucagcccgaacaugaccgagcgcgaggccgccaacuucaucaugaaggugauccaguccugcuuccugagcaaccggucccgcaccuacgacaugauccaguacuaccagaacgacauccccuacuga

SEQ ID NO: 34559 - RNA, 2406 nt, Artificial Sequence
  derived and/or modified sequence opt1 from PI4KB__Homo_sapiens__NP_001185703
augggcgacaccguggucgagcccgccccgcugaagcccaccagcgagcccacguccgggcccccgggcaacaacgggggcagccuccuguccgugaucaccgagggggugggcgagcugagcgucaucgaccccgagguggcccagaaggcgugccaggaggugcucgagaaggucaagcugcugcacggcgggguggccguguccagccgcggcacgccccucgagcuggucaacggggacggcguggacuccgagauccggugccuggacgacccgcccgcccagauccgcgaggaggaggacgagaugggggccgccguggcgagcggcaccgccaagggcgcccggcgccggcgccagaacaacuccgccaagcagagcuggcuccugcggcuguucgaguccaagcuguucgacaucagcauggcgaucuccuaccuguacaacagcaaggagcccgggguccaggccuacaucggcaaccgccuguucugcuuccggaacgaggacguggacuucuaccucccccagcugcugaacauguacauccacauggacgaggacgugggggacgccaucaagcccuacaucguccaccgcugccggcaguccaucaacuucagccuccagugcgcccugcugcucggcgccuacuccagcgacaugcacaucuccacccagcgccacagccggggcaccaagcugcgcaagcugauccucagcgacgagcugaagccggcgcaccggaagcgcgagcugcccucccucagccccgcccccgacaccgggcuguccccgagcaagcggacccaccagcgcuccaagagcgacgccacggccuccaucagccuguccagcaaccucaagcggaccgccuccaaccccaagguggagaacgaggacgagcccgugcgccuggcgcccgagcgggaguucaucaagagccugauggccaucggcaagcgccucgccacccugccgaccaaggagcagaagacgcagcgccugaucuccgagcucagccugcugaaccacaagcuccccgcccgggucuggcugcccaccgccggguucgaccaccacguggugcgcgucccccacacccaggcgguggugcugaacuccaaggacaaggccccguaccucaucuacgucgaggugcuggagugcgagaacuucgacaccacgagcguccccgcccggauccccgagaaccgcauccgguccacccgcagcguggagaaccugcccgagugcggcaucacccacgagcagcgggccggguccuucagcaccgugccgaacuacgacaacgacgacgaggccuggagcgucgacgacaucggcgagcuccagguggagcugcccgaggugcacacgaacuccugcgacaacaucagccaguucuccgucgacagcaucaccucccaggagagcaaggagcccguguucaucgcggccggcgacauccgccggcgccuguccgagcagcucgcccacaccccgaccgccuucaagcgggaccccgaggaccccagcgcgguggcccugaaggagcccuggcaggagaagguccgccggauccgcgagggguccccguacggccaccuccccaacuggcggcugcucagcgugaucgugaagugcggggacgaccugcgccaggagcugcucgccuuccagguccugaagcagcugcaguccaucugggagcaggagcgggugccccucuggaucaagcccuacaagauccuggugaucagcgccgacuccggcaugaucgagccggucgugaacgccgugagcauccaccaggucaagaagcagucccagcugagccuccuggacuacuuccugcaggagcacggguccuacacgaccgaggcguuccucagcgcccagcgcaacuucgugcagagcugcgccggcuacugccuggugugcuaccugcuccaggucaaggaccggcacaacggcaacauccugcuggacgccgaggggcacaucauccacaucgacuucggcuucauccucuccagcagcccccgcaaccugggguucgagaccuccgccuucaagcugaccacggaguucguggacgugaugggcgggcucgacggcgacauguucaacuacuacaagaugcugaugcugcagggccucaucgcggcccgcaagcacauggacaaggucgugcagaucguggagaucaugcagcaggggucccagcugcccugcuuccacggcagcuccaccauccggaaccugaaggagcgcuuccacaugagcaugaccgaggagcagcuccagcugcuggucgagcagaugguggacggguccaugcggagcaucaccacgaagcucuacgacggcuuccaguaccugaccaacggcaucauguga

SEQ ID NO: 34560 - RNA, 1956 nt, Artificial Sequence
  derived and/or modified sequence opt1 from PIAS1__Homo_sapiens__NP_057250
auggccgacagcgccgagcugaagcagauggugaugucccuccgcgucagcgagcuccaggugcugcugggcuacgcggggcggaacaagcacggccgcaagcacgagcugcugaccaaggcccuccaccuccugaaggccgggugcucccccgccgugcagaugaagaucaaggagcuguaccggcgccgguucccgcagaagaucaugacccccgccgaccugagcauccccaacguccacuccagccccaugccggcgacgcugucccccagcaccaucccccagcucaccuacgacggccaccccgccuccagcccgcugcugcccgugucccuccuggggcccaagcacgagcuggagcucccccaccugaccagcgcccugcacccggugcaccccgacaucaagcuccagaagcugcccuucuacgaccugcucgacgagcugaucaagcccacgucccuggccagcgacaacucccagcgcuuccgggagaccugcuucgcguucgcccucaccccgcagcagguccagcagaucagcuccagcauggacaucuccggcaccaagugcgacuucacgguccaggugcagcugcgcuucugccugagcgagaccagcugcccccaggaggaccacuucccgcccaaccucugcgugaaggugaacaccaagcccugcucccugcccggcuaccugccgcccaccaagaacgggguggagcccaagcggcccagccgccccaucaacaucacgucccucguccggcugagcaccaccgugcccaacaccaucguggucuccuggacggccgagaucggccgcaacuacagcauggccguguaccuggugaagcagcucuccagcaccguccugcugcagcggcuccgcgccaaggggauccggaacccggaccacucccgcgcgcugaucaaggagaagcugaccgccgaccccgacagcgagaucgccaccacgucccuccgggugagccugcugugcccccucggcaagaugcgccugaccaucccgugccgggcccugaccugcucccaccuccagugcuucgacgccacccuguacauccagaugaacgagaagaagcccacgugggugugccccgucugcgacaagaaggcgcccuacgagcaccugaucaucgacgggcuguucauggagauccucaaguacugcaccgacugcgacgagauccaguucaaggaggacggcaccugggccccgaugcgcagcaagaaggaggugcaggagguguccgccagcuacaacggcgucgacgggugccuguccagcacccuggagcaccagguggccucccaccaccagagcagcaacaagaacaagaaggucgaggugaucgaccucacgaucgacuccagcuccgacgaggaggaggaggagcccagcgccaagcggaccugccccucccugagccccaccuccccgcugaacaacaagggcauccucagccugccccaccaggcgucccccgugagccgcacccccucccugccggccgucgacacgagcuacaucaacaccucccucauccaggacuaccgccaccccuuccacaugacccccaugcccuacgaccugcaggggcuggacuucuucccguuccucagcggcgacaaccagcacuacaacaccucccugcuggccgccgccgcggccgccgugagcgacgaccaggaccuccugcacuccagccgguucuuccccuacacgagcucccagauguuccuggaccagcucagcgccggcggguccaccagccugcccaccaccaacggcuccagcuccgggagcaacuccagccugguguccagcaacucccuccgcgagagccacucccacaccgucacgaaccggagcuccaccgacaccgcgagcaucuucggcaucauccccgacaucaucucccuggacuga

SEQ ID NO: 34561 - RNA, 1866 nt, Artificial Sequence
  derived and/or modified sequence opt1 from PIAS2__Homo_sapiens__NP_004662
auggccgacuucgaggagcugcgcaacauggugagcuccuuccgggucagcgagcuccaggugcugcugggcuucgccgggcgcaacaaguccggccggaagcacgaccuccugaugcgcgcgcugcaccuccucaagagcgggugcucccccgccgugcagaucaagauccgggagcuguaccgccggcgcuacccgcggacccucgagggccugagcgaccuguccaccaucaagagcuccgucuucagccucgacgggggcuccagccccguggagcccgaccuggccguggccggcauccacucccugcccagcacguccgucaccccgcacagccccuccagccccgugggguccgugcuccugcaggacaccaagcccaccuucgagaugcagcagccgagcccgcccaucccgcccguccaccccgacgugcagcugaagaaccuccccuucuacgacgugcuggacguccugaucaagcccacgagccucgugcaguccagcauccagcgcuuccaggagaaguucuucaucuucgcccugaccccgcagcagguccgggagaucugcaucucccgcgacuuccugcccggcgggcggcgcgacuacaccguccaggugcagcugcggcugugccuggcggagaccagcugcccccaggaggacaacuaccccaacucccucugcaucaaggugaacggcaagcuguucccgcugcccggguacgccccgccgcccaagaacggcaucgagcagaagcgccccggccggccccucaacaucacgagccuggugcgccuguccagcgccgugcccaaccagaucuccaucagcugggccuccgagaucgggaagaacuacagcauguccguguaccucguccggcagcugaccagcgcgaugcugcuccagcgccugaagaugaagggcauccggaaccccgaccacucccgcgcccugaucaaggagaagcucaccgccgaccccgacagcgagaucgccaccacgucccugcgcgugagccugaugugcccccucgggaagaugcggcugaccauccccugccgcgccgugaccugcacccaccuccagugcuucgacgcggcccuguaccugcagaugaacgagaagaagcccacguggaucugccccgucugcgacaagaaggccgccuacgagucccugauccucgacggccuguucauggagauccugaacgacugcagcgacguggacgagaucaaguuccaggaggacggcagcuggugccccaugcggccgaagaaggaggccaugaaggucuccagccagcccugcaccaagaucgaguccagcuccgugcugagcaagcccugcuccgugaccgucgcgagcgaggccuccaagaagaagguggacgugaucgaccucaccaucgagagcuccagcgacgaggaggaggacccgcccgccaagcgcaagugcaucuucauguccgagacgcagagcucccccaccaaggggguccugauguaccagcccagcuccgugcgggugcccagcgucaccagcguggacccggccgccaucccgcccucccugaccgacuacagcgugcccuuccaccacacgcccaucuccagcauguccagcgaccuccccggccuggacuuccugucccucauccccgucgacccccaguacugcccgcccauguuccuggacagccugaccagcccccucaccgcguccuccaccagcgugacgaccaccuccagccacgaguccagcacccacguguccagcuccagcagccgcuccgagacgggggucaucaccagcuccggcagcaacauccccgacaucaucucccuggacuga

SEQ ID NO: 34562 - RNA, 1533 nt, Artificial Sequence
  derived and/or modified sequence opt1 from PIAS4__Homo_sapiens__NP_056981
auggccgccgagcugguggaggcgaagaacauggucaugagcuuccgcguguccgaccuccagaugcugcugggcuucguggggcggagcaaguccggccucaagcacgagcuggucacccgcgcccugcagcucgugcaguucgacugcagccccgagcuguucaagaagaucaaggagcuguacgagacccgguacgccaagaagaacuccgagccggcgccccagccccaccgcccccucgacccgcugacgaugcacagcaccuacgaccgggccggggccgugccccgcacgccccuggccggccccaacaucgacuacccgguccucuacgggaaguaccugaacggccugggccggcuccccgccaagacccugaagcccgaggugcgccuggugaagcuccccuucuucaacaugcuggacgagcugcucaagccgaccgagcuggucccccagaacaacgagaagcugcaggagucccccugcaucuucgcccucacgccccgccagguggagcugauccggaacagccgggagcugcagccgggggugaaggcgguccagguggugcuccgcaucugcuacuccgacaccagcugcccccaggaggaccaguacccgcccaacaucgccgucaaggugaaccacuccuacugcagcgugcccggcuacuaccccuccaacaagcccggggucgagcccaagcggccgugccgccccaucaaccugacccaccugauguaccucagcuccgccaccaaccggaucaccgugaccuggggcaacuacggcaagagcuacuccguggcccuguaccugguccgccagcucaccagcuccgagcugcugcagcggcucaagacgaucggggugaagcaccccgagcugugcaaggcccuggugaaggagaagcuccgccuggaccccgacagcgagaucgcgaccaccggcguccgggugagccugaucugcccgcucgucaagaugcgccuguccgugcccugccgggccgagaccugcgcccaccuccagugcuucgacgccguguucuaccugcagaugaacgagaagaagcccacguggaugugcccggucugcgacaagcccgcccccuacgaccagcugaucaucgacgggcugcucagcaagauccuguccgagugcgaggacgcggacgagaucgaguaccugguggacggcagcuggugccccauccgcgccgagaaggagcgcuccugcagcccgcagggggccauccuggugcucggccccuccgacgccaacggccugcugcccgcccccagcgucaacggguccggcgcgcucgggagcaccggcgggggcggcccggugggguccauggagaacggcaagcccggggccgacguggucgaccugacccuggacagcuccagcuccagcgaggacgaggaggaggaggaggaggaggaggaggacgaggacgaggagggcccccggcccaagcgccggugcccguuccagaaggggcucgugcccgccugcuga

SEQ ID NO: 34563 - RNA, 2274 nt, Artificial Sequence
  derived and/or modified sequence opt1 from PIBF1__Homo_sapiens__NP_006337
augagccgcaagaucuccaaggagagcaagaaggugaacaucuccagcucccuggagagcgaggacaucucccucgagaccaccguccccacggacgacaucagcuccagcgaggagcgggagggcaaggugcgcaucacccggcagcugaucgagcgcaaggagcugcuccacaacauccagcugcugaagaucgagcucucccagaagaccaugaugaucgacaaccugaagguggacuaccugaccaagaucgaggagcucgaggagaagcugaacgacgcccugcaccagaagcagcuccugacgcugcggcucgacaaccagcuggccuuccagcagaaggacgcgagcaaguaccaggagcugaugaagcaggagauggagaccauccuccugcgccagaagcagcuggaggagaccaaccuccagcugcgggagaaggccggggacguccgccggaaccugcgcgacuucgagcucaccgaggagcaguacaucaagcugaaggccuucccggaggaccagcuguccauccccgaguacgugagcgugcgguucuacgagcucgucaacccccugcgcaaggagaucugcgagcuccaggugaagaagaacauccuggccgaggagcuguccacgaacaagaaccagcugaagcagcucaccgagaccuacgaggaggaccggaagaacuacagcgaggugcagauccgcugccagcggcuggcccuggagcucgcggacaccaagcagcugauccagcagggcgacuaccgccaggagaacuacgacaaggucaaguccgagcgggacgcccuggagcaggaggugaucgagcuccgccggaagcacgagauccuggaggccagccacaugauccagacgaaggagcgcuccgagcugagcaaggagguggucacccucgagcagaccgugacccugcugcagaaggacaaggaguaccucaaccggcagaacauggagcugagcgugcgcugcgcccacgaggaggaccgccuggagcggcuccaggcgcagcuggaggaguccaagaaggcccgcgaggagauguacgagaaguacgucgccagccgggaccacuacaagacggaguacgagaacaagcugcacgacgagcuggagcagauccgccucaagaccaaccaggagaucgaccagcugcggaacgccucccgcgagauguacgagcgggagaaccgcaaccugcgggaggcccgcgacaacgcgguggccgagaaggagcgggccgugauggccgagaaggacgcccucgagaagcacgaccagcugcuggaccgcuaccgggagcuccagcugagcaccgaguccaaggucaccgaguuccugcaccagagcaagcucaaguccuucgagagcgagcgcgugcagcugcugcaggaggagacggcgcggaaccucacccagugccagcuggagugcgagaaguaccagaagaagcuggaggugcucaccaaggaguucuacucccugcaggccagcuccgagaagcgcaucaccgagcugcaggcccagaacagcgagcaccaggcccggcucgacaucuacgagaagcuggagaaggagcuggacgagaucaucaugcagacggccgagaucgagaacgaggacgaggcggagcgcguccucuucuccuacggguacggcgccaacgugcccaccaccgccaagcggcgccugaagcagagcgugcaccuggcccgccggguccuccagcuggagaagcagaacucccugauccucaaggaccuggagcaccgcaaggaccaggugacccagcugagccaggagcucgaccgggccaacucccugcugaaccagacgcagcagccguaccgcuaccucaucgagagcguccggcagcgcgacuccaagaucgacagccugaccgagagcaucgcgcagcuggagaaggacguguccaaccucaacaaggagaaguccgcccugcugcagaccaagaaccagauggcccucgaccuggagcagcugcucaaccaccgggaggagcuggccgcgaugaagcagauccuggugaagaugcacagcaagcacagcgagaacucccuccugcugaccaagacggagcccaagcacgucaccgagaaccagaaguccaagacccucaacgugcccaaggagcacgaggacaacaucuucacccccaagccgacgcuguucaccaagaaggaggcccccgaguggagcaagaagcagaagaugaagaccuga

SEQ ID NO: 34564 - RNA, 1833 nt, Artificial Sequence
  derived and/or modified sequence opt1 from PICALM__Homo_sapiens__NP_001008660
augagcggccagucccugaccgaccgcaucaccgccgcccagcacagcgugacgggguccgcggucagcaagaccgugugcaaggccaccacccacgagaucaugggccccaagaagaagcaccucgacuaccugauccagugcacgaacgagaugaacgugaacaucccgcagcuggccgacucccucuucgagcggaccaccaacagcuccugggucgugguguucaagagccugaucaccacgcaccaccugauggucuacgggaacgagcgcuucauccaguaccucgccucccggaacacccuguucaaccugagcaacuuccucgacaaguccggccugcagggguacgacaugagcaccuucauccgccgguacucccgcuaccugaacgagaaggccgugagcuaccgccagguggcguucgacuucaccaaggucaagcggggcgccgacggcgugaugcggacgaugaacaccgagaagcuccugaagaccgugcccaucauccagaaccagauggacgcccugcucgacuucaacgucaacuccaacgagcugaccaacggggugaucaacgccgcguucaugcuccuguucaaggacgccauccgccuguucgccgccuacaacgagggcaucaucaaccugcucgagaaguacuucgacaugaagaagaaccagugcaaggaggggcuggacaucuacaagaaguuccugacgcggaugacccgcaucagcgaguuccucaagguggccgagcaggucggcaucgaccgcggggacauccccgaccugucccaggcgcccagcucccugcucgacgcccuggagcagcaccuggccagccucgagggcaagaagaucaaggacagcaccgccgccucccgggcgaccacgcugagcaacgccguguccagccuggccuccaccggccucagccugaccaagguggacgagcgggagaagcaggccgcccuggaggaggagcaggcgcgccucaaggcccugaaggagcagcggcugaaggagcucgccaagaagccgcacaccucccugacgaccgccgccagccccgucuccaccagcgccgggggcaucaugaccgcgcccgccaucgacaucuucuccacgcccagcuccagcaacuccaccagcaagcugccgaacgaccuccuggaccugcagcagcccaccuuccaccccuccgugcaccccaugagcaccgccucccagguggcgagcacguggggcggguucaccccgagccccgucgcccagccccaccccuccgccggccucaacguggacuucgagagcguguucgggaacaaguccaccaacgucaucguggacagcggcggguucgacgagcugggcgggcugcucaagccgaccgucgccucccagaaccagaaccugcccguggccaagcugccgcccagcaagcugguguccgacgaccucgacagcucccuggcgaaccuggucggcaaccucggcaucgggaacggcacgaccaagaacgacgugaacuggagccagcccggggagaagaagcugaccggcggguccaacuggcagcccaagguggcccccaccaccgccuggaacgccgccacgaugaacggcaugcacuucccccaguacgcgccgcccgucauggccuaccccgccaccacccccaccggcaugaucggguacggcaucccgccccagauggggagcgugcccgugaugacgcagccgacccugaucuacucccagcccgucaugcgcccgcccaaccccuucggccccgugagcggggcccagauccaguucauguga

SEQ ID NO: 34565 - RNA, 1248 nt, Artificial Sequence
  derived and/or modified sequence opt1 from PICK1__Homo_sapiens__NP_001034673
auguucgccgaccuggacuacgacaucgaggaggacaagcucggcauccccaccgugccggggaaggucacccugcagaaggacgcccagaaccugaucggcaucagcaucgggggcggggcgcaguacugccccugccucuacaucguccagguguucgacaacacgcccgccgcccuggacggcaccguggccgccggcgacgagaucaccggggugaacggccgcuccaucaaggggaagaccaagguggaggucgcgaagaugauccaggaggugaagggcgaggugacgauccacuacaacaagcugcaggccgaccccaagcaggggaugagccucgacaucguccugaagaaggugaagcaccggcugguggagaacauguccagcggcaccgccgacgcccucggccugucccgcgcgauccugugcaacgacgggcucgucaagcggcuggaggagcuggagcgcaccgccgagcucuacaagggcaugaccgagcacacgaagaaccugcugcgggccuucuacgagcucagccagacccaccgcgccuucggggacguguucuccgugaucggcguccgggagccgcagcccgccgcgagcgaggccuucgugaaguucgccgacgcccaccgcuccaucgagaaguucggcauccggcugcugaagaccaucaagcccaugcucaccgaccugaacacguaccugaacaaggccauccccgacacccgccucaccaucaagaaguaccuggacgugaaguucgaguaccugagcuacugccucaaggucaaggagauggacgacgaggaguacuccugcaucgcgcugggggagccgcuguaccgggugagcaccggcaacuacgaguaccgccucauccugcggugccgccaggaggcccgggcccgcuucucccagaugcggaaggacgugcuggagaagauggagcuccuggaccagaagcacguccaggacaucguguuccagcugcagcgccucgugagcacgauguccaaguacuacaacgacugcuacgccguccugcgggacgccgacguguuccccaucgaggucgaccuggcgcacaccacccucgccuacgggcugaaccaggaggaguucaccgacggcgaggaggaggaggaggaggaggacacggccgccggggagcccagccgcgacacccggggcgccgcgggcccccuggacaagggcggguccuggugcgacagcuga

SEQ ID NO: 34566 - RNA, 654 nt, Artificial Sequence
  derived and/or modified sequence opt1 from PID1__Homo_sapiens__NP_001094288
auguggcagcccgccaccgagcgccugcagcacuuccagaccaugcucaagagcaagcugaacgugcugacgcucaagaaggagccgcugcccgccgucaucuuccacgagcccgaggcgaucgagcugugcaccaccacgccccucaugaagacccggacccacuccggcugcaaggugaccuaccuggggaaggugagcaccacgggcaugcaguuccuguccgggugcaccgagaagccggucaucgagcucuggaagaagcacacccuggcccgcgaggacguguuccccgccaacgcccugcucgagauccggcccuuccagguguggcugcaccaccuggaccacaagggcgaggccaccguccacauggacacguuccagguggcgcgcaucgccuacugcaccgccgaccacaacgugagccccaacaucuucgccugggucuaccgggagaucaacgacgaccucuccuaccagauggacugccacgcgguggagugcgagagcaagcuggaggccaagaagcuggcccacgccaugauggaggccuuccgcaagaccuuccacuccaugaaguccgacgggcggauccacagcaacagcuccagcgaggaggugucccaggagcucgagagcgacgacggcuga

SEQ ID NO: 34567 - RNA, 2763 nt, Artificial Sequence
  derived and/or modified sequence opt1 from PIDD1__Homo_sapiens__XP_011518511
augcagcugccccgcgcccucccgggccaggccugccugcgggcggggaccugccuggccagcaaggaccgccggugggccauggccgccaccguggagggccccgagcucgaggcggccgccgccgcgggggacgccuccgaggacagcgacgccggcucccgcgcccugcccuuccucgggggcaaccggcucagccuggaccuguaccccggcgggugccagcagcuccugcaccugugcguccagcagccgcuccagcugcugcaggucgaguuccuccgccuguccacgcacgaggacccccagcugcucgaggccacccuggcgcagcugccccagagccucuccugccugcggagccuggugcucaagggcgggcagcgccgggacacccugggcgccugccugcgcggggcccucaccaaccugcccgccggccuguccggccucgcccaccuggcgcaccuggaccucagcuucaacucccuggagacgcugccggccugcguccuccagaugcgggggcugggcgcccugcuccugagccacaacugccuguccgagcuccccgaggcccugggggcccugcccgcgcucaccuuccugaccgugacccacaaccgccugcagacgcugcccccggcccugggcgcccugagcacccugcagcggcucgaccugucccagaaccugcucgacacccugccgcccgagaucggcgggcugggcagccuccuggagcugaaccucgccuccaaccgccugcagagccugcccgccucccucgcggggcugcggagccugcgccuccuggugcugcacagcaaccuccuggccuccguccccgccgaccuggcccggcucccccugcugacccgccucgaccugcgggacaaccagcugcgcgaccucccgcccgagcugcuggacgcgcccuucgugcggcuccagggcaacccccugggggaggccagccccgacgcccccuccagcccgguggccgcccugauccccgagaugccccgccucuuccugacguccgaccuggacagcuuccccgugaccccgcagggcugcuccgugacccucgcgugcggcgugcgccugcaguuccccgccggggccaccgccacgcccaucaccauccgguaccgccugcuccugccggagcccggccuggucccccucgggccccacgacgcccugcugagccacgugcucgagcugcagccgcacggcguggcguuccagcaggacgucgggcuguggcuccuguucaccccgccccaggcccggcgcugccgggagguggugguccgcacccggaacgacaacuccuggggcgaccuggagacguaccucgaggaggaggcgccccagcgccugugggcccacugccaggugccccacuucagcugguuccugguggucucccggcccgugagcaacgccugccucgugccgcccgagggcacccugcugugcuccagcgggcaccccggcgucaaggugaucuucccgcccggggccaccgaggagccccgccgggucuccaugcaggucgugcgcauggccggccgggagcuccaggcccugcugggggagcccgaggccgcggugagcccccuccugugccugucccagagcggcccgcccuccuuccuccagcccgugaccgugcagcugccccugcccagcggcaucacggggcucagccuggaccgcucccggcugcaccuccuguacugggcgcccccggccgccaccugggacgacaucaccgcccaggucgugcuggagcucacccaccuguacgcccgcuuccaggugacgcacuucagcugguacuggcugugguacaccaccaagaacugcgucggcgggcucgcccggaaggccugggagcgccugcggcugcaccgcgugaaccucaucgcccugcagcgccggcgcgaccccgagcagguccugcuccagugccugccccggaacaagguggacgccacccugcgccggcuccuggagcgcuaccggggcccggagcccuccgacacgguggagauguucgagggcgaggaguucuucgcggccuucgagcgcgggaucgacguggacgccgaccggcccgacugcgucgagggccgcaucugcuucguguucuacagccaccugaagaacgugaaggaggucuccuucuaccgcggggccgugcccgugcgggucccggaggaggccgaggcggcccggcagcgcaagggcgccgacgcccucuggauggcgacccugcccaucaagcugccccggcuccgcgggagcgagggcccccggcgcggcgccgggcugucccuggccccgcucaaccugggcgacgccgagaccggguuccugacccagagcaaccugcucuccguggccggccggcuggggcuggacuggcccgcgguggcccuccaccugggcgucagcuaccgcgaggugcagcggauccgccacgaguuccgcgacgaccuggacgagcagauccggcacaugcuguucuccugggccgagcgccaggccggccagcccggggccgugggccuccugguccaggcgcucgagcagagcgaccggcaggacguggccgaggaggugcgcgccguccuggagcuggggcggcgcaaguaccaggacuccauccggcgcaugggccucgcccccaaggacccggcccugcccgggagcuccgcgccccagcccccggagcccgcccaggccuga

SEQ ID NO: 34568 - RNA, 7566 nt, Artificial Sequence
  derived and/or modified sequence opt1 from PIEZO1__Homo_sapiens__NP_001136336
auggagccccacgugcugggcgccgugcuguacuggcugcugcuccccugcgcccugcuggccgccugccuccugcgcuucuccgggcugucccucguguaccugcuguuccuccugcugcuccccugguuccccggccccacccggugcgggcugcagggccacaccgggcgccugcuccgggcccugcugggccucagccugcuguuccucguggcccaccuggcccugcagaucugccuccacaucgugccgcgccuggaccagcugcucggccccuccugcagccggugggagacccugucccgccacaucggggugacccggcuggaccucaaggacauccccaacgcgauccgccugguggcccccgaccugggcauccucgucgugagcuccgugugccuggggaucugcggccggcuggcccgcaacacccggcagagcccgcacccccgcgagcucgacgacgacgagcgggacgucgacgccucccccaccgcggggcugcaggaggccgccacccuggcccccacccgccggagccgccucgccgcgcgguuccgcgugaccgcccacuggcugcugguggccgccggccggguccucgccgugacccugcuggcgcucgccggcaucgcccacccguccgcccugagcuccguguaccugcuccuguuccuggcccugugcacguggugggcgugccacuuccccaucagcacccgcggguucucccggcucugcgucgccgugggcugcuucggggccggccaccugaucugccuguacugcuaccagaugccccucgcccaggcccugcugcccccggcgggcaucugggcccgcgugcucgggcugaaggacuucgucggccccaccaacugcagcagcccccacgcccuggugcucaacaccgggcuggacuggcccguguacgccagcccgggcguccugcuccugcugugcuacgcgacggccucccuccgcaagcugcgggccuaccgccccagcgggcagcggaaggaggccgccaagggcuacgaggcgcgcgagcuggagcucgccgagcuggaccaguggccccaggagcgggagagcgaccagcacguggugcccaccgccccggacaccgaggccgacaacugcaucguccacgagcugaccggccaguccagcgugcuccgccggcccguccgccccaagcgggccgagccccgcgaggcguccccgcugcacagccuggggcaccucaucauggaccaguccuacgugugcgcccugaucgccaugaugguguggagcaucacguaccacuccuggcugaccuucguccuccugcugugggccugccucaucuggaccgugcggagccgccaccagcuggccaugcugugcucccccugcauccuccuguacggcaugacccugugcugccuccgguacgugugggcgauggaccugcgccccgagcugccgacgacccucgggcccgucagccugcggcagcugggccucgagcacacccgcuaccccugccuggaccugggggccaugcuccuguacacccugacguucuggcuccugcugcggcaguucgugaaggagaagcuccugaagugggccgagucccccgccgcgcugaccgaggugaccgucgccgacaccgagccgacgcgcacccagacccuccugcagagccugggcgagcucgugaagggcguguacgccaaguacuggaucuacgucugcgccgggauguucaucgugguguccuucgccggccggcuggucguguacaagaucguguacauguuccuguuccuccugugccugacccucuuccaggucuacuacagccuguggcgcaagcugcucaaggcguucugguggcuggugguggccuacacgaugcugguccucaucgccguguacaccuuccaguuccaggacuuccccgccuacuggcgcaaccugaccggguucaccgacgagcagcugggcgaccucgggcuggagcaguucuccgugagcgagcuguucuccagcauccucguccccggcuucuuccugcuggccugcauccuccagcugcacuacuuccaccggcccuucaugcagcugacggacauggagcacgugucccucccgggcacccgccugccccggugggcgcaccgccaggacgccgugagcgggacgccccuccuccgggaggagcagcaggagcaccagcagcagcagcaggaggaggaggaggaggaggaggacagccgcgacgagggccugggggucgccacgccccaccaggccacccaggugccggagggcgccgcgaaguggggccugguggccgagcggcuccuggagcuggccgccggguucuccgacguccucagccgcguccagguguuccugcggcgccugcuggagcuccacgucuucaagcugguggcgcuguacacggugugggucgcccucaaggagguguccgugaugaaccugcugcucgucgugcugugggccuucgcccugcccuacccccgguuccgccccauggccagcugccucuccaccguguggaccugcgucaucaucgugugcaagaugcuguaccagcugaagguggucaacccgcaggaguacagcuccaacugcaccgagcccuuccccaacagcacgaaccuccugcccaccgagaucucccagagccugcucuaccggggcccgguggaccccgcgaacugguucggggugcgcaagggcuuccccaaccugggguacauccagaaccaccuccagguccuccugcugcucguguucgaggccaucguguaccggcgccaggagcacuaccggcgccagcaccagcuggcgccccugccggcccaggccgucuucgcguccggcacccggcagcagcucgaccaggaccugcugggcugccucaaguacuucaucaacuucuucuucuacaaguucgggcuggagaucugcuuccugauggccgugaacgucaucggccagcgcaugaacuuccucgugacccugcacgggugcuggcugguggccauccucacgcggcgccaccgccaggccaucgcccggcuguggcccaacuacugccuguuccucgcgcuguuccugcucuaccaguaccugcugugccucggcaugcccccggcccugugcaucgacuaccccuggcgcuggagccgggccguccccaugaacuccgcccugaucaaguggcucuaccugcccgacuucuuccgcgccccgaacagcaccaaccugaucuccgacuuccuccugcugcucugcgcgagccagcaguggcaggucuucuccgccgagcggaccgaggaguggcagcgcauggccggggugaacaccgaccggcuggagccccugcgcggcgagcccaaccccgucccgaacuucauccacugccggagcuaccucgacaugcugaagguggccguguuccgcuaccuguucuggcucguccuggugguggucuucgugacgggcgcgacccggaucagcaucuucgggcugggcuaccuccuggccugcuucuaccugcuccuguucgggaccgcccugcuccagcgcgacacccgggcccgccuggugcugugggacugccucauccuguacaacgucacggugaucaucuccaagaacaugcugagccuccuggccugcguguucgucgagcagaugcagaccggcuucugcugggugauccagcuguucucccucgugugcaccgucaagggguacuacgaccccaaggagaugauggaccgggaccaggacugccugcugcccguggaggaggcgggcaucaucugggacagcgugugcuucuucuuccuccugcugcagcgccgggucuuccucucccacuacuaccugcacgugcgcgccgaccugcaggccaccgcccuccuggccagccggggcuucgcgcuguacaacgccgccaaccucaaguccaucgacuuccaccgccgcaucgaggagaagucccuggcccagcugaagcggcagauggagcgcauccgggccaagcaggagaagcaccgccaggggcggguggaccgcucccggccccaggacacgcucggcccgaaggaccccgggcuggagcccggccccgacagccccgggggcuccuccccgccccgccggcagugguggcgccccuggcuggaccacgcgaccgucauccacuccggcgacuacuuccucuucgagagcgacuccgaggaggaggaggaggccgugccggaggacccccggcccagcgcccaguccgccuuccagcuggcguaccaggccugggugaccaacgcccaggccguccugcgccggcgccagcaggagcaggagcaggcccggcaggagcaggcggggcagcuccccaccggcgggggcccgagccaggagguggagcccgccgagggccccgaggaggccgccgccgggcgcucccacgugguccagcgggugcugagcacggcgcaguuccuguggaugcucggccaggcccugguggacgagcugacccgcuggcugcaggaguucacccggcaccacgggaccaugagcgacguccuccgcgccgagcgguaccugcugacgcaggagcuccugcagggcggggaggugcaccgcggcgugcuggaccagcucuacaccucccaggccgaggccacccugcccggcccgaccgaggcgcccaacgcccccagcacggucuccagcgggcugggcgccgaggagccgcucuccagcaugaccgacgacauggggagcccccugagcaccggcuaccacacccgcuccgggagcgaggaggccgugacggaccccggcgagcgggaggcgggcgccucccuguaccaggggcucaugcgcaccgccagcgagcugcugcucgaccggcgccugcggauccccgagcuggaggaggccgagcuguucgccgagggccaggggcgcgcgcugcggcugcuccgcgccguguaccagugcgucgccgcccacuccgagcugcugugcuacuucaucaucauccucaaccacauggugaccgccagcgcgggcucccuggugcugccgguccucguguuccugugggccaugcugagcaucccccggcccuccaagcgcuucuggaugaccgccaucguguucaccgagaucgccgucguggugaaguaccucuuccaguucggguucuuccccuggaacagccacgucgugcugcggcgcuacgagaacaagccguacuucccgccccggauccugggccucgagaagacggacggcuacaucaaguacgaccugguccagcugauggcccucuucuuccaccgcucccagcugcugugcuacgggcucugggaccacgaggaggacagccccagcaaggagcacgacaaguccggcgaggaggagcagggggcggaggagggcccgggcgugcccgccgccaccaccgaggaccacauccagguggaggcccgggucgggcccaccgacggcacgcccgagccccagguggagcugcgcccccgggacacccgccggaucagccugcgcuuccgccggcgcaagaaggaggggcccgcccggaagggcgcggccgccaucgaggccgaggaccgcgaggaggaggagggggaggaggagaaggaggcgcccaccggccgggagaagcgcccgucccggagcggcgggcgcgugcgggccgccggccgccggcuccagggguucugccugucccuggcccagggcaccuaccgcccccuccggcgcuucuuccacgacauccugcacacgaaguaccgggccgcgaccgacgucuacgcccugauguuccucgccgacgugguggacuucaucaucaucaucuucggguucugggccuucggcaagcacagcgccgcgaccgacaucaccuccagccuguccgacgaccagguccccgaggccuuccuggugaugcuccugauccaguucagcacgaugguggucgaccgcgcccuguaccuccggaagaccgugcugggcaagcuggccuuccagguggcccucguccuggcgauccaccuguggauguucuucauccuccccgccgugaccgagcgcauguucaaccagaacguggucgcccagcugugguacuucgugaagugcaucuacuucgcccuguccgcguaccagauccggugcggguacccgacccgcauccucggcaacuuccugacgaagaaguacaaccaccugaaccucuuccuguuccagggguuccggcuggugcccuuccucgucgagcugcgcgccgugauggacuggguguggaccgacaccacccugagccucuccagcuggaugugcgucgaggacaucuacgccaacaucuucaucaucaagugcucccgcgagacggagaagaaguacccccagcccaagggccagaagaagaagaagaucgugaaguacgggaugggcggccugaucauccuguuccucaucgccaucaucugguucccgcugcuguucaugagccucgugcgguccgucguggggguggucaaccagcccaucgacgugaccgugacccugaagcugggcggguacgagccccucuucaccaugagcgcccagcagccguccaucauccccuucacggcgcaggccuacgaggagcugagccgccaguucgacccccagccccuggccaugcaguucaucagccaguacuccccggaggacaucgucaccgcccagaucgagggcagcuccggggcccucuggcggaucuccccgcccucccgcgcgcagaugaagcgggagcuguacaacggcaccgccgacaucacccugcgcuucacguggaacuuccagcgggaccucgccaagggcgggaccguggaguacgccaacgagaagcacaugcuggcccuggcgcccaacagcaccgcccgccggcagcucgccucccugcuggagggcaccagcgaccaguccguggucaucccgaaccucuuccccaaguacauccgcgcccccaacgggcccgaggcgaacccggugaagcagcugcagcccaacgaggaggccgacuaccugggcgugcggauccagcuccgccgggagcagggcgccggggccacgggcuuccuggaguggugggucaucgagcugcaggagugccgcaccgacugcaaccugcuccccauggugaucuucagcgacaaggugagcccgcccagccugggguuccuggccggcuacgggaucaugggccucuacgucuccaucgugcuggugaucggcaaguucguccggggguucuucagcgagaucucccacagcaucauguucgaggagcugcccugcguggaccgcauccucaagcugugccaggacaucuuccuggugcgggagacccgcgagcucgagcuggaggaggagcuguacgcgaagcucaucuuccuguaccggucccccgagaccaugaucaaguggacgcgcgagaaggaguga

SEQ ID NO: 34569 - RNA, 8259 nt, Artificial Sequence
  derived and/or modified sequence opt1 from PIEZO2__Homo_sapiens__NP_071351
auggccagcgagguggucugcggccugaucuuccgccugcugcugcccaucugccucgccguggcgugcgccuuccgguacaacgggcugagcuucguguaccugaucuaccuccugcugaucccccuguucagcgagcccaccaagaccacgaugcagggccacaccgggcgccugcugaagucccucugcuucaucagccuguccuuccugcuccugcacaucaucuuccacaucacccuggucagccucgaggcccagcaccggaucgcccccggcuacaacugcuccaccugggagaagacguuccgccagaucggguucgagagccugaagggcgccgacgcgggcaacgggauccggguguucgugcccgacaucggcauguucaucgccucccugaccaucuggcuccugugccgcaacaucguccagaagccggugaccgacgaggccgcccagagcaaccccgaguucgagaacgaggagcuggcggagggggagaagaucgacuccgaggaggcccucaucuacgaggaggacuucaacggcggggacggcguggagggcgagcuggaggagagcaccaagcugaagauguuccggcgccucgccuccgucgccagcaagcugaaggaguucaucgggaacaugaucacgaccgccggcaaggugguggucaccauccugcucggguccagcggcaugaugcugcccucccugaccagcuccguguacuucuucguguuccucggccugugcacgugguggagcuggugccggaccuucgacccccuccuguucagcugccugugcguccugcucgcgaucuucaccgccgggcaccugaucggccuguaccucuaccaguuccaguucuuccaggaggccgugccgcccaacgacuacuacgcccgccuguucgggaucaaguccgugauccagaccgacugcagcuccacguggaagaucaucgucaaccccgaccugagcugguaccaccacgccaaccccauccuccugcuggugauguacuacacccucgcgacccugauccggaucuggcugcaggagccgcuggugcaggacgagggcaccaaggaggaggacaaggcccucgccugcucccccauccagaucacggccgggcgccggcgcagccugugguacgccacccacuaccccaccgacgagcggaagcugcucuccaugacccaggacgacuacaagcccagcgacggccugcuggucacggugaacggcaacccgguggacuaccacaccauccaccccucccuccccauggagaacgggcccggcaaggcggaccuguacagcaccccgcaguaccgcugggagcccuccgacgagagcuccgagaagcgggaggaggaggaggaggagaaggaggaguucgaggaggagcgcagccgggaggagaagcgcuccaucaagguccacgccauggugagcgucuuccaguucaucaugaagcaguccuacaucugcgcccugaucgccaugauggccuggagcaucaccuaccacuccuggcucacguucgugcugcugaucuggagcugcacccucuggaugauccggaaccgccgcaaguacgcgaugaucagcucccccuucaugguggucuacgggaaccugcugcucauccugcaguacaucuggagcuucgagcugcccgagaucaagaaggugccgggcuuccucgagaagaaggagcccggggagcuggccuccaagauccuguucaccaucaccuucuggcuccugcugcggcagcaccucacggagcagaaggcccugcaggagaaggaggcccugcucagcgaggugaagaucggcucccaggagaacgaggagaaggacgaggagcugcaggacauccaggucgagggcgagcccaaggaggaggaggaggaggaggcgaaggaggagaagcaggagcgcaagaagguggagcaggaggaggccgaggaggaggacgagcaggacaucaugaaggugcuggggaaccucgucguggccauguucaucaaguacuggaucuacgugugcggcgggauguucuucuucgucagcuucgagggcaagaucgugauguacaagaucaucuacauggugcuguuccuguucugcgucgcccucuaccaggugcacuacgagugguggcggaagauccugaaguacuucuggauguccguggucaucuacaccaugcuggugcucaucuucaucuacaccuaccaguucgagaacuuccccgggcuguggcagaacaugaccggccugaagaaggagaagcucgaggaccugggccugaagcaguucacgguggccgagcuguucacccgcaucuucaucccgaccagcuuccugcuggucugcauccuccaccuccacuacuuccacgaccgguuccuggagcucaccgaccugaaguccauccccagcaaggaggacaacaccaucuaccgccuggcgcaccccgaggggucccucccggaccugacgaugaugcaccugaccgccagccucgagaagcccgaggugcggaagcuggccgagcccggcgaggagaagcuggagggguacuccgagaaggcccagaagggcgaccucggcaaggacagcgaggaguccgaggaggacggggaggaggaggaggagagcgaggaggaggaggagaccuccgaccugcgcaacaaguggcaccuggugaucgaccggcucaccguccuguuccugaaguuccucgaguacuuccacaagcuccagguguucaugugguggauccuggagcuccacaucaucaagaucgugagcagcuacaucaucugggucuccgugaaggaggugagccuguucaacuacgucuuccugaucuccugggccuucgcgcuccccuacgccaagcugcgccggcuggccagcuccgugugcacgguguggaccugcgucaucaucgugugcaagaugcucuaccagcugcagaccaucaagccggagaacuucagcgugaacugcucccugcccaacgagaaccagaccaacauccccuucaacgagcucaacaagagccugcuguacuccgcccccaucgacccgacggagugggucggccuccgcaagagcagcccccugcugguguaccuccggaacaaccugcugaugcucgccauccuggcguucgaggugaccaucuaccgccaccaggaguacuaccgggggcgcaacaaccugaccgcccccgucagccggaccaucuuccacgacaucacgcgccuccaccuggacgacggccugaucaacugcgccaaguacuucaucaacuacuucuucuacaaguucgggcucgagaccugcuuccugauguccgugaacgugaucggccagcggauggacuucuacgccaugauccacgcgugcuggcugaucgccguccucuaccgccgccggcgcaaggccaucgccgagaucuggcccaaguacugcugcuuccuggccugcaucaucaccuuccaguacuucaucugcaucggcaucccgcccgcgcccugccgggacuaccccuggcgcuucaagggggccagcuucaacgacaacaucaucaaguggcuguacuucccggacuucaucgugcggcccaaccccguguuccuggucuacgacuucaugcuccugcugugcgccucccuccagcgccagaucuucgaggacgagaacaaggccgccgugcggaucauggcgggcgacaacguggagaucugcaugaaccuggacgccgccagcuucucccagcacaaccccgucccggacuucauccacugccgcagcuaccuggacauguccaaggugaucaucuucagcuaccucuucugguucgugcugaccaucaucuucaucacggggaccacccggaucagcaucuucugcaugggcuaccuggucgccugcuucuacuuccuccuguucgggggcgaccugcuccugaagcccaucaaguccauccugcgcuacugggacuggcucaucgccuacaacguguucgucaucaccaugaagaacauccugagcaucggcgcgugcggguacaucggcacgcuggugcacaacuccugcuggcucauccaggccuucagccuggccugcaccgugaagggguaccagaugcccgccgcgaacucccccugcacccugccgagcggcgaggccgggaucaucugggacuccaucugcuucgccuuccuccugcugcagcggcgcgucuucaugagcuacuacuuccuccacgugguggccgacaucaaggccucccagauccuggcgagccggggcgccgagcuguuccaggccaccaucgucaaggccgugaaggcccgcaucgaggaggagaagaaguccauggaccagcucaagcggcagauggaccgcaucaaggcgcggcagcagaaguacaagaagggcaaggagcgcaugcugagccugacgcaggagcccggggagggccaggacaugcagaagcucuccgaggaggacgacgagcgggaggccgacaagcagaaggccaaggggaagaagaagcagugguggcgccccuggguggaccacgccagcaugguccgguccggcgacuacuaccuguucgagaccgacagcgaggaggaggaggaggaggagcugaagaaggaggacgaggagccgccccgccgcuccgccuuccaguucguguaccaggcguggaucaccgaccccaagaccgcccuccggcagcgccacaaggagaagaagcggagcgcccgcgaggagcggaagcgccggcgcaagggguccaaggagggccccguggagugggaggaccgggaggacgagccgaucaagaagaaguccgacggccccgacaacaucaucaagcgcaucuucaacauccugaaguucacguggguccuguuccucgccaccguggacagcuucaccaccuggcugaacuccaucagccgggagcacaucgacaucuccacggugcugcgcaucgagcggugcaugcucacccgcgagaucaagaaggggaacguccccacccgggagagcauccacauguacuaccagaaccacaucaugaaccugucccgcgagagcggccuggacaccaucgacgagcaccccggggccgcguccggcgcccagacggcccaccggauggacagccucgacucccacgacagcaucuccagcgagccgacccagugcaccaugcuguacucccgccagggcaccaccgagacgaucgaggagguggaggccgagcaggaggaggaggcggggagcaccgcccccgagccccgggaggccaaggaguacgaggccaccggcuacgacgugggggccaugggcgcggaggaggccucccugacccccgaggaggagcucacgcaguucagcacccuggacggggacgucgaggccccgcccuccuacagcaaggccguguccuucgagcaccugagcuucggcagccaggacgacuccgccggcaagaaccgcauggcggugagccccgacgacucccgcaccgacaagcucgggagcuccauccugcccccgcugacccacgagcucacggccagcgagcugcugcucaagaagauguuccacgacgacgagcuggaggaguccgagaaguucuacgucggccagccccgguuccugcuccuguucuacgccauguacaacacccugguggcccgcagcgagauggugugcuacuucgucaucauccucaaccacaugguguccgccagcaugaucacccugcugcuccccauccugaucuuccugugggcgaugcucuccgugccccggccgagccgccgguucuggaugauggccaucgucuacaccgagguggccaucguggucaaguacuucuuccaguucggguucuuccccuggaacaagaacguggaggugaacaaggacaagcccuaccacccgcccaacaucaucggcgucgagaagaaggagggguacgugcuguacgaccugauccagcuccuggcccuguucuuccaccgcuccauccucaagugccacggccugugggacgaggacgacaugacggagagcggcauggcgcgggaggaguccgacgacgagcugagccucgggcacggccgccgggacuccagcgacucccucaagagcaucaaccuggccgccagcguggaguccguccacgugaccuuccccgagcagcagaccgccgugcgccggaagcgcagcggguccagcuccgagcccagccagcgguccagcuucuccagcaaccgcucccagcggggcagcaccuccacgcgcaacagcucccagaaggggagcuccguccucagcaucaagcagaagggcaagcgggagcuguacauggagaagcugcaggagcaccucaucaaggccaaggcguucaccaucaagaagacccuggagaucuacgugcccaucaagcaguucuucuacaaccugauccacccggaguacuccgccgugaccgacgucuacgugcucauguuccuggccgacacgguggacuucaucaucaucgucuucggcuucugggccuucgggaagcacagcgccgcggccgacaucaccagcucccugagcgaggaccaggugcccggccccuuccucgugaugguccugauccaguucgggaccauggugguggaccgcgcccuguaccuccggaagaccguccugggcaaggugaucuuccaggucauccugguguucggcauccacuucuggauguucuucauccucccgggggugacggagcgcaaguucucccagaaccuggucgcccagcugugguacuucgugaagugcguguacuucggccucagcgccuaccagauccggugcggguaccccacccgcguccugggcaacuuccugaccaaguccuacaacuacgugaaccucuuccuguuccagggguuccgccuggugcccuuccugaccgagcuccgggcggucauggacuggguguggacggacaccacccugagccuguccagcuggaucugcguggaggacaucuacgcccacaucuucauccucaagugcuggcgcgaguccgagaagcgguacccccagccgcgcggccagaagaagaagaaggucgugaaguacggcaugggcgggaugaucaucgugcugcugaucugcaucgucugguucccccuccuguucaugagccugaucaaguccguggccggggugaucaaccagccccucgacgucagcgugaccaucacgcugggcggguaccagcccaucuucaccauguccgcccagcagagccagcugaaggugauggaccagcaguccuucaacaaguucauccaggcguucagccgggacaccggcgccaugcaguuccucgagaacuacgagaaggaggacaucaccgucgccgagcuggagggcaacuccaacagccuguggacgaucagcccgcccuccaagcagaagaugauccacgagcuccuggaccccaacagcuccuucagcgugguguucuccuggagcauccagcgcaaccugucccucggggccaagagcgagaucgccaccgacaagcuguccuucccccugaagaacaucacccggaagaacaucgcgaagaugaucgccggcaacagcaccgaguccagcaagaccccggucacgaucgagaagaucuaccccuacuacgugaaggcccccuccgacagcaacuccaagcccaucaagcagcuccugagcgagaacaacuucauggacaucaccaucauccugucccgcgacaacaccaccaaguacaacagcgaguggugggugcucaaccugacggggaaccggaucuacaacccgaacucccaggcccuggagcucgucguguucaacgacaagguguccccgcccagccugggcuuccuggccggguacggcaucaugggccucuacgcguccgucgugcuggugaucgggaaguucguccgcgaguucuucagcggcaucucccacagcaucauguucgaggagcugcccaacguggaccggauccucaagcugugcaccgacaucuuccuggugcgcgagaccggggagcucgagcuggaggaggaccuguacgccaagcucaucuuccuguaccgguccccggagaccaugaucaaguggacgcgcgagaagaccaacuga

SEQ ID NO: 34570 - RNA, 2124 nt, Artificial Sequence
  derived and/or modified sequence opt1 from PIF1__Homo_sapiens__NP_001273426
augcugagcggcaucgaggccgccgcgggggaguacgaggacuccgagcuccgcugccggguggccgucgaggagcugagccccggcgggcagccgcgccggcgccaggcccugcggaccgccgagcucucccugggccgcaacgagcggcgcgagcugaugcuccggcugcaggcccccgggcccgcgggccgcccccggugcuucccgcugcgcgccgcccgccucuucacccgguucgccgaggcgggccggagcacgcugcgccugcccgcccacgacacccccggggccggcgccgugcagcuccugcuguccgacugcccgcccgaccggcuccgccgguuccugcgcacccugcggcucaagcuggccgcggcccccgggcccggccccgccagcgcccgcgcccagcugcucgggccgcgcccccgggacuucgugaccaucucccccguccagcccgaggagcgccggcugcgcgcggccacgcgggugccggacaccacccuggugaagcgccccgucgagccccaggccggcgccgagcccagcaccgaggccccgcgguggccccuccccgugaagcgccugucccugcccagcacgaagccgcagcucuccgaggagcaggcggccgugcugcgggccguccugaagggccagagcaucuucuucaccggguccgccggcaccggcaagagcuaccuccugaagcgcauccuggggucccucccgcccaccggcacgguggccaccgcgagcaccgggguggccgccugccacaucggcgggaccacgcugcacgccuucgcgggcaucggguccggccaggcgccccuggcccagugcgucgcccucgcccagcggcccggcgugcgccagggguggcugaacugccagcggcuggugaucgacgagaucagcauggucgaggccgaccucuucgacaagcuggaggccguggcccgcgccgugcggcagcagaacaagcccuucggcgggauccagcugaucaucugcggcgacuuccuccagcugcccccggucaccaaggggucccagccgccccgcuucugcuuccagagcaagagcuggaagcggugcgugcccgugacccuggagcucaccaaggucuggcgccaggccgaccagacguucaucucccugcugcaggcggugcggcucggccgcugcagcgacgaggugacccgccagcugcaggccaccgccucccacaaggucggccgggacgggaucguggccacccgccugugcacgcaccaggacgacgucgcccugaccaacgagcggcgccuccaggagcugcccggcaaggugcaccgguucgaggcgauggacagcaaccccgagcuggccuccacccucgacgcccagugccccgugagccagcugcugcagcucaagcugggggcccaggucaugcuggugaagaaccucuccgugagccgcggccuggucaacggggcgcggggcgugguggucggcuucgaggccgaggggcgcggccugccccaggugcgguuccucugcggggugaccgaggucauccacgccgaccgcuggacggugcaggccaccggcggccagcugcugucccggcagcagcucccgcugcagcuggccugggcgaugagcauccacaagucccaggggaugacccucgacugcguggagaucagccugggccgcgucuucgccuccgggcaggccuacguggcccugagccgggcccgcucccuccagggccugcgggugcuggacuucgaccccauggcgguccgcugcgacccccgggugcuccacuucuacgccacccugcgccgggggcgcagccugucccucgccgccgagggccggggcaacgaggaccgcugcagcggguccagcauccgcgcccugggcggggacugguggggccugcggcucggggcggccagcaagcagcgcacggagcugcggugcguguccaccgcccgccccagccuggcccagccgcggaccaacacccuccagucccugacgaaggagcacaagcugcagaacguccaccccuacuucaagcuccuguuccagggcaucaacagcguguggggccacuga

SEQ ID NO: 34571 - RNA, 477 nt, Artificial Sequence
  derived and/or modified sequence opt1 from PIFO__Homo_sapiens__NP_001287760
augugcuucagccgcgccgacgccgcggacaacuaccccuucgggaccugccagcagcggaagcuguucccccacuuccacccgcccaaccucaucggcaacaaguucgugccccugcgcggcuccccgcaccgggggcccggcugcuacuucagcgacgagaugacgccccacgccgggcgcuaccagaaggucagcccccagcaggagaagcacaagcagaacuucgccccguucaacgugcuggugccccgguucaagaacuaccccaaggacaccuacuaccccuccccgggcgccuacaaccccgagaagaagcccccgcccaagaucgccuggcccaugaaguucggcucccccgacugggcgcagguccccugccuccagaagcgcacccugaaggccgagcugagcaccgacaaggacuuccggaagcaccgcaaccggguggccuaccucucccuguacuacaacuga

SEQ ID NO: 34572 - RNA, 1455 nt, Artificial Sequence
  derived and/or modified sequence opt1 from PIGA__Homo_sapiens__NP_002632
auggccugccgcggcggggccggcaacgggcaccgggcgagcgccacccugucccgcgugagccccggcucccucuacacgugccggacccgcacccacaacaucugcauggucagcgacuucuucuacccgaacaugggcgggguggagucccacaucuaccagcugagccagugccugaucgagcggggccacaaggugaucaucgucacccacgccuacgggaaccgcaagggcauccgguaccucaccuccgggcugaagguguacuaccugccccucaaggugauguacaaccagagcacggccaccacccuguuccacucccugccccuccugcgcuacaucuucguccgggagcgcgugaccaucauccacagccacuccagcuucuccgccauggcgcacgacgcccuguuccacgccaagacgaugggccuccagaccguguucaccgaccacagccuguucggguucgccgacgucuccagcgugcugaccaacaagcuccugacggugucccugugcgacaccaaccacaucaucugcgucagcuacaccuccaaggagaacaccgugcuccgggcggcccugaaccccgagaucgugagcgucaucccgaacgccguggaccccacggacuucacccccgaccccuuccgccggcacgacagcaucaccaucguggucgugucccgccugguguaccggaagggcaucgaccuccugagcggcaucaucccggagcugugccagaaguaccccgaccucaacuucaucaucgggggcgaggggcccaagcgcaucauccuggaggagguccgggagcgcuaccagcugcacgaccgggugcgccuccugggcgcccuggagcacaaggacgugcggaacguccucgugcagggccacaucuuccugaacaccucccugacggaggccuucugcauggcgaucgucgaggccgccagcugcgggcuccaggugguguccacccgcgucggcgggauccccgaggugcugccggagaaccugaucauccucugcgagcccagcgugaagucccugugcgagggccuggagaaggccaucuuccagcucaagagcgggacccugcccgcccccgagaacauccacaacaucgucaagaccuucuacacguggcgcaacguggcggagcggaccgagaagguguacgaccgcgucuccguggaggccgugcugccgauggacaagcggcucgaccgccugaucagccacugcggccccgucaccggcuacaucuucgcccugcucgccguguucaacuuccuguuccugaucuuccuccgguggaugacccccgacuccaucaucgacguggccaucgacgcgacggggccccgcggcgccuggaccaacaacuacagccacuccaagcgcgggggcgagaacaacgagaucagcgagacccgguga

SEQ ID NO: 34573 - RNA, 660 nt, Artificial Sequence
  derived and/or modified sequence opt1 from PIGF__Homo_sapiens__NP_002634
augaaggacaacgacaucaagcgccugcucuacacccaccuccugugcaucuucagcaucauccuguccguguucauccccagccuguuccuggagaacuucuccauccucgagacccaccugacguggcugugcaucugcagcggcuucgucaccgccgugaaccucgugcuguaccuggucgugaagccgaacaccuccagcaagcgguccagccucucccacaaggugaccggguuccugaagugcugcaucuacuuccugaugagcugcuucuccuuccacgucaucuucgugcucuacggcgcgccccugaucgagcuggcccucgagacguuccuguucgccgugauccugagcaccuucaccaccguccccugccucugccugcuggggcccaaccucaaggccuggcugcgcguguucucccggaacggcgugacgagcaucugggagaacucccugcagaucaccaccaucagcuccuucgucggggccuggcucggcgcccugccgaucccccuggacugggagcgccccuggcaggucuggcccaucagcugcacccucggcgcgacguucggguacguggccggccuggugaucuccccgcuguggaucuacuggaaccggaagcagcucaccuacaagaacaacuga

SEQ ID NO: 34574 - RNA, 2952 nt, Artificial Sequence
  derived and/or modified sequence opt1 from PIGG__Homo_sapiens__NP_001120650
augcgccugggcagcgggaccuucgcgaccugcugcguggccaucgagguccucggcaucgcgguguuccugcggggguucuuccccgccccggugcgcuccagcgcccgggccgagcacggcgccgagccgcccgcgcccgagcccuccgccggggccagcuccaacuggacgacccugcccccgccccucuucagcaaggucgugaucgugcugaucgacgcccugcgcgacgacuucgucuucggcuccaagggcgugaaguucaugcccuacaccaccuaccucguggagaagggggcgagccacuccuucgucgccgaggccaagccgcccacggugaccaugccccggaucaaggcccugaugaccggcagccugcccggguucguggacgucauccgcaaccucaacucccccgcccugcuggaggacagcgugauccggcaggcgaaggccgccggcaagcgcaucguguucuacggggacgagaccugggucaagcuguuccccaagcacuucguggaguacgacggcacgaccuccuucuucgugagcgacuacaccgaggucgacaacaacgugacccggcaccuggacaaggugcugaagcgcggcgacugggacauccucauccugcacuaccuggggcucgaccacaucggccacaucuccgggcccaacagcccgcugaucggccagaagcuguccgagauggacagcguccucaugaagauccacacgucccugcagagcaaggagcgggagaccccgcugcccaaccuccuggugcugugcggcgaccacgggaugagcgagaccggcucccacggggccagcuccaccgaggaggugaacacgccccucauccugaucagcuccgccuucgagcgcaagcccggcgacauccggcaccccaagcacguccagcagaccgacguggcggccacccuggccaucgcccucgggcugcccauccccaaggacagcgucggcucccugcuguucccggugguggagggccgccccaugcgggagcagcugcgcuuccugcaccucaacaccguccagcugagcaagcugcuccaggagaacgugcccuccuacgagaaggaccccggguucgagcaguucaagaugagcgagcggcugcacggcaacuggauccgccuguaccucgaggagaagcacuccgaggugcuguucaaccuggggagcaagguccuccggcaguaccuggacgcccugaagacgcucucccugagccuguccgcccagguggcccaguacgacaucuacagcaugauggugggcaccgucguggugcuggagguccucacccugcugcuccuguccgugccgcaggcccugcgccggaaggccgagcucgaggugccccugagcucccccggguucagccuccucuucuaccuggucauccuggugcucagcgccgugcacgucaucgugugcaccuccgcggagagcuccugcuacuucugcggccugagcuggcuggccgccggcggggugaugguccucgccuccgcgcugcugugcgugaucgugagcguccucacgaacgugcuggugggcgggaacaccccgcgcaagaaccccaugcaccccuccagccgcugguccgagcuggaccuccugauccugcucggcaccgccgggcacguccugagccugggcgccuccagcuucguggaggaggagcaccagaccugguacuuccucgugaacacgcugugccuggcccucucccaggagaccuaccggaacuacuuccugggcgacgacggggagcccccgugcggccugugcgucgagcaggggcacgacggcgccaccgcggccuggcaggacggccccgggugcgacgugcucgagcgcgacaagggccacgggagccccuccaccagcgaggugcugcggggccgcgagaaguggaugguccuggccucccccuggcucauccuggccugcugccggcugcuccgcagccugaaccagacgggggugcagugggcccaccggccggaccugggccacuggcucaccagcuccgaccacaaggcggagcugagcgugcuggccgcccucucccugcuggucguguucgugcucguccagcgcggcugcagccccguguccaaggccgcccuggcgcuggggcuccugggcguguacugcuaccgggccgccaucgggagcguccgcuuccccuggcggcccgacuccaaggacaucagcaagggcaucaucgaggcccgcuucguguacguguucguccuggggauccucuucaccggcaccaaggaccugcugaagucccaggugaucgcggccgacuucaagcucaagacggugggccugugggagaucuacagcgggcugguccuccuggccgcccuccucuuccggccgcacaaccugcccgugcuggccuucucccuccugauccagacccugaugaccaaguucaucuggaagccccuccgccacgacgcggccgagaucaccgugaugcacuacugguucggccaggccuucuucuacuuccaggggaacagcaacaacaucgccaccgucgacaucuccgccggcuucguggggcuggacacguacgucgagauccccgcggugcugcucaccgccuucggcaccuacgccggcccggugcugugggccagccaccugguccacuuccucuccagcgagacccgguccgggagcgcccugucccacgcgugcuucugcuacgcccugaucugcagcauccccguguucacguacaucgugcucgucaccagccugcgcuaccaccuguucaucugguccguguucagccccaagcuccuguacgagggcaugcaccuccugaucaccgccgccgugugcgucuucuucaccgcgauggaccagacgcggcugacccaguccuga

SEQ ID NO: 34575 - RNA, 759 nt, Artificial Sequence
  derived and/or modified sequence opt1 from PIGL__Homo_sapiens__NP_004269
auggaggccauguggcugcucugcguggcccuggcgguccuggccuggggcuuccucugggugugggacagcuccgagcgcaugaagucccgggagcagggcgggcgccugggggccgagagccggacccugcucgugaucgcccaccccgacgacgaggccauguucuucgcgccgaccguccugggccuggcccgccuccggcacuggguguaccugcugugcuucagcgccgggaacuacuacaaccagggcgagacgcgcaagaaggagcuccugcaguccugcgacgugcugggcaucccccucagcuccgucaugaucaucgacaaccgggacuuccccgacgaccccgggaugcagugggacaccgagcacguggcccgcgugcugcugcagcacaucgaggucaacggcaucaaccucguggugaccuucgacgccgggggcgucagcgggcacuccaaccacaucgcgcuguacgccgccgugcgggcccugcacagcgagggcaagcucccgaagggcugcuccgugcugacccugcagagcgucaacgugcuccgcaaguacaucucccugcuggaccucccccugagccugcuccacacgcaggacgugcuguucguccugaacuccaaggagguggcgcaggccaagaaggccaugagcugccaccggucccagcuccugugguuccgccggcuguacaucaucuucagccgcuacaugcggaucaacucccucagcuuccuguga

SEQ ID NO: 34576 - RNA, 1272 nt, Artificial Sequence
  derived and/or modified sequence opt1 from PIGM__Homo_sapiens__NP_660150
augggcagcaccaagcacuggggcgaguggcugcucaaccugaagguggcccccgccggggucuucgggguggcguuccuggcccgcguggcccucgucuucuacggcguguuccaggaccggacccugcacgugcgcuacacggacaucgacuaccaggucuucaccgacgccgcccgguucgugaccgaggggcgcuccccguaccugcgggcgaccuaccgcuacacgccccuccugggcuggcugcucacccccaacaucuaccugagcgagcuguucggcaaguuccucuucaucuccugcgaccugcugaccgccuuccuccuguaccggcugcuccugcugaaggggcucggccgccggcaggccugcggguacugcguguucuggcugcugaacccccucccgauggccgucagcucccgcggcaacgcggacagcaucguggccucccuggugcugaugguccucuaccugaucaagaagcggcugguggccugcgccgccguguucuacggguucgcgguccacaugaagaucuaccccgugaccuacauccuccccaucacgcugcaccuccugcccgaccgcgacaacgacaagagccugcggcaguuccgcuacaccuuccaggccugccuguacgagcuccugaagcggcugugcaaccgcgccgugcuccuguucgucgccguggccggccugaccuucuucgcgcucuccuucggcuucuacuacgaguacgggugggaguuccuggagcacaccuacuucuaccaccugacgcggcgcgacauccggcacaacuucagcccguacuucuacaugcucuaccugaccgccgaguccaaguggagcuucucccugggcaucgccgccuuccucccccagcugauccugcugagcgccguguccuucgcguacuaccgcgaccucgucuucugcugcuuccugcacaccagcaucuucgugaccuucaacaaggugugcacgucccaguacuuccugugguaccucugccugcugccccucgucaugccccuggugcggaugccguggaagcgcgccgucgugcugcucaugcugugguucaucgggcaggccauguggcuggcccccgccuacgugcucgaguuccagggcaagaacaccuuccuguucaucuggcuggcgggccucuucuuccugcugaucaacugcagcauccucauccagaucaucucccacuacaaggaggagccccugaccgagcgcaucaaguacgacuga

SEQ ID NO: 34577 - RNA, 2796 nt, Artificial Sequence
  derived and/or modified sequence opt1 from PIGN__Homo_sapiens__NP_789744
augcuccuguucuucacccugggccugcucauccacuucguguucuucgccagcaucuucgacaucuacuucaccagcccccugguccacgggaugacgccgcaguucacgccccugccgccgcccgcccgccggcucgugcuguucguggcggacggccugcgcgccgacgcccucuacgagcuggacgagaacgggaacucccgggcccccuucauccgcaacaucaucaugcacgagggcuccugggggaucagccacacccggguccccaccgagucccgccccggccacguggcccugaucgcgggcuucuacgaggacgugagcgccgucgccaagggguggaaggagaaccccguggaguucgacucccucuucaacgagagcaaguacaccugguccuggggcagccccgacauccugcccauguucgccaagggggcguccggcgaccacguguacaccuacagcuacgacgccaagcgggaggacuucggggcccaggacgccaccaagcuggacaccugggucuucgacaacgugaaggacuucuuccaccacgcccgcaacaaccagucccucuucagcaagaucaacgaggagaagaucguguucuuccugcaccuccugggcaucgacacgaacggccacgcgcaccggcccuccagccgcgacuacaagcacaacaucaagaaggucgacgacggggugaaggagaucguguccauguucaaccacuucuacggcaacgacgggaagaccaccuucaucuucaccagcgaccacggcaugacggacuggggcucccacggggccggccacccgagcgagacccugacgccccuggucaccuggggcgccgggaucaaguacccccagcgggugagcgcccagcaguucgacgacgccuuccucaaggaguggcgccuggagaacuggaagcggcuggacgugaaccaggcggacaucgcgccccucaugaccucccugaucggggucccguucccccugaacagcgugggcauccuccccguggacuaccugaacaacaccgaccuguucaaggccgaguccauguucaccaacgccguccagauccucgagcaguucaaggugaagaugacccagaagaaggaggugacgcugcccuuccuguucaccccguucaagcuccugagcgacuccaagcaguucaacauccugcgcaaggcccggagcuacaucaagcaccgcaaguucgacgaggucgugucccucugcaaggagcugauccaccuggcccucaagggccugagcuacuaccacaccuacgaccgguucuuccugggggucaacguggugaucggcuucgucggguggaucuccuacgccagccuccugaucaucaagucccacagcaaccugaucaagggcguguccaaggaggugaagaagcccagccaccuccugcccugcuccuucgucgccaucgggauccugguggccuucuuccuccugauccaggccugccccuggaccuacuacguguacggccugcugccgcuccccaucugguacgcgguccugcgcgaguuccaggugauccaggaccugguggucagcgugcucacguacccccugucccacuucgugggcuaccugcucgccuucacccuggggaucgagguccuggugcucagcuucuucuaccgguacaugcugaccgccggccugaccgccuucgcggccuggcccuuccucacgcgccuguggacccgggccaagaugaccucccugagcuggaccuucuucagccuccugcuggccguguucccgcucaugcccgucguggggcgcaagcccgacaucucccuggugaugggcgccgggcugcucguccugcugcucagccugugcguggugacgucccugaugaagcgcaaggacagcuucaucaaggaggagcuccugguccaccuccuccaggugcuguccaccgugcugagcauguacgucguguacuccacccagagcucccugcugcggaagcagggccugccgcucaugaaccagaucaucagcugggcgacccuggccuccagccugguggucccccuccuguccagccccgugcuguuccagcgccucuucuccauccugcugagccucauguccacguaccugcugcucagcaccggcuacgaggcccuguucccccuggugcucagcugccugauguucgucuggaucaacaucgagcaggagacccugcagcaguccggggugugcugcaagcagaagcucaccagcauccaguucuccuacaacaccgacaucacgcaguuccggcagcuguaccuggacgacauccgccgggccuucuuccucguguucuuccuggucaccgccuucuucggcaccgggaacaucgcgagcaucaacuccuucgaccuggccagcguguacugcuuccucaccguguucuccccguucaugaugggcgcccugaugauguggaagauccugauccccuucguccucgugaugugcgccuucgaggccgugcagcugacgacccagcugagcuccaagagccucuuccugaucguccuggugaucuccgacaucauggcgcuccacuucuucuuccuggugaaggacuacggcagcuggcuggacaucgggaccuccaucagccacuacgucaucgugauguccaugaccaucuuccucguguuccugaacggccuggcccagcuccugacgaccaagaagcugcgccucugcgggaagcccaagagccacuucauguga

SEQ ID NO: 34578 - RNA, 2019 nt, Artificial Sequence
  derived and/or modified sequence opt1 from PIGO__Homo_sapiens__NP_001188413
augcagaaggccagcgugcuccucuuccuggccugggucugcuuccuguucuacgcgggcaucgcccucuucaccuccggguuccugcugacccgccucgagcugacgaaccacagcuccugccaggagcccccgggccccgggagccugcccuggggcucccaggggaagcccggcgccugcuggauggccagccgguucucccgcguggugcucguccugaucgacgcccugcgguucgacuucgcgcagccgcagcacagccacgugccccgcgagccgcccgugucccuccccuuccugggcaagcugagcucccuccagcggauccuggagauccagccccaccacgcccgccuguaccggagccaggucgacccgcccaccaccaccaugcagcgccucaaggcccugacgaccgggucccugcccaccuucaucgacgccggcagcaacuucgcgucccacgccaucguggaggacaaccucaucaagcagcugaccagcgccgggcggcgcguggucuucaugggcgacgacacguggaaggaccuguuccccggggccuucuccaaggccuucuucuuccccagcuucaacgugcgggaccucgacaccguggacaacggcauccuggagcaccuguaccccaccauggacuccggcgagugggacguccucaucgcgcacuuccuggggguggaccacugcggccacaagcacgggccgcaccaccccgagauggccaagaagcugagccagauggaccaggugauccagggccucgucgagcgccuggagaacgacacccugcucgugguggccggcgaccacgggaugacgaccaacggcgaccacgggggcgacagcgagcuggaggucuccgccgcccuguuccucuacagccccaccgcgguguuccccuccaccccgcccgaggagcccgaggugaucccccaggucagccuggugccgacgcuggcccuccugcuggggcuccccauccccuucggcaacaucggcgaggugauggccgagcuguucuccgggggcgaggacagccagccccacuccagcgcccuggcccaggcguccgcccuccaccugaacgcccagcaggucagccgguuccugcacaccuacuccgccgccacccaggaccuccaggcgaaggagcugcaccagcugcagaaccuguucagcaaggccuccgccgacuaccaguggcuccugcagagcccgaagggggccgaggcgacccugcccacggugaucgccgagcuccagcaguuccugcgcggcgcccgggccaugugcaucgaguccugggcccgcuucagccuguccuuccuccugcugcaccuccuggcggccgggauccccgucaccaccccgggccccuucaccgugcccuggcaggccgugagcgccugggcccugauggcgacgcagaccuucuacuccaccggccaccagcccgucuucccggccauccacuggcacgccgccuucgugggguuccccgagggccacgggagcugcaccuggcuccccgcccugcuggugggcgcgaacacguucgccagccaccuccuguucgccgucgggugcccccugcuccugcuguggccguuccucugcgagucccagggccugcggaagcgccagcagccgcccggcaacgaggccgacgcgcgggugcgccccgaggaggaggaggagccccugauggagaugcggcuccgcgacgcgccccagcacuucuacgccgcccugcugcagcucgggcugaaguaccuguucauccucggcauccagauccuggccugcgcccuggccgccagcauccuccgccggcaccugaugguguggaaggucuucgcccccaaguucaucuucgaggccgugggguucaucguguccagcgucggccugcuccugggcaucgcgcuggugaugcgcguggacggggccgucuccagcugguuccggcagcuguuccuggcccagcagcgcuga

SEQ ID NO: 34579 - RNA, 477 nt, Artificial Sequence
  derived and/or modified sequence opt1 from PIGP__Homo_sapiens__NP_710148
auggugccccgcagcaccucccugacccucaucgucuuccuguuccaccggcugagcaaggccccgggcaagaugguggagaacucccccagcccccuccccgagcgcgccaucuacggguucgugcuguuccuguccagccaguucggcuucauccucuaccuggucugggcguucaucccggaguccuggcugaacagccucgggcugacguacuggccccagaaguacugggccguggcccugcccguguaccuccugaucgccaucgucaucggcuacgugcuccuguucgggaucaacaugauguccaccagcccccuggacuccauccacaccaucaccgacaacuacgccaagaaccagcagcagaagaaguaccaggaggaggcgaucccggcccugcgggacaucagcaucuccgaggugaaccagauguucuuccucgccgccaaggagcuguacacgaagaacuga

SEQ ID NO: 34580 - RNA, 1746 nt, Artificial Sequence
  derived and/or modified sequence opt1 from PIGQ__Homo_sapiens__NP_004195
auggugcugaaggccuucuucccgaccugcugcgucagcaccgacuccggccuccugguggggcggugggugcccgagcagagcuccgccgucgugcuggcggugcuccacuuccccuucauccccauccaggucaagcagcugcuggcccaggugcggcaggccagccaggugggcgucgccgugcucgggacguggugccacugccgccaggagcccgaggagucccugggccgguuccuggagagccucggggccguguucccgcacgagcccuggcugcgccugugccgggagcgcggcggcaccuucugguccugcgaggcgacccaccggcaggcccccaccgcccccggggccccgggcgaggaccaggucaugcucaucuucuacgaccagcgccaggugcugcugagccagcuccaccuccccacggugcugcccgaccggcaggcgggggccaccaccgccuccaccggcgggcucgccgccgucuucgacacgguggcgcgcagcgaggugcuguuccgguccgaccgcuucgacgagggccccguccggcugagccacuggcaguccgagggcguggaggccagcauccucgccgagcuggcccgccgggccuccgggccgaucugccugcuccuggcgagccugcucucccuggugagcgccgucuccgccugccgcguguucaagcuguggccccucagcuuccugggcagcaagcuguccacgugcgagcagcuccggcaccgccuggagcaccugacccucaucuucagcacccggaaggccgagaaccccgcccagcugaugcgcaaggcgaacaccguggccuccguccugcucgacguggcccuggggcugaugcuccugagcuggcugcacggccggucccgcaucggccaccucgccgacgcccugguccccguggcggaccacguggccgaggagcugcagcaccuccugcaguggcugaugggggccccggccggccugaagaugaaccgcgcgcucgaccagguccuggggcgguucuuccuguaccacauccaccucuggaucagcuacauccaccugaugucccccuucguggagcacauccuguggcacgugggccucagcgccugccuggggcugaccgucgcccucucccugcugagcgacaucaucgcccuccugaccuuccacaucuacugcuucuacguguacggcgcccgccuguacugccucaagauccacggccuguccagccuguggcgccucuuccgggggaagaaguggaacgugcugcggcagcgcgucgacuccugcagcuacgaccuggaccagcuguucaucggcacccugcuguucacgauccuccuguuccugcuccccaccaccgcgcuguacuaccugguguucacccuccugcggcugcucguggucgccgugcaggggcugauccaccuccucguggaccugaucaacucccugccccucuacagccugggccugcgccucugccggccguaccgccuggccgccggggucaaguuccgggugcugcgccacgaggccggccggccccuccgccugcugaugcagaucaacccccuccccuacucccgggugguccacacguaccgccugccgagcugcggcugccaccccaagcacuccuggggcgcgcugugccggaagcuguuccugggggagcugaucuaccccuggcgccagcgcggggacaagcaggacuga

SEQ ID NO: 34581 - RNA, 2295 nt, Artificial Sequence
  derived and/or modified sequence opt1 from PIGR__Homo_sapiens__XP_011507931
augcugcuguucgugcugaccugccugcucgccgucuuccccgccaucagcaccaaguccccgaucuucggccccgaggaggugaacagcguggaggggaacuccgucagcaucacgugcuacuacccgcccaccuccgugaaccgccacacccggaaguacuggugccgccagggcgcgcgcgggggcugcaucacccugaucagcuccgagggguacgugagcuccaaguacgccggccgggccaaccugacgaacuuccccgagaacggcaccuucgucgugaacaucgcccagcucagccaggacgacuccgggcgguacaagugcggccuggggaucaacagccgcggccuguccuucgacgugagccucgaggucucccaggggcccggccugcugaacgacaccaagguguacaccguggaccucggccggacggucaccaucaacugccccuucaagaccgagaacgcccagaagcgcaagagccuguacaagcagaucgggcuguaccccgugcucgugaucgacuccagcggcuacgucaacccgaacuacaccgggcggauccgccuggacauccagggcacgggccagcuccucuucuccguggugaucaaccagcugcggcugagcgacgcggggcaguaccucugccaggccggcgacgacagcaacuccaacaagaagaacgccgaccugcagguccugaagcccgagcccgagcucguguacgaggaccugcgcgggagcgugaccuuccacugcgcccugggccccgaggucgcgaacguggccaaguuccucugccggcaguccagcggggagaacugcgacguggucgugaacacccugggcaagcgcgccccggccuucgagggccggauccugcucaacccccaggacaaggacggguccuucagcgucgugaucaccggccugcgcaaggaggacgccgggcgguaccugugcggcgcgcacuccgacgggcagcuccaggagggcagccccauccaggccuggcagcuguucgugaacgaggaguccacgaucccccgcagcccgaccgucgugaagggcguggccgggggcuccgucgccgugcugugccccuacaaccggaaggagagcaaguccaucaaguacuggugccucugggagggggcccagaacggccgcugcccccugcugguggacagcgaggggugggucaaggcgcaguacgagggccggcucucccugcuggaggagcccggcaacgggaccuucaccgugauccucaaccagcugacgagccgcgacgccggcuucuacuggugccugaccaacggggacacccucuggcgcaccacgguggagaucaagaucaucgagggcgagccgaaccugaagguccccggcaacgugaccgccgugcugggggagacccucaagguccccugccacuuccccugcaaguucuccagcuacgagaaguacuggugcaaguggaacaacaccggcugccaggcccugccgucccaggacgaggggcccagcaaggccuucgugaacugcgacgagaacagccggcuggugucccugacgcucaaccuggucacccgcgcggacgagggcugguacuggugcggggugaagcagggccacuucuacggcgagaccgccgccguguacgucgccguggaggagcggaaggccgcggggagccgcgacgugucccuggccaaggccgacgccgcgcccgacgagaagguccucgacagcggcuuccgggagaucgagaacaaggccauccaggacccccgccuguucgccgaggagaaggccguggccgacacccgggaccaggcggacgggucccgcgccagcguggacuccggcagcuccgaggagcagggcgggagcucccgggcccuggucagcacgcucgugccgcugggccuggugcucgccgucggggccguggcggugggcgucgcccgcgcccggcaccgcaagaacguggaccggguguccauccgcagcuaccggaccgacaucuccaugagcgacuucgagaacucccgcgaguucggggccaacgacaacaugggcgccagcagcaucacccaggagaccucccucgggggcaaggaggaguucgucgcgacgaccgagagcaccaccgagaccaaggagcccaagaaggccaagcgguccagcaaggaggaggccgagauggccuacaaggacuuccugcugcaguccagcacgguggcggccgaggcccaggacggcccccaggaggccuga

SEQ ID NO: 34582 - RNA, 1569 nt, Artificial Sequence
  derived and/or modified sequence opt1 from PIGT__Homo_sapiens__NP_001171657
auggccgccgcgaugccccuggcccuccuggugcugcuccugcugggccccgggggcuggugccucgccgagccgccccgcgacagccugcgggaggagcuggucaucacgccccucccguccggggacguggccgccaccuuccaguuccgcacccggugggacagcgagcugcagcgcgagggcgugucccacuaccggcuguuccccaaggcgcucgggcagcugaucagcaaguacucccugcgcgagcuccaccugagcuucacccagggcuucuggcggacccgcuacuggggcccgcccuuccugcaggccccguccgacaccgaccacuacuuccuccgguacgccguccugccccgcgagguggugugcacggagaaccugacccccuggaagaagcuccugcccugcagcuccaaggccgggcugagcguccuccugaaggcggaccggcuguuccacaccuccuaccacagccaggccgugcacauccgcccggugugccggaacgcccgcugcaccuccaucagcugggagcuccggcagacgcuguccgucguguucgacgccuucaucaccggccaggggaagaaggacuggagccuguuccgcauguucucccggacccucaccgagcccugcccccuggccagcgagucccgcguguacgucgacaucacgaccuacaaccaggacaacgagacccuggaggugcacccgccgcccaccacgaccuaccaggacgugauccucggcacccggaagaccuacgcgaucuacgaccugcuggacacggccaugaucaacaacagccgcaaccucaacauccagcugaaguggaagcggccgcccgagaacgaggccccgcccguccccuuccugcacgcccagcgcuacgugagcggguacggccuccagaagggcgagcuguccacccugcucuacaacacccaccccuaccgcgccuuccccgugcugcugcucgacaccguccccugguaccugcggcuguacgugcacacgcucaccaucaccagcaaggggaaggagaacaagcccuccuacauccacuaccagcccgcgcaggaccgccugcagccccaccuccuggagaugcugauccagcugcccgccaacagcgugaccaaggucuccauccaguucgagcgggcccugcucaaguggacggaguacacccccgacccgaaccacggcuucuacgugagccccuccgugcugagcgcccugguccccuccaugguggccgcgaagcccgucgacugggaggagagcccccucuucaacucccuguuccccgugagcgacggguccaacuacuucgugcgccuguacaccgagccccuccuggucaaccugcccaccccggacuucagcaugcccuacaacgugaucugccucacgugcaccguggucgccgugugcuacggcuccuucuacaaccugcugacccggaccuuccacaucgaggagccccgcacgggcgggcucgccaagcggcuggccaaccugauccgccgggcccgcggcgugcccccgcucuga

SEQ ID NO: 34583 - RNA, 1308 nt, Artificial Sequence
  derived and/or modified sequence opt1 from PIGU__Homo_sapiens__NP_536724
auggccgcgccccuggugcucguccuggugguggccgucaccgugcgcgccgcccuguuccggagcucccucgccgaguucaucagcgagcgcguggaggucguguccccgcugagcuccuggaagcggguggucgagggccugagccuccuggaccugggggugucccccuacagcggcgccguguuccacgagacgccccucaucaucuaccuguuccacuuccugaucgacuacgcggagcucgucuucaugaucaccgacgcccugaccgccaucgcccuguacuucgcgauccaggacuucaacaaggugguguucaagaagcagaagcuccugcuggagcucgaccaguacgcccccgacgucgccgagcugauccgcaccccgauggagaugcgguacaucccccugaagguggcccucuucuaccugcugaaccccuacaccauccucuccugcguggccaagagcacgugcgcgaucaacaacacccugaucgccuucuucauccugaccaccaucaagggguccgccuuccucagcgccaucuuccuggcccuggcgacguaccagucccucuacccccugacccuguucgucccgggccuccuguaccugcuccagcgccaguacauccccgugaagaugaaguccaaggccuucuggaucuucagcugggaguacgccaugauguacguggggagccuggucgugaucaucugccuguccuucuuccuccugagcuccugggacuucauccccgccguguacggcuucauccugagcguccccgaccucaccccgaacaucggccuguucugguacuucuucgccgagauguucgagcacuucagccuguucuucgugugcgucuuccagaucaacguguucuucuacaccaucccccucgcgaucaagcugaaggagcaccccaucuucuucauguucauccagaucgccgugaucgccaucuucaaguccuaccccacggucggggacguggcccuguacauggccuucuucccgguguggaaccaccucuaccgguuccugcgcaacaucuucguccugaccugcaucaucaucgugugcagccuccuguuccccgugcuguggcaccuguggaucuacgcgggcuccgccaacagcaacuucuucuacgccaucacccucaccuucaacgucgggcagauccugcugaucuccgacuacuucuacgccuuccuccggcgcgaguacuaccugacgcacggccuguaccucaccgcgaaggacgggaccgaggccaugcuggugcugaaguga

SEQ ID NO: 34584 - RNA, 1515 nt, Artificial Sequence
  derived and/or modified sequence opt1 from PIGW__Homo_sapiens__NP_848612
augagcgagaagcagaugaaggaggcguucguguccaaccugaacggcaccaccguccucgagaucacgcaggggcugugcuuccccgccuucugcauccugugccgcggcuuccucaucaucuucagccaguaccugugcuccuucagcccgaccuggaagacccgguuccugaccgacuucguggugcucaucguccccaugguggcgacgcugaccaucugggccuccuucauccugcucgagcugcugggggugaucaucuucggcgccgggcuccuguaccagaucuaccgccggcggaccugcuacgcccgccugcccuuccucaagauccuggagaaguuccugaacaucagccucgaguccgaguacaaccccgccaucagcugcuuccgcgucaucaccuccgcguucacggccaucgccauccuggccguggacuucccgcuguucccccggcgcuucgcgaagaccgagcucuacggcaccggcgccauggacuucggggugggcggguucgucuucggcagcgccauggugugccuggaggugcggcgccggaaguacauggagggguccaagcugcacuacuucaccaacagccucuacuccgucuggccccugguguuccugggcaucggccgccucgccaucaucaagagcaucggguaccaggagcaccugacggaguacggcgugcacuggaacuucuucuucaccaucaucgucgugaagcugaucacgccccuccugcugaucaucuucccgcucaacaaguccuggaucaucgcccuggggaucaccgugcuguaccagcucgcgcuggacuucaccagccugaagcggcucauccuguacggcaccgacggcuccgggacccgcgucggccugcucaacgccaaccgggaggggaucaucagcacccugggcuacguggccauccacauggccggggugcagacgggccuguacaugcacaagaaccgcucccacaucaaggaccucaucaaggucgccugcuuccugcugcucgcggccaucagccuguucaucagccuguacguggugcaggucaacguggaggccgucucccggcgcauggccaaccuggccuucugcaucuggaucguggcgagcucccucauccugcugagcucccuccugcugggcgacaucauccucagcuucgccaaguuccugaucaagggggcccuggugcccugcuccuggaagcucauccagagccccgucaccaacaagaagcacuccgagagccuggugcccgaggccgagcggauggagccgucccugugccucaucaccgcccugaaccgcaagcagcugaucuucuuccuccugagcaacaucaccacgggccugaucaaccucaugguggacacccugcacuccagcacccugugggcccucuucgucgugaaccuguacauguucuccaacugccugaucguguacguccucuaccugcaggacaagaccgugcaguucugguga

SEQ ID NO: 34585 - RNA, 216 nt, Artificial Sequence
  derived and/or modified sequence opt1 from PIGY__Homo_sapiens__NP_001036081
auguuccugagccuccccacccugaccgugcugaucccgcucgucucccuggccggccuguucuacagcgccuccguggaggagaacuucccccaggggugcacgagcaccgcgucccucugcuucuacagccugcugcuccccaucaccauccccguguacgucuucuuccaccuguggaccuggaugggcaucaagcuguuccgccacaacuga

SEQ ID NO: 34586 - RNA, 873 nt, Artificial Sequence
  derived and/or modified sequence opt1 from PIH1D1__Homo_sapiens__NP_060386
auggccaaccccaagcugcucggcauggggcugagcgaggccgaggcgaucggcgccgacuccgcccgcuucgaggagcugcuccugcaggccagcaaggagcugcagcaggcccagaccacccggccggaguccacgcagauccagccccagcccggguucugcaucaagaccaacagcuccgagggcaagguguucaucaacaucugccacagccccuccaucccgccgcccgcggacgucaccgaggaggagcuccugcagaugcuggaggaggaccaggccggguuccgcauccccaugagccucggcgagccccacgccgagcuggacgccaagggccaggggugcaccgcguacgacguggccgugaacuccgacuucuaccggcgcaugcagaacagcgacuuccugcgggagcucgucaucacgaucgcccgcgagggccuggaggacaaguacaaccugcagcucaaccccgaguggcggaugaugaagaaccgccccuucaugggguccaucagccagcagaacauccgguccgagcagcgcccccggauccaggagcugggcgaccuguacaccccggcccccgggcgcgccgagagcggccccgagaagccccaccucaaccuguggcuggaggcgccggaccuccugcuggccgagguggaccuccccaagcuggacggcgcccuggggcucucccuggagaucggcgagaaccggcuggugaugggcgggccccagcagcucuaccaccuggacgccuacaucccccugcagaucaacagccacgaguccaaggccgcguuccaccgcaagcggaagcagcucauggucgccaugccgcugcugcccgugcccagcuga

SEQ ID NO: 34587 - RNA, 2418 nt, Artificial Sequence
  derived and/or modified sequence opt1 from PIK3AP1__Homo_sapiens__NP_689522
auggccgccagcggcgugccccgcgggugcgacauccugaucgucuacucccccgacgcggaggaguggugccaguaccuccagacccuguuccugagcucccgccaggugcgcagccagaagauccucacccaccggcugggccccgaggccuccuucagcgccgaggaccugucccucuuccugagcacgcgcugcguggucgugcugcucuccgccgagcuggugcagcacuuccacaagcccgcccugcucccccugcugcagcgggcguuccacccgccccaccgcgucgugcggcuccugugcggggugcgcgacagcgaggaguuccuggacuucuuccccgacugggcccacuggcaggagcucacgugcgacgacgagcccgagaccuacgucgccgccgugaagaaggcgaucuccgaggacagcggcugcgacuccgugaccgacacggagcccgaggacgagaaggucgugagcuacuccaagcagcagaaccugcccaccgugaccagccccgggaaccugauggucgugcagcccgaccggauccgcugcggcgccgagaccacgguguacgucaucgugcggugcaagcucgacgaccgcguggccaccgaggccgaguucucccccgaggacagccccuccguccggauggaggccaagguggagaacgaguacaccaucagcgugaaggcgcccaaccugagcuccggcaacgucagccugaagaucuacuccggggaccucguggucugcgagaccgugaucagcuacuacacggacauggaggagaucggcaaccugcuguccaacgccgccaaccccguggaguucaugugccaggccuucaagaucgucccguacaacaccgagacccucgacaagcugcugaccgagagccucaagaacaacauccccgccuccgggcugcaccuguucggcaucaaccagcucgaggaggaggacaugaugaccaaccagcgggacgaggagcugcccacccugcuccacuucgcggccaaguacgggcugaagaaccugaccgcccuccugcugaccugccccggcgcccuccaggccuacagcguggcgaacaagcacggccacuacccgaacacgaucgccgagaagcacggguuccgggaccugcgccaguucaucgacgaguacguggagaccgucgacaugcugaagucccacaucaaggaggagcucaugcacggcgaggaggccgacgccguguacgagagcauggcccaccuguccaccgaccugcucaugaagugcagccugaaccccgggugcgacgaggaccuguacgaguccauggcggccuucgugcccgccgccaccgaggaccuguacgucgagaugcuccaggcgagcacguccaaccccaucccgggcgacggcuucagccgggccaccaaggacuccaugauccgcaaguuccuggaggggaacagcaugggcaugaccaaccuggagcgggaccagugccaccucgggcaggaggaggacguguaccacaccguggacgacgacgaggccuucuccgucgaccuggccagccgcccgcccgugcccgugccccggcccgagacgaccgcccccggcgcgcaccagcugccggacaacgagcccuacaucuucaaggucuucgccgagaagucccaggagcgccccgggaacuucuacgugagcagcgaguccauccgcaaggggcccccggugcggcccuggcgcgaccggccccagagcuccaucuacgaccccuucgccggcaugaagaccccgggccagcgccagcucaucacccugcaggagcaggucaagcugggcaucgugaacguggacgaggccguccuccacuucaaggaguggcagcugaaccagaagaagcggagcgaguccuuccgcuuccagcaggagaaccugaagcggcuccgcgacagcaucacgcggcgccagcgggagaagcagaaguccgggaagcagaccgaccuggagaucaccgugcccauccgccacagccagcaccuccccgccaagguggaguucggcgucuacgaguccgggccccgcaagagcgugaucccgccccggaccgagcugcggcgcggcgacuggaagacggacuccaccagcuccaccgcgagcuccaccagcaaccggagcuccacccgcagccugcuguccgugagcuccggcauggagggggacaacgaggacaacgagguccccgaggugacgcggagccgcucccccggcccgccccagguggacgggacccccaccaugagccucgagcggcccccgcgcgucccgccccgcgccgccucccagcggccgcccacccgcgagacguuccacccgcccccgcccgugccgccccggggccgcuga

SEQ ID NO: 34588 - RNA, 5061 nt, Artificial Sequence
  derived and/or modified sequence opt1 from PIK3C2A__Homo_sapiens__NP_002636
auggcccagaucagcuccaacagcggcuucaaggagugccccuccagccacccggagcccacccgggccaaggacguggacaaggaggaggcgcuccagauggaggccgaggcccucgccaagcugcagaaggaccgccaggugaccgacaaccagcggggguucgagcuguccagcuccacccggaagaaggcccagguguacaacaagcaggacuacgaccucaugguguuccccgagagcgacucccagaagcgcgcgcuggacaucgacgucgagaagcugacccaggccgagcucgagaagcugcugcucgacgacagcuucgagaccaagaagacccccgugcugccggugacgcccauccugucccccagcuucuccgcccagcucuacuuccggcccaccauccagcgcggccaguggccgcccgggcugcccggccccagcaccuacgcccugccguccaucuaccccagcaccuacuccaagcaggcggccuuccagaacggguucaacccccggaugcccacguucccgagcaccgagcccaucuaccucucccugcccggccagagccccuacuucagcuacccgcugacccccgccacccccuuccacccccagggcucccucccgaucuaccgccccgucgugagcacggacauggccaagcuguucgacaagaucgccuccaccagcgaguuccugaagaacgggaaggcgcggaccgaccucgagaucaccgacuccaaggugagcaaccugcaggucucccccaagagcgaggacaucuccaaguucgacuggcuggaccucgacccccugagcaagccgaagguggacaacguggagguccuggaccacgaggaggagaagaacguguccagccuccuggccaaggaccccugggacgccgugcugcucgaggagcgcuccacggccaacugccaccuggagcggaaggucaacggcaagagccuguccguggccaccgugacccgcagccagucccucaacauccggaccacgcagcuggcgaaggcccaggggcacaucagccagaaggaccccaacggcaccuccagccugccgaccgggagcucccuccugcaggaggucgaggugcagaacgaggagauggccgccuucugccgcagcaucaccaagcugaagacgaaguuccccuacaccaaccaccggaccaaccccggcuaccuccugucccccgugaccgcccagcgcaacaucugcggcgagaacgcgagcgucaagguguccaucgacaucgagggguuccagcugccggugacguucacgugcgacgucagcuccaccguggagaucaucaucaugcaggcccucugcuggguccacgacgaccugaaccagguggacgugggcagcuacguccugaaggugugcgggcaggaggaggugcuccagaacaaccacugccugggcucccacgagcacauccagaacugccggaagugggacaccgagauccgccugcagcuccugacguucagcgccaugugccagaaccuggcccggaccgccgaggacgacgagacccccgucgaccugaacaagcaccucuaccagaucgagaagcccugcaaggaggcgaugacccgccaccccguggaggagcugcuggacuccuaccacaaccagguggagcucgcccugcagaucgagaaccagcaccgggccgucgaccaggugaucaaggccgugcgcaagaucugcagcgcgcuggacggcgucgagacgcucgccaucaccgaguccgugaagaagcugaagcgcgccgugaaccugccgcggagcaagaccgccgacgucaccucccucuucgggggcgaggacaccagccgcuccagcacgcgggggagccugaaccccgagaaccccguccagguguccaucaaccagcugaccgccgcgaucuacgaccuccugcgccugcacgccaacagcggccggucccccaccgacugcgcccagagcuccaagagcgucaaggaggccuggaccacgaccgagcagcuccaguucaccaucuucgccgcgcacgggaucuccagcaacuggguguccaacuacgagaaguacuaccugaucugcagccugucccacaacggcaaggaccucuucaagccgauccagagcaagaaggugggcaccuacaagaacuucuucuaccugaucaagugggacgagcugaucaucuuccccauccagaucucccagcucccccuggagagcguccugcaccucacgcuguucgggauccugaaccaguccagcggcuccagccccgacuccaacaagcagcgcaaggggccggaggcccucggcaaggugagccugccccuguucgacuucaagcgguuccugaccugcgggaccaagcugcuguaccucuggaccagcucccacacgaacagcgugcccggcaccgucaccaagaagggcuacgugauggagcgcaucgugcugcaggucgacuuccccuccccggccuucgacaucaucuacaccacgccccagguggaccggagcaucauccagcagcacaaccuggagacccucgagaacgacaucaaggggaagcugcuggacauccuccacaaggacuccagccugggccuguccaaggaggacaaggccuuccucugggagaagcgcuacuacugcuucaagcaccccaacugccugcccaagauccuggccagcgcgccgaacuggaagugggugaaccucgccaagaccuacucccugcugcaccaguggcccgcccucuacccccugaucgcccuggagcuccuggacagcaaguucgcggaccaggagguccggucccuggccgugaccuggaucgaggccaucagcgacgacgagcucacggaccugcugccgcaguucgugcaggcccucaaguacgagaucuaccugaacuccagccugguccaguuccuccugucccgcgcccuggggaacauccagaucgcgcacaaccucuacuggcugcugaaggacgcccuccacgacgugcaguucagcacccgguacgagcacgugcugggcgcccugcucuccgucgggggcaagcgccugcgggaggagcugcucaagcagaccaagcuggugcagcugcucggcgggguggccgagaagguccgccaggccagcggcuccgcgcgccagguggugcugcagcgcagcauggagcggguccagagcuucuuccagaagaacaagugccgccugccccucaagcccucccugguggccaaggagcugaacaucaagagcugcuccuucuucagcuccaacgccgugccccucaaggucaccauggugaacgccgacccgaugggggaggagaucaacgugauguucaaggucggcgaggaccugcgccaggacaugcuggcccuccagaugaucaagaucauggacaagaucuggcugaaggagggccuggaccuccggauggugaucuucaagugccugagcacggggcgcgaccggggcaugguggagcugguccccgcguccgacacccuccgcaagauccagguggaguacggggucaccggcagcuucaaggacaagccccuggccgaguggcugcggaaguacaaccccuccgaggaggaguacgagaaggccagcgagaacuucaucuacuccugcgccgggugcugcguggcgaccuacgugcucggcaucugcgaccgccacaacgacaacaucaugcugcggagcacgggccacauguuccacaucgacuucgggaaguuccugggccacgcccagauguucggguccuucaagcgcgaccgggccccguucguccugaccagcgacauggccuacgugaucaacggcggggagaagcccaccauccgcuuccagcuguucguggaccucugcugccaggccuacaaccugauccggaagcagaccaaccucuuccugaaccugcucucccugaugauccccagcggccugcccgagcucacguccauccaggaccugaaguacguccgcgacgcgcugcagccgcagaccaccgacgccgaggccaccaucuucuucacgcggcucaucgagagcucccugggcagcaucgccaccaaguucaacuucuucauccacaaccuggcccagcuccgcuucagcgggcugcccuccaacgacgagcccauccugagcuucucccccaagaccuacagcuuccggcaggacggccgcaucaaggagguguccguguucaccuaccacaagaaguacaacccggacaagcacuacaucuacgucgugcggauccuccgcgaggggcagaucgagcccagcuucguguuccggaccuucgacgaguuccaggagcugcacaacaagcuguccaucaucuucccccucuggaagcugcccggcuucccgaaccgcaugguccuggggcggacgcacaucaaggacguggcggccaagcgcaagaucgagcucaacagcuaccugcagucccugaugaacgccagcaccgacguggccgagugcgaccucgucugcaccuucuuccacccccugcugcgcgacgagaaggccgagggcaucgcgcgguccgccgacgccggcagcuucucccccacccccgggcagaucggcggggccgugaagcucagcaucuccuaccgcaacggcacgcuguucaucauggugaugcacaucaaggaccuggucaccgaggacggggccgacccgaaccccuacgugaagaccuaccuccugcccgacaaccacaagaccagcaagcggaagacgaagaucucccgcaagacccggaaccccaccuucaacgagaugcugguguacagcggcuacuccaaggagacccuccgccagcgggagcugcagcugagcguccucagcgcggagucccugcgcgagaacuucuuccugggcggggugacgcucccgcugaaggacuucaaccugagcaaggagaccgugaagugguaccagcucaccgccgccaccuaccuguga

SEQ ID NO: 34589 - RNA, 4905 nt, Artificial Sequence
  derived and/or modified sequence opt1 from PIK3C2B__Homo_sapiens__NP_002637
augagcuccacccagggcaacggggagcacuggaagagccuggaguccgugggcaucagccgcaaggagcucgccauggccgaggcgcugcagauggaguacgacgcccugucccggcuccgccacgacaaggaggagaaccgggccaagcagaacgccgaccccagccugaucuccugggacgagccgggggucgacuucuacagcaagcccgccggccgccggaccgaccugaagcuccugcgcgggcuguccggcagcgaccccacgcucaacuacaacucccugagcccccaggagggcccgcccaaccacuccaccagccaggggccccagcccggcuccgacccguggcccaaggggagccuguccggcgacuaccucuacaucuucgacgggagcgacggcggcguguccagcagccccgggcccggcgacaucgagggguccugcaagaagcugagcccgcccccccugcccccgcgggcguccaucugggacacccccccccuccccccgcgcaagggcagccccuccagcuccaagaucagccagcccuccgacaucaacaccuucagccugguggagcagcugcccggcaagcuccuggagcaccggauccuggaggaggaggagguccucgggggcgggggccaggggcgccugcugggcuccguggacuacgacggcaucaacgacgccaucacgcggcucaaccugaagagcaccuacgacgccgagaugcugcgcgacgccacccggggguggaaggagggccgcgggccgcucgacuucuccaaggacaccagcggcaagcccguggcgcgguccaagacgaugcccccccaggucccgccccgcaccuacgccagccgguacgggaaccgcaagaacgccacccccggcaagaaccggcgcaucuccgccgccccggugggcagccggccccacaccguggcgaacgggcacgagcuguucgaggucuccgaggagcgcgacgaggagguggccgccuucugccacaugcuggacauccuccgcagcggcagcgacauccaggacuacuuccugacgggguacgugugguccgccgucacccccagccccgagcaccugggcgacgaggugaaccucaaggugaccguccugugcgaccggcugcaggaggcccucaccuucacgugcaacugcuccagcaccguggaccugcugaucuaccagacccucugcuacacccacgacgaccugcgcaacguggacgucggggacuucgugcugaagccgugcggccucgaggaguuccugcagaacaagcacgcgcugggcucccacgaguacauccaguacugccggaaguucgacaucgacauccgccuccagcugauggagcagaaggugguccggagcgaccuggcccgcacggugaacgacgaccagucccccagcacccucaacuaccuggugcaccugcaggagcggcccgucaagcagaccaucucccgccaggcccugagccuccuguucgacaccuaccacaacgagguggacgccuuccugcucgccgacggggacuucccccugaaggcggaccgggucgugcaguccgugaaggccaucugcaacgcccuggccgccgucgagacgccggagaucaccagcgcgcucaaccagcugccccccugccccucccgcaugcagccgaagauccagaaggaccccagcgugcuggccgugcgggagaaccgcgagaaggucguggaggcccucaccgccgcgauccuggaccugguggagcucuacugcaacaccuucaacgccgacuuccagacggccguccccggcucccggaagcacgaccuggugcaggaggccugccacuucgcccgcagccuggcguucaccguguacgccacccaccggauccccaucaucugggccaccuccuacgaggacuucuaccucagcugcagccugucccacgggggcaaggagcugugcagcccgcuccagacgcgccgggcccacuucuccaaguaccuguuccaccugaucgucugggaccagcagaucugcuuccccgugcaggugaaccgccucccccgggagacccugcugugcgccacccucuacgcgcugcccaucccgccccccggcagcuccagcgaggccaacaagcagcgccgcguccccgaggcccuggggugggugaccacgccgcucuucaacuuccggcaggugcugaccugcggccgcaagcugcucgggcuguggcccgccacccaggagaaccccuccgcccgguggagcgcgccgaacuuccaccagcccgacuccgucauccugcagaucgacuuccccaccagcgccuucgacaucaaguucaccucccccccgggcgacaaguucagcccccgcuacgaguucgggucccuccgggaggaggaccagcgcaagcugaaggacaucaugcagaaggagagccuguacuggcucacggacgccgacaagaagcggcugugggagaagcgcuacuacugccacuccgaggugagcucccugccccucgugcuggccagcgcgcccuccugggagugggccugccugccggacaucuacguccuccugaagcaguggacccacaugaaccaccaggacgcccugggccuccugcacgccaccuuccccgaccaggaggugcggcgcauggccgugcaguggaucggcagccugagcgacgcggagcuccuggacuaccugccccagcucguccaggcccugaaguacgagugcuaccuggacuccccccucgugcgguuccugcugaagcgcgccgugagcgaccuccgggucacccacuacuucuucuggcugcugaaggacgggcucaaggacucccaguucagcauccgcuaccaguaccugcuggccgcccuccugugcugcugcggcaaggggcugcgggaggaguucaaccgccagugcuggcucgugaacgcgcuggccaagcuggcccagcaggugcgggaggccgccccguccgcgcgccagggcauccuccggacggggcuggaggaggucaagcaguucuucgcccugaacggcagcugccgccucccccugucccccagccugcucgugaagggcaucgugccccgggacugcuccuacuucaacagcaacgccgucccgcugaagcuguccuuccagaacguggacccccucggggagaacauccgcgugaucuucaagugcggcgacgaccugcgccaggacaugcugacccuccagaugauccggaucaugagcaagaucuggguccaggaggggcuggacaugcgcauggugaucuuccggugcuucuccaccggccgcgggcggggcaugguggagaugauccccaacgccgagacccugcgcaagauccaggucgagcacggcgugacggggagcuucaaggaccggccccucgcggacuggcugcagaagcacaacccgggcgaggacgaguacgagaaggccguggagaacuucaucuacuccugcgccgggugcugcgucgccaccuacgugcugggcaucugcgaccgccacaacgacaacaucaugcucaagaccaccgggcacauguuccacaucgacuucggccgguuccugggccacgcccagauguucgggaacaucaagcgcgaccgggcgcccuucguguucacgagcgacauggccuacgucaucaacggcggggacaagcccuccagccgcuuccacgacuucguggaccugugcugccaggccuacaaccucauccggaagcacacccaccuguuccugaaccuccugggccugaugcuguccugcggcauccccgagcucagcgaccuggaggaccugaaguacguguacgacgcccuccgcccgcaggacaccgaggccaacgcgaccacguacuucacccggcugaucgagagcucccuggggagcgucgccaccaagcucaacuucuucauccacaaccuggcccagaugaaguucaccggcuccgacgaccgccugacgcucagcuucgccucccggacccacacccugaagagcuccgggcgcaucagcgacguguuccugugccggcacgagaagaucuuccaccccaacaagggcuacaucuacguggucaaggugaugcgcgagaacacccacgaggccacguacauccagcgcaccuucgaggaguuccaggagcuccacaacaagcugcggcugcucuuccccuccagccaccugcccuccuucccgagccgcuucgucaucgggcggucccgcggcgaggcgguggccgagcggcgccgggaggagcugaacggcuacaucuggcaccucauccacgccccccccgagguggccgagugcgaccuggucuacaccuucuuccacccgcugccccgcgacgagaaggccauggggaccagccccgcgcccaaguccagcgacggcacgugggcccggccgguggggaaggugggcggggaggucaagcucuccaucagcuacaagaacaacaagcuguucaucauggugaugcacauccgcggccugcagcuccugcaggacggcaacgaccccgaccccuacgugaagaucuaccugcuccccgacccgcagaagaccaccaagcggaagaccaaggucgcccgcaagacgugcaaccccaccuacaacgagaugcugguguacgacgggauccccaagggcgaccugcagcagcgggagcuccagcuguccgugcugagcgagcagggguucugggagaacguccuccugggcgaggugaacauccgccugcgggagcucgaccuggcccaggagaagaccgggugguucgcgcugggcagccgcucccacggcacccucuga

SEQ ID NO: 34590 - RNA, 4461 nt, Artificial Sequence
  derived and/or modified sequence opt1 from PIK3C2G__Homo_sapiens__NP_001275701
auggccuacagcuggcagaccgaccccaacccgaacgagucccacgagaagcaguacgagcaccaggaguuccuguucgugaaccagccccacagcuccagccaggucucccucggcuucgaccagaucguggacgagaucagcgggaagaucccccacuacgaguccgagaucgacgagaacaccuucuucgugcccacggccccgaagugggacagcaccggccacucccugaacgaggcgcaccagaucagccugaacgaguucaccuccaagagccgcgagcucuccuggcaccaggucagcaaggcccccgccaucggguucucccccagcgugcugcccaagccgcagaacaccaacaaggagugcuccuggggcagccccaucgggaagcaccacggcgccgacgacucccgguucagcauccuggcccccagcuucacgucccucgacaagaucaaccuggagaaggagcuggagaacgagaaccacaacuaccacaucggcuucgagagcuccaucccgcccaccaacagcuccuucagcuccgacuucaugcccaaggaggagaacaagcgcagcgggcacgugaacaucgucgagcccucccucaugcugcugaagggcagccuccagcccgggaugugggaguccaccuggcagaagaacaucgagagcaucggcugcuccauccagcugguggaggugccgcagagcuccaacaccagccuggcguccuucugcaacaaggucaagaagauccgggagcgcuaccacgccgccgacgugaacuucaacagcgggaagaucugguccacgaccaccgccuuccccuaccagcuguucagcaagaccaaguucaacauccacaucuucaucgacaacagcacgcagccccugcacuucaugcccugcgcgaacuaccuggugaaggaccucaucgccgagauccugcacuucugcaccaacgaccagcugcucccgaaggaccacauccuguccgucugcggcagcgaggaguuccugcagaacgaccacugccucggcucccacaagauguuccagaaggacaagagcgugauccagcugcaccuccagaagucccgggaggcccccgggaagcucagccgcaagcacgaggaggaccacucccaguucuaccugaaccagcugcucgaguucaugcacaucuggaaggugagccggcagugccugcugacccucauccgcaaguacgacuuccaccugaaguaccugcucaagacccaggagaacgucuacaacaucaucgaggaggugaagaagaucugcuccgugcugggcugcgucgagacgaagcagaucaccgacgccgugaacgagcugagccucauccugcagcggaagggggagaacuucuaccaguccagcgagaccuccgccaagggccugaucgagaaggugaccacggagcucagcaccuccaucuaccagcugaucaacgucuacugcaacagcuucuacgcggacuuccagcccgugaacgugccccgcugcaccuccuaccugaacccgggccuccccagccaccugagcuucaccgucuacgccgcccacaacauccccgagacgugggugcacuccuacaaggccuucagcuucacgugcuggcugaccuacgccgggaagaagcucugccagguccggaacuaccgcaacauccccgacaagaagcuguucuucuuccuggugaacuggaacgagaccaucaacuucccgcuggagaucaagucccucccccgggagagcaugcugaccgugaagcuguucggcaucgcgugcgccaccaacaacgccaaccuccuggccuggaccugccugccccucuucccgaaggagaaguccauccuggggagcaugcuguucuccaugacccuccagagcgagccgcccgucgagaugaucacgcccggcgugugggacgugucccagcccagccccgucacccugcagaucgacuuccccgccaccgggugggaguacaugaagcccgacuccgaggagaaccgcagcaaccuggaggagccgcucaaggagugcaucaagcacaucgcgcggcugucccagaagcagacgccccugcuccugagcgaggagaagaagcgcuaccugugguucuaccgguucuacugcaacaacgagaacugcucccucccccuggugcugggcagcgcccccggcugggacgagcgcaccguguccgagaugcacaccauccuccggcgcuggaccuucagccagccgcuggaggcccuggggcuccugaccuccagcuuccccgaccaggagauccggaaggucgccgugcagcagcuggacaaccuccugaacgacgagcugcucgaguaccugccccagcuggugcaggccgucaaguucgaguggaaccucgagagcccccuggugcagcugcuccugcaccgcucccugcagagcauccagguggcgcaccgccucuacuggcugcugaagaacgccgagaacgaggccuacuucaaguccugguaccagaagcuccuggccgcgcugcaguucugcgccggcaaggcccucaacgacgaguucagcaaggagcagaagcugaucaagauccugggggacaucggcgagcgggucaaguccgccagcgaccaccagcgccaggaggugcucaagaaggagaucgggcggcuggaggaguucuuccaggacgugaacacgugccaccucccgcugaaccccgcccugugcaucaagggcaucgaccacgacgcgugcuccuacuucaccagcaacgcccugccccucaagaucaccuucaucaacgccaaccccaugggcaagaacaucuccaucaucuucaaggccggggacgaccugcgccaggacaugcugguccuccagcugauccaggugauggacaacaucuggcugcaggagggccucgacaugcagaugaucaucuaccggugccugagcaccgggaaggaccagggccuggugcagauggucccggacgccgugacccucgcgaagauccaccgccacuccgggcugaucggcccccugaaggagaacacgaucaagaagugguucagccagcacaaccaccucaaggccgacuacgagaaggcccugcggaacuucuucuacuccugcgccggcuggugcguggucaccuucauccugggggugugcgaccgccacaacgacaacaucaugcucaccaagagcggccacauguuccacaucgacuucgggaaguuccugggccacgcccagaccuucggcgggaucaagcgggaccgcgcgcccuucaucuucacguccgagauggaguacuucaucaccgagggcgggaagaacccccagcacuuccaggacuucguggagcugugcugccgggccuacaacaucauccgcaagcacagccagcuccugcugaaccuccuggagaugaugcuguacgccggccucccggagcuguccgggauccaggaccugaaguacgucuacaacaaccuccggccccaggacaccgaccuggaggccaccagccacuucacgaagaagaucaaggagucccuggagugcuuccccgugaagcucaacaaccugauccacacccuggcgcagaugagcgccaucagcccggccaaguccaccagccagaccuucccccaggaguccugccuccugagcacgacccgcuccaucgagcgggccaccauccugggcuucagcaagaaguccagcaaccucuaccugauccaggugacccacuccaacaacgagacgagccugaccgagaaguccuucgagcaguucagcaagcuccacucccagcugcagaagcaguucgccagccugacccugcccgaguucccccacugguggcaccucccguucaccaacuccgaccaccgccgguuccgcgaccugaaccacuacauggagcagauccugaacgucagccacgaggugacgaacuccgacugcgugcucagcuucuuccuguccgaggcgguccagcagaccguggaggagagcagccccguguaccugggcgagaaguuccccgacaagaagcccaagguccagcucgugaucuccuacgaggacgugaagcugaccauccuggucaagcacaugaagaacauccaccucccggacgggagcgcccccuccgcccacguggaguucuaccugcugcccuaccccagcgaggugcggcgccgcaagaccaaguccgucccgaagugcacggaccccaccuacaacgagaucgugguguacgacgaggucaccgagcuccagggccacgugcugaugcugaucgucaagagcaagaccguguucgugggggccaucaacauccggcucugcuccgugccccuggacaaggagaagugguacccccugggcaacagcaucaucuga

SEQ ID NO: 34591 - RNA, 2664 nt, Artificial Sequence
  derived and/or modified sequence opt1 from PIK3C3__Homo_sapiens__NP_002638
augggcgaggccgagaaguuccacuacaucuacagcugcgaccuggacaucaacgugcagcucaagaucgggucccuggagggcaagcgcgagcagaaguccuacaaggccguccuggaggaccccaugcucaaguucuccgggcuguaccaggagaccugcagcgaccuguacgugaccugccagguguucgcggagggcaagccccucgcccugcccguccggacguccuacaaggccuucagcacccgcuggaacuggaacgaguggcugaagcuccccgugaaguaccccgaccugccgcggaacgcccagguggcccugaccaucugggacgucuacgggcccggcaaggcggugcccgugggcgggaccacggucucccucuucggcaaguacgggauguuccgccagggcaugcacgaccugaagguguggcccaacguggaggccgacgggagcgagccgaccaagacccccggccggaccuccagcacgcuguccgaggaccagaugagccgccucgccaagcugaccaaggcccaccggcagggccacauggucaagguggacuggcuggaccgccucaccuuccgggagaucgagaugaucaacgaguccgagaagcgcagcuccaacuucauguaccugaugguggaguuccggugcgucaagugcgacgacaaggaguacgggaucguguacuacgagaaggacggcgacgagagcucccccauccugaccagcuucgagcucgugaagguccccgacccgcagauguccauggagaaccugguggagagcaagcaccacaagcuggcgcgcagccuccgguccgggcccagcgaccacgaccugaagcccaacgccgccacgcgcgaccagcugaacaucaucguguccuacccgcccaccaagcagcucaccuacgaggagcaggaccuggucuggaaguuccgguacuaccugaccaaccaggagaaggcccucacgaaguuccugaagugcgugaacugggaccugccccaggaggccaagcaggcgcucgagcugcugggcaaguggaagcccauggacguggaggacagccucgagcugcuguccagccacuacaccaaccccaccguccgccgguacgccguggcccgccuccggcaggccgacgacgaggaccugcugauguaccuccugcagcugguccaggcccucaaguacgagaacuucgacgacaucaagaacggccuggagccgaccaagaaggacucccagagcuccgugagcgagaacguguccaacagcgggaucaacuccgcggagaucgacagcucccagaucaucacgagcccccugcccuccgucagcagcccgccgcccgccagcaagaccaaggaggugcccgacggcgagaaccucgagcaggaccugugcaccuuccugaucagccgcgccugcaagaacuccacccuggccaacuaccucuacugguacgugaucgucgagugcgaggaccaggacacgcagcagcgggaccccaagacccacgagauguaccugaacgugaugcgccgcuucagccaggcccugcucaagggggacaaguccgugcgggucaugcgcagccugcuggcggcccagcagaccuucguggaccggcucgugcaccugaugaaggccguccagcgcgaguccggcaaccggaagaagaagaacgagcgccugcaggcccuccugggggacaacgagaagaugaaccugagcgacguggagcucaucccccugccccuggagccccaggugaagauccggggcaucaucccggagaccgccacccucuucaaguccgcgcugaugcccgcccagcuguucuucaagacggaggacggcgggaaguaccccgucaucuucaagcacggcgacgaccuccgccaggaccagcugauccugcagaucaucagccucauggacaagcugcugcggaaggagaaccucgaccugaagcugacccccuacaaggugcucgccaccuccacgaagcacggguucaugcaguucauccagagcgugccggucgccgaggugcuggacaccgagggcuccauccagaacuucuuccgcaaguacgcgcccagcgagaacgggcccaacggcaucuccgccgaggugauggacaccuacgucaagagcugcgccggcuacugcgugaucaccuacauccugggggugggcgaccggcaccucgacaaccugcugcucacgaagaccgggaagcuguuccacaucgacuucggcuacauccuggggcgcgaccccaagccgcucccgccgcccaugaagcugaacaaggagauggucgagggcaugggcgggacccaguccgagcaguaccaggaguuccggaagcagugcuacaccgccuuccugcaccuccgccgguacagcaaccugauccugaaccucuucucccugaugguggacgccaacauccccgacaucgcgcuggagcccgacaagaccgugaagaagguccaggacaaguuccgccucgaccugagcgacgaggaggccgugcacuacaugcagagccugaucgacgaguccgugcacgcccucuucgccgccgucguggagcagauccacaaguucgcgcaguacuggcggaaguga

SEQ ID NO: 34592 - RNA, 3207 nt, Artificial Sequence
  derived and/or modified sequence opt1 from PIK3CA__Homo_sapiens__NP_006209
augcccccgcgccccagcuccggcgagcugugggggauccaccucaugccgccccggauccugguggagugccugcuccccaacggcaugaucgucacccuggagugccugcgcgaggccacccucaucacgaucaagcacgagcuguucaaggaggcccggaaguacccccugcaccagcuccugcaggacgagagcuccuacaucuucgugagcgugacccaggaggcggagcgcgaggaguucuucgacgagacccggcgccugugcgaccuccggcuguuccagcccuuccugaaggucaucgagcccguggggaaccgcgaggagaagauccucaaccgggagaucggcuucgccaucgggaugccggugugcgaguucgacauggucaaggaccccgaggugcaggacuuccgccggaacauccugaacgugugcaaggaggccgucgaccugcgcgaccucaacagcccccacagccgggccauguacguguacccgcccaacguggaguccagccccgagcugcccaagcacaucuacaacaagcuggacaagggccagaucaucgucgugaucugggugaucgucucccccaacaacgacaagcagaaguacacccucaagaucaaccacgacugcgugccggagcaggucaucgccgaggcgauccgcaagaagacgcggagcaugcugcuguccagcgagcagcucaagcugugcgugcuggaguaccagggcaaguacauccucaaggugugcgggugcgacgaguacuuccuggagaaguacccccugucccaguacaaguacauccgcagcugcaucaugcucggccggaugcccaaccugaugcugauggccaaggagucccucuacagccagcugcccauggacugcuucaccaugccguccuacagccgccggaucuccaccgccacccccuacaugaacggggagacgagcaccaagagccugugggugaucaacuccgcccuccgcaucaagauccugugcgcgaccuacgucaacgugaacauccgggacaucgacaagaucuacgugcgcaccggcaucuaccacgggggcgagccccugugcgacaacgucaacacgcagcgcgugcccugcagcaacccgcgguggaacgaguggcucaacuacgacaucuacauccccgaccugccccgcgccgcccggcugugccucuccaucugcagcgucaagggccgcaagggggccaaggaggagcacugcccccuggccuggggcaacaucaaccuguucgacuacaccgacacccucguguccgggaagauggcgcugaaccuguggccggugccccacggccucgaggaccugcugaaccccaucggcgucaccgggagcaacccgaacaaggagacgcccugccuggagcucgaguucgacugguucuccagcguggugaaguuccccgacauguccgucaucgaggagcacgccaacuggagcgugucccgggaggccggcuucagcuacucccacgccgggcugagcaaccgccuggcccgggacaacgagcuccgcgagaacgacaaggagcagcugaaggcgaucuccacccgggacccccugagcgagaucaccgagcaggagaaggacuuccucuggucccaccgccacuacugcgugaccaucccggagauccugcccaagcugcuccugagcgucaaguggaacucccgggacgagguggcccagauguacugccuggugaaggacuggccgcccaucaagcccgagcaggccauggagcuccuggacugcaacuaccccgaccccaugguccgcggcuucgccgugcggugccuggagaaguaccucacggacgacaagcugagccaguaccugauccagcucgugcagguccugaaguacgagcaguaccuggacaaccuccuggugcgcuuccugcucaagaaggcccugaccaaccagcggaucgggcacuucuucuucuggcaccugaaguccgagaugcacaacaagaccgugucccagcgcuucggccuccugcuggagagcuacugccgggcgugcggcauguaccucaagcaccugaaccgccaggucgaggccauggagaagcugaucaaccucaccgacauccugaagcaggagaagaaggacgagacgcagaaggugcagaugaaguuccugguggagcagaugcggcgccccgacuucauggacgcccuccagggguuccuguccccgcugaaccccgcccaccagcucggcaaccugcgccuggaggagugccggaucaugagcuccgccaagcgcccccucuggcugaacugggagaaccccgacaucaugagcgagcuccucuuccagaacaacgagaucaucuucaagaacggggacgaccugcggcaggacaugcugacccuccagaucauccgcaucauggagaacaucuggcagaaccagggccuggaccugcggaugcucccguacgggugccuguccaucggcgacugcgucggccugaucgagguggugcgcaacagccacaccaucaugcagauccagugcaagggcgggcucaagggggcgcugcaguucaacucccacacccugcaccaguggcucaaggacaagaacaagggcgagaucuacgacgccgccaucgaccuguucacgcggagcugcgccggguacugcgucgcgaccuucauccugggcaucggcgaccgccacaacuccaacaucauggugaaggacgacgggcagcuguuccacaucgacuucggccacuuccuggaccacaagaagaagaaguucggguacaagcgggagcgcgugcccuucguccugacccaggacuuccucaucgugaucagcaagggcgcccaggagugcaccaagacgcgggaguucgagcgcuuccaggagaugugcuacaaggccuaccuggccauccggcagcacgccaaccuguucaucaaccucuucuccaugaugcugggcagcgggaugcccgagcugcaguccuucgacgacaucgcguacauccgcaagacccucgcccuggacaagaccgagcaggaggcccuggaguacuucaugaagcagaugaacgacgcccaccacggcggguggaccacgaagauggacuggaucuuccacaccaucaagcagcacgcccucaacuga

SEQ ID NO: 34593 - RNA, 3213 nt, Artificial Sequence
  derived and/or modified sequence opt1 from PIK3CB__Homo_sapiens__NP_006210
augugcuucagcuucaucaugcccccggccauggccgacauccuggacaucugggcgguggacucccagaucgccagcgacggcuccauccccgucgacuuccuccugcccaccgggaucuacauccagcuggaggugccccgcgaggccaccaucagcuacaucaagcagaugcucuggaagcagguccacaacuacccgauguucaaccugcugauggacaucgacuccuacauguucgccugcgugaaccagacggccguguacgaggagcucgaggacgagacccggcgccugugcgacgugcggcccuuccugcccguccucaagcuggugacccgcagcugcgaccccggcgagaagcuggacuccaagaucggggugcucaucggcaaggggcugcacgaguucgacagccugaaggacccggaggucaacgaguuccggcgcaagaugcggaaguucuccgaggagaagauccucagccuggugggccuguccuggauggacuggcucaagcagaccuacccgcccgagcacgagcccagcauccccgagaaccuggaggacaagcuguacggcgggaagcucaucguggcgguccacuucgagaacugccaggacguguucuccuuccaggugagccccaacaugaaccccaucaaggucaacgagcuggccauccagaagcgccugacgauccacggcaaggaggacgaggugucccccuacgacuacgugcuccaggucagcgggcggguggaguacguguucggcgaccacccgcugauccaguuccaguacauccgcaacugcgucaugaaccgggcccugccccacuucauccucguggagugcugcaagaucaagaagauguacgagcaggagaugaucgccaucgaggcggccaucaaccgcaacuccagcaaccugccccugccccucccgcccaagaagacccggaucaucucccacgugugggagaacaacaaccccuuccagaucguccuggugaaggggaacaagcugaacaccgaggagaccgucaaggugcacgugcgcgccggccucuuccacggcacggagcugcugugcaagaccaucgucagcagcgagguguccgggaagaacgaccacaucuggaacgagccccucgaguucgacaucaacaucugcgaccugccgcggauggcccgccugugcuucgccguguacgcgguccucgacaaggugaagaccaagaaguccaccaagacgaucaaccccagcaaguaccagaccauccggaaggccggcaaggugcacuaccccgucgccugggugaacaccaugguguucgacuucaaggggcagcugcgcaccggcgacaucauccugcacagcugguccagcuuccccgacgagcucgaggagaugcugaacccgaugggcacgguccagaccaaccccuacaccgagaacgccaccgcccugcacgugaaguuccccgagaacaagaagcagccguacuacuacccgcccuucgacaagaucaucgagaaggcggccgagaucgccuccagcgacuccgccaacgugagcucccgcgggggcaagaaguuccuccccguccugaaggagauccuggaccgggacccccucagccagcugugcgagaacgagauggaccugaucuggacgcugcggcaggacugccgcgagaucuucccccagucccuccccaagcugcugcucagcaucaaguggaacaagcuggaggacguggcccagcugcaggcgcuccugcagaucuggcccaagcugccgccccgcgaggcccucgagcugcuggacuucaacuaccccgaccaguacgugcgggaguacgccgucgggugccuccgccagauguccgacgaggagcugagccaguaccugcuccagcugguccaggugcugaaguacgagcccuuccucgacugcgcccugucccgguuccugcucgagcgcgcccugggcaaccggcgcaucgggcaguuccuguucuggcaccuccggagcgaggugcacaucccggcgguguccgugcaguucggcgucauccuggaggccuacugccgcggcagcguggggcacaugaaggugcugagcaagcaggucgaggcccucaacaagcugaagacccugaacucccucaucaagcugaacgccgugaagcugaaccgggcgaagggcaaggaggccaugcacacgugccucaagcagagcgccuaccgcgaggcccuguccgaccugcagagcccccucaaccccugcgugauccuguccgagcuguacgucgagaagugcaaguacauggacagcaagaugaagccccucuggcugguguacaacaacaagguguucggggaggacuccgucggcgugaucuucaagaacggggacgaccugcggcaggacaugcucacccugcagaugcugcgccucauggaccugcuguggaaggaggccggccucgaccugcggaugcugccguacggcugccucgcgacgggggaccgcagcggccugaucgagguggucuccaccagcgagaccaucgccgacauccagcugaacuccagcaacguggccgccgccgcggccuucaacaaggacgcccuccugaacuggcugaaggaguacaacuccggggacgaccucgaccgggccaucgaggaguucacccugagcugcgccggcuacugcguggcguccuacguccuggggaucggcgaccgccacagcgacaacaucauggugaagaagacgggccagcuguuccacaucgacuucgggcacauccucggcaacuucaaguccaaguucgggaucaagcgggagcgcgugcccuucauccugaccuacgacuucauccacgucauccagcagggcaagaccggcaacaccgagaaguucgggcgguuccgccagugcugcgaggacgccuaccucauccugcgccggcacggcaaccuguucaucacccucuucgcccugaugcugaccgccgggcuccccgagcugaccagcgugaaggacauccaguaccugaaggacagccucgcgcugggcaaguccgaggaggaggcccugaagcaguucaagcagaaguucgacgaggcccuccgcgagagcuggaccacgaaggugaacuggauggcccacaccguccggaaggacuaccgcuccuga

SEQ ID NO: 34594 - RNA, 2487 nt, Artificial Sequence
  derived and/or modified sequence opt1 from PIK3CD__Homo_sapiens__XP_011539885
auggccugcgcccugcgcaagaaggcgaccguguuccggcagccccucgucgagcagccggaggacuacacccuccaggugaacggccgccacgaguaccuguacgggagcuacccccugugccaguuccaguacaucugcuccugccugcacagcggccugacgccccaccucaccauggugcacuccagcuccauccuggccaugcgggacgagcagagcaaccccgccccgcagguccagaagccccgcgccaagcccccgcccauccccgccaagaagcccuccagcgugucccuguggagccucgagcagcccuuccggaucgagcugauccagggguccaaggugaacgcggacgagcgcaugaagcuggucgugcaggccggccucuuccacgggaacgagaugcugugcaagaccgugagcuccagcgaggucuccgugugcagcgagccgguguggaagcagcggcuggaguucgacaucaacaucugcgaccucccccgcauggcccggcugugcuucgcccuguacgcggucaucgagaaggccaagaaggcccgcuccaccaagaagaaguccaagaaggccgacugccccaucgccugggcgaaccucaugcuguucgacuacaaggaccagcugaagacgggcgagcggugccucuacauguggcccagcgugccggacgagaagggcgagcugcugaaccccaccgggaccgugcgcagcaaccccaacaccgacagcgccgccgcccuccugaucugccugcccgaggucgccccgcaccccguguacuaccccgcgcucgagaagauccuggagcugggccggcacuccgagugcgugcacgucacggaggaggagcagcuccagcugcgcgagauccuggagcggcgcgggagcggcgagcucuacgagcacgagaaggaccugguguggaagcugcggcacgaggugcaggagcacuuccccgaggcccucgcccgccugcugcucgucaccaaguggaacaagcacgaggacguggcccagaugcuguaccugcucugcuccuggccggagcugcccgugcugagcgcccucgagcugcuggacuucuccuuccccgacugccacgucgggagcuucgcgaucaagucccuccggaagcugaccgacgacgagcuguuccaguaccugcuccagcuggugcagguccugaaguacgagagcuaccucgacugcgagcugaccaaguuccugcucgaccgcgcccuggccaaccggaagaucggccacuuccuguucuggcaccuccgcuccgagaugcacgugcccagcguggcccugcgcuucggccugauccucgaggccuacugccggggguccacgcaccacaugaagguccugaugaagcagggcgaggcgcugagcaagcucaaggcccugaacgacuucgugaagcuguccagccagaagaccccgaagccccagaccaaggagcucaugcaccugugcaugcgccaggaggccuaccuggaggcccucucccaccuccagagcccccuggacccguccacccugcuggcggaggugugcgucgagcagugcacguucauggacagcaagaugaagccccuguggaucauguacuccaacgaggaggccgggagcggcggcagcguggggaucaucuucaagaacggcgacgaccuccggcaggacaugcugacccugcagaugauccagcucauggacgugcuguggaagcaggaggggcuggaccuccgcaugacccccuacggcugccugcccaccggggaccggacgggccugaucgaggucgugcuccgcuccgacaccaucgccaacauccagcugaacaagagcaacauggccgccaccgcggccuucaacaaggacgcccugcucaacuggcugaaguccaagaacccgggcgaggcccuggaccgggccaucgaggaguucacccucagcugcgcgggguacugcguggccacguacguccugggcaucggggaccgccacuccgacaacaucaugauccgggagagcggccagcuguuccacaucgacuucgggcacuuccucggcaacuucaagaccaaguucggcaucaaccgcgagcgggugcccuucauccugaccuacgacuucgugcacgucauccagcaggggaagaccaacaacuccgagaaguucgagcgcuuccggggcuacugcgagcgcgccuacacgauccugcggcgccacgggcuccuguuccugcaccucuucgcccugaugcgggccgcgggccugcccgagcucagcugcuccaaggacauccaguaccugaaggacagccuggcccucgggaagaccgaggaggaggcccugaagcacuuccgcgugaaguucaacgaggcccugcgggaguccuggaagaccaaggugaacuggcucgcgcacaacgucagcaaggacaaccgccaguga

SEQ ID NO: 34595 - RNA, 3309 nt, Artificial Sequence
  derived and/or modified sequence opt1 from PIK3CG__Homo_sapiens__NP_001269355
auggagcuggagaacuacaagcagcccgugguccuccgcgaggacaacugccggcgccggcgccggaugaagccgcgcagcgccgccgcgucccugagcuccauggagcugauccccaucgaguucgugcuccccaccagccagcggaagugcaagucccccgagaccgcccugcugcacguggccggccacgggaacgucgagcagaugaaggcccagguguggcuccgcgcccuggagacgagcguggcggccgacuucuaccaccggcugggcccgcaccacuuccuccugcuguaccagaagaaggggcagugguacgagaucuacgacaaguaccaggucgugcagacccucgacugccugcgcuacuggaaggccacccaccggucccccggccagauccaccuggugcagcgccacccgcccagcgaggagucccaggccuuccagcggcagcucaccgcgcugaucggguacgacgucacggacgugagcaacgugcacgacgacgagcuggaguucacccgccggggccucgucacgccccgcauggccgagguggccucccgggaccccaagcuguacgccaugcaccccugggugaccagcaagccccugccggaguaccucuggaagaagaucgccaacaacugcaucuucaucgucauccaccgcuccaccaccagccagaccaucaaggugucccccgacgacacccccggcgcgauccugcagagcuucuucacgaagauggccaagaagaagucccugauggacauccccgagagccaguccgagcaggacuucgugcuccgggucugcgggcgcgacgaguaccuggugggcgagaccccgaucaagaacuuccagugggugcggcacugccugaagaacggggaggagauccacgucgugcucgacaccccgcccgaccccgcccuggacgaggugcgcaaggaggaguggccccuggucgacgacugcaccggcgugacgggguaccacgagcagcucaccauccacggcaaggaccacgagagcgucuucaccgugagccugugggacugcgaccgcaaguuccgggugaagauccgcggcaucgacauccccguccugccccggaacaccgaccucacgguguucguggaggccaacauccagcacgggcagcagguccugugccagcgccggaccucccccaagccguucaccgaggaggugcuguggaacguguggcucgaguucagcaucaagaucaaggaccugcccaagggcgcccugcucaaccugcagaucuacugcgggaaggcgcccgcccuguccagcaaggccuccgccgagagccccuccagcgaguccaagggcaagguccagcuccuguacuacgugaaccugcuccugaucgaccaccgcuuccugcuccggcgcggcgaguacgugcugcacauguggcagaucagcgggaagggcgaggaccagggguccuucaacgccgacaagcugaccagcgcgacgaacccggacaaggagaacuccaugagcaucuccauccugcucgacaacuacugccaccccaucgcccugcccaagcaccagccgacccccgaccccgagggcgaccggguccgcgccgagaugcccaaccagcugcggaagcagcucgaggccaucaucgccaccgacccgcugaacccccugaccgcggaggacaaggagcuccuguggcacuuccgcuacgagagccugaagcaccccaaggccuaccccaagcuguucuccagcgugaagugggggcagcaggagaucguggccaagacguaccagcuccuggcccggcgcgaggucugggaccaguccgcgcucgacgugggccugaccaugcagcugcucgacugcaacuucagcgacgagaacgugcgggccaucgccguccagaagcuggagagccuggaggacgacgacgugcuccacuaccugcugcagcucgugcaggccgucaaguucgagccguaccacgacuccgcccuggcgcgcuuccugcucaagcggggccugcgcaacaagcggaucgggcacuuccuguucugguuccuccgcagcgagaucgcccagucccgccacuaccagcagcgguucgccgugauccuggaggccuaccugcgcggcugcgggaccgccaugcuccacgacuucacccagcagguccaggugaucgagaugcugcagaaggugacgcuggacaucaagagccucuccgcggagaaguacgacgugagcucccaggucaucagccagcugaagcagaagcuggagaaccuccagaacucccagcugcccgagagcuuccgggugcccuacgaccccggccugaaggccggggcccucgccaucgagaagugcaaggugauggccuccaagaagaagccgcuguggcuggaguucaagugcgcggaccccaccgcccucagcaacgagaccaucggcaucaucuucaagcacggcgacgaccugcgccaggacaugcugauccuccagauccugcggaucauggaguccaucugggagaccgagagccuggaccucugccugcugcccuacgggugcaucuccacgggcgacaagaucgggaugaucgagaucgucaaggacgccaccaccaucgccaagauccagcagagcaccgugggcaacaccggggcguucaaggacgaggugcucaaccacuggcugaaggagaagucccccacggaggagaaguuccaggccgccgucgagcgcuucguguacagcugcgccggcuacugcguggccaccuucguccugggcaucggggaccggcacaacgacaacaucaugaucaccgagaccggcaaccucuuccacaucgacuucgggcacauccugggcaacuacaagagcuuccugggcaucaacaaggagcgcgugccguucgugcucacgcccgacuuccuguucgucauggggaccuccggcaagaagaccagcccccacuuccagaaguuccaggacaucugcgugaaggcguaccuggcccuccggcaccacaccaaccugcugaucauccucuucuccaugaugcugaugacggggaugccccagcugaccagcaaggaggacaucgaguacauccgcgacgcccucaccgugggcaagaacgaggaggacgccaagaaguacuuccuggaccagaucgaggucugccgggacaagggguggaccgugcaguucaacugguuccugcaccucgugcugggcaucaagcagggcgagaagcacuccgccuga

SEQ ID NO: 34596 - RNA, 522 nt, Artificial Sequence
  derived and/or modified sequence opt1 from PIK3IP1__Homo_sapiens__NP_001129383
augcugcuggccugggugcaggccuuccuggucagcaacaugcugcucgcggaggccuacggcuccgggggcugcuucugggacaacgggcaccuguaccgcgaggaccagaccagccccgccccgggccugcggugccucaacuggcuggacgcccaguccgggcuggccagcgcgcccguguccggcgccggcaaccacagcuacugccgcaaccccgacgaggacccccgggggccguggugcuacguguccggcgaggccgggguccccgagaagcgccccugcgaggaccuccggugccccgagaccacgagccaggcccugccggcguucaccaccgagauccaggaggccuccgagggccccggggccgacgagguccagguguucgcccccgccaacgcgcugcccgcccgcagcgaggccgccgccgugcagccggugaucggcaucucccagcgggugcgcaugaacagcaaggagaagaaggaccucggcacccucgggggccggaucuga

SEQ ID NO: 34597 - RNA, 1086 nt, Artificial Sequence
  derived and/or modified sequence opt1 from PIK3R1__Homo_sapiens__NP_001229395
augcacggcgacuacacccugacccuccgcaagggcgggaacaacaagcugaucaagaucuuccaccgggacgggaaguacggcuucagcgacccccugacguucuccagcguggucgagcucaucaaccacuaccgcaacgagucccuggcccaguacaacccgaagcuggacgugaagcuccuguaccccgugagcaaguaccagcaggaccaggucgugaaggaggacaacaucgaggccguggggaagaagcugcacgaguacaacacccaguuccaggagaagucccgggaguacgaccgccucuacgaggaguacacccggaccagccaggagauccagaugaagcgcacggcgaucgaggccuucaacgagaccaucaagaucuucgaggagcagugccagacccaggagcgguacuccaaggaguacaucgagaaguucaagcgcgagggcaacgagaaggagauccagcggaucaugcacaacuacgacaagcucaagagccgcaucuccgagaucaucgacagccggcgccggcuggaggaggaccugaagaagcaggccgccgaguaccgcgagaucgacaagcggaugaacuccaucaagcccgaccugauccagcugcgcaagacccgggaccaguaccucauguggcugacgcagaagggcguccgccagaagaagcugaacgaguggcucgggaacgagaacaccgaggaccaguacagccugguggaggacgacgaggaccugccccaccacgacgagaagaccuggaacgugggcuccagcaaccggaacaaggccgagaaccuccugcgcgggaagcgggacggcaccuuccugguccgcgaguccagcaagcaggggugcuacgcgugcuccgugguggucgacggcgaggugaagcacugcgugaucaacaagacggccaccggcuacggguucgccgagccguacaaccucuacagcucccugaaggagcugguccuccacuaccagcacaccagccuggugcagcacaacgacagccugaacgugacccucgccuaccccgucuacgcgcagcagcgccgguga

SEQ ID NO: 34598 - RNA, 2187 nt, Artificial Sequence
  derived and/or modified sequence opt1 from PIK3R2__Homo_sapiens__NP_005018
auggccggccccgagggguuccaguaccgcgcccuguacccguuccggcgcgagcggcccgaggaccucgagcugcugcccggcgacgugcucgucgugagccgcgcggcccugcaggcccuggggguggccgagggcggggagcggugcccccaguccgucggcuggaugccgggccucaacgagcgcacccggcagcgcggggacuuccccggcaccuacguggaguuccuggggcccguggcccuggcgcggcccggcccgcgcccccgggggccccgcccccucccggcccggccccgcgacggcgcccccgagcccggccugacgcugccggaccuccccgagcaguucagcccccccgacgucgccccgccccugcuggugaagcucguggaggcgaucgagcggaccgggcuggacuccgagagccacuaccgccccgagcugcccgccccgcggaccgacuggucccucagcgacgucgaccagugggacaccgccgcccuggccgacggcaucaaguccuuccugcucgcgcugcccgccccccuggugacgcccgaggccagcgccgaggcccgccgggcgcuccgcgaggccgccgggccggugggccccgcccuggagcccccgacccugccccuccaccgggcccugacccugcgcuuccuccugcagcaccugggccgcgucgcgcggcgcgcccccgcccucgggcccgccgugcgggcccugggcgcgaccuucgggccgcugcuccugcgcgcccccccccccccguccagccccccccccggcggggccccggacggcuccgagcccagccccgacuuccccgcccugcucguggagaagcugcugcaggagcaccucgaggagcaggaggucgcgccgcccgcccugccccccaagccgcccaaggccaagcccgcccccacggugcuggccaacggcggguccccgcccagccuccaggacgcggagugguacuggggcgacaucucccgggaggaggugaacgagaagcugcgcgacacccccgacgggaccuuccugguccgggacgccagcuccaagauccagggcgaguacacccucacgcugcgcaaggggggcaacaacaagcugaucaagguguuccaccgggacggccacuacggguucagcgagccgcugaccuucugcuccguggucgaccucaucaaccacuaccgccacgagagccuggcccaguacaacgccaagcuggacacccggcuccuguaccccgugagcaaguaccagcaggaccagaucgugaaggaggacuccgucgaggccgugggcgcgcagcugaaggucuaccaccagcaguaccaggacaagagccgcgaguacgaccagcucuacgaggaguacacccggacgucccaggagcugcagaugaagcgcaccgccaucgaggccuucaacgagaccaucaagaucuucgaggagcaggggcagacccaggagaagugcagcaaggaguaccuggagcgguuccgccgggagggcaacgagaaggagaugcagcgcauccuccugaacuccgagcggcugaagagccgcaucgccgagauccacgagucccgcacgaagcucgagcagcagcugcgggcccaggcgagcgacaaccgcgagaucgacaagcggaugaacucccugaagcccgaccucaugcagcugcgcaagauccgggaccaguaccugguguggcucacccagaagggggcccgccagaagaagaucaacgaguggcugggcaucaagaacgagaccgaggaccaguacgcccugauggaggacgaggacgaccucccccaccacgaggagcggaccugguacgugggcaagaucaaccgcacgcaggccgaggagaugcugagcgggaagcgggacggcaccuuccugauccgcgaguccagccagcgggggugcuacgcgugcuccgucgugguggacggcgacaccaagcacugcgucaucuaccgcaccgccacgggcuucggguucgccgagccguacaaccucuacggcagccugaaggagcuggugcuccacuaccagcacgccucccuggugcagcacaacgacgcccugaccgucacccucgcgcaccccgugcgggcccccgggcccggcccgccccccgccgcccgcuga

SEQ ID NO: 34599 - RNA, 1524 nt, Artificial Sequence
  derived and/or modified sequence opt1 from PIK3R3__Homo_sapiens__NP_001290356
augggccccagccgccuggugcgggggccgcgcccccagggcaugcggucccccuaccgccggcccgggaugggcuggccgcgcccccgguucccccgcauguucaagugcagccggcgccgguaccagcaggggcuccgcggccggaccgccuccagcgccgcgaucaaccccgccacccgcgccaugggcaucaacaacacgcacaccgacaccaccaucgucuggaucuucccgccccaggcccugccgcccaagccgcccaagcccaugacguccgccgugcccaacgggaugaaggacagcuccgugagccugcaggacgcggagugguacuggggcgacaucucccgggaggaggucaacgacaagcuccgcgacaugcccgacgggaccuuccuggugcgggacgccagcaccaagaugcagggcgacuacacccugacgcuccgcaagggcgggaacaacaagcugaucaagaucuaccaccgggacggcaaguacggguucuccgacccccugaccuucaacagcguggucgagcucaucaaccacuaccaccacgagucccuggcccaguacaaccccaagcuggacgugaagcucauguaccccgugagccgcuaccagcaggaccagcuggucaaggaggacaacaucgacgccgugggcaagaagcugcaggaguaccacucccaguaccaggagaaguccaaggaguacgaccggcucuacgaggaguacacccgcaccagccaggagauccagaugaagcgcacggcgaucgaggccuucaacgagaccaucaagaucuucgaggagcagugccacacccaggagcagcacagcaaggaguacaucgagcgguuccgccgggaggggaacgagaaggagaucgagcgcaucaugaugaacuacgacaagcugaagucccggcugggcgagauccacgacagcaagaugcgccucgagcaggaccugaagaaccaggcccuggacaaccgggagaucgacaagaagaugaacagcaucaagccggaccucauccagcugcgcaagauccgggaccagcaccugguguggcucaaccacaagggcguccgccagaagcggcugaacguguggcuggggaucaagaacgaggacgccgacgagaacuacuucaucaacgaggaggacgagaaccucccccacuacgacgagaagaccugguucguggaggacaucaaccgcguccaggccgaggaccugcuguacggcaagcccgacggggcguuccucauccgggaguccagcaagaagggcugcuacgccugcuccgugguggccgacggggaggucaagcacugcgugaucuacagcacggcccgcggcuacggcuucgccgagcccuacaaccuguacuccagccugaaggagcucgugcugcacuaccagcagaccucccugguccagcacaacgacagccucaacgugcggcuggcguacccggugcacgcccagaugcccucccugugccgcuga

SEQ ID NO: 34600 - RNA, 4077 nt, Artificial Sequence
  derived and/or modified sequence opt1 from PIK3R4__Homo_sapiens__NP_055417
augggcaaccagcuggccgggaucgcccccagccagauccucuccguggagagcuacuucuccgacauccacgacuucgaguacgacaagagccugggcuccacccgcuucuucaaggucgcgcgggccaagcaccgcgaggggcuggugguggucaagguguucgccauccaggacccgacccucccccugacgagcuacaagcaggagcuggaggagcucaagauccggcugaacuccgcccagaacugccugcccuuccagaaggccagcgagaaggcguccgagaaggccgccaugcucuuccgccaguacgugcgggacaaccuguacgaccgcaucagcacccggcccuuccugaacaacaucgagaagcgcuggaucgccuuccagauccucaccgcggucgaccaggcccacaaguccggcgugcggcacggggacaucaagaccgagaacgugauggucacgagcuggaacugggugcugcugaccgacuucgccuccuucaagccgaccuaccuccccgaggacaaccccgccgacuucaacuacuucuucgacaccagccgccggcgcacgugcuacaucgcccccgagcgguucguggacggcggcauguucgcgaccgagcuggaguacaugcgcgacccguccaccccccuggucgaccucaacagcaaccagcggacccgcggggagcugaagcgggccauggacaucuucuccgccggcugcgugaucgccgagcuguucacggagggggugccccucuucgaccugagccagcugcucgccuaccgcaacggccacuucuuccccgagcagguccugaacaagaucgaggaccacuccauccgggagcuggugacccagaugauccaccgcgagccggacaagcggcucgaggcggaggacuaccugaagcagcagcgcgggaacgccuuccccgagaucuucuacaccuuccugcagcccuacauggcccaguucgccaaggagaccuuccucagcgccgacgagcgcauccuggugauccggaaggaccugggcaacaucauccacaaccucugcggccacgaccugcccgagaaggcggagggggagccgaaggagaacggccuggucauccucgugagcgugaucacguccugccugcagacccugaaguacugcgacagcaagcucgccgcccuggagcugauccuccaccuggccccccgccuguccgucgagauccuccuggaccggaucacccccuaccugcuccacuucagcaacgacuccgugccccgcgugcgggccgaggcgcugcgcacccugacgaagguccuggcccucgugaaggaggucccgcggaacgacaucaacaucuaccccgaguacauccugcccgggaucgcccaccuggcccaggacgacgcgaccaucgugcgccucgccuacgccgagaacaucgcccugcuggccgagaccgcgcuccgguuccuggagcuggugcagcucaagaaccugaacauggagaacgaccccaacaacgaggagaucgacgaggucacccacccgaacggcaacuacgacacggagcugcaggcccuccacgagauggugcagcagaagguggucacccugcugagcgaccccgagaacaucgugaagcagacccucauggagaacggcaucacccgccugugcguguucuucgggcggcagaaggccaacgacguccugcucucccacaugaucacguuccugaacgacaagaacgacuggcaccugcgcggcgccuucuucgacagcaucguggggguggccgcguacgucggcuggcaguccagcuccauccucaagccccugcugcagcaggggcucagcgacgccgaggaguucgugaucgugaaggcccuguacgcccugaccugcaugugccagcucggccugcugcagaagccccacgucuacgaguucgccuccgacaucgcgccguuccucugccaccccaaccuguggauccgguacggcgccgugggguucaucaccguggucgcccgccagaucagcaccgccgacguguacugcaagcugaugcccuaccucgacccguacaucacgcagcccaucauccagaucgagcggaagcuggugcugcucuccguccugaaggagcccgugagccgcuccaucuucgacuacgcgcugcggagcaaggacaucaccucccucuuccgccaccugcacaugcggcagaagaagcgcaacggcagccugcccgacugcccgccccccgaggaccccgccaucgcccagcuccugaagaagcugcucagccaggggaugaccgaggaggaggaggacaagcugcuggcccucaaggacuucaugaugaaguccaacaaggccaaggcgaacaucguggaccagagccaccugcacgacuccagccagaagggcgucaucgaccuggccgcccucgggaucaccggccgccagguggaccuggugaagacgaagcaggagccggacgacaagcgggcccgcaagcacgucaagcaggacuccaacgugaacgaggaguggaagagcauguucggcucccuggacccccccaacaugccccaggcccucccgaaggggagcgaccaggaggugauccagaccggcaagcccccccgguccgagagcuccgcggggaucugcgucccccugagcaccuccagccaggugccggaggugaccaccguccagaacaagaagcccgugauccccgugcuguccagcacgauccuccccuccaccuaccagauccgcaucaccaccugcaagacggagcugcagcagcugauccagcagaagcgggagcagugcaacgccgagcgcaucgccaagcagaugauggagaacgccgagugggagagcaagccgcccccccccggcuggcggccgaaggggcuccuggucgcccaccugcacgagcacaagagcgcggugaaccgcauccggguguccgacgagcacagccucuucgccaccugcuccaacgacggcaccgucaagaucuggaacagccagaagauggagggcaagaccacgaccacccgcuccauccugaccuacagccggaucgggggccgcgugaagacgcugaccuucugccaggggucccacuaccucgccaucgccagcgacaacggcgcggugcagcugcugggcaucgaggccuccaagcuccccaagagccccaagauccacccgcugcagucccggauccuggaccagaaggaggacgggugcgucguggacaugcaccacuucaacagcggcgcccaguccgugcucgccuacgccaccgucaacgggagccuggugggcugggaccugcgcuccagcuccaacgcguggacccucaagcacgaccugaagagcgggcugaucacguccuucgccguggacauccaccagugcuggcucugcaucggcaccagcagcggcaccauggccugcugggacaugcgguuccagcugcccaucuccagccacugccaccccucccgcgcccggauccgccggcugagcaugcacccccucuaccaguccugggucaucgccgcggugcaggggaacaacgaggugagcaugugggacauggagaccggcgaccgccgguucacgcugugggccuccagcgccccgccccuguccgagcuccagcccagcccccacuccguccacgggaucuacugcagcccggccgacggcaaccccauccugcugaccgccggguccgacaugaagauccgcuucugggaccucgcguaccccgagcgcagcuacguggucgccggcuccaccagcucccccagcguguccuacuaccggaagaucaucgagggcaccgaggugguccaggagauccagaacaagcagaagguggggccgagcgacgacacgccccgccggggccccgagagccugcccguggggcaccacgacaucaucaccgacgucgccaccuuccagaccacgcagggcuucaucgugaccgccucccgcgacgggaucgugaaggucuggaaguga

SEQ ID NO: 34601 - RNA, 2643 nt, Artificial Sequence
  derived and/or modified sequence opt1 from PIK3R5__Homo_sapiens__NP_055123
augcagcccggcgccacgaccugcacggaggaccgcauccagcacgcccuggagcggugccuccacgggcugagccugucccgccggagcaccuccuggagcgcgggccucugccugaacugcuggucccugcaggagcucgugagccgcgacccggggcacuuccugauccugcucgagcagauccugcagaagacccgggagguccaggagaagggcaccuacgaccugcucacgccccuggcccuccucuucuacuccaccgugcugugcacgccccacuucccgcccgacagcgaccugcuccugaaggccgccuccaccuaccaccgcuuccugaccuggcccgugcccuacugcagcaucugccaggagcuccugaccuucaucgacgccgagcugaaggcgcccgggaucuccuaccagcggcucguccgcgccgagcagggccugccgauccggagccaccgcuccagcaccgugaccgugcugcuccugaaccccgucgaggugcaggccgaguuccuggccguggcgaacaagcucuccacgcccggccacagcccccacuccgccuacaccacccugcugcuccacgccuuccaggccaccuucggggcccacugcgacgucccgggccugcacugccggcugcaggcgaagacgcucgccgagcuggaggacaucuucaccgagaccgccgaggcccaggagcuggccagcgggaucggcgacgcggccgaggcccgccgguggcuccgcaccaagcugcaggccgugggggagaaggccggcuuccccggcgugcuggacacggcgaagcccgggaagcuccacaccauccccaucccggucgcccggugcuacaccuacuccuggagccaggacagcuucgacauccugcaggagauccugcugaaggagcaggagcugcugcagcccggcauccucggggacgacgaggaggaggaggaggaggaggaggagguggaggaggaccuggagaccgacggccacugcgccgagcgcgacucccugcugagcaccuccagccucgccucccacgacagcacccugucccuggccagcucccaggcgagcggccccgcccucucccggcaccuccugaccagcuucguguccgggcugagcgacggcauggacuccggguacgucgaggacagcgaggaguccagcuccgaguggcccuggcgccggggcagccaggagcgccgggggcaccgccgcccgggccagaaguucauccggaucuacaagcuguucaagagcaccucccagcuggugcuccgccgggacagccgcucccuggagggcagcuccgacacggcccugccccuccggcgcgccgggagccugugcagcccccuggacgagcccguguccccgcccucccgggcgcagcgcagccggucccucccccagcccaagcugggcacccagcugccgagcuggcuccuggcccccgccucccgcccccagcggcgccggccguuccugagcggggacgaggaccccaaggccuccacccuccgcgucgugguguucggcagcgaccggaucuccgggaaggucgcccgcgcguacagcaaccugcggcgccuggagaacaaccggccccuccugacccgcuucuucaagcugcaguucuucuacgugcccgugaagcgcagccacggcacguccccgggcgccugcccgccgccccggagccagacccccuccccgcccaccgacagcccccgccacgccucccccggggagcucggcaccacgcccugggaggagagcaccaacgacaucucccacuaccuggggaugcuggaccccugguacgagcggaacguccucggccugaugcaccucccgcccgaggugcugugccagcagagccugaaggccgaggcccaggcgcuggaggggucccccacccagcuccccauccuggccgacaugcugcucuacuacugccgcuucgccgcccggcccguccugcuccagguguaccagaccgagcugaccuucaucacgggcgagaagaccaccgagaucuucauccacagccuggagcugggccacuccgccgcgacccgcgccaucaaggccagcgggcccggcuccaagcggcucgggaucgacggcgaccgcgaggccgugccccugacgcugcagaucaucuacagcaagggcgcgaucuccgggcggagccgcugguccaaccucgagaaggucugcaccagcgugaaccugaacaaggccugccggaagcaggaggagcuggacuccagcauggaggcccucacccugaaccugaccgagguggucaagcgccagaacagcaaguccaagaagggcuucaaccagaucagcacgucccagaucaagguggacaaggugcagaucaucgggagcaacuccugccccuucgccgucugccucgaccaggacgagcggaagauccugcagagcguggugcgcugcgaggucucccccugcuacaagccggagaaguccgaccugagcagcccgccccagaccccgcccgaccuccccgcccaggcggcccccgaccugugcucccugcucugccugcccaucaugaccuucagcggcgcccugcccuga

SEQ ID NO: 34602 - RNA, 1647 nt, Artificial Sequence
  derived and/or modified sequence opt1 from PIKFYVE__Homo_sapiens__NP_001171471
auggccaccgacgacaagaccagccccacgcuggacuccgccaacgaccucccgcgcagccccaccucccccagccaccugacccacuucaagccccugaccccggaccaggacgagccgcccuucaaguccgcguacagcuccuucgugaaccucuuccgguucaacaaggagcgcgccgagggcgggcagggcgagcagcagccccugagcggguccuggacgagcccccagcugcccucccggacccagagcguccgcucccccacccccuacaagaagcagcucaacgaggagcugcagcggcgcagcuccgcccuggacacccggcgcaaggccgagccgacguucggcgggcacgacccccggaccgccgugcagcuccgcagccuguccaccgugcugaagcggcucaaggagaucauggagggcaagagccaggacuccgaccugaagcaguacuggaugcccgacagccagugcaaggagugcuacgacugcagcgagaaguucaccacguuccgccggcgccaccacugccggcugugcggccagaucuucugcucccgcugcugcaaccaggagauccccgggaaguucaugggcuacaccggggaccuccgggcgugcaccuacugccgcaagaucgcccugagcuacgcccacuccaccgacagcaacuccaucggcgaggaccugaacgcccucagcgacuccgcgugcagcgucuccgugcuggacccgagcgagccccggacgcccguggggucccgcaaggccagccggaacaucuuccuggaggacgaccucgccuggcagucccugauccaccccgacagcuccaacaccccgcugagcacccgccucgucuccgugcaggaggacgccggcaagagccccgcccgcaaccgguccgcgagcaucaccaaccugagccuggaccgcuccggcagccccauggugcccuccuacgagacgagcgucuccccgcaggccaaccggaccuacgugcgcaccgagaccacggaggacgagcggaagauccuccuggacagcgugcagcugaaggaccucuggaagaagaucugccaccacuccagcgggauggaguuccaggaccaccgcuacuggcugcggacccaccccaacugcaucgucggcaaggagcuggugaacuggcucauccgcaacgggcacaucgccacccgggcccaggccaucgcgaucggccaggccaugguggacggccgcuggcuggacugcgucucccaccacgaccagcuguuccgggacgaguacgcccucuaccgcccccugcagagcaccgaguucuccgagacgcccagcccggacuccgacagcgugaacuccguggaggggcacagcgagcccuccugguucaaggacaucaaguucgacgacagcgacaccgagcagaucgccgaggagggcgacgacaaccuggccaacagcgcgucccccagcaagcggaccuccgucagcuccuuccagagcaccguggacuccgacagcgccgccuccaucagccucaacguggagcuggacaacgucaacuuccacaucaagaagccguccaaguacccccacgugccgccccaccccgccgaccagaaggggcgccgguga

SEQ ID NO: 34603 - RNA, 912 nt, Artificial Sequence
  derived and/or modified sequence opt1 from PILRA__Homo_sapiens__NP_038467
augggccgcccccugcuccugccccugcucccccugcugcucccgcccgccuuccugcagcccagcggguccaccggcagcgggcccuccuaccuguacggcgugacccagcccaagcaccucagcgccuccaugggcgggagcgucgagauccccuucuccuucuacuacccgugggagcuggccacggcccccgacgugcggaucagcuggcgccggggccacuuccaccgccaguccuucuacagcacccggccgcccuccauccacaaggacuacgugaaccgccuguuccucaacuggaccgaggggcagaaguccggcuuccugcggaucuccaaccugcagaagcaggaccagagcgucuacuucugccgcguggagcucgacacccgguccagcgggcgccagcaguggcaguccaucgagggcacgaagcugagcaucacccaggccgugaccaccacgacccagcggcccuccagcaugaccaccacguggcgccugagcuccaccaccaccacgaccgggcuccgggucacccagggcaagcgccggagcgacuccuggcacaucagccuggagaccgccgugggcguggccgucgcggugacggugcuggggaucaugauccucggccugaucugccugcuccgcuggcggcgccggaaggggcagcagcgcaccaaggccaccacccccgcccgggagcccuuccagaacacggaggagcccuacgagaacauccgcaacgagggccagaacaccgacccgaagcugaaccccaaggacgacggcaucgucuacgccucccuggcgcucagcuccagcaccagcccccgcgcgcccccgagccaccggccccugaaguccccgcagaacgagacccuguacagcgugcucaaggccuga

SEQ ID NO: 34604 - RNA, 1215 nt, Artificial Sequence
  derived and/or modified sequence opt1 from PIM1__Homo_sapiens__NP_001230115
augccccacgagccgcacgagccccugaccccgcccuucagcgcccugcccgaccccgccggcgcgcccucccgccggcagagccgccagcggccccagcuguccagcgacuccccgagcgccuuccgcgccucccggagccacucccgcaacgccacccggagccacucccacagccacagcccccgccacucccugcggcacucccccgggagcggcuccugcgggagcuccagcggccaccgccccugcgccgacauccucgagguggggaugcugcugagcaagaucaacucccucgcgcaccuccgggccgccccgugcaacgaccugcacgccacgaagcuggcgcccggcaaggagaaggagccccuggagagccaguaccaggucggcccccugcucggguccggcggguucggcagcguguacuccgggauccgcgugagcgacaaccugccggucgccaucaagcacguggagaaggaccggaucuccgacuggggcgagcugcccaacggcacccgcgugcccauggaggucgugcuccugaagaaggugagcuccggguucagcggcgucauccggcugcucgacugguucgagcgccccgacuccuucgugcugauccuggagcggccggagcccgugcaggaccucuucgacuucaucaccgagcgcggggcccugcaggaggagcuggcccggagcuucuucuggcagguccucgaggccgugcgccacugccacaacugcggcgugcugcaccgggacaucaaggacgagaacauccugaucgaccucaaccgcggcgagcugaagcugaucgacuucggguccggcgcgcuccugaaggacaccgucuacacggacuucgacgggacccgcguguacagcccgcccgaguggauccgguaccaccgcuaccacggccgguccgccgccguguggagccuggggauccuccuguacgacauggucugcggcgacauccccuucgagcacgacgaggagaucauccgcggccagguguucuuccggcagcgcguguccagcgagugccagcaccugauccgguggugccucgcccugcgccccuccgaccggcccaccuucgaggagauccagaaccaccccuggaugcaggacguccugcucccgcaggagaccgccgagauccaccuccacagccugagccccgggcccuccaaguga

SEQ ID NO: 34605 - RNA, 936 nt, Artificial Sequence
  derived and/or modified sequence opt1 from PIM2__Homo_sapiens__NP_006866
augcugaccaagccccuccagggcccgcccgccccgcccgggacccccacgcccccgcccggcgggaaggaccgcgaggccuucgaggccgaguaccggcugggcccccugcucgggaagggcggcuucgggaccguguucgccggccaccgccugaccgaccggcugcaggucgccaucaaggugaucccccgcaaccgggugcucggguggagcccccuguccgacagcgugaccugcccccuggagguggcccuccuguggaaggugggcgccgggggcggccacccgggggucauccgccugcucgacugguucgagacgcaggagggcuucaugcuggugcuggagcggccccuccccgcgcaggaccuguucgacuacaucaccgagaaggggccccugggcgagggcccgucccgcugcuucuucgggcaggucgucgccgccauccagcacugccacagccggggcguggugcaccgcgacaucaaggacgagaacauccucaucgaccugcggcgcgggugcgccaagcugaucgacuucggcuccggggcgcuccugcacgacgagcccuacaccgacuucgacggcacccgggucuacagcccgcccgaguggaucucccgccaccaguaccacgcccugcccgccacgguguggagccucggcauccugcuguacgacauggugugcggggacauccccuucgagcgggaccaggagauccucgaggccgagcugcacuuccccgcccacgucucccccgacugcugcgcgcugauccgccggugccucgccccgaagcccagcucccgccccagccuggaggagauccugcucgaccccuggaugcagaccccggccgaggacgugccccugaaccccuccaagggcgggccggcgccccuggccuggagccuccugcccuga

SEQ ID NO: 34606 - RNA, 981 nt, Artificial Sequence
  derived and/or modified sequence opt1 from PIM3__Homo_sapiens__NP_001001852
augcugcucagcaaguucggcucccuggcccaccugugcgggcccggcgggguggaccaccucccggucaagauccugcagcccgccaaggcggacaaggagagcuucgagaaggccuaccaggugggcgccgugcugggguccggcggcuucgggaccgucuacgccggcagccgcaucgccgacgggcuccccguggcggugaagcacgucgugaaggagcgggugaccgaguggggcucccucgggggcgccacggucccccuggagguggugcugcugcgcaaggucggcgccgccgggggcgcgcgcggggugauccggcugcucgacugguucgagcggccggacggcuuccugcuggugcucgagcgccccgagcccgcccaggaccuguucgacuucaucaccgagcggggcgcccuggacgagccccucgcccgccgguucuucgcccagguccuggcggccgugcgccacugccacagcugcggggugguccaccgggacaucaaggacgagaaccugcucguggaccugcgcuccggcgagcugaagcucaucgacuucgggagcggcgcccugcugaaggacaccguguacaccgacuucgacgggacgcgggucuacuccccgcccgaguggauccgcuaccaccgguaccacggccgcagcgccaccguguggucccucggcgugcugcuguacgacauggucugcggggacauccccuucgagcaggacgaggagauccuccggggccgccugcuguuccggcgccgggugagccccgagugccagcagcucauccgcuggugccugucccugcgcccgagcgagcggcccucccucgaccagaucgccgcgcaccccuggaugcugggggccgacggcgggguccccgagagcugcgaccugcgccucugcacccuggacccggacgacguggccuccaccacgagcuccagcgagagccuguga

SEQ ID NO: 34607 - RNA, 492 nt, Artificial Sequence
  derived and/or modified sequence opt1 from PIN1__Homo_sapiens__NP_006212
auggccgacgaggagaagcugcccccgggcugggagaagcgcaugagccgguccagcgggcgcguguacuacuucaaccacaucaccaacgccucccagugggagcggcccagcggcaacuccagcuccgggggcaagaacgggcagggcgagcccgcgcgcguccggugcagccaccuccuggugaagcacucccagagccgccggcccuccagcuggcgccaggagaagaucacccggacgaaggaggaggcccuggagcucaucaacggcuacauccagaagaucaaguccggggaggaggacuucgagagccuggccucccaguucagcgacugcuccagcgccaaggcccgcggcgaccugggggcguucucccggggccagaugcagaagccguucgaggacgccagcuucgcccuccgcaccggggagaugagcggccccguguucaccgacuccggcauccacaucauccugcggaccgaguga

SEQ ID NO: 34608 - RNA, 402 nt, Artificial Sequence
  derived and/or modified sequence opt1 from PIN4__Homo_sapiens__NP_001164218
augcccauggccggccugcucaaggggcuggugcgccagcuggagcgguucagcguccagcagcaggccuccaagaugccgcccaagggcaagagcggguccggcaaggcggggaagggcggcgccgccagcggguccgacagcgccgacaagaaggcccagggccccaagggcggcgggaacgcggugaaggugcgccacauccucugcgagaagcacgggaagaucauggaggccauggagaagcugaaguccggcaugcgguucaacgaggucgccgcccaguacagcgaggacaaggcgcgccaggggauccccucccugcagcagcacgccggccaccaccgggaccuccgcagcacccugaucucccuggugagcuaccuccagaccacgccguga

SEQ ID NO: 34609 - RNA, 525 nt, Artificial Sequence
  derived and/or modified sequence opt1 from PINX1__Homo_sapiens__NP_001271285
augagcaugcuggccgagcgccggcgcaagcagaagugggccguggacccccagaacaccgcgugguccaacgacgacagcaaguucggccagcggaugcucgagaagauggggugguccaagggcaaggggcugggcgcccaggagcagggggccaccgaccacaucaagguccaggugaagaacaaccaccugggccucggcgccacgaucaacaacgaggacaacuggaucgcccaccaggacgacuucaaccagcugcuggcggagcucaacacgugccacgggcaggagaccaccgacagcuccgacaagaaggagaagaaguccuucagccuggaggagaaguccaagaucagcaagaaccgcgugcacuacaugaaguucaccaagggccggugccagagccugcacucccgcggggagcggaaccacgacaaccagcgccuccaccacccgggcguccugugccaggccgacgggagcaccgaggagcaggcccccggcuccagcucccggguguga

SEQ ID NO: 34610 - RNA, 1221 nt, Artificial Sequence
  derived and/or modified sequence opt1 from PIP4K2A__Homo_sapiens__NP_005019
auggccacccccggcaaccuggggagcuccgugcucgccagcaagaccaagacgaagaagaagcacuucgucgcgcagaaggugaagcuguuccgcgccuccgacccgcugcucagcgugcugauguggggcgucaaccacuccaucaacgagcugagccacgugcagauccccgugaugcucaugcccgacgacuucaaggccuacuccaagaucaaggucgacaaccaccuguucaacaaggagaacaugcccagccacuucaaguucaaggaguacugcccgaugguguuccggaaccugcgcgagcgguucgggaucgacgaccaggacuuccagaacucccucacccgcagcgcgccccugcccaacgacucccaggcccggagcggcgcccgcuuccacaccuccuacgacaagcgguacaucaucaagaccaucacgagcgaggacguggccgagaugcacaacauccugaagaaguaccaccaguacaucgucgagugccacgggaucacccuccugccccaguuccugggcauguaccgccucaacguggacggcguggagaucuacgucaucgugacccggaacguguucucccaccgccugagcgucuaccggaaguacgaccugaagggguccaccguggcccgcgaggccagcgacaaggagaaggcgaaggagcucccgacgcugaaggacaacgacuucaucaacgagggccagaagaucuacaucgacgacaacaacaagaagguguuccuggagaagcucaagaaggacgucgaguuccuggcccagcugaagcucauggacuacucccugcugguggggauccacgacguggagcgggccgagcaggaggaggucgagugcgaggagaacgacggcgaggaggagggggagagcgacggcacccaccccgugggcaccccgcccgacagccccgggaacacccucaacuccagcccgccccuggcccccggcgaguucgaccccaacaucgacguguacgggaucaagugccacgagaacagcccccgcaaggaggucuacuucauggccaucaucgacauccugacgcacuacgacgcgaagaagaaggccgcccacgccgccaagaccgugaagcacggcgcgggcgccgagaucuccaccgucaaccccgagcaguacuccaagcgguuccucgacuucaucgggcacauccugaccuga

SEQ ID NO: 34611 - RNA, 1251 nt, Artificial Sequence
  derived and/or modified sequence opt1 from PIP4K2B__Homo_sapiens__NP_003550
augagcuccaacugcaccagcaccacggccguggccgucgcgccccuguccgccagcaagaccaagaccaagaagaagcacuucgugugccagaaggugaagcuguuccgcgccuccgagccgauccucagcguccugauguggggcgugaaccacaccaucaacgagcucuccaacgugcccguccccgugaugcugaugcccgacgacuucaaggccuacagcaagaucaagguggacaaccaccuguucaacaaggagaaccucccgucccgguucaaguucaaggaguacugccccauggucuuccgcaaccugcgggagcgcuucgggaucgacgaccaggacuaccagaacagcgugacgcgguccgcccccaucaacagcgacucccagggccgcugcgggacccgguuccugaccaccuacgaccgccgguucgugaucaagacggucagcuccgaggacguggcggagaugcacaacauccucaagaaguaccaccaguucaucguggagugccacggcaacacccugcugccccaguuccucgggauguaccgccugaccgucgacggcguggagaccuacaugguggucacgcggaacguguucagccaccgccugaccgugcaccggaaguacgaccucaagggcuccaccgucgcccgcgaggccagcgacaaggagaaggccaaggaccugccgaccuucaaggacaacgacuuccugaacgaggggcagaagcuccacgugggcgaggaguccaagaagaacuuccuggagaagcugaagcgggacguggaguuccucgcgcagcugaagaucauggacuacagccugcucgucgggauccacgacguggaccgcgccgagcaggaggagauggaggucgaggagcgggccgaggacgaggagugcgagaacgacggcgucgggggcaaccugcugugcagcuacggcacgccgcccgacucccccgggaaccuccugagcuucccccgcuucuucggccccggggaguucgaccccuccguggacguguacgccaugaagucccacgagagcagccccaagaaggagguguacuucauggccaucaucgacauccugaccccguacgacaccaagaagaaggcggcccacgccgccaagaccgugaagcacggcgccggcgcggagaucuccacggucaaccccgagcaguacagcaagcgguucaacgaguucauguccaacauccucaccuga

SEQ ID NO: 34612 - RNA, 1212 nt, Artificial Sequence
  derived and/or modified sequence opt1 from PIP4K2C__Homo_sapiens__NP_001139731
auggccagcuccagcgugcccccggccaccgucuccgcggccaccgccggccccgggcccggcuucggguucgccagcaagacgaagaagaagcacuucgugcagcagaaggugaaggucuuccgcgccgcggacccccuggugggcguguuccucuggggcgucgcccacuccaucaacgagcugagccaggugccgccgcccgugaugcugcuccccgacgacuucaaggccuccagcaagaucaaggaguacugcccccaggucuuccggaaccugcgcgaccgguucgggaucgacgaccaggacuaccuggugucccucacccgcaacccgcccagcgaguccgagggcagcgacgggcgguuccugaucuccuacgaccgcacccuggugaucaaggaggucagcuccgaggacaucgccgacaugcacagcaaccucuccaacuaccaccaguacaucgugaagugccacggcaacacccugcugccccaguuccucgggauguaccgggugagcgucgacaacgaggacuccuacaugcuggugaugcgcaacauguucagccaccggcugcccgugcaccgcaaguacgaccucaagggcagccuggucucccgggaggcgagcgacaaggagaaggugaaggagcugcccacgcucaaggacauggacuuccugaacaagaaccagaagguguacaucggggaggaggagaagaagaucuuccuggagaagcucaagcgcgacgucgaguuccuggugcagcugaagaucauggacuacucccuccugcugggcauccacgacaucauccggggcagcgagcccgaggaggaggcccccgugcgcgaggacgaguccgaggucgacggggacugcagccucaccggcccgcccgcccuggugggguccuacggcaccagccccgagggcaucgggggcuacauccacucccaccggccccuggggccgggcgaguucgagagcuucaucgacgucuacgccauccgcuccgccgagggggcgccccagaaggagguguacuucaugggccucaucgacauccugacccaguacgacgccaagaagaaggccgcccacgccgcgaagacggugaagcacggcgccggggccgagaucagcaccguccaccccgagcaguacgccaagcgguuccuggacuucaucaccaacaucuucgccuga

SEQ ID NO: 34613 - RNA, 1569 nt, Artificial Sequence
  derived and/or modified sequence opt1 from PIP5K1A__Homo_sapiens__NP_001129108
auggccagcgccuccagcggccccuccagcuccgugggguucagcuccuucgacccggcgguccccagcugcacccuguccagcgccgccuccggcaucaagcgccccauggccagcgaggugcccuacgccuccgggaugccgaucaagaagaucggccaccggagcguggacuccagcggggagaccacguacaagaagaccaccuccagcgcgcucaagggcgccauccagcugggcaucacccacacggucgggucccugagcaccaagcccgagcgcgacgugcucaugcaggacuucuacguggucgagagcaucuucuuccccuccgagggcagcaaccugacccccgcccaccacuacaacgacuuccgguucaagaccuacgccccgguggcguuccgcuacuuccgggagcuguucgggauccgccccgacgacuaccucuacucccugugcagcgagccccugaucgagcucugcuccagcggcgccuccgggagccuguucuacguguccagcgacgacgaguucaucaucaagacgguccagcacaaggaggccgaguuccugcagaagcuccugcccggcuacuacaugaaccugaaccagaacccgcggacccuccugcccaaguucuacggccuguacugcgugcaggccgggggcaagaacauccgcaucguggucaugaacaaccuccugccccgguccgugaagaugcacaucaaguacgaccugaaggggagcaccuacaagcgccgggccucccagaaggagcgcgagaagccccucccgaccuucaaggaccuggacuuccugcaggacauccccgacggccucuuccuggacgcggacauguacaacgcccugugcaagacgcuccagcgggacugccuggugcugcagagcuucaagaucauggacuacucccuccugaugagcauccacaacaucgaccacgcccagcgcgagccccuguccagcgagacccaguacuccgucgacacccggcgccccgccccgcagaaggcccucuacagcaccgcgauggagagcauccagggcgaggcccggcgcgggggcacgauggagaccgacgaccaguucgugaagaagcuggagcacuccuggaaggcccuggugcacgacggggacaccgucagcgugcaccggcccggcuucuacgccgagcgcuuccagcgguucaugugcaacaccguguucaagaagaucccccucaagcccuccccgagcaagaaguuccgcuccgggagcuccuucagccgccgggccggcuccagcggcaacuccugcaucacguaccagcccagcgucuccggggagcacaaggcccaggugaccaccaaggcggagguggagcccggcguccaccuggggcgccccgacgugcugccgcagaccccgccccucgaggagaucagcgagggcucccccauccccgaccccagcuucagcccccuggucggggagacgcugcagaugcucaccaccuccaccacgcuggagaagcuggagguggccgagagcgaguucacccacuga

SEQ ID NO: 34614 - RNA, 1509 nt, Artificial Sequence
  derived and/or modified sequence opt1 from PIP5K1B__Homo_sapiens__XP_006717364
augagcuccgccgccgagaacggcgaggcggcccccgggaagcagaacgaggagaagaccuacaagaagaccgccagcuccgccaucaagggcgccauccagcuggggaucggcuacacgguggggaaccucaccagcaagccggagcgcgacguccugaugcaggacuucuacgugguggaguccgucuuccugcccagcgagggcuccaaccucacccccgcgcaccacuaccccgacuuccgguucaagaccuacgccccgcuggccuuccgcuacuuccgggagcuguucggcaucaagcccgacgacuaccucuacagcaucugcuccgagccccugaucgagcugagcaaccccggggccuccggcagccucuucuucgugacguccgacgacgaguucaucaucaagaccgugcagcacaaggaggcggaguuccugcagaagcugcucccgggguacuacaugaaccugaaccagaacccccgcacccugcuccccaaguucuacggccuguacugcaugcagagcgggggcaucaacauccggaucgucgugaugaacaacgugcugccccgcuccaugcggaugcacuucaccuacgaccucaagggcagcacguacaagcgccgggccucccgcaaggagcgggagaaguccaacccgaccuucaaggaccuggacuuccugcaggacaugcacgaggggcucuacuucgacaccgagaccuacaacgcccugaugaagacgcugcagcgcgacugccggguccucgagagcuucaagaucauggacuacagccugcugcucggcauccacuuccuggaccacagccugaaggagaaggaggaggagacgccccagaacgugcccgacgccaagcgcaccgggaugcagaaggugcucuacuccaccgccauggagagcauccagggccccggcaaguccggggacggcaucaucaccgagaacccggacaccaugggcgggauccccgccaagagccaccgcggggagaagcugcuccuguucaugggcaucaucgacauccugcaguccuaccggcugaugaagaagcucgagcacagcuggaaggcgcuggucuacgacggcgacaccguguccgugcaccggcccagcuucuacgccgaccgcuuccugaaguucaugaacucccgggucuucaagaagauccaggcccucaaggccagccccuccaagaagcgcugcaacagcaucgcggcccugaaggccaccucccaggagaucgugagcuccaucagccaggaguggaaggacgagaagcgggaccugcucacggaggggcaguccuucagcucccuggacgaggaggcccugggcagccgccaccgcccggaccucgugcccagcacccccucccuguucgaggccgcgagccuggccaccaccaucuccagcuccagccucuacgucaacgagcacuacccccacgaccggccgacgcuguacuccaacagcaaguga

SEQ ID NO: 34615 - RNA, 1923 nt, Artificial Sequence
  derived and/or modified sequence opt1 from PIP5K1C__Homo_sapiens__NP_001182662
auggagcuggaggugcccgacgaggccgagagcgccgaggcgggcgccgucccguccgaggccgccugggccgcggagagcggggccgccgccggccucgcgcagaagaaggccgcccccaccgaggugcuguccaugaccgcccagcccgggcccggccacgggaagaagcugggccaccgcggcguggacgccagcggggagacgaccuacaagaagaccaccuccagcacgcucaagggcgcgauccagcuggggaucggcuacaccgucgggcaccuguccagcaagccggagcgggacgugcucaugcaggacuucuacguggucgaguccaucuucuuccccagcgagggcuccaaccugacccccgcccaccacuuccaggacuuccgcuucaagaccuacgcccccguggccuuccgguacuuccgcgagcuguucggcauccggccggacgacuaccucuacagccugugcaacgagccccugaucgagcucuccaaccccggggccagcggcucccuguucuacgugacgagcgacgacgaguucaucaucaagaccgucaugcacaaggaggcggaguuccugcagaagcuccugcccggguacuacaugaaccugaaccagaacccgcgcacccuccugcccaaguucuacggccuguacugcgugcaguccggcgggaagaacauccggguggucgugaugaacaacauccucccccgcguggucaagaugcaccugaaguucgaccugaagggcagcaccuacaagcggcgcgccuccaagaaggagaaggagaaguccuuccccacguacaaggaccucgacuucaugcaggacaugccggaggggcugcugcucgacgccgacaccuucagcgcccuggugaagacccugcagcgggacugccucgugcuggagagcuucaagaucauggacuacagccugcuccugggcguccacaacaucgaccagcacgagcgcgagcggcaggcccagggggcgcaguccaccagcgacgagaagcgccccgugggccagaaggcccuguacuccacggccauggagagcauccagggcggggccgcccggggcgaggcgaucgaguccgacgacaccaugggcgggauccccgccgugaacgggcgcggcgagcggcuccugcugcacaucggcaucaucgacauccuccagagcuaccgcuucaucaagaagcuggagcacaccuggaaggcccugguccacgacggggacaccguguccgugcaccggcccagcuucuacgccgagcgcuucuucaaguucauguccaacacggucuuccggaagaacagcucccucaagagcuccccgagcaagaagggccgcgggggcgcgcugcuggccgugaagccccucgggcccaccgccgccuucuccgccagccagauccccuccgagcgcgaggaggcgcaguacgaccugcggggcgcccgcagcuacccgacccuggaggacgagggccggcccgaccuccugcccugcacgcccccgagcuucgaggaggccaccaccgccuccaucgccaccacccugagcuccacgagccuguccauccccgagcgcagccccuccgagaccagcgagcagccgcgguaccgccggcgcacccaguccagcgggcaggacggccggccccaggaggagccgcccgcggaggaggaccuccagcagaucaccguccagguggagcccgccugcuccguggagaucgucgugcccaaggaggaggacgccgggguggaggccagccccgccggcgcguccgccgccgucgagguggagacggccagccaggcguccgacgaggagggcgcccccgccagccaggccuccgacgaggaggacgccccggcgaccgacaucuacuucuga

SEQ ID NO: 34616 - RNA, 1185 nt, Artificial Sequence
  derived and/or modified sequence opt1 from PIP5KL1__Homo_sapiens__NP_001128691
auggccgcccccagcccgggcccccgcgaggugcuggcgcccucccccgaggccgggugccgggccgucaccagcucccgccggggccuccuguggcgccugcgggacaagcagagccgccucgggcuguucgagaucuccccgggccacgagcugcacgggaugaccugcaugaugcaggccggccucugggccgcgacccaggugagcauggaccacccgcccacgggcccgcccucccgggacgacuucagcgaggugcugacccagguccacgagggguucgagcugggcacccucgccgggcccgccuucgccuggcugcgccggucccugggccucgcggaggaggacuaccaggccgcccuggggcccggcggccccuaccugcaguuccucagcacguccaagagcaaggccuccuucuuccugagccacgaccagcgcuucuuccugaagacccaggggcggcgcgaggugcaggcccuccuggcgcaccucccccgguacgugcagcaccuccagcgccacccccacucccugcuggcccggcugcugggcguccacagccugcgcguggaccgggggaagaagaccuacuucaucgugaugcaguccgucuucuaccccgccggccgcaucagcgagcgguacgacaucaagggcugcgaggugucccgcuggguggaccccgccccggaggggagcccccucguccuggugcugaaggaccucaacuuccagggcaagaccaucaaccuggggccccagcggagcugguuccugcgccagauggagcucgacacgaccuuccugcgcgagcugaacgugcucgacuacucccugcugaucgccuuccagcggcuccacgaggacgagcgcggccccgggagcucccugaucuuccggaccgcgcgcagcguccagggcgcccaguccccggaggagagccgggcccagaaccgccggcugcuccccgacgcccccaacgcccugcacauccuggacggccccgagcagcgcuacuuccucggggugguggaccuggcgaccgucuacggccugcggaagcgccucgagcaccuguggaagacgcugcgguacccggggcgcaccuucuccaccgugagccccgcccgguacgcccgccggcugugccaguggguggaggcccacaccgaguga

SEQ ID NO: 34617 - RNA, 441 nt, Artificial Sequence
  derived and/or modified sequence opt1 from PIP__Homo_sapiens__NP_002643
augcgccugcuccagcugcuguuccgggccagccccgccacccuccugcuggugcucugccugcagcugggcgcgaacaaggcccaggacaacacccgcaagaucaucaucaagaacuucgacaucccgaaguccguccggcccaacgacgaggugacggccgugcucgccguccagaccgagcugaaggagugcaugguggugaagaccuaccugaucagcuccaucccccuccagggggccuucaacuacaaguacaccgcgugccugugcgacgacaaccccaagacguucuacugggacuucuacaccaaccgcaccguccagaucgccgccgugguggacgucauccgggagcugggcaucugcccggacgacgccgcggugauccccaucaagaacaaccgcuucuacaccaucgagauccucaagguggaguga

SEQ ID NO: 34618 - RNA, 1173 nt, Artificial Sequence
  derived and/or modified sequence opt1 from PIPOX__Homo_sapiens__NP_057602
auggccgcccagaaggaccugugggacgcgaucgugaucggcgccgggauccagggcugcuucaccgccuaccaccucgccaagcaccgcaagcggauccugcugcucgagcaguucuuccugccccacagccgcggguccagccacggccagucccggaucauccgcaaggccuaccuggaggacuucuacacccggaugaugcacgagugcuaccagaucugggcgcagcucgagcacgaggccgggacgcagcugcaccgccagaccggccugcuccugcugggcaugaaggagaaccaggagcucaagaccauccaggccaaccugagccggcagcgcgucgagcaccagugccuguccagcgaggagcucaagcagcgguucccgaacauccgccugccccgcggggaggugggccugcucgacaacuccgggggcgugaucuacgccuacaaggcgcugcgggcccugcaggacgccauccggcagcucgggggcaucguccgcgacggcgagaaggugguggagaucaaccccgggcugcuggucaccgugaagacgaccagccgguccuaccaggccaagagccucgugaucaccgccggccccuggaccaaccagcugcugcgcccgcucgggaucgagaugccccugcagacgcugcggaucaacgucugcuacuggcgcgagauggugcccggcuccuacggcgugagccaggcguuccccugcuuccucuggcuggggcugugcccgcaccacaucuacggccuccccaccggggaguaccccggccugaugaaggucuccuaccaccacgggaaccacgccgaccccgaggagcgggacugcccgaccgcccgcaccgacaucggcgacgugcagauccugagcuccuucgugcgggaccaccuccccgaccugaagcccgagcccgccgucaucgagagcugcauguacacgaacaccccggacgagcaguucauccuggaccgccaccccaaguacgacaacaucgugaucggcgccggguucuccggccacggguucaagcucgcgcccguggucggcaagauccuguacgagcugagcaugaagcucacccccuccuacgaccuggccccguuccgcaucagccgguuccccagccuggggaaggcccaccucuga

SEQ ID NO: 34619 - RNA, 873 nt, Artificial Sequence
  derived and/or modified sequence opt1 from PIR__Homo_sapiens__NP_003653
augggcagcagcaagaaggugacccugagcguccucucccgcgagcagagcgagggggugggcgcccgggugcgccgguccaucgggcgccccgagcugaagaaccuggacccguuccuccuguucgacgaguucaagggcgggcggcccggcggcuuccccgaccacccccaccgcggguucgagaccgucagcuaccugcucgagggcggguccauggcccacgaggacuucugcggccacacggggaagaugaacccgggcgaccugcaguggaugaccgcgggccgggggauccugcacgccgagaugcccugcagcgaggagcccgcccacggccuccagcugugggugaaccugcgcuccagcgagaagaugguggagccccaguaccaggagcucaaguccgaggagaucccgaagcccagcaaggacggggucaccguggccgugaucuccggcgaggcccugggcaucaagagcaaggucuacacccggacgcccacccuguaccucgacuucaagcuggaccccggggcgaagcacucccagccgauccccaagggcuggaccagcuucaucuacaccaucuccggggacguguacaucggccccgacgacgcccagcagaagaucgagccccaccacacggccgugcugggggagggcgacagcguccagguggagaacaaggacccgaagcgcucccacuucgugcucaucgccggcgagccccugcgggagcccgucauccagcacgggcccuucgugaugaacaccaacgaggagaucagccaggcgauccuggacuuccgcaacgccaagaacggcuucgagcgggccaagaccuggaaguccaagaucgggaacuga

SEQ ID NO: 34620 - RNA, 1230 nt, Artificial Sequence
  derived and/or modified sequence opt1 from PISD__Homo_sapiens__XP_005261512
auggccaccagcgugggccaccgcugccuggggcuccugcacggcgucgcccccuggcgguccagccugcacccgugcgagaucaccgcgcucucccagagccugcagccccugcgcaagcuccccuuccgggccuuccgcacggacgcccggaagauccacaccgcccccgcccgcaccauguuccugcugcggccgcuccccauccugcuggugaccgggggcggguacgcgggcuaccgccaguacgagaaguaccgggagcgcgagcucgagaagcugggccuggagaucccgcccaagcucgccgggcacugggagguggcccuguacaaguccguccccacgcggcugcucagccgcgccuggggccggcugaaccagguggagcugccccacuggcuccgccggcccguguacucccuguacaucuggaccuucggggucaacaugaaggaggcggccguggaggaccugcaccacuaccgcaaccucagcgaguucuuccggcgcaagcugaagccccaggcccggccggugugcggccugcacuccgucaucagccccuccgacgggcgcauccucaacuucggccaggugaagaacugcgagguggagcaggucaagggcgugaccuacagccuggaguccuuccuggggccccggaugugcaccgaggaccuccccuucccgcccgccgccagcugcgacuccuucaagaaccagcuggugacgcgcgagggcaacgagcuguaccacugcgucaucuaccucgcgcccggggacuaccacugcuuccacagccccaccgacuggaccgugucccaccgccggcacuucccgggcagccugauguccgugaaccccggcauggcccgcuggaucaaggagcuguucugccacaacgagcgggucgugcucaccggggacuggaagcacggcuucuucagccugacggccgugggggccaccaacgucggcagcauccgcaucuacuucgaccgggaccugcacaccaacagcccccgccacuccaagggguccuacaacgacuucagcuucgugacccacacgaaccgggagggcgugcccaugcgcaagggcgagcaccucggggaguucaaccugggcuccaccaucguccugaucuucgaggccccgaaggacuucaacuuccagcucaagaccgggcagaagauccgguucggcgaggcgcuggggagccuguga

SEQ ID NO: 34621 - RNA, 813 nt, Artificial Sequence
  derived and/or modified sequence opt1 from PITPNA__Homo_sapiens__NP_006215
auggugcugcucaaggaguaccgcgucauccugcccgugagcguggacgaguaccaggucggccagcuguacuccguggccgaggccagcaagaacgagaccgggggcggggagggcguggagguccucgugaacgagccguacgagaaggacggggagaagggccaguacacccacaagaucuaccaccuccaguccaaggugcccacguucguccggaugcuggcgcccgagggcgcccugaacauccacgagaaggccuggaacgccuaccccuacugccgcaccgugaucaccaacgaguacaugaaggaggacuuccugaucaagaucgagaccuggcacaagccggaccuggggacgcaggagaacgugcacaagcucgagcccgaggccuggaagcacgucgaggcgguguacaucgacaucgccgaccggagccaggugcuguccaaggacuacaaggccgaggaggaccccgccaaguucaagagcaucaagaccggccgcgggccccugggcccgaacuggaagcaggagcucgucaaccagaaggacugccccuacaugugcgcguacaagcuggugaccgugaaguucaaguggugggggcugcagaacaaggucgagaacuucauccacaagcaggagcggcgccucuucaccaacuuccaccggcagcuguucugcuggcuggacaaguggguggaccucacgauggacgacauccgccggauggaggaggagaccaagcgccagcuggacgagaugcggcagaaggaccccgugaagggcaugaccgccgacgacuga

SEQ ID NO: 34622 - RNA, 3732 nt, Artificial Sequence
  derived and/or modified sequence opt1 from PITPNM1__Homo_sapiens__NP_001124320
augcugaucaaggaguaccacauccuccugcccaugagccuggacgaguaccagguggcccagcucuacaugauccagaagaagucccgcgaggagagcuccggcgaggggagcggcgucgagauccuggccaaccggccguacaccgacgggcccggcggguccggccaguacacccacaagguguaccacgugggcagccacauccccgggugguuccgcgcgcugcuccccaaggccgcccugcaggucgaggaggaguccuggaacgccuacccguacacgcggacccgcuacacgugccccuucguggagaaguucagcaucgagaucgagaccuacuaccugcccgacggcgggcagcagcccaacguguucaaccucuccggcgccgagcggcgccagcggauccuggacacgaucgacaucguccgcgacgcgguggccccgggggaguacaaggccgaggaggacccccggcuguaccacagcgugaagaccggccgcggcccccucuccgacgacugggcccggaccgcggcccagaccgggccccugaugugcgccuacaagcugugcaaggucgaguuccgcuacuggggcaugcaggccaagaucgagcaguucauccacgacguggggcuccggcgcgugaugcugcgggcccaccgccaggcguggugcuggcaggacgaguggacggagcugagcauggccgacauccgggcccucgaggaggagaccgcccgcaugcuggcccagcggauggcgaagugcaacaccggcuccgagggcagcgaggcccagccgcccgggaagcccuccaccgaggcccgcagcgccgccuccaacacgggcacccccgacgggccggaggcgccgcccggccccgacgccagccccgacgccuccuucgggaagcaguggagcagcuccagccgguccagcuacuccagccagcacggcggcgccgucagcccccagucccuguccgaguggcgcaugcagaacaucgcccgcgacagcgagaacuccagcgaggaggaguucuucgacgcgcacgagggguucuccgacagcgaggagguguuccccaaggagaugaccaaguggaacuccaacgacuucaucgacgccuucgccagccccguggaggccgagggcaccccggagcccggggcggaggccgccaagggcaucgaggacggggcccaggcgccccgggacuccgagggccucgacggcgccggggagcugggcgccgaggccugcgccguccacgcccuguuccucauccugcacagcgggaacauccuggacuccggccccggggacgcgaacagcaagcaggccgacgugcagacccucagcuccgccuucgaggccgugacccgcauccacuucccggaggcccugggccacgucgcgcugcggcucgugcccugcccgcccaucugcgccgccgccuacgcgcuggugagcaaccugucccccuacagccacgacggcgacucccucagccgcucccaggaccacaucccccuggccgcccugccccuccuggccaccagcuccagccgguaccagggggccgucgcgaccgugaucgcccgcacgaaccaggccuacuccgccuuccugcggagcccggagggcgccggguucugcggccagguggcgcucaucggcgacggggucggcgggauccugggcuucgacgcccugugccacuccgccaacgccgggaccggcagccgcggcuccagccggcgcggguccaugaacaacgagcuccugagccccgaguucggccccgugcgggacccccuggccgacggggucgagggccucgggcgcggcagcccggagcccuccgcgcugccgccccagcggauccccagcgacauggccucccccgagcccgagggcagccagaacucccugcaggccgcccccgcgaccaccagcuccugggagccgcgccgggccagcacggccuucugcccgcccgccgccuccagcgaggcgcccgacgggcccuccagcaccgcccgccucgacuucaagguguccggcuucuuccuguucgggagcccccugggccuggugcucgcccugcggaagaccgucaugcccgcccuggaggcccagaugcgccccgcgugcgagcagaucuacaaccucuuccacgccgccgacccgugcgccucccggcuggagccccugcucgcccccaaguuccaggcgaucgccccgcugaccgugccccgcuaccagaaguucccccugggggacggcagcucccuccugcuggccgacacgcuccagacccacagcucccuguuccuggaggagcucgagaugcuggugcccagcaccccgaccagcacguccggcgccuucuggaaggggagcgagcuggccaccgacccgcccgcgcagcccgccgcccccuccaccaccagcgaggucgugaagauccucgagcgcugguggggcacgaagcggaucgacuacucccuguacugccccgaggcccugaccgcguuccccaccgugacccucccccaccuguuccacgccagcuacugggaguccgccgacgucguggccuucauccugcgccaggugaucgagaaggagcggccgcagcucgccgagugcgaggagcccagcaucuacucccccgcguucccccgcgagaaguggcagcggaagcgcacccaggucaagauccggaacgugacgagcaaccaccgcgccuccgacaccguggucugcgaggggcggccccaggugcugagcggccgcuucauguacgggccgcuggacguggucacccucaccggcgagaagguggacguguacaucaugacgcagccccuguccggcaaguggauccacuucgggaccgaggucaccaacagcuccggccggcugaccuuccccgugccgcccgagcgcgcccucgggaucggcguguaccccguccggaugguggugcgcggcgaccacacguacgccgagugcugccugaccgucguggcccgggggaccgaggcgguggucuucagcaucgacggcuccuucaccgccagcguguccaucauggggagcgaccccaaggugcgcgccggcgccgucgacguggugcggcacuggcaggacagcggguaccugaucgucuacgugacgggccgcccggacaugcagaagcaccggguggucgccuggcucucccagcacaacuucccccacggcguggugagcuucugcgacgggcugacccacgacccccugcgccagaaggcgauguuccuccagucccugguccaggagguggagcugaacaucguggccggcuacgggagccccaaggacgucgccguguacgccgcgcucggccuguccccgagccagaccuacaucguggggcgggccguccgcaagcugcaggcccagugccaguuccucuccgacggcuacguggcccaccugggccagcuggaggccgggagccacucccacgcgagcuccggcccgccccgcgccgcccucggcaagagcuccuacgggguggccgcccccgucgacuuccugcggaagcagagccagcugcuccgcucccgggggcccagccaggcggagcgcgagggccccggcacgcccccgaccacccuggcccgggggaaggcccgcuccaucagccugaagcucgacuccgaggaguga

SEQ ID NO: 34623 - RNA, 2817 nt, Artificial Sequence
  derived and/or modified sequence opt1 from PITPNM3__Homo_sapiens__NP_001159438
auggccaaggccggccgcgcgggcgggccgccgcccggcggcggggcccccuggcaccuccggaacgugcugagcgacuccgucgagagcuccgacgacgaguucuucgacgcccgcggcgagggcaccgcccccugcaccagcuccauccugcaggagaagcagcgggagcuguaccgcgugagccuccggcgccagcgguuccccgcccagggguccaucgagauccacgaggacagcgaggagggcugcccccagcgcuccugcaagacgcacgugcugcugcucguccugcacgggggcaacauccuggacaccggggcgggcgaccccagcugcaaggccgccgacauccacaccuucuccagcgugcucgagaaggugacccgggcccacuuccccgcggcccugggccacauccugaucaaguucgucccgugccccgccaucugcuccgaggccuucagccucgugucccaccugaaccccuacagccacgacgaggggugccuguccagcucccaggaccacgugccccucgccgcgcugccgcugcucgccaucagcagcccccaguaccaggacgccgucgccacggugaucgagcgcgccaaccagguguaccgggaguuccugaaguccagcgacggcaucggguucuccggccaggucugccugaucggcgacugcgucgggggccuccuggcguucgacgccaucugcuacagcgccgggcccuccggcgacagccccgccuccagcucccgcaaggggagcaucuccagcacccaggacaccccgguggccguggaggaggacugcucccuggcgagcuccaagcggcucagcaaguccaacaucgacaucagcuccggccuggaggacgaggagcccaagcgcccccugccccggaagcagagcgacagcuccaccuacgacugcgaggccaucacgcagcaccacgccuuccucagcuccauccacagcuccgugcugaaggacgagagcgagaccccggccgccggcgggccccagcugcccgaggugucccucggccgcuucgacuucgacgucagcgacuucuuccuguucgggagcccccugggccucgugcuggcgaugcggcgcaccgugcugccggggcucgacggcuuccagguccggcccgccugcucccagguguacuccuucuuccacugcgccgaccccagcgccucccgccuggagccccugcucgagccgaaguuccaccuggugccgcccgucagcgugccccgguaccagcgcuucccccugggcgacgggcagucccuccugcuggcggacgcccuccacacccacagcccccuguuccuggagggcuccagccgcgacagcccgccccuccuggacgcccccgccuccccgccccaggccagccgguuccagcgccccgggcggcgcauguccgagggcagcucccacagcgaguccagcgaguccagcgacuccauggcgcccgucggggccagccggaucacggccaagugguggggcuccaagcgcaucgacuacgcccuguacugccccgacgugcugaccgccuuccccaccguggcgcucccgcaccuguuccacgccagcuacugggaguccaccgacgucguggccuucauccugcgccaggugaugcgguacgagagcgucaacaucaaggaguccgcccggcucgaccccgccgcgcugagccccgccaacccccgcgagaaguggcugcggaagcgcacccaggugaagcuccggaacgugacggccaaccaccgcgccaacgacgucaucgcggccgaggacggcccccaggugcugguggggcgguucauguacggcccccuggacauggucgcccucaccggggagaagguggacauccuggugauggccgagcccuccagcggccgcuggguccaccuggacaccgagaucacgaacagcuccggccggaucaccuacaacgugccccgcccgcggcgccucggggugggcgucuaccccgugaagauggugguccgcggggaccagaccugcgccaugagcuaccugaccgugcugccccggggcauggagugcguggucuucuccaucgacgggagcuucgcggccuccgugagcaucaugggcuccgaccccaaggugcgcccgggcgccgucgacguggugcggcacuggcaggaccucggguacaugauccuguacaucacgggccgccccgacaugcagaagcagcgggucgugagcuggcugucccagcacaacuucccccaggggaugaucuucuucagcgacggccucgugcacgacccgcugcgccagaaggccaucuuccugcggaaccucaugcaggagugcuucaucaagaucuccgccgcguacgggagcaccaaggacaucuccgucuacagcgugcugggccugcccgccucccagaucuucaucgugggccgccccaccaagaaguaccagacccagugccaguuccucagcgagggguacgccgcccaccuggccgcgcuggaggccucccaccggagccgccccaagaagaacaacucccggaugauccuccgcaagggcagcuucgggcugcacgcccagccggaguuccugcggaagcgcaaccaccuccggcgcacgaugagcguccagcagcccgacccgcccgccgcgaaccccaagcccgagcgggcccagucccagcccgagagcgacaaggaccacgagcgcccccugccggcccuguccugggcccgggggccgcccaaguucgagagcgugcccuga

SEQ ID NO: 34624 - RNA, 3117 nt, Artificial Sequence
  derived and/or modified sequence opt1 from PITRM1__Homo_sapiens__NP_001229236
auguggcgcugcggcgggcggcagggccugugcgugcuccgccggcugagcgggggccacgcccaccaccgcgccuggcgguggaacuccaaccgcgcgugcgagcgggcccugcaguacaagcucggggacaagauccacggcuucaccgucaaccaggugaccagcgugcccgagcuguuccugacggccgucaagcucacccacgacgacaccggcgcccgcuaccugcaccuggcccgggaggacaccaacaaccucuucuccgugcaguuccgcacgaccccgauggacagcaccggggugccccacauccuggagcacaccguccugugcggcucccagaaguaccccugccgggaccccuucuucaagaugcucaaccgcagccuguccacguucaugaacgcguucaccgccagcgacuacacccuguacccguucuccacccagaaccccaaggacuuccagaaccuccugagcguguaccuggacgccacguucuuccccugccuccgggagcuggacuucuggcaggagggguggcgccuggagcacgagaaccccuccgacccgcagacgccccucguguucaagggcgucguguucaacgagaugaagggggccuucaccgacaacgagcggaucuucagccagcaccuccagaaccgccugcuccccgaccacaccuacuccguggucagcggcggcgacccccugugcaucccggagcugaccugggagcagcucaagcaguuccacgcgacccacuaccaccccuccaacgcccgguucuucaccuacgggaacuucccccuggagcagcaccugaagcagauccacgaggaggcccucagcaaguuccagaagaucgagcccuccaccguggugccggcccagacgcccugggacaagccccgcgaguuccagaucacgugcggccccgacagcuucgccaccgacccguccaagcagaccaccaucagcgucagcuuccugcugcccgacaucaccgacaccuucgaggcguucacccucucccugcugagcucccuccugacgagcgggcccaacucccccuucuacaaggcccugaucgagagcggccucggcaccgacuucuccccggacgugggguacaacggcuacacccgggaggccuacuucagcguggggcugcagggcaucgccgagaaggacaucgagaccguccgcucccugaucgaccggacgaucgacgaggugguggagaagggguucgaggacgaccgcaucgaggcccuccugcacaagaucgagauccagaugaagcaccagagcaccuccuucggccugaugcucaccagcuacaucgcguccugcuggaaccacgacggcgaccccgucgagcugcugaagcucgggaaccagcuggccaaguuccgccagugccugcaggagaaccccaaguuccugcaggagaaggugaagcaguacuucaagaacaaccagcacaagcucacccugagcaugcggcccgacgacaaguaccacgagaagcaggcccagguggaggccacgaagcugaagcagaaggucgaggcccucuccccgggcgaccgccagcagaucuacgagaaggggcuggagcugcggagccagcaguccaagccccaggacgcgagcugccuccccgcccugaagguguccgacaucgagccgaccauccccgucaccgagcuggacguggugcucaccgccggcgacauccccguccaguacugcgcccagcccaccaacgggaugguguacuuccgcgccuucagcagccugaacacgcugccggaggagcuccggcccuacgugccccuguucugcuccguccugaccaagcucggcugcggccugcuggacuaccgcgagcaggcgcagcagaucgagcucaagaccgggggcaugagcgccagcccccacgugcugccggacgacucccacauggacaccuacgagcaggucggggugcuguucuccagccucugccuggaccggaaccugcccgacaugaugcagcucugguccgagaucuucaacaaccccugcuucgaggaggaggagcacuucaaggugcuggugaagaugacggcccaggagcuggccaacggcauccccgacagcgggcaccucuacgcguccauccgcgccggccggacccugaccccggccggcgaccugcaggagaccuucagcgggauggaccagguccgccucaugaagcggaucgccgagaugacggacaucaagcccauccugcgcaagcugccccggaucaagaagcaccuccugaacggcgacaacaugcgcugcuccgugaacgccacgccccagcagaugccgcagaccgagaaggcgguggaggacuuccugcggagcaucgggcgcuccaagaaggagcggcgccccguccggccccacaccguggagaagcccgugccgagcuccagcggcggcgacgcccacgucccccacgggucccaggugauccgcaagcucgugauggagcccaccuucaagcccuggcagaugaagacccacuuccugaugccguuccccgucaacuacgugggcgagugcauccgcaccgugcccuacaccgacccggaccacgccagccugaagauccucgcccggcugaugacggccaaguuccugcacaccgagauccgcgagaagggcggggcguacgggggcggcgccaagcucagccacaacgggaucuucacccuguacuccuaccgggaccccaacaccaucgagacgcugcagagcuucggcaaggccgucgacugggccaaguccgggaaguucacccagcaggacaucgacgaggccaagcucagcguguucuccaccguggacgcgcccgucgcccccagcgacaagggcauggaccacuuccuguacgggcuguccgacgagaugaagcaggcccaccgcgagcagcuguucgccgugagccacgacaagcugcuggcgguguccgaccgguaccucggcaccggcaagagcacgcacgggcuggccauccugggcccggagaaccccaagaucgccaaggaccccuccuggaucauccaguga

SEQ ID NO: 34625 - RNA, 945 nt, Artificial Sequence
  derived and/or modified sequence opt1 from PITX1__Homo_sapiens__NP_002644
auggacgccuucaagggcgggaugagccuggagcgccuccccgagggccugcggccgcccccgccgccgccccacgacauggggcccgccuuccaccuggcgcgccccgccgacccccgggagccccucgagaacuccgccagcgaguccagcgacaccgagcugcccgagaaggagcgcggcggggagcccaagggccccgaggacuccggcgccgggggcaccgggugcggcggggccgacgaccccgcgaagaagaagaagcagcggcgccagcggacccacuucaccagccagcagcugcaggagcucgaggccaccuuccagcgcaaccgguaccccgacauguccaugcgcgaggagaucgccguguggaccaaccugacggagccccggguccgcgugugguucaagaaccggcgcgccaaguggcggaagcgcgagcggaaccagcagcuggaccucugcaagggcggcuacgugccgcaguucagcgggcugguccagcccuacgaggacguguacgcggccggcuacuccuacaacaacugggccgccaagagccuggcccccgcgccccucuccaccaagagcuucaccuucuucaacuccaugagcccgcuguccagccaguccauguucagcgcccccuccagcaucagcuccaugaccaugcccagcuccauggggcccggcgccgugccgggcaugcccaacagcgggcugaacaacaucaacaaccucacgggcuccagccugaacuccgccaugagccccggggccugccccuacggcaccccggcgucccccuacagcgucuaccgcgacacgugcaacuccagccuggccucccuccggcucaagagcaagcagcacuccagcuucggguacggcggccugcaggggcccgccuccggccugaacgccugccaguacaacagcuga

SEQ ID NO: 34626 - RNA, 975 nt, Artificial Sequence
  derived and/or modified sequence opt1 from PITX2__Homo_sapiens__NP_000316
augaacugcaugaagggcccccugcaccucgagcaccgcgccgccgggaccaagcugagcgcgguguccagcuccagcugccaccacccgcagccccuggccauggccuccguccucgcccccggccagccccggagccuggacuccagcaagcaccgccuggaggugcacaccaucuccgacacgagcuccccggaggccgcggagaaggacaagagccagcaggggaagaacgaggacgugggcgccgaggaccccuccaagaagaagcggcagcgccggcagcgcacccacuucaccagccagcagcuccaggagcuggaggccaccuuccagcggaaccgcuaccccgacauguccacgcgggaggagaucgccgucuggaccaaccugaccgaggcgcgcgugcgggugugguucaagaaccgccgggccaaguggcgcaagcgggagcgcaaccagcaggccgagcucugcaagaacggguucggcccccaguucaacggccugaugcagccguacgacgacauguaccccggguacagcuacaacaacugggccgccaagggccugaccuccgcgagccucuccaccaagagcuuccccuucuucaacagcaugaacgucaacccccuguccagccaguccauguucagcccgcccaacuccaucagcuccaugagcauguccagcuccauggugcccagcgccgugacggggguccccggcuccagccugaacucccucaacaaccugaacaaccugagcuccccgagccucaacuccgccgugcccacccccgccugccccuacgccccgcccaccccgcccuacguguaccgggacacgugcaacagcagccuggcgucccugcgccucaaggccaagcagcacagcuccuucggguacgccagcguccagaaccccgccuccaaccugagcgccugccaguacgcgguggaccggcccguguga

SEQ ID NO: 34627 - RNA, 909 nt, Artificial Sequence
  derived and/or modified sequence opt1 from PITX3__Homo_sapiens__NP_005020
auggaguucggccugcucagcgaggccgaggcccgcucccccgcgcugagccuguccgacgccgggaccccgcacccccagcuccccgagcacggcugcaaggggcaggagcacagcgacuccgagaaggccagcgccucccugcccggcgggagcccggaggacggcucccugaagaagaagcagcggcgccagcggacccacuucacgagccagcagcuccaggagcuggaggccaccuuccagcgcaaccgguaccccgacauguccacccgcgaggagaucgcgguguggaccaaccugacggaggcccggguccgcgugugguucaagaaccggcgcgccaaguggcggaagcgcgagcggagccagcaggccgagcucugcaagggcuccuucgcggcgccccucgggggccuggugcccccguacgaggaggucuaccccggguacagcuacggcaacuggccgcccaaggcccuggccccgccccuggccgccaagaccuuccccuucgccuucaacuccgugaacguggggccccuggccagccagccggucuucuccccgcccagcuccaucgccgccagcauggugcccagcgcggccgccgcccccggcaccgugcccggccccggggcccuccagggccucgggggcggcccgcccgggcuggcgcccgccgccgucuccagcggcgccguguccugccccuacgccagcgcggccgccgccgcggccgccgccgccuccagccccuacguguaccgcgaccccugcaacuccagccuggcgucccugcggcugaaggccaagcagcacgccagcuucuccuaccccgccguccacgggcccccgcccgccgcgaaccucagccccugccaguacgccguggagcgccccguguga

SEQ ID NO: 34628 - RNA, 2490 nt, Artificial Sequence
  derived and/or modified sequence opt1 from PIWIL1__Homo_sapiens__NP_001177900
augaccggccgcgcccgggcccgcgcgcgggggcgcgcccggggccaggagaccgcccagcugguggggagcaccgccucccagcagcccggcuacauccagccgcgcccccagcccccgcccgccgagggggagcuguucggccggggccgccagcgggggaccgcgggcgggaccgccaagagccagggccugcagaucuccgccggguuccaggagcugagccucgccgagcgcggcggccggcgccgggacuuccacgaccugggggucaacacccgccagaaccuggaccacgugaaggaguccaagacgggcagcuccgggaucaucgugcggcucagcaccaaccacuuccgccugaccucccggccccagugggcgcuguaccaguaccacaucgacuacaacccccucauggaggcccgccggcugcgcagcgcccuccucuuccagcacgaggaccugaucggcaagugccacgccuucgacggcaccauccuguuccuccccaagcggcugcagcagaaggucacggagguguucuccaagacccgcaacggggaggacgugcgcaucaccaucacccugacgaacgagcucccgcccaccagcccgaccugccugcaguucuacaacaucaucuuccggcgccugcucaagaucaugaaccugcagcagaucggccggaacuacuacaaccccaacgaccccaucgacauccccucccaccgccuggucaucuggcccggguucaccacgagcauccuccaguacgagaacuccaucaugcugugcaccgacgugagccacaaggugcugcgguccgagaccguccucgacuucauguucaacuucuaccaccagaccgaggagcacaaguuccaggagcaggucagcaaggagcugaucggccugguggugcucacgaaguacaacaacaagaccuaccgcguggacgacaucgacugggaccagaaccccaaguccaccuucaagaaggccgacgggagcgaggugagcuuccuggaguacuaccggaagcaguacaaccaggagaucaccgaccugaagcagccgguccucgugucccagcccaagcgccggcgcggccccggcgggacgcugcccggcccggcgaugcugauccccgagcucugcuaccugaccgggcugaccgacaagaugcggaacgacuucaacgugaugaaggaccucgccguccacacccgccugacgcccgagcagcggcagcgcgaggugggccggcugaucgacuacauccacaagaacgacaacgugcagcgcgagcuccgggacugggggcugagcuucgacuccaaccugcucagcuucuccggccgcauccugcagaccgagaagauccaccagggcgggaagaccuucgacuacaacccccaguucgccgacuggagcaaggagacccggggcgccccgcugaucuccgucaagccccucgacaacuggcugcugaucuacacgcgccgcaacuacgaggccgcgaacagccugauccagaaccucuucaaggugacccccgccauggggaugcagaugcggaaggccaucaugaucgagguggacgaccgcaccgaggccuaccugcggguccugcagcagaaggugaccgccgacacgcagaucgucgugugccuccuguccagcaaccgcaaggacaaguacgacgcgaucaagaaguaccugugcaccgacugccccaccccgucccagugcguggucgcccggacccucggcaagcagcagaccgugauggccaucgccacgaagaucgcccugcagaugaacugcaagaugggcggggagcuguggcgcguggacaucccccucaagcuggucaugaucgugggcaucgacugcuaccacgacaugaccgcggggcggcgcagcaucgccggcuucguggccuccaucaacgaggggaugacccggugguucagccgcugcaucuuccaggaccggggccaggagcuggucgacggccucaaggugugccugcaggccgcgcugcgcgccuggaacuccugcaacgaguacaugcccagccggaucaucguguaccgcgacggggucggcgacgggcagcucaagacccuggugaacuacgaggugccgcaguuccuggacugccucaaguccaucggccggggguacaacccccgccugacggucaucguggugaagaagcgggucaacacccgcuucuucgcccagagcggcggccggcugcagaacccccuccccgggaccgugaucgacguggaggucacccgcccggagugguacgacuucuucaucgugucccaggccgugcggagcggcagcgucucccccacgcacuacaacgugaucuacgacaacagcgggcugaagcccgaccacauccagcgccugaccuacaagcucugccacaucuacuacaacuggcccguguccgccagcacgugcuga

SEQ ID NO: 34629 - RNA, 2922 nt, Artificial Sequence
  derived and/or modified sequence opt1 from PIWIL2__Homo_sapiens__NP_001129193
auggaccccuuccgcccgagcuuccggggccagucccccauccaccccagccagugccaggccgugcgcaugcccgggugcuggccgcaggccuccaagccccuggaccccgcgcucggccgcggggcccccgccggccgggggcacgucuucggcaagccggaggagcccagcacccagcggggccccgcccagcgcgaguccguggggcuggugagcauguuccggggccuggggaucgagaccgucuccaagacgccccucaagcgcgagaugcugccgagcggccgggggauccugggccgcggccucuccgccaaccuggugcggaaggaccgcgaggagcugagccccaccuucugggaccccaaggugcucgcggccggggacuccaagauggccgagaccagcgucggcuggucccggacccuggggcgcggcagcuccgacgccagccugcucccccugggccgggcggccgggggcaucucccgcgagguggacaagccgcccugcacguucagcacccccucccgggggcccccgcagcugagcuccccgcccgcccucccccagagcccccugcacagccccgaccgcccccuggugcucaccgucgagcacaaggagaaggagcugaucgugaagcagggcuccaaggggacgccccagagccugggccucaaccuggugaagauccagugccacaacgaggccgucuaccaguaccacgugaccuucuccccgaacguggagugcaagagcaugcgguucggcaugcugaaggaccaccaggccgucaccgggaacgugaccgcguucgacggcuccauccucuaccugcccgugaagcugcagcagguccucgagcucaagagccagcgcaagaccgacuccgccgagaucagcaucaagauccagaugacgaagauccuggagcccugcuccgaccugugcaucccguucuacaacgugguguuccggcgcgucaugaagcugcuggacaugaagcucguggggcgcaacuucuacgaccccaccagcgccauggugcugcagcagcaccggcugcagaucuggcccggcuacgccgccuccauccgccggaccgacgggggccucuuccugcuggcggacgucagccacaaggugauccgcaacgacugcguccucgacgugaugcacgccaucuaccagcagaacaaggagcacuuccaggacgagugcaccaagcugcuggugggcaacaucgucaucacgcgguacaacaaccgcaccuaccggaucgacgacguggacuggaacaagacccccaaggacuccuucaccaugagcgacgggaaggagaucacguuccucgaguacuacuccaagaacuacggcaucaccgugaaggaggaggaccagccgcugcugauccaccgccccagcgagcggcaggacaaccacgggaugcuccugaagggcgagauccugcuccugcccgagcuguccuucaugaccgggauccccgagaagaugaagaaggacuuccgcgccaugaaggaccuggcccagcagaucaaccucagcccgaagcagcaccacagcgcccuggagugccugcuccagcggaucgcgaagaacgaggccgccaccaacgagcugaugcgcuggggccugcggcuccagaaggacguccacaagaucgagggccgcgugcugcccauggagcggaucaaccugaagaacacguccuucaucaccagccaggagcucaacugggugaaggaggucacccgcgaccccuccauccugaccauccccaugcacuucugggcccuguucuacccgaagcgggccauggaccaggcgcgcgagcucgugaacaugcuggagaagaucgccgggcccaucggcaugcggaugagcccgcccgccuggguggagcugaaggacgaccgcaucgagacguacguccgcaccauccaguccacccucggggccgagggcaagauccagaugguggugugcaucaucaugggcccccgggacgaccuguacggggcgaucaagaagcugugcugcguccagagccccgugcccucccagguggucaacgugcgcaccaucggccagcccacgcggcuccgcagcguggcccagaagauccugcugcagaucaacugcaagcucgggggcgagcuguggggcgucgacaucccgcugaagcagcucauggugaucgggauggacguguaccacgaccccucccggggcaugcgcagcgucgugggguucguggccuccaucaaccugacccugaccaagugguacagccgggucguguuccagaugccccaccaggagaucguggacucccucaagcugugccuggucggcagccucaagaaguucuacgaggugaaccacugccugcccgagaagaucguggucuaccgcgacgggguguccgacggccagcugaagaccguggccaacuacgagaucccgcagcuccagaagugcuucgaggccuucgagaacuaccagcccaagauggucguguucgugguccagaagaagaucagcacgaaccuguaccuggcggcgccccagaacuucgugaccccgacccccgggaccguggucgaccacaccaucacguccugcgaguggguggacuucuaccuccuggcccaccacgugcggcagggcugcggcauccccacccacuacgucugcgugcugaacaccgccaaccucagccccgaccacaugcagcgccugaccuucaagcugugccacauguacuggaacuggccggggacgauccgggugcccgcccccugcaaguacgcccacaagcucgccuuccugagcggccacauccugcaccacgagcccgccauccagcucugcgagaaccuguucuuccuguga

SEQ ID NO: 34630 - RNA, 2649 nt, Artificial Sequence
  derived and/or modified sequence opt1 from PIWIL3__Homo_sapiens__NP_001008496
augcccggccgcgcccggacccgcgcccgggggcgcgcgcggcgccgggagagcuaccagcaggaggccccgggcgggccccgcgcccccggcuccgccaccacgcaggagcccccgcagcugcagagcacgccccggccccuccaggaggaggugcccgucgugcgcccgcugcagccccgggccgcgcgcgggggcgccggcgggggcgcccagucccagggggugaaggagcccggccccgaggccgggcugcacaccgcgccgcuccaggagcggcgcaucggcggcgucuuccaggaccugguggugaacacccggcaggacaugaagcacgucaaggacagcaagaccggguccgagggcaccguggugcagcugcucgccaaccacuuccgcgucaucagccggccccaguggguggccuacaaguacaacguggacuacaagcccgacaucgaggacgggaaccugcgcaccauccugcucgaccagcaccggcgcaaguucggcgagcggcacaucuucgacggcaacucccugcugcucagccgcccccugaaggagcgccgggucgaguggcuguccaccacgaaggacaagaacaucgugaagaucaccguggaguucagcaaggagcucaccccgaccucccccgacugccugcgcuacuacaacauccuguuccggcgcacguucaagcuccuggacuucgagcaggucgggcggaacuacuacaccaagaagaaggccauccagcuguaccgccacggcaccagccucgagaucuggcugggguacgugaccuccgugcugcaguacgagaacagcaucacgcucugcgccgacgucucccacaagcugcugcggaucgagaccgcguacgacuucaucaagcgcaccagcgcccaggcccagaccggcaacauccgggaggaggugacgaacaagcucaucggguccaucgugcugaccaaguacaacaacaagaccuaccgcgucgacgacaucgacuggaagcagaaccccgaggacaccuucaacaagagcgacggcuccaagaucacguacaucgacuacuaccggcagcagcacaaggagaucgugaccgugaagaagcagccccugcucgucagccagggccgcuggaagaaggggcugaccggcacccagcgggagccgauccugcucaucccccagcugugccacaugacggggcugaccgacgagaucugcaaggacuacagcaucgugaaggagcucgccaagcacacccgccugagcccccggcgccggcaccacacccugaaggaguucaucaacacgcuccaggacaacaagaagguccgcgagcugcugcagcucugggaccugaaguucgacaccaacuuccuguccgugcccggccgggugcucaagaacgccaacaucguccaggggcgccgcauggugaaggcgaacucccagggcgacuggagccgggagauccgcgagcugccgcugcucaacgccaugccccugcacuccuggcugauccuguacagccgguccagccaccgcgaggccaugucccucaagggccaccuccagagcgugaccgcccccauggggaucaccaugaagcccgccgagaugaucgaggucgacggcgacgcgaacuccuacaucgacacgcugcggaaguacacccgcccgacccugcagauggggaugagcugccugcugguguucaaggugaucugcauccuccccaacgacgacaagcggcgcuacgacuccaucaagcgguaccugugcaccaagugccccaucccgagccagugcgucgugaagaagacccuggagaaggugcaggcccgcacgaucgucaccaagaucgcccagcagaugaacugcaagaugggcggggcccucuggaagguggagaccgacgugcagcggaccauguucgucggcaucgacugcuuccacgacaucgugaaccgccagaaguccaucgccggcuucguggcgagcacgaacgccgagcugaccaagugguacucccagugcgucauccagaagaccggggaggagcuggugaaggagcucgagaucugccugaaggccgcccuggacguguggugcaagaacgagagcuccaugccccacagcgucaucguguaccgggacggcgugggggacggccagcuccaggcgcugcuggaccacgaggccaagaagaugagcaccuaccucaagacgaucucccccaacaacuucacccuggccuucaucgucgugaagaagcgcaucaacacccgguucuuccugaagcacggcagcaacuuccagaacccgccgcccgggaccgugaucgacgucgagcucacgcgcaacgagugguacgacuucuucaucgugucccagagcgugcaggacggcaccgucacccccacccacuacaacgugaucuacgacacgaucgggcugucccccgacaccgugcagcggcugaccuacugccucugccacauguacuacaaccugcccggcaucauccgcguccccgcccccugccacuacgcccacaagcuggcguaccucguggggcagagcauccaccaggagcccaaccggucccugagcacccgccuguucuaccucuga

SEQ ID NO: 34631 - RNA, 2559 nt, Artificial Sequence
  derived and/or modified sequence opt1 from PIWIL4__Homo_sapiens__NP_689644
augagcggccgcgcccgggugaaggcccgcgggaucgcgcggucccccagcgccaccgaggucggccgcauccaggccuccccgcugccccggagcguggaccucuccaacaacgaggccagcuccagcaacggguuccugggcaccucccgcaucagcacgaacgacaaguacgggaucuccagcggcgacgccggcuccaccuucauggagcgcggggugaagaacaagcaggacuucauggaccugagcaucugcacccgcgagaagcucgcgcacguccggaacugcaagaccggcuccagcgggauccccgugaagcuggugacgaaccuguucaaccucgacuucccccaggacuggcagcuguaccaguaccacgucaccuacaucccggaccuggccucccgccggcuccgcaucgcccugcuguacagccacuccgagcucagcaacaaggccaaggcguucgacggcgccauccuguuccugagccagaagcucgaggagaaggugaccgagcuguccagcgagacccagcgcggggagacgaucaagaugaccaucacccugaagcgggagcuccccuccagcucccccgugugcauccaggucuucaacaucaucuuccggaagauccugaagaagcugagcauguaccagaucggccgcaacuucuacaaccccuccgagccgauggagaucccccagcacaagcucagccuguggcccggcuucgccaucuccgugagcuacuucgagcggaagcugcuguucuccgccgacgugagcuacaagguccugcgcaacgagaccgugcuggaguucaugacggcccucugccagcggaccgggcuguccugcuucacccagaccugcgagaagcagcugaucggccucaucgugcugacgcgcuacaacaaccggaccuacagcaucgacgacaucgacugguccgucaagcccacccacaccuuccagaagcgcgacgggacggagaucaccuacguggacuacuacaagcagcaguacgacaucaccgugagcgaccugaaccagccgaugcucgucucccugcugaagaagaagcgcaacgacaacagcgaggcgcagcucgcccaccugauccccgagcugugcuuccucaccggccugacggaccaggccaccuccgacuuccagcugaugaaggccguggccgagaagacccggcucagccccagcggccgccagcagcggcuggcgcgccugguggacaacauccagcggaacaccaacgcccgcuucgagcucgagacgugggggcugcacuucggcucccagaucagccugaccgggcggaucguccccuccgagaagauccucaugcaggaccacaucugccagccggugagcgccgccgacugguccaaggacauccggaccugcaagauccugaacgcccagagccugaacaccuggcugauccucugcuccgaccggacggaguacguggcggagagcuuccugaacugccugcgccgggucgccggcuccaugggguucaacguggacuaccccaagaucaucaagguccaggagaaccccgccgccuucgugcgcgccauccagcaguacguggaccccgacguccagcucgugaugugcauccugccgagcaaccagaagaccuacuacgacuccaucaagaaguaccugagcuccgacugccccgugcccagccagugcguccucgcgcggacccugaacaagcagggcaugaugauguccaucgccaccaagaucgccaugcagaugacgugcaagcugggcggggagcucugggccguggagaucccccucaagagccugaugguggucggcaucgacgugugcaaggacgcgcucuccaaggacgugauggucguggggugcguggccagcgucaacccgcgcaucacccggugguucagccgcugcauccugcagcggaccaugaccgacguggccgacugccugaagguguucaugaccggcgcccucaacaagugguacaaguacaaccacgaccugcccgcccgcaucaucgucuaccgggcgggggugggcgacggccagcugaagacgcucaucgaguacgaggugccccagcugcuguccagcgucgccgaguccagcuccaacaccagcucccgccucagcgugaucgugguccgcaagaagugcaugccccgguucuucaccgagaugaaccgcaccgugcagaacccgccccuggggacgguggucgacuccgaggccacccggaacgagugguacgacuucuaccugaucagccagguggccugccgcggcaccgugucccccaccuacuacaacgucaucuacgacgacaacgggcucaagccggaccacaugcagcggcugacguucaagcugugccaccucuacuacaacuggcccggcaucgugagcgugcccgcccccugccaguacgcgcacaagcugaccuuccuggucgcccaguccauccacaaggagccgagccucgagcuggccaaccaccuguucuaccucuga

SEQ ID NO: 34632 - RNA, 1368 nt, Artificial Sequence
  derived and/or modified sequence opt1 from PJA1__Homo_sapiens__NP_071763
augggccaggagagcagcaagcccguguggcccaaccccaccggcggcuaccagagcaacaccgggcgccgguacggccgccggcacgccuacgucuccuuccgcccgcccacgagccagcgggagcgcaucgccucccagcggaagaccaacagcgaggugcccaugcaccgcuccgcgcccagccagaccaccaagcggucccgcagccccuucuccacgacccggcgcagcugggacgacuccgagagcuccgggaccaaccugaacaucgacaacgaggacuacagcuccaccagccgguggcgcgacacggccaacgacaacgagggccacuccgacggccucgcccggcgcgggcggggcgagagcagcuccggguaccccgagccgaaguaccccgaggacaagcgcgaggcccggagcgaccaggugaagcccgagaaggucccccgccggcgccgcaccauggccgacccggacuucuggacccacuccgacgacuacuacaaguacugcgacgaggacagcgacuccgacaaggaguggaucgcggcccugcggcgcaaguaccggagccgcgagcagacccuguccagcuccggcgagagcugggagacgcuccccgggaaggaggagcgggagccgccccaggccaagguguccgccagcaccggcaccucccccggccccggggcgagcgccuccgccggcgccggggccggcgcgagcgccggcuccaacgggagcaacuaccuggaggaggugcgcgagcccucccugcaggaggagcaggccagccucgaggagggcgagauccccuggcugcaguaccacgagaacgacagcuccagcgagggggacaacgacuccggccacgagcugaugcagccgggggucuucaugcucgacggcaacaacaaccuggaggacgacagcuccgugagcgaggaccuggagguggacuggucccucuucgacggcuucgccgacgggcugggcgucgccgaggcgaucagcuacguggacccccaguuccugaccuacauggcccucgaggagcggcuggcccaggccauggagacggcccuggcgcaccucgagucccuggccguggacgucgagguggccaacccgcccgccagcaaggaguccaucgacgcccugcccgagauccucgugaccgaggaccacggggcggucggccaggagaugugcugccccaucugcugcagcgaguacgugaagggggagguggccaccgagcugcccugccaccacuacuuccacaagcccugcgucuccaucuggcugcagaaguccgggaccugcccggugugccgcugcauguucccgccgccccucuga

SEQ ID NO: 34633 - RNA, 2127 nt, Artificial Sequence
  derived and/or modified sequence opt1 from PJA2__Homo_sapiens__NP_055634
augagccaguacaccgagaaggagcccgccgccauggaccaggaguccggcaaggcgguguggcccaagcccgccgggggcuaccagaccaucacggggcgccgguacggccgccggcacgccuacgucagcuucaagcccugcaugacccgccacgagcggucccuggggcgcgccggcgacgacuacgaggugcucgagcuggacgacgugcccaaggagaacagcuccggcagcuccccgcuggaccaggucgacagcucccuccccagcgagcccaucuucgagaaguccgagaccgagaucccgaccugcgggagcgcccugaaccagacgaccgaguccagccaguccuucguggcggugcaccacagcgaggagggccgggacacccugggguccagcaccaaccuccacaaccacuccgagggcgaguacauccccggggccugcagcgccagcuccguccagaacggcaucgcccuggugcacacggacagcuacgaccccgacggcaagcacggggaggacaacgaccaccuccagcuguccgcggagguggucgagggcagccgcuaccaggagucccuggggaacaccguguucgagcuggagaaccgggaggccgaggccuacaccggccucagcccgcccgugcccuccuucaacugcgagguccgcgacgaguucgaggagcuggacagcgugccccuggugaaguccagcgccggcgacaccgaguucguccaccagaacucccaggagauccagcggagcucccaggacgagauggugagcacgaagcagcagaacaacaccucccaggagcgccagaccgagcacagccccgaggacgccgcgugcgggcccggccacaucugcuccgagcagaacaccaacgaccgggagaagaaccacgggagcuccccggagcaggucgugcgccccaaggugcggaagcucaucagcagcucccagguggaccaggagacgggcuucaaccgccacgaggccaagcagcggagcguccagcgcuggcgggaggcccuggagguggaggaguccgggagcgacgaccugcucaucaagugcgaggaguacgacggcgagcacgacugcauguuccuggacccgcccuacucccgcgugaucacccagcgggagaccgagaacaaccagaugaccagcgaguccggcgccacggccgggcgccaggaggucgacaacaccuucuggaacggcugcggggacuacuaccagcuguacgacaaggacgaggacagcuccgagugcagcgacggcgagugguccgcgagccucccccaccgcuucuccgggaccgagaaggaccagagcuccagcgacgaguccugggagacccugcccggcaaggacgagaacgagcccgagcugcagagcgacagcuccggccccgaggaggagaaccaggagcucagccugcaggagggggagcagacgucccuggaggagggcgagaucccguggcuccaguacaacgaggugaacgagagcuccagcgacgaggggaacgagcccgccaacgaguucgcccagcccgccuucaugcuggacggcaacaacaaccuggaggacgacuccagcgucuccgaggaccucgacguggacuggagccuguucgacggguucgccgacggccugggcguggcggaggccaucuccuacgucgacccccaguuccucaccuacauggcccuggaggagcggcuggcccaggccauggagaccgcgcucgcccaccuggagagccuggccguggacguggaggucgccaacccgcccgcguccaaggagagcaucgacgggcuccccgagacccuggugcuggaggaccacacggccaucggccaggagcagugcugcccgaucugcugcuccgaguacaucaaggacgacaucgccaccgagcuccccugccaccacuucuuccacaagcccugcgugagcaucuggcugcagaaguccgggaccugccccgucugccgccggcacuucccgcccgccgugaucgaggccagcgcggcccccuccagcgagcccgacccggacgccccgcccagcaacgacuccaucgccgaggcccccuga

SEQ ID NO: 34634 - RNA, 12909 nt, Artificial Sequence
  derived and/or modified sequence opt1 from PKD1__Homo_sapiens__NP_000287
augccgcccgccgcccccgcccgccuggcccuggcccugggccuggggcucuggcugggcgcccuggccgggggccccgggcggggcugcggccccugcgagccgcccugccucugcgggcccgcccccggcgccgccugccgcgugaacugcuccgggcggggccugcgcacccuggggcccgcccuccggauccccgccgacgccaccgcccuggacgucucccacaaccugcuccgcgcccuggacgugggccugcucgccaaccugagcgcccuggccgagcucgacaucuccaacaacaagaucagcacccuggaggagggcaucuucgccaaccuguucaaccucuccgagaucaaccugagcgggaaccccuucgagugcgacugcggccuggccuggcucccccggugggccgaggagcagcagguccgcgucgugcagcccgaggccgcgaccugcgccgggcccggcucccuggccggccagccccugcucgggaucccccugcuggacagcggcugcggggaggaguacguggccugccucccggacaacuccagcggcaccgucgcggccguguccuucagcgccgcccacgaggggcugcugcagcccgaggccugcuccgcguucugcuucagcaccggccagggccucgccgcccuguccgagcagggguggugccugugcggcgccgcgcagcccagcuccgccagcuucgccugccucucccugugcagcgggcccccgccgccgcccgccccgaccugccggggccccacccugcuccagcacguguuccccgccagccccggggcgacccuggucggcccgcacggcccccuggccuccgggcagcucgccgccuuccacaucgccgcgccccugccggugaccgccacgcgcugggacuucggcgacgggagcgccgagguggacgccgccggccccgcggccucccaccgguacguccugcccgggcgcuaccacgugaccgccgugcucgcccugggcgcgggcagcgcccugcucgggaccgacguccagguggaggccgcccccgccgcgcuggagcuggugugcccguccagcguccaguccgacgagagccuggaccucuccauccagaaccggggcgggagcggccuggaggccgccuacuccaucguggcccugggcgaggagcccgcccgcgcggugcacccccucugccccagcgacaccgagaucuucccggggaacggccacugcuaccggcuggucguggagaaggccgccuggcugcaggcccaggagcagugccaggccugggcgggggccgcccucgccaugguggacucccccgcgguccagcgcuuccuggugagccgggucacgcgcucccuggacguguggaucggcuucagcaccgugcagggggucgaggugggccccgcgccccagggcgaggccuucucccucgagagcugccagaacuggcugccgggggagccccaccccgccaccgccgagcacugcgugcggcugggccccaccggguggugcaacacggaccucugcuccgcgccgcacagcuacgucugcgagcugcagcccggcgggcccgugcaggacgccgagaaccugcucgugggcgcccccagcggcgaccugcaggggccgcugacgccccuggcccagcaggacggccuguccgcgccccacgagcccgucgaggugaugguguucccggggcugcgccucagccgggaggcguuccugaccaccgccgaguucggcacgcaggagcugcgccgccccgcccagcuccggcugcaggucuaccgccugcucuccaccgccgggacccccgagaacggcagcgagccggagucccggagccccgacaaccgcacccagcuggcccccgcgugcaugcccggcgggcgguggugcccgggcgccaacaucugccugccccucgacgccuccugccacccccaggccugcgccaacgggugcacgagcggccccgggcugccgggcgcgcccuacgcccuguggcgcgaguuccucuucuccgugcccgccggcccgcccgcccaguacagcgugacccugcacgggcaggacguccugaugcuccccggcgaccugguggggcugcagcacgacgcgggccccggcgcccuccugcacugcucccccgcccccgggcaccccggcccccaggcccccuaccugagcgccaacgcguccagcuggcucccgcaccuccccgcccagcuggaggggaccugggccugccccgccugcgcccugcggcugcuggcggccaccgagcagcucacggugcugcugggccuccgccccaacccggggcugcggcugcccggccgcuacgagguccgggccgaggugggcaacggggugucccgccacaaccucagcugcuccuucgacgucgugagccccguggccggccugcgggucaucuaccccgccccgcgcgacgggcggcuguacgugcccaccaacggcagcgcgcucgugcugcaggucgacuccggggccaacgccaccgccaccgcgcgcuggcccggcggcagcguguccgcccgguucgagaacgugugcccggcccuggucgccacguucgugcccgggugccccugggagaccaacgacacccucuucagcguggucgcccugcccuggcuguccgagggcgagcacgugguggacgucgugguggagaacagcgcgucccgcgccaaccucagccugcgggucaccgccgaggagccgaucugcgggcugcgcgccacgcccucccccgaggcccgcgugcuccagggcgugcugguccgguacagccccgugguggaggcgggguccgacauggucuuccgcuggaccaucaacgacaagcagagccugaccuuccagaacgugguguucaacgucaucuaccaguccgccgccguguucaagcucagccugaccgccuccaaccacgugagcaacgucaccgugaacuacaacgucacgguggagcggaugaaccgcaugcagggccuccagguguccaccgucccggccgugcucagccccaacgcgacccuggcccugaccgccggcgugcucgucgacuccgccguggagguggcguuccuguggacguucggggacggcgagcaggcccugcaccaguuccagccgcccuacaacgagagcuucccgguccccgaccccagcguggcccaggugcucgucgagcacaacgugaugcacaccuacgccgcccccggggaguaccugcugaccgugcucgcguccaacgccuucgagaaccugacccagcaggucccggugagcgugcgggccucccugcccagcgucgccgugggcguguccgacggcguccucguggccgggcgccccgugacguucuacccccacccgcugcccagccccggcgggguccuguacaccugggacuucggcgacgggucccccgugcucacccagagccagccggcggccaaccacaccuacgccucccggggcacguaccacgugcgccuggaggucaacaacaccgugagcggcgccgccgcgcaggccgacgugcgggucuucgaggagcugcgcgggcucuccguggacaugagccuggccguggagcagggcgcccccgucgugguguccgccgcgguccagaccggggacaacaucaccuggacguucgacaugggcgacgggaccgugcugagcggccccgaggccaccguggagcacgucuaccuccgggcccagaacugcaccgugacggugggcgccgcgucccccgccgggcaccuggcccgcagccugcacguccugguguucgugcucgagguccugcggguggagccggccgccugcauccccacccagcccgacgcgcgccugaccgccuacgugaccggcaacccggcccacuaccucuucgacuggacguucggggacggcuccagcaacaccaccguccgggggugccccaccgugacgcacaacuucacccgcuccggcaccuucccccuggcccuggugcucagcagccgggucaaccgcgcccacuacuucaccuccaucugcguggagcccgaggucggcaacgugacgcugcagccggagcggcaguucgugcagcugggggacgaggcguggcucgucgccugcgccuggccgcccuuccccuaccgcuacaccugggacuucggcaccgaggaggccgccccgacccgggcgcgcgggcccgaggugacguucaucuaccgcgaccccggcagcuaccuggugaccgucaccgccuccaacaacaucagcgccgccaacgacuccgcgcugguggaggugcaggagcccguccucgugaccagcaucaaggugaacgggucccugggccuggagcuccagcagccguaccuguucagcgccgucggccgggggcgccccgccuccuaccugugggaccucggcgacgggggcuggcuggagggccccgaggugacccacgccuacaacagcacgggggacuucaccgugcgggucgccggcuggaacgaggugucccgcagcgaggcguggcugaacgugaccgucaagcggcgcgugcgggggcucguggucaacgccucccgcaccguggugccccugaacggcagcgucuccuucagcacgucccuggaggccgggagcgacgugcgguacuccugggugcucugcgaccgcugcaccccgauccccggcggccccaccaucagcuacaccuuccggagcgucgggacguucaacaucaucgugaccgccgagaacgaggugggcuccgcccaggacagcaucuucgucuacgugcugcagcugaucgaggggcuccagguggucggcgggggccgcuacuuccccaccaaccacaccgugcagcugcaggcggugguccgggacggcacgaacguguccuacagcuggaccgccuggcgcgaccgggggccggcccuggccggcuccgggaagggcuucagccucaccgugcuggaggccgggaccuaccacguccagcugcgcgcgacgaacaugcucggcuccgccugggccgacugcaccauggacuucguggagcccgugggcuggcugauggucgccgcgagccccaaccccgccgccgugaacaccuccgugacccugagcgccgagcucgccgggggcuccggggucguguacacguggagccuggaggagggccuguccugggagaccagcgagccguucaccacccacuccuuccccacgcccgggcuccaccuggugaccaugaccgcgggcaacccgcugggcagcgccaacgccaccgucgagguggacgugcagguccccguguccgggcucagcauccgggccuccgagcccggcgggagcuucgucgccgcgggcagcuccgugcccuucuggggccagcuggccacggggaccaacgugagcuggugcugggccgucccgggcggguccagcaagcgcggcccccacgugaccaugguguuccccgacgccgggaccuucuccauccggcugaacgccagcaacgcggucuccugggugagcgccacguacaaccucaccgccgaggagcccaucgugggccugguccugugggccuccagcaaggugguggccccgggccagcucguccacuuccagauccugcuggcggccggguccgccgugaccuuccgccuccaggugggcggggccaaccccgagguccugcccggcccccgcuucagccacuccuucccgcgggugggggaccacguggucagcgugcgcggcaagaaccacguguccugggcgcaggcccagguccggaucguggugcuggaggccgucagcggccuccaggugcccaacugcugcgagcccgggaucgccaccggcacggagcgcaacuucaccgcccgggugcagcgcgggucccgggucgcguacgccugguacuucagccugcagaaggugcagggcgacucccuggugauccucagcgggcgcgacgucaccuacacccccguggccgccggccugcuggagauccaggugcgggccuucaacgcgcucggcagcgagaaccgcacccugguccuggaggugcaggacgccgugcaguacgucgcccuccaguccgggccgugcuucacgaaccggagcgcccaguucgaggccgcgaccucccccagcccccgccggguggccuaccacugggacuucggcgacgggucccccggccaggacaccgacgagccgcgcgccgagcacagcuaccugcggcccggcgacuaccgcgugcaggucaacgccuccaaccuggugagcuucuucguggcgcaggccaccgucacgguccaggugcucgccugccgggagcccgaggucgacguggugcugccccugcagguccucaugcgccggucccagcgcaacuaccuggaggcccacguggaccugcgggacugcgugaccuaccagaccgaguaccgcugggaggucuaccgcaccgccagcugccagcggccggggcgccccgcgcggguggcccuccccggcgucgacgugucccgcccccggcuggugcugccgcgccucgcccugcccgucgggcacuacugcuucguguucguggucagcuucggcgacacgccccugacccaguccauccaggccaacgugaccguggccccggagcggcucguccccaucaucgagggcgggagcuaccgcgugugguccgacacccgggaccuggugcuggacggcagcgaguccuacgaccccaaccucgaggacggggaccagacgccccugagcuuccacugggcgugcgucgccagcacccagcgcgaggccggcgggugcgcccugaacuucggcccgcggggguccagcaccgugaccaucccccgcgagcggcucgccgcgggcguggaguacacguucucccugaccgucuggaaggccggccgcaaggaggaggccaccaaccagaccgugcugauccggagcgggcgcgugcccaucgucucccucgagugcgugagcugcaaggcccaggccguguacgaggucucccggagcuccuacguguaccuggagggccgcugccugaacugcagcuccgggagcaagcggggccgcugggcggcccgcacguucuccaacaagacccucgugcuggacgagaccaccacgagcaccggguccgccggcaugcggcugguccuccgccggggcgugcugcgcgacggggagggcuacaccuucacccugacggugcucgggcggagcggcgaggaggaggggugcgccuccauccgccugagccccaaccggccgccccugggcggcuccugccgccucuucccccugggggcgguccacgcccugaccaccaaggugcacuucgagugcaccggcuggcacgacgccgaggacgccggggcgccccugguguacgcgcuccugcugcggcgcugccggcagggccacugcgaggaguucugcgucuacaagggcagccucagcuccuacggggccgugcugccgcccggcuuccgcccccacuucgagguggggcuggccgucguggugcaggaccagcucggcgccgccgucguggcgcugaaccggagccuggccaucacgcuccccgagccgaacggguccgccaccggccugaccguguggcugcacggccucaccgccagcguccugcccgggcugcuccgccaggccgacccccagcacgugaucgaguacucccuggcgcuggugacgguccucaacgaguacgagcgggcccuggacguggccgccgagcccaagcacgagcgccagcaccgggcgcagauccgcaagaacaucaccgagacccuggugagccuccggguccacaccguggacgacauccagcagaucgccgccgcccuggcccagugcaugggcccgucccgcgagcuggugugccggagcugccucaagcagacgcugcacaagcuggaggcgaugaugcucauccugcaggccgagaccaccgccgggaccgucacccccacggccaucggcgacuccauccugaacaucaccggggaccucauccaccuggccagcuccgacgugcgcgcgccccagcccagcgagcugggcgccgaguccccgagccgcaugguggccucccaggccuacaaccucaccagcgcccugaugcggauccugaugcgcucccggguccucaacgaggagccccugacccuggcgggcgaggagaucguggcccaggggaagcgcagcgacccccggucccuccugugcuacggcggggcccccggcccggggugccacuucagcauccccgaggccuucagcggcgcgcuggccaaccucuccgacgucgugcagcugaucuuccugguggacagcaaccccuucccguucggcuacaucuccaacuacacggucagcaccaagguggccuccauggccuuccagacccaggccggggcgcagauccccaucgagcgccucgccagcgagcgggccaucaccgugaagguccccaacaacuccgacugggccgcccgcggccaccggagcuccgcgaacagcgccaacuccguggugguccagccccaggccagcgugggggccguggucacgcuggacuccagcaacccggccgcgggccugcaccuccagcugaacuacacccugcucgacggccacuaccuguccgaggagcccgagcccuaccuggccguguaccuccacagcgagccccgcccgaacgagcacaacugcuccgccagccggcgcauccggcccgagucccugcagggggccgaccaccgccccuacaccuucuucaucagccccggcagccgggacccggccggguccuaccaccugaaccucagcucccacuuccgcuggagcgcgcuccagguguccgucggccuguacaccagccucugccaguacuucuccgaggaggacaugguguggcggacggaggggcugcugccccucgaggagaccagcccccgccaggccgugugccugacccggcaccugaccgccuucggcgccucccucuucgugcccccgagccacgugcgcuucguguuccccgagcccacggcggacgucaacuacaucgugaugcugaccugcgccgugugccuggucaccuacauggugauggccgccauccuccacaagcuggaccagcuggacgccucccgcggccgggcgauccccuucugcgggcagcgcggccgguucaaguacgagauccucgugaagaccggguggggccgcgggagcggcacgaccgcccacgucggcaucaugcuguacgggguggacucccggagcggccaccgccaccuggacggggaccgggccuuccaccgcaacucccucgacaucuuccggaucgccaccccgcacagccugggcuccguguggaagauccgcgucuggcacgacaacaaggggcugagccccgccugguuccuccagcacgugaucgugcgggaccugcagaccgcgcgcuccgccuucuuccuggucaacgacuggcucagcguggagacggaggccaacggcggccugguggagaaggagguccuggccgccagcgacgcggcccuccugcgguuccgccggcugcucguggccgagcugcagcgcggguucuucgacaagcacaucuggcuguccaucugggaccggccgccccgcagccgguucacccgcauccagcgggcgaccugcugcgugcuccugaucugccuguuccucggcgcgaacgccgucugguacggggccgugggcgacuccgccuacagcaccgggcacgugucccgccugagcccgcuguccgucgacacgguggccgugggccucgucagcuccgugguggucuaccccguguaccuggcgauccuguuccuguuccgcaugagccgguccaagguggccggcagccccucccccaccccggccgggcagcagguccucgacaucgacagcugccuggacuccagcgugcuggacuccagcuuccucaccuucuccggccugcacgccgaggccuucgucgggcagaugaaguccgaccuguuccucgacgacagcaagucccuggugugcuggcccagcggcgagggcacccuguccuggcccgaccuccugagcgacccguccaucguggggagcaaccugcgccagcucgcgcggggccaggccgggcacggccuggggcccgaggaggacggcuucucccuggccagccccuacucccccgccaagagcuucuccgccagcgacgaggaccucauccagcagguccuggcggagggcguguccagcccggcccccacgcaggacacccacauggagaccgaccugcucuccagccuguccagcacccccggggagaagacggagacccuggcccuccagcgccugggcgagcuggggcccccgagccccggccucaacugggagcagccccaggccgcgcggcugucccgcaccgggcugguggagggccuccggaagcgccugcugcccgccuggugcgccagccucgcccacggccugucccugcuccuggucgccguggcgguggccgucagcgggugggugggcgccuccuucccgcccggggugagcgucgccuggcugcucuccagcuccgccagcuuccuggcguccuuccugggcugggagccccucaaggugcugcuggaggcccucuacuucagccugguggccaagcggcugcaccccgacgaggacgacacccucgucgaguccccggccgugacccccgugagcgcccgcgucccccgggugcgcccgccccacggguucgcgcuguuccuggccaaggaggaggcccggaaggugaagcgccuccacggcaugcugcggucccugcucgucuacaugcuguuccugcucgugacgcugcuggccagcuacggcgacgccuccugccacgggcacgcguaccgccuccagagcgccaucaagcaggagcugcacucccgggccuuccuggccaucacccgcagcgaggagcucuggcccuggauggcgcacgugcugcugcccuacguccacggcaaccagagcucccccgagcucgggccgccccggcugcgccaggugcgccugcaggaggcccucuaccccgacccgcccggcccccgggugcacacgugcagcgccgccggcggguucuccaccagcgacuacgacgucggcugggagagcccccacaacgggagcggcacgugggccuacuccgcgcccgaccugcugggggccuggagcuggggcuccugcgccguguacgacagcggcggguacgugcaggagcucggccugucccuggaggagagccgcgaccggcuccgcuuccugcagcugcacaacuggcucgacaaccggucccgcgccgucuuccuggagcugacccgguacagccccgccguggggcuccacgcggccgugacccugcgccuggaguuccccgccgccggccgggcccucgcggcccuguccguccgccccuucgcccugcggcgccucagcgccgggcugucccugccgcuccugaccagcgugugccugcuccuguucgcggugcacuucgccgucgccgaggcccggacguggcaccgcgagggccgguggcgcgugcugcggcucggcgccugggcgcgcuggcugcugguggcccugaccgccgccaccgcccucguccggcuggcgcagcugggggccgccgaccgccaguggacccgguucgugcgcggccgcccccggcgcuucacguccuucgaccagguggcccagcucagcagcgccgcgcgggggcuggccgccucccuccuguuccugcugcucgucaaggccgcccagcagcugcgcuucgugcggcaguggagcguguucggcaagacccugugccgcgcgcuccccgagcugcugggggucacccucggccugguggugcugggcgucgccuacgcccagcucgccauccugcugguguccagcugcguggacucccucuggagcgucgcgcaggcccugcuggugcucugccccgggaccggccuguccacgcugugcccggccgagagcuggcaccucagcccccugcugugcgucgggcucugggcccugcggcuguggggcgcccuccgccugggggcggugauccugcgguggcgcuaccacgcccuccggggcgagcuguaccgccccgccugggagccccaggacuacgagaugguggagcuguuccuccggcgccugcggcuguggaugggccucagcaaggucaaggaguuccgccacaaggugcgguucgaggggauggagccgcugcccucccgcagcucccggggcagcaaggugucccccgacgugcccccgcccagcgccggguccgacgccagccaccccuccaccagcagcucccagcuggacggccucagcgugucccugggccgccuggggacccgcugcgagcccgagcccagccggcuccaggcgguguucgaggcccugcugacccaguucgaccgccucaaccaggccacggaggacgucuaccagcuggagcagcagcugcacucccuccagggccggcgcagcucccgggcccccgccgggagcucccgcggccccagccccgggcugcggccggcgcugcccucccgccucgcccgggccagccgcggcguggaccuggccaccggccccucccggaccccgcugcgcgcgaagaacaaggugcaccccagcuccaccuga

SEQ ID NO: 34635 - RNA, 8550 nt, Artificial Sequence
  derived and/or modified sequence opt1 from PKD1L1__Homo_sapiens__NP_612152
auggccgaggaggccgcccagaacaucagcgacgaccaggagcgcugccugcaggccgccugcugccucagcuucggcggggagcugagcguguccaccgacaagagcuggggccugcaccucugcuccugcuccccgcccgggggcgggcugugggucgagguguacgccaaccacgugcugcucauguccgacgggaagugcggcugccccuggugcgcccugaacgggaaggcggaggaccgggagagccagucccccagcuccagcgccucccgccagaagaacaucuggaagaccaccagcgaggccgcccuguccgucgugaacgagaagacccaggcgguggucaacgagaagacccaggcgccccuggacugcgacaacagcgccgaccggaucccccacaagcccuucaucaucaucgcccgcgccugguccagcggcgggccccgguuccaccaccgccggcugugcgcgaccggcacggccgacuccaccuucagcgcccugcuccagcugcaggggaccaccagcgccgccgcgcccugcucccugaagauggaggccagcugcugcgugcuccgccugcugugcugcgccgaggacguggccacgggccuccugcccggcaccgucaccauggagacccccacgaagguggcccggcccacccagaccuccagccagcgcgugccccuguggcccaucucccacuuccccaccagcccccgguccagccacgggcugccgcccggcaucccccgcacgcccuccuucaccgcgagccaguccgggagcgagauccuguacccgcccacccagcacccgcccgucgccauccuggcccggaacuccgacaacuucaugaaccccgugcucaacugcagccuggagguggaggcccgcgccccgcccaaccugggcuuccggguccacauggcguccggcgaggcccucugccugaugauggacuucggggacagcuccggcguggagaugcgccugcacaacaugagcgaggccauggccgugaccgcguaccaccaguacuccaaggggaucuucuuccaccuccugcacuuccagcuggacaugagcacguacaaggaggccgagacccagaacaccacccucaacgucuaccugugccagagcgagaacuccugccuggaggacagcgaccccuccaaccucggcuacgagcugaucagcgccuucgugacgaaggggguguacaugcugaaggccgucaucuacaacgaguuccacggcaccgagguggagcucggccccuacuacguggagaucgggcacgaggccgucuccgcguucaugaacagcuccagcgugcacgaggacgagguccugguguucgccgacucccaggugaaccagaaguccaccgucgugauccaccacuucccguccauccccagcuacaacguguccuucaucagccagacccaggucggcgacucccaggccuggcacagcaugacggugugguacaagaugcaguccgugagcgucuacaccaacgggaccguguucgccaccgacacggacaucaccuucaccgccgugaccaaggagacgaucccccuggaguucgagugguacuucggcgaggacccgcccguccggaccaccagccgcuccaucaagaagcggcucagcaucccccagugguaccgcgugauggugaaggcguccaaccggaugagcuccgucgugagcgagccccacgugauccgcguccagaagaagaucguggccaaccgccugaccuccccgagcuccgcccuggugaacgccagcgucgccuucgagugcuggaucaacuucgggaccgacguggcguaccucugggacuucggcgacggcacggugucccuggggagcuccagcuccagccacgucuacucccgggagggcgaguucaccguggaggugcuggccuucaacaacgucagcgccuccacccuccgccagcagcuguucaucgugugcgagcccugccagccgccccucgugaagaacauggggccgggcaagguccagaucuggcggagccagcccgugcgccugggggugaccuucgaggccgcggucuucugcgacaucagccagggccucuccuacacguggaaccugauggacagcgagggccugcccgugucccuccccgccgccguggacacccaccggcagacccugauccugccgagccacacccucgaguacgggaacuacacggcccuggccaagguccagaucgagggcuccgugguguacagcaacuacugcgucgggcuggaggugcgcgcgcaggcccccguguccgucaucagcgagggcacccaccucuucuucucccggaccaccagcucccccaucgugcugcgcggcacgcagagcuucgaccccgacgacccgggggccacccugcgguaccacugggagugcgccaccgccggcucccccgcgcaccccugcuucgacagcuccaccgcccaccagcucgacgccgccgcccccacggugagcuucgaggcgcaguggcuguccgacagcuacgaccaguuccuggucaugcuccgcguguccagcgggggccggaacagcuccgagacccgcguguuccugagcccguaccccgacuccgccuuccgguucguccacaucagcuggguguccuucaaggacaccuucgugaacuggaacgacgagcugagccuccaggccaugugcgaggacugcuccgagauccccaaccugagcuacuccugggaccuguuccucgucaacgccaccgagaagaaccgcaucgaggugcccuucugccgggucguggggcugcugggcagccucggccugggggcgaucuccgagagcucccagcugaaccuccugcccacggagcccggcaccgccgaccccgacgccaccaccacgccguucagccgcgagcccucccccgugacccuggggcagcccgccaccagcgccccgcggggcacccccacggagcccaugaccggggucuacuggaucccgcccgcgggcgacuccgccgugcucggcgaggcccccgaggaggggagccuggaccuggagcccggcccccaguccaaggggagccucaugaccggccgcagcgagcggucccagccgacccacagccccgacccccaccuguccgacuucgaggccuacuacagcgacauccaggaggccauccccuccgggggccgccagccggcgaaggacacgagcuuccccggcuccgggcccagccuguccgccgaggagagccccggcgacggggacaaccucguggacccgucccugagcgccggccgcgccgagcccguccugaugaucgacuggcccaaggcccuccuggggcgggcgguguuccagggcuacuccagcuccggcaucaccgagcagaccgugaccaucaagcccuacagccuguccagcggggagacguacguccuccagguguccguggccagcaagcacggccugcuggggaaggcccagcucuaccugaccgucaacccggcgccccgcgacauggccugccaggugcagccccaccacggccuggaggcgcacaccguguucagcgucuucugcauguccggcaagcccgacuuccacuacgaguucagcuaccagaucgggaacaccuccaagcacacccucuaccacggccgggacacgcaguacuacuucgugcugccggccggggagcaccuggacaacuacaaggugauggucagcaccgagaucaccgacggcaagggguccaaggugcagcccugcaccguggucgugacggugcucccccgcuaccacggcaacgacugccugggcgaggaccuguacaacagcucccucaagaaccugagcacccugcagcucaugggguccuacaccgagauccggaacuacaucaccgucaucacgcgcauccugagccggcuguccaaggaggacaagaccgccagcugcaaccaguggucccgcauccaggacgcccucaucagcuccgugugccggcuggcguucguggaccaggaggagaugaucggcagcguccugaugcuccgcgaccugguguccuucagcaacaagcugggguucauguccgccgugcucauccugaaguacacccgggcccugcucgcccagggccaguucagcgggccguucgucaucgacaagggcgugcgccuggagcugaucggccucaucagccgggugugggaggucuccgagcaggagaacagcaaggaggagguguaccgccacgaggaggggaucaccgugaucuccgaccugcugcucggcugccugagccugaaccacgucuccacggggcagauggaguuccggacccuccugcacuacaaccugcagagcuccgugcagagccucggcuccgugcagguccaccuccccggggaccuggccggccacagccccgcgggcgccgagacccagucccccugcuacaucagccagcucauccuguucaagaagaacccguaccccgggucccaggcccccggccagaucgggggcguggugggccugaaccucuacacgugcagcucccgccggcccaucaaccgccaguggcugcggaagccggucaugguggaguucggggaggaggacggccuggacaaccgccggaacaagacgaccuucgugcuccugcgcgacaaggucaaccugcaccaguucaccgagcucagcgagaacccccaggagucccugcagaucgagaucgaguucagcaagcccgugacccgcgccuuccccgugaugcugcugguccgguucagcgagaagccgacgcccuccgacuuccucgugaagcagaucuacuucugggacgagagcaucgugcagaucuacauccccgccgcgucccagaaggacgccagcgucggguaccugucccugcucgacgccgacuacgaccgcaagcccccgaaccgguaccuggccaaggccgugaacuacaccguccacuuccaguggauccgcugccuguucugggacaagcgggaguggaaguccgagcgcuucagcccccagcccggcaccagccccgagaaggugaacugcuccuaccaccggcucgcggccuucgcccugcugcgccggaagcucaaggccagcuucgagguguccgacaucagcaagcugcagucccacccggagaaccugcuccccagcaucuucaucaugggguccgucauccuguacggcuuccugguggccaagagccgccagguggaccaccacgagaagaagaaggccggcuacaucuuccuccaggaggccucccugcccgggcaccagcuguacgccgucgugaucgacaccggcuuccgggcccccgcgcgccucacgagcaagguguacaucguccugugcggggacaacggccuguccgagaccaaggagcucagcugcccggagaagccccuguucgagcggaacagccgccacaccuucauccuguccgcccccgcccagcucgggcugcugcggaagauccgccucuggcacgacagccggggccccuccccgggcugguucaucagccacgugauggugaaggagcugcacaccgggcagggcugguucuuccccgcccagugcuggcuguccgccgggcgccacgacggccgggucgagcgcgagcucacgugccugcagggcgggcugggcuuccgcaagcuguucuacugcaaguucaccgaguaccuggaggacuuccacguguggcugagcguguacucccggcccagcuccagccgcuaccuccacaccccgcggcugaccgucuccuucagccugcucugcguguacgcgugccugacggcccugguggccgccgggggccaggagcagccccaccucgacgucucccccacccuggggagcuuccgcgugggccugcucugcacccugcuggccucccccggggcgcagcuccugagccuccuguuccggcuguccaaggaggccccgggcagcgcccgcguggagccccacagcccccugcggggcggggcccagaccgaggcgccccacggcccgaacuccugggggcgcauccccgacgcccaggagccccggaagcagcccgccagcgccauccucuccggcagcggccgcgcccagcggaaggcggccuccgacaacgggacggccugcccggcccccaagcugcagguccacggcgccgaccacagccgcaccucccugaugggcaagagccacugcugcccgccccacacccaggcgccguccagcggccucgaggggcugaugccccaguggucccgggcccugcagcccugguggagcuccgccgugugggccaucugcggcaccgccagccucgcgugcucccugggcaccggguuccuggccuaccgcuucggccaggagcagugcgugcaguggcuccaccuccugagccucuccgucgugugcugcaucuucaucacgcagccccugauggugugccugauggcccucggguucgccuggaagcggcgcgccgacaaccacuucuucaccgagagccugugcgaggcgacccgggaccuggacuccgagcucgccgagcgcagcuggacccggcugccguucuccagcagcugcuccauccccgacugcgccggcgaggucgagaaggugcuggccgcgcgccagcaggcccggcaccuccgcugggcccacccgcccagcaaggcccagcugcgcgggacgcggcagcgcaugcggcgcgagucccggacccgcgccgcgcugcgggacaucagcauggacauccucaugcugcugcuccugcugugcgugaucuacggccgcuucucccaggacgaguacagccucaaccaggccauccggaaggaguucacccgcaacgcccggaacugccugggcgggcugcgcaacaucgccgacuggugggacuggucccucaccacgcugcuggacggccucuaccccgggggcacccccagcgcccggguccccggggcgcagccgggcgcccugggcgggaagugcuaccugaucggcuccagcgugauccgccagcucaagguguucccccggcaccugugcaagccgccccgcccguucuccgcccugaucgaggacagcaucccgaccugcucccccgaggucgggggccccgagaacccguaccucaucgaccccgagaaccagaacgugacccugaacgggcccggcggcugcgggacgcgggaggacugcgugcugagccucggccgcacccggaccgaggcccacaccgcccugucccgccugcgcgcgagcauguggaucgaccgguccacgcgcgccgucagcgugcacuucacccuguacaacccgcccacccagcuguucaccuccgugagccugcgggucgagauccugcccacggggagccucgugcccuccagccugguggaguccuucagcaucuuccgcuccgacagcgcccugcaguaccaccucaugcugccccagcuggucuuccucgcccugucccugauccaccucugcgugcagcuguaccggaugauggacaagggcgugcugagcuacuggcgcaagccccggaacuggcucgagcuguccgucgugggcgugagccugaccuacuacgcggucuccgggcaccucgugacccuggccggcgacgugaccaaccaguuccaccgcgggcugugccgggccuucauggaccucacgcugauggccagcuggaaccagcgcgcccgguggcugcgcggcauccuccuguuccuguucacccucaagugcgucuaccugcccgggauccagaacaccauggcguccugcagcuccaugaugcggcacagccugcccuccaucuucguggccggccucgucggcgcccugaugcuggccgcccucagccaccuccaccgcuuccugcucuccaugugggugcugcccccggggaccuucacggacgcguuccccggccuccuguuccacuucccccggcgcagccagaaggacugccugcuggggcucagcaaguccgaccagcgggccauggccugcuacuucggcauccugcugaucgugagcgccacccucugcuucgggaugcugcgcggcuuccugaugacccucccccagaagcggaaguccuuccagagcaaguccuucguccgccugaaggacgugaccgccuacaugugggagaaggugcugacguuccuccggcuggagaccccgaagcuggaggaggcggagauggucgagaaccacaacuacuaccucgacgaguucgccaaccugcuggacgagcuccugaugaagaucaacggccugagcgacucccuccagcugccccugcucgagaagaccagcaacaacaccggggaggcccgcacggaggagagcccccugguggacaucagcuccuaccaggccgcggagcccgccgacaucaaggacuucuga

SEQ ID NO: 34636 - RNA, 2976 nt, Artificial Sequence
  derived and/or modified sequence opt1 from PKD1L2__Homo_sapiens__NP_001070248
augagcgccgugggccugguccuccuggugcuggcccuccgccugcgggcgaccaccgugaagcccgaggagggguccuucugcagcaacucccaggucgccuuccgcgacgccugcuacgaguucgugccccugggccggacguuccgcgacgcccagagcuggugcgaggggcagggcgggcaccucguguucauccaggacgagggcacccagugguuccugcagaagcacaucucccaggaccgggagugguggaucggccugaccuggaaccucgcccgcaacgggaccacggagggccccgggaccuggcuggacaccagcaacgucaccuacuccaacuggcacggcgggcaggcggccgccgcccccgacacgugcggccacaucggccgggggcccagcuccgagugggugaccagcgacugcgcgcagaccuucgccuucaugugcgaguuccgcgugggccagucccuggccugcgaggggcucaacgccaccguccacugcggccugggccaggugauccaggugcaggacgccgucuacgggcggcagaacccgcacuucugcacgcaggacgcgggccgccccagcgaccuggagcaggggugcuccugggccaacgugaaggaggagguggccggccagugccaggagcuccagagcugccaggucgccgccgacgagaccuacuucgggaaccugugccccacccagggcuccuaccugugggugcaguaccagugccgggaggcgcuccagcugauggugagcuccgagagcuucaucuucgacaacgucaccaucucccugacguggcuccugagccccuacaucggcaaccugagcugcaucaucuccaccggggacagccacaccuucgacccguacaacccgcccuccgugagcuccaacgugacccaccaguucacgagccccggcgaguucaccgucuucgccgagugcaccaccuccgaguggcacgugacggcccagcgccaggugaccguccgggacaagauggagacccucagcgugaccgccugcuccgggcugagccaguccggcgccgggccccugugccaggcggucuucggcgacccccucuggauccagguggagcuggacggcgggacgggcgugaccuacaccguccugcucggggacaucacccuggccgagagcacgacccagaagggcucccugcccuacaaccucauccuggaccgcgagacccagaagcugauggggcccggccggcaccgccucgagauccaggccaccggcaacacgaccaccagcaccaucucccggaacaucaccgugcaccugguggagcugcucagcgggcugcaggccuccugggccagcgaccaccuggagcucggccaggaccugcugaucacgaucucccucgcgcaggggaccccggaggagcugaccuucgaggucgccggccugaacgccaccuucagccacgagcaggucagcuucggcgagcccuucgggaucugccgccucgccgugcccguggagggcacguuccuggugaccaugcuggugcggaacgcguucuccaaccugagccucgagaucgggaacaucaccaucaccgcccccuccggccugcaggagccgagcgggaugaacgccgagggcaaguccaaggacaagggcgacauggaggucuacauccagcccgggcccuacguggaccccuucacgaccgugacccugggcuggccggacaacgacaaggagcuccgcuuccaguggagcugcggguccugcugggcccuguggagcuccugcgucgagcggcagcugcuccgcaccgaccagcgcgagcugguggugcccgccagcugccugcccccgcccgacuccgcggucacgcuccggcuggccgugcugcgcggccaggagcucgagaaccgggccgagcagugccuguacgugagcgcccccugggagcugcgcccccgggucuccugcgagcgcaacugccggccggugaacgccagcaaggacauccuccugcgcgugaccaugggggaggacucccccgucgcgauguucagcugguaccuggacaacacccccaccgagcaggccgagccccuccuggacgccugccggcugcgcggcuucuggccgcggucccucacgcugcugcagagcaacaccagcacccuccugcugaacuccagcuuccuccagucccgcggcgaggugauccggauccgcgccaccgcccugacgcggcacgcguacggggaggacaccuacgugaucagcaccgucccgccccgcgaggugcccgccugcaccaucgcccccgaggagggcacggugcugaccuccuucgccaucuucugcaacgcgagcaccgcccucgggccccuggaguucugcuucugccuggaguccggcagcugccuccacugcgggcccgagcccgcccugccguccgucuaccugccccucggcgaggagaacaacgacuucgugcugaccguggucaucagcgccacgaaccgggccggcgacacccagcagacccaggcgauggccaagguggcccugggggacacgugcguggaggacgucgccuuccaggccgcgguguccgagaagauccccaccgcccuccagggcgagggcgggcccgagcagcugcugcagcucgccaaggccgugagcuccaugcugaaccaggagcacgagagccagggguccggccagagccuguccaucgacguccgccagaaggugcgggagcacgugcucggcagccuguccgccgucaccaccgggcuggaggacgugcagcgcgugcaggagcucgcggagguccugcgcgaggugaccugccggagcaaggagcugacgccgagcgcccagggcuccugcaugggggacagcugggagggcgccccgcccgccgcgcacgugucccacgcccgcuga

SEQ ID NO: 34637 - RNA, 5199 nt, Artificial Sequence
  derived and/or modified sequence opt1 from PKD1L3__Homo_sapiens__NP_853514
auguucuucaagggcgggagcuggcuguggcucuacauccgcaccuccaucauccugggcagcgagcugaacucccccgccccgcacgggcagaacaacugcuaccagcucaaccgguuccagugcagcuucgaggaggcccagcacuacugccacgugcagcgcggcuuccuggcgcacaucuggaacaaggagguccaggaccugauccgggacuaccucgaggaggggaagaagugguggaucggccagaacgugaugccccugaagaagcaccaggacaacaaguaccccgccgacguggccgccaacgggccgcccaagccccuguccugcaccuaccucagccgcaacuucauccggaucuccagcaagggggacaagugccugcugaaguacuacuucaucugccagaccggcgacuuccucgacggggacgcccacuacgagcgcaacggcaacaacucccaccuguaccagcggcacaagaagaccaagcgcggggucgcgaucgcccgggacaagaugccgcccggccccggccaccuccccacgaccugccacuacccccuccccgcccaccugagcaagacccugugccacccgaucucccaguuccccagcgugcucuccagcaucaccucccaggugaccagcgccgcguccgagcccagcucccagccccugccggucaucacccagcugacgaugcccgugagcgugacccacgccgggcagagccucgccgagaccaccuccagccccaaggaggagggccaccccaacacguucaccuccuaccugcaggucagccugcagaaggccuccggccaggugaucgacgagaucgccggcaacuucagccgcgcggugcacggccuccaggcccugaacaagcugcaggaggccugcgaguuccuccagaagcugaccgcccugaccccgcgguucuccaagcccgcccaggucaaccucaucaacagccugaucuaccuguccgaggagcuccugcgcauccccuuccagaacaacaacagccugggguucaaggugcccccgacggugugccccuuccacucccucaacaacgucaccaaggcgggcgaggggagcuggcuggaguccaagcggcacaccgagcccguggaggacauccuggagaugagccucguggaguucggcaacaucggggaggccuuccuggagcagaaccagucccccgagagcuccgucacccugacgagcgccaacgccacccuccugcugucccgccagaacaucagcacccucccgcugagcuccuacacccugggccaccccgcccccgugcggcucggcuucccgagcgcgcuggcccugaaggagcugcucaacaagcaccccggggugaacguccagaucacgggccuggccuucaaccccuucaaggaccuggacaaccgcaacaucgugggguccaucggcagcgugcuccuguccgccaaccggaagcugcuccagguccacgaccugauggaggacaucgagaucaugcuguggcgcaacgugagccucgagacccaccccaccucccugaacaugagcacccaccagcugacgaucaccgucaacgugaccucccucgagaagucccugaucgugagcaucgacccggacagcccccugcucaugacccuguaccugggguuccaguaccagcccaacugcacgcacuuccaccucaacaucacccugcccaaggacaaggucuggcagaaggacgaggaguacaccugggugcugaacccggagcaccuccagcacggcaucggcaccuacuacaucacggccgugcuguccgagcggcaggagggggcgcagcagacccccagccuggucuccgugaucaccgccgugacccagugcuacuacugggagauccacaaccagaccuggagcuccgccggcugccaggucgggccccagagcacgauccuccgcacccagugccugugcaaccaccugaccuucuucgccagcgacuucuucguggugccccggaccgucaacguggaggacacgaucaagcuguuccugcgcgugaccaacaacccggucggcgugucccugcucgcgagccugcugggguucuacgugaucaccgucgugugggcccgcaagaaggaccaggccgacaugcagaaggugaaggucaccgugcucgccgacaacgaccccuccgcccaguuccacuaccugauccagguguacacgggcuaccggcgcagcgcggccaccaccgccaaggucgugaucacccuguacggcuccgaggggcggagcgagccccaccaccucugcgacccccagaagacgguguucgagcgcggcgggcuggacgucuuccugcucaccaccuggaccucccugggcaaccugcacagccuccggcuguggcacgacaacuccggcgugagcccguccugguacgugagccaggucaucgugugcgacauggccgugaagcgcaaguggcacuuccugugcaacugcuggcucgccgucgaccugggggacugcgagcuggaccggguguucauccccguguccaagcgcgagcuguucagcuuccggcaccuguucuccagcaugaucgucgagaaguucacgcaggacuaccuguggcucuccaucgcgacccgccaccccuggaaccaguucacccgggugcagcgccugagcugcugcaugacccugcuccugugcaacauggugaucaacgucauguucuggaagaucaacuccacgaccgccaagcgggacgagcagaugcgccccuucgccguggccuggagcgagcugcucgugagcauccacaccgccgucauccuguucccgaucaaccuggugaucggccgccucuucccccugaucgagccccaggagacccugccccucuucccgcccauccaggcguccugccugagcgacgccuccguggagccccugagcgccacgauggucguggaggagcucaaggagaccgugcgcuuccugcugcggcgcaacaccuaccuccuguccaagugcgagcagccgcccuggagcuccugggacaucaccaagcuggucaagcuccugagcucccuggugagcucccaccucgaggggcagggcugccaccagcagggggagcggcacugggcccgcgugguccccgagaaccaccaccacuucugcugcuaccugcaccgcgugcugcagcggcucaagagccaccugggcacgcugggccucacccaggggcaccaguccugcgacuuccuggacgcggccagccagcugcagaagcuccaggagcugcuggagacccacauccuccccaccgagcaggagccgucccgcgaggucacgagcuucgccauccuguccagcgaggagggcaagaagcccaucuccaacgggcugagcaaguggcucaccagcgugugcuggcugcugcucggcuucaccucccuggccagcgccuucuucaccgcgcuguacucccuggagcucagcaaggaccaggccacguccuggaugaucagcaucauccuguccgugcugcagaacaucuucaucagccagcccgucaaggugguguucuucaccuuccucuacucccugaugaugagccggaugccccgccugaacaaggagaacgagcagcagaccaagcggauccucgcccugcuggccaagugcuccagcuccgucccggggagccgcgacaagaacaaccccguguacguggcccccgcgaucaacucccccaccaagcacccggagcggacccucaagaagaagaagcuguucaagcugacgggcgacauccucguccagauccuguuccugacccuccugaugaccgccaucuacagcgccaagaacuccaaccgcuucuaccugcaccaggccaucuggaagaccuucagccaccaguucuccgagaucaagcuccugcaggacuucuaccccugggccaaccacauccugcuccccagccuguacggcgacuaccgggggaagaacgcggugcuggagcccagccacugcaagugcggcgugcagcucaucuuccagaucccgcgcacgaagaccuacgagaaggucgacgaggggcagcuggccuucugcgacaacggccacacgugcgggcggcccaagucccuguuccccggccuccaccuccggcgguucagcuacaucugcagcccccgcccgauggugcugauccccaccgacgagcuccacgagcggcugacgagcaagaacgagaacggcuucuccuacaucaugcgcggggccuucuucaccagccugcggcucgaguccuucaccagccugcagauguccaagaagggcugcguguggagcaucaucucccaggucaucuacuaccugcucgugugcuacuacgccuucauccaggggugccagcugaagcagcagaaguggcgcuucuucaccggcaagcggaacauccuggacacgagcaucauccucaucuccuucauccugcuggggcucgacaugaaguccaucucccugcacaagaagaacauggcgcgcuaccgggacgaccaggaccgcuucaucagcuucuacgaggccgugaaggucaacuccgccgccacccaccuggugggcuuccccgugcuccuggccaccguccagcuguggaaccuccugcgccacagcccccggcugcgcgugaucucccggacccucagccgcgcgugggacgagguggucggcuuccugcugaucauccucauccugcugacgggguacgccaucgccuucaaccuccuguucggcugcagcaucuccgacuaccggaccuucuucagcuccgccgugaccguggucgggcugcucaugggcaucagccaccaggaggagguguucgcccuggacccggugcugggcaccuuccucauccugacguccgucauccugauggugcucguggucaucaaccuguucgugagcgcgauccugauggccuucgggaaggagcgcaagucccucaagaaggaggccgcccugaucgacacccugcuccagaagcugagcaaccugcucggcaucuccuggccccagaagaccagcuccgagcaggccgcgaccacggccguggggagcgacaccgagguccuggacgagcugcccuga

SEQ ID NO: 34638 - RNA, 2907 nt, Artificial Sequence
  derived and/or modified sequence opt1 from PKD2__Homo_sapiens__NP_000288
auggugaacagcucccgcguccagccccagcagccgggcgacgccaagcggccgcccgcgccccgcgcgcccgaccccgggcggcugauggccggcugcgccgccgugggggccagccucgcggcccccggcgggcugugcgagcagcgcggccuggagaucgagaugcagcggauccgccaggccgccgcgcgggacccgcccgccggcgccgccgccucccccagcccgccccuguccagcugcucccgccaggcguggagccgggacaaccccggguucgaggccgaggaggaggaggaggagguggagggcgaggagggcgggauggucguggagauggacguggaguggcgccccgggucccggcgcagcgccgccuccagcgccgucuccagcgugggcgcgcggucccgcggccucgggggcuaccacggggccggccaccccagcggccggcgccggcgccgggaggaccaggggcccccgugccccucccccgugggcgggggcgacccccugcaccgccaccucccgcuggaggggcagccgccccgggucgccugggccgagcgccuggugcgcggccuccggggccugugggggacccgccugauggaggagagcuccaccaaccgggagaaguaccucaagagcgugcugcgcgagcuggucacguaccuccuguuccugaucgugcucugcauccugaccuacggcaugaugagcuccaacguguacuacuacacccggaugaugagccagcuguuccucgacacccccgucuccaagacggagaagaccaacuucaagacccugagcuccauggaggacuucuggaaguucaccgaggggagccugcucgacggccuguacuggaagaugcagcccuccaaccagacggaggccgacaaccgcagcuucaucuucuacgagaaccugcuccugggggugccccggauccgccagcugcgggugcgcaacggcuccugcagcaucccccaggaccuccgggacgagaucaaggagugcuacgacgucuacuccgugagcuccgaggaccgcgcgcccuucggcccgcggaacgggaccgccuggaucuacaccagcgagaaggaccugaacggcuccagccacugggggaucaucgccaccuacuccggcgccggguacuaccuggaccucagccgcacgcgggaggagaccgccgcccagguggccucccugaagaagaacgucuggcuggaccgcggcacccgggccaccuucaucgacuucagcguguacaacgccaacaucaaccucuucugcgugguccgccugcugguggaguuccccgcgacgggcggggucauccccagcuggcaguuccagccgcucaagcugauccgguacgugaccaccuucgacuucuuccuggccgccugcgagaucaucuucugcuucuucaucuucuacuacguggucgaggagauccucgagauccgcauccacaagcugcacuacuuccgcuccuucuggaacugccuggacguggugaucgucgugcucagcguggucgccaucggcaucaacaucuaccggaccuccaacguggaggugcugcugcaguuccucgaggaccagaacacguuccccaacuucgagcaccuggccuacuggcagauccaguucaacaacaucgcggccgucaccguguucuucguguggaucaagcuguucaaguucaucaacuucaaccgcaccaugagccagcuguccaccacgaugagccggugcgccaaggaccucuucggguucgccaucauguucuucaucaucuuccuggccuacgcgcagcuggccuaccucgucuucggcacccagguggacgacuucuccaccuuccaggagugcaucuucacccaguuccgcaucauccugggcgacaucaacuucgccgagaucgaggaggccaaccgggugcuggggcccaucuacuucacgaccuucgucuucuucauguucuucauccuccugaacauguuccuggccaucaucaacgacaccuacagcgaggugaaguccgaccucgcgcagcagaaggccgagauggagcugagcgaccugauccgcaagggcuaccacaaggcccucgugaagcugaagcugaagaagaacaccgucgacgacaucuccgagagccuccggcagggcggcgggaagcugaacuucgacgagcugcgccaggaccucaaggggaagggccacacggacgccgagaucgaggcgaucuucaccaaguacgaccaggacggggaccaggagcugaccgagcacgagcaccagcagaugcgggacgaccuggagaaggagcgcgaggaccucgaccuggaccacuccagccugccccggccgauguccagccgcuccuucccccggagccucgacgacagcgaggaggacgacgacgaggacuccggccacagcucccgccggcgcgggagcaucuccagcggcguguccuacgaggaguuccaggugcugguccggcgcguggaccggauggagcacagcaucggguccaucgugagcaagaucgacgccgucaucgugaagcuggagaucauggagcgcgccaagcucaagcggcgcgaggugcugggccgccugcucgacggcgucgccgaggacgagcggcuggggcgcgacuccgagauccaccgggagcagauggagcgccuggugcgggaggagcucgagcgcugggagagcgacgacgccgcgucccagaucagccacggccuggggacccccgugggccugaacgggcagccccggccgcgcuccagccggcccuccagcucccagagcacggagggcauggagggcgccgggggcaacgggagcuccaacguccacguguga

SEQ ID NO: 34639 - RNA, 2277 nt, Artificial Sequence
  derived and/or modified sequence opt1 from PKD2L1__Homo_sapiens__NP_001240766
augaacccccgccggcgccacaccggcccgcggugccccgccgccgcgagcaucuccgugaaggccagcgaggccucccugcccugcccccucgggcuguggggcaccacgcugaccgagaacaccgccgagaaccgcgagcucuacaucaagaccacgcugcgggagcugcucgucuacaucguguuccugguggacaucugccugcucaccuacgggaugaccagcuccagcgccuacuacuacaccaaggucauguccgagcuguuccugcacacgccgagcgacaccggcguguccuuccaggcgaucagcuccauggccgacuucugggacuucgcccaggggccccuccuggacagccuguacuggaccaagugguacaacaaccagucccucggccacggcagccacuccuucaucuacuacgagaacaugcugcugggggugccccgccuccggcagcugaagguccgcaacgacagcugcguggugcacgaggacuuccgggaggacauccuguccugcuacgacgucuacagccccgacaaggaggagcagcucccguucggccccuucaacgggaccgccuggacguaccacucccaggacgagcugggcggguucagccacuggggccgccugaccagcuacuccggcgggggcuacuaccucgaccugcccgggagccggcagggcuccgcggaggcccugcgcgcccuccaggagggccuguggcuggaccgggggacccgcgugguguucaucgacuucagcgucuacaacgccaacaucaaccucuucugcgugcugcggcugguggucgaguuccccgccaccggcggggcgaucccguccuggcagauccgcacggugaagcucauccgguacgugagcaacugggacuucuucaucgucggcugcgaggugaucuucugcguguucaucuucuacuacgucguggaggagauccuggagcugcacauccaccgccuccgguaccuguccagcaucuggaacauccuggaccucguggucauccugcuguccaucguggccgucggguuccacaucuuccgcacccucgaggugaaccggcugaugggcaagcugcuccagcagcccaacaccuacgccgacuucgaguuccuggccuucuggcagacccaguacaacaacaugaacgccgugaaccuguucuucgcguggaucaagaucuucaaguacaucagcuucaacaagacgaugacccagcucuccagcacccuggcccgcugcgccaaggacauccugggcuucgccgucauguucuucaucguguucuucgccuacgcgcagcugggguaccuccuguucggcacccagguggagaacuucuccacguucaucaagugcaucuucacccaguuccgcaucauccugggggacuucgacuacaacgccaucgacaacgccaaccggauccucggccccgccuacuucgucaccuacguguucuucguguucuucguccugcugaacauguuccucgccaucaucaacgacaccuacagcgaggugaaggaggagcuggcggggcagaaggacgagcugcagcucuccgaccugcugaagcagggcuacaacaagacgcuccugcgccugcggcuccgcaaggagcgggugagcgacguccagaaggugcugcagggcggggagcaggagauccaguucgaggacuucaccaacacccugcgcgagcucggccacgccgagcacgagaucaccgagcugacggccaccuucaccaaguucgaccgggacgggaaccgcauccuggacgagaaggagcaggagaagaugcggcaggaccucgaggaggagcgcguggcccugaacaccgagaucgagaagcugggccgguccaucgucagcagcccccaggggaaguccggcccggaggcggcccgcgccggcgggugggugagcggcgaggaguucuacaugcucacgcggcgcgugcugcagcuggagaccguccucgaggggguggugucccagaucgacgccgucggcagcaagcugaagaugcuggagcggaagggcuggcucgcccccucccccggggugaaggagcaggcgaucuggaagcacccccagccggcccccgccgugacccccgaccccuggggcguccagggcgggcaggagagcgaggugccguacaagcgcgaggaggaggcccuggaggagcggcgccugucccgcggggagauccccacccuccagcggagcuga

SEQ ID NO: 34640 - RNA, 1482 nt, Artificial Sequence
  derived and/or modified sequence opt1 from PKDCC__Homo_sapiens__NP_612379
augcgccggcgccgggccgccguggcggccggcuucugcgccagcuuccugcucggguccguccugaacgugcuguucgcccccggcagcgagccgccccgccccgggcagucccccgagccgagccccgcccccggccccgggcggcgcggcggccgcggggagcucgcgcgccagauccgggcccgcuacgaggaggugcagcgguacucccgcggcgggccgggccccggggccggccggcccgagcgccggcgccugauggaccuggcccccggcgggccgggccucccccggccccggcccccgugggcgcggccccugagcgacggggcccccggcuggcccccggcccccggccccgggucccccggcccggggccccgccugggcugcgccgcccuccggaacgucagcggggcgcaguacaugggcuccggcuacaccaaggccguguaccgcgugcgccugcccgggggcgccgccgucgcccugaaggcgguggacuucagcgggcacgaccucggcuccugcgugcgggaguucgggguccgccggggcugcuaccgccuggccgcccacaagcugcucaaggagauggugcugcuggagcggcuccgccaccccaacgugcugcagcuguacggcuacugcuaccaggacagcgaggacaucccggacacccucacgaccaucaccgagcugggggcccccgucgagaugauccagcugcuccagaccuccugggaggaccgguuccgcaucugccugagccugggccggcuccugcaccaccuggcccacagcccccucggguccgugacgcugcuggacuuccgcccgcggcaguucgugcucgucgacggcgagcugaaggugaccgaccuggacgacgcgcgcguggaggagacccccugcgccggguccaccgacugcauccucgaguuccccgcccggaacuucacgcugcccugcagcgcccagggcuggugcgagggcaugaacgagaagcgcaaccuguacaacgccuaccgguucuucuucaccuaccuccugccgcacuccgcgccgcccagccugcgcccccuccuggacagcaucgucaacgccaccggggagcuggccuggggcguggacgagacccucgcccagcuggagaaggugcugcaccucuaccgguccgggcaguaccugcagaacagcacggcguccagcuccaccgaguaccagugcauccccgacagcaccaucccccaggaggacuaccgcugcuggcccuccuaccaccacggcagcugccugcuguccgucuucaaccucgccgaggccguggacgugugcgagagccacgcccagugccgggccuucgucgugaccaaccagacgaccuggaccggccgccagcuggucuucuucaagaccggguggucccagguggugcccgacccgaacaagacgaccuacgucaaggcgagcggcuga

SEQ ID NO: 34641 - RNA, 6762 nt, Artificial Sequence
  derived and/or modified sequence opt1 from PKDREJ__Homo_sapiens__NP_006062
augcgccccggccccgcccuccuccugcugggggugggccucagccuguccguggggcggcugccccugccgcccgugccccgcggcgcccaggcggccgugagcggggcccccggcggccugcugcgcggggcgcccggccucgggguccgcggcgggcgggcccugcugucccuccgccccagcgcggugcgggccggcggcgccgugcuguccgggcgcggcagccugugcuucccgcacgggggcaccggccggcgcugguacugccucgaccugcggguccugcucuccgcccagcgccugcccuggcccgcggcccccgcccuggcccucguggaccugcagcugagcgcccgcgggggccggcucucccugaccuggagcgugcggcugccgcgcucccccgggcggcucgcgugggccuuccgccugcggcugcucggccccggggccgcccgccccgccagcccggcggcccgggucagcccccggagcgccgcccccggcccccgcccgcagcagggcuucguggcccggaccgagugccccaccgacgggcccgcgcgcgugaugcugcaggccgucaacuccagcucccaccgggccguggagagcuccgugagcugccagaucaacgccugcgucauccagcgcgugcggaucaacaccgaccagaagggcgcccccgugcgccugagcaugcaggcggaggccaccaucaacgccuccguccagcucgacugcccggccgcgcgggccaucgcccaguacuggcaggucuucagcgugcccgccgucgggcaggcccccgacuggacgcagccccuggaccugccgcagcucgagauccgcaacagcccccucuucauccacauccccaacaacucccugcaguggggcguguacguguucaacuucaccgucuccaucaccaccgggaacccgaagaugcccgaggugaaggacagcgacgcggucuacguguggaucgugcgguccagccuccaggccgucaugcugggcgacgccaacaucacggccaacuucaccgagcagcugauccucgacggcuccaccagcuccgaccccgacgccgacagcccccugcaggggcugcaguucuucugguacugcaccacggacccgcgcaacuacggcggggaccggaucauccucggcuccaaggaggugugccaccccgagcaggcgaaccugaaguggcccugggccagcgggcccgugcugacccuccugccggagacccugaagggcgaccacgucuacuucuuccgcauggugauccggaaggacucccgcaccgccuucagcgacaagcgggugcacguccugcagggccccaaggccaucgcccacaucacgugcaucgagaacugcgagcgcaacuucaucguguccgaccgguucagccucuuccugaacugcaccaacugcgcgucccgcgacuucuacaaguggagcauccugagcuccagcgggggcgagaugcuguucgacuggaugggggagaccgugaccggccggaacggcgccuaccuguccaucaaggccuucgccuuccgccacuuccuggaggcggaguucagcaucucccucuaccuggccugcuggagcggggucacguccguguuccgccacagcuucaucaucaaccacggcccccagaucggggagugcaagaucaaccccgccaagggcaucgcccugaucaccaaguucgugguccagugcuccaacuuccgggacaagcacgugccgcucaccuacaagaucaucgugagcgaccugcacuccgucggggagaucagcuccgugaaggagaacacccugggcacgauccucuaccugggcccccagagcaccgugccgcccuccuuccugccggucgggaugcucgccagccaguacggccugaagaucuacgcccagguguacgacucccugggggccuucagccaggugacccuccacgccaccgcccaggcccccacggacaagaacagcuccaagaccguccugaaccagcugcucagcuucaccgugggccccuccagccugcuguccacccucauccagaagaaggacuuccugcccgcgggguaccugcucuacaucguggccagcguccugaacaacaugaagacggagcugccgcuccgcgacgaccgggugaaccugcgcaagcaccugaucgaccaguccuuccuccugcccgugagcacccuggucgagaucggccagguggugaugaccaucaccaagcucacgcagaagcccuccgaguucaccugggacgcccagaagcgggccaccaugcgcgucuggcaggccaaccaggcgcugcaggaguaccagcagaaggacaagcgguuccgcagcgagcagaucgagaucguguccaccggcauccugaugagccucuccaacauccugaagaugaccagcccccaccagguggucaaggacccguucuacgugaucgagucccugagcgacacgauccucgccaacaaggugcccgggaacaagaccaccuccaugcggacccccaacuucaacauguacgucaagaagguggagaaguggggcaucaaccagcuguuccgcaacgagaagcacugccggaacugcuucuacccgacgcugaacgugagcuccguccccgggcucagcgccaacggccccaucagcaccauguucugcgacuucaccaacgaccuguuccccuggcugaacgaccaggagaacaccuccguggaggugagcggguuccgcaugacgggcgucgccgacaacggcuccgugcucgagaucaccccggacguggcggaggucuaccuggugcggaagaaccugaccuucgccgccuucaaccucaccguggggcccaacagcgaggucgacggcucccugaagaagacgaccgggggcuucagcuuccagguggacuccaccguccugcgcgaggugcucgugcacaucgucaccgaggugauggugcuguucacgguccugguguacaccgggagccagaucacccccaccgcccucguggccacguuccuggucccccacgacaucccgcccuucgcgucccagagcgcccuguucgaccccgccugcaccgugaagaaggcccggguggucugccuccccgugucccugcugcagcucaucgcccagcacagccacuccccgcacugcaccgugagcaucguccugcaggcgccccgcuucgugaugaagcugaacgacaagcucgugcggaucuccaucuucagcguccagugccuggacauguacggcauccaguccgaguggcgcgagggcuacugcauccugggggagaagaccagcugguacgaggugcacugcaucugcaagaacgugguccgggcccgccggcagcucggcacgaucgggcugaccggcauccaccuccacacccacuacgugauggccaaggugaucgucauccccaaccccguggaccuccgccugaacaucaucaagucccugcaccagaacccggugacccucuucacgguccuguucaucauccugcucuacgugggccuggccuucugggcccuguaccgcgacgagauggaccagcaccuccgggggcacgugaucguccugcccgacaacgaccccuacgacaaccugugcuaccucgugaccaucuucaccggcagccgcugggggagcggcacccgggcgaacguguucguccagcugcgcgggacgguguccaccagcgacgugcacugccugucccacccccacuucaccacccucuaccggggcagcaucaacacguuccugcugaccaccaaguccgaccucggcgacauccacagcauccgcgucuggcacaacaacgaggggcgguccccgagcugguaccugucccgcaucaagguggagaaccuguucagccggcacaucuggcuguucaucugccagaaguggcuguccguggacaccacccuggaccgcacguuccacgucacccaccccgacgagcggcugacccgcaaggacuucuucuucaucgacgugagcuccaaccuccggaagaaccacaugugguucagcaucuucgccuccguggucgccaagaccuucaaccgccugcagcggcugagcugcugccucgccaugcugcuguccagccuccugugcaacaucauguucuucaaccugaaccgccaggagcagacggagucccgggagcgcaaguacaugcggagcaugaugaucggcaucgagagcgugcucaucaccauccccgugcagcugcugaucaccuuccucuucacgugcucccagcgcaagccccaggccgaccugaaggaggucagcccgcagaagcacccccugauguccgaggcgagcgagcacugggaggaguaccuccgcaaguggcacgccuacgagacggccaaggugcacccccgggagguggccaagcccgcguccaaggggaagccgcgccugcccaaggccagccccaaggccaccuccaagccgaagcaccggcaccgcaaggcccagaucaagacccccgagacccugggccccaacacgaacagcaacaacaacaucgaggacgaccaggacguccacuccgagcagcaccccagccagaaggaccuccagcagcugaagaagaagccgcggaucgugcugcccugguggugcguguacgucgccugguuccucguguucgcgaccuccagcaucuccagcuucuucaucgucuucuacgggcugaccuacggcuacgacaaguccaucgaguggcuguucgccagcuucugcuccuucugccagagcgugcuccuggugcagcccuccaagaucauccugcucagcggcuuccgcaccaacaagcccaaguacugcaagaaccugagcugguccacgaaguacaaguacaccgagauccggcuggacgggaugcgcaugcacccggaggagaugcagcggauccacgaccagaucguccgcauccggggcacccgcauguaccagccccucaccgaggacgagauccggaucuucaagcgcaagaagcggaucaagcgccgggcccugcuguuccucagcuacauccugacgcacuucaucuuccuggcccuccugcugauccucaucgugcugcugcgccacaccgacugcuucuacuacaaccaguucauccgggaccgcuucuccauggaccucgccaccgugaccaagcuggaggacaucuaccgguggcugaacagcguccuccugccccugcuccacaacgaccugaaccccacguuccugccggaguccagcuccaagauccucgggcugccccugaugcgccaggugcgcgcgaaguccuccgagaagaugugccuccccgccgagaaguucgugcagaacagcauccggcgcgagauccacugccaccccaaguacggcaucgacccggaggacaccaagaacuacuccggguucuggaacgaggucgacaagcaggccaucgacgagagcaccaacggcuucaccuacaagccccagggcacgcaguggcuguacuacuccuacgggcugcuccacaccuacggcagcgggggcuacgcccuguacuucuuccccgagcagcagcgguucaacuccacccugcgccucaaggagcugcaggagagcaacuggcuggacgagaagaccugggccguggugcucgagcugacgaccuucaaccccgacaucaaccuguucugcuccaucagcgucaucuucgaggugucccagcucggcguggucaacaccagcaucagccugcacuccuucagccuggcggacuucgaccggaaggccuccgccgagaucuaccucuacguggccauccugaucuucuuccuggcguacguggucgacgaggggugcaucaucaugcaggagcgcgccagcuacgugcgguccguguacaaccuccugaacuucgcccugaagugcaucuucaccguccucaucgugcuguuccugcgcaagcacuuccucgccacgggcaucauccgguucuaccugagcaacccggaggacuucauccccuuccacgccgugucccaggucgaccacaucaugcgcaucauccugggguuccuccuguuccugaccauccucaagacccugcgguacagccgcuucuucuacgacgugcggcuggcgcagcgcgccauccaggccgcccuccccggcaucugccacauggccuucguggucuccguguacuucuucguguacauggcguucggguaccuggucuucggccagcacgaguggaacuacagcaaccugauccacuccacccagaccguguucagcuacugcguguccgccuuccagaacacggaguucagcaacaaccggauccucggcguccuguuccuguccagcuucaugcucgugaugaucugcgugcugaucaaccuguuccaggccgucauccucuccgccuacgaggagaugaagcagcccguguacgaggagccgagcgacgagguggaggccaugaccuaccugugccgcaagcugcggaccauguucagcuuccucaccucccagagcaaggcgaaggacgagcccgaguucuucaucgacaugcuguacgggcagcccgagaagaacucccaccgcuaccugggccugaagacgcggaacaucaacgggaagaagauggucuaccucgugguguga

SEQ ID NO: 34642 - RNA, 10191 nt, Artificial Sequence
  derived and/or modified sequence opt1 from PKHD1__Homo_sapiens__NP_733842
augaccgcguggcugaucagccucauguccaucgaggugcugcugcucgccgugcgccaccugagccugcacaucgagcccgaggagggcucccucgccggcgggaccuggaucaccgugaucuucgacgggcuggagcugggcgugcucuaccccaacaacgggagccagcuggagauccaccuggugaacgugaacaugguggugcccgcccuccgguccgugcccugcgacguguuccccgucuuccuggaccugcccguggugaccugccgcacccggagcguccucuccgaggcccacgagggccuguacuuccuggaggccuacuucggcgggcagcucgugagcucccccaaccccggcccccgcgacagcugcaccuucaaguucuccaaggcccagacccccaucgugcaccaggucuacccgcccagcggggugcccggcaagcugauccacguguacggguggaucaucaccggccggcuggagaccuucgacuucgacgcggaguacaucgacucccccgucauccucgaggcccagggcgacaagugggugacccccugcagccugaucaaccgccagaugggguccugcuaccccauccaggaggaccacggccuggggacccuccagugccacguggagggcgacuacaucggcagccagaacgucuccuucagcguguucaacaaggggaaguccauggugcacaagaaggccuggcugaucagcgccaagcaggaccuguuccucuaccagacccacagcgagauccuguccgucuuccccgagaccggcagccucggcgggcggaccaacaucaccaucaccggggacuucuucgacaacuccgcgcaggucaccaucgccgggauccccugcgacauccgccacgucagcccccggaagaucgagugcaccacgcgcgcccccggcaaggacgugcggcucaccacgccccagccggggaaccgcggccugcuguucgaggugggggacgccgucgagggccucgagcugaccgaggccacgcccggguaccgguggcagaucgugcccaacgcguccagccccuucggcuucuggucccaggagggccagccguuccgcgcccggcugagcggguucuucguggcccccgagaccaacaacuacaccuucuggauccaggccgacucccaggccagccuccacuucuccuggagcgaggagccccgcaccaaggucaagguggcguccaucagcgugggcacggccgacugguucgacuccugggagcagaaccgggacgaggggaccuggcagcagaagacccccaagcuggagcugcucggcggggccauguacuaccuggaggccgagcaccacggcaucgccccgagccgcggcaugcggaucgggguccagauccacaacaccuggcugaaccccgacguggugacgaccuaccuccgcgagaagcaccagauccggguccgcgcgcagcgccugcccgagguccaggugcugaacgucuccggccgggggaacuucuuccucaccugggacaacgugagcucccagccgauccccgccaacgccaccgcccaccugauccagacgaccaucgaggagcugcucgccgugaagugcaagcuggagccccuguggagcaacauccugcuccgccugggcuucgagcggggccccgaggucagcaacuccgacggggaccugaccagcggcaccgagccguucugcgggcgcuucucccuccggcagccccgccaccuggugcugacgccgcccgcggcccagaagggcuaccggcucgaccaguacacccaccugugccuggccuacaaggggcacaugaacaagauccucaagaugaucgugagcuucaccaucggcuuccagaacauggucaagaacacgaccugcgacuggucccugacgcgcaccagcccggaguccuggcaguucgacugcaccgaccugugggagaccugcgugcggugcuucggcgaccuccagccgccgcccgccaacagcccggugcugguccaccagaucaaccugcucccccuggcgcaggagacggggcuguucuacguggacgagaucaucaucgccgacaccaacgugaccgucucccaggccgacagcggcaccgcccgccccgggggcaaccucguggaguccgugagcgucguggggagcccgcccguguacagcgucacguccuggcuggccggcugcggcaccgagcugccccucaucaccgcgcggagcgugcccaccgaggggacggaggagggcuccgggcuggugcuggucaccacccagcgccggcagcgcaccuccccgccccucggcgggcacuuccggauccagcugcccaacacggugaucagcgacgugcccguccagaucuccgcccaccaccuccaccagcugcugcagaacaacgccgacgacuucaccagccgcuaccugaacgccuccgacuucaccgugaaggaggaccucuacacgugcuacgagcacguguggacgcugagcugguccacccagaucggcgaccugcccaacuucauccgggucagcgacgagaaccucaccggcgugaaccccgccgcggccacccgcguggucuacgacgggggcguguuccuggggcccaucuucggcgacaugcuggccacggccaaccagcacacccagguggucgugcgggugaacgacguccccgcccacugccccggguccugcagcuuccaguaccuccagggcuccacccccugcgugcacagcgucugguacuccaucgacggcgacaucaaccugaugaucuacaucaccgggacgggcuucagcggggacucccaguuccuccaggugaccgugaacaagaccagcugcaaggucaucuucuccaaccagaccaacguggugugccagacggaccugcugcccgucggcaugcaccgcauccugaugcucgugcgccccagcggccuggcgaucuccgccaccggggaggaccuguuccucaacgugaagccgcggcuggacauggucgagcccagccgcgccgccgacaucggcgggcugugggcgaccauccggggcuccagccucgagggggugagccugauccuguucggcuccuacagcugcgccaucaacguggccaccuccaacagcucccgcauccagugcaaggugccgccccgcggcaaggacgggcgcaucgugaacgugacggucauccggggcgacuacagcgccgugcucccgcgcgccuucaccuacguguccagccugaaccccgucaucgugacccugucccggaacaucagcaacaucgccgggggcgagacccucgugaucggggucgcccgccugaugaacuacaccgaccuggacguggaggugcacguccaggacgcccucgcccccgugcacacgcaguccgccuggggccuggagguggcgcugcccccgcuccccgccggccugcaccggaucagcgucuccaucaacggggugagcauccacucccagggcguggaccugcacauccaguaccucaccgaggucuucagcaucgagcccugcugcgggucccugcugggcgggaccauccucagcaucuccggcaucggcuucagccgcgaccccgcccuggugugggugcuggucgggaaccggagcugcgacaucgugaaccucaccgaggccuccaucuggugcgagacgcugccggcgccccagauccccgacgcgggcgcccccaccgugccggccgccgucgaggugugggcggggaaccgcuucuucgcccggggccccagccccucccuggugggcaagggguucaccuucauguacgaggccgccgccacccccgucgugacggcgaugcagggcgagaucaccaacagcucccucagccugcacgucgggggcuccaaccugagcaacuccgucauccuccuggggaaccugaacugcgacguggagacccagagcuuccagggcaacgugucccucagcggcugcuccaucccgcugcacagccuggaggccgggaucuacccccuccagguccgccagaagcagaugggcuucgccaacauguccguggugcugcagcaguucgccgucaugccccggaucauggccaucuuccccagccagggguccgcgugcggcgggaccauccugacggugcgcggccuccugcugaacagccggcgccgguccgugcgcgucgaccucagcggcccguucacgugcgugauccugagccugggggaccacaccauccucugccaggucucccuggagggcgacccccugcccggggccagcuucucccucaacgugaccgugcuggucaacggccugacgagcgagugccaggggaacugcacccuguucauccgcgaggaggccuccccggugauggacgcccucagcaccaacaccuccggcagccugacgaccgugcugauccggggccagcgccucgccaccaccgcggacgagcccauggucuucguggacgaccagcugcccugcaacgugacguucuucaacgccucccacgucgugugccagacccgggaccuggcccccgggccgcacuaccucagcguguucuacacccgcaacggcuacgccugcuccgggaacgucagccggcacuucuacaucaugccccagguguuccacuacuuccccaagaacuucucccugcacggcgggagccugcucaccaucgagggcacgggccugcgcgggcagaacaccaccuccguguacaucgaccagcagaccugccugacggucaacaucggcgccgagcucauccggugcaucgugcccaccgggaacggcagcguggcgcuggagaucgaggucgacggccugugguaccacaucggggugaucggcuacaacaaggccuucaccccggagcucaucuccaucagccaguccgacgacauccugaccuucgccguggcccagaucagcggggcggccaacaucgacaucuucaucggcaugagccccugcgucgggguguccggcaaccacacggugcugcagugcgucgugcccagccuccccgccggcgaguaccacgugcgcggguacgacugcauccggggcugggccuccagcgcccuggucuucaccucccgcgugaucaucaccgcggugaccgagaacuucgggugccugggcgggcggcucguccacguguucggcgccggcuucagcccggggaacguguccgccgccgucugcggcgcccccugccgcgugcuggcgaacgccaccgugagcgccuucuccugccugguccucccccuggacgugagccuggccuuccucugcgggcugaagcgggaggaggacuccugcgaggccgcgcgccacacguacgugcagugcgaccugaccgucgccauggccaccgagcagcuccuggagagcuggcccuaccuguacaucugcgaggaguccagccagugccucuucgugccggaccacugggccgaguccauguuccccagcuucuccggccuguucaucagccccaagcuggagcgggacgaggugcucaucuacaacuccagcugcaacaucaccauggagacggaggcggagauggagugcgagacccccaaccagccgaucaccgucaagaucaccgagauccgcaagcggugggggcagaacacgcagggcaacuucagccugcaguucugccgccgguggucccgcacccacagcugguuccccgagcgccugccccaggacggcgacaacgugaccguggagaacgggcagcuccugcugcucgacaccaacacguccauccugaaccugcuccacaucaagggcgggaagcugaucuucauggcccccggcccgaucgagcugcgggcccacgccauccucgucagcgacgggggcgagcugcgcaucggcuccgaggacaagcccuuccaggggcgggcccagaucacccuguacggcagcuccuacagcacccccuucuuccccuacggggugaaguuccucgcggugcgcaacggcacccugucccugcacggcagccucccggaggucaucgugacgugccugcgggccaccgcccacgcccuggacaccgugcucgcccuggaggacgcggucgacuggaaccccggggacgagguggucaucaucuccggcaccggggugaagggcgccaagcccauggaggagaucgugacggucgagaccgugcaggacaccgaccuguaccucaagagcccgcugcgcuacucccacaacuucaccgagaacuggguggccggggagcaccacauccugaaggccacggucgcccuccugagccgguccaucaccauccagggcaaccugaccaacgagcgcgagaagcuccuggugagcugccaggaggcgaacgcccccgagggcaaccugcagcacugccucuacuccaugagcgagaagaugcuggggagccgggacaugggcgcccgcgugaucguccaguccuuccccgaggagcccagccaggugcagcugaagggggugcaguuccagguccucggccaggccuuccacaagcaccuguccagccugacccucgugggggcgaugcgggaguccuucauccagggcugcacggugcgcaacagcuucucccggggccugagcaugugcgggacccugggccucaaggucgacuccaacguguucuacaacauccuggggcacgcccugcucguggggaccugcaccgagaugcgcuacaucagcugggaggccauccacgggcggaaggacgacugguccggccacggcaacaucauccgcaacaacgucaucauccaggugagcggggccgagggccuguccaacccggagaugcugacgcccagcgggaucuacaucugcucccccaccaacgugaucgagggcaaccgggucugcggcgccggguacggcuacuucuuccaccucaugaccaaccagaccagccaggcgccccugcuguccuucacgcagaacaucgcccacagcugcacccgcuacgggcuguucguguacccgaaguuccagccgcccugggacaacgugaccggcaccacgcuguuccaguccuucaccgucugggagagcgccgggggcgcccagaucuuccggagcuccaaccugcgccucaagaacuucaagguguacagcugccgggacuucggcaucgacgugcuggaguccgacgccaacaccagcgucaccgacucccugcuccuggggcacuucgcgcacaagggcagccugugcauguccagcgggaucaagacccccaagcgcugggagcucaugguguccaacacgaccuucgugaacuucgaccugaucaacugcgucgccauccggaccugcagcgacugcucccagggccagggcggcuucaccgugaagacgagccagcugaaguucaccaacuccagcaaccucguggccuucccguucccccacgccgccauccuggaggaccuggacggcucccugagcgggaagaaccggucccacauccucgcgagcauggagacccuguccgccagcugccuggucaacagcuccuucggccgcguggugcacgggagcgccugcggcgggggcguccucuuccaccggauguccaucggccuggccaacacccccgaggugagcuacgaccugacgaugaccgacucccgcaacaagaccaccacggugaacuacguccgggacacccucagcaacccccgcggguggauggcccugcugcucgaccaggagaccuacucccugcagagcgagaaccuguggaucaaccggucccuccaguacagcgcgaccuucgacaacuucgccccgggcaacuaccugcugcucgugcacacggaccugccgcccuaccccgacauccugcuccgcugcgggucccgggugggccugagcuucccguuccugcccucccccgggcagaaccagggcugcgacugguucuucaacagccagcuccgccagcugaccuaccuggucuccggcgagggccagguccaggugauccuccgggucaaggagggcaugcccccgaccaucagcgccuccaccagcgcccccgaguccgcgcugaaguggagccugcccgagacguggcaggggguggaggagggcuggggcggguacaacaacaccaucccgggccccggggacgacgugcucauccugcccaaccgcaccguccugguggacaccgaccuccccuucuucaagggccuguacgugauggggacgcuggacuucccggucgaccggagcaacgugcucuccgucgccugcauggugaucgccggcggcgagcugaagguggggacccuggagaacccccucgagaaggagcagaagcugcugauccuccugcgcgccagcgagggcgucuucugcgaccggaugaacgggauccacaucgaccccggcaccaucgggguguacggcaaggugcaccuguacuccgccuaccccaagaacagcuggacccaccucggcgcggacaucgccuccgggaacgagcgcaucaucgucgaggacgccguggacuggcggccgcacgacaagaucgugcugagcuccagcuccuacgagccccacgaggccgagguccugacggugaaggaggugaagggccaccacguccgcaucuacgagcggcucaagcaccgccacaucgggagcgugcacgugaccgaggacggccgccacauccggcuggccgcggaggucgggcugcucacccgcaacauccagauccagcccgacguguccugccggggccgccuguucgugggcagcuuccggaaguccagccgcgaggaguucuccgggguccugcagcuccugaacguggagauccagaacuucggcagcccccuguacuccagcguggaguucuccaacgucagcgccgggagcuggaucaucuccagcacccuccaccaguccugcggcggcgggauccacgccgccgccagccacggcgugcugcugaacgacaacaucguguucgggacggcgggccacgggaucgaccucgagggccaggccuacaccgucaccaacaaccugguggugcugaugacccagccggccugguccacgaucugggucgccggcaucaaggugaaccaggugaaggacaucaaccuccacgggaacgucguggcgggcagcgagcggcugggguuccacauccgcggccacaagugcuccagcugcgagcugcucugguccgacaacguggcccacagcucccugcacgggcugcaccucuacaaggagagcggccuggacaacugcacccggaucuccggcuuccuggccuucaagaacuucgacuacggggccaugcuccacgucgagaacagcguggagaucgagaacaucacccugguggacaacaccaucggccugcucgccgucguguacguguucuccgcgccccagaacagcgucaagaaggugcagaucgugcugcgcaacuccgucaucguggccaccagcuccagcuucgacugcauccaggacaaggugaagccccacagcgccaaccugacguccaccgaccgggcccccagcaacccgcgcgggggccggaucgggauccucuggcccgucuucaccuccgagcccaaccaguggccccaggagccguggcacaaggugcgcaacgaccacagcaucuccggcaucaugaagcugcaggacgugaccuucagcuccuucgucaagagcugcuacuccgacgaccuggacgugugcauccuccccaacgccgagaacagcggcaucaugcaccccaucacggcggagcggacccgcaugcugaagaucaaggacaagaacaaguucuacuuccccucccugcagccgcggaaggaccucgggaagguggucugccccgagcuggacugcgccagcccccgcaaguaccuguucaaggaccucgacggccgggcccuggggcugcccccgcccguguccgucuuccccaagaccgaggccgaguggaccgccagcuucuucaacgcggugacgaccgagcaggcccucaagaucuccgaguga

SEQ ID NO: 34643 - RNA, 231 nt, Artificial Sequence
  derived and/or modified sequence opt1 from PKIA__Homo_sapiens__NP_006814
augaccgacguggagaccacguacgccgacuucaucgccagcggccgcaccgggcggcgcaacgcgauccacgacauccuggucuccagcgccuccggcaacagcaacgagcucgcccugaagcuggccgggcucgacaucaacaagaccgagggcgaggaggacgcccagcgguccagcaccgagcaguccggggaggcgcagggcgaggccgccaagagcgaguccuga

SEQ ID NO: 34644 - RNA, 258 nt, Artificial Sequence
  derived and/or modified sequence opt1 from PKIB__Homo_sapiens__NP_001257323
augagccaccaggacguggccaugcgcaccgacuccagcaagaugaccgacgucgaguccggcguggccaacuucgcgagcuccgcccgggccgggcgccggaacgcccugcccgacauccagagcuccgccgcgacggacggcaccagcgaccucccgcugaagcuggaggcccucuccgugaaggaggacgccaaggagaaggacgagaagaccacccaggaccagcuggagaagccccagaacgaggagaaguga

SEQ ID NO: 34645 - RNA, 1725 nt, Artificial Sequence
  derived and/or modified sequence opt1 from PKLR__Homo_sapiens__NP_000289
augagcauccaggagaacaucuccagccugcagcuccgcuccugggugagcaagucccagcgggaccuggccaagagcauccugaucggcgcccccgggggcccggcgggguaccuccgccgggccuccgucgcccagcugacccaggagcugggcaccgccuucuuccagcagcagcagcuccccgccgcgauggccgacacguuccuggagcaccugugccuccuggacaucgacagcgagcccguggccgcccgcuccaccagcaucaucgcgaccaucgggcccgccucccggagcguggagcgccugaaggagaugaucaaggccggcaugaacaucgcccggcucaacuucucccacggcagccacgaguaccacgccgaguccaucgcgaacguccgcgaggccguggagagcuucgccggguccccgcugagcuaccggcccguggccaucgcccuggacaccaagggccccgagauccgcacggggauccuccagggcgggcccgaguccgaggucgagcuggugaagggcagccaggugcuggucaccguggacccggcguuccggacccgcggcaacgccaacaccgugugggucgacuaccccaacaucgugcgggugguccccgucgggggccgcaucuacaucgacgacgggcucaucagccugguggugcagaagaucggccccgagggccuggugacccagguggagaacgggggcguccucgggucccggaagggcgugaaccugccgggggcccagguggaccugcccggccucagcgagcaggacguccgcgaccugcgguucggcguggagcacggggucgacaucguguucgccuccuucgugcgcaaggccagcgacgucgcggccgugcgggccgcccugggccccgaggggcacggcaucaagaucaucuccaagaucgagaaccacgagggggugaagcgcuucgacgagauccucgaggucagcgacggcaucaugguggcccggggcgaccuggggaucgagauccccgcggagaagguguuccuggcccagaagaugaugaucggccgcugcaaccucgccgggaagccggucgugugcgccacgcagaugcuggaguccaugaucaccaagccccgccccacccgggcggagacgagcgacguggccaacgccguccuggacggcgccgacugcaucaugcucuccggggagaccgccaagggcaacuuccccguggaggcggugaagaugcagcacgccaucgcccgcgaggccgaggccgcggucuaccaccggcagcuguucgaggagcugcgccgggccgccccgcucagccgcgaccccaccgaggugaccgccaucggcgccguggaggcggccuucaagugcugcgccgccgcgaucaucguccugacgaccaccgggcgguccgcccagcugcucagccgcuaccggccccgcgccgccgugaucgccgugacccgguccgcgcaggccgcccgccagguccaccugugccggggcguguucccccugcucuaccgcgagccgcccgaggccaucugggccgacgacguggaccggcgcguccaguucgggaucgagagcggcaagcugcggggcuuccugcgcgugggggaccucgugaucgucgugacgggcuggcggcccggguccggcuacaccaacaucaugcgcgugcugagcaucuccuga

SEQ ID NO: 34646 - RNA, 1818 nt, Artificial Sequence
  derived and/or modified sequence opt1 from PKM__Homo_sapiens__NP_001193725
augcaguggagcuccgagcgcggcgagcggcugcucacccccggggccugcagcuccgaggugccgagcgccguccccucccgcagcggcgggucccccggccacaccguguucagcuccgagcggagccugcuggugcgcccccggucccacccggagcccaagggggagcacuacgucacgggcagccccacccccgagaaccagcgcaccuccgcggccaugagcaagccgcacuccgaggccggcaccgccuucauccagacgcagcagcuccacgccgcgauggccgacaccuuccuggagcacaugugccggcuggacaucgacagcccgcccaucaccgcccgcaacaccgggaucaucugcacgaucggccccgccucccggagcguggagacccucaaggagaugaucaaguccgggaugaacguggcgcgccugaacuucagccacggcacccacgaguaccacgccgagaccaucaagaacguccggacggccaccgagagcuucgccuccgaccccauccuguaccgccccguggccguggcgcucgacaccaaggggcccgagauccggaccggccugaucaagggcagcgggacggccgaggucgagcugaagaagggcgccacccucaagaucacccuggacaacgccuacauggagaagugcgacgagaacauccuguggcucgacuacaagaacaucugcaaggugguggaggucggguccaagaucuacguggacgacggccugaucagccuccaggugaagcagaagggcgccgacuuccuggucaccgagguggagaacgggggcucccuggggagcaagaagggcgugaaccugcccggggcggccgucgaccucccggccguguccgagaaggacauccaggaccugaaguucggcguggagcaggacgucgacaugguguucgccagcuucauccgcaaggccuccgacgugcacgagguccggaaggugcugggcgagaaggggaagaacaucaagaucaucagcaagaucgagaaccacgagggcguccgccgguucgacgagauccucgaggcguccgacgggaucaugguggcccgcggcgaccuggggaucgagauccccgccgagaagguguuccuggcccagaagaugaugaucggccggugcaaccgcgccggcaagcccgucaucugcgcgacgcagaugcucgagagcaugaucaagaagccccggccgacccgcgccgagggguccgacguggccaacgccgugcuggacggcgcggacugcaucaugcugagcggggagaccgccaagggcgacuacccccucgaggccguccgcaugcagcaccugaucgcccgggaggccgaggcggccauguuccaccgcaagcuguucgaggagcucgugcgggccuccagccacuccaccgaccugauggaggccauggccauggggagcguggaggcguccuacaagugccuggccgccgcccucaucguccugacggagagcggccgcagcgcccaccagguggcgcgguaccgcccccgggcccccaucaucgccgugacccgcaacccgcagaccgcccggcaggcgcaccuguaccgcggcaucuuccccguccucugcaaggaccccgugcaggaggccugggccgaggacguggaccugcgggucaacuucgccaugaacguggggaaggcccgcggcuucuucaagaagggggacguggucaucgugcugaccggcuggcggcccggcuccggguucacgaacaccaugcgcguggucccggugcccuga

SEQ ID NO: 34647 - RNA, 1293 nt, Artificial Sequence
  derived and/or modified sequence opt1 from PKMYT1__Homo_sapiens__NP_001245379
augcuggagcgcuggcaccagcuccagccccggcgcgugagcuuccggggcgaggccuccgagacccugcagagcccgggguacgaccccucccgccccgagagcuucuuccagcaguccuuccagcggcugagccgccucggccacggguccuacggcgaggucuucaaggugcggagcaaggaggacgggcgccuguacgccgugaagcgguccaugagccccuuccgcggcccgaaggaccgggcgcgcaagcuggccgaggucggcucccacgagaagguggggcagcaccccugcugcgugcggcucgagcaggccugggaggagggcgggauccuguaccugcagaccgagcucugcggccccagccugcagcagcacugcgaggccuggggcgccucccugcccgaggcgcaggucuggggguaccuccgcgacacccugcuggcccucgcccaccuccacagccagggccuggugcaccuggacgugaagccggccaacaucuuccuggggccccggggccgcugcaagcugggggacuucggccuccuggucgagcugggcaccgcgggggccggcgaggugcaggagggggacccccgguacauggcccccgagcuccugcagggcuccuacgggaccgccgccgacguguucagccugggccucaccauccuggaggucgcgugcaacauggagcugccgcacggcggggagggcuggcagcagcuccgccagggguaccugccgcccgaguucacggccggccuguccagcgagcuccgguccgugcuggugaugaugcuggagcccgaccccaagcuccgcgccaccgccgaggcccugcuggcgcuccccguccugcggcagccccgcgccuggggcgugcuguggugcauggccgccgaggcccucagccgcgggugggcgcuguggcaggcccugcucgcccugcugugcuggcucuggcacggccuggcccaccccgccagcuggcugcagccgcuggggccgcccgcgacgccgcccggcuccccgcccugcagccuccugcuggacuccagccucuccagcaacugggacgacgacucccuggggcccagccugucccccgaggccgugcucgcccggaccgucggcagcaccuccacgccccgcagccggugcacgccccgcgacgcccuggaccuguccgacaucaacagcgagccgccccggggguccuuccccagcuucgagccccgcaaccuccugucccuguucgaggacacccucgaccccaccuga

SEQ ID NO: 34648 - RNA, 2829 nt, Artificial Sequence
  derived and/or modified sequence opt1 from PKN1__Homo_sapiens__NP_002732
auggccagcgacgccgugcaguccgagccccgcagcuggucccugcucgagcagcugggccuggcgggggccgaccucgccgccccgggcguccagcagcagcuggagcuggagcgggagcgccuccggcgcgagauccggaaggagcugaagcugaaggagggggccgagaaccuccgccgggcgaccaccgaccugggccgcagccuggggcccguggagcuccugcugcggggcuccagccgccggcucgaccugcugcaccagcagcuccaggagcugcacgcccacgugguccugcccgaccccgccgccacgcacgacggcccgcagucccccggggcgggcgggccgaccugcagcgccaccaaccucucccgcguggccggccuggagaagcagcuggccaucgagcucaaggugaagcagggggccgagaacaugauccagaccuacagcaacggcuccacgaaggaccggaagcugcugcucaccgcgcagcagaugcugcaggacagcaagaccaagaucgacaucauccgcaugcagcugcggcgcgcccuccaggccggccagcuggagaaccaggccgcccccgacgacacccaggggucccccgaccugggcgcggucgagcuccggaucgaggagcugcgccaccacuuccggguggagcacgccguggccgagggggccaagaacguccugcgccuccugagcgccgcgaaggcccccgaccggaaggccguguccgaggcccaggagaagcugacggagagcaaccagaagcucggccugcugcgcgaggcccucgagcgccggcugggcgagcugcccgcggaccaccccaaggggcgccuccugcgggaggagcuggccgccgccuccagcgcggccuucuccacccgccucgccggcccguuccccgccacccacuacagcacccugugcaagcccgcgccccugacggggacccuggaggugcgggucgugggcugccgcgaccucccggagaccauccccuggaaccccacccccagcaugggcgggccgggcacgcccgacucccggccgcccuuccugagccgccccgcccgggggcuguacucccgcagcggcucccucagcgggcgguccagccugaaggccgaggccgagaacaccuccgaggugagcaccguccugaagcucgacaacaccguggugggccagacguccuggaagcccugcgggcccaacgccugggaccagagcuucacccuggagcuggagcgcgcccgggagcucgagcuggcggucuucuggcgcgaccagcggggccugugcgcccucaaguuccugaagcuggaggacuuccucgacaacgagcgccacgaggugcagcuggacauggagccccagggcugccugguggccgaggucaccuuccggaacccggugaucgagcgcaucccccggcuccgccgccagaagaagaucuucuccaagcagcaggggaaggccuuccagcgggcccgccagaugaacaucgacguggcgaccuggguccggcugcugcgccggcucauccccaacgccacgggcaccgggaccuucagcccgggcgccucccccgggagcgaggcccgcaccacgggcgacaucuccguggagaagcugaaccugggcaccgacagcgacuccagcccccagaaguccagccgggacccgcccagcucccccagcucccucagcucccccauccaggagagcaccgcgcccgagcugccguccgagacccaggagacgcccgggcccgcccugugcagcccccuccgcaaguccccgcugacccuggaggacuucaaguuccucgccguccugggccgggggcacuucggcaaggugcugcucagcgaguuccgccccuccggcgagcuguucgccaucaaggcccugaagaagggggacaucguggcgcgggacgaggucgagagccucaugugcgagaagcgcauccuggccgccgugaccuccgccggccaccccuuccuggugaaccucuucgggugcuuccagacccccgagcacgucugcuucgugauggaguacagcgccggcggggaccugaugcugcacauccacuccgacguguucagcgagccgcgggcgaucuucuacagcgccugcgucgugcucggccugcaguuccugcacgagcacaagaucguguaccgcgaccucaagcuggacaaccugcuccuggacacggagggcuacgucaagaucgccgacuucgggcugugcaaggagggcaugggguacggcgaccggaccuccaccuucugcgggacccccgaguuccucgcccccgaggugcugaccgacacgagcuacacccgcgccguggacugguggggccugggcguccuccuguacgagaugcuggugggggagucccccuucccgggcgacgacgaggaggagguguucgacagcaucgucaacgacgaggugcgguacccccgcuuccucuccgcggaggccaucgggaucaugcggcgccugcugcggcgcaaccccgagcgccggcucggcagcuccgagcgcgacgccgaggacgugaagaagcagcccuucuuccggacccuggggugggaggcccugcucgcgcgccggcugccgccgcccuucguccccacccugagcggccgcacggacguguccaacuucgacgaggaguucaccggcgaggcccccacccucagcccgccccgggacgcccgcccccugaccgccgccgagcaggcggccuuccuggacuucgacuucguggccgggggcugcuga

SEQ ID NO: 34649 - RNA, 3036 nt, Artificial Sequence
  derived and/or modified sequence opt1 from PKN2__Homo_sapiens__XP_011540071
auggccagcaaccccgagcgcggcgagauccugcucaccgagcugcagaacugcgggcacuccggcgggcuggccugcuucaucuacugggaguuccagggcugggagaaggugcagaacgagaaguccggggacucccggagccuccccuucuccgagaacgucagcgcggugcagaagcuggacuucuccgacaccauggugcagcagaagcuggacgacaucaaggaccgcaucaagcgggagauccgcaaggagcucaagaucaaggagggcgccgagaaccugcggaaggucacgaccgacaagaagucccuggccuacguggacaacauccucaagaaguccaacaagaagcuggaggagcugcaccacaagcuccaggagcugaacgcccacaucguggucagcgaccccgaggacaucaccgacugcccccgcacccccgacacgccgaacaacgacccccggugcuccaccagcaacaaccgccugaaggcccuccagaagcagcuggacaucgagcugaaggugaagcagggcgcggagaacaugauccagauguacuccaacgggagcuccaaggaccggaagcuccacggcaccgcccagcagcugcugcaggacagcaagaccaagaucgaggugauccgcaugcagauccuccaggccguccagacgaacgagcuggccuucgacaacgcgaagcccgugaucagcccccuggagcuccggauggaggagcugcgccaccacuuccggaucgaguucgccguggccgagggggccaagaacgucaugaagcugcucggcagcgggaaggugaccgaccgcaaggcccuguccgaggcgcaggcccgguucaacgagagcagccagaagcuggaccuccugaaguacucccuggagcagcgccucaacgaggugccgaagaaccaccccaagagccggaucaucaucgaggagcugucccuggucgccgccagccccacccucagcccccgccagagcaugaucuccacccagaaccaguacagcacgcuguccaagccggccgcgcugaccggcacccucgaggugcggcugaugggcugccaggacauccuggagaacgugcccgggcgcagcaaggccaccuccgucgcccuccccggcuggagccccuccgagacgcggagcuccuucaugagccgcaccuccaagagcaaguccgggagcagccgcaaccugcugaagaccgacgaccucuccaacgacgugugcgccgugcugaagcuggacaacaccgucgugggccagacgagcuggaagccgaucuccaaccagagcugggaccagaaguucacccucgagcuggaccggucccgcgagcuggagaucagcguguacuggcgggacuggcgcucccugugcgccgucaaguuccuccggcuggaggacuuccuggacaaccagcgccacggcaugugccucuaccuggagccccaggggacccuguucgcggaggugaccuucuucaaccccgucaucgagcggcgccccaagcuccagcggcagaagaagaucuucagcaagcagcagggcaagacguuccugcgcgccccgcagaugaacaucaacaucgccaccugggggcggcuggugcgccgggccauccccaccgugaaccacuccggcaccuucagcccccaggcccccgucccgacgaccgugcccguggucgacgugcgcaucccccagcucgcgcccccggccuccgacagcaccgugaccaagcuggacuucgaccuggagcccgagcccccgcccgccccgccccgggccuccagccucggggagaucgacgaguccagcgagcugcgcguccuggacauccccggccaggacuccgagacgguguucgacauccagaacgaccggaacagcauccuccccaagagccaguccgaguacaagcccgacacgccccagagcggccuggaguacuccgggauccaggagcuggaggaccgccggagccagcagcgcuuccaguucaaccuccaggacuuccgcugcugcgcggugcugggccgggggcacuucggcaagguccugcucgccgaguacaagaacaccaacgagauguucgccaucaaggcccugaagaagggggacaucguggcccgcgacgagguggacucccugaugugcgagaagcggaucuucgagaccgucaacagcgugcgccacccguuccucgugaaccuguucgcgugcuuccagaccaaggagcacgucugcuucgugauggaguacgccgccggcggcgaccugaugaugcacauccacaccgacguguucuccgagccccgggccgucuucuacgccgcgugcguggugcucgggcugcaguaccugcacgagcacaagaucgucuaccgcgaccucaagcuggacaaccugcuccuggacaccgagggcuucgugaagaucgccgacuucgggcugugcaaggagggcaugggguacggcgaccggaccagcaccuucugcggcacgcccgaguuccucgcccccgaggugcugaccgagaccuccuacacccgcgccgucgacuggugggggcugggcgugcucaucuacgagaugcuggugggggagagcccguuccccggcgacgacgaggaggaggucuucgacuccaucgugaacgacgaggugcgguacccccgcuuccugagcacggaggccaucuccaucaugcggcgccuccugcggcgcaaccccgagcggcgccugggcgcgagcgagaaggacgccgaggacgucaagaagcacccguucuuccggcucaucgacugguccgcccugauggacaagaaggugaagccgcccuucauccccaccauccgcgggcgggaggacgugagcaacuucgacgacgaguucaccuccgaggcccccauccugaccccgccccgcgagccccggauccucagcgaggaggagcaggagauguuccgcgacuucgacuacaucgcggacuggugcuga

SEQ ID NO: 34650 - RNA, 2670 nt, Artificial Sequence
  derived and/or modified sequence opt1 from PKN3__Homo_sapiens__NP_037487
auggaggagggcgcgccccgccagccggggcccagccaguggccgcccgaggacgagaaggaggugauccggcgcgccauccagaaggagcugaagaucaaggagggcgucgagaaccuccggcgcguggccaccgaccggcgccaccuggggcacgugcagcagcugcuccgguccagcaaccgccggcuggagcagcugcacggcgagcuccgcgagcugcacgcccggauccugcucccggggcccggccccggccccgccgagccggucgccuccgggccccgccccugggccgagcagcugcgggcgcgccaccuggaggcccuccggcgccagcugcacguggagcugaaggugaagcagggcgccgagaacaugacccacacgugcgccagcgggacccccaaggagcggaagcuccuggcggccgcccagcagaugcugcgcgacucccagcucaaggucgcccugcugcggaugaagaucagcucccucgaggccagcggcuccccggagcccgggcccgagcugcuggcggaggagcuccagcaccgccugcacguggaggccgccguggccgagggcgccaagaacgucgugaagcugcucagcucccggcgcacccaggaccgcaaggcgcuggccgaggcccaggcccagcugcaggagagcucccagaagcucgaccugcugcggcucgcccuggagcagcugcucgagcagcugcccccggcgcacccccugcgcagccgggugacccgcgagcuccgggccgccguccccggcuacccccagccguccgggacgcccgugaagcccaccgcccugaccggcacccuccaggugcgccuccuggggugcgagcagcugcucacggccguccccggccggagcccggcggccgcccuggccuccagccccuccgagggcuggcugcgcaccaaggcgaagcaccagcgggggcgcggcgagcucgccagcgaggugcuggccgugcugaaggucgacaaccgggugguggggcagaccggcugggggcaggucgccgagcagagcugggaccagaccuucgugaucccccuggagcgcgcccgggagcucgagaucggcgugcacuggcgcgacuggcggcagcugugcggcgucgcguuccugcgccucgaggacuuccuggacaacgccugccaccagcugucccucagccuggugccccaggggcuccucuucgcccaggucacguucugcgacccggugaucgagcggcgcccccggcugcagcgccaggagcgcaucuucuccaagcggcgcggccaggacuuccugcgggccagccagaugaaccucgggauggccgcguggggccgccuggugaugaaccugcugcccccgugcuccagccccuccaccaucagcccgcccaaggggugcccccggacccccaccacgcugcgcgaggccuccgaccccgccacccccagcaacuuccugccgaagaagacgccccucggcgaggagaugaccccgccgcccaagccgccccggcuguaccugccccaggagcccaccuccgaggagacgccccgcaccaagcggccccacauggagccccgcacccggcgcggccccagcccgcccgccucccccacccggaagccgccccgccuccaggacuuccggugccuggccguccuggggcgcggccacuucgggaaggugcuccuggugcaguucaagggcaccgggaaguacuacgcgaucaaggcccugaagaagcaggagguccucagccgggacgagaucgagucccuguacugcgagaagcgcauccuggaggccgugggcugcaccggccaccccuuccuccugagccugcucgccugcuuccagaccuccagccacgcgugcuucgugacggaguucguccccgggggcgaccugaugaugcagauccacgaggacguguuccccgagccccaggcccgguucuacguggccugcgucgugcuggggcuccaguuccugcacgagaagaagaucaucuaccgcgaccugaagcucgacaaccugcugcucgacgcccagggcuuccugaagaucgccgacuucggccugugcaaggaggggaucggcuucggggaccggaccuccaccuucugcggcacccccgaguuccucgcgcccgaggugcugacgcaggaggccuacacccgcgccgucgacuggugggggcugggcgugcuccuguacgagaugcuggugggcgagugccccuuccccggggacaccgaggaggaggucuucgacugcaucgugaacauggacgcccccuacccgggcuuccucagcgugcaggggcuggaguucauccagaagcugcuccagaagugccccgagaagcgccugggcgccggggagcaggacgcggaggagaucaagguccagcccuucuuccggaccacgaacuggcaggcccugcucgcccgcaccauccagcccccguucgugcccacccugugcggccccgccgaccugcgguacuucgagggcgaguucaccgggcugcccccggcccugaccccgcccgcgccccacagccugcucacggcccgccagcaggccgccuuccgggacuucgacuucguguccgagcgcuuccuggagcccuga

SEQ ID NO: 34651 - RNA, 960 nt, Artificial Sequence
  derived and/or modified sequence opt1 from PKNOX1__Homo_sapiens__NP_001273187
auggugaaggccauccagguccugcgcauccaccuccuggagcuggagaaggugaacgagcucugcaaggacuucugcagccgguacaucgccugccugaagaccaagaugaacuccgagacccugcucagcggcgagcccggguccccguacagccccgugcagucccagcagauccagagcgcgaucacgggcaccaucagcccccaggggaucgucgugcccgccuccgcccugcagcagggcaacguggccauggccaccgucgccgggggcaccguguaccagccggugacggucgugacgccccagggccagguggucacccagacccugucccccgggaccauccgcauccagaacagccagcuccagcugcagcugaaccaggaccucuccauccugcaccaggacgacggcagcuccaagaacaagcgcggggugcugcccaagcacgcgaccaacgugaugcggagcuggcuguuccagcacaucggccacccguaccccaccgaggacgagaagaagcagaucgccgcccagaccaaccucacgcugcuccaggucaacaacugguucaucaacgcgcggcgccggauccugcagcccaugcuggacuccagcugcuccgagacccccaagaccaagaagaagaccgcccagaaccgcccggugcagcgguucuggcccgacagcaucgccuccgggguggcccagcccccgcccagcgagcucacgaugagcgagggcgccgucgugaccaucaccacccccgugaacaugaacgucgacucccugcagagccuguccagcgacggcgcgacgcucgccgugcagcaggucaugauggccgggcaguccgaggacgagagcguggacuccaccgaggaggacgccggcgcccuggcgcccgcccacaucagcgggcuggugcucgagaacuccgacagccugcaguga

SEQ ID NO: 34652 - RNA, 1332 nt, Artificial Sequence
  derived and/or modified sequence opt1 from PKNOX2__Homo_sapiens__XP_005271700
augaccgccaccgcccagcccccgagcaaggcgcaggccgugcacaucuccgcccccagcgccgccgcguccacgcccguccccagcgccccgaucgacccccaggcccagcuggaggccgacaagcgcgcgguguaccggcacccccucuucccccugcugacccuccuguucgagaagugcgagcaggccacccagggcuccgagugcaucaccagcgccuccuucgacguggacaucgagaacuucguccaccagcaggagcaggagcacaagccguucuucagcgacgaccccgagcuggacaaccucauggugaaggccauccaggugcugcgcauccaccuccuggagcuggagaaggucaacgagcugugcaaggacuucugcaaccgguacaucacgugccucaagaccaagaugcacuccgacaaccugcugcgcaacgaccucgggggccccuacagccccaaccagccguccaucaaccugcacagccaggaccugcuccagaacucccccaacagcauguccggggugagcaacaacccccagggcaucgugguccccgccuccgcgcugcagcaggggaacaucgccaugaccaccgugaacagccagguggucuccggcggcgcccuguaccagccggugacgauggugaccagccaggggcaggucgugacccaggccaucccccagggcgccauccagauccagaacacccaggugaaccucgaccugacgagccugcucgacaacgaggacaagaaguccaagaacaagcgcgggguccugcccaagcacgcgaccaacaucaugcggagcuggcuguuccagcaccucaugcaccccuacccgaccgaggacgagaagcggcagaucgccgcccagaccaaccugacgcugcuccaggugaacaacugguucaucaacgcccgccggcgcauccugcagcccaugcuggacgccuccaaccccgaccccgcgccgaaggccaagaagaucaagagccagcaccggcccacccagcgcuucuggcccaacuccaucgccgccggcgugcuccagcagcagggcggggcccccggcaccaacccggacgggagcaucaaccuggacaaccugcagucccucagcuccgacagcgcgaccauggccaugcagcaggccaugauggccgcgcacgacgacucccuggacggcacggaggaggaggacgaggacgagauggaggaggaggaggaggaggagcuggaggaggaggucgacgagcuccagaccaccaacgugagcgaccuggggcuggagcacuccgacagccucgaguga

SEQ ID NO: 34653 - RNA, 2244 nt, Artificial Sequence
  derived and/or modified sequence opt1 from PKP1__Homo_sapiens__NP_000290
augaaccacagcccccugaagaccgcccucgccuacgagugcuuccaggaccaggacaacuccacccuggcgcugccgagcgaccagaagaugaagacgggcaccuccgggcgccagcgggugcaggagcaggucaugaugaccgugaagcgccagaaguccaagagcagccaguccagcacccucucccacagcaaccggggcuccauguacgacgggcuggccgacaacuacaacuacggcacgaccagccgcuccagcuacuacuccaaguuccaggccgggaacggcagcuggggcuaccccaucuacaacgggacccugaagcgggagcccgacaaccgccgguucuccagcuacucccagauggagaacuggagccgccacuacccccggggcagcugcaacaccacgggggccggcuccgacaucugcuucaugcagaagaucaaggccagccgcuccgagccggaccucuacugcgacccccgggggacccugcgcaagggcacccugggcagcaaggggcagaagaccacgcagaaccgguacuccuucuacagcacgugcuccggccagaaggcgaucaagaagugccccgugcggcccccgagcugcgccuccaagcaggaccccgucuacaucccgcccaucagcugcaacaaggaccucuccuucgggcacagccgcgccuccagcaagaucugcuccgaggacaucgagugcagcggccugaccauccccaaggccgugcaguaccuguccagccaggacgagaaguaccaggcgaucggcgccuacuacauccagcacacgugcuuccaggacgaguccgccaagcagcaggucuaccagcucgggggcaucugcaagcugguggaccugcuccgcagccccaaccagaacgugcagcaggccgccgcgggggcccugcggaaccugguguuccgcagcaccaccaacaagcucgagacccggcgccagaacggcauccgggaggccgucucccugcugcgccgcaccgggaacgccgagauccagaagcagcucaccggccugcuguggaaccucagcuccaccgacgagcugaaggaggagcugaucgccgacgcgcuccccgugcuggccgaccgggugaucauccccuucagcggcuggugcgacgggaacuccaacaugagccgcgaggucguggacccggagguguucuucaacgccaccggcugccugcggaagcgccucgggaugcgggagcugcuggcccucgucccccagcgcgccaccuccagccgggugaaccuguccagcgcggacgccggccgccagacgaugcggaacuacuccgggcugaucgacagccucauggccuacgugcagaacugcgucgccgccucccgcugcgacgacaagagcguggagaacugcaugugcgugcugcacaaccuguccuaccggcucgacgcggagguccccacccgcuaccggcagcuggaguacaacgcccgcaacgccuacaccgagaaguccagcaccggcugcuucagcaacaagagcgacaagaugaugaacaacaacuacgacugcccccugccggaggaggagacgaaccccaagggcuccggguggcucuaccacagcgacgccauccggaccuaccugaaccugaugggcaaguccaagaaggacgcgacccucgaggccugcgccggggcccugcagaaccugaccgccagcaagggccucauguccagcgggaugucccagcugaucggccugaaggagaagggccugccccagaucgcgcgccuccugcagagcgggaacuccgacguggugcggagcggcgccucccugcucagcaacaugucccgccacccccugcugcaccgggucauggggaaccagguguucccggaggucacgcgccuccugaccagccacaccggcaacaccuccaacagcgaggacauccuguccagcgccugcuacacggugcgcaaccucauggccucccagccccagcuggccaagcaguacuucagcagcuccaugcugaacaacaucaucaaccucugccggagcuccgcgagccccaaggccgccgaggccgcccgccugcugcucuccgacauguggagcuccaaggagcugcagggcgugcugcggcagcagggguucgaccgcaacaugcucggcacccuggcgggggccaacagccugcggaacuucaccucccgcuucuga

SEQ ID NO: 34654 - RNA, 2514 nt, Artificial Sequence
  derived and/or modified sequence opt1 from PKP2__Homo_sapiens__NP_001005242
auggccgcccccggcgcgccggccgaguacggguacauccgcaccgugcugggccagcagauccucgggcagcuggacagcuccagccuggcccuccccuccgaggccaagcugaagcuggccggcagcuccgggcggggcggccagaccgucaagagccuccgcauccaggagcagguccagcagacgcuggcgcggaaggggcgcuccagcgugggcaacgggaaccugcaccggaccuccagcgugcccgaguacguguacaaccuccaccugguggagaacgacuucgucggcgggcgcucccccgugccgaagaccuacgacaugcugaaggccggcaccacggccaccuacgagggccggugggggcgcggcaccgcccaguacagcucccagaaguccguggaggagcggagccuccgccacccccugcggcgccuggagaucagccccgacuccagccccgagcgggcgcacuacacccacuccgacuaccaguacagccagcgcagccaggccgggcacacgcuccaccaccaggagucccggcgcgccgcccugcuggucccgccccgguacgcccgcagcgagaucgugggcgugucccgggcgggcaccaccagccgccagcggcacuucgacaccuaccaccgccaguaccagcacggguccgucagcgacacgguguucgacuccauccccgccaaccccgcccuccugaccuacccgcgccccggcaccagccgguccauggggaaccugcucgagaaggagaacuaccugaccgccggccugacgguggggcagguccgcccccucgugccccugcagccggugacccagaaccgggccagccgcuccagcuggcaccaguccagcuuccacuccacccggacccugcgcgaggcgggccccagcgucgccguggacuccagcggccggcgcgcccaccucacgguggggcaggccgccgcgggcggguccggcaaccugcugaccgagcggagcaccuucaccgacagccagcucgggaacgccgacauggagaugacgcuggagcgcgccgucuccaugcuggaggccgaccacaugcuccccagccggaucuccgccgcggccaccuucauccagcacgagugcuuccagaaguccgaggcccgcaagcgggugaaccagcugcgcggcauccugaagcuccugcagcugcucaaggugcagaacgaggacguccagcgggccgugugcggcgcgcugcgcaaccuggucuucgaggacaacgacaacaagcucgagguggccgagcugaacggggugccccggcugcuccagguccugaagcagacccgcgaccuggagaccaagaagcagaucacgggccuccuguggaaccugagcagcaacgacaagcugaagaaccucaugaucaccgaggcccugcugacccucaccgagaacaucaucaucccguucuccggguggcccgagggcgacuaccccaaggccaacgggcugcuggacuucgacaucuucuacaacgugacgggcugccuccggaacaugagcuccgccggcgcggacgggcgcaaggccaugcgccggugcgacggccugaucgacagccuggugcacuacguccgcgggaccaucgccgacuaccagcccgacgacaaggccaccgagaacugcgugugcauccuccacaaccuguccuaccagcuggaggccgagcucccggagaaguacagccagaacaucuacauccagaaccggaacauccagaccgacaacaacaaguccaucggcugcuucggcagccgcucccggaaggugaaggagcaguaccaggacguccccaugcccgaggagaaguccaaccccaaggggguggaguggcuguggcacagcaucgugauccgcauguaccugagccucaucgccaagagcguccggaacuacacgcaggaggcgucccugggcgcccugcagaaccucaccgccgggagcggcccgaugcccaccuccguggcccagaccgugguccagaaggagagcgggcugcagcacacccgcaagaugcugcacgugggcgaccccuccgugaagaagacggcgaucagccuccugcggaaccugucccgcaaccucagccugcagaacgagaucgccaaggagacccugccggaccucgucuccaucauccccgacaccgugcccagcaccgaccugcugaucgagacgaccgccuccgccugcuacacccucaacaacaucauccagaacagcuaccagaacgcgcgggaccugcugaacaccggcgggauccagaagaucauggccaucuccgccggcgacgccuacgccagcaacaaggcguccaaggccgccagcgugcuccuguacucccugugggcccacacggagcuccaccacgccuacaagaaggcgcaguucaagaagaccgacuucgucaacagccgcaccgccaaggccuaccacucccugaaggacuga

SEQ ID NO: 34655 - RNA, 2394 nt, Artificial Sequence
  derived and/or modified sequence opt1 from PKP3__Homo_sapiens__NP_009114
augcaggacggcaacuuccugcucagcgcccugcagcccgaggccggggugugcucccuggcgcucccgagcgaccugcagcuggaccgccggggcgccgaggggcccgaggccgagcgccuccgggccgcccgcguccaggagcagguccgggcgcgccugcugcagcucggccagcagccccggcacaacggggccgccgagcccgagccggaggccgagaccgcgcgcggcaccucccggggccaguaccacacgcugcaggccggguucagcucccgcagccagggccuguccggggacaagaccagcggcuuccggcccaucgccaagcccgccuacucccccgccagcugguccagccgcuccgcgguggaccucagcugcucccggcgccugagcuccgcccacaacgggggcagcgccuucggcgccgccggguacggcggggcgcagccgaccccgcccaugcccacccggcccguguccuuccacgagcgcggcggcguggggagccgggccgacuacgacacgcugagccuccgcucccugcggcugggccccgggggccucgacgaccgcuacagccugguguccgagcagcuggagcccgccgccaccagcaccuaccgggccuucgcguacgagcgccaggccuccagcuccagcucccgcgccgggggccucgacuggcccgaggccaccgaggucagcccgucccggacgauccgcgcccccgcggugcggacccugcagcgcuuccagagcucccaccggagccgcggcgucgggggcgccgugcccggggccgugcuggagcccguggcccgggcgccguccguccgcagccucucccugagccuggccgacuccggccaccuccccgacgugcacggguucaacagcuacggcagccaccggacccugcagcgccuguccagcggcuucgacgacaucgaccuccccuccgccgugaaguaccugauggccagcgaccccaaccugcagguccucggggccgcguacauccagcacaagugcuacuccgacgccgccgccaagaagcaggcccggagccugcaggcggugccgcgccuggugaagcuguucaaccacgccaaccaggagguccagcggcacgccaccggcgccaugcgcaaccucaucuacgacaacgccgacaacaagcuggcgcucguggaggagaacgggaucuucgagcugcugcggacgcuccgcgagcaggacgacgagcugcggaagaacgugaccggcauccuguggaaccucuccagcuccgaccaccugaaggaccgccuggcccgggacacccucgagcagcugaccgaccugguccugagcccccucuccggggccggcggcccgccccugauccagcagaacgccagcgaggcggagaucuucuacaacgccacgggguuccugcgcaaccucuccagcgccucccaggccacccgccagaagaugcgggagugccacggccugguggacgcccuggugaccagcaucaaccacgcgcucgacgccgggaagugcgaggacaaguccgucgagaacgccgugugcguccugcgcaaccugagcuaccggcucuacgacgagaugccgcccagcgcccugcagcgccuggagggccggggccgccgggaccucgccggggcgccgcccggcgaggugguggggugcuucacgccccagucccgccggcugcgcgagcugccccucgccgccgacgcccugaccuucgccgaggucagcaaggaccccaagggccuggaguggcucuggagcccccagaucguggggcuguacaaccggcugcuccagcgcugcgagcugaaccggcacaccaccgaggcggccgccggcgcccugcagaacaucaccgcgggcgaccgccggugggccggggugcucucccgccuggcccuggagcaggagcggauccucaacccccugcuggaccgcguccggacggccgaccaccaccagcuccgcucccugaccggccugauccggaaccucagccgcaacgcccgcaacaaggacgagauguccaccaagguggugagccaccugaucgagaagcugcccggguccgucggcgagaaguccccgcccgcggaggugcucgugaacaucaucgccguccugaacaaccuggugguggccagccccaucgccgcccgggaccuccuguacuucgacgggcugcgcaagcucaucuucaucaagaagaagcgggacagccccgacuccgagaaguccagccgcgcggccagcucccugcuggccaaccucuggcaguacaacaagcugcaccgggacuuccgcgccaagggcuaccggaaggaggacuuccugggccccuga

SEQ ID NO: 34656 - RNA, 3450 nt, Artificial Sequence
  derived and/or modified sequence opt1 from PKP4__Homo_sapiens__NP_001005476
augcccgccccggagcaggccagccugguggaggagggccagccccagacccgccaggaggcggccuccaccgggcccggcauggagcccgagacgaccgccaccaccauccuggccagcgucaaggagcaggagcugcaguuccagcggcugacgcgcgagcucgagguggagcggcagaucguggccucccagcuggagcgcugccggcugggggcggagagcccguccaucgccagcaccuccagcaccgagaaguccuuccccuggcgcagcaccgacguccccaacacgggcguguccaagccccgggugagcgacgccguccagccgaacaacuaccucauccgcaccgagcccgagcaggggacccuguacucccccgagcagaccagccugcacgaguccgagggcagccucggcaacucccggagcuccacgcagaugaacagcuacagcgacuccggguaccaggaggccggcagcuuccacaacucccagaacgugagcaaggcggacaaccgccagcagcacuccuucaucgggagcaccaacaaccacgugguccggaacucccgcgccgagggccagacccuggugcagcccagcguggccaaccgggccaugcgccgggucuccagcgugccgucccgcgcccagagccccuccuacgugaucagcaccggggucucccccagccggggcucccugcgcacgagccucggcuccggguucggcagccccagcgugaccgacccgcggccccugaaccccuccgcguacagcuccaccacccugcccgccgcccgcgccgccagcccguacucccagcggcccgcgagccccacggccauccgccgcaucggguccgugaccagccggcagaccuccaaccccaacggcccgacgccccaguaccagaccaccgcccgcgucggcagcccccucacccugaccgacgcccagacgcggguggccucccccagccagggccaggugggguccagcuccccgaagcgcagcgggaugaccgcggucccccagcaccugggccccucccuccagcggaccgugcacgacauggagcaguucgggcagcagcaguacgacaucuacgagcgcauggugccgccccggcccgacagccugaccggccugcgcagcuccuacgccagccagcacucccagcucggccaggaccugcggagcgccgucucccccgaccugcacaucacgccgaucuacgaggggcgcaccuacuacagccccguguaccggucccccaaccacggcaccgucgagcuccaggggagccagaccgcccuguaccgcacgggcuccguggggaucggcaaccugcagcggaccagcucccagcgcagcacccucaccuaccagcggaacaacuacgcccugaacaccacggcgaccuacgccgagcccuaccgcccgauccaguaccgggugcaggagugcaacuacaaccgccugcagcacgccguccccgccgacgacggcaccacccggucccccagcaucgacuccauccagaaggacccccgcgaguucgcguggcgcgacccggagcuccccgaggugauccacaugcugcagcaccaguuccccagcgugcaggccaacgccgccgccuaccugcagcaccucugcuucggggacaacaaggucaagauggaggugugccggcugggcgggaucaagcaccugguggaccuccuggaccaccgcguccuggaggugcagaagaacgcgugcggcgcccuccggaaccugguguucgggaaguccacggacgagaacaagaucgccaugaagaacgucggcggcauccccgcccugcuccgccugcugcgcaagagcaucgacgccgaggugcgggagcucgugaccgggguccuguggaaccuguccagcugcgacgcggugaagaugaccaucauccgggacgcccucagcacccugacgaacaccgugaucgucccgcacuccggcuggaacaacagcuccuucgacgacgaccacaagaucaaguuccagaccagccuggugcugcgcaacaccacggggugccuccggaaccuguccagcgccggcgaggaggcccgcaagcagaugcgguccugcgagggccugguggacagccuccuguacgucauccacacgugcgugaacaccuccgacuacgacagcaagaccguggagaacugcgucugcacccugcgcaaccucuccuaccggcuggagcuggaggugccccaggcccgccuccuggggcugaacgagcucgacgaccugcugggcaaggagagccccuccaaggacagcgagcccuccugcugggggaagaagaagaagaagaagaagcggaccccgcaggaggaccagugggacggcguggggcccauccccggccucagcaagucccccaagggcgucgagaugcuguggcacccgagcguggugaagcccuaccugacccuccuggcggaguccagcaaccccgccacccuggaggggagcgccggcucccuccagaaccugagcgccgggaacuggaaguucgcggccuacauccgcgccgccguccggaaggagaagggccugccgauccucguggagcugcugcgcauggacaacgaccggguggucuccagcguggccacggcgcuccgcaacauggcccuggacgugcggaacaaggagcugaucgggaaguacgccaugcgcgaccucgucaaccgccugcccggcggcaacgggcccuccgugcugagcgacgagaccauggccgccaucugcugcgcgcuccacgaggugaccuccaagaacauggagaacgccaaggcccuggccgacagcggcgggaucgagaagcuggucaacaucaccaagggccgcggggaccgguccagccucaagguggugaaggccgcggcccagguccugaacacgcuguggcaguaccgggaccuccgcuccaucuacaagaaggacggcuggaaccagaaccacuucaucacccccgugagcacccuggagcgggaccgcuucaagucccacccgagccuguccaccacgaaccagcagaugagccccaucauccaguccggcagcuccaagcccagccccaucuacaucagcuccuacagcuccccggcccgggagcagaaccgccggcuccagcaccagcagcuguacuacagccaggacgacuccaaccgcaagaacuucgacgccuaccggcuguaccuccagagcccccacuccuacgaggaccccuacuucgacgaccgcgugcacuuccccgcgagcaccgacuacuccacccaguacgggcucaagagcaccacgaacuacgucgacuucuacuccaccaagcggccgagcuaccgcgccgagcaguaccccggcucccccgacagcuggguguga

SEQ ID NO: 34657 - RNA, 1323 nt, Artificial Sequence
  derived and/or modified sequence opt1 from PLA1A__Homo_sapiens__NP_001193889
augcccccgggccccugggagagcugcuucugggucgggggccugauccucuggcuguccguggggagcuccggcgacgccccgcccacgccccagcccaagugcgccgacuuccagagcgcgaaccuguucgaggggaccgaccucaaggugcaguuccugcuguucgugcccuccaaccccagcugcggccagcucgucgagggcuccagcgaccugcagaacuccggguucaacgccacccugggcaccaagcucaucauccacggguuccgcgugcugggcaccaagccgagcuggaucgacaccuucauccggacgcugcuccgcgccaccaacgccaacgugaucgccgucgacuggaucuacggguccaccggcguguacuucagcgcggugaagaacguccugggcguguccgagagcuccauccacaucaucggggugagccugggcgcccacgucgggggcauggugggccagcuguucgggggccagcucgggcagaucaccggccuggaccccgccgggcccgaguacacgcgggccuccguggaggagcgccucgacgcgggcgacgcccuguucgucgaggccauccacaccgacaccgacaaccugggcauccggauccccguggggcacguggacuacuucgucaacggcgggcaggaccagccgggcugccccaccuucuucuacgccggguacagcuaccucaucugcgaccacaugcgcgccgugcaccuguacaucuccgcgcuggagaacagcugcccccucauggccuuccccugcgccagcuacaaggccuuccuggccggccggugccuggacugcuucaacccguuccuccuguccugcccccgcaucggccugguggagcagggcggggucaagaucgagccccuccccaaggaggugaagguguaccugcugacgaccagcuccgcgccguacugcaugcaccacagccucgucgaguuccaccugaaggagcugcggaacaaggacaccaacaucgaggugaccuuccucuccagcaacaucacguccagcuccaagaucaccauccccaagcagcagcgcuacgggaagggcaucaucgcccacgccacgccccagugccagaucaaccaggucaaguucaaguuccagagcuccaaccggguguggaagaaggaccgcaccaccaucaucgggaaguucugcaccgcccugcugcccgugaacgaccgggagaagauggucugccucccggagcccgugaaccugcaggccagcgugaccgucuccugcgaccugaagaucgcgugcguguga

SEQ ID NO: 34658 - RNA, 498 nt, Artificial Sequence
  derived and/or modified sequence opt1 from PLA2G10__Homo_sapiens__NP_003552
augggcccccugccggugugccuccccaucaugcugcugcuccugcugcccagccuccugcugcuccugcugcuccccgggccgggcuccggggaggccagccgcauccugcggguccaccgccggggcauccuggagcucgccgggaccgugggcugcgugggcccccgcacccccaucgcguacaugaaguacgggugcuucugcggccucgggggccacgggcagccccgggacgccaucgacuggugcugccacggccacgacugcugcuacacgcgcgccgaggaggccggcugcuccccgaagaccgagcgguacagcuggcagugcgucaaccaguccgugcugugcgggcccgccgagaacaagugccaggagcugcugugcaagugcgaccaggagaucgcgaacugccuggcccagaccgaguacaaccucaaguaccuguucuacccccaguuccugugcgagcccgacagcccgaagugcgacuga

SEQ ID NO: 34659 - RNA, 570 nt, Artificial Sequence
  derived and/or modified sequence opt1 from PLA2G12A__Homo_sapiens__NP_110448
auggcccugcucagccgccccgcccugacccugcuccugcugcucauggcggccgugguccggugccaggagcaggcccagaccacggacuggcgcgccacccugaagaccauccggaacggcgugcacaagaucgacaccuaccugaacgccgcgcucgaccugcucgggggcgaggacgggcugugccaguacaagugcuccgacggcagcaagccguucccccgcuacggguacaagcccuccccgcccaacggcugcggcagcccccuguucggggugcaccugaacaucggcauccccucccucacgaagugcugcaaccagcacgaccggugcuacgagaccugcggcaagagcaagaacgacugcgacgaggaguuccaguacugccuguccaagaucugccgcgacguccagaagacccuggggcucacccagcacgugcaggccugcgagacgaccguggagcugcuguucgacagcgucauccaccucgggugcaagcccuaccuggacucccagcgggccgccugccgcugccacuacgaggagaagaccgaccuguga

SEQ ID NO: 34660 - RNA, 588 nt, Artificial Sequence
  derived and/or modified sequence opt1 from PLA2G12B__Homo_sapiens__NP_115951
augaagcuggccagcggcuuccucgugcuguggcugucccucgggggcgggcuggcccagagcgacaccucccccgacaccgaggagagcuacuccgacuggggccugcgccaccuccgggggagcuucgaguccgucaacagcuacuucgacuccuuccuggagcugcucggcggcaagaacggggugugccaguaccgcugccgguacggcaaggcgccgaugccccgccccggguacaagccccaggagccgaacggcugcgggagcuacuuccugggccugaaggugcccgaguccauggaccucggcauccccgccaugacgaagugcugcaaccagcuggacgucugcuacgacacgugcggggccaacaaguaccggugcgacgccaaguuccgcuggugccugcacagcaucugcuccgaccucaagcggagccugggcuucguguccaagguggaggccgcgugcgacagccuggucgacaccguguucaacaccguguggacccucgggugccgccccuucaugaacucccagcgggccgccugcaucugcgccgaggaggagaaggaggagcuguga

SEQ ID NO: 34661 - RNA, 1239 nt, Artificial Sequence
  derived and/or modified sequence opt1 from PLA2G15__Homo_sapiens__NP_036452
augggccugcaccuccgccccuaccggguggggcugcugccggacggccuccuguuccugcuccugcugcucaugcugcuggccgaccccgcccuccccgcggggcgccacccgcccgucgugcuggugcccggcgaccuggggaaccagcucgaggccaagcuggacaagcccaccgucgugcacuaccugugcagcaagaagaccgaguccuacuucacgaucuggcucaaccuggagcugcuccugcccgugaucaucgacugcuggaucgacaacauccggcuggucuacaacaagaccagccgcgccacccaguucccggacggcguggacgugcggguccccggcuucgggaagaccuucucccucgaguuccuggaccccagcaaguccagcgugggcuccuacuuccacacgaugguggagagccuggucggguggggcuacacccgcggggaggacgugcggggcgcccccuacgacuggcgccgggccccgaacgagaacggccccuacuuccucgcgcugcgcgagaugaucgaggagauguaccagcuguacgggggccccgugguccucguggcccacuccauggggaacauguacacccuguacuuccugcagcggcagccccaggccuggaaggacaaguacauccgcgccuucgugagccucggcgcgccguggggcggggucgccaagacccugcgggugcuggccuccggcgacaacaaccgcauccccgugaucgggccccucaagauccgggagcagcagcgcagcgccgucuccacgagcuggcugcugcccuacaacuacaccugguccccggagaagguguucgugcagacccccaccaucaacuacacgcuccgggacuaccgcaaguucuuccaggacaucggcuucgaggacggguggcugaugcggcaggacaccgagggccuggucgaggccaccaugccgcccggcgugcagcuccacugccuguacgggaccggcguccccacgcccgacagcuucuacuacgaguccuuccccgaccgcgaccccaagaucugcuucggggacggcgacgggaccgugaaccucaagagcgcgcugcagugccaggccuggcagucccggcaggagcaccaggugcugcugcaggagcucccgggcagcgagcacaucgagaugcuggccaacgccaccacccuggccuaccugaagcgcguccuccugggccccuga

SEQ ID NO: 34662 - RNA, 489 nt, Artificial Sequence
  derived and/or modified sequence opt1 from PLA2G16__Homo_sapiens__NP_009000
augcgcgcccccaucccggagcccaagcccggcgaccugaucgagaucuuccggcccuucuaccgccacugggccaucuacgugggggacggcuacgucgugcaccucgcgccgcccagcgagguggccggggccggcgccgccuccgucaugagcgcgcugaccgacaaggccaucgugaagaaggagcugcucuacgacguggccggguccgacaaguaccaggucaacaacaagcacgacgacaaguacagcccccugcccugcuccaagaucauccagcgggccgaggagcuggugggccaggaggugcucuacaagcugaccagcgagaacugcgagcacuucgucaacgagcugcgcuacggcguggcgcgguccgaccaggugcgcgacgucaucaucgccgccagcguggccgggaugggccucgccgcgaugucccugaucggggugauguucagccggaacaagcgccagaagcaguga

SEQ ID NO: 34663 - RNA, 447 nt, Artificial Sequence
  derived and/or modified sequence opt1 from PLA2G1B__Homo_sapiens__NP_000919
augaagcugcucgugcuggccguccugcucaccguggccgcggccgacagcggcaucagcccccgcgccguguggcaguuccggaagaugaucaagugcgucaucccgggguccgaccccuuccuggaguacaacaacuacggcugcuacugcgggcugggcggguccggcacccccguggacgagcucgacaagugcugccagacgcacgacaacugcuacgaccaggccaagaagcuggacagcugcaaguuccugcucgacaaccccuacacccacaccuacuccuacagcugcuccggcagcgccaucacgugcuccagcaagaacaaggagugcgaggcguucaucugcaacugcgaccgcaacgccgccaucugcuucuccaaggccccguacaacaaggcgcacaagaaccuggacaccaagaaguacugccagagcuga

SEQ ID NO: 34664 - RNA, 1530 nt, Artificial Sequence
  derived and/or modified sequence opt1 from PLA2G3__Homo_sapiens__NP_056530
augggcgugcaggccgggcuguucggcaugcucggguuccugggcgucgcccucgggggcagccccgcgcugcgcugguaccggaccuccugccaccugaccaaggccgugccgggcaacccccugggguaccucagcuuccuggccaaggacgcccagggccuggcccucauccacgcgcgcugggacgcccaccggcgccugcaguccugcagcugggaggacgagcccgagcugacggccgccuacggggcgcucugcgcccacgagaccgccuggggcuccuucauccacacccccgggccggagcugcagcgggcccuggccacccuccagagccagugggaggcgugccgcgcccuggaggagucccccgccggcgcccggaagaagcgcgccgcgggccagagcggggugcccggcgggggccaccagcgggagaagcgcggcuggacgaugcccgggacccuguggugcggcgucggggacuccgccggcaacagcuccgagcucgggguguuccagggcccggaccugugcugccgggagcacgaccgcugcccccagaacaucagcccccugcaguacaacuacggcauccggaacuaccgcuuccacaccaucucccacugcgacugcgacacccgguuccagcagugccuccagaaccagcacgacagcaucuccgacaucgugggggucgccuucuucaacgugcuggagauccccugcuucgugcuggaggagcaggaggccugcgucgccugguacugguggggcgggugccgcauguacggcacggugccgcucgcgcggcugcagccccgcaccuucuacaacgccagcugguccagccgggccaccucccccacccccagcagccgcuccccggccccgcccaagccccggcagaagcagcaccuccgcaaggggccgccccaccagaagggcagcaagcgccccuccaaggccaacacgaccgcgcugcaggaccccauggugagcccgcggcuggacgucgcccccaccggccugcaggggccccagggcgggcucaagccccagggcgcccgcugggugugccgguccuuccgccggcaccuggaccagugcgagcaccagaucgggccgcgcgagaucgaguuccagcugcucaacagcgcccaggagccccuguuccacugcaacugcacccggcgccuggcgcgguuccuccgccugcacuccccgcccgaggugacgaacaugcugugggagcuccugggcacgaccugcuucaagcuggccccgccccucgacugcgucgagggcaagaacugcagccgggacccccgcgccauccggguguccgcccgccaccuccggcgccugcagcagcggcgccaccagcugcaggacaaggggaccgacgagcggcagcccuggcccagcgagccccugcgcggccccauguccuucuacaaccagugccugcagcucacccaggccgcgcgccggcccgaccgccagcagaaguccuggagccaguga

SEQ ID NO: 34665 - RNA, 2250 nt, Artificial Sequence
  derived and/or modified sequence opt1 from PLA2G4A__Homo_sapiens__NP_077734
augagcuucaucgaccccuaccagcacaucaucguggagcaccaguacucccacaaguucaccgucguggugcugcgcgccaccaaggucacgaagggcgccuucggggacaugcucgacaccccggaccccuacguggagcuguucaucagcaccacccccgacucccggaagcgcacgcggcacuucaacaacgacaucaaccccguguggaacgagaccuucgaguucauccuggacccgaaccaggagaacguccucgagaucacccugauggacgcgaacuacgugauggacgagacccugggcacggccaccuucaccgugagcuccaugaaggucggggagaagaaggaggugcccuucaucuucaaccaggugaccgagaugguccucgagaugagccuggaggugugcuccugccccgaccugcgcuucagcauggcccucugcgaccaggagaagacguuccggcagcagcgcaaggagcacauccgggaguccaugaagaagcugcugggccccaagaacagcgaggggcuccacuccgcccgcgacgugccggucguggccauccugggcagcggcgggggcuuccgggcgauggugggguucuccggcgucaugaaggcccuguacgagagcgggauccucgacugcgccaccuacguggccggccuguccggcagcaccugguacauguccacccuguacagccaccccgacuuccccgagaaggggcccgaggagaucaacgaggagcucaugaagaacgugucccacaacccgcugcugcuccugacgccccagaaggucaagcgcuacguggagagccuguggaagaagaaguccuccggccagcccgugaccuucaccgacaucuucgggaugcucaucggcgagacccugauccacaaccggaugaacacgacccugagcucccucaaggagaaggucaacaccgcgcagugcccccugccgcuguucacgugccuccacgugaagcccgacgucagcgagcugauguucgccgacuggguggaguucucccccuacgagaucggcauggccaaguacgggaccuucauggcccccgaccuguucggcagcaaguucuucauggggaccguggucaagaaguacgaggagaacccgcuccacuuccugaugggcguguggggguccgccuucagcauccuguucaaccgcgugcucggcgucuccggcagccagucccgggggagcaccauggaggaggagcuggagaacaucaccacgaagcacaucguguccaacgacagcuccgacagcgacgacgagucccacgagcccaagggcaccgagaacgaggacgcggggagcgacuaccaguccgacaaccaggccagcuggauccaccgcaugaucauggcccuggugagcgacuccgcccucuucaacacccgggagggccgcgccgggaagguccacaacuucaugcugggccugaaccucaacaccagcuacccccugagcccccugagcgacuucgcgacgcaggacuccuucgacgacgacgagcucgacgccgccguggccgacccggacgaguucgagcggaucuacgagccccuggacgucaagagcaagaagauccacgugguggacuccggccugaccuucaaccuccccuacccccugauccugcgcccgcagcgcgggguggaccugaucaucagcuucgacuucuccgcccggcccagcgacuccagcccgcccuucaaggagcuccugcuggcggagaagugggccaagaugaacaagcuccccuuccccaagaucgaccccuacgucuucgaccgggagggccugaaggagugcuacguguucaagccgaagaaccccgacauggagaaggacugccccaccaucauccacuucgugcuggccaacaucaacuuccgcaaguacaaggcccccggggucccgcgcgagaccgaggaggagaaggagaucgccgacuucgacaucuucgacgaccccgagucccccuucagcacguucaacuuccaguaccccaaccaggcguucaagcggcuccacgaccugaugcacuucaacacccugaacaacaucgacgugaucaaggaggccaugguggaguccaucgaguaccgccggcagaacccgagccgcugcuccgucagccucagcaacguggaggcccggcgcuucuucaacaaggaguuccuguccaagcccaaggccuga

SEQ ID NO: 34666 - RNA, 2346 nt, Artificial Sequence
  derived and/or modified sequence opt1 from PLA2G4B__Homo_sapiens__NP_001108105
auggccguggccgaggucagccgcacgugccugcucaccgugcgggugcugcaggcgcaccgccugcccuccaaggaccucgucacgccgagcgacugcuacgugacccuguggcugcccaccgccugcucccaccggcuccagacccgcacggugaagaacagcuccagccccgucuggaaccaguccuuccacuuccggauccaccgccagcugaagaacgugauggagcugaagguguucgaccaggaccucgucaccggcgacgaccccgugcugagcgugcuguucgacgccgggacccuccgggccggcgaguuccgccgggaguccuucagccuguccccgcagggggagggccgccuggaggucgaguuccggcuccagagccuggccgaccgcggggaguggcugguguccaacggcgugcucgucgcgcgggagcugagcugccugcacgugcagcucgaggagaccggcgaccagaaguccagcgagcaccgcgugcagcuggucgugcccggguccugcgagggcccccaggaggccagcguggggacgggcaccuuccgguuccacugccccgccugcugggagcaggagcuguccauccgccuccaggacgccccggaggagcagcugaaggcgccccugagcgcccuccccagcgggcaggucgugcggcugguguuccccaccucccaggagccgcugaugcgcgucgagcucaagaaggaggccggccugcgggagcuggccgugcgccucggcuucgggcccugcgccgaggagcaggcguuccugagccggcgcaagcaggucguggccgccgcccugcgccaggcccuccagcuggacggcgaccugcaggaggacgagauccccguggucgcgaucauggccaccgggggcggcauccgggccaugacgucccucuacgggcagcuggccggccugaaggagcucgggcugcuggacugcgugagcuacaucaccggcgccuccgggagcaccugggcgcucgccaaccuguacgaggaccccgaguggucccagaaggaccuggccggcccgaccgagcuccugaagacccaggugaccaagaacaagcugggcguccuggcccccagccagcuccagcgcuaccggcaggagcuggccgagcgcgcgcggcugggguaccccuccugcuucaccaaccucugggcccugaucaacgaggcccugcuccacgacgagccccacgaccacaagcugagcgaccagcgcgaggcccugucccacggccagaacccgcuccccaucuacugcgcgcugaacaccaaggggcagagccugacgaccuucgaguucggcgaguggugcgaguucucccccuacgaggugggguuccccaaguacggcgccuucaucccgagcgagcuguucggcuccgaguucuucauggggcagcucaugaagcggcugcccgagagccgcaucugcuuccucgagggcaucugguccaaccuguacgccgccaaccugcaggacagccucuacugggccuccgagcccagccaguucugggaccggugggugcgcaaccaggcgaaccuggacaaggagcaggucccccugcucaagaucgaggagccgcccagcaccgccgggcggaucgccgaguucuucaccgaccugcugacguggcgcccccucgcccaggccacccacaacuuccugcggggccugcacuuccacaaggacuacuuccagcacccgcacuucuccaccuggaaggcgaccacgcucgacgggcugcccaaccagcugacccccagcgagccccaccucugccugcuggacgugggcuaccucaucaacaccuccugccugccgcugcuccagcccacccgcgacguggaccugauccugagccucgacuacaaccugcacggcgccuuccagcagcugcagcuccuggggcgguucugccaggagcagggcauccccuucccgcccaucucccccagccccgaggagcagcugcagccccgcgagugccacacguucuccgacccgaccugccccggggcccccgccguccuccacuucccccuggugagcgacuccuuccgggaguacagcgccccgggcgugcgccggacccccgaggaggcggccgccggcgaggucaaccuguccagcuccgacagccccuaccacuacaccaaggugacguacucccaggaggacguggacaagcuccugcaccugacccacuacaacgucugcaacaaccaggagcagcuccuggaggcccugcgccaggcggugcagcgccggcgccagcggcgcccccacuga

SEQ ID NO: 34667 - RNA, 1656 nt, Artificial Sequence
  derived and/or modified sequence opt1 from PLA2G4C__Homo_sapiens__NP_001152794
augcgcacccggccccgcccgcggcugcgccggaccgagaacuuccucacggccgugcaccacggcaagaaggaggagaaggccgcggucgagcgccggcgccugcacgugcugaaggcccucaagaagcugcggaucgaggccgacgaggcccccguggucgccgugcuggggagcggcgggggccuccgcgcgcacaucgccugccugggggugcuguccgagaugaaggagcagggccuccuggacgccgucaccuaccuggccggcgugagcggguccaccugggcgaucagcucccucuacaccaacgacggcgacauggaggcccuggaggccgaccugaagcaccgguucacgcgccaggagugggaccucgccaagagccugcagaagaccauccaggccgcgcgguccgagaacuacagccugaccgacuucugggccuacauggugaucuccaagcagacccgcgagcuccccgagagccaccuguccaacaugaagaagcccgucgaggaggggacgcugccguaccccaucuucgccgccaucgacaacgaccuccagcccagcuggcaggaggcccgggcgcccgagaccugguucgaguucaccccgcaccacgccggcuucuccgcccugggggccuucgugagcaucacccacuucggcuccaaguucaagaagggccgccuggugcggacgcaccccgagcgcgaccucaccuuccugcgggggcuguggggcagcgcccucgggaacaccgaggucauccgcgaguacaucuucgaccagcugcggaaccugacccucaagggccuguggcgccgcgcgguggccaacgccaaguccaucggccaccugaucuucgcccggcuccugcgccugcaggagagcucccagggggagcacccgccgcccgaggacgagggcggggagcccgagcacacguggcucaccgagaugcuggagaacuggacccggaccagccuggagaagcaggagcagccccacgaggaccccgagcgcaagggcagccucuccaaccugauggacuucgugaagaagacggggaucugcgccagcaagugggaguggggcaccacccacaacuuccuguacaagcacggcgggauccgggacaagaucauguccagccgcaagcaccuccaccuggucgacgcgggccuggccaucaacacccccuucccccucgugcugccgcccacgcgggaggugcaccugauccucuccuucgacuucagcgccggggaccccuucgagaccauccgcgccaccaccgacuacugccggcgccacaagauccccuucccccaggucgaggaggcggagcuggaccugugguccaaggcccccgccagcugcuacauccugaagggcgagacggggccgguggugaugcacuucccccucuucaacaucgacgccugcggcggcgacaucgaggccugguccgacaccuacgacaccuucaagcuggcggacaccuacacgcuggacgucguggugcuccugcuggcccucgccaagaagaacguccgggagaacaagaagaagauccugcgcgagcugaugaacguggccgggcucuacuaccccaaggacagcgcccgguccugcugccuggcguga

SEQ ID NO: 34668 - RNA, 2457 nt, Artificial Sequence
  derived and/or modified sequence opt1 from PLA2G4D__Homo_sapiens__NP_828848
auggagagccugucccccggcgggccgcccggccaccccuaccagggggaggccagcacgugcuggcagcucaccgugcgcguccuggaggcccggaaccugcgcugggcggaccuccuguccgaggccgaccccuacgugauccugcagcucagcaccgcccccggcaugaaguucaagaccaagacccugaccgacacgucccaccccguguggaacgaggccuuccgguuccugauccagagccaggucaagaacgugcucgagcuguccaucuacgacgaggacagcgugaccgaggacgacaucugcuucaagguccuguacgacaucuccgaggugcuccccgggaagcugcugcgcaagaccuucagccagagcccccagggcgaggaggagcucgacguggaguuccugauggaggagaccuccgaccggccggagaaccugaucacgaacaaggucaucguggcccgcgagcucuccugccuggacgugcaccuggacagcaccggcuccaccgcggucguggccgaccaggacaagcucgagcuggagcuggugcucaaggggagcuacgaggacacccagacguccuuccugggcaccgccagcgccuuccgguuccacuacauggcggcccuggagaccgagcucuccgggcgccugcggagcagccgcuccaacggcuggaacggggacaacagcgccggcuaccugaccgucccccuccggccccugacgaucggcaaggaggugaccauggacgugcccgccccgaacgcccccgggguccgccugcagcucaaggcggagggcugccccgaggagcuggccgugcaccugggguucaaccucugcgccgaggagcaggccuuccugucccggcgcaagcaggucguggccaaggcgcugaagcaggcccuccagcuggaccgggaccugcaggaggacgaggugcccguggucggcaucauggccaccggcgggggcgcccgcgccaugaccagccucuacgggcaccuccuggcgcugcagaagcugggccugcucgacugcgugacguacuucuccgggaucagcggcuccaccuggaccauggcccaccuguacggcgacccggaguggagccagcgggaccuggaggggcccauccgcuacgcccgggagcaccuggccaaguccaagcucgaggucuucagccccgagcgccuggccuccuaccggcgcgagcuggagcuccgcgcggagcagggccaccccaccacguucguggaccugugggcccuggugcucgagagcaugcugcacgggcaggucauggaccagaagcuguccggccagcgggccgcccucgagcgcgggcagaacccgcugccccuguaccucagccugaacgugaaggagaacaaccuggagacccucgacuucaaggaguggguggaguucucccccuacgaggucggcuuccugaaguacggcgcguucgugcccccggagcuguucgggagcgaguucuucaugggccggcucaugcgccggauccccgagccccgcaucugcuuccuggaggccaucugguccaacaucuucagccugaaccuccuggacgccugguacgaccugaccuccagcggggagagcuggaagcagcacaucaaggacaagacccggucccucgagaaggagccccugacgaccagcggcaccuccagccgccuggaggccuccuggcuccagccggggaccgcccuggcgcaggccuucaagggcuuccugacgggccggccccuccaccagcgcagccccaacuuccugcaggggcugcagcuccaccaggacuacugcucccacaaggacuucagcaccugggccgacuaccagcuggacuccaugccgagccagcugacccccaaggagccccggcucugccugguggacgccgccuacuucaucaacaccuccagccccuccauguuccgcccgggccggcgccuggaccucauccugagcuucgacuacucccugagcgcgcccuucgaggcccuccagcagacggagcuguacugccgggcccgcgggcugcccuucccccgggucgagccgagcccccaggaccagcaccagccccgcgagugccaccucuucuccgaccccgccugcccggaggcccccauccugcugcacuucccccucgugaacgcgagcuucaaggaccacuccgcccccggcgugcagcggagcccggccgagcugcagggcgggcaggucgaccugaccggcgcgaccugccccuacacccucuccaacaugaccuacaaggaggaggacuucgagcgccugcugcgccucagcgacuacaacgugcagacgucccagggggccauccugcaggcccugcggaccgcccucaagcaccgcacccuggaggcccggccgccccgcgcccagaccuga

SEQ ID NO: 34669 - RNA, 510 nt, Artificial Sequence
  derived and/or modified sequence opt1 from PLA2G5__Homo_sapiens__XP_011539888
auggaggugcgcaccaagcggccccgcaucggcaccgacacgaaccggccguucgucgaggaggagauccagauggccauccgcacccccgagaugaaggggcugcucccccuggccugguuccuggcgugcagcgugcccgccgugcagggcgggcuccuggaccugaaguccaugaucgagaaggucaccggcaagaacgcccucaccaacuacggguucuacggcugcuacugcggcuggggcgggcgggggacgccgaaggacggcaccgacuggugcugcugggcccacgaccacugcuacgggcgccuggaggagaagggcugcaacauccggacccagagcuacaaguaccgcuucgccuggggcguggugaccugcgagcccgggcccuucugccacgucaaccugugcgcgugcgaccggaagcucguguacugccugaagcgcaaccugcgguccuacaacccccaguaccaguacuucccgaacauccucugcagcuga

SEQ ID NO: 34670 - RNA, 2259 nt, Artificial Sequence
  derived and/or modified sequence opt1 from PLA2G6__Homo_sapiens__NP_001186491
augcaguucuucggccgccuggugaacaccuucagcggggucaccaaccucuucuccaaccccuuccgggugaaggagguggccgucgccgacuacacgagcuccgaccgcgugcgggaggagggccagcugauccuguuccagaacaccccgaaccgcaccugggacugcgugcucgucaacccccggaacagccaguccggguuccgccuguuccagcuggagcucgaggcggacgcccuggugaacuuccaccaguacagcucccagcugcuccccuucuacgagagcagcccccaggugcugcacaccgagguccugcagcaccucacggaccugauccggaaccacccguccugguccguggcccaccuggccguggagcucggcauccgcgagugcuuccaccacagccggaucaucuccugcgccaacugcgcggagaacgaggaggggugcacgccccugcaccuggccugccgcaagggcgacggcgagauccucgucgagcuggugcaguacugccacacccagauggacgugaccgacuacaagggggagaccgucuuccacuacgccgugcagggcgacaacagccaggugcugcagcuccuggggcggaacgccgucgcgggccugaaccaggugaacaaccaggggcucacgccccugcaccuggccugccagcucggcaagcaggagauggugcgcguccugcugcucugcaacgcccggugcaacaucaugggccccaacggguacccgauccacuccgccaugaaguucagccagaagggcugcgccgagaugaucaucuccauggacagcucccagauccacagcaaggacccccgcuacggggcgagcccccugcacugggccaagaacgccgagauggcccggaugcugcucaagcgcggcugcaacgugaacuccaccagcuccgccggcaacaccgcgcugcacguggccgucaugcggaaccgcuucgacugcgccaucgugcugcucacccacggggccaacgccgacgcgcggggcgagcacgggaacacgccccugcaccuggccaugagcaaggacaacgucgagaugaucaaggcccucaucguguucggcgccgagguggacaccccgaacgacuucggggagacccccaccuuccuggccuccaagaucggccgccagcugcaggaccucaugcacaucagccgggcgcgcaagcccgccuucauccugggcuccaugcgcgacgagaagcggacccacgaccaccuccugugccuggacgggggcggggucaagggccugaucaucauccagcuccugaucgccaucgagaaggccagcgggguggcgaccaaggaccuguucgacuggguggccggcaccuccacgggcgggauccuggcccucgccauccugcacagcaaguccauggccuacaugcgcggcauguacuuccggaugaaggacgaggucuuccgcgggagccggcccuacgaguccggcccgcuggaggaguuccucaagcgcgaguucggggagcacaccaagaugaccgacgugcggaagcccaaggugaugcugaccggcacgcugagcgaccgccagcccgcggagcuccaccuguuccggaacuacgacgcccccgagaccguccgcgagccgcgguucaaccagaacgugaaccugcgcccgcccgcccagcccuccgaccagcucguguggcgggccgcccgcagcuccggcgcggcccccaccuacuuccggcccaacgggcgcuuccuggacggcgggcugcucgccaacaaccccacccuggacgccaugacggagauccacgaguacaaccaggaccugauccggaagggccaggccaacaaggucaagaagcucagcaucguggugucccugggcaccgggcgcagcccccaggucccggugaccugcguggacgucuuccggcccagcaaccccugggagcuggcgaagaccguguucggcgccaaggagcucgggaagaugguggucgacugcugcacggacccggacggccgcgccguggaccgcgcccgggcguggugcgagaugguggggauccaguacuuccgccugaacccccagcugggcaccgacaucaugcucgacgaggucuccgacaccgugcuggugaacgcccugugggagaccgaggucuacaucuacgagcaccgggaggaguuccagaagcucauccagcugcugcucagccccuga

SEQ ID NO: 34671 - RNA, 1326 nt, Artificial Sequence
  derived and/or modified sequence opt1 from PLA2G7__Homo_sapiens__NP_005075
auggugcccccgaagcugcacguccucuucugccugugcggcugccuggccgugguguaccccuucgacuggcaguacaucaaccccgucgcccacaugaaguccagcgcgugggugaacaagauccaggugcucauggccgccgccagcuucgggcagaccaagaucccccgcggcaacgggccguacuccgucggcugcaccgaccugauguucgaccacacgaacaaggggaccuuccugcggcucuacuaccccagccaggacaacgaccgccuggacacccuguggauccccaacaaggaguacuucuggggccucuccaaguuccugggcacccacuggcugauggggaacauccuccggcugcuguucggcagcaugacgacccccgccaacuggaacuccccgcuccgccccggggagaaguacccccuggugguguucagccacggccugggggcguuccggacccucuacuccgccaucggcaucgaccuggccagccacggcuucaucgucgccgcgguggagcaccgcgaccgguccgccagcgccaccuacuacuucaaggaccaguccgccgccgagaucggggacaagagcuggcuguaccuccgcacgcugaagcaggaggaggagacccacauccggaacgagcagguccgccagcgggcgaaggagugcucccaggcccugagccucauccuggacaucgaccacggcaagcccgugaagaacgcccuggaccucaaguucgacauggagcagcugaaggacuccaucgaccgcgagaagaucgccgugaucgggcacagcuucggcggcgccaccgugauccagacccuguccgaggaccagcgguuccgcugcgggaucgcgcucgacgccuggauguucccgcugggcgacgaggucuacagccggaucccccagccccuguucuucaucaacagcgaguacuuccaguaccccgccaacaucaucaagaugaagaagugcuacuccccggacaaggagcgcaagaugaucacgauccgggggagcgugcaccagaacuucgccgacuucaccuucgccaccggcaagaucaucgggcacaugcucaagcugaagggcgacaucgacuccaacguggcgaucgaccugagcaacaaggccucccucgccuuccugcagaagcaccugggccuccacaaggacuucgaccagugggacugccugaucgagggggacgacgagaaccugauccccggcaccaacaucaacacgaccaaccagcacaucaugcuccagaacagcuccgggaucgagaaguacaacuga

SEQ ID NO: 34672 - RNA, 3975 nt, Artificial Sequence
  derived and/or modified sequence opt1 from PLA2R1__Homo_sapiens__NP_001007268
augcugcucagccccucccugcugcuccugcugcuccugggcgccccgcgcgggugcgccgagggcguggcggccgcccugacccccgagcggcuccuggaguggcaggacaaggggaucuucgucauccagagcgagucccugaagaagugcauccaggccggcaagagcgugcucacccuggagaacugcaagcaggccaacaagcacaugcuguggaaguggguguccaaccacggccucuucaacaucgggggcagcgggugccugggccugaacuucuccgcgcccgagcagccccucagccuguacgagugcgacuccacgcuggucagccuccgcuggcggugcaaccgcaagaugaucaccgggccgcugcaguacuccguccagguggcccacgacaacaccgugguggccagccggaaguacauccacaaguggaucuccuacggcagcgggggcggcgacaucugcgaguaccugcacaaggaccuccacaccaucaaggggaacacgcacggcaugcccugcauguuccccuuccaguacaaccaccaguggcaccacgagugcacccgcgaggggcgggaggacgaccugcuguggugcgccaccaccucccgcuacgagcgggacgagaaguggggcuucugccccgacccgacgagcgcggaggugggcugcgacaccaucugggagaaggaccucaacucccacaucugcuaccaguucaaccugcugagcucccucagcuggagcgaggcccacuccagcugccagaugcagggcgggacccugcuguccaucaccgacgagacggaggagaacuucauccgcgagcacaugagcuccaagaccgucgagguguggauggggcucaaccagcuggacgagcacgccggcuggcaguggagcgacgggacgccccugaacuaccucaacuggucccccgaggugaacuucgagcccuucgucgaggaccacugcggcaccuucagcuccuucaugccgagcgccuggcggucccgcgacugcgagagcacccugcccuacaucugcaagaaguaccugaaccacaucgaccacgagaucguggagaaggacgccuggaaguacuacgcgacccacugcgagcccggcuggaaccccuacaaccggaacugcuacaagcuccagaaggaggagaagaccuggcacgaggcccugcgcuccugccaggccgacaacagcgcccugaucgacaucaccucccucgccgagguggaguuccuggucacgcugcucggggacgagaacgcgagcgagaccuggaucggccuguccagcaacaagaucccgguguccuucgaguggagcaacgacagcuccgugaucuucaccaacuggcacacccuggagccccacaucuuccccaaccggagccagcucugcgucuccgccgagcagagcgaggggcacuggaaggugaagaacugcgaggagcgccuguucuacaucugcaagaaggccggccacgugcuguccgacgccgagagcgggugccaggagggcugggagcggcacggcggguucugcuacaagaucgacacgguccugcgcuccuucgaccaggccagcuccggcuacuacugcccgcccgcgcucgugaccaucaccaaccgguucgagcaggccuucaucaccagccugaucuccagcguggucaagaugaaggacuccuacuucuggaucgcccugcaggaccagaacgacacgggggaguacaccuggaagcccgugggccagaagcccgagcccguccaguacacccacuggaacacccaccagccgcgcuacagcgggggcugcguggccaugcggggccgccacccccucgggcgcugggaggugaagcacugccggcacuucaaggccaugucccugugcaagcagcccgucgagaaccaggagaaggcggaguacgaggagcgcuggcccuuccacccgugcuaccuggacugggagagcgagcccggccucgccuccugcuucaagguguuccacagcgagaaggugcugaugaagcggacguggcgcgaggccgaggccuucugcgaggaguucggggcgcaccuggccagcuucgcccacaucgaggaggagaacuucgucaacgagcuccugcacuccaaguucaacuggaccgaggagcggcaguucuggaucggcuucaacaagcgcaacccccugaacgccggcagcugggagugguccgaccggaccccgguggugagcuccuuccucgacaacaccuacuucggggaggacgcccgcaacugcgcggucuacaaggccaacaagacgcugcugccccuccacugcggcagcaagcgggaguggaucugcaagaucccccgcgacgugaagcccaagaucccguucugguaccaguacgacgugcccuggcuguucuaccaggacgccgaguaccuguuccacaccuucgccuccgaguggcucaacuucgaguucgucugcagcuggcugcacuccgaccugcucaccauccacagcgcccacgagcaggaguucauccacuccaagaucaaggcgcugagcaaguacggggccuccugguggaucggccugcaggaggagcgggccaacgacgaguuccgcuggcgggacgggacccccgugaucuaccagaacugggacaccggccgcgagcggacggugaacaaccagagccagcgcugcggcuucaucuccagcaucaccgggcucuggggcuccgaggagugcagcgucuccaugcccagcaucugcaagcggaagaagguguggcugaucgagaagaagaaggacaccccgaagcagcacgggaccugccccaagggcuggcuguacuucaacuacaagugccuccugcugaacauccccaaggaccccagcuccuggaagaacuggacgcacgcccagcacuucugcgccgaggagggcgggacccucguggcgaucgagagcgaggucgagcaggccuucaucaccaugaaccuguucggccagaccacguccguguggaucgggcugcagaacgacgacuacgagaccuggcucaacggcaagccgguggucuacagcaacuggucccccuucgacaucaucaacauccccagccacaacaccaccgaggugcagaagcacaucccccugugcgcccugcucuccagcaacccgaacuuccacuucacggggaagugguacuucgaggacugcggcaaggagggguacggcuucgugugcgagaagaugcaggacaccuccggccacggggucaacaccagcgacauguaccccaugcccaacacccuggaguacggcaaccgcacguacaagaucaucaacgccaacaugaccugguacgcggccaucaagaccugccugaugcacaaggcccagcucguguccaucaccgaccaguaccaccagagcuuccugacggugguccugaaccggcucggguacgcccacuggaucggccuguucaccaccgacaacgggcugaacuucgacugguccgacggcaccaagagcuccuucacguucuggaaggacgaggagagcucccuccugggcgacugcguguucgccgacagcaacgggcgcuggcacuccaccgcgugcgagagcuuccugcagggcgccaucugccacgugcccccggagacccgccagagcgagcaccccgagcucugcuccgagaccagcauccccuggaucaaguucaaguccaacugcuacagcuucuccacgguccuggacagcauguccuucgaggccgcccacgaguucugcaagaaggaggggagcaaccugcucaccaucaaggacgaggccgagaacgcguuccugcuggaggagcuguucgccuucggcuccagcgugcagaugguguggcucaacgcccaguucgacggcaacuccaaguga

SEQ ID NO: 34673 - RNA, 2388 nt, Artificial Sequence
  derived and/or modified sequence opt1 from PLAA__Homo_sapiens__NP_001026859
augaccagcggcgccacccgcuaccggcuguccugcagccuccgcgggcacgagcuggacgugcggggccuggucugcugcgccuacccgcccggggcguucguguccgugagccgcgaccggacgacccgccucugggcccccgacucccccaaccggagcuucaccgagaugcacugcauguccggccacagcaacuucgucuccugcgugugcaucauccccagcuccgacaucuacccgcacgggcugaucgccaccggcggcaacgaccacaacaucugcaucuucagccuggacucccccaugccccucuacauccugaaggggcacaagaacacggugugcagccuguccagcggcaaguucgggacccuccuguccggcagcugggacaccaccgccaaggucuggcugaacgacaagugcaugaugacgcuccaggggcacaccgccgcggugugggccgugaagauccugcccgagcagggccugaugcucaccggcuccgccgacaagaccgucaagcuguggaaggccgggcgcugcgagcggacguucagcggccacgaggacugcgugcgcgggcuggcgauccucagcgagaccgaguuccuguccugcgccaacgacgccagcauccggcgcuggcagaucaccggcgagugccuggagguguacuacggccacaccaacuacaucuacuccaucagcgucuucccgaacugccgggacuucgugacgaccgccgaggaccgcucccuccggaucuggaagcacggggagugcgcccagaccauccgccugcccgcgcagagcaucuggugcugcugcgugcuggacaacggcgacaucgucgugggggccuccgacggcaucauccggguguucaccgagagcgaggaccgcacggccuccgccgaggagaucaaggccuucgagaaggagcucagccacgcgaccaucgacuccaagaccggggaccugggcgacaucaacgccgagcagcugcccggccgggagcaccucaacgagcccgggacccgcgagggccagacgcggcugauccgcgacggggagaaggucgaggccuaccaguggagcguguccgagggccgcuggaucaagaucggggacguggucggcagcuccggcgccaaccagcagaccagcgggaaggugcuguacgagggcaaggaguucgacuacguguucuccaucgacgucaacgagggcgggccgagcuacaagcuccccuacaacaccuccgacgaccccuggcugaccgccuacaacuuccugcagaagaacgaccucaaccccauguuccuggaccagguggcgaaguucaucaucgacaacacgaaggggcagaugcugggccucggcaacccgagcuucagcgaccccuucaccgggggcgggcgguacguccccggcuccagcggcuccagcaacacccugcccaccgccgacccguucacgggggccggccgcuacgugcccggguccgccagcaugggcaccaccauggccgggguggaccccuucaccggcaacuccgcguaccggagcgccgccuccaagacgaugaacaucuacuuccccaagaaggaggccgucaccuucgaccaggcgaacccgacccagauccugggcaagcucaaggagcugaacgggaccgcccccgaggagaagaagcugaccgaggacgaccucauccugcuggagaagauccucagccugaucugcaacuccagcuccgagaagcccacggugcagcagcugcagauccucuggaaggccaucaacugccccgaggacaucguguucccggcccuggacauccugcgccugagcaucaagcaccccuccgucaacgagaacuucugcaacgagaaggagggcgcccaguucagcucccaccucaucaaccugcugaaccccaaggggaagccggcgaaccagcuccuggcccugcggaccuucugcaacugcuucgugggccaggccgggcagaagcucaugaugagccagcgcgagagccugaugucccacgccaucgagcucaagagcggcuccaacaagaacauccacaucgcccuggcgacccuggcccugaacuacagcgugugcuuccacaaggaccacaacaucgagggcaaggcccagugccucucccugaucagcaccauccuggaggucgugcaggaccucgaggccacguuccggcugcugguggcccucgggacccugaucuccgacgacagcaacgcgguccagcuggccaagucccucggcguggacagccagaucaagaaguacuccagcguguccgagcccgccaaggucagcgagugcugccgcuucauccugaaccugcucuga

SEQ ID NO: 34674 - RNA, 639 nt, Artificial Sequence
  derived and/or modified sequence opt1 from PLAC1__Homo_sapiens__NP_068568
augaagguguucaaguucaucggccugaugauccuccugaccagcgccuucuccgccgggagcggccagucccccaugaccguccugugcagcaucgacugguucauggugacggugcacccguucaugcucaacaacgacgucugcgugcacuuccacgagcugcaccuggggcucggcugcccgcccaaccacgugcagccccacgcguaccaguucaccuaccgcgucaccgagugcgggauccgggccaaggccgugucccaggacauggugaucuacagcaccgagauccacuacuccagcaagggcacgcccuccaaguucgucauccccgugagcugcgccgcgccccagaagucccccuggcugaccaagccgugcagcaugcgcguggccuccaagagccgggccaccgcccagaaggacgagaagugcuacgaggucuucucccugagccaguccagccagcgccccaacugcgacugcccgcccugcguguucuccgaggaggagcacacccaggugcccugccaccaggccggcgcgcaggaggcccagccccuccagcccagccacuuccuggacaucagcgaggacuggucccugcacacggacgacaugaucgggagcauguga

SEQ ID NO: 34675 - RNA, 348 nt, Artificial Sequence
  derived and/or modified sequence opt1 from PLAC8__Homo_sapiens__NP_001124187
augcaggcccaggcccccguggucguggugacccagccgggcgucgggcccggccccgcgccccagaacagcaacuggcagaccgggaugugcgacugcuucuccgacugcggcgugugccugugcgggacguucugcuucccgugccucggcugccagguggccgccgacaugaacgagugcugccugugcggcaccagcgucgccaugcgcacccuguaccggacccgcuacgggauccccggcuccaucugcgacgacuacauggccacgcucugcugcccccacugcacccugugccagaucaagcgggacaucaaccgccggcgcgcgaugcggaccuucuga

SEQ ID NO: 34676 - RNA, 1503 nt, Artificial Sequence
  derived and/or modified sequence opt1 from PLAG1__Homo_sapiens__NP_001108106
auggccaccgugauccccggcgaccugagcgagguccgcgacacccagaaggugccguccgggaagcggaagcgcggcgagacgaagccccggaagaacuuccccugccagcucugcgacaaggccuucaacagcguggagaagcugaagguccacuccuacagccacaccggggagcgccccuacaagugcauccagcaggacugcaccaaggcguucguguccaaguacaagcugcagcggcacauggccacccacagcccggagaagacgcacaagugcaacuacugcgagaagauguuccaccgcaaggaccaccucaagaaccaccuccacacccacgaccccaacaaggagaccuucaagugcgaggagugcggcaagaacuacaacaccaagcugggguucaagcggcaccucgcccugcacgccgccacguccggcgaccugaccugcaaggugugccuccagaccuucgagagcaccggcguccugcuggagcaccucaagucccacgcggggaaguccagcggcggggugaaggagaagaagcaccagugcgagcacugcgaccgccgguucuacacgcgcaaggacgugcggcgccacauggucgugcacaccggccggaaggacuuccugugccaguacugcgcccagcgcuucgggcggaaggaccaccugacccgccacaugaagaagucccacaaccaggagcuccugaaggugaagaccgagcccgucgacuuccuggaccccuucacgugcaacgugagcgugccgaucaaggacgagcuccugcccgucaugagccugcccuccagcgagcuccuguccaagcccuucaccaacacccugcagcucaaccuguacaacaccccguuccagagcaugcaguccagcggcagcgcccaccagaugaucacgacccugccccucggcaugaccugccccaucgacauggacaccgugcaccccucccaccaccugagcuucaaguacccguucuccagcacguccuacgccaucagcauccccgagaaggagcagccccugaagggggagaucgaguccuaccucauggagcugcagggcggggugcccagcuccagccaggacucccaggcgagcuccagcuccaagcugggccucgacccgcagaucggcagccuggacgacggggccggcgaccugucccucagcaaguccagcaucagcaucuccgacccccugaacacccccgcccuggacuucagccagcuguucaacuucaucccccugaacgggccgcccuacaacccccuguccgucggcagccucgggauguccuacagccaggaggaggcccacuccagcgugucccagcugcccccgcagacccaggaccugcaggaccccgccaacaccaucggccucggcagccugcacucccugagcgcggccuucacguccagccucuccaccagcaccacccugccccgguuccaccaggccuuccaguga

SEQ ID NO: 34677 - RNA, 1236 nt, Artificial Sequence
  derived and/or modified sequence opt1 from PLAGL1__Homo_sapiens__NP_001275966
auggccacccacagcccccagaagucccaccagugcgcccacugcgagaagaccuucaaccgcaaggaccaccugaagaaccaccuccagacgcacgacccgaacaagauggcguucggcugcgaggagugcgggaagaaguacaacaccaugcugggcuacaagcggcaccuggcccuccacgccgccagcuccggggaccugaccugcggcgugugcgcccuggagcucgggagcaccgagguccugcuggaccaccucaaggcgcacgccgaggagaagccgcccuccggcacgaaggagaagaagcaccagugcgaccacugcgagcgcugcuucuacacccggaaggacgugcgccggcaccuggugguccacaccggcugcaaggacuuccugugccaguucugcgcccagcgcuucgggcggaaggaccaccucacccgccacacgaagaagacccacagccaggagcugaugaaggagucccugcagaccggcgaccuccugagcaccuuccacacgaucucccccagcuuccagcugaaggccgcggcccucccgcccuucccccugggggccuccgcccagaacggccuggccagcucccuccccgcggaggugcacagccugacccuguccccgcccgagcaggccgcccagcccaugcagccccuccccgagagccuggccucccugcaccccagcgugucccccgggagcccgcccccgccccuccccaaccacaaguacaacaccaccagcacguccuacagcccccuggccucccugccccucaaggcggacaccaagggcuucugcaacaucagccuguucgaggaccugccccuccaggagccccaguccccgcagaagcugaaccccggcuucgaccuggccaaggggaacgccggcaaggucaaccuccccaaggagcugcccgccgacgccgugaaccugaccaucccggcgagccucgaccugagcccccugcucggguucuggcagcugcccccgcccgccacccagaacacguucggcaacuccacccuggcccucggccccggggagucccugccccaccggcugagcugccucggccagcagcagcaggagccgccccuggccauggggaccgugucccugggccagcugccccugcccccgaucccccacgucuucagcgccgggaccggcuccgcgauccucccccacuuccaccacgccuuccgcuga

SEQ ID NO: 34678 - RNA, 1491 nt, Artificial Sequence
  derived and/or modified sequence opt1 from PLAGL2__Homo_sapiens__NP_002648
augaccaccuucuucacgagcgugcccccguggauccaggacgccaagcaggaggaggaggucggcuggaagcuggugccccgcccccgggggcgcgaggccgagucccaggugaagugccagugcgagaucagcggcacccccuucuccaacggggagaagcuccggccgcacagccugccccagcccgagcagcgccccuacuccugcccgcagcugcacugcggcaaggcguucgccagcaaguacaagcucuaccggcacauggccacccacuccgcccagaagccccaccagugcauguacugcgacaagauguuccaccgcaaggaccaccuccggaaccaccuccagacccacgaccccaacaaggaggcccugcacugcagcgagugcgggaagaacuacaacacgaagcugggcuaccgccggcaccuggcgaugcacgccgccuccagcggcgaccuguccugcaaggucugccugcagaccuucgagagcacccaggcccugcucgagcaccugaaggcgcacucccgccggguggccgggggcgccaaggagaagaagcaccccugcgaccacugcgaccgccgguucuacacccgcaaggacgugcggcgccaccuggucgugcacacggggcggaaggacuuccucugccaguacugcgcccagcgcuucggccggaaggaccaccugacccgccacgugaagaagucccacucccaggagcugcucaagaucaagaccgagccggucgacaugcuggggcugcucagcugcuccagcaccguguccgugaaggaggagcugagccccguccugugcauggccagccgggacgugaugggcacgaaggcguuccccggcaugcuccccauggggauguacggcgcccacaucccgaccaugcccuccaccggggugccccacagccugguccacaacacccugcccaugggcauguccuacccgcucgagagcucccccaucagcucccccgcccagcugcccccgaaguaccagcugggcagcacguccuaccuccccgacaagcugcccaagguggagguggacagcuuccuggccgagcuccccgggucccugagccuguccagcgccgagccgcagcccgcgagcccccagccggccgccgccgccgcgcuccuggacgaggcccugcucgccaagagccccgccaaccuguccgaggcccugugcgcggccaacgucgacuucagccaccuccugggcuuccugccccucaaccugcccccgugcaacccgcccggggccaccggcgggcuggugaugggcuacucccaggccgaggcgcagccccuccugaccacccugcaggcccagccccaggacagccccggcgccgggggcccccugaacuucgggccccuccacagccugccgcccguguucacguccggccugagcuccaccacccucccccgcuuccaccaggccuuccaguga

SEQ ID NO: 34679 - RNA, 1689 nt, Artificial Sequence
  derived and/or modified sequence opt1 from PLAT__Homo_sapiens__NP_000921
auggacgccaugaagcgcggccugugcugcgugcuccugcugugcggggccgucuucgugagccccucccaggagauccacgcgcgguuccgccggggcgcccgcagcuaccaggugaucugccgggacgagaagacccagaugaucuaccagcagcaccaguccuggcuccgcccgguccugcggagcaaccgcguggaguacugcuggugcaacuccgggcgggcccagugccacagcgugcccgucaaguccugcagcgagccccgcugcuucaacggcgggaccugccagcaggcccuguacuucuccgacuucgugugccagugccccgagggcuucgccggcaagugcugcgagaucgacacgcgggcgaccugcuacgaggaccaggggaucagcuaccgcggcaccugguccaccgccgagagcggggccgagugcacgaacuggaacuccagcgcccucgcgcagaagccguacuccggccggcgccccgacgccauccggcuggggcugggcaaccacaacuacugccgcaaccccgaccgggacagcaagcccuggugcuacguguucaaggccggcaaguacuccagcgaguucugcuccaccccggccugcagcgaggggaacagcgacugcuacuucggcaacggguccgccuaccgcggcacccacagccucaccgaguccggcgcgagcugccugcccuggaacuccaugauccugaucgggaaggucuacacggcccagaaccccagcgcccaggcccucggccuggggaagcacaacuacugccggaaccccgacggcgacgccaagccguggugccacgugcugaagaaccgccggcucaccugggaguacugcgacgugcccuccugcagcacgugcgggcugcgccaguacucccagccccaguuccgcaucaagggcggccuguucgcggacaucgccagccaccccuggcaggccgccaucuucgccaagcaccggcgcuccccgggggagcgguuccucugcggcgggauccugaucagcuccugcuggauccugagcgcggcccacugcuuccaggagcgcuucccgccccaccaccucaccgucauccugggccggaccuaccgcguggugcccggggaggaggagcagaaguucgaggucgagaaguacaucgugcacaaggaguucgacgacgacaccuacgacaacgacaucgcccugcuccagcugaaguccgacagcucccggugcgcccaggagagcuccgugguccgcaccgugugccugccgcccgccgaccuccagcugcccgacuggaccgagugcgagcugagcggcuacggcaagcacgaggcgcucagccccuucuacuccgagcggcugaaggaggcccacgugcgccuguaccccagcucccggugcacgagccagcaccuccugaaccgcaccgucaccgacaacaugcugugcgccggggacacccgguccggcgggccccaggccaaccuccacgacgcgugccagggcgacagcgggggcccccuggugugccugaacgacggccgcaugacgcucguggggaucaucuccuggggccuggggugcggccagaaggacguccccggcguguacaccaaggucaccaacuaccuggacuggauccgggacaacaugcgcccguga

SEQ ID NO: 34680 - RNA, 1245 nt, Artificial Sequence
  derived and/or modified sequence opt1 from PLAU__Homo_sapiens__NP_001138503
augguguuccaccuccgcacccgguacgagcaggccaacugcgacugccugaacggcgggaccugcgucagcaacaaguacuucuccaacauccacuggugcaacugccccaagaaguucggcgggcagcacugcgagaucgacaagagcaagacgugcuacgagggcaacgggcacuucuaccgcggcaaggccuccaccgacaccaugggccggccgugccugcccuggaacagcgcgaccgugcugcagcagacguaccacgcccaccgcuccgacgcccuccagcuggggcugggcaagcacaacuacugccggaaccccgacaaccgccggcgccccuggugcuacgugcaggucgggcucaagccgcuggugcaggagugcauggugcacgacugcgccgacggcaagaagcccagcuccccgcccgaggagcugaaguuccagugcgggcagaagacccuccggccccgcuucaagaucaucggcggcgaguucaccaccaucgagaaccagcccugguucgccgcgaucuaccggcgccaccgcgggggcagcgucacguacgugugcgggggcucccugaucagccccugcugggugaucuccgccacccacugcuucaucgacuaccccaagaaggaggacuacaucgucuaccugggccggagccggcucaacuccaacacccagggggagaugaaguucgagguggagaaccugauccugcacaaggacuacagcgccgacacccucgcccaccacaacgacaucgcgcugcugaagauccgcuccaaggagggccggugcgcccagccgagccgcacgauccagaccaucugccuccccuccauguacaacgacccccaguucgggaccagcugcgagaucaccggcuucgggaaggagaacuccacggacuaccuguaccccgagcagcugaagaugaccguggucaagcucaucagccaccgggagugccagcagccgcacuacuacggcagcgaggugaccaccaagaugcugugcgccgccgacccccaguggaagacggacuccugccagggcgacagcgggggcccccuggugugcucccuccaggggcgcaugacccugaccggcaucgucagcugggggcggggcugcgcccugaaggacaagcccggcguguacacccgcgugucccacuuccucccguggauccgcagccacacgaaggaggagaacgggcuggcgcuguga

SEQ ID NO: 34681 - RNA, 846 nt, Artificial Sequence
  derived and/or modified sequence opt1 from PLAUR__Homo_sapiens__NP_001005376
augggccacccgccccugcucccccugcugcuccugcugcacacgugcgugcccgccagcugggggcuccgcugcaugcagugcaagaccaacggcgacugccgcgucgaggagugcgcccuggggcaggaccugugccgcaccaccaucgugcggcucugggaggagggcgaggagcuggagcugguggagaaguccugcacccacagcgagaagaccaaccgcacgcucuccuaccggaccgggcugaagaucaccagccugaccgaggucgugugcggccucgaccugugcaaccagggcaacuccgggcgcgcggugacguacagccggucccgcuaccuggagugcaucagcugcggcuccagcgacauguccugcgagcgggggcgccaccagagccuccagugccggucccccgaggagcagugccuggacgucgugacccacuggauccaggagggcgaggaggggcgcccgaaggacgaccggcaccuccgcggcugcggcuaccugcccgggugccccggcagcaacggguuccacaacaacgacaccuuccacuuccugaagugcugcaacaccacgaagugcaacgagggccccauccuggagcucgagaaccugccgcagaacggccggcagugcuacuccugcaaggggaacagcacccacggcugcuccagcgaggagaccuuccugaucgacugccgcgggcccaugaaccagugccucguggccaccggcacgcacgagcggucccugugggggagcuggcugcccugcaagagcaccaccgcccuccggcccccgugcugcgaggaggcccaggccacccacgucuga

SEQ ID NO: 34682 - RNA, 4344 nt, Artificial Sequence
  derived and/or modified sequence opt1 from PLB1__Homo_sapiens__NP_001164056
augggccugcgccccgggaucuuccuccuggagcugcuccugcugcucggccaggggaccccgcagauccacaccagcccccggaaguccacgcuggagggccagcuguggcccgagacccucaagaacagccccuucccgugcaaccccaacaagcugggggugaacaugcccuccaagagcguccacucccugaagcccagcgacaucaaguucguggccgccaucggcaaccucgagaucccgcccgaccccggcaccggggaccuggagaagcaggacuggaccgagcgcccccagcaggucugcaugggcgugaugacggugcuguccgacaucauccgguacuucagcccguccgugcccaugcccgucugccacaccgggaagcgcgugaucccccacgacggcgcggaggaccucuggauccaggcccaggagcuggugcggaacaugaaggagaaccugcagcucgacuuccaguucgacuggaagcugaucaacgucuucuucagcaacgccucccagugcuaccugugcccgagcgcccagcaggcccccucccucagcaccgugcugcugucccagaacgggcucgcggccggcggcguggacgagcugauggggguccuggacuaccuccagcaggaggugccccgcgccuucgugaaccuggucgaccugagcgagguggccgaggugucccggcaguaccacggcaccuggcucagccccgcgccggagcccugcaacugcuccgaggagacgacccgccuggccaaggucgugaugcaguggagcuaccaggaggccuggaacagccugcucgccuccagccgguacuccgagcaggagagcuucaccguggucuuccagcccuucuucuacgagaccacgcccucccugcacagcgaggacccgcgccugcaggacuccaccacccucgccuggcaccuguggaaccggaugauggagcccgcgggggagaaggacgagccccugagcgugaagcacggccgccccaugaagugcccgucccaggagagccccuaccucuucuccuaccggaacagcaacuaccugacccgccugcagaagccccaggacaagcucgaggugcgggagggcgccgagauccgcugcccggacaaggaccccuccgacacgguccccaccagcgugcaccggcugaagcccgccgacaucaacgucaucggggcccugggcgacucccucaccgccgggaacggcgcggggagcaccccgggcaacgugcuggacgugcugacgcaguaccgcggccucuccuggagcgucgggggcgacgagaacaucgggaccgugaccacccuggccaacauccugcgggaguucaaccccucccugaagggcuucagcguggggacgggcaaggagaccagccccaacgccuuccucaaccaggccgucgccggcgggcgcgcggaggaccugcccgugcaggcccggcgccugguggaccucaugaagaacgacacccgcauccacuuccaggaggacuggaagaucaucacccuguucaucggcgggaacgaccugugcgacuucugcaacgaccucgucccgcgggccuucgugaaccuggugacgguccuggagaucgugaaccuccgcgagcuguaccaggagaagaagguguacugcccccggaugauccugcgcucccucugccccugcguccugaaguucgacgacaacagcaccgagcuggccacccucaucgaguucaacaagaaguuccaggagaagacccaccagcugaucgaguccggccgguacgacacgcgcgaggacuucaccguggugguccagcccuucuucgagaacguggacaugccgaagaccagcgaggggcugcccgacaacuccuucuucgcccccgacugcuuccacuucagcuccaagagccacucccgggcggccagcgcccucuggaacaacaugcuggagcccgugggccagaagaccacgcgccacaaguucgagaacaagaucaacaucacgugcccgaaccagguccagcccuuccugcggaccuacaagaacuccaugcagggccacgggaccuggcuccccugccgcgaccgggcccccagcgcgcugcacccgaccuccgugcacgcccugcgccccgccgacauccagguggucgccgcccucggcgacagccugaccgcggggaacggcaucggcuccaagcccgacgaccugcccgacgugaccacccaguaccgggggcucagcuacuccgccggcggggacggcagccuggagaacgugaccacgcugccgaacauccuccgcgaguucaaccggaaccugaccggguacgccgucggcaccggcgacgccaacgacaccaacgccuuccugaaccaggcggugcccggggccaaggccgaggaccucaugagccaggugcagacgcugaugcagaagaugaaggacgaccaccgcgucaacuuccacgaggacuggaaggugaucaccgugcugaucggcggguccgaccucugcgacuacugcaccgacagcaaccuguacuccgccgccaacuucguccaccaccuccggaacgcgcuggacgugcugcaccgcgaggugccccggguccuggugaaccucguggacuuccugaacccgaccaucaugcgccaggucuuccugggcaaccccgacaagugccccgugcagcaggccagcgugcucugcaacugcguccugacgcugcgcgagaacucccaggagcucgcccggcuggaggccuucagccgcgcguaccgguccagcaugcgcgagcuggugggguccggccgguacgacacccaggaggacuucagcgugguccuccagcccuucuuccagaacauccagcugccggugcuggccgacggccuccccgacaccuccuucuucgcccccgacugcauccaccccaaccagaaguuccacagccagcuggcccgcgcccuguggaccaacaugcucgagccgcugggguccaagacggagacccuggaccuccgggcggagaugcccaucacgugccccacccagaacgagcccuuccugcgcaccccgcggaacagcaacuacaccuaccccaucaagcccgccaucgagaacuggggcuccgacuuccugugcaccgaguggaaggccagcaacuccgugcccaccagcguccaccagcuccgcccggccgacaucaaggugguggccgcgcugggggacucccugacgaccgccgucggcgcccggcccaacaacagcagcgaccuccccaccuccuggcgcgggcugagcugguccaucggcggcgacgggaaccuggagacccacacgacccuccccaacauccugaagaaguucaacccguaccugcucggcuucagcaccuccaccugggaggggacggccggccugaacguggccgcggagggggcccgggcccgcgacaugcccgcccaggcgugggaccuggucgagcggaugaagaacagccccgacaucaaccucgagaaggacuggaagcuggugacccuguucaucggcgugaacgaccucugccacuacugcgagaaccccgaggcccaccuggccaccgaguacguccagcacauccagcaggcccuggacauccucuccgaggagcugccgcgcgccuucgugaacguggucgaggugauggagcuggcgagccucuaccagggccagggcgggaagugcgccaugcuggccgcccagaacaacugcacgugccugcggcacucccagagcucccucgagaagcaggagcugaagaaggugaacuggaaccugcagcacgggaucagcuccuucagcuacuggcaccaguacacccagcgcgaggacuucgccgucguggugcagcccuucuuccagaacacccucacgccccugaacgagcggggcgacaccgaccugaccuucuucuccgaggacugcuuccacuucagcgaccgcggccacgcggagauggccaucgcccucuggaacaacaugcuggagcccgucgggcggaagaccaccuccaacaacuucacccacagccgcgccaagcugaagugcccgucccccgagagccccuaccuguacacccuccgcaacagccggcugcugccggaccaggccgaggaggcgcccgaggugcucuacugggccgugcccgucgccgccggcguggggcugguggucggcaucaucgggacggugguguggcgcugccggcgcggcggccggcgcgaggacccgcccaugucccugcggaccgucgcccucuga

SEQ ID NO: 34683 - RNA, 1662 nt, Artificial Sequence
  derived and/or modified sequence opt1 from PLBD1__Homo_sapiens__NP_079105
augacccgcggcgggcccggcgggcggccgggccugccccagcccccgccccuccugcugcuccugcugcuccugccccugcuccuggugaccgccgagccgcccaagcccgccggggucuacuacgcgacggccuacuggaugcccgccgagaagaccguccaggugaagaacgugauggacaagaacggcgacgccuacggcuucuacaacaacagcgugaagaccaccggguggggcauccuggagauccgcgccggguacggcucccagacgcucagcaacgagaucaucauguucguggcgggguuccuggagggcuaccugaccgcgccccacaugaacgaccacuacaccaaccucuacccccagcugaucaccaagccguccaucauggacaagguccaggacuucauggagaagcaggacaaguggacgcggaagaacaucaaggaguacaagaccgacagcuucuggcgccacaccggcuacgugauggcccagaucgacgggcuguacgugggcgccaagaagcgggccauccucgaggggaccaagcccaugacgcuguuccagauccaguuccugaacuccgucggcgaccuccuggaccugauccccagccucucccccaccaagaacggcagccugaagguguucaagcgcugggacauggggcacugcuccgcccugaucaaggugcucccgggcuucgagaacauccuguucgcccacagcuccugguacaccuacgccgccaugcugcggaucuacaagcacugggacuucaacgucaucgacaaggacaccagcuccagccgccucuccuucagcuccuaccccggguuccuggagagccuggacgacuucuacauccucuccagcggccugauccugcuccagacgaccaacagcguguucaacaagacccugcugaagcaggucauccccgagacccuccuguccuggcagcgggugcgcguggcgaacaugauggccgacagcgggaagcggugggccgacaucuucuccaaguacaacagcggcacguacaacaaccaguacauggugcuggaccucaagaaggucaagcugaaccacucccuggacaagggcacccucuacaucguggagcagauccccaccuacguggaguacagcgagcagaccgacguccugcgcaagggguacuggccguccuacaacgugcccuuccacgagaagaucuacaacuggagcggcuacccccugcucgugcagaagcuggggcuggacuacuccuacgaccuggcgccccgggccaagaucuuccgccgggaccagggcaaggucacggacaccgccagcaugaaguacaucaugcgcuacaacaacuacaagaaggacccguacucccgcggggaccccugcaacaccaucugcugccgggaggaccucaacagccccaaccccuccccgggcggcugcuacgacaccaagguggccgacaucuaccuggccagccaguacacguccuacgccaucagcgggcccaccguccagggcgggcugcccguguuccggugggaccgcuucaacaagacccuccaccagggcaugccggagguguacaacuucgacuucaucaccaugaagcccauccugaagcuggacaucaaguga

SEQ ID NO: 34684 - RNA, 3651 nt, Artificial Sequence
  derived and/or modified sequence opt1 from PLCB1__Homo_sapiens__NP_056007
auggccggcgcccagcccggggugcacgcgcugcagcucaagccggucugcgugagcgacucccugaagaagggcaccaaguucgugaagugggacgacgacagcaccaucgucacgcccaucauccugcgcaccgacccccagggguucuucuucuacuggaccgaccagaacaaggagaccgagcuccuggaccugucccucgugaaggacgcccggugcggccgccacgccaaggcccccaaggacccgaagcugcgggagcugcucgacguggggaacaucggccgccuggagcagcggaugaucacggucguguacggccccgaccuggugaacaucagccaccucaaccuggucgccuuccaggaggagguggcgaaggaguggaccaacgagguguucucccuggccaccaaccuccuggcccagaacaugagccgcgacgccuuccuggagaaggcguacaccaagcucaagcugcaggucacgcccgaggggcggaucccccugaagaacaucuaccgccucuucuccgccgaccggaagcgcguggagaccgcccuggaggccugcagccugccguccagccggaacgacuccaucccccaggaggacuucacccccgagguguaccgcgucuuccucaacaaccugugcccccggccggagaucgacaacaucuucagcgaguucggcgccaaguccaagcccuaccugaccguggaccagaugauggacuucaucaaccucaagcagcgcgacccccggcugaacgagauccuguacccgccccucaagcaggagcagguccaggugcugaucgagaaguacgagcccaacaacagccuggcgcgcaaggggcagaucuccguggacggcuucaugcgguaccucagcggggaggagaacggcguggucucccccgagaagcuggaccugaacgaggacaugagccagccccucucccacuacuucaucaacagcagccacaacacguaccugaccgccggccagcuggccgggaacuccagcguggagauguaccgccaggugcuccuguccggcugccggugcgucgagcuggacugcuggaaggggcgcaccgccgaggaggagccggugaucacccacggcuucacgaugaccaccgagaucagcuucaaggaggucaucgaggccaucgcggagugcgccuucaagaccucccccuuccccauccuccugagcuucgagaaccacguggacucccccaagcagcaggccaagauggccgaguacugccggcugaucuucggcgacgcccuccugauggagccgcuggagaaguacccccucgagagcggggugccccugcccuccccgauggaccugauguacaagauccuggucaagaacaagaagaagucccacaagagcagcgagggcuccgggaagaagaagcucagcgagcaggcguccaacacguacagcgacuccagcuccauguucgagcccagcagccccggcgccggggaggccgacaccgaguccgacgacgacgacgacgacgacgacugcaagaaguccagcauggacgagggcaccgccggcagcgaggccauggcgaccgaggagauguccaaccuggugaacuacauccagccggugaaguucgagagcuucgagaucuccaagaagcgcaacaagagcuucgagauguccagcuucgucgagacgaaggggcuggagcagcucaccaagucccccguggaguucguggaguacaacaagaugcagcugagccgcaucuaccccaagggcacccgggucgacuccagcaacuacaugccccagcuguucuggaacgccgggugccagaugguggcccucaacuuccagaccauggaccuggccaugcagaucaacaugggcauguacgaguacaacgggaaguccggcuaccgccugaagccggaguucaugcggcgccccgacaagcacuucgaccccuucacggagggcaucguggacgggaucgucgcgaacacccucagcgugaagaucaucuccggccaguuccugagcgacaagaagguggggaccuacgucgagguggacauguucggccugcccguggacacccggcgcaaggccuucaagacgaagaccagccaggggaacgccgucaacccggugugggaggaggagcccaucguguucaagaaggucgugcuccccacccuggccugccugcggaucgccguguacgaggagggcggcaaguucaucgggcaccgcauccuccccguccaggcgauccggccgggcuaccacuacaucugccugcgcaacgagcggaaccagccccugacccuccccgccguguucguguacaucgaggucaaggacuacgugcccgacacguacgccgacgugaucgaggcccuguccaacccgauccgcuacgucaaccugauggagcagcgggccaagcagcucgcggcccugacccuggaggacgaggaggaggugaagaaggaggccgaccccggggagacccccagcgaggcccccuccgaggcccgcaccaccccggcggagaacggcgugaaccacacgaccacccucacccccaagccgcccagccaggcccugcacucccagcccgcccccggcagcgucaaggcccccgcgaagacggaggaccugauccaguccgugcucaccgagguggaggcccagaccaucgaggagcugaagcagcagaaguccuucgucaagcugcagaagaagcacuacaaggagaugaaggaccucgugaagcggcaccacaagaagaccacggaccugaucaaggagcacaccaccaaguacaacgagauccagaacgacuaccugcgccggcgcgccgcccucgagaaguccgccaagaaggacagcaagaagaaguccgagccgagcagccccgaccacgggagcuccaccaucgagcaggaccuggcggcccuggacgccgagaugacgcagaagcucaucgaccugaaggacaagcagcagcagcagcugcucaaccugcggcaggagcaguacuacagcgagaaguaccagaagcgcgagcacaucaagcugcucauccagaagcugaccgacguggccgaggagugccagaacaaccagcugaagaagcucaaggagaucugcgagaaggagaagaaggagcugaagaagaagauggacaagaagcgccaggagaagaucaccgaggccaaguccaaggacaagagccagauggaggaggagaagaccgagaugauccgguccuacauccaggaggucgugcaguacaucaagcgccuggaggaggcgcagagcaagcggcaggagaagcucguggagaagcacaaggagauccgccagcagauccuggacgagaagcccaagcugcaggucgagcucgagcaggaguaccaggacaaguucaagcggcugccccuggagauccucgaguucgugcaggaggccaugaagggcaagaucagcgaggacuccaaccacgggagcgccccgcugucccugagcuccgaccccggcaaggugaaccacaagacgcccagcuccgaggagcucgggggcgacauccccggcaaggaguucgacaccccgcuguga

SEQ ID NO: 34685 - RNA, 3546 nt, Artificial Sequence
  derived and/or modified sequence opt1 from PLCB2__Homo_sapiens__NP_001271226
augagccugcucaaccccgugcugcugccgcccaaggucaaggccuaccucucccagggcgagcgcuucaucaagugggacgacgagaccaccguggccagccccgugauccugcgggucgaccccaagggguacuaccuguacuggacguaccaguccaaggagauggaguuccucgacaucaccagcauccgcgacacccgguucggcaaguucgcgaagaugccgaagucccagaagcugcgcgacguguucaacauggacuuccccgacaacagcuuccugcucaagacccugacgguggucuccgggcccgacaugguggaccugaccuuccacaacuucgugagcuacaaggagaacgucggcaaggccugggccgaggacgugcucgcccuggugaagcacccccugaccgccaacgcgucccggagcaccuuccucgacaagauccuggucaagcugaagaugcagcucaacuccgaggggaagaucccggugaagaacuucuuccagauguuccccgccgaccgcaagcggguggaggccgcccugagcgcgugccaccuccccaagggcaagaacgacgccaucaaccccgaggacuucccggagcccgucuacaaguccuuccucaugagccugugcccccgccccgagaucgacgagaucuucacguccuaccacgccaaggccaagccguacaugaccaaggagcaccugaccaaguucaucaaccagaagcagcgggacagccgccucaacucccugcuguucccgcccgcccggcccgaccaggugcagggccucaucgacaaguacgagcccagcgggaucaacgcgcagcgcggccagcugucccccgaggggauggugugguuccugugcggccccgagaacagcguccucgcccaggacaagcugcugcuccaccacgacaugacccagccccugaaccacuacuucaucaacagcucccacaacacguaccugaccgccgggcaguucagcggccucuccagcgccgagauguaccgccaggugcugcuguccggcugccggugcguggagcucgacugcuggaaggggaagccgcccgacgaggagcccaucaucacccacggcuucaccaugacgaccgacaucuucuucaaggaggccaucgaggcgaucgccgagagcgccuucaagaccucccccuacccgaucauccugagcuucgagaaccacgucgacagcccccggcagcaggccaagauggccgaguacugccgcaccaucuucggggacaugcugcucacggagccccuggagaaguucccgcugaagcccggcgugccccuccccuccccggaggaccugcggggcaagauccugaucaagaacaagaagaaccaguucuccgggcccaccagcuccagcaaggacaccggcggggaggcggagggcuccagcccgcccuccgcccccgccgugugggccggggaggagggcaccgagcucgaggaggaggaggucgaggaggaggaggaggaggagagcggcaaccuggacgaggaggagaucaagaagaugcaguccgacgaggggacggccggccuggaggugaccgcguacgaggagaugagcagccuggucaacuacauccagcccaccaaguucguguccuucgaguucagcgcccagaagaaccgcuccuacgugaucagcuccuucaccgagcucaaggccuacgaccugcugagcaaggccuccguccaguucguggacuacaacaagcggcagaugagccgcaucuaccccaaggggacgcggauggacuccagcaacuacaugccccagauguucuggaacgcgggcugccagaugguggcccucaacuuccagaccauggaccugccgaugcagcagaacauggccgucuucgaguucaacgggcaguccggcuaccugcucaagcacgaguucaugcgccgccccgacaagcaguucaaccccuucagcguggaccggaucgacguggucguggccaccacccuguccaucacggugaucagcggccaguuccuguccgagcgcagcguccggaccuacguggagguggagcuguucgggcugcccggcgacccgaagcgccgguaccgcaccaagcugucccccagcaccaacagcaucaaccccgucuggaaggaggagcccuucguguucgagaagauccucaugccggagcuggccucccugcggguggcggucauggaggaggggaacaaguuccucggccaccgcaucauccccaucaacgcccugaacagcggguaccaccaccugugccuccacuccgagagcaacaugccccugacgaugcccgcccuguucaucuuccucgagaugaaggacuacaucccgggcgccugggccgaccugaccguggcgcuggccaaccccaucaaguucuucuccgcccacgacaccaagagcgugaagcucaaggaggccaugggcgggcugcccgagaagccguucccccuggccucccccgucgcgagccaggugaacggcgcccucgcccccaccuccaacgggagcccggccgcgcgggccggcgcccgcgaggaggccaugaaggaggccgcggagccccggaccgccucccuggaggagcugcgcgagcucaagggcguggucaagcugcagcggcgccacgagaaggagcugcgggagcucgagcgccgcggggcccggcggugggaggagcugcugcagcgcggcgccgcccagcucgcggagcuggggccgcccggcgucgggggcgugggcgccugcaagcuggggcccggcaaggggagccgcaagaagcggucccucccccgcgaggagagcgccggcgccgcccccggggagggccccgagggcguggacgggcgggugcgcgagcugaaggaccggcuggagcucgagcugcugcgccagggcgaggagcaguacgagugcgugcucaagcggaaggagcagcacgucgcggagcagaucuccaagaugauggagcuggcccgcgagaagcaggccgccgagcugaaggcgcucaaggagacgagcgagaacgacaccaaggagaugaagaagaagcuggagaccaagcggcuggagcgcauccaggggaugaccaaggugacgaccgacaagauggcccaggagcggcucaagcgcgagaucaacaacucccacauccaggaggugguccaggugaucaagcagaugaccgagaaccuggagcggcaccaggagaagcuggaggagaagcaggccgccugccucgagcagauccgcgagauggagaagcaguuccagaaggaggcccuggcggaguacgaggcccggaugaagggccuggaggccgaggugaaggagagcguccgcgccugccuccggaccugcuucccguccgaggccaaggacaagcccgagcgcgcgugcgagugcccgcccgagcugugcgagcaggacccccugaucgccaaggccgacgcccaggagagccggcucuga

SEQ ID NO: 34686 - RNA, 3504 nt, Artificial Sequence
  derived and/or modified sequence opt1 from PLCB3__Homo_sapiens__NP_001171812
auggccggcgcccagcccggggugcacgcgcugcagcucgagccgcccaccgucguggagacccugcgccggggcagcaaguucaucaagugggacgaggagaagcugaugacgguggucuccgggcccgaccccgugaacaccguguuccucaacuucauggccguccaggacgacaccgccaagguguggagcgaggagcuguucaagcuggccaugaacauccucgcccagaacgcgucccgcaacaccuuccugcggaaggccuacacgaagcugaagcuccaggugaaccaggacggccgcaucccggucaagaacauccugaagauguucagcgccgacaagaagcggguggagaccgcccuggaguccugcgggcucaaguucaaccgcagcgaguccauccggcccgacgaguucagccuggagaucuucgagcgcuuccugaacaagcucugccugcggcccgacaucgacaagauccugcucgagaucggcgcgaagggcaagcccuaccugacccuggagcagcucauggacuucaucaaccagaagcagcgcgacccgcggcugaacgaggugcuguacccgccccuccgccccucccaggcccggcugcugaucgagaaguacgagcccaaccagcaguuccucgagcgcgaccagaugagcauggagggguucucccgguaccugggcggggaggagaacggcauccugccccucgaggcccuggaccugagcaccgacaugacgcagccccucuccgccuacuucaucaacagcucccacaacaccuaccugaccgccgggcagcuggcgggcaccagcuccgucgagauguaccgccaggcccuccuguggggcugccggugcguggagcuggacguguggaaggggcggcccccggaggaggagcccuucaucacgcacggcuucaccaugaccaccgaggucccccuccgcgacgugcuggaggccaucgccgagacggccuucaagaccagccccuacccggugauccuguccuucgagaaccacgucgacagcgcgaagcagcaggccaagauggccgaguacugccgcagcaucuucggggacgcccuccugaucgagccccuggacaaguacccccucgcccccggcgugccgcugcccagcccccaggaccugaugggccggauccucgugaagaacaagaagcgccaccgccccuccgccgggggcccggacuccgcggggcggaagcgcccccuggagcagagcaacuccgcccugagcgaguccagcgccgccaccgagcccuccagcccgcagcugggcucccccagcuccgacagcugccccgggcucuccaacggcgaggaggucggccuggagaagcccagccuggagccgcagaagucccucggggacgagggccugaaccgggggcccuacgugcugggccccgcggaccgcgaggacgaggaggaggacgaggaggaggaggagcagaccgaccccaagaagccgacgaccgacgaggggaccgccagcuccgaggugaacgccaccgaggagaugagcacgcucgucaacuacaucgagcccgugaaguucaagagcuucgaggccgcgcggaagcgcaacaagugcuucgagauguccagcuucgucgagaccaaggccauggagcagcugaccaagucccccauggaguucguggaguacaacaagcagcagcugagccggaucuaccccaagggcacccgcguggacuccagcaacuacaugccgcagcuguucuggaacgucggcugccagcugguggcccugaacuuccagacgcucgacguggccaugcagcugaacgccggggucuucgaguacaacggccgguccggguaccugcucaagcccgaguucaugcgccggcccgacaagagcuucgaccccuucaccgaggugaucguggacggcaucgucgcgaacgcccugcgcgugaaggugaucuccgggcaguuccugagcgaccggaaggucggcaucuacguggagguggacauguucggccucccggucgacacccgccggaaguaccgcacccggacgucccaggggaacagcuucaaccccgugugggacgaggagcccuucgacuuccccaaggugguccugccgacccuggccucccuccgcaucgccgccuucgaggagggcgggaaguucgugggccaccggauccugcccgugagcgcgauccgcuccggcuaccacuacgucugccugcgcaacgaggccaaccagccccucugccugcccgcccugcucaucuacaccgaggccagcgacuacaucccggacgaccaccaggacuacgccgaggcgcugaucaaccccaucaagcacgugucccugauggaccagcgggcccgccagcucgccgcccugaucggggagagcgaggcgcaggccggccaggagaccugccaggacacgcagagccagcagcuggggucccagcccagcuccaacccgacccccagcccccucgacgccagcccccggcgcccgcccggccccaccaccucccccgccuccaccagccuguccagcccggggcagcgggacgaccugaucgccuccauccucagcgagguggcgcccacgccccuggacgagcugcgcggccacaaggcccucgucaagcugcggucccgccaggagcgggaccugcgcgagcuccggaagaagcaccagcgcaaggccgugacccugacccggcgccugcucgacggccuggcccaggcccaggcggaggggcggugccgccugcggcccggcgcccucgggggcgccgccgacguggaggacaccaaggagggggaggacgaggccaagcgcuaccaggaguuccagaaccggcagguccagagccugcuggagcuccgcgaggcccagguggacgcggaggcccagcggcgccuggagcaccuccgccaggcccuccagcggcugcgcgaggugguccuggacgcgaacacgacccaguucaagcggcucaaggagaugaacgagcgcgagaagaaggagcugcagaagauccuggaccggaagcgccacaacuccaucagcgaggccaagaugcgggacaagcacaagaaggaggccgagcucaccgagaucaaccgccggcacaucaccgaguccgugaacagcauccgccggcuggaggaggcccagaagcagcgccacgaccggcugguggccggccagcagcagguccuccagcagcuggcggaggaggagccgaagcugcucgcccagcuggcccaggagugccaggagcagcgcgcccggcugccccaggagauccgccggucccuccugggcgagaugcccgaggggcugggcgacgggccccucguggccugcgcgagcaacggccacgccccggggagcuccggccaccugagcggcgccgacuccgagagccaggaggagaacacgcagcuguga

SEQ ID NO: 34687 - RNA, 3585 nt, Artificial Sequence
  derived and/or modified sequence opt1 from PLCB4__Homo_sapiens__NP_000924
auggccaagcccuacgaguucaacuggcagaaggaggugccgagcuuccugcaggagggcgccgucuucgaccgcuacgaggaggaguccuucguguucgagcccaacugccucuucaagguggacgaguucggguucuuccugaccuggcggagcgagggcaaggaggggcagguccuggagugcucccucaucaacagcauccgcuccggcgcgauccccaaggaccccaagauccuggccgcccuggaggccgugggcaagagcgagaacgaccucgaggggcggaucgugugcgucugcuccggcaccgaccuggugaacaucagcuucacguacaugguggccgagaacccggaggucaccaagcaguggguggaggggcugcgcuccaucauccacaacuuccgggcgaacaacgugagccccaugaccugccucaagaagcacuggaugaagcuggccuucaugaccaacacgaacggcaagauccccguccgcuccaucacccggaccuucgccagcgggaagaccgagaaggugaucuuccaggcccugaaggagcucggccugcccuccgggaagaacgacgagaucgagccgacggcguucagcuacgagaaguucuacgagcugacccagaagaucugcccccgcaccgacaucgaggaccucuucaagaagaucaacggcgacaagaccgacuaccugacgguggaccagcuggucuccuuccucaacgagcaccagcgggacccccgccugaacgagauccuguuccccuucuacgacgccaagcgggccaugcagaucaucgagauguacgagccggacgaggaccucaagaagaagggccugaucagcuccgacggguucugccgcuaccugaugagcgacgagaacgcccccguguuccucgaccggcuggagcuguaccaggagauggaccacccccucgcccacuacuucaucuccagcagccacaacaccuaccugaccggccgccaguucgggggcaaguccagcguggagauguaccggcagguccugcucgcgggcugccgcugcguggagcuggacugcugggacgggaagggcgaggaccaggagcccaucaucacccacgggaaggccaugugcacggacauccuguucaaggacgugauccaggccaucaaggagaccgccuucgucaccuccgaguacccggugauccucagcuucgagaaccacugcuccaaguaccagcaguacaagaugagcaaguacugcgaggaccuguucggcgaccugcuccugaagcaggcccuggagucccacccccucgagcccgggcgggcgcugcccagcccgaacgaccugaagcgcaagauccucaucaagaacaagcggcugaagcccgagguggagaagaagcagcuggaggcccuccgcuccaugauggaggccggcgagagcgccucccccgccaacauccuggaggacgacaacgaggaggagaucgagagcgcggaccaggaggaggaggcccaccccgaguucaaguucggcaacgagcuguccgccgacgaccucgggcacaaggaggccgucgccaacagcgugaagaagggccuggucaccguggaggacgagcaggcguggauggccuccuacaaguacgugggggccacgaccaacauccacccguaccugagcaccaugaucaacuacgcccagcccgucaaguuccagggcuuccacguggcggaggagcggaacauccacuacaacauguccagcuucaacgaguccguggggcugggcuaccucaagacccacgccaucgaguucgucaacuacaacaagcgccagaugagccgcaucuaccccaagggcgggcggguggacagcuccaacuacaugccccagaucuucuggaacgccggcugccagauggugagccugaacuaccagacgccggaccuggccaugcagcucaaccaggggaaguucgaguacaacggcuccugcggguaccugcugaagcccgacuucaugcgccggcccgaccgcaccuucgacccguucagcgagacccccgucgacggcgugaucgccgcgaccugcuccgugcaggucaucagcggccaguuccucuccgacaagaagaucgggacguacguggagguggacauguacggccugcccaccgacaccauccggaaggaguuccgcacccggauggucaugaacaacgggcugaaccccguguacaacgaggagagcuucguguuccgcaaggucauccucccggaccuggccgugcugcggaucgccguguacgacgacaacaacaagcucaucggccagcgcauccugccccuggacggccuccaggccggguaccggcacaucucccugcgcaacgagggcaacaagccccugagccuccccacgaucuucugcaacaucguccugaagaccuacgugccggacggguucggcgacaucguggacgcccuguccgaccccaagaaguuccucagcaucaccgagaagcgggcggaccagaugcgcgccauggggaucgagaccuccgacaucgccgacguccccagcgacacguccaagaacgacaagaagggcaaggccaacaccgccaaggcgaacgugacgccccagagcuccagcgagcugcggccgaccaccaccgccgcccuggccagcggcguggaggcgaagaaggggaucgagcucaucccccagguccgcaucgaggaccugaagcagaugaaggccuaccugaagcaccucaagaagcagcagaaggagcugaacucccugaagaagaagcacgccaaggagcacagcaccaugcagaagcuccacugcacccagguggacaagaucguggcccaguacgacaaggagaaguccacccacgagaagauccuggagaaggccaugaagaagaagggcgggagcaacugccuggagaugaagaaggagacggagaucaagauccagacccucaccuccgaccacaagagcaaggucaaggagaucguggcgcagcacaccaaggagugguccgagaugaucaacacgcacagcgccgaggagcaggagauccgggaccugcaccugucccagcagugcgagcuccugaagaagcugcucaucaacgcccacgagcagcagacccagcagcugaagcugagccacgaccgcgaguccaaggagaugcgggcccaccaggccaagaucagcauggagaacuccaaggcgaucagccaggacaaguccaucaagaacaaggccgagcgcgagcgccgggugcgcgagcucaacagcuccaacaccaagaaguuccuggaggagcggaagcgccuggccaugaagcagagcaaggagauggaccagcucaagaagguccagcuggagcaccuggaguuccucgagaagcagaacgagcagcugcugaaguccugccacgccgugagccagacccagggcgagggggacgccgcggacggcgagaucggcagccgggacgggccccagacguccaacagcuccaugaagcuccagaacgccaacuga

SEQ ID NO: 34688 - RNA, 2334 nt, Artificial Sequence
  derived and/or modified sequence opt1 from PLCD1__Homo_sapiens__NP_001124436
augcagugccugggcauccgcagccggucccgcagccgggagcucuaccugcaggagcgcucccugaagguggccgcccucaacgggcggcgccugggccugcaggacgacgaggaccuccaggcgcugcugaaggggagccagcuccugaaggucaaguccagcuccuggcggcgcgagcgguucuacaagcugcaggaggacugcaagaccaucuggcaggagagccgcaaggugaugcggacccccgagucccagcuguucagcaucgaggacauccaggaggugcgcaugggccaccggacggaggggcuggagaaguucgcccgcgacgucccggaggaccggugcuucuccaucguguucaaggaccagcgcaacacccuggaccucaucgcccccagccccgccgacgcccagcacugggugcugggccugcacaagaucauccaccacuccggcagcauggaccagcggcagaagcuccagcacuggauccacuccugccugcgcaaggcggacaagaacaaggacaacaagaugagcuucaaggagcugcagaacuuccucaaggagcugaacauccaggucgacgacuccuacgcccggaagaucuuccgcgagugcgaccacagccagaccgacucccuggaggacgaggagaucgaggccuucuacaagaugcucacccagcggguggagaucgaccgcacguucgccgaggcggccgggagcggcgagacccugagcguggaccagcuggucaccuuccuccagcaccagcagcgcgaggaggccgccgggcccgcccuggcgcugucccucaucgagcgguacgagccgagcgagaccgccaaggcccagcgccagaugacgaaggacggcuuccugauguaccugcucuccgccgacgggagcgccuucucccuggcgcaccggcgcguguaccaggacaugggccagccccugagccacuaccucguguccagcucccacaacaccuaccugcuggaggaccagcucgccggccccagcuccaccgaggccuacauccgggcccugugcaaggggugccgcugccuggagcucgacugcugggacggccccaaccaggagccgaucaucuaccacggguacaccuucacgagcaagauccuguucugcgacguccugcgggccauccgcgacuacgcguucaaggccucccccuaccccgugauccucagccuggagaaccacugcacccuggagcagcagcgggugauggcccgccaccuccacgccauccugggccccaugcugcugaaccggccgcucgacggcgucaccaacucccugcccagccccgagcagcugaaggggaagauccuccugaagggcaagaagcucgggggccuccugcccccgggcggggagggcgggcccgaggccaccgugguguccgacgaggacgaggcggccgagauggaggacgaggccguccgcagccgggugcagcacaagcccaaggaggacaagcugcgccucgcccaggagcuguccgacauggugaucuacugcaagagcguccacuucggcggguucagcucccccggcacgccggggcaggcguucuacgagauggccagcuucuccgagaaccgggcccugcgccuccugcaggagagcggcaacggcuucgugcggcacaacguggggcaccugucccgcaucuaccccgccggcuggcggaccgacagcuccaacuacagccccgucgagauguggaacgggggcugccagaucguggcccucaacuuccagacccccgggccggagauggacgucuaccagggccgcuuccaggacaacggcgcgugcggguacgugcugaagcccgccuuccugcgcgaccccaacggcaccuucaacccccgggcccucgcccaggggccguggugggcccgcaagcggcugaacauccgcgugaucuccggccagcagcugcccaaggucaacaagaacaagaacagcaucguggaccccaaggugacggucgagauccacggcgugucccgggacguggcgagccgccagaccgccgucaucaccaacaacggguucaacccguggugggacaccgaguucgccuucgagguggugguccccgaccucgcccugauccgguuccugguggaggacuacgacgccuccagcaagaacgacuucaucggccaguccacgaucccccucaacagccugaagcagggguaccgccacgugcaccugauguccaagaacggcgaccagcaccccagcgcgacccucuucgucaagaucagccugcaggacuga

SEQ ID NO: 34689 - RNA, 2370 nt, Artificial Sequence
  derived and/or modified sequence opt1 from PLCD3__Homo_sapiens__NP_588614
augcugugcggccgcuggcggcgcugccggcggcccccggaggagccgcccguggccgcccaggucgcggcccagguggccgcccccguggcccuccccagcccgcccacccccuccgacgggggcaccaagcgccccgggcugcgcgcgcugaagaagaugggccucacggaggacgaggacguccgggccaugcugcgcgggagccggcugcgcaagauccggucccgcaccuggcacaaggagcggcucuaccgccugcaggaggacggccugagcgugugguuccagcggcgcaucccccgggcccccucccagcacaucuucuucgugcagcacaucgaggccguccgcgagggccaccagagcgaggggcuccggcgcuucggcggggcguucgcccccgcccggugccugaccaucgccuucaagggccgccgcaagaaccuggaccucgccgcgccgaccgccgaggaggcccagcggugggugcgcgggcugacgaagcugcgggcccgccucgacgccaugucccagcgggagcgccuggaccacuggauccacagcuaccugcaccgggcggacuccaaccaggacagcaagauguccuucaaggagaucaagagccuccugcgcauggugaacgucgacaugaacgacauguacgccuaccugcuguucaaggagugcgaccacuccaacaacgaccggcuggagggcgccgagaucgaggaguuccugcgccggcuccugaagcgccccgagcuggaggagaucuuccaccaguacagcggcgaggaccgggugcucuccgcccccgagcugcuggaguuccucgaggaccagggggaggagggcgccacccuggcgcgcgcccagcagcugauccagaccuacgagcucaacgagaccgccaagcagcacgagcugaugacgcuggacggguucaugauguaccuccugagccccgagggcgccgcccuggacaacacccacacgugcguguuccaggacaugaaccagccgcucgcgcacuacuucaucuccagcucccacaacaccuaccugaccgacagccagaucggcgggcccagcuccaccgaggccuacguccgggccuucgcccagggcugccgcugcguggagcuggacugcugggaggggcccggcggggagcccgugaucuaccacggccacacccucaccagcaagauccuguuccgggacgucgugcaggcggugcgcgaccacgccuucacgcuguccccguaccccgucauccucagccuggagaaccacugcggccuggagcagcaggccgccauggcccggcaccucugcaccauccugggggacaugcuggugacccaggcgcuggacucccccaaccccgaggagcucccgagccccgagcagcugaagggccgcgugcuggucaaggggaagaagcuccccgccgcccgcuccgaggacggccgggcccugagcgaccgcgaggaggaggaggaggacgacgaggaggaggaggaggagguggaggccgcggcccagcggcgccuggccaagcagaucucccccgagcucagcgcccuggccguguacugccacgcgacccggcugcgcacgcuccacccggcccccaacgcgccccagccgugccaggucuccagccuguccgagcggaaggccaagaagcugauccgcgaggccgggaacagcuucgugcggcacaacgcccgccagcucacccgggucuacccccugggccugcgcaugaacuccgccaacuacagcccccaggagauguggaacuccggcugccagcucguggcccugaacuuccagacccccggguacgagauggaccugaacgccggccgguuccucgugaacgggcagugcggcuacguccugaagccggcgugccugcgccagcccgacagcaccuucgaccccgaguaccccgggccgccccggacgacccucuccauccaggugcugaccgcccagcagcugcccaagcucaacgccgagaagccccacagcaucguggacccgcugguccgcaucgagauccacggcgugcccgccgacugcgcccggcaggagaccgacuacgugcugaacaacggcuucaacccccgcugggggcagacgcuccaguuccagcugcgggcgcccgagcuggcccucguccgcuucgugguggaggacuacgacgccaccagcccgaacgacuucgucggccaguucacccugccccuguccagccucaagcagggguaccggcacauccaccuccuguccaaggacggcgccagccucucccccgccacccuguucauccagauccgcauccagcgcagcuga

SEQ ID NO: 34690 - RNA, 2289 nt, Artificial Sequence
  derived and/or modified sequence opt1 from PLCD4__Homo_sapiens__NP_116115
auggccagccugcuccaggaccagcugaccaccgaccaggaccugcuccugaugcaggagggcaugcccaugcgcaaggugcgguccaagagcuggaagaagcugcgcuacuuccggcuccagaacgacgggaugacggucuggcacgcccgccaggcgcggggcuccgccaagccgagcuucuccaucagcgacguggagaccauccgcaacgggcacgacuccgagcugcugcggagccucgccgaggagcugccccuggagcagggcuucaccaucguguuccacgggcgccgguccaaccucgaccugauggccaacagcgucgaggaggcccagaucuggaugcgcggccugcagcuccugguggaccuggugaccuccauggaccaccaggagcggcucgaccaguggcugagcgacugguuccagcgcggcgacaagaaccaggacgggaagauguccuuccaggagguccagcggcugcuccaccugaugaacguggagauggaccaggaguacgcguucagccuguuccaggccgccgacacgucccagagcggcacccucgagggggaggaguucgugcaguucuacaaggcccugaccaagcgcgcggagguccaggagcuguucgaguccuucagcgccgacggccagaagcucacccugcuggaguuccucgacuuccugcaggaggagcagaaggagcgggacugcacguccgagcuggcccucgagcugaucgaccgcuacgagcccagcgacagcgggaagcugcggcacgugcucuccauggacggcuuccugagcuaccugugcuccaaggacggcgacaucuucaaccccgccugccucccgaucuaccaggacaugacccagccccugaaccacuacuucaucugcagcucccacaacaccuaccuggugggggaccagcucugcggccagagcuccgucgagggguacauccgcgcccugaagcggggcugccgcugcguggagguggacgucugggacggccccagcggggagcccgugguguaccacggccacacccugacgucccggauccucuucaaggacgucguggcgaccguggcccaguacgccuuccagaccagcgacuacccggucauccugucccuggagacccacugcagcugggagcagcagcagacgauggcccgccaccucaccgagauccugggggagcagcugcuguccaccacccucgacggcgugcugcccacgcagcugcccagccccgaggagcuccgccggaagauccuggugaaggggaagaagcugacccucgaggaggaccuggaguacgaggaggaggaggccgagccggagcuggaggaguccgagcucgcgcuggagagccaguucgagaccgagcccgagccccaggagcagaaccugcagaacaaggacaagaagaagaaguccaagcccauccucugcccggcccugagcucccuggucaucuaccucaagagcgugagcuuccgcuccuucacccacagcaaggagcacuaccacuucuacgagaucuccagcuucuccgagacgaaggccaagcggcugaucaaggaggccggcaacgaguucguccagcacaacaccuggcagcugagccgcguguaccccuccggccuccggaccgacagcuccaacuacaacccccaggagcuguggaacgccgggugccagaugguggcgaugaacaugcagaccgccggccuggagauggacaucugcgacgggcacuuccgccagaacggcgggugcggcuacguccucaagcccgacuuccugcgggacauccagagcuccuuccacccggagaagcccaucagccccuucaaggcccagacgcugcucauccaggugaucuccggccagcagcugcccaagguggacaagaccaaggaggggagcaucgucgacccgcuggugaaggugcagaucuucggcguccgccucgacaccgcccggcaggagaccaacuacguggagaacaacggguucaaccccuacuggggccagacgcugugcuuccgcgugcugguccccgagcucgccaugcugcgguucguggugauggacuacgacuggaagucccgcaacgacuucaucgggcaguacacccugcccuggaccugcaugcagcagggcuaccggcacauccaccuccugagcaaggacggcaucucccugcgcccggcgagcaucuucgucuacaucugcauccaggaggggcucgagggcgacgagagcuga

SEQ ID NO: 34691 - RNA, 5985 nt, Artificial Sequence
  derived and/or modified sequence opt1 from PLCE1__Homo_sapiens__NP_001159451
auggugagcgagggguccgccgccgggcgcgacuucgccggcauggaggaggugcggcagcugcacgugcgcuucugcaaggggaucaagaucuggcaccaggccugguuccugugcagccugcugggccgggagccccaggagcgcgaggccgggugccagcucuggcugugcacgcuguccgccgugcucaaggugggcuggcuguucccccugagcgaggugcccaacuucacccuccugaaggacggcugcgggugcuggcggcugaaggaggaccagaucuacaacgccgugcgccgggaggagacggagaacaccgugggcucccuccugcacuuccugaccaagcuccccgcgagcgagaccgcccacgggcgcaucuccgugggccccugccugaagcagugcgugcgggacacggucugcgaguaccgcgccacccugcagcggaccagcaucucccaguacaucaccgggagccuccuggaggccacgaccucccugggcgcgcgcagcggccuccuguccaccuucgggggcagcaccgggcggaugaugcugaaggagcgccagccgggccccuccguggccaacagcaacgcccuccccuccagcuccgccggcaucagcaaggagcugaucgaccugcagccccucauccaguucccggaggagguggccagcauccugauggagcaggagcagacgaucuaccggcgcguccugcccguggacuaccucugcuuccugacccgggaccuggggacccccgagugccaguccagccuccccugccugaaggcguccaucagcgccuccauccugaccacgcagaacggcgagcacaacgcccucgaggaccuggugaugcgcuucaacgaggucagcuccugggugaccuggcugauccucaccgccgggagcauggaggagaagcgggagguguucuccuaccugguccacguggccaagugcugcuggaacaugggcaacuacaacgcggugauggaguuccuggccgggcuccgcagccggaagguccugaagauguggcaguucauggaccaguccgacaucgagaccaugcgcagccugaaggacgccauggcccagcacgaguccagcugcgaguaccgcaagguggugacgcgggcccuccacaucccgggcugcaaggucgugcccuucugcggcgucuuccugaaggagcugugcgaggugcucgacggggcguccggccugaugaagcugugcccccgcuacaacagccaggaggagacccuggaguucguggccgacuacuccgggcaggacaacuuccuccagcgggucggccagaacgggcugaagaacagcgagaaggaguccaccgugaacagcaucuuccaggugauccgcagcugcaaccggucccuggagaccgacgaggaggacagccccuccgagggcaacagcucccgcaagagcucccucaaggacaagagccgguggcaguucaucaucggcgaccugcuggacuccgacaacgacaucuucgagcagagcaaggaguacgacucccacgggagcgaggacucccagaaggccuucgaccacggcacggagcucaucccgugguacguccugagcauccaggccgacgugcaccaguuccugcuccagggggccaccgugauccacuacgaccaggacacccaccuguccgcgcgcugcuuccugcagcuccagcccgacaacagcacccugacgugggucaagcccaccaccgccucccccgccagcagcaaggccaagcugggcgugcucaacaacaccgcggagccggggaaguucccccugcugggcaacgccggccucuccagccugacggagggggugcuggaccucuucgccgucaaggccguguacaugggccaccccgggaucgacauccacaccgugugcguccagaacaagcugggcuccauguuccugagcgagaccggcgugacccuccuguacgggcugcagacgaccgacaaccggcuccugcacuucguggcccccaagcacaccgcgaagaugcuguucuccggccuccuggagcugacccgcgccguccggaagaugcgcaaguucccggaccagcggcagcaguggcuccgcaagcaguacgugagccuguaccaggaggacgggcgguacgagggccccacccuggcccacgccguggagcuguucgggggccgccggugguccgcccgcaaccccagccccggcacguccgcgaagaacgccgagaagccgaacaugcagcggaacaacacccuggggaucagcaccaccaagaagaagaagaagauccugaugcgcggcgaguccggggaggucacggacgacgagauggccacccgcaaggccaagaugcacaaggagugccggagccgcuccggcagcgacccccaggacaucaacgagcaggaggaguccgaggugaacgccaucgcgaacccgcccaacccccuccccagccggcgcgcccacucccugaccaccgccgggagccccaaccuggccgcgggcacguccagcccgauccggcccgugagcucccccguccucagcuccagcaacaagucccccagcuccgccuggagcuccagcuccuggcacggccgcaucaagggcgggaugaagggguuccagagcuucaugguguccgacagcaacauguccuucguggaguucgucgagcuguucaagagcuucuccgugcggagccgcaaggaccugaaggaccucuucgacguguacgccgucccgugcaaccgguccggcagcgagagcgcgccccucuacaccaaccugaccaucgacgagaacaccuccgaccuccagcccgaccuggaccugcucacgcgcaacgugagcgaccuggggcuguucaucaaguccaagcagcagcucagcgacaaccagcggcagaucuccgacgccaucgcggccgccagcaucgugaccaacggcaccggcaucgaguccaccagccuggggaucuucggcgucgggauccugcagcucaacgacuuccuggugaacugccagggcgagcacugcacguacgacgagauccuguccaucauccagaaguucgagcccagcaucuccaugugccaccaggggcucaugagcuucgagggcuucgcccgcuuccugauggacaaggagaacuucgccuccaagaacgacgagagccaggagaacaucaaggagcugcagcucccgcuguccuacuacuacaucgagagcucccacaacaccuaccugaccggccaccagcucaagggggagagcuccguggagcuguacagccagguccugcuccagggcugccggagcguggagcuggacugcugggacggggacgacggcaugcccaucaucuaccacggccacacccugacgaccaagauccccuucaaggagguggucgaggcgaucgaccgcuccgccuucaucaacagcgaccuccccaucaucaucuccaucgagaaccacugcagccugccgcagcagcggaagauggccgagaucuucaagaccguguucggggagaagcuggugaccaaguuccucuucgagacggacuucuccgacgaccccaugcugcccagccccgaccagcugcgcaagaagguccuccugaagaacaagaagcugaaggcccaccagaccccgguggacauccucaagcagaaggcccaccagcuggcguccaugcagguccaggccuacaacggcgggaacgccaacccccggcccgccaacaacgaggaggaggaggacgaggaggacgaguacgacuacgacuacgagagccuguccgacgacaacauccucgaggaccgccccgagaacaagagcugcaacgacaagcugcaguucgaguacaacgaggagaucccgaagcggaucaagaaggcggacaacuccgccugcaacaagggcaaggucuacgacauggagcugggggaggaguucuaccucgaccagaacaagaaggagagccgccagaucgcccccgagcuguccgaccuggugaucuacugccaggccgugaaguuccccggccucagcacccugaacgccuccggcagcucccgggggaaggagcgcaagagccgcaaguccaucuucggcaacaacccggggcggaugagccccggcgagaccgcgagcuucaacaagacguccggcaagagcuccugcgagggcauccgccagaccugggaggagagcuccagcccccugaaccccaccaccucccucagcgccaucauccggacgccgaagugcuaccacaucuccagccugaacgagaacgccgccaagcgccugugccggcgcuacucccagaagcugacccagcacaccgccugccagcuccugcggaccuaccccgcggccacgcgcaucgacagcuccaaccccaacccccugauguucuggcuccacggcauccagcuggucgcccugaacuaccagaccgacgaccucccgcugcaccugaacgccgccauguucgaggcgaacgggggcugcggguacgugcucaagccgcccgugcugugggacaagaacugccccauguaccagaaguucagcccgcuggagcgggaccucgacuccauggaccccgccgucuacagccugaccaucguguccggccagaacgucugccccagcaacuccauggggagccccugcaucgagguggacgugcugggcaugccgcucgacagcugccacuuccgcaccaagcccauccaccggaacacccugaaccccauguggaacgagcaguuccuguuccacguccacuucgaggaccucguguuccugcgcuucgccguggucgagaacaacuccagcgccgugacggcccagcggaucaucccccugaaggcgcucaagcgcggcuaccggcaccuccagcugcgcaaccuccacaacgaggugcuggagaucuccagccuguucaucaacucccggcgcauggaggagaacagcuccgggaacaccaugagcgccuccagcauguucaacaccgaggagcggaagugccuccagacccaccgcgucacggugcacggcgugccggggcccgagcccuucaccgucuucaccaucaacggcggcaccaaggccaagcagcugcugcagcagauccucacgaacgagcaggacaucaagcccgugaccaccgacuacuuccugauggaggagaaguacuucaucuccaaggagaagaacgagugccgcaagcagccguuccagcgggccaucgggcccgaggaggagaucaugcagauccugagcuccugguuccccgaggagggcuacauggggcgcaucgugcucaagacccagcaggagaaccuggaggagaagaacaucguccaggacgacaaggaggugauccugagcuccgaggaggagagcuucuucgugcagguccacgacgugucccccgagcagccgcggacggugaucaaggcgccccgcgucagcaccgcccaggacgugauccagcagacccucugcaaggccaaguacagcuacuccauccugagcaaccccaacccguccgacuacgugcugcucgaggaggucgugaaggacaccacgaacaagaagaccaccacccccaagagcucccagcgggugcugcuggaccaggagugcgucuuccaggcccagagcaaguggaagggcgccgggaaguucauccucaagcugaaggagcagguccaggcgucccgcgaggacaagaagaagggcaucagcuucgccuccgagcugaagaagcucaccaagagcaccaagcagccccggggccugaccucccccagccagcugcucaccuccgagagcauccagacgaaggaggagaagccggucggcgggcuguccagcuccgacaccauggacuaccgccaguga

SEQ ID NO: 34692 - RNA, 3876 nt, Artificial Sequence
  derived and/or modified sequence opt1 from PLCG1__Homo_sapiens__NP_002651
auggccggcgccgccagccccugcgccaacgggugcggcccgggggcccccuccgacgccgaggugcugcaccucugccgcagccuggaggucggcaccgugaugacccuguucuacuccaagaagucccagcggcccgagcgcaagacguuccaggugaagcucgagacccggcagaucaccuggagccgcggggccgacaagaucgagggcgcgaucgacauccgggagaucaaggagauccgccccggcaagaccagccgggacuucgaccgcuaccaggaggacccggccuuccggcccgaccagucccacugcuucgucauccuguacgggauggaguuccgccugaagacgcucagccugcaggccaccuccgaggacgaggugaacauguggaucaagggccugaccuggcucauggaggacacccugcaggcccccacgccccugcagaucgagcgguggcuccgcaagcaguucuacagcguggaccggaaccgcgaggaccggaucuccgcgaaggaccugaagaacaugcugagccaggucaacuaccgcgugccgaacaugcgguuccuccgcgagcggcugaccgaccuggagcagcgcuccggggacaucaccuacggccaguucgcccagcucuaccggagccugauguacuccgcccagaagaccauggaccugcccuuccucgaggccagcacgcugcgcgccggggagcgccccgagcugugccgggugucccuccccgaguuccagcaguuccugcuggacuaccagggcgagcucugggcggucgaccgccuccaggugcaggaguucaugcugagcuuccuccgggacccgcugcgcgagaucgaggagcccuacuucuuccuggacgaguucgugaccuuccucuucuccaaggagaacagcgucuggaacagccagcuggacgccgugugccccgacaccaugaacaacccccugucccacuacuggaucagcuccagccacaacaccuaccucacgggcgaccaguucuccagcgaguccagccuggaggccuacgcccggugccugcgcauggggugccggugcaucgagcucgacugcugggacggcccggacgggaugcccgugaucuaccacggccacacccugaccaccaagaucaaguucuccgacguccugcacacgaucaaggagcacgccuucguggcgagcgaguaccccgugauccucuccaucgaggaccacugcagcaucgcccagcagcgcaacauggcccaguacuucaagaagguccugggcgacacccugcucaccaagcccguggagaucuccgccgacgggcugccgagccccaaccagcugaagcggaagauccucaucaagcacaagaagcuggccgagggcuccgcguacgaggaggugcccaccagcaugauguacuccgagaacgacaucagcaacuccaucaagaacgggauccuguaccuggaggaccccgucaaccacgagugguacccgcacuacuucgugcucacgagcagcaagaucuacuacuccgaggagaccagcuccgaccagggcaacgaggacgaggaggagcccaaggaggugagcuccagcaccgagcugcacuccaacgagaagugguuccacgggaagcugggcgccggccgcgacgggcggcacaucgccgagcgccuccugaccgaguacugcaucgagacgggcgcccccgacgggagcuuccugguccgggaguccgagaccuucgugggcgacuacacccucagcuucuggcgcaacgggaagguccagcacugccggauccacucccgccaggacgccggcacccccaaguucuuccugacggacaaccugguguucgacagccucuacgaccugaucacccacuaccagcaggucccgcugcggugcaacgaguucgagaugcgccucuccgagcccgugccccagaccaacgcgcacgagagcaaggagugguaccacgccucccugacccgggcccaggccgagcacaugcugaugcgcgugccgcgcgacggcgcguuccucgugcggaagcgcaacgagcccaacagcuacgccaucuccuuccgggccgaggggaagaucaagcacugccgcguccagcaggagggccagacggugaugcuggggaacagcgaguucgacagccugguggaccucaucuccuacuacgagaagcacccccuguaccggaagaugaagcugcgcuaccccaucaacgaggaggcccucgagaagaucggcaccgccgagccggacuacggggcgcuguacgagggccggaaccccggcuucuacgucgaggccaaccccaugcccaccuucaagugcgccgugaaggcccuguucgacuacaaggcccagcgcgaggacgagcucaccuucaucaagagcgcgaucauccagaacguggagaagcaggagggcgggugguggcgcggggacuacggcggcaagaagcagcugugguucccguccaacuacgucgaggagauggugaaccccguggcccuggagcccgagcgggagcaccucgacgagaacagcccccugggggaccugcuccggggcguccuggacgugccggccugccagaucgccauccgccccgaggggaagaacaaccggcuguucguguucuccaucagcauggccuccgucgcgcacuggagccucgacguggccgccgacucccaggaggagcugcaggacugggugaagaagauccgcgaggucgcccagaccgcggacgcccggcugacggagggcaagaucauggagcgccggaagaagaucgcccucgagcugagcgagcuggugguguacugccgccccguccccuucgacgaggagaagaucgggaccgagcgggccugcuaccgcgacauguccagcuucccggagaccaaggccgagaaguacgugaacaaggcgaagggcaagaaguuccuccaguacaaccggcugcagcugucccgcaucuaccccaagggccagcgccucgacagcuccaacuacgacccccugcccauguggaucugcgggagccagcugguggcccucaacuuccagaccccggacaagcccaugcagaugaaccaggcccuguucaugacgggccggcacugcggguacguccugcagcccuccaccaugcgcgacgaggccuucgaccccuucgacaagagcucccuccggggccuggagccgugcgccaucagcaucgaggugcugggggcgcgccaccuccccaagaacggccggggcaucgugugccccuucgucgagaucgagguggccggggccgaguacgacagcaccaagcagaagaccgaguucguggucgacaacggccugaacccgguguggcccgccaagcccuuccacuuccagaucuccaaccccgaguucgccuuccugcgcuucguggucuacgaggaggacauguucagcgaccagaacuuccucgcgcaggccacguucccggugaaggggcugaagaccggcuaccgggccgugccccugaagaacaacuacuccgaggaccucgagcuggccagccugcucaucaagaucgacaucuuccccgcgaagcaggagaacggggaccugucccccuucagcggcaccucccugcgcgagcggggcagcgacgccuccgggcagcuguuccacggccgcgcccgggaggggagcuucgagucccgcuaccagcagccguucgaggacuuccggaucagccaggagcaccuggccgaccacuucgacucccgcgagcggcgcgcgccccggcgcacccgggucaacggcgacaaccgccuguga

SEQ ID NO: 34693 - RNA, 3798 nt, Artificial Sequence
  derived and/or modified sequence opt1 from PLCG2__Homo_sapiens__NP_002652
augagcaccaccgugaacgucgacucccuggccgaguacgagaagucccagaucaagcgcgcccucgagcugggcacggugaugaccguguucagcuuccgcaagagcacccccgagcggcggaccguccaggugaucauggagacgcgccagguggcgugguccaagaccgccgacaagaucgagggguuccuggacaucauggagaucaaggagauccggccgggcaagaacagcaaggacuucgagcgcgccaaggccguccggcagaaggaggacugcugcuucaccauccucuacgggacccaguucgugcuguccacgcugagccucgccgcggacuccaaggaggacgccgugaacuggcugagcggccugaagauccuccaccaggaggccaugaacgccuccacccccaccaucaucgagagcuggcugcgcaagcagaucuacuccgucgaccagacccggcgcaacagcaucucccugcgggagcucaagacgauccugccccugaucaacuucaaggugagcuccgcgaaguuccucaaggacaaguucguggagaucggggcccacaaggacgagcugagcuucgagcaguuccaccuguucuacaagaagcucauguucgagcagcagaaguccauccuggacgaguucaagaaggacagcagcgucuucauccugggcaacaccgaccgccccgacgccuccgccguguaccuccacgacuuccagcgguuccugauccacgagcagcaggagcacugggcccaggaccugaacaaggugcgcgagcggaugaccaaguucaucgacgacaccaugcgcgagacggcggagccguuccucuucgucgacgaguuccugaccuaccuguucagccgggagaacuccaucugggacgagaaguacgacgccguggacaugcaggacaugaacaacccccucagccacuacuggaucuccagcucccacaacaccuaccugaccggcgaccagcugcgcagcgaguccagccccgaggccuacauccggugccuccgcauggggugccggugcaucgagcuggacugcugggacggccccgacgggaagccggugaucuaccacggcuggacgcgcaccaccaagaucaaguucgacgacgucgugcaggccaucaaggaccacgccuucgugaccuccagcuuccccgucauccuguccaucgaggagcacugcagcguggagcagcagcgccacauggcgaaggccuucaaggagguguucggggaccuccugcugacgaagcccaccgaggccuccgccgaccagcuccccagcccgucccagcugcgggagaagaucaucaucaagcacaagaagcugggcccccgcggcgacgucgacgugaacauggaggacaagaaggacgagcacaagcagcagggggagcucuacaugugggacagcaucgaccagaaguggacccggcacuacugcgccaucgcggacgccaagcuguccuucagcgacgacaucgagcagaccauggaggaggaggucccccaggacaucccgcccacggagcugcacuucggcgagaagugguuccacaagaagguggagaagcgcaccagcgccgagaagcuccugcaggaguacugcauggagaccgggggcaaggacggcaccuuccuggugcgggaguccgagacguuccccaacgacuacacccucagcuucuggcgcuccgggcggguccagcacugccgcauccggagcaccauggagggcgggacccugaaguacuaccugacggacaaccucaccuucuccagcaucuacgcccugauccagcacuaccgcgagacccaccuccggugcgccgaguucgagcugcgccucaccgaccccgugcccaacccgaacccccacgaguccaagcccugguacuacgacagccugucccggggcgaggcggaggacaugcugaugcgcaucccccgggacggggccuuccucauccgcaagcgggagggcagcgacuccuacgccaucaccuuccgcgcccggggcaaggugaagcacugccgcaucaaccgcgacgggcggcacuucguccugggcacgagcgcguacuucgagucccugguggagcucgugagcuacuacgagaagcacucccuguaccgcaagaugcggcugcgcuacccggucacccccgagcuccuggagcgguacaacauggagcgcgacaucaacagccuguacgacgugucccggauguacguggaccccagcgagaucaaccccagcaugccgcagcgcaccgucaaggcccucuacgacuacaaggccaagcgguccgacgagcugagcuucugccgcggggcccugauccacaacguguccaaggagcccggcgggugguggaagggcgacuacggcacccggauccagcaguacuuccccagcaacuacguggaggacaucuccacggccgacuucgaggagcucgagaagcagaucaucgaggacaacccgcuggggagccugugccgcggcauccucgaccugaacaccuacaacgucgugaaggcgccccaggggaagaaccagaaguccuucguguucauccuggagcccaagcagcagggcgacccgcccgucgaguucgccaccgaccggguggaggagcuguucgagugguuccagagcauccgcgagaucaccuggaagaucgacacgaaggagaacaacaugaaguacugggagaagaaccaguccaucgccaucgagcugagcgaccugguggucuacugcaagcccaccuccaagaccaaggacaaccucgagaaccccgacuuccgggagauccgcagcuucguggagaccaaggccgacuccaucauccggcagaagcccguggaccugcugaaguacaaccagaaggggcucacgcgcgucuacccgaagggccagcggguggacagcuccaacuacgaccccuuccgccuguggcugugcggcagccagaugguggcccucaacuuccagaccgcggacaaguacaugcagaugaaccacgcccuguucucccugaacgggcggaccggcuacguccuccagcccgagagcaugcgcaccgagaaguacgaccccaugccgcccgagucccagcgcaagauccugaugacgcugaccgugaaggugcucggggcccggcaccuccccaagcugggccgcagcaucgccugccccuucgucgagguggagaucugcggcgccgaguacgacaacaacaaguucaagaccaccguggucaacgacaacgggcucagcccgaucugggcgcccacgcaggagaaggugaccuucgagaucuacgaccccaaccuggccuuccugcgguucguggucuacgaggaggacauguucuccgaccccaacuuccucgcccacgccaccuacccgaucaaggcggucaagagcggcuuccgcuccgugccccugaagaacggguacagcgaggacaucgagcuggccucccuccugguguucugcgagaugcggcccgugcuggagagcgaggaggagcucuacuccagcugccgccagcugcggcgccggcaggaggagcugaacaaccagcuguuccuguacgacacccaccagaaccugcgcaacgccaaccgggacgcccucgugaaggaguucuccgucaacgagaaccagcugcagcuguaccaggagaagugcaacaagcgccuccgggagaagcgcgugagcaacuccaaguucuacagcuga

SEQ ID NO: 34694 - RNA, 5082 nt, Artificial Sequence
  derived and/or modified sequence opt1 from PLCH1__Homo_sapiens__NP_001124432
auggccgaccuggagguguacaagaaccucagccccgagaaggucgagcgcugcauguccgugaugcagagcggcacccagaugaucaagcugaagcgggggaccaagggccuggugcgccucuucuaccuggacgagcaccggacgcgccugcgguggcgcccgucccggaagagcgagaaggccaagauccucaucgacuccaucuacaaggucaccgaggggcgccagagcgagaucuuccaccggcaggcggagggcaacuucgaccccuccugcugcuucaccaucuaccacgggaaccacauggagagccuggaccugaucaccuccaaccccgaggaggcccgcacguggaucaccggccucaaguaccugauggccggcaucagcgacgaggacucccuggccaagcggcagcgcacccacgaccagugggugaagcagaccuucgaggaggccgacaagaacggggacggccuccugaacaucgaggagauccaccagcugaugcacaagcucaacgugaaccugccccggcgcaagguccggcagauguuccaggaggcggacacggacgagaaccaggggacccugaccuucgaggaguucugcguguucuacaagaugaugagccuccgccgggaccuguaccugcuccugcuguccuacagcgacaagaaggaccaccucaccguggaggagcuggcccaguuccugaaggucgagcagaagaugaacaacgugacgaccgacuacugccucgacaucaucaagaaguucgagguguccgaggagaacaaggucaagaacgugcugggcaucgagggguucaccaacuucaugcgcagcccggccugcgacaucuucaacccccugcaccacgagguguaccaggacauggaccagccccucugcaacuacuacaucgccuccagccacaacaccuaccugacgggcgaccagcugcucucccagagcaaggucgacauguacgcgcgggugcugcaggagggcugccgcugcguggaggucgacugcugggacgggcccgacggcgagccgguggugcaccacggguacacccugaccagcaagauccucuuccgggacgucguggagaccaucaacaagcacgccuucgugaagaacgaguuccccgucauccuguccaucgagaaccacugcagcauccagcagcagcgcaagaucgcccaguaccugaagggcaucuucggcgacaagcucgaccuguccagcguggacacgggggagugcaagcagcugcccuccccccagagccucaagggcaagauccuggucaaggggaagaagcugccguaccaccucggcgacgacgccgaggagggggagguguccgacgaggacagcgccgacgagaucgaggacgagugcaaguucaagcugcacuacuccaacggcaccaccgagcaccagguggagagcuucauccgcaagaagcuggagucccuccugaaggagagccagauccgggacaaggaggaccccgacuccuucaccguccgcgcgcugcugaaggccacgcacgagggccucaacgcccaccugaagcagagccccgacgugaaggaguccgggaagaagagccacggccggucccugaugaccaacuucgggaagcacaagaagaccaccaagagccgcuccaagagcuacagcacggacgacgaggaggacacccagcaguccaccggcaaggaggggggccagcucuaccggcugggccgccggcgcaagaccaugaagcugugccgggagcucagcgaccugguggucuacacgaacuccguggccgcccaggacaucguggacgacgggaccaccggcaacguccugagcuucuccgagacccgcgcgcaccagguggugcagcagaagagcgagcaguucaugaucuacaaccagaagcagcucacgcggaucuaccccuccgccuaccgcaucgacagcuccaacuucaacccgcugcccuacuggaacgccgggugccagcuggucgcccucaacuaccagagcgagggccggaugaugcagcugaaccgcgccaaguucaaggcgaacgggaacugcggcuacgugcugaagccccagcagaugugcaagggcaccuucaaccccuucuccggggacccgcuccccgccaaccccaagaagcagcugauccugaaggugaucagcggccagcagcuccccaagccgcccgacuccauguucggggaccggggcgagaucaucgaccccuucgucgagguggagaucaucggccugcccguggacugcugcaaggaccagacccgcgucguggacgacaacggguucaacccggugugggaggagacccugaccuucacgguccacaugcccgagaucgcccucgugcgguuccuggugugggaccacgaccccaucggccgcgacuucgucgggcagcggaccgugaccuucagcucccuggugccgggcuaccgccacgucuaccucgaggggcugaccgaggccagcaucuucgugcacaucacgaucaacgagaucuacggcaagugguccccccugauccucaaccccagcuacaccauccugcacuuccugggcgccaccaagaaccgccagcuccaggggcugaagggccuguucaacaagaacccccggcacagcuccagcgagaacaacucccacuacgugcgcaagcggagcaucggggaccgcauccuccggcgcaccgcguccgccccggccaagggccggaagaagagcaagaugggguuccaggagauggucgagaucaaggacuccgugagcgaggccacgcgcgaccaggacggcgugcugcggcgcaccacccggucccugcaggcgcgccccgucagcaugcccguggaccggaaccuccugggcgcccugucccuccccgugagcgagaccgccaaggacaucgaggggaaggagaacucccuggccgaggacaaggacggccgccggaaggggaaggccagcaucaaggacccgcacuuccugaacuucaacaagaagcucuccagcuccagcuccgcgcugcugcacaaggacacgagccagggcgacaccaucgucagcaccgcccacauguccgugaccggggagcagcucggcaugagcuccccccgcggcgggcggacgaccagcaacgccaccuccaacugccaggagaaccccugccccagcaagucccugagcccgaagcagcaccuggcccccgaccccguggucaaccccacccaggaccuccacggcgugaagaucaaggagaaggggaacccggaggacuucguggagggcaaguccauccugagcggguccguccugagccacuccaaccucgagaucaagaaccuggagggcaaccgcggcaaggggcgggccgcgacgagcuucucccugagcgacguguccaugcucugcagcgacauccccgaccugcacuccaccgccauccugcaggagagcgugaucagccaccucaucgacaacgucacccugaccaacgagaacgagcccggcuccagcaucuccgcccugaucgggcaguucgacgagacgaacaaccaggcccucaccguggugagccaccugcacaacaccuccgucaugagcggccacugcccccugccgucccucggccugaagaugcccaucaagcacggguucugcaagggcaagagcaaguccagcuuccugugcuccagccccgagcucaucgcccuguccagcuccgagaccacgaagcacgcgaccaacaccguguacgagaccacgugcacccccaucagcaagaccaagccggacgacgaccuguccagcaaggccaagaccgccgcccucgaguccaaccugcccgggagccccaacacgagccgcggcuggcugccgaagucccccaccaagggggaggacugggagacccucaagagcugcucccccgcgagcucccccgaccugacccuggaggacgugaucgccgacccgacccucugcuucaacagcggcgaguccagccuggucgagaucgacggcgaguccgagaaccugagccucacgaccugcgaguaccggcgcgaggggaccucccagcuggccagcccccugaagcucaaguacaaccagggcguggucgagcacuuccagcgcgggcugcggaacggcuacugcaaggagacccugcgccccuccgugcccgagaucuucaacaacauccaggacgugaagacgcagagcaucuccuaccucgccuaccagggggccggcuucguccacaaccacuucagcgacuccgacgcgaagauguuccagaccugcgugccgcagcagagcuccgcccaggacaugcacgugcccguccccaagcagcuggcccaccugccccucccggcccugaagcugcccagccccugcaagagcaagucccucggcgaccugaccagcgaggacaucgccugcaacuucgaguccaaguaccagugcaucagcaaguccuucgugaccacggggauccgggacaagaagggcgugaccgucaagaccaagagccuggagcccaucgacgcgcucaccgagcagcugcgcaagcugguguccuucgaccaggaggacaacugccaggugcuguacagcaagcaggacgccaaccagcucccgcgggcccugguccgcaagcuguccagccggucccagagccgcgugcggaacaucgccucccgcgccaaggagaagcaggaggcgaacaagcagaaggugcccaaccccagcaacggggccggcgucgugcuccggaacaagcccuccgccccgacgcccgccgugaaccgccacagcaccggguccuacaucgcgggcuaccugaagaacaccaagggcgggggccuggaggggcggggcauccccgagggcgccugcaccgcccuccacuacgggcacgucgaccaguucugcagcgacaacuccgugcugcagacggagcccagcagcgacgacaagccggagaucuacuuccugcuccgccuguga

SEQ ID NO: 34695 - RNA, 3288 nt, Artificial Sequence
  derived and/or modified sequence opt1 from PLCL1__Homo_sapiens__NP_006217
auggccgagggcgccgcggggcgcgaggaccccgccccgcccgacgccgccggcggggaggacgacccccgggugggccccgacgccgcgggggacugcgucaccgccgccagcggcggccgcaugcgggaccgccgguccgggguggcccugccgggcgcggccgggacccccgccgacagcgaggccggccuccuggaggccgcgcgcgccacgccccggcgcuccagcaucaucaaggaccccuccaaccagaagugcgggggccggaagaagaccgugagcuucuccagcaugccguccgagaagaagaucagcuccgccaacgacugcaucagcuucaugcaggccggcugcgagcugaagaagguccgccccaacucccggaucuacaaccgcuucuucacccucgacaccgaccugcaggcccugcggugggagcccagcaagaaggaccucgagaaggcgaagcuggacaucuccgccaucaaggagauccgccuggggaagaacacggagaccuuccggaacaacggccucgccgaccagaucugcgaggacugcgccuucagcauccugcacggggagaacuacgagucccuggaccucguggccaacagcgcggacguggccaacaucugggucuccggccugcgcuaccuggugagccggagcaagcagccccucgacuucauggagggcaaccagaacaccccgcgcuucauguggcugaagaccguguucgaggccgccgacgucgacgggaacggcaucaugcuggaggacacguccguggagcucaucaagcagcugaaccccacccugaaggaggccaagauccggcucaaguucaaggagauccagaaguccaaggagaagcugaccacccgcgugacggaggaggaguucugcgaggcguucugcgagcugugcacccggcccgaggucuacuuccuccuggugcagaucagcaagaacaaggaguaccuggacgccaacgaccucaugcuguuccuggaggccgagcagggggugacccacaucaccgaggacaucugccucgacaucauccgccgcuacgagcugagcgaggagggccggcagaagggguuccuggccaucgacggcuucacgcaguaccuccuguccagcgagugcgacaucuucgaccccgagcagaagaaggucgcgcaggacaugacccagccgcugucccacuacuacaucaacgccagccacaacaccuaccucaucgaggaccaguuccgcggccccgccgacaucaacggguacauccgggcccugaagaugggcugccgcuccguggagcuggacgugagcgacggguccgacaacgagcccauccucugcaaccggaacaacaugaccacgcacgucagcuuccgcuccgugaucgaggugaucaacaaguucgccuucgucgcgagcgaguacccccugauccugugccucggcaaccacugcucccugccgcagcagaaggugauggcccagcagaugaagaagguguucgggaacaagcuguacaccgaggcgccccuccccagcgaguccuaccugcccagcccggagaagcugaagcggaugaucaucgucaagggcaagaagcuccccuccgaccccgacgugcuggagggcgaggucaccgacgaggacgaggaggccgagaugagccgccggaugagcguggacuacaacggggagcagaagcagauccgccugugccgggagcuguccgaccucgugagcaucugcaaguccguccaguaccgcgacuucgagcugagcaugaagucccagaacuacugggagaugugcagcuucuccgagaccgaggccagccggaucgccaacgaguaccccgaggacuucgugaacuacaacaagaaguuccugucccgcaucuacccgagcgccaugcggaucgacuccagcaaccucaacccccaggacuucuggaacugcggcugccagaucguggccaugaacuuccagacgcccgggccgaugauggaccugcacaccggcugguuccugcagaacgggggcugcggcuacguccuccgccccuccaucaugcgggacgaggugagcuacuucuccgccaacaccaaggggauccugcccggcgugagcccccuggcccuccacaucaagaucaucuccgggcagaacuucccgaagcccaagggcgcgugcgccaagggcgacgucaucgaccccuacgugugcaucgagauccacgggauccccgccgacugcagcgagcagcgcaccaagacggugcagcagaacagcgacaacccgaucuucgacgagaccuucgaguuccaggucaaccugcccgagcuggccaugauccgguucguggugcucgacgacgacuacaucggcgacgaguucaucgggcaguacaccauccccuucgagugccugcagcccggcuaccgccacgucccgcugcgcuccuucgugggggacaucauggagcacgugacccucuucguccacaucgcgaucacgaaccggagcggcggcgggaaggcccagaagcgcucccugagcgugcggaugggcaagaaggugcgcgaguacaccaugcugcggaacaucgggcucaagaccaucgacgacaucuucaagaucgccguccacccccugcgcgaggccaucgacaugcgggagaacaugcagaacgccaucguguccaucaaggagcugugcggccucccgcccaucgcgagccugaagcagugccugcucacccuguccagccgccugaucacguccgacaacacccccagcgugucccucgucaugaaggacagcuuccccuaccuggagccccugggggccauccccgacgugcagaagaagaugcucaccgccuacgaccugaugauccaggagucccgguuccugaucgagauggccgacaccgugcaggagaagaucguccagugccagaaggccggcauggaguuccacgaggagcuccacaaccugggcgcgaaggaggggcugaagggccgcaagcucaacaaggccaccgagagcuucgccuggaacaucacggugcugaaggggcagggcgaccugcucaagaacgccaagaacgaggccaucgagaacaugaagcagauccagcuggcgugccuguccugcgggcucagcaaggccccguccagcuccgccgaggccaagagcaagcggagccuggaggcgaucgaggagaaggaguccagcgaggagaacggcaagcuguga

SEQ ID NO: 34696 - RNA, 3384 nt, Artificial Sequence
  derived and/or modified sequence opt1 from PLCL2__Homo_sapiens__NP_001137854
auggccgagugcggccgcgggggcgccgccgggggcgcgcugcccaccagcccggggcccgcccucggcgccaagggcgcccugaaggcgggggugggcgagggcggcgggggcggcgggcggcugggccacgggcgcgcccgguacgacuccggcggcgucagcaacggggacugcucccucggcgugagcggggacgaggcccgcgccucccccacccggggcccccgcgggguggcgcuggccccgacgcccagcgccgucgugugcacccugccccgggaguccaagcccggcggccucccgcgccggagcuccaucaucaaggacgggaccaagcagaagcgcgagcggaagaagaccgugagcuucuccagcaugcccacggagaagaagaucuccagcgccuccgacugcaucaacagcauggucgagggcuccgagcugaagaaggugcgcagcaacucccggaucuaccaccgcuacuuccugcucgacgccgacaugcagagccugcggugggagcccagcaagaaggacuccgagaaggcgaagaucgacaucaagagcaucaaggaggugcgcaccgggaagaacaccgacaucuuccgguccaacggcaucagcgaccagaucuccgaggacugcgccuucagcgucaucuacggggagaacuacgagucccuggaccucguggccaacagcgccgacguggccaacaucugggucaccggccugcgcuaccugaucuccuacggcaagcacacgcucgacaugcuggagagcucccaggacaacaugcggaccagcugggugucccagauguucagcgagaucgacguggacaaccuggggcacaucacccucugcaacgcgguccagugcauccgcaaccugaaccccggccugaagaccuccaagaucgagcucaaguucaaggagcugcacaagagcaaggacaaggccgggacggaggugaccaaggaggaguucaucgagguguuccacgagcugugcacccggccggagaucuacuuccuccugguccaguucuccagcaacaaggaguuccuggacaccaaggaccucaugauguuccuggaggccgagcagggcguggcccacaucaacgaggagaucucccuggagaucauccacaaguacgagcccagcaaggaggggcaggagaagggcuggcucagcaucgacggcuucacgaacuaccugaugucccccgacugcuacaucuucgaccccgagcacaagaaggugugccaggacaugaagcagccgcugagccacuacuucaucaacuccagccacaacaccuaccucaucgaggaccaguuccgcgggcccuccgacaucaccggcuacauccgcgcccugaagauggggugccggagcgucgagcuggacgugugggacggccccgacaacgagcccgugaucuacaccggccacacgaugaccucccagaucgucuuccgcagcgugaucgacaucaucaacaaguacgcguucuucgccuccgaguacccgcucauccugugccuggagaaccacugcagcaucaagcagcagaaggucauggugcagcacaugaagaagcuccugggggacaagcuguacaccaccucccccaacguggaggagagcuaccuccccucccccgacguccugaagggcaagauccugaucaaggccaagaagcucagcuccaacugcagcgggguggagggcgacgugacggacgaggacgagggggccgagaugucccagcggaugggcaaggagaacauggagcagccgaacaacguccccgugaagcgcuuccagcugugcaaggagcugagcgagcucgugagcaucugcaaguccguccaguucaaggaguuccaggugagcuuccaggugcagaaguacugggaggucugcuccuucaacgaggugcuggccagcaaguacgcgaacgagaaccccggcgacuucgugaacuacaacaagcgguuccuggcccgcgucuuccccuccccgaugcggaucgacagcuccaacaugaacccccaggacuucuggaagugcgggugccagaucguggccaugaacuuccagacccccggccugaugauggaccucaacaucgggugguuccgccagaacggcaacugcggguacgugcugcggccggccaucaugcgcgaggaggucagcuucuucuccgcgaacaccaaggacagcgugcccggcgugagcccccagcugcuccacaucaagaucaucagcggccagaacuuccccaagccgaagggguccggcgccaagggggacgucguggaccccuacguguacgucgagauccacggcauccccgccgacugcgccgagcagcggaccaagacggugcaccagaacggggacgcccccaucuucgacgagagcuucgaguuccagaucaaccugccggagcuggcgauggugcgcuucgucgugcucgacgacgacuacaucggcgacgaguucaucggccaguacaccauccccuucgagugccugcagaccggguaccggcacgugccccugcagucccucaccggcgagguccuggcccacgccagccuguucgugcacguggccaucacgaaccgccggggcggcgggaagccccacaagcgcgggcucuccguccggaaggggaagaagucccgcgaguacgccucccugcggacccuguggaucaagaccguggacgagguguucaagaacgcgcagccgcccauccgcgacgccaccgaccuccgcgagaacaugcagaacgccgucgugagcuucaaggagcugugcgggcugagcuccguggccaaccucaugcagugcaugcuggccgucagcccccgguuccugggccccgacaacacgccgcucguggugcugaaccuguccgagcaguaccccaccauggagcuccaggggaucguccccgaggugcugaagaagaucgugaccaccuacgacaugaugauccagagccugaaggcgcucaucgagaacgccgacgccgucuacgagaagaucgugcacugccagaaggccgcgauggaguuccacgagcaccuccacuccaucggcaccaaggagggccugaaggagcgcaagcugcagaaggccguggagagcuucacguggaacaucaccauccugaaggggcaggccgaccugcucaaguacgccaagaacgagacccuggagaaccugaagcagauccacuucgccgcggucuccugcggccucaacaagcccgggaccgagaacgccgacgugcagaagccgcggcgcagccuggaggugauccccgagaaggccaacgacgagacgggcgaguga

SEQ ID NO: 34697 - RNA, 918 nt, Artificial Sequence
  derived and/or modified sequence opt1 from PLCXD2__Homo_sapiens__NP_001172035
augcuggccgugcgcaaggcccggcgcaagcuccggaugggcaccaucugcagccccaacccguccgggaccaagacgagcuccgaggucugcaacgcggacuggauggccagccugccgccccaccuccacaaccugccccuguccaaccuggccauccccggcagccacgacuccuucagcuacuggguggacgagaagucccccguggggcccgaccagacccaggccaucaagcgccucgcccggaucagccuggucaagaagcugaugaagaagugguccgugacccagaaccucaccuuccgcgagcagcuggaggcgggcauccgguacuucgaccugcgcgugagcuccaagcccggggacgccgaccaggagaucuacuucauccacggccucuucggcaucaaggucugggacgggcugauggagaucgacagcuuccugacgcagcacccgcaggagaucaucuuccucgacuucaaccacuucuacgccauggacgagacccaccacaagugccuggugcugcggauccaggaggccuucggcaacaagcucugccccgcgugcuccguggagagccugacccugcgcacccucugggagaagaacugccagguccugaucuucuaccacugccccuucuacaagcaguaccccuuccuguggccggggaagaagauccccgcccccugggccaacacgaccuccgugcggaagcucauccuguuccuggagaccacccucagcgagcgcgccucccggggcagcuuccacgugagccaggccauccugacgccccgcgucaagaccaucgcgcgggggcuggugggcggccucaagaacacccuggugcacuccaaccgcuggaacagccacgggccgucccugcucagccaggagcgguccuga

SEQ ID NO: 34698 - RNA, 966 nt, Artificial Sequence
  derived and/or modified sequence opt1 from PLCXD3__Homo_sapiens__NP_001005473
auggccagcucccagggcaagaacgagcugaagcucgccgacuggauggcgacccugcccgagagcaugcacuccaucccgcugaccaaccucgccauccccgggagccacgacuccuucagcuucuacaucgacgaggccucccccgugggccccgagcagccggagacgguccagaacuucgugagcguguucgggaccgucgccaagaagcugaugcgcaaguggcuggccacccagaccaugaacuucacgggccagcucggggcgggcauccgguacuucgaccugcgcaucuccaccaagccccgggaccccgacaacgagcuguacuucgcccacggccucuucagcgccaaggugaacgaggggcuggaggagaucaacgccuuccugaccgaccaccacaaggagguggucuuccucgacuucaaccacuucuacggcaugcagaaguaccaccacgagaagcuggugcagaugcugaaggacaucuacgggaacaagaugugccccgcgaucuucgcccaggaggugucccucaaguaccugugggagaaggacuaccagguccugguguucuaccacagcccgguggcccucgagguccccuuccuguggcccggccagaugaugcccgccccgugggccaacaccacggaccccgagaagcugauccaguuccuccaggcguccaucaccgagcgccggaagaaggggagcuucuucaucucccagguggugcugacccccaaggccagcaccgucgugaagggcguggccuccggccugcgcgagacgaucaccgagcgggcccuccccgccaugaugcaguggguccgcacccagaagccgggggagagcggcaucaacaucgugaccgcggacuucguggagcugggggacuucaucuccacggucaucaagcugaacuacguguucgacgagggcgaggccaacaccuga

SEQ ID NO: 34699 - RNA, 1827 nt, Artificial Sequence
  derived and/or modified sequence opt1 from PLCZ1__Homo_sapiens__NP_149114
auggagaugcgcugguuccugagcaagauccaggacgacuuccggggcgggaagaucaaccucgagaagacccagcgccugcuggagaagcucgacauccggugcuccuacauccacgugaagcagaucuucaaggacaacgaccgccugaagcagggccggaucaccaucgaggaguuccgcgccaucuaccggaucaucacgcaccgcgaggagaucaucgagaucuucaacaccuacagcgagaaccggaagauccugcucgccuccaaccuggcgcaguuccugacccaggagcaguacgccgccgagaugagcaaggccaucgccuucgagaucauccagaaguacgagcccaucgaggagguccgcaaggcgcaccagaugucccucgagggguucacccgguacauggacagccgcgagugccugcuguucaagaacgagugccggaagguguaccaggacaugacgcacccgcucaacgacuacuucaucuccagcucccacaacaccuaccuggugagcgaccagcugcucggccccuccgaccuguggggguacgucagcgcccuggugaagggcugccgcugccucgagaucgacugcugggacggcgcccagaacgagcccguggucuaccacggguacacccugaccuccaagcuccucuucaagacggugauccaggccauccacaaguacgcguucaugaccagcgacuaccccgugguccugucccuggagaaccacugcagcaccgcccagcaggaggugauggccgacaaccuccaggccaccuucggcgagucccugcugagcgacaugcucgacgacuucccggacacgcugcccucccccgaggcccugaaguucaagauccucgugaagaacaagaagaucgggacccugaaggagacccacgagcggaagggcagcgacaagcgcggggacaaccaggacaaggagaccggcgucaagaagcugcccggcgugaugcuguucaagaagaagaagacgcggaagcugaagaucgcgcuggcccucagcgaccuggugaucuacaccaaggccgagaaguucaaguccuuccagcacagccgccuguaccagcaguucaacgagaacaacuccaucggggagacccaggcccggaagcucagcaagcugcgcguccacgaguucaucuuccacacccggaaguucaucacgcgcaucuacccgaaggccacccgcgcggacuccagcaacuucaacccccaggaguucuggaacaucggcugccagaugguggcccugaacuuccagacccccgggcuccccauggaccugcagaacggcaaguuccuggacaacggcggguccggcuacauccucaagccgcacuuccugcgggagagcaaguccuacuucaaccccagcaacaucaaggaggggaugcccaucacccugacgauccgccucaucuccggcauccagcugccccugacccacagcuccagcaacaagggggacucccuggugaucaucgaggucuucggcgugccgaacgaccagaugaagcagcagacccgggugaucaagaagaacgccuucagcccccgcuggaacgagaccuucacguucaucauccacguccccgagcucgcccugauccgguucgugguggagggccaggggcugaucgccggcaacgaguuccucgggcaguacacccugccccugcucugcaugaacaagggcuaccgccggaucccgcuguucucccgcaugggggagagccuggagcccgcgucccucuucgucuacgugugguacguccgguga

SEQ ID NO: 34700 - RNA, 3111 nt, Artificial Sequence
  derived and/or modified sequence opt1 from PLD1__Homo_sapiens__NP_001123553
augagccugaagaacgagccccgcgugaacaccuccgcccuccagaagaucgccgcggacaugagcaacaucaucgagaaccuggacacccgggagcugcacuucgagggcgaggaggucgacuacgacguguccccgagcgaccccaagauccaggagguguacauccccuucuccgccaucuacaacacgcagggguucaaggagcccaacauccagaccuaccucagcggcugcccgaucaaggcccagguccuggagguggagcgcuucaccuccaccacgcgggugcccagcaucaaccuguacaccaucgagcucacccacggggaguucaaguggcaggucaagcgcaaguucaagcacuuccaggaguuccaccgggagcugcugaaguacaaggccuucauccgcauccccauccccacccggcgccacacguuccggcgccagaacgugcgggaggagccgcgcgagaugcccucccucccccggagcuccgagaacaugauccgcgaggagcaguuccugggccggcgcaagcagcuggaggacuaccucaccaagauccugaagaugcccauguaccggaacuaccacgccaccaccgaguuccuggacaucagccagcucuccuucauccacgaccuggggccgaagggcaucgagggcaugaucaugaagcgcagcgggggccaccggauccccgggcugaacugcugcggccaggggcgcgcgugcuaccggugguccaagcgcuggcucaucgugaaggacagcuuccugcuguacaugaagcccgacuccggcgccaucgccuucguccuccugguggacaaggaguucaagaucaaggugggcaagaaggagacggagaccaaguacgggauccgcaucgacaaccugagccggacccucauccugaagugcaacuccuaccgccacgcccggugguggggcggggcgaucgaggaguucauccagaagcacggcaccaacuuccugaaggaccaccgcuucggcagcuacgccgccauccaggagaacgcccucgccaagugguacgucaacgcgaagggguacuucgaggacguggccaacgccauggaggaggccaacgaggagaucuucaucacggacugguggcugagccccgagaucuuccugaagcggccgguggucgagggcaaccgcuggcggcucgacugcauccugaagcgcaaggcccagcagggggugcggaucuucaucaugcuguacaaggagguggagcucgcgcugggcaucaacuccgaguacaccaagcgcacccugaugcggcuccaccccaacaucaaggucaugcgccaccccgaccacgugagcuccaccguguaccugugggcccaccacgagaagcuggucaucaucgaccagagcguggccuucgucgggggcaucgaccucgccuacggccggugggacgacaacgagcaccgccugacggacgugggguccgugaagcgggucaccagcggccccucccuggggagccucccgcccgccgcgauggaguccauggagagccugcgccugaaggacaagaacgagcccgugcagaaccuccccauccagaaguccaucgacgacguggacagcaagcugaagggcaucgggaagccgcggaaguucuccaaguucagccuguacaagcagcuccaccgccaccaccuccacgacgccgacuccaucagcuccaucgacagcaccuccaacaccggcagcauccggagccugcagacgggcgucggggagcugcacggcgagacccgcuucuggcacgggaaggacuacugcaacuucguguucaaggacugggugcagcuggacaagcccuucgccgacuucaucgaccgcuacuccacgccccggaugcccuggcacgacaucgccagcgccguccacggcaaggcggcccgcgacguggcccggcacuucauccagcgcuggaacuucaccaagaucaugaaguccaaguaccggagccuguccuacccguuccugcuccccaagagccagaccaccgcccacgagcugcgcuaccaggugcccggguccguccacgcgaacgugcagcugcuccggagcgccgccgacugguccgccggcaucaaguaccacgaggagagcauccacgccgcguacgugcacgucaucgagaacucccgccacuacaucuacaucgagaaccaguucuucaucagcugcgccgacgacaaggugguguucaacaagaucggcgacgccaucgcccagcggauccugaaggcccaccgcgagaaccagaaguaccgggucuacguggugaucccgcugcuccccggguucgagggcgacaucuccaccgggggcggcaacgcgcugcaggccaucaugcacuucaacuaccgcaccaugugccgcggggagaacagcauccugggccagcucaaggccgagcuggggaaccaguggaucaacuacaucuccuucugcggccugcggacgcacgccgagcucgaggggaaccuggucaccgagcugaucuacgugcacagcaagcuccugaucgccgacgacaacaccgugaucaucggcuccgcgaacaucaacgaccggagcaugcugggcaagcgcgacagcgagauggccgucaucgugcaggacaccgagacggugcccuccgucauggacgggaaggaguaccaggccggccgguucgcccgcgggcuccggcugcagugcuuccgcguggugcugggcuaccucgacgaccccagcgaggacauccaggacccggucuccgacaaguucuucaaggaggugugggugagcaccgcggcccggaacgccaccaucuacgacaaggucuuccgcugccugcccaacgacgaggugcacaaccugauccagcuccgcgacuucaucaacaagcccgugcuggccaaggaggaccccauccgggccgaggaggagcugaagaagauccgcggguuccucguccaguucccguucuacuuccuguccgaggagagccugcuccccuccgugggcaccaaggaggcgaucgugcccauggaggucuggaccuga

SEQ ID NO: 34701 - RNA, 2769 nt, Artificial Sequence
  derived and/or modified sequence opt1 from PLD2__Homo_sapiens__NP_001230037
augaccgccacccccgagagccuguuccccacgggcgacgagcucgacuccagccagcugcagauggaguccgacgagguggacacccugaaggagggggaggaccccgccgaccgcaugcaccccuuccucgcgaucuacgagcugcagagccugaagguccacccccucguguucgccccgggcgugcccgucaccgcccaggugguggggaccgagcgguacacguccggcagcaaggucgggaccugcacccuguacuccgugcgccugacccacggcgacuucagcuggacgaccaagaagaaguaccggcacuuccaggagcuccaccgcgaccugcugcggcacaaggugcucaugucccugcugccccucgcccgcuucgccgucgcguacagccccgcccgggacgccggcaaccgcgagaugccgucccugccccgggccgggcccgagggcagcacccgccacgcggccuccaagcagaaguaccuggagaacuaccucaaccggcugcugaccaugagcuucuaccgcaacuaccacgccaugacggaguuccucgaggugucccagcugagcuucauccccgaccuggggcggaagggccucgaggggaugauccgcaagcgguccggcggccaccgcgugccggggcugaccugcugcggccgggaccaggucugcuaccgcuggagcaagcgguggcugguggugaaggacuccuuccuccuguacaugugccuggagaccggggccaucagcuucguccagcuguucgaccccggcuucgagguccaggugggcaagcgcagcaccgaggcccggcacggggugcgcaucgacacgucccaccgcagccucauccugaagugcuccagcuaccggcaggcgcgcuggugggcccaggagaucaccgagcucgcccagggccccgggcgggacuuccugcagcugcaccgccacgacuccuacgcgcccccgcggcccggcacccucgcccgcugguucgugaacggggccggcuacuucgccgccguggccgacgccauccugcgggcgcaggaggagaucuucaucaccgacugguggcugagccccgaggucuaccucaagcgccccgcccacuccgacgacuggcggcuggacaucaugcugaagcgcaaggccgaggagggcgugcgggugagcauccuccuguucaaggaggucgagcuggcccucgggaucaacuccggcuacagcaagcgcgcccugaugcugcuccacccgaacaucaaggugaugcggcaccccgaccaggucacgcugugggcgcaccacgagaagcugcuggugguggaccaggucguggccuuccucgggggccuggaccuggccuacgggcgcugggacgaccuccacuaccggcugaccgaccugggcgacuccagcgaguccgccgcgagccagccgcccacgccccgccccgacucccccgccacccccgaccucagccacaaccaguucuucuggcugggcaaggacuacuccaaccugaucaccaaggacugggugcagcucgaccggccguucgaggacuucaucgaccgcgagaccacgccccggaugcccuggcgcgacgucgggguggugguccacggccugccggcccgcgaccuggcccggcacuucauccagcgcuggaacuucaccaagaccaccaaggccaaguacaagacccccaccuaccccuaccuccugcccaagagcacguccaccgcgaaccagcugccguucacccuccccgggggccagugcaccacgguccaggugcugcggagcguggaccgcuggagcgccgggacccuggagaacuccauccucaacgccuaccugcacaccauccgggagagccagcacuuccuguacaucgagaaccaguucuucaucuccugcagcgacggccgcaccgugcucaacaaggugggcgacgagaucgucgaccggauccugaaggcccacaagcagggguggugcuaccgcguguacgugcugcucccccugcugcccggcuucgagggggacaucuccaccggcggcgggaacagcauccaggccauccuccacuucacguaccggacccugugccgcggcgaguacuccauccugcaccggcucaaggcggccauggggaccgccuggcgcgacuacaucagcaucugcggccugcggacccacggggagcugggcggccacccggucuccgagcucaucuacauccacagcaaggugcugaucgccgacgaccgcacggugaucaucggguccgccaacaucaacgaccggagccugcucggcaagcgcgacuccgagcuggcgguccugaucgaggacaccgagaccgagcccagccucaugaacggggccgaguaccaggccggcuccgugauccugggggccaacacccggcccgaccuggaccuccgcgaccccaucugcgacgacuucuuccagcuguggcaggacauggcggagagcaacgccaacaucuacgagcagaucuuccggugccugccguccaacgccacgcgcagccuccggacccugcgcgaguacguggccgucgagccccuggccaccgugagcccgccccucgcgcgcuccgagcugacccaggugcagggccaccugguccacuucccccucaaguuccuggaggacgagagccugcucccgccccugggcuccaaggaggggaugaucccccuggagguguggacguga

SEQ ID NO: 34702 - RNA, 1473 nt, Artificial Sequence
  derived and/or modified sequence opt1 from PLD3__Homo_sapiens__NP_001026866
augaagcccaagcugauguaccaggagcucaaggugccggccgaggagcccgccaacgagcugcccaugaacgagaucgaggcguggaaggccgccgagaagaaggcccgcuggguccugcucgugcugauccuggccguggucggcuucggggcgcucaugacccagcuguuccugugggaguacggcgaccuccaccuguucgggcccaaccagcggccggcccccugcuacgaccccugcgaggccgugcugguggagagcauccccgagggccucgacuucccgaacgccuccaccgggaaccccagcacgucccaggcguggcugggccugcucgccggcgcccacagcucccuggacaucgccagcuucuacuggacccugaccaacaacgacacccacacgcaggagcccuccgcccagcagggggaggagguccuccgccagcugcagacccuggcgcccaagggcgugaacgugcggaucgccgucagcaagccguccgggccccagccccaggccgaccuccaggcccugcugcagagcggcgcccaggugcgcaugguggacaugcagaagcucacccacgggguccugcacaccaaguucugggugguggaccagacgcacuucuaccugggcuccgcgaacauggacuggcggagccucacccaggucaaggagcugggcguggugauguacaacugcuccugccuggcccgcgaccucaccaagaucuucgaggccuacugguuccuggggcaggccggcagcuccauccccagcaccuggccgcgguucuacgacacgcgcuacaaccaggagacccccauggagaucugccugaacgggacccccgcccucgcguaccuggccuccgcgcccccgccccugugccccagcggccggacccccgaccucaaggcccugcugaacgucguggacaacgcccgcuccuucaucuacguggccgucaugaacuaccucccgacgcuggaguucagccacccccaccgguucuggcccgccaucgacgacggccugcgccgggccaccuacgagcgcggggugaaggugcggcuccugaucagcugcuggggccacuccgagcccagcaugcgcgccuuccugcucucccuggcggcccugcgggacaaccacacccacagcgacauccaggucaagcuguucguggucccggccgacgaggcccaggcccgcauccccuacgcgcgggugaaccacaacaaguacauggugaccgagcgcgccacguacaucgggaccuccaacuggagcggcaacuacuucaccgagaccgccgggacgucccuccuggucacccagaacggccggggcgggcugcgcagccagcucgaggccaucuuccugcgcgacugggacucccccuacagccacgaccuggacaccuccgccgacagcgugggcaacgcgugccggcuccuguga

SEQ ID NO: 34703 - RNA, 1521 nt, Artificial Sequence
  derived and/or modified sequence opt1 from PLD4__Homo_sapiens__NP_620145
augcugaagccccucuggaaggccgccguggcgccgaccuggcccugcagcaugccgccccgccggcccugggaccgcgaggccggcacccugcagguccugggggcccucgccgugcuguggcugggcuccguggcccucaucugccugcuguggcaggucccccggccgcccacguggggccaggugcagcccaaggacgugccccgcagcugggagcacggguccagccccgcgugggagccccucgaggccgaggcccggcagcagcgcgacuccugccagcugguccugguggagagcaucccgcaggaccuccccuccgccgcggggagccccuccgcccagccccugggccaggccuggcugcagcuccuggacaccgcccaggagagcgugcacgucgccuccuacuacuggagccugaccggcccggacaucggggugaacgacuccagcucccagcucggcgaggcgcugcugcagaagcuccagcagcugcuggggcggaacaucagccucgccguggccaccuccagccccacgcuggcccgcaccuccaccgaccugcagguccucgccgcgcggggcgcccacgugcgccaggugcccauggggcggcugacccgcggcguccugcacagcaaguucugggugguggacggccggcacaucuacauggggagcgccaacauggacuggcgcucccucacgcaggucaaggagcugggcgccgugaucuacaacugcagccaccuggcccaggaccucgagaagaccuuccagaccuacugggugcuggggguccccaaggcggugcugccgaagaccuggccccagaacuucuccagccacuucaaccgguuccagcccuuccacggccucuucgacggcgugcccacgaccgccuacuucuccgccagcccgcccgcccugugcccccaggggcgcacccgggaccuggaggcccuccuggcggucaugggcuccgcccaggaguucaucuacgccagcgugauggaguacuuccccaccacgcgcuucucccacccgccccgguacuggcccguccuggacaacgcccuccgcgcggccgccuucgggaagggcgugcgggugcgccugcuggucgggugcggccucaacaccgacccgaccauguuccccuaccugcgcagccugcaggcccucuccaaccccgccgcgaacgugagcguggacgucaagguguucaucgugcccgucggcaaccacuccaacaucccguucagccgggugaaccacuccaaguucauggugaccgagaaggccgccuacaucgggacgagcaacugguccgaggacuacuucagcuccaccgccggcgucgggcugguggugacccagagccccggcgcccagcccgcgggggccaccguccaggagcagcugcgccagcuguucgagcgggacuggagcucccgcuacgccgugggccucgacggccaggcccccgggcaggacugcguguggcagggcuga

SEQ ID NO: 34704 - RNA, 1425 nt, Artificial Sequence
  derived and/or modified sequence opt1 from PLD5__Homo_sapiens__NP_001182740
augagccagcagaagugcaucgugaucuucgcccuggucugcugcuucgccauccucguggcgcugaucuucuccgccguggacaucaugggcgaggacgaggacgggcugagcgagaagaacugccagaacaagugccgcaucgcccucgucgagaacauccccgagggccugaacuacuccgagaacgccccguuccaccugagccucuuccagggguggaugaaccugcugaacauggccaagaaguccguggacaucgugagcucccacugggaccucaaccacacgcaccccagcgcgugccagggccagcggcuguucgagaagcugcuccagcugaccucccagaacaucgagaucaagcuggucagcgacgugacggccgacuccaaggugcucgaggcccugaagcugaagggggccgaggucaccuacaugaacaugaccgcguacaacaagggccgccuccagagcuccuucuggaucguggacaagcagcacguguacaucggcagcgccgggcuggacuggcagucccugggccagaugaaggagcucggggucaucuucuacaacugcagcugccuggugcuggaccuccagcggaucuucgcccuguacuccagccugaaguucaagucccgcgugccccagaccuggagcaagcggcucuacggcgucuacgacaacgagaagaagcugcagcugcagcucaacgagaccaagagccaggccuucguguccaacagccccaagcuguucugcccgaagaaccgcuccuucgacaucgacgccaucuacagcgugaucgacgacgcgaagcaguacgucuacaucgccgugauggacuaccugcccaucuccagcacguccaccaagcggaccuacuggcccgaccucgacgccaagauccgcgaggcccuggugcugcggagcguccgcgugcggcuccugcuguccuucuggaaggagacggacccccucaccuucaacuucaucagcucccugaaggccaucugcaccgagaucgcgaacugcagccugaaggugaaguucuucgaccucgagcgcgagaacgccugcgccaccaaggagcagaagaaccacacguucccgcggcugaaccgcaacaaguacauggucaccgacggggccgccuacaucggcaacuucgacugggugggcaacgacuucacccagaacgcggggaccggccuggucaucaaccaggccgacgugcggaacaaccgcuccaucaucaagcagcucaaggacguguucgagcgggacugguacagccccuacgccaagacgcugcagcccaccaagcagcccaacugcuccagccuguucaagcucaagccgcuguccaacaagaccgccaccgacgacaccgggggcaaggacccccgcaacgucuga

SEQ ID NO: 34705 - RNA, 13725 nt, Artificial Sequence
  derived and/or modified sequence opt1 from PLEC__Homo_sapiens__NP_000436
augagcggcgaggacgccgaggugcgcgccgucuccgaggacgugagcaacggguccagcggcucccccagcccgggggacacccugcccuggaaccucggcaagacccagcggucccgccggagcgggggcggcgcgggguccaacggcagcgugcuggaccccgccgagcgcgccgucauccggaucgccgacgagcgcgaccgggugcagaagaagacguucaccaagugggugaacaagcaccugaucaaggcccagcgccacaucuccgaccucuacgaggaccugcgggacgggcacaaccugaucagccuccuggagguccuguccggcgacagccucccccgcgagaaggggcggaugcgcuuccacaagcugcagaacgugcagaucgcgcuggacuaccuccggcaccgccaggugaagcuggucaacauccggaacgacgacaucgccgacggcaacccgaagcugacccucggccugaucuggaccaucauccugcacuuccagaucuccgacauccaggugagcgggcaguccgaggacaugacggccaaggagaagcuccugcuguggagccagcgcaugguggagggcuaccaggggcuccggugcgacaacuucaccuccagcuggcgcgacggccggcuguucaacgccaucauccaccgccacaagccccugcucaucgacaugaacaaggucuaccggcagaccaaccuggagaaccuggaccaggcguucagcguggccgagcgcgaccucggcgugacccgccugcuggaccccgaggacgucgacgugccccagccggacgagaaguccaucaucacguacgugagcucccucuacgacgccaugccccggguccccgacgugcaggacggggugcgcgccaacgagcugcagcugcgguggcaggaguaccgcgagcucguccugcugcuccugcaguggaugcggcaccacaccgccgcguucgaggagcgccgguuccccagcuccuucgaggagaucgagauccuguggagccaguuccucaaguucaaggagauggagcugccggccaaggaggccgacaagaaccgcuccaagggcaucuaccagagccuggagggggccgugcaggccggccagcucaaggugccccccggguaccacccccuggacgucgagaaggaguggggcaagcugcacguggcgauccucgagcgggagaagcagcugcgcuccgaguucgagcggcuggagugccuccagcgcaucgucaccaagcugcagauggaggccggccugugcgaggagcagcugaaccaggccgacgcccuccugcagagcgacgugcggcugcucgccgcggggaaggugccgcagcgcgccggcgaggucgagcgggaccuggacaaggccgacuccaugauccgccugcucuucaacgacgugcagacccugaaggacgggcggcacccccagggcgagcagauguaccgccggguguaccgccugcacgagcgccucgucgccauccggacggaguacaaccugcgccugaaggccgggguggcggcccccgccacccagguggcccaggucacccuccagagcgugcagcggcgccccgagcuggaggacuccacccugcgguaccuccaggaccugcuggcguggguggaggagaaccagcaccgcgucgacggcgccgaguggggcguggaccucccgagcguggaggcccagcuggggucccaccggggccugcaccagagcaucgaggaguuccgcgccaagaucgagcgggcccgcuccgacgaggggcagcucagccccgcgacgcggggcgccuaccgcgacugccuggggcggcuggaccuccaguacgccaagcugcugaacuccagcaaggcccgccuccggagccuggagucccugcacagcuucgucgccgcggccaccaaggagcucauguggcugaacgagaaggaggaggaggaggugggcuucgacugguccgaccgcaacaccaacaugaccgccaagaaggagagcuacuccgcccugaugcgggagcucgagcugaaggagaagaagaucaaggagcugcagaacgccggcgaccgccuccugcgggaggaccaccccgcgcgccccacgguggagagcuuccaggccgcccugcagacccagugguccuggaugcuccagcugugcugcugcaucgaggcccaccugaaggagaacgcggccuacuuccaguucuucagcgacguccgggaggccgaggggcagcuccagaagcugcaggaggcccugcgccgcaaguacuccugcgaccggagcgccaccgugacccgccucgaggaccugcugcaggacgcgcaggacgagaaggagcagcucaacgaguacaagggccaccuguccgggcuggccaagcgggccaaggccgugguccagcucaagccgcgccaccccgcccaccccaugcggggccgccugccccugcucgcggugugcgacuacaagcagguggaggucacggugcacaagggcgacgagugccagcugguggggccggcccagcccagccacuggaagguccuguccagcuccggcagcgaggccgccgugcccuccgugugcuuccucgucccgccccccaaccaggaggcccaggaggcggugacccggcuggaggcccagcaccaggcccuggugacccucuggcaccagcugcacgucgacaugaagagccugcucgccuggcagagccugcgccgggacgugcagcugauccgcuccuggagccucgcgaccuuccggacgcugaagcccgaggagcagcgccaggcccugcacucccucgagcugcacuaccaggccuuccugcgggacagccaggacgccgggggcuucgggccggaggaccgccucauggccgagcgggaguacggcuccugcagccaccacuaccagcagcugcugcagucccucgagcagggcgcgcaggaggagagccgcugccagcggugcaucuccgagcugaaggacauccgccugcagcucgaggccugcgagacccggaccgugcaccgccugcgccugccccucgacaaggagcccgcccgggagugcgcccagcgcaucgccgagcagcagaaggcgcaggccgaggucgaggggcugggcaaggggguggcccggcugagcgccgaggccgagaaggugcucgcgcugcccgagccgucccccgccgcccccacccugcgcagcgagcucgagcugacgcugggcaagcucgagcagguccggucccugagcgccaucuaccuggagaagcucaagaccaucucccuggugauccgcgggacccagggcgccgaggaggugcugcgggcgcacgaggagcagcugaaggaggcccaggccguccccgccacccucccggagcuggaggcgacgaaggccagccugaagaagcuccgcgcccaggccgaggcccagcagcccaccuucgacgcgcugcgggacgagcugcgcggcgcccaggaggugggggagcggcuccagcagcgccacggcgagcgggacguggaggucgagcgcuggcgggagcgcguggcccagcugcuggagcgguggcaggccgugcucgcccagaccgacguccgccagcgggagcuggagcagcuggggcgccagcuccgguacuaccgcgaguccgcggacccccugggcgccuggcugcaggacgcccgccggcgccaggagcagauccaggccaugccccucgccgacagccaggcggugcgggagcagcugcgccaggagcaggcccugcucgaggagaucgagcggcacggggagaagguggaggagugccagcgcuucgccaagcaguacaucaacgccaucaaggacuacgagcugcagcuggucaccuacaaggcgcagcucgagccgguggccucccccgccaagaagcccaagguccagagcggcagcgaguccgugauccaggaguacguggaccugcggacccacuacagcgagcugacgacccucaccucccaguacaucaaguucaucagcgagacccugcgccggauggaggaggaggagcgccuggccgagcagcagcgggccgaggagcgcgagcggcucgcggaggucgaggccgcccuggagaagcagcgccagcuggccgaggcccacgcgcaggccaaggcccaggccgagcgggaggccaaggagcuccagcagcgcaugcaggaggagguggugcggcgcgaggaggcggccgucgacgcccagcagcagaagcgguccauccaggaggagcugcagcagcugcgccagagcuccgaggccgagauccaggcgaaggcccgccaggccgaggccgccgagcggagccgccuccggaucgaggaggagauccgcguggugcggcugcagcuggaggcgacggagcgccagcggggcggggccgagggcgagcuccaggcccugcgcgcccgggccgaggaggcggaggcccagaagcgccaggcccaggaggaggccgagcggcugcgccggcagguccaggacgagucccagcgcaagcggcaggccgagguggagcucgcgagccgcgugaaggccgaggccgaggccgcccgggagaagcagcgcgcgcugcaggcccuggaggagcuccggcugcaggccgaggaggccgagcgccggcugcgccaggcggaggucgagcgcgcccggcaggugcagguggcccucgagaccgcccagcgcuccgccgaggcggagcugcagagcaagcgggccuccuucgccgagaagaccgcccagcuggagcgcagccuccaggaggagcacgucgccguggcgcagcugcgggaggaggccgagcgccgggcccagcagcaggccgaggccgagcgcgcgcgggaggaggccgagcgcgagcuggagcgguggcagcucaaggccaacgaggcccugcgccugcggcuccaggcggaggagguggcccagcagaagucccuggcccaggccgaggccgagaagcagaaggaggaggcggagcgcgaggcccggcgccgggggaaggccgaggagcaggccguccgccagcgggagcuggccgagcaggagcucgagaagcagcgccagcuggcggagggcaccgcccagcagcgccuggccgccgagcaggagcucauccggcugcgcgccgagacggagcagggggagcagcagcggcagcugcucgaggaggagcuggcgcgccugcagcgggaggccgccgccgcgacccagaagcgccaggagcucgaggccgagcuggccaaggugcgggccgagauggaggugcugcucgccagcaaggcgcgcgccgaggaggagucccggagcaccuccgagaagagcaagcagcgccuggaggccgaggccggccgguuccgcgagcuggccgaggaggcggcccggcuccgcgcccuggccgaggaggccaagcggcagcgccagcuggcggaggaggacgccgcccggcagcgcgccgaggccgagcggguccucgcggagaagcuggccgccaucggcgaggccacccgccugaagacggaggcggagaucgcccucaaggagaaggaggccgagaacgagcggcugcgccgccuggccgaggacgaggccuuccagcggcgccggcucgaggagcaggcggcccagcacaaggccgacaucgaggagcgccuggcccagcugcggaaggccagcgacuccgagcucgagcgccagaaggggcugguggaggacacccugcggcagcgccggcagguggaggaggagauccucgcgcugaaggccagcuucgagaaggccgccgccggcaaggcggagcuggagcucgagcuggggcgcauccgguccaacgccgaggacacccugcgcagcaaggagcaggccgagcucgaggccgcgcggcagcgccagcuggccgccgaggaggagcggcgccggcgcgaggccgaggagcggguccagaagucccuggccgcggaggaggaggccgcccgccagcgcaaggccgcccucgaggagguggagcggcugaaggcgaagguggaggaggcccgccggcugcgcgagcgggccgagcaggagagcgcccgccagcuccagcuggcccaggaggcggcccagaagcggcugcaggccgaggagaaggcccacgccuucgcgguccagcagaaggagcaggagcugcagcagacccuccagcaggagcaguccgugcuggaccagcugcgcggcgaggccgaggccgcccggcgcgcggccgaggaggccgaggaggcccgggugcaggccgagcgcgaggcggcccagagccggcgccaggucgaggaggccgagcggcucaagcaguccgccgaggagcaggcccaggcgcgcgcccaggcccaggccgccgcggagaagcugcggaaggaggccgagcaggaggccgcccgccgggcgcaggccgagcaggccgcccugcgccagaagcaggccgcggacgccgagauggagaagcacaagaaguucgccgagcagacgcuccggcagaaggcccagguggagcaggagcugaccacccugcgccuccagcuggaggagaccgaccaccagaagaaccugcucgacgaggagcugcagcgccugaaggccgaggcgacggaggccgcccggcagcgcagccagguggaggaggagcucuucuccguccgggugcagauggaggagcugagcaagcugaaggcccgcaucgaggccgagaaccgggcgcucauccugcgcgacaaggacaacacccagcgguuccugcaggaggaggccgagaagaugaagcagguggccgaggaggccgcgcgccucuccgucgccgcccaggaggccgcccggcugcgccagcuggcggaggaggaccucgcccagcagcgggcccuggccgagaagaugcugaaggagaagaugcaggccgugcaggaggcgacccgccucaaggccgaggccgagcugcugcagcagcagaaggagcucgcccaggagcaggcccggcgccugcaggaggacaaggagcagauggcgcagcagcuggccgaggagacccagggcuuccagcggacgcucgaggccgagcgccagcggcagcuggagaugagcgccgaggccgagcgccugaagcuccggguggcggagaugucccgcgcccaggcccgcgccgaggaggacgcgcagcgguuccgcaagcaggccgaggagaucggggagaagcugcaccggaccgagcuggccacccaggagaaggucacccucgugcagacgcuggagauccagcgccagcagagcgaccacgacgccgagcggcugcgcgaggccaucgcggagcucgagcgggagaaggagaagcugcagcaggaggccaagcugcuccagcugaaguccgaggagaugcagaccgugcagcaggagcagcugcuccaggagacccaggcccugcagcagagcuuccuguccgagaaggacagccuccugcagcgcgagcgguucaucgagcaggagaaggccaagcuggagcagcucuuccaggacgaggucgccaaggcgcagcagcugcgcgaggagcagcagcggcagcagcagcagauggagcaggagcgccagcggcugguggccagcauggaggaggcccgccggcgccagcacgaggccgaggagggcgugcggcgcaagcaggaggagcuccagcagcuggagcagcagcggcgccagcaggaggagcugcucgccgaggagaaccagcggcugcgcgagcagcugcagcuccuggaggagcagcaccgcgcggcccuggcccacuccgaggaggucaccgccagccagguggcggccacgaagacccuccccaacgggcgggacgcccuggacggcccggccgccgaggcggagcccgagcacuccuucgacgggcugcgccggaaggugagcgcccagcgccuccaggaggccggcauccuguccgccgaggagcugcagcggcucgcccagggccacaccaccgucgacgagcuggcgcgccgggaggacgugcgccacuaccugcaggggcggagcuccaucgccggccuccugcugaaggccacgaacgagaagcucagcguguacgccgcccugcagcgccagcugcucucccccgggaccgcgcugauccugcucgaggcccaggccgccagcggcuuccugcuggaccccguccggaaccgccggcucaccgugaacgaggcggucaaggaggggguggugggcccggagcugcaccacaagcugcucuccgccgagcgcgccgucaccggcuacaaggaccccuacaccgggcagcagaucagccuguuccaggccaugcagaagggccugaucgugcgggagcacgggauccgccuccuggaggcccagaucgcgacgggcggggugaucgaccccguccacucccaccgggugccgguggacgucgccuaccgccggggcuacuucgacgaggagaugaaccgcgugcuggccgaccccagcgacgacaccaagggcuucuucgaccccaacacccacgagaaccucaccuaccugcagcugcuggagcgcugcguggaggaccccgagacggggcucugccugcugccgcucaccgacaaggccgccaagggcggggagcuggucuacaccgacuccgaggcgcgggacguguucgagaaggccaccgugagcgcccccuucggcaaguuccagggcaagacggucaccaucugggagaucaucaacuccgaguacuucaccgccgagcagcgccgggaccugcuccgccaguuccggaccgggcgcaucacgguggagaagaucaucaagaucaucaucaccguggucgaggagcaggagcagaagggccggcugugcuucgaggggcugcgcagccucgugcccgccgcggagcugcuggagucccgggugaucgaccgcgagcucuaccagcagcugcagcggggcgagcgcagcguccgggacguggccgagguggacaccguccgccgggcccugcgcggggccaacgugaucgccggcguguggcucgaggaggcgggccagaagcugagcaucuacaacgcccugaagaaggaccuccugcccuccgacauggccgucgcccugcucgaggcgcaggccgggaccggccacaucaucgacccggccacgagcgcccggcugaccguggacgaggccgugcgcgcggggcuggucggccccgaguuccacgagaagcuccuguccgccgagaaggccgugaccggguaccgggaccccuacaccggccagagcgugucccuguuccaggcccucaagaagggccugaucccccgcgagcaggggcugcggcuccuggacgcccagcugagcacgggcgggaucgucgacccguccaagagccaccgcgugccccucgacguggcgugcgcccgcggcugccuggacgaggagaccucccgggcccugagcgccccccgcgccgacgcgaaggccuacuccgaccccagcaccggggagccggccaccuacggcgagcuccagcagcggugccgccccgaccagcugacgggccugucccuccugccccugagcgagaaggccgcgcgggcccgccaggaggagcucuacuccgagcugcaggcccgggagaccuucgagaagacccccgucgaggugccgguggggggcuucaaggggcgcaccgucacggugugggagcugaucagcuccgaguacuucaccgccgagcagcggcaggagcuccugcgccaguuccggaccggcaaggugaccgucgagaaggugaucaagauccugaucacgaucguggaggaggucgagacccuccgccaggagcggcugagcuucuccgggcugcgcgcccccgugcccgcgagcgagcuccuggccagcggcgugcugucccgggcccaguucgagcagcucaaggacggcaagaccaccgucaaggaccugagcgagcugggguccgugcgcacgcuccugcagggcagcgggugccuggccggcaucuaccucgaggacaccaaggagaagguguccaucuacgaggccaugcggcgcggccugcugcgggcgaccaccgccgcccuccugcuggaggcccaggccgcgaccggguuccucgucgaccccgugcgcaaccagcgccuguacguccacgaggccgugaaggccggcguggucgggccggagcugcacgagcagcuccugagcgccgagaaggccgugacgggcuaccgggaccccuacuccgggagcaccaucucccuguuccaggcgaugcagaagggccucgugcugcgccagcacggcauccggcugcucgaggcccagaucgccaccgggggcaucaucgaccccguccacagccaccgcgugcccguggacgucgccuaccagcggggguacuucuccgaggagaugaaccgcgugcuggcggacccgagcgacgacaccaagggcuucuucgaccccaacacgcacgagaaccugaccuaccggcagcuccuggagcgcugcguggaggaccccgagaccgggcugcggcuccugccgcugaagggcgccgagaaggccgaggucguggagaccacgcagguguacaccgaggaggagacccgccgggccuucgaggagacccagaucgacauccccggcgggggcucccacgggggcagcacgaugucccucugggaggucaugcagagcgaccugauccccgaggagcagcgcgcccagcugauggcggacuuccaggccgggcgggugaccaaggagcgcaugaucaucaucaucaucgagaucaucgagaagaccgagaucauccggcagcagggccucgccuccuacgacuacgugcgccggcgccugaccgccgaggaccuguucgaggcccggaucaucagccucgagacguacaaccugcugcgcgagggcacccggagccuccgcgaggcgcuggaggccgaguccgccuggugcuaccuguacgggaccggcagcgucgccgggguguaccugcccggcucccgccagacccucagcaucuaccaggcccugaagaaggggcugcucuccgcggagguggcccggcugcugcucgaggcccaggccgcgacgggcuuccugcuggacccggucaagggcgagcgccucaccguggacgaggccgugcggaaggggcuggucggccccgagcugcacgaccgccuccugagcgccgagcgggccgugaccggguaccgcgaccccuacaccgagcagacgaucucccuguuccaggccaugaagaaggagcucauccccaccgaggaggcgcugcggcugcucgacgcccagcuggccaccggcggcaucguggacccgcgccugggguuccaccucccccuggaggucgccuaccagcggggcuaccugaacaaggacacccacgaccagcucagcgagcccuccgaggugcgcagcuacguggaccccuccacggacgagcggcugagcuacacccagcugcuccgccggugccgccgggacgacgggaccggccagcugcugcucccgcuguccgacgcccgcaagcugaccuuccgggggcuccgcaagcagaucacgauggaggagcugguccggagccaggugauggacgaggcgaccgcccugcagcuccgcgagggccugaccuccaucgaggaggugaccaagaaccugcagaaguuccucgagggcacgagcugcaucgccggggucuucguggacgccaccaaggagcgccuguccguguaccaggccaugaagaagggcaucauccggcccgggaccgcguucgagcugcucgaggcccaggccgccaccggcuacgucaucgaccccaucaaggggcugaagcugacgguggaggaggcggugcgcaugggcaucgucggccccgaguucaaggacaagcuccugagcgccgagcgggccgugaccggguacaaggacccguacuccggcaagcugaucagccucuuccaggccaugaagaaggggcugauccugaaggaccacggcauccgccuccuggaggcccagaucgcgaccgggggcaucaucgaccccgaggagagccaccggcugcccguggaggucgccuacaagcgcggccucuucgacgaggagaugaacgagauccugaccgaccccuccgacgacaccaagggguucuucgacccgaacacggaggagaaccugaccuaccuccagcugauggagcggugcaucaccgacccccagaccggccugugccuccugccccugaaggagaagaagcgcgagcggaagacgagcuccaagagcuccgugcgcaagcggcgcguggucaucguggaccccgagaccgggaaggagaugagcguguacgaggccuaccggaagggccucaucgaccaccagaccuaccuggagcuguccgagcaggagugcgagugggaggagaucaccaucagcuccagcgacggcgucgugaaguccaugaucaucgaccgccggagcgggcgccaguacgacaucgacgacgccaucgccaagaaccucaucgaccgguccgcgcuggaccaguaccgcgccggcacgcugagcaucaccgaguucgccgacaugcucuccgggaacgccggcggguuccggagccgcuccagcuccgugggcagcagcuccagcuacccgaucucccccgccgucagccggacccagcuggcguccuggagcgaccccaccgaggagacgggccccguggccgggauccuggacaccgagacccucgagaaggucuccaucaccgaggccaugcaccgcaaccugguggacaacaucacgggccagcgccugcucgaggcccaggccugcaccgggggcaucaucgacccgagcaccggggagcgguuccccgugaccgacgcggucaacaagggccugguggacaagaucaugguggaccgcaucaaccuggcccagaaggccuucugcggcuucgaggacccccggacgaagaccaagauguccgccgcgcaggcccucaagaagggguggcuguacuacgaggccggccagcgcuuccuggagguccaguaccucaccgggggccugaucgagccggacacccccgggcgggugccccuggacgaggcccuccagcgcggcacgguggacgcccggaccgcgcagaagcugcgcgacgucggcgccuacagcaaguaccugaccugccccaagaccaagcucaagaucuccuacaaggacgcccuggaccggagcaugguggaggaggggacgggccugcgccuccuggaggccgccgcgcaguccaccaagggguacuacagcccguacuccgugagcggcuccgggagcaccgccggcucccggaccggcagccgcacggggagccgggccggcucccgccgggggagcuucgacgccaccggcuccggcuucagcaugaccuucuccagcuccagcuacuccagcuccggguacggccgccgguacgccagcggguccagcgcgucccugggcgggcccgagagcgccgucgccuga

SEQ ID NO: 34706 - RNA, 1062 nt, Artificial Sequence
  derived and/or modified sequence opt1 from PLEK2__Homo_sapiens__NP_057529
auggaggacggcgugcugaaggagggguuccucgucaagcgcggccacaucgugcacaacuggaaggcccggugguucauccugcgccagaacacccugguguacuacaagcucgagggcgggcggcgcgucacgcccccgaaggggcggauccugcuggacggcugcaccaucacgugccccugccucgaguacgagaaccgcccccugcugaucaagcucaagacccagaccagcaccgaguacuuccuggaggccugcucccgggaggagcgcgacgcgugggccuucgagaucaccggcgccauccacgccgggcagcccggcaaggugcagcagcugcacagccuccggaacuccuucaagcugccgccccacaucagccugcaccgcaucguggacaagaugcacgacuccaacaccgggauccggagcucccccaacauggagcagggcagcaccuacaagaagacguuccucggguccagccuggucgacuggcugaucuccaacagcuucaccgccucccgccucgaggcggugacccuggccagcaugcugauggaggagaacuuccuccggcccgugggcguccgcuccaugggcgccauccggagcggggaccuggccgagcaguuccuggacgacuccaccgcgcucuacacguucgccgagagcuacaagaagaagaucuccccgaaggaggagaucagccugagcaccguggagcuguccggcaccguggucaagcagggguaccucgccaagcagggccacaagcgcaagaacuggaaggugcggcgcuucgugcugcggaaggaccccgccuuccugcacuacuacgaccccagcaaggaggagaaccgccccgucggcggguucucccuccggggcagccugguguccgcccuggaggacaacggggugccgaccggcgucaaggggaacgugcagggcaaccucuucaaggugaucacgaaggacgacacccacuacuacauccaggcgagcuccaaggccgagcgcgccgaguggaucgaggccaucaagaagcugaccuga

SEQ ID NO: 34707 - RNA, 1215 nt, Artificial Sequence
  derived and/or modified sequence opt1 from PLEKHA1__Homo_sapiens__NP_001001974
augcccuacguggaccgccagaaccggaucugcggcuuccuggacaucgaggagaacgagaacagcgggaaguuccuccgccgguacuucauccuggacacccgcgaggacuccuucgucugguacauggacaacccgcagaaccugcccagcggcuccagccgggugggggccaucaagcucaccuacaucuccaaggugagcgacgccacgaagcugcgccccaaggcggaguucugcuucgucaugaacgccggcaugcggaaguacuuccugcaggccaacgaccagcaggaccucguggagugggugaacguccugaacaaggccaucaagaucaccgugcccaagcaguccgacagccagccgaacuccgacaaccugagccgccacggggagugcggcaagaagcaggucuccuaccggaccgacaucgugggcggggugcccaucaucacccccacgcagaaggaggaggugaacgagugcggcgagagcaucgaccgcaacaaccucaagcggucccagagccaccuccccuacuucaccccgaagccgccccaggacuccgccgucaucaaggcgggguacugcgugaagcagggcgccgugaugaagaacuggaagcgccgguacuuccagcuggacgagaacaccaucggguacuucaagagcgagcuggagaaggagccccugcgcgucaucccccugaaggaggugcacaaggugcaggagugcaagcaguccgacaucaugaugcgggacaaccucuucgagaucgucaccacgagccgcaccuucuacgugcaggccgacucccccgaggagaugcacagcuggaucaaggccgugagcggcgcgaucgucgcccagcggggccccgggcgcuccgccagcuccgagcacccgcccggccccagcgaguccaagcacgccuuccggcccaccaacgccgcgaccgccacgagccacuccaccgccagccgcuccaacagccugguguccaccuucaccauggagaagcggggguucuacgagagccuggccaaggugaagcccggcaacuucaagguccagacgguguccccgcgcgagcccgccagcaaggucaccgagcaggcgcuccugcgcccccaguccaagaacggcccccaggagaaggacugcgaccugguggaccucgacgacgccagccugccgguguccgacgucuga

SEQ ID NO: 34708 - RNA, 1278 nt, Artificial Sequence
  derived and/or modified sequence opt1 from PLEKHA2__Homo_sapiens__NP_067636
augcccuacguggaccgccagaaccggaucugcggcuuccuggacaucgaggagcacgagaacagcgggaaguuccuccgccgguacuucauccuggacacccaggccaacugccugcucugguacauggacaacccgcagaaccuggccaugggcgcgggggccgucggcgcccugcagcucaccuacaucuccaaggugagcaucgccacgcccaagcagaagcccaagacccccuucugcuucgugaucaacgcccugucccagcgcuacuuccugcaggcgaacgaccagaaggacaugaaggacugggucgaggcccucaaccaggccagcaagaucaccgugccgaagggcgggggccugcccaugaccacggaggugcugaagucccucgccgcgccgcccgcccuggagaagaagccccaggucgccuacaagaccgagaucaucgggggcguggugguccacacccccaucagccagaacgggggcgacgggcaggagggcuccgagcccggcagccacaccauccugcggcgcucccagagcuacauccccacguccgggugccgggccagcaccggcccgccccucaucaaguccggguacugcgugaagcagggcaacgugcgcaagagcuggaagcggcgcuucuucgcccuggacgacuucaccaucugcuacuucaagugcgagcaggaccgggagccccugcgcaccaucuuccucaaggacguccugaagacgcacgagugccuggugaaguccggcgaccuccugaugcgggacaaccuguucgagaucaucaccagcucccgcaccuucuacgugcaggcggacagccccgaggacaugcacuccuggaucaaggagaucggggccgccguccaggcccucaagugccacccgcgggagaccagcuucagccgcuccaucagccugacgcggcccggcuccagcucccugagcuccgggcccaacagcauccucugccgcggccggcccccgcuggaggagaagaaggcccugugcaaggcgcccuccguggccagcuccuggcagcccuggacccccgugccgcaggccggggagaagcuccugccgcccggcgacaccagcgaggacucccuguucacgccccgccccggcgaggggagcgcccccggcguccuccccuccagccggauccgccaccgcuccgagccgcagcaccccaaggagaagcccuucauguucaaccuggacgacgagaacauccggaccagcgacguguga

SEQ ID NO: 34709 - RNA, 3525 nt, Artificial Sequence
  derived and/or modified sequence opt1 from PLEKHA5__Homo_sapiens__NP_001137293
auggccgccgaccugaaccucgaguggaucagccugccccgcuccuggaccuacggcaucacccgcgggggccggguguucuucaucaacgaggaggcgaaguccacgaccuggcugcacccggucaccggggaggccguggugaccggccaccggcgccaguccacggaccuccccaccgggugggaggaggccuacaccuucgagggcgcccgguacuacaucaaccacaacgagcgcaaggugaccugcaagcaccccgucacgggccagcccagccaggacaacugcaucuucguggucaacgagcagaccguggccaccaugaccuccgaggagaagaaggagcggccgaucagcaugaucaacgaggcguccaacuacaacgugacgagcgacuacgccguccaccccaugucccccguggggcgcaccagccgggccuccaagaaggugcacaacuucggcaagcgcagcaacuccaucaagcggaaccccaacgccccggucgugcgccggggguggcuguacaagcaggacagcaccggcaugaagcuguggaagaagcgcugguucgugcucuccgaccugugccuguucuacuaccgggacgagaaggaggaggggauccucggcagcauccugcugcccuccuuccagaucgcgcuccugaccagcgaggaccacaucaaccgcaaguacgccuucaaggccgcccaccccaacaugcggacguacuacuucugcaccgacaccggcaaggagauggagcuguggaugaaggccaugcucgacgcggcccugguccagaccgagcccgugaagcgcguggacaagaucacguccgagaacgccccgaccaaggagaccaacaacauccccaaccaccggguccugaucaagcccgagauccagaacaaccagaagaacaaggagaugagcaagaucgaggagaagaaggcccucgaggccgagaaguacggguuccagaaggacggccaggaccgcccccugaccaagaucaacagcgugaagcugaacucccucccgagcgaguacgaguccgggagcgcgugccccgcccagacggugcacuaccggcccaucaaccuguccagcuccgagaacaagaucgucaacgugagccuggccgaccuccgcggcggcaaccgccccaacaccgggccgcuguacaccgaggccgaccgggugauccagcgcaccaacuccaugcagcagcuggagcaguggaucaagauccagaagggccgggggcacgaggaggagacgcgcggcgucaucagcuaccagacccucccccggaacaugcccucccaccgcgcccagaucauggcgcgguaccccgagggguaccgcacccugccgcggaacagcaagacccgccccgaguccaucugcagcgugacgcccuccacccacgacaagacccugggccccggcgccgaggagaagcggcgcagcaugcgggacgacaccauguggcagcucuacgaguggcagcagcgccaguucuacaacaagcaguccacgcugccgcggcacagcacccuguccagccccaagaccauggucaacaucagcgaccagaccaugcacuccauccccaccagcccgucccacgggagcaucgccgccuaccagggcuacagcccccagcgcacguaccggagcgagguguccagccccauccagcgcggggacgugaccaucgaccggcgccaccgcgcccaccaccccaagcacgucuacgugccggaccggcgcuccgugcccgcgggccucacccugcagagcgucagcccccagagccugcaggggaagacccccgaggagcucacgcugcugcucaucaagcugcggcgccagcaggccgagcuguccagcauccgggagcacacccucgcccagcugaugcagcugaagcucgaggcccacuccccgaagaacgagauccugagccaccaccuccagcgcaacaccaucuaccuggaccaccagcugucccaggacgagggccggggcacccuguacaaguaccgccccgaggagguggacaucgacgcgaagcugagccggcucugcgagcaggacaaggugguccacgcccuggaggagaagcugcagcagcuccacaaggagaaguacacgcuggagcaggcccugcucagcgccucccaggagaucgagaugcacgccgacaaccccgcggccauccagaccguggugcugcagcgcgacgaccugcagaacgggcuccugagcacgugccgggagcugucccgcgccaccgccgagcucgagcgggccuggcgcgaguacgacaagcuggaguacgacgucaccgugacccggaaccagaugcaggagcagcuggaccaccucggcgaggugcagaccgagagcgcggggauccagcgcgcccagauccagaaggagcuguggcggauccaggacgucauggagggccuguccaagcacaagcagcagcgcgggaccacggagaucggcaugaucggcagcaagcccuucuccaccgugaaguacaagaacgaggggccggacuaccggcucuacaagagcgagcccgagcugaccaccguggccgaggucgacgaguccaacggcgaggagaaguccgagcccguguccgagaucgagacgagcguggucaaggggucccacuuccccgugggcguggucccgccccgcgccaagagccccacccccgaguccagcaccaucgccuccuacgugacccugcggaagacgaagaagaugauggaccuccgcaccgagcgcccgcggagcgcgguggagcagcugugccuggccgaguccacccgcccccggaugaccgucgaggagcagauggagcgcauccggcgccaccagcaggccugccuccgggagaagaagaagggccugaacgugaucggggccagcgaccagagcccccugcagucccccagcaaccuccgcgacaacccguuccggacgacccagacccgccggcgcgacgacaaggagcuggacaccgcgauccgggagaacgacgugaagcccgaccacgagacgcccgccaccgagaucguccagcugaaggagaccgagccgcagaacguggacuucuccaaggagcucaagaagaccgagaacaucagcuacgagaugcuguucgagcccgagcccaacggcgugaacuccgucgagaugauggacaaggagcgcaacaaggacaagaugcccgaggacgugacguucagcccgcaggacgagacccagaccgccaaccacaagcccgaggagcaccccgaggagaacaccaagaacuccguggacgagcaggaggagaccgucaucagcuacgaguccacgcccgaggugagccgggggaaccagaccauggccgugaagucccugagcccgucccccgagagcuccgccagccccguccccuccacccagccgcagcucaccgagggcagccacuucaugugcguguga

SEQ ID NO: 34710 - RNA, 3147 nt, Artificial Sequence
  derived and/or modified sequence opt1 from PLEKHA6__Homo_sapiens__NP_055750
augagcaacaagaccggcgggaagcgccccgccaccacgaacuccgacaucccgaaccacaacauggugagcgaggucccgcccgagcggcccuccgugcgcgccacccggaccgcgcgcaaggccguggccuucggcaagcggagccacuccaugaagcgcaaccccaacgcccccgucaccaaggccggguggcuguucaagcaggcgagcuccggcgugaagcaguggaacaagcggugguucgugcucgucgaccgcugccuguucuacuacaaggacgagaaggaggagagcauccugggguccaucccccuccugagcuuccggguggccgccgugcagcccuccgacaacaucagccgcaagcacacguucaaggccgagcacgcgggcguccggaccuacuucuucuccgccgagagcccggaggagcaggaggccuggauccaggccaugggcgaggccgcgcgcgugcagaucccgcccgcccagaaguccgugccccaggccguccggcacagccacgagaagcccgacuccgagaacgugccgcccagcaagcaccaccagcagccgccccacaacucccugcccaagcccgagcccgaggccaagacccgcggggagggcgacgggcggggcugcgagaaggccgagcgccggcccgagcgccccgaggugaagaaggagccgcccgucaaggcgaacgggcuccccgccggccccgagcccgccagcgagcccggcagcccguaccccgaggggccccgggugccgggcgggggcgagcagcccgcccagcccaacggcuggcaguaccacucccccagccgcccgggguccaccgccuuccccagccaggacggcgagaccgggggccaccggcgcuccuucccgccccgcaccaaccccgacaagaucgcgcagcgcaagagcuccaugaaccagcugcagcagugggugaaccugcggcgcggggugcccccgcccgaggaccuccggagccccucccgguucuaccccgucagccgccgggugcccgaguacuacggccccuacuccagccaguacccggacgacuaccaguacuacccgcccggcguccgccccgaguccaucugcagcaugcccgccuacgaccggaucuccccgcccugggcccuggaggacaagcgccacgccuuccggaacgggggcgggcccgccuaccagcugcgcgaguggaaggagcccgcgagcuacggccggcaggacgccaccguguggauccccucccccagccgccagccgguguacuacgacgagcucgacgccgccuccagcagccugcggcgccugucccuccagccccggagccacuccgucccccgcagccccucccaggggagcuacucccgggcgcgcaucuacagcccggugcgcucccccagcgcccgguucgagcgccugccgccccgguccgaggacaucuacgccgaccccgccgccuacgucaugcgccggagcaucuccagccccaaggugccgcccuaccccgagguguuccgcgacucccugcacaccuacaagcucaacgagcaggacacggacaagcugcugggcaagcucugcgagcagaacaaggucgugcgggagcaggaccgccuggugcagcagcugcgggcggagaaggagagccucgaguccgcccugaugggcacccaccaggagcuggagauguucgggagccagcccgccuaccccgagaagcuccgccacaagaaggacagccugcagaaccagcugaucaacauccgggucgagcucucccaggccaccaccgcccugacgaacagcaccaucgaguacgagcaccuggaguccgaggugagcgcgcuccacgacgaccugugggagcagcugaaccucgacacccagaacgaggugcugaaccgccagauccagaaggagaucuggcggauccaggacgucauggagggccugcgcaagaacaaccccucccgggggaccgacacggccaagcaccgcggcgggcucggcccgagcgccaccuacuccagcaacucccccgccagcccccuguccagcgccucccugaccagcccccucuccccguucagccugguguccggcagccaggggucccccaccaagcccggcagcaacgagcccaaggcgaacuacgagcagagcaagaaggacccgcaccagacgcugccccucgacacgccccgggacaucucccuggugcccacccgccaggaggucgaggccgagaagcaggccgcccugaacaagguggggguggucccgccccggaccaagagccccacggacgacgaggugaccccguccgcggugguccgccggaacgccagcggccucaccaacggccuguccagccaggagcgccccaaguccgccguguuccccggggagggcaaggugaagaugagcgucgaggagcagaucgaccgcaugcggcgccaccaguccgggagcaugcgggagaagcgccggucccugcagcugcccgccagcccggcccccgaccccagcccccgcccggcguacaagguggugcggcgccaccgguccauccacgaggucgacaucuccaaccucgaggccgcccugcgcgccgaggagcccggcgggcacgccuacgagacgccccgggaggagaucgcgcgccugcggaagauggagcucgagccccagcacuacgacguggacaucaacaaggagcugagcaccccggacaaggugcugauccccgagcgcuacaucgaccucgagcccgacacgccccuguccccggaggagcugaaggagaagcagaagaaggucgagcggaucaagacccucaucgccaagagcuccaugcagaacguggugcccaucggcgagggcgacagcgucgacgugccccaggacagcgagucccagcugcaggagcaggagaagcgcaucgagaucagcugcgcccuggccaccgaggccucccggcgcgggcggaugcucagcgugcagugcgcgacccccuccccgcccaccagccccgccucccccgccccgcccgccaacccccugagcuccgagagcccccgcggcgcggacuccagcuacaccaugcgcgucuga

SEQ ID NO: 34711 - RNA, 3366 nt, Artificial Sequence
  derived and/or modified sequence opt1 from PLEKHA7__Homo_sapiens__NP_778228
auggccgccgcgaccgugggccgcgacacccugcccgagcacuggagcuacggggucugccgggacggccgcguguucuucaucaacgaccagcuccggugcacgaccuggcugcacccgcgcaccggggagcccgugaacuccggccacaugauccggagcgaccugccccgcgggugggaggagggcuucaccgaggagggcgccuccuacuucaucgaccacaaccagcagacgaccgccuuccggcaccccgucaccgggcaguucagcccggagaacuccgaguucauccuccaggaggagcccaacccccacaugagcaagcaggaccgcaaccagcggcccuccagcaugguguccgagaccagcacggccggcaccgccuccacccuggaggcgaagccggggcccaagaucaucaagagcuccagcaaggugcacuccuucggcaagcgcgaccaggccauccggcgcaaccccaacguccccguggugguccggggguggcugcacaagcaggacagcuccggcaugcgccucuggaagcggcgcugguucgugcuggccgacuacugccuguucuacuacaaggacagccgggaggaggccgugcucggcuccaucccgcugcccagcuacgucaucagccccguggcgcccgaggaccgcaucucccggaaguacagcuucaaggccgugcacaccgggaugcgcgcccugaucuacaacuccagcacggccggcucccaggccgagcagagcgggaugcggaccuacuacuucuccgcggacacccaggaggacaugaacgccuggguccgcgccaugaaccaggccgcccaggugcucagccgcuccagccugaagcgggacauggagaagguggagcgccaggcggucccgcaggccaaccacaccgaguccugccacgagugcggccgggugggccccgggcacacgcgcgacugcccccaccggggccacgacgacaucgugaacuucgagcgccaggagcaggagggggagcaguaccggagccagcgcgacccccuggagggcaagcgggaccgcuccaaggcccggagcccguacucccccgccgaggaggacgcccucuucauggaccugcccaccgggccccgcggccagcaggcgcagccgcagcgggccgagaagaacggcaugcugcccgccagcuacgggcccggcgagcagaacgggaccggcggguaccagcgcgccuucccgccccggaccaaccccgagaagcacucccagcgcaagagcaaccucgcccaggucgagcacugggcgcgggcccagaagggcgacucccgcagccugccccuggaccagacgcucccgcggcagggccccgggcagagccuguccuuccccgagaacuaccagacccugcccaagagcacccgccacccguccggcgggagcuccccgccgccccgcaaccuccccagcgacuacaaguacgcccaggaccgggccucccaccugaagaugagcuccgaggagcgccgggcgcaccgcgacggcaccguguggcagcuguacgaguggcagcagcggcagcaguuccgccacgggagccccacggcccccaucugccucggcucccccgaguucaccgaccagggccggagccgcuccaugcuggaggugccccggagcaucuccgucccgcccagccccuccgacaucccgccgcccgggccgccccgcguguucccgccccggcgcccccacacccccgccgagcgggucaccgugaagccgcccgaccagcgccggagcguggacaucagccugggcgacagcccccgccgggcccgcgggcacgccgucaagaacuccucccacguggaccggcgcagcaugcccuccaugggcuacaugacgcacaccgugagcgcgcccucccuccacggcaagagcgccgacgacaccuaccugcagcugaagaaggaccucgaguaccuggaccugaagaugaccgggcgggaccuccugaaggaccgcucccugaagcccgucaagaucgccgagagcgacacggacgugaagcucuccaucuucugcgagcaggaccgcgugcugcaggaccuggaggacaagauccgggcccucaaggagaacaaggaccagcuggagagcguccuggaggugcuccaccgccagauggagcaguaccgggaccagccccagcaccuggagaagaucgccuaccagcagaagcugcuccaggaggaccuggugcacauccgcgcggagcugucccgggagagcaccgagauggagaacgccuggaacgaguaccugaagcucgagaacgacgucgagcagcugaagcagacccugcaggagcagcaccgccgggccuucuucuuccaggagaagucccagauccagaaggaccucuggcgcaucgaggacgugaccgccggccugagcgccaacaaggagaacuuccggauccugguggaguccgucaagaaccccgagcgcaagacggugccccucuucccccacccgcccgugcccagccuguccaccagcgagagcaagcccccgccccagcccagcccgcccaccucccccguccggacgccccuggaggugcgccucuucccccagcugcagaccuacgugcccuaccggccccacccgccccagcugcgcaaggucaccagcccccuccagucccccaccaaggcgaagcccaagguggaggacgaggcgcccccgcggccgccccugcccgagcuguacucccccgaggaccagccgcccgccgugccgccccucccccgcgaggccaccaucauccggcacaccagcguccgcgggcugaagcggcaguccgacgagcgcaagcgcgaccgggagcugggccagugcgugaacggggacagccgcguggagcuccgguccuacgucagcgagcccgagcuggccacgcuguccggcgacauggcccagcccagccucggccugguggggcccgagucccgcuaccagacccugcccggccgggggcucagcggcuccaccagccgccugcagcaguccagcaccaucgcccccuacgugacgcugcggcgcgggcucaacgccgaguccagcaaggccaccuucccgcggcccaagagcgcgcuggagcgccuguacuccggcgaccaccagcggggcaagaugagcgccgaggagcagcucgagcgcaugaagcggcaccagaaggcccugguccgcgagcggaagcgcacccuggggcagggcgagcggaccgggcuccccuccagccgcuaccugucccggccccugccgggcgaccucgggagcgugugcuga

SEQ ID NO: 34712 - RNA, 627 nt, Artificial Sequence
  derived and/or modified sequence opt1 from PLEKHB1__Homo_sapiens__NP_001123505
augagccccgccgccccggugccgcccgacuccgcgcuggagagccccuucgaggagauggcccucguccgcggcggguggcuguggcggcaguccagcauccugcgccgguggaagcgcaacugguucgcccucuggcuggacggcacccugggguacuaccacgacgagaccgcccaggacgaggaggaccgggugcucauccacuucaacgugcgcgacaucaagaucggccccgagugccacgacguccagccgcccgaggggcggucccgcgacggccugcugacggugaaccuccgggagggcgggcgccugcaccugugcgccgagaccaaggacgacgcgcucgccuggaagaccgcccugcuggaggccaacagcacccccgugcgggucuacucccccuaccaggacuacuacgagguggugccgcccaacgcgcacgaggccacguacguccgcagcuacuacggcccgcccuacgccgggcccggcgugacccacgugaucguccgggaggaccccugcuacuccgccggggcgccccucgccaugggcaugcuggccggcgccgccaccggggccgcgcugggcagccucauguggucccccugcugguucuga

SEQ ID NO: 34713 - RNA, 1521 nt, Artificial Sequence
  derived and/or modified sequence opt1 from PLEKHD1__Homo_sapiens__NP_001154970
auguucaccagcaaguccaacagcgugucccccagcccgucccuggagcaggccgacagcgacgcccucgacaucuccaccaagguccagcuguacggcgugcuguggaagcgccccuucgggcggcccagcgcgaaguggucccgccgguucuucaucaucaaggagagcuuccuccuguacuacuccgagagcgagaagaaguccuucgagacgaacaaguacuucaacauccaccccaagggcgugaucccgcucgggggcugccuggucgagcccaaggaggagcccagcaugcccuacgccaugaagaucucccaccaggacuuccacgggaacauccugcuggccgccgagagcgaguucgagcagacccaguggcucgagaugcugcaggaguccggcaaggugaccuggaagaacgcccagcugggcgaggcgaugaucaagagccucgaggcccaggggcugcagcuggccaaggagaagcaggaguaccucgacaagcugauggaggagaccgaggagcugugccuccagcgcgagcagcgggaggagcuggagcgccugaaccaggugcucgaggccgagaagcagcaguucgaggaggucgugcaggagcugcggauggagcaggagcagaucaagcgcgagcuggagcucacggcgcggugccugaagggcguggagcaggagaagaaggagcugcgccaccucaccgagucccugcagcagacccuggaggagcucagcaucgagaagaagaagacccuggagaugcuggaggagaacgagaaccaccuccagacgcuggccaaccagagcgagcagccgccgcccuccgggggccugcacagcaaccuccggcagaucgaggagaagaugcagcagcugcuggaggagaagcuccuggccgagaagcgcaugaaggagaacgaggagcggucccgcgcccuggaggaggagcgggaguucuacagcucccagagccaggcccuccagaacucccugcaggagcugaccgcggagaagcagcaggccgagcgcgagcucaaggccgaggucaaggugcggauggaccuggagcgccggcugcgcgaggccgagggggcccuccggagccuggagcagggccugaacuccaaggugcgcaacaaggagaaggaggagcgcaugcgggcggacgucagccaccugaagcgcuucuucgaggagugcauccggaacgccgagcucgaggccaagaugcccgugaucaugaagaacuccguguacauccacaaggccgccacccgccggaucaagagcugccgcuuccaccggcgccgguccagcaccuccuggaacgacaugaagcccagccaguccuucaugacgagccagcuggacgcgaacaacauggaggagcugaaggaggucgccaagcgccucucccgggaccagcgcuuccgggagagcaucuaccacaucauggccacccagcccggcgcccccagcgcccugucccgcgggggcaaguga

SEQ ID NO: 34714 - RNA, 840 nt, Artificial Sequence
  derived and/or modified sequence opt1 from PLEKHF1__Homo_sapiens__NP_077286
augguggaccaccuggccaacaccgagaucaacagccagcgcaucgccgcggucgaguccugcuucggcgccagcgggcagccccucgcccugccgggccgggugcugcucggggagggcgugcugaccaaggagugccgcaagaaggccaagccccggaucuucuuccuguucaacgacauccucgucuacggguccaucgugcugaacaagcgcaaguaccggagccagcacaucaucccccuggaggaggugacgcucgagcugcugcccgagacccuccaggccaagaaccgcuggaugaucaagaccgcgaagaaguccuucgucgugagcgccgccuccgccaccgagcggcaggaguggaucagccacaucgaggagugcgugcgccggcagcugcgcgcgacgggccggccgcccuccaccgagcacgccgcccccuggauccccgacaaggccaccgacaucugcaugcgcugcacccagacgcgguucagcgcccugacccgccggcaccacugccgcaagugcggcuucgucgugugcgcggagugcucccggcagcgcuuccuccugccgcggcugagccccaagcccgugcgcgucugcucccucugcuaccgggagcuggccgcccagcagcgccaggaggaggccgaggagcagggggccggcagccccgggcagccggcgcaccuggcccgccccaucugcggcgccuccagcggggacgacgacgacuccgacgaggacaaggagggcagccgggacggcgacuggcccuccagcguggaguucuacgccagcgggguggccugguccgcguuccacagcuga

SEQ ID NO: 34715 - RNA, 750 nt, Artificial Sequence
  derived and/or modified sequence opt1 from PLEKHF2__Homo_sapiens__NP_078889
augguggaccgccuggccaacagcgaggccaacacccggcgcaucuccaucgucgagaacugcuucggcgccgccgggcagccccucaccaucccgggccgggugcugaucggggagggcgugcugacgaagcucugccgcaagaagcccaaggcccggcaguucuuccuguucaacgacauccuggucuacgggaacaucgugauccagaagaagaaguacaacaagcagcacaucaucccccucgagaacgugaccaucgacagcaucaaggacgagggcgaccugcgcaacggcuggcugaucaagacccccaccaaguccuucgccgucuacgccgcgacggccaccgagaaguccgaguggaugaaccacaucaacaagugcgugaccgaccuccugagcaagagcgggaagaccccguccaacgagcacgccgccguguggguccccgacagcgaggcgacggugugcaugcggugccagaaggccaaguucacccccgugaaccgccggcaccacugccgcaagugcggcuucgucgugugcgggcccugcuccgagaagcgguuccugcucccgagccaguccagcaagcccgugcgcaucugcgacuucugcuacgaccugcuguccgccggcgacauggcgaccugccagcccgcccggagcgacuccuacagccagucccucaagagcccccugaacgacauguccgacgacgacgacgacgacgacagcagcgacuga

SEQ ID NO: 34716 - RNA, 4158 nt, Artificial Sequence
  derived and/or modified sequence opt1 from PLEKHG1__Homo_sapiens__NP_001025055
auggagcugagcgacuccgaccgccccgugagcuucggcuccaccagcuccagcgccuccagccgggacucccacgggagcuucggcucccgcaugacccucgucagcaacucccacauggggcuguucaaccaggacaaggaggugggcgccaucaagcuggagcucaucccggcgcggcccuucagcuccagcgagcugcagcgcgacaaccccgccacggggcagcagaacgccgacgagggcuccgagcggcccccgcgcgcccaguggcggguggacagcaacggcgcccccaagaccaucgcggacuccgccaccagccccaagcugcucuacgucgaccgcguggugcaggagauccuggagaccgagcggacguacguccaggaccugaaguccaucguggaggacuaccucgacugcauccgcgaccagaccaagcugccccuggggaccgaggagcgguccgcccucuucggcaacauccaggacaucuaccacuucaacagcgagcugcugcaggaccucgagaacugcgagaacgacccgguggccaucgcggagugcuucgucuccaagagcgaggaguuccacaucuacacccaguacugcacgaacuacccccgcuccguggccgugcugaccgagugcaugcggaacaagauccuggccaaguucuuccgcgagcggcaggagacccucaagcacagccugccccugggguccuaccuccugaagcccguccagcgcauccugaaguaccaccuccugcugcacgagaucgagaaccaccucgacaaggacaccgagggcuacgacguggugcuggacgccaucgacacgaugcagcgggucgccuggcacaucaacgacaugaagcgcaagcacgagcacgcggugcggcugcaggagauccagagccuccugaccaacuggaaggggccggaccugaccuccuacggcgagcucgugcuggagggcaccuuccgcauccagcgggccaagaacgagcgcacgcuguuccucuucgacaagcugcugcucaucaccaagaagcgcgacgacaccuucaccuacaaggcccacauccugugcgggaaccugaugcucgucgaggugauccccaaggagccccugagcuucuccguguuccacuacaagaaccccaagcugcagcacacgguccaggccaagagccagcaggacaagcggcucugggugcugcaccugaagcgccucauccuggagaaccacgccgcgaagaucccggccaaggccaagcaggccauccuggagauggacgccauccaccaccccggcuucugcuacucccccgagggcgggaccaaggcgcuguucggcagcaaggagggguccgcccccuaccggcuccgccggaaguccgagccguccagccgcucccacaaggugcugaagaccagcgagaccgcccaggacauccagaaggucagccgggaggagggcagcccccagcugagcuccgcccgccccagccccgcccagcggaacucccagccgagcuccagcacgaugaucuccgugcuccgcgccgggggcgcgcugcggaacaucuggaccgaccaccagauccgccaggcccuguuccccagccggcgcagcccccaggagaacgaggacgacgaggacgacuaccagauguucguccccagcuucuccagcuccgaccucaacagcacccggcugugcgaggacuccaccagcagccgcccgugcuccuggcacauggggcagauggagagcacggagaccuccagcuccggccaccggaucgugcgccgggccagcuccgcgggcgagagcaacacgugcccgcccgagaucgggaccuccgaccgcacccgcgagcugcagaacagccccaagaccgagggccaggaggagaugacccccuucggguccagcaucgagcucaccaucgacgacaucgaccacguguacgacaacaucuccuacgaggaccugaagcugauggucgccaagcgggaggaggccgagagcacgcccuccaagagcgcccgcgacuccgugcggcccaagagcaccccggagcucgccuucaccaagcgccaggcgggccacuccaaggggagccuguacgcccagaccgacggcacccugagcggcggggaggccuccagccaguccacgcacgagcuccaggccguggaggagaacaucuacgacaccaucggccugcccgacccgcccagccugggguucaagugcuccagccucaagcgggccaagcgcuccaccuuccugggccuggaggcggacuucgucugcugcgacagccuccggcccuucgugucccaggacagccugcagcuguccgaggacgaggcccccuaccaccaggccacccccgaccacggguaccucagccugcuguacgacucccccagcggcaaccucuccaugccgcacaagcccgugagcgacaagcuguccgaggaggucgacgagaucuggaacgaccuggagaacuacaucaagaagaacgaggacaaggcccgcgaccggcuccuggccgcguuccccgugagcaaggacgacgugcccgaccgccugcacgccgaguccacgccggagcucagccgggacgucggccgcagcguguccacccugagccugcccgagucccaggcccuccugacccccgucaagagccgggccgggcgcgcgucccgggccaacugccccuucgaggaggaccugaucagcaaggagggcuccuucaugagccucaaccgccugucccuggccagcgagaugccgcucauggacaaccccuacgaccuggccaacuccgggcugagccagaccgaccccgagaaccccgaccucggcauggaggccacggacaagaccaagucccggguguucaugauggcgcgccaguacagccagaagaucaagaaggccaaccagcugcugaaggugaagucccucgagcuggagcagccgcccgccagccagcaccagaaguccaugcacaaggaccuggccgccauccucgaggagaagaagcagggcgggcccgcgaucggcgcccggaucgccgaguacagccagcuguacgaccagaucguguuccgcgaguccccgcugaagauccagaaggacgggugggccagcccccaggagagcucccuccugcggagcgucucccccagccaggugcaccacggcuccggggacuggcugcuccacagcaccuacuccaacggcgagcuggccgacuucugccugcccccggagcaggaccuccgcagccgcuaccccaccuucgagaucaacacgaaguccacgccccggcagcugagcgcggccugcuccgugcccagccugcagaccuccgacccgcuccccggcagcguccagcgcugcuccgugguggucagccagcccaacaaggagaacuggugccaggaccaccuguacaacucccuggggcggaagggcaucagcgccaagucccagcccuaccaccgcagccagagcuccagcuccgugcucaucaacaagagcauggacuccaucaacuacccgagcgacguggggaagcagcagcugcugucccuccaccggagcucccgcugcgagagccaccaggaccugcugcccgacaucgccgacucccaccagcagggcaccgagaagcucagcgaccugacccugcaggacucccagaaggucgugguggucaaccggaaccucccccugaacgcgcagaucgccacccagaacuacuucagcaacuucaaggagaccgacggggacgaggacgacuacguggagaucaaguccgaggaggacgagagcgagcuggagcucucccacaaccgccggcgcaagagcgacuccaaguucguggacgccgacuucagcgacaacgucugcagcggcaacacccugcacucccugaacagcccccggacgccgaagaagcccgugaacuccaagcucggccugagccccuaccugacccccuacaacgacuccgacaagcucaacgacuaccuguggcgcgggccgagccccaaccagcagaacaucgugcagucccugcgggagaaguuccagugccucagcuccagcuccuucgccuga

SEQ ID NO: 34717 - RNA, 4161 nt, Artificial Sequence
  derived and/or modified sequence opt1 from PLEKHG2__Homo_sapiens__NP_073746
augcccgagggcgcccaggggcugucccuguccaagccgucccccucccugggcugcgggcgccggggcgaggugugcgacugcgggaccgugugcgagacccgcaccgcccccgccgcccccaccauggccagcccgcggggcuccggcagcuccaccagccuguccaccguggggagcgagggcgaccccgcccccgggcccaccccggccugcuccgccagccgccccgagccccuccccggcccgcccauccggcugcaccugucccccguggggauccccggcagcgcccgcccgucccggcucgagcgcgucgcccgggagaucguggagaccgagcgcgccuacgugcgggaccugcgcagcaucgucgaggacuaccugggcccccuccuggacgggggcgugcuggggcucuccguggagcaggucggcacccuguucgccaacaucgaggacaucuacgaguucagcuccgagcugcucgaggaccuggagaacagcagcuccgccggcgggaucgccgagugcuucgugcagcggagcgaggacuucgacaucuacacccuguacugcaugaacuaccccuccagccucgcccugcugcgcgagcucucccuguccccgcccgccgcgcuguggcuccaggagcggcaggcccagcugcgccacucccugccccuccagagcuuccugcugaagcccgugcagcggauccucaaguaccaccuccugcuccaggagcugggcaagcacugggccgaggggcccggcaccggcgggcgcgagauggucgaggaggccaucguguccaugaccgccguggccugguacaucaacgacaugaagcggaagcaggagcacgccgcccgccugcaggagguccagcggcgccucggcggguggaccgggcccgagcugagcgccuucggggagcuggugcucgagggcgccuuccgcgggggcggcgggggcgggccccggcugcgcggcggggagcggcuccuguuccuguucucccgcaugcugcucguggcgaagcggcgcggccuggaguacaccuacaagggccacaucuucugcugcaaccugagcgucuccgagagcccccgggacccccucggguucaagguguccgaccugacgaucccgaagcaccgccaccuccugcaggccaagaaccaggaggagaagcggcucuggauccacugccugcagcgccuguucuucgagaaccaccccgccagcauccccgccaaggccaagcagguccuccuggagaacucccugcacugcgcgcccaagagcaagcccguccucgagccccugacgccgccccugggcagcccccggccccgcgacgcccggagcuucacccccgggcgccggaacaccgcccccagccccggccccuccgugauccgccggggccgccggcagagcgagcccgugaaggacccguacgucauguucccccagaacgccaagcccggguucaagcacgcgggcuccgagggggagcucuacccgcccgagagccagccgcccguguccggcagcgcgccgcccgaggaccuggaggacgccgggccgcccacccuggaccccuccggcaccagcaucaccgaggagauccucgagcugcugaaccagcgcggccuccgcgaccccgggcccuccacccacgacauccccaaguucccgggcgacagccagguccccggggacuccgagacgcugaccuuccaggcccugcccagccgggacuccagcgaggaggaggaggaggaggaggagggccucgagauggacgagcgcgggcccuccccgcugcacgugcuggagggccucgagagcuccaucgccgcggagaugcccagcauccccugccugaccaagauccccgacgugccgaaccugcccgagauccccagccggugcgagauccccgagggcucccgccucccgagccuguccgacaucagcgacgucuucgagaugcccugccugcccgccauccccuccgugccgaacacccccagccucuccagcacgcccacccuguccugcgacagcuggcugcaggggccccuccaggagccggccgaggcccccgccacccggcgcgagcuguucuccggcagcaaccccgggaagcugggcgagcccccguccgggggcaaggcgggccccgaggaggacgaggagggggugagcuucaccgacuuccagccccaggacgucacgcagcaccagggcuuccccgacgagcucgccuuccgguccugcagcgagauccgcuccgccuggcaggcccuggagcaggggcagcuggcccggccgggcuuccccgagccccuccugauccuggaggacagcgaccucgggggcgacuccggcagcgggaaggcgggcgccccgagcuccgagcgcaccgccagccgggugcgcgagcuggcccggcuguacuccgagcgcauccagcagaugcagcgggcggagacccgcgccagcgccaacgcgccccggcgccggccccgcgugcucgcccagccccagccgucccccugccugccccaggagcaggcggagcccgggcugcucccggccuucggccacguccuggugugcgagcuggccuucccccugaccugcgcccaggagagcgugccccugggccccgccgucugggugcaggcggccaucccgcuguccaagcagggcgggagccccgacgggcagggccuccacguguccaaccugcccaagcaggaccugcccgggauccacgucagcgccgccacgcuccugccggagcagggcggcucccggcacgugcaggcccccgcggccacgccccugcccaagcaggaggggccgcuccaccuccaggugcccgcccugaccaccuucagcgaccagggccaccccgagauccagguccccgccacgaccccgcuccccgagcaccgcucccacauggugauccccgcgcccagcaccgccuucugcccggagcaggggcacugcgccgacauccacgugcccaccacccccgcccugccgaaggagaucugcuccgacuucacggucagcgugaccacccccgugcccaagcaggagggccaccuggacuccgagagccccaccaacaucccgcucacgaagcagggcggcucccgcgacguccagggccccgaccccgugugcagccagcccauccagccgcugagcuggcacggguccagccuggacccccagggccccggggacacccugccgccccugcccugccaccuccccgaccuccagauccccggcaccagcccccugcccgcccacgggucccaccuggaccaccggauccccgcgaacgcgccccucucccugagccaggagcugccggacacccaggugcccgccacgacgccccugccccugccgcagguccugaccgacaucugggugcaggcccuccccaccucccccaagcagggcagccugccggacauccagggccccgccgcggcgccgccccugccggagcccucccucacggacacccaggugcagaagcugacccccagccuggagcagaagucccucaucgacgcccacguccccgccgccaccccgcugcccgagcgcgggggcagccuggacauccaggggcucucccccacgcccgugcagaccaccauggugcugagcaagccgggcggcucccuggcgagccacgucgcccggcucgaguccagcgaccugacgccgccccacagcccgccgcccagcagccgccagcugcucgggcccaacgccgccgcccugucccgguaccuggcggccagcuacaucucccagagccuggcccgccggcagggccccgggggcggggcccccgcggccucccgcggcagcugguccagcgcccccacgucccgggccagcagcccgccgccccagccccagcccccgcccccgcccgcccgccggcucagcuacgcgaccaccgugaacauccacgugggcgggggcgggcgccugcggcccgccaaggcccagguccgccugaaccaccccgcccuccuggccuccacccaggagagcaugggccugcaccgggcgcagggggcccccgacgcccccuuccacauguga

SEQ ID NO: 34718 - RNA, 4026 nt, Artificial Sequence
  derived and/or modified sequence opt1 from PLEKHG3__Homo_sapiens__XP_011534927
augcccgugagcaccucccugcaccaggacggcagccaggagcgcccggucucccucaccagcacgaccuccagcuccgggagcuccugcgacagccgguccgccauggaggagcccagcuccagcgaggcccccgcgaagaacggcgccgggucccugcgcagccggcaccucccgaacuccaacaacaacagcuccagcuggcucaacgugaagggcccgcugagccccuucaacucccgcgccgccgccgggcccgcgcaccacaagcugagcuaccucggccgggugguccgcgagaucguggagaccgagcggauguacgugcaggaccugcgcuccaucgucgaggacuaccugcucaagaucaucgacacccccggccugcugaagccggagcaggucagcgcccucuucgggaacaucgagaacaucuacgcccugaacucccagcugcuccgggaccuggacagcugcaacuccgaccccguggccgucgcgagcugcuucguggagcgcucccaggaguucgacaucuacacgcaguacugcaacaacuaccccaacagcguggccgcccugaccgagugcaugcgggacaagcagcaggccaaguucuuccgcgaccggcaggagcuccugcagcacucccugccccucggcagcuaccugcugaagccgguccagcgcauccucaaguaccaccuccugcuccaggagaucgccaagcacuucgacgaggaggaggacggguucgaggugguggaggacgcgaucgacaccaugaccugcgucgccugguacaucaacgacaugaagcggcgccacgagcacgccgugcggcugcaggagauccagucccugcucaucaacuggaagggccccgaccugacgaccuacggggagcuggugcucgagggcaccuuccgcguccaccgggugcgcaacgagcggaccuucuuccuguucgacaagacgcugcucaucaccaagaagcgcggcgaccacuucguguacaaggggaacauccccugcagcucccugaugcugaucgagagcacccgcgacucccucugcuucaccgucacgcacuacaagcacagcaagcagcaguacuccauccaggccaagaccguggaggagaagcggaacuggacccaccacaucaagcgccugauccuggagaaccaccacgccaccaucccccagaaggcgaaggaggccauccucgagauggacagcuacuacccgaaccgguaccgcugcagccccgagcggcugaagaaggccugguccagccaggacgagguguccacgaacguccgccagggccggcgccagagcgagcccgggcacucccccuacagccgggccacccugcccuccggccagcgcggcuucgugaugcccagccugaaggggcggcgcaaguccgagcccaccaagcaccuccugcggcagcugaacgagaaggcccgcgcggccggcaugaagcacgccgggagcgccggcacccugcuggacuucgggcagcccucccggacgcgcggccugcagccggaggccgagggcgcgacccaggaggaggaggaggaggaggaggaggugguggaggaggaggaggaggaggaggaggaggagcaggccuuccaggugagccuggaggaccugaccgggcacgagggcaacgagaagggggccggccccgagccgcccggguccgaggaggaggaggaggagcaggaggagagccuggccgucgcggagcagggcaagggccggcgcgaguccgagagcucccggagcagccgccgccccuccgggcggagccccaccuccacggagaagcgcaugagcuucgaguccaucagcucccuccccgagguggagccggaccccgaggccggcagcgagcaggagguguucuccgccgucgaggggcccagcgccgaggagacccccuccgacaccgagagcccggaggugcuggagacccagcuggacgcccaccagggccuccuggggauggacccgcccggcgacaugguggacuucgucgcggccgaguccacggaggaccugaaggcccucagcuccgaggaggaggaggagaugggcggggccgcccaggagcccgagagccugcugccgcccuccgugcucgaccaggcgagcgugaucgccgagcgguucgucuccagcuucagccgccgguccagcguggcccaggaggacuccaagagcuccggcuucgggagcccccgccuggugucccggagcuccagcguccugucccucgagggcagcgagaagggccuggcccgccacggguccgccaccgacagccuguccugccagcucagccccgagguggacaucuccgugggcgucgcgaccgaggacagccccuccgugaacgggauggagccgcccagccccggcugccccguggagcccgaccggagcuccugcaagaagaaggagagcgcccuguccacccgcgaccggcugcuccuggacaagaucaagagcuacuacgagaacgccgagcaccacgacgccggguucuccguccgccggcgcgagagccuguccuacauccccaagggccucgugcggaacagcaucucccgcuucaacagccugccccggccggaccccgagcccgugcccccggucggcuccaagcgccagguggggagccggcccacguccugggcgcuguucgagcuccccggcccgagccaggccgugaagggggacccgccgcccaucuccgacgccgaguuccgccccagcuccgagaucgucaagaucugggagggcauggagagcuccgggggcagccccggcaaggggcccggccaggggcaggccaacggcuucgaccugcacgagccccuguucauccucgaggagcacgagcugggggccaucaccgaggagagcgcgaccgccucccccgagagcuccagccccaccgagggccggucccccgcccaccuggcccgcgagcucaaggagcuggugaaggagcugagcuccagcacccagggcgagcucguggcgccccugcacccgcgcaucguccagcugucccacgugauggacagccacguguccgagcgggucaagaacaagguguaccagcucgcccgccaguacagccugcggaucaaguccaacaagcccgugauggcccgcccgccccugcagugggagaaggucgcccccgagcgggacggcaagagccccacggugcccugccuccaggaggaggccggggagccccucgggggcaaggggaagcgcaagccggugcugucccuguucgacuacgagcagcugauggcccaggagcacagcccgcccaagcccuccagcgcgggcgagaugagcccccagcgguucuucuucaaccccuccgccgucagccagcgcaccaccucccccggcgggcggcccagcgcccgcuccccgcugagccccaccgagacguucuccuggcccgacgugcgggagcucugcagcaaguacgccucccgcgacgaggcgcggcgcgccggcgggggccggccgcgcggcccgcccgugaaccggagccacuccguccccgagaacaugguggagccgccccugagcgggcgcgugggccggugccgcucccugagcaccaagcgcgggcggggcgggggcgaggccgcccagucccccggcccccucccccagagcaagcccgacgggggcgagacccuguacgucaccgccgaccugacgcucgaggacaaccgccgggugaucgugauggagaaggggccccugcccuccccgaccgcgggccuggaggagagcuccgggcagggccccagcucccccgucgcccuccugggccaggugcaggacuuccagcagagcgccgagugccagcccaaggaggaggggagccgcgacccggccgaccccucccagcagggccgggugcgcaaccugcgggagaaguuccaggcccucaacagcgucggguga

SEQ ID NO: 34719 - RNA, 3576 nt, Artificial Sequence
  derived and/or modified sequence opt1 from PLEKHG4__Homo_sapiens__NP_001123201
auggagcgcccccuggagaacggcgacgagagcccggacucccaggggcacgccaccgacuggcgguucgccgugugcagcuuccgcgacgcgugggaggaggaggagcccgccucccagaugcacgucaaggaccccgggcccccgcggccgcccgccggggccacccaggacgaggagcuccagggcagcccccugucccgcaaguuccagcugccgcccgccgcggacgagagcggggacgcccagcggggcacgguggaguccagcuccgugcucagcgagggccccgggcccuccggcgucgagagccugcugugccccauguccagccaccucucccuggcccagggggagagcgacacccccggcguggggcuggugggcgaccccggccccucccgcgccaugccgagcgggcucucccccggcgcgcuggacagcgaccccgucgggcugggcgacccccucagcgagaucuccaagcugcuggaggccgccccgagcggcuccgggcuccccaagcccgccgacugccugcuggcccaggaccucugcugggagcugcuggcgagcggcauggccacccuccccgggacccgggacgugcagggccgcgccgugcugcugcucugcgcccacuccccggccuggcugcagagcgagugcuccagccaggagcugauccggcuccugcuguaccuccgcuccaucccccggcccgagguccaggcgcuggggcugacggugcucguggacgcccgcaucugcgcccccagcuccagccuguucuccggccugagccagcuccaggaggccgccccgggcgcggucuaccaggugcugcuggugggguccacccuccugaaggagguccccagcggccugcagcucgagcagcugcccucccagagccugcucacccacaucccgaccgccgggcugcccacgucccugggcgggggccuccccuacugccaccaggccuggcuggacuuccggcgccggcuggaggcccugcuccagaacugccaggccgcgugcgcccugcugcagggcgccaucgagagcgugaaggccgugccccagccgauggagcccggggaggucggccagcuccugcagcagaccgaggugcugaugcagcagguccucgacagccccuggcuggcguggcugcagugccagggcggccgcgagcucaccuggcugaagcaggagguccccgaggugacccuguccccggacuaccggacggccauggacaaggccgacgagcucuacgaccgcguggacgggcugcugcaccagcucacccugcagagcaaccagcggauccaggcccuggagcucguccagacccuggaggcccgcgaguccggccugcaccagaucgagguguggcuccagcaggucggcuggcccgcgcuggaggaggccggggagcccagccuggacaugcuccugcaggcccagggcuccuuccaggagcuguaccagguggcccaggagcagguccggcagggggagaaguuccuccagccccugaccggcugggaggccgcggagcuggacccgcccggcgcccgcuuccucgcccugcgcgcccagcugacggaguucagccgggcccucgcgcagcgcugccagcggcuggccgacgccgagcgccuguuccagcuguuccgggaggcccucaccugggcggaggaggggcagcgcgugcuggccgagcucgagcaggagcggcccggcguggugcugcagcagcugcagcuccacuggacccgccaccccgaccugccgcccgcccacuuccggaagaugugggcccuggccaccgggcucggcuccgaggcgauccgccaggagugccggugggccugggcccgcugccaggacacguggcuggcccuggaccagaagcucgaggccagccugaagcugccgcccgucggguccaccgcgagccucugcgugucccaggugcccgccgcccccgcccacccgccccugcggaaggccuacagcuucgaccgcaaccugggccagucccucagcgagcccgcgugccacugccaccacgccgccaccaucgccgcgugccggcgccccgaggccggcgggggcgcccugccccaggccuccccgaccgugcccccgcccgggagcuccgacccccggagccugaaccgccuccagcuggugcuggccgagaugguggcgacggagcgggaguacguccgcgcccucgaguacaccauggagaacuacuuccccgagcuggaccgccccgacgugccccagggccugcgggggcagcgcgcccaccucuucggcaaccuggagaagcugcgggacuuccacugccacuucuuccuccgcgagcuggaggccugcacccggcacccgccccgcguggccuacgcguuccugcggcaccgcguccaguucggcauguacgcccucuacagcaagaacaagccccgguccgacgcccugaugagcuccuacgggcacaccuucuucaaggacaagcagcaggcccugggcgaccaccucgaccuggccagcuaccugcucaagcccauccagcgcauggggaaguacgcgcugcugcuccaggagcuggcccgggccugcggcgggccgacgcaggagcuguccgcccuccgcgaggcccagagccuggugcacuuccagcugcggcacggcaacgaccuccuggcgauggacgccauccagggcugcgacgugaaccugaaggagcaggggcagcucguccgccaggacgaguucguggugcggaccggccgccacaaguccguccggcgcaucuuccuguucgaggagcugcuccuguucagcaagccccggcacgggcccaccggcguggacaccuucgccuacaagcgcuccuucaagauggccgaccuggggcucacggagugcugcggcaacagcaaccugcgguucgagaucugguuccgccgccggaaggcgcgcgacaccuucgugcugcaggccuccagccuggccaucaagcaggccuggaccgccgacaucucccaccuccuguggcggcaggcgguccacaacaaggaggugcgcauggccgagauggugagcaugggcgucgggaacaaggccuuccgggacaucgcccccuccgaggaggccaucaacgaccgcaccgugaacuacgugcugaagugccgggagguccgcagccgggcguccaucgccguggccccguucgaccacgacagccucuaccugggcgccuccaacagccugcccggggaccccgccagcugcuccgugcucggcagccugaaccugcaccucuaccgcgaccccgcgcugcugggccuccggugcccgcuguaccccuccuuccccgaggaggccgcccuggaggccgaggcggagcucgggggccagcccagccugacggccgaggacuccgagaucagcucccagugcccgagcgccuccgggagcuccggcagcgacuccagcugcgucuccgggcaggcccugggccgcggccucgaggaccugcccugcguguga

SEQ ID NO: 34720 - RNA, 2373 nt, Artificial Sequence
  derived and/or modified sequence opt1 from PLEKHG6__Homo_sapiens__NP_001138328
augaaggccuucgggcccccgcacgaggggccccugcagggccucguggccagccgcaucgagaccuacgggggccggcaccgcgcguccgcccagagcaccgccgggcggcuguacccccgcggcuaccccguccuggacccgucccggcgccggcuccagcaguacgugcccuucgcccgcggcagcgggcaggcccggggccugucccccaugcgccugcgggaccccgagccggagaagcgccacgggggccacgugggggcgggccuccugcacagccccaagcugaaggagcucacgaaggcccacgagcuggagguccggcugcacaccuucuccauguucggcaugccccgccugcccccggaggaccggcgccacugggagaucggggagggcggggacagcggccucaccaucgagaaguccuggcgggagcuggugcccggccacaaggagaugagccaggagcucugccaccagcaggaggcccugugggagcugcucaccacggagcugaucuacgugcgcaagcugaagaucaugaccgaccuccuggccgcggggcugcucaaccugcagcgggucggccugcucauggagguguccgccgagacccuguucgggaacgugcccagccugauccgcacccaccgguccuucugggacgagguccucggccccacgcuggaggagacccgcgccagcgggcagccgcuggaccccaucggccuccaguccggcuuccugaccuucgggcagcgcuuccaccccuacgugcaguacugccugcgggugaagcagaccauggccuacgcccgcgagcagcaggagacgaacccccucuuccacgcguucguccaguggugcgagaagcacaagcggagcggccgccagaugcugugcgaccugcucaucaagccgcaccagcggaucaccaaguacccccugcugcuccacgccgugcugaagcgcucccccgaggcccgggcccaggaggcccugaacgcgaugaucgaggccguggagagcuuccuccgccacaucaacgggcagguccggcagggcgaggagcaggagucccuggccgccgccgcgcagcgcaucgggcccuacgaggugcuggagccgcccagcgacgagguggagaagaaccuccggcccuucagcacccuggaccugaccucccccaugcugggcgucgccagcgagcacacgcgccagcuccugcuggagggcccggugcgggugaaggaggggcgcgagggcaagcucgacgucuaccuguuccuguucuccgacgugcuccuggugaccaagccccagcggaaggccgacaaggccaaggucauccggcccccgcugaugcucgagaagcuggugugccagccccugcgcgaccccaacagcuuccuccugauccaccugaccgaguuccagugcgucuccagcgcccuccuggugcacugccccuccccgaccgaccgcgcgcaguggcuggagaagacgcagcaggcccaggccgcccuccagaagcugaaggcggaggaguacgugcagcagaagcgggagcugcucacccuguaccgcgaccaggaccgcgagagccccuccacccggcccagcacccccucccuggaggggagccaguccagcgccgagggccgcacgccggaguucuccaccaucaucccccaccucgucgugaccgaggacaccgacgaggacgcgccccuggugcccgacgacacgagcgacuccggguacggcacccugaucccgggcacccccaccgggagccggagcccccucucccgccugcggcagcgcgcccugcggcgcgacccccggcucacguucagcacccuggagcugcgcgacaucccgcuccggccccacccgcccgacccccaggcgccccagcgccgguccgcccccgagcugcccgagggcauccugaagggcggcagccucccgcaggaggacccgcccaccugguccgaggaggaggacggcgccagcgagcgcgggaacgucgugguggagacccugcaccgggcccgccugcggggccagcuccccuccagccccacgcacgccgacuccgccggggagagccccugggaguccagcggcgaggaggaggaggaggggccccuguuccugaaggccggccacaccucccuccgcccgaugcgggccgaggacaugcugcgcgagauccgggaggagcuggccagccagcgcaucgagggcgccgaggagccccgcgacucccggccccgcaagcucacccgggcccagcugcagcgcaugcgggggccccacaucauccagcuggacaccccgcucagcgcguccgaggucuga

SEQ ID NO: 34721 - RNA, 4482 nt, Artificial Sequence
  derived and/or modified sequence opt1 from PLEKHH2__Homo_sapiens__NP_742066
auggccgagcugagcgagcccgagggcccgguggacuggaaggagcgcugcgucgcccucgagucccagcugaugaaguuccgggugcaggcgagcaagauccgcgagcugcucgccgagaagaugcagcagcuggagcggcaggugaucgacgccgagcgccaggccgagaaggccuuccagcagguccaggugauggaggacaagcugaaggcggccaacauccagaccuccgagagcgagacccggcucuacaacaagugccaggaccuggagucccugauccaggagaaggacgacgugauccagaaccucgagcugcagcuggaggagcagaagcagauccgcauccaggaggccaagaucaucgaggagaaggccgcgaagaucaaggagugggucacggugaagcucaacgagcuggagcuggagaaccagaaccuccggcugaucaaccagaaccagaccgaggagauccgcaccaugcagagcaagcugcaggaggugcaggggaagaaguccagcaccgucuccacgcucaagcugagcgagggccagcggcuguccagccucaccuucgggugcuuccugucccgcgcccggagccccccccagguggugaaguccgaggagaugagcaagaucuccagcaaggagcccgaguucaccgagggcaaggacauggaggagauggagaucccggagaaguccgucgacaaccaggugcuggagaacaaccgcgggcagcggacccuccaccagacgcccugcggcagcgagcagaaccgcaagacccggaccagcuucgccaccgacggcgggaucucccagaacagcggcgcccccguguccgacuggagcuccgacgaggaggacgggagcaagggccgcuccaagagccggugcacguccacccugagcucccacaccagcgaggaggggguccagugcucccgcaugggcagcgagauguaccugaccgccuccgacgacagcuccagcaucuucgaggaggagacguucggcaucaagcggcccgagcacaagaagcucuacuccuggcagcaggaggcgcaguggaaggcccugaacagcccgcuggggaagggcaacagcgagcucuccaagaaggagcaggacagcuccagcgacgagcugaacaagaaguuccagucccagcgccuggacuacagcuccagcuccagcgaggccaacacccccucccccauccucacccccgcccugaugccgaagcaccccaacagccuguccgggaagggcacccagcucgugcccagcucccaccugcccccgcccaagcugcggauccccaacguguucagcaucuccgucgcccucgcgaagcgccaccugagccagccccagcugagcuccgaccgcauguucggcacgaaccggaacgccaucagcaugauccgcccgcuccggccccaggagaccgaccuggaccugguggacggggacuccaccgaggugcucgagaacauggacaccagcugcgacgacggccuguucuccuacgacagccuggacucccccaacagcgacgaccaggagcacugcgacuccgccaagaaggucgccuacagcaagcccccgacgcccccccuccaccgcuuccccuccugggagagccggaucuacgccguggcgaaguccgggauccgcaugagcgaggccuucaacauggaguccgugaacaagaacagcgccgccacccuguccuacaccaccagcggccuguacacgucccugaucuacaagaacaugaccaccccggucuacaccacgcucaaggggaaggccacccagaucagcagcucccccuuccuggacgacagcuccggcagcgaggaggaggacuccagccgguccagcucccgcaccagcgaguccgacagccggucccgcagcggccccggguccccgcgggcgaugaagcgcggcgugagccuguccagcgucgccuccgagagcgacuacgccaucccccccgacgccuacagcaccgacacggaguacucccagcccgagcagaagcucccgaagaccugcagcuccagcuccgacaacgggaagaacgagccccuggagaagagcggcuaccugcucaagauguccgggaaggugaagagcuggaagcggcgcugguucgugcugaagggcggcgagcugcucuacuacaagucccccagcgacgucauccggaagccccaggggcacaucgagcuguccgcgagcugcuccauccugcgcggcgacaacaagcagaccgugcagcucaccaccgagaagcacacguacuaccugaccgccgacagcccgaacauccuggaggaguggaucaaggugcuccagaacguccugcgggugcaggccgccaacccccugucccuccagcccgaggggaagcccaccaugaagggccugcugaccaaggugaagcacggguacagcaagcgcgucuggugcacgcucaucggcaagacccuguacuacuuccggucccaggaggacaaguucccgcugggccagaucaagcucugggaggccaagguggaggagguggaccgcagcugcgacuccgacgaggacuacgaggcgagcgggcgcagccugcuguccacccacuacaccaucgucauccaccccaaggaccagggccccacguaccuccugaucgggagcaagcacgagaaggacaccuggcuguaccaccucaccguggccgccggcuccaacaacgugaacgucggcagcgaguucgagcagcuggugugcaagcugcucaacaucgacggggagcccuccagccagaucuggcggcacccgacccugugccacuccaaggagggcaucaucagcccccugacgacccuccccuccgaggcccugcagaccgaggccaucaagcuguucaagaccugccagcucuucaucaacgcggccguggacagccccgccaucgacuaccacaucucccuggcccagagcgcccugcagaucugccucacgcacccggagcugcagaacgagaucugcugccagcugaucaagcagacccgccggcgccagccccagaaccagcccgggccccuccagggcuggcagcugcuggcgcucugcgucgggcuguuccugccgcaccaccccuuccucuggcugcugcggcuccaccugaagcgcaacgccgacucccggaccgaguucggcaaguacgccaucuacugccagcgcugcguggagcggacccagcagaacggcgaccgcgaggcccggcccagccgcauggagauccuguccacgcuccugcggaacccguaccaccacagccugcccuucuccauccccgugcacuucaugaacgggaucuaccaggucgugggcuucgacgcgagcaccaccguggaggaguuccucaacacccugaaccaggacacggggaugcgcaagcccgcccaguccggcuucgcccuguucaccgacgacccgagcgggcgggaccucgagcacugccugcagggcaacaucaagaucugcgacaucaucagcaagugggagcaggccuccaaggagcagcagcccggcaagugcgaggggacccgcaccguccggcugacguacaagaaccgccucuacuucagcgugcaggcccggggcgagaccgaccgcgagaagcugcugcucauguaccagaccaacgaccagaucaucaacgggcuguucccccugaacaaggaccucgcgcuggagauggccgcccugcucucccagguggagaucggcgacuucgagcggcccuucagcaccccggccgggcacgucacgaaccagugcaaggugaaccagacccugaagcaggugaucgagaaguucuaccccaagcgcuaccgcgacggcugcuccgaggagcagcugcggcagcucugccagcgccugagcacccgguggauggcccugcgcggccacuccgcggccgacugcguccggaucuaccucaccguggcccgcaaguggcccuucuucggggccaagcuguuccuggccaagcccaucacgccgagcucccucggcagcaccuuccuguggcuggcggugcacgaggacgggcucucccugcuggaguacaacagcaugcggcucaucgucuccuacguguacaagagccugaugaccuucggcggguaccaggacgacuucaugguggucaucaacaacacccacuccaaggacaagcccaccgagaagcugcucuucgccauggccaagcccaagauccuggagaucacgcugcugaucgccagcuacaucaacaacuuccaccagcagaaggcggccuuccaccaccucuccgcccccgcccugcugagcgcccagacccgcggcccgcaggcgcggaugaugggcucccagccccuccugagcagcucccgccccaccaaggggcccacccugcucuga

SEQ ID NO: 34722 - RNA, 3171 nt, Artificial Sequence
  derived and/or modified sequence opt1 from PLEKHM1__Homo_sapiens__NP_055613
augcugagcguggucgagaacggccucgacccccaggccgccaucccggugaucaagaagaagcuggugggguccgucaaggcgcugcagaagcaguacgugagccucgacaccguggucaccuccgaggacggcgacgccaacacgaugugcagcgcccuggaggccguguucauccacgggcugcacgccaagcacauccgcgcggaggccggcgggaagcggaagaaguccgcccaccagaagccccucccccagcccguguucuggccgcugcugaaggccgucacccacaagcacaucaucagcgagcucgagcaccugaccuucgugaacaccgacgugggccgcugccgggcguggcugcgccucgcccugaacgacggccugauggagugcuaccucaagcugcugcuccaggagcaggcccggcugcacgaguacuaccagcccacggcccugcuccgcgacgccgaggagggggaguuccugcuguccuuccuccagggccugaccagccuguccuucgagcucagcuacaaguccgcgauccugaacgaguggacccugacgccccucgcccugagcgggcugugcccccucuccgagcuggacccgcugagcaccuccggcgccgagcuccagcggaaggagagccuggacuccaucagccacuccagcgggagcgaggacaucgagguccaccacuccggccacaagauccgccggaaccagaagcugaccgccagcucccucagccuggacaccgccuccagcucccagcugagcugcucccucaacagcgacuccugccugcugcaggagaacggcagcaagucccccgaccacugcgaggagcccaugagcugcgacuccgaccucgggaccgcgaacgccgaggacagcgaccgcucccugcaggaggugcugcucgaguucagcaaggcccaggugaacuccguccccacgaacggccugagccaggagaccgagaucccgacgccccaggccagccugucccugcacgggcucaacaccagcaccuaccugcacugcgaggcccccgcggagccccugccggcccaggccgccuccggcacccaggacggcgugcacgugcaggagccccggccccaggcccccagcccgcucgaccugcagcagcccgucgaguccaccagcgggcagcagcccuccagcaccguguccgagacggcgcgcgaggugggccaggggaacggccugcagaaggcccaggcccacgacggggccggccucaagcuggucgugagcucccccaccagcccgaagaacaaguccuggaucagcgaggacgacuucuaccggcccucccgcgagcagccccuggagagcgcguccgaccaccccaucgccagcuaccggggcaccccggggagccgccccggccuccaccggcacuucucccaggagccccgcaagaacugcagccugggggcccuggaccaggccugcgugccgucccccggccggcgccaggcccaggcggcccccagccaggggcacaaguccuuccgggucgugcaccgccgccagaugggccucagcaaccccuuccggggccugaugaagcuggggaccgucgagcgccggggcgccauggggaucuggaaggagcuguucugcgagcuguccccgcuggaguuccgccucuaccugagcaacgaggagcacacgugcguggagaacugcucccugcuccggugcgagagcgugggccccgcccacuccgacgggcgcuucgagcuggucuucagcggcaagaagcuggcccuccgggcguccagccaggacgaggccgaggacuggcuggaccgcgugcgggaggcccugcagaaggugcgcccccagcaggaggacgagugggucaacgugcaguaccccgaccagccggaggagccgcccgaggcgccccagggcugccucucccccagcgaccugcuguccgagcccgccgcccuccaggggacccaguucgacuggagcuccgcccaggugcccgagcccgacgccaucaaggagagccugcuguaccucuacauggaccggaccuggaugccguacaucuucagccugucccuggaggcccucaagugcuuccgcauccggaacaacgagaagaugcugagcgacucccacggcgucgagaccauccgcgacauccugcccgacacgagccucgggggccccuccuucuucaagaucaucaccgcgaaggccgugcugaagcugcaggccggcaacgccgaggaggccgcgcucuggcgggaccuggugcgcaagguccuggccagcuaccucgagaccgccgaggaggccgugacccucgggggcucccuggacgagaacugccaggaggugcucaaguucgccacgcgggagaacggguuccugcugcaguaccucgucgcgauccccauggagaagggccuggacagccaggggugcuucugcgccggcugcucccgccagaucggcuucagcuucgugcggccgaagcugugcgccuucuccgggcucuacuacugcgacaucugccaccaggacgacgccagcgugauccccgcccgcaucauccacaacugggaccugaccaagcgccccaucugccggcaggcgcugaaguuccucacccagauccgcgcccagccccugaucaaccugcagauggucaacgccucccucuacgagcacguggagcggaugcaccugaucggccgccggcgcgagcagcugaagcuccugggggacuaccugggccucugccggagcggggcccugaaggagcuguccaagcgccucaaccaccggaacuaccugcuggagagcccgcaccgcuucuccguggcggaccuccagcagaucgccgacggcgucuacgagggcuuccugaaggcccugaucgaguucgccagccagcacguguaccacugcgaccucugcacccagcggggguucaucugccagaucugccagcaccacgacaucaucuuccccuucgaguucgacacgaccgugcgcugcgccgagugcaagaccgucuuccaccaguccugccaggcgguggugaagaagggcugcccccggugcgcccgccggcgcaaguaccaggagcagaacaucuucgccuga

SEQ ID NO: 34723 - RNA, 681 nt, Artificial Sequence
  derived and/or modified sequence opt1 from PLEKHO1__Homo_sapiens__NP_001291653
augcugacccucgaccugauccaggaggaggaccccagcccggaggagcccaccuccugcgccgagagcuuccgcguggaccuggacaaguccgucgcccagcucgcgggcagccggcgccgggccgacuccgaccgcauccagcccagcgccgaccgggccuccagccugucccgccccugggagaagaccgacaagggggccaccuacaccccgcaggcgcccaagaagcugacccccacggagaagggccggugcgccagccucgaggagauccugucccagcgcgacgccgccagcgcgcggacccugcagcuccgcgccgaggagcccccgacccccgcccugcccaaccccgggcagcugucccggauccaggaccucguggcccgcaagcuggaggagacccaggagcugcucgccgaggugcagggccugggggacggcaagcggaaggcgaaggacccgccccgcagcccgcccgacuccgagagcgagcagcugcuccuggagacggagcggcugcucggcgaggccuccagcaacuggucccaggccaagcgcguccugcaggaggugcgggagcugcgcgaccucuaccggcagauggaccugcagacccccgacagccaccuccgccagaccacgccccacagccaguaccggaagucccugauguga

SEQ ID NO: 34724 - RNA, 1473 nt, Artificial Sequence
  derived and/or modified sequence opt1 from PLEKHO2__Homo_sapiens__NP_079477
auggaggaggagggcgugaaggaggccggggagaagccccgcggcgcccagauggucgacaaggcgggguggaucaagaaguccuccggcgggcugcucggcuucuggaaggaccgguaccugcugcucugccaggcccagcugcugguguacgagaacgaggacgaccagaagugcguggagaccgucgagcucggcagcuacgagaagugccaggaccugcgcgcccugcucaagcggaagcaccgcuucauccugcugcgguccccggggaacaaggugagcgacaucaaguuccaggcccccaccggcgaggagaaggaguccuggaucaaggcccucaacgaggggaucaaccgcggcaagaacaaggcguucgacgaggugaaggucgacaagagcugcgcccuggagcacgugacgcgggaccgcgugcgcgggggccagcggcggcgcccgcccacccggguccaccugaaggagguggccuccgccgcgagcgacggccuccugcgccuggaccucgacgugcccgacagcgggccgcccgucuucgcccccagcaaccacguguccgaggcccagccccgggagacgccccgcccccugaugcccccgaccaagcccuuccuggcccccgagaccaccagccccggcgaccggguggagaccccggucggggagcgcgcccccacccccguguccgcgagcuccgaggugagccccgagucccaggaggacagcgagacgccggccgaggaggacuccggcagcgagcagccgcccaacagcguccuccccgacaagcugaagguguccugggagaaccccagcccccaggaggcccccgccgccgaguccgcggagcccagccaggccccgugcuccgagaccagcgaggccgcgccccgggagggcgggaagcccccgaccccgccgcccaagauccuguccgagaagcucaaggccagcaugggcgagaugcaggccuccgggccgcccgcccccggcaccgugcaggucagcgugaacgggauggacgacucccccgagcccgccaagcccagccaggccgagggcacgcccggcacgccgcccaaggacgccaccaccuccaccgcgcugccgcccugggaccugccgccccaguuccacccccgcugcagcucccucggggaccugcugggcgaggggccccggcacccccuccagccccgcgagcgccuguaccgggcccagcuggaggugaaggucgccagcgagcagaccgagaagcuccugaacaaggugcugggcuccgagcccgcccccgucagcgcggagacccuccugucccaggccguggagcagcugcgccaggccacccaggugcuccaggagaugcgggaccugggggagcugagccaggaggcccccggccuccgcgagaagcggaaggagcuggucacgcuguaccgccggagcgcccccuga

SEQ ID NO: 34725 - RNA, 1053 nt, Artificial Sequence
  derived and/or modified sequence opt1 from PLEK__Homo_sapiens__NP_002655
auggagcccaagcgcauccgggagggcuaccuggugaagaaggggagcgucuucaacaccuggaagccgauguggguggugcuccuggaggacggcaucgaguucuacaagaagaaguccgacaacagccccaaggggaugaucccccugaagggcuccacccucacgagccccugccaggacuucgggaagcgcauguucgucuucaagaucaccaccaccaagcagcaggaccacuucuuccaggccgccuuccuggaggagcgggacgcgugggugcgcgacaucaagaaggccaucaagugcaucgagggcggccagaaguucgcccggaaguccacgcgccggagcauccgccugccggagaccaucgaccucggggcccuguaccuguccaugaaggacaccgagaagggcaucaaggagcucaaccuggagaaggacaagaagaucuucaaccacugcuucaccgggaacugcgugaucgacuggcuggucagcaaccaguccgugcggaaccgccaggagggccucaugaucgccagcucccugcugaacgagggguaccuccagcccgcgggcgacaugagcaaguccgccguggacggcacggccgagaaccccuuccuggacaaccccgacgccuucuacuacuucccggacagcggguucuucugcgaggagaacuccagcgacgacgacgucauccugaaggaggaguuccggggcgugaucaucaagcaggggugccuccugaagcagggccaccgccggaagaacuggaaggugcgcaaguucauccugcgggaggaccccgcguaccuccacuacuacgaccccgccggcgccgaggacccccugggggccauccaccuccgcggcugcgucgugaccuccguggagagcaacuccaacgggcgcaagagcgaggaggagaaccuguucgagaucaucaccgccgacgagguccacuacuuccugcaggcggccaccccgaaggagcggacggaguggauccgggccauccagauggccagccgcaccggcaaguga

SEQ ID NO: 34726 - RNA, 2433 nt, Artificial Sequence
  derived and/or modified sequence opt1 from PLG__Homo_sapiens__NP_000292
auggagcacaaggaggugguccugcuccugcugcuguuccucaagagcggccagggggagccccuggacgacuacgugaacacccagggcgccucccucuucagcgugaccaagaagcagcugggggccggcuccaucgaggagugcgcggccaagugcgaggaggacgaggaguucacgugccgcgccuuccaguaccacagcaaggagcagcagugcgucaucauggccgagaaccggaaguccagcaucaucauccgcaugcgggacguggugcuguucgagaagaaggucuaccucuccgagugcaagaccgggaacggcaagaacuaccgcggcaccaugagcaagaccaagaacgggaucacgugccagaagugguccagcaccuccccgcaccggccccgcuucagccccgccacccaccccuccgagggccuggaggagaacuacugccggaacccggacaacgacccccaggggcccuggugcuacaccacggaccccgagaagcgcuacgacuacugcgacauccuggagugcgaggaggagugcaugcacugcagcggcgagaacuacgacgggaagaucuccaagaccaugagcggccucgagugccaggcgugggacucccagagcccgcacgcccacggcuacauccccuccaaguuccccaacaagaaccugaagaagaacuacugccggaaccccgaccgcgagcugcggccguggugcuucaccaccgaccccaacaagcgcugggagcucugcgacaucccccggugcacgacgcccccgcccagcagcgggcccaccuaccagugccucaagggcaccggggagaacuaccgcggcaacguggccgugaccgucuccggccacacgugccagcacuggagcgcccagacgccccacacccacaaccggaccccggagaacuuccccugcaagaaccuggacgagaacuacugccgcaaccccgacgggaagcgggcgcccuggugccacaccaccaacucccaggugcgcugggaguacugcaagaucccgagcugcgacuccagccccguguccaccgagcagcuggcccccaccgcgcccccggagcugacccccgucgugcaggacugcuaccacggcgacgggcagagcuaccggggcaccuccagcaccacgaccaccgggaagaagugccaguccuggagcuccaugacgccccaccgccaccagaagaccccggagaacuaccccaacgccggccugaccaugaacuacugccggaaccccgacgccgacaagggccccuggugcuucaccaccgacccgagcgugcgcugggaguacugcaaccucaagaagugcuccgggacggaggccagcgucguggccccgccgcccgugguccugcugcccgacguggagacccccuccgaggaggacugcauguucggcaacgggaagggcuaccgcgggaagcgggccaccaccgugaccggcacgcccugccaggacugggccgcccaggagccccaccgccacagcaucuucacccccgagaccaacccccgggcgggccucgagaagaacuacugccgcaaccccgacggggacgucggcgggcccuggugcuacaccacgaacccgcggaagcuguacgacuacugcgacgugccccagugcgccgcccccuccuucgacugcggcaagccccagguggagccgaagaagugccccgggcgcgucgugggcggcugcgucgcccacccccacagcuggcccuggcaggucagccugcggacccgcuucgggaugcacuucugcggcgggacccucaucuccccggagugggugcugaccgccgcgcacugccuggagaaguccccgcggcccagcagcuacaaggugauccucggcgcccaccaggaggugaaccuggagccccacgugcaggagaucgaggucucccgccuguuccucgagcccacgcggaaggacaucgcccugcugaagcucagcucccccgccgugaucaccgacaaggugauccccgccugccugccgagccccaacuacgucguggcggaccgcaccgagugcuucaucaccggcuggggcgagacgcaggggaccuucggggccggccugcucaaggaggcccagcugcccgugaucgagaacaaggucugcaaccgguacgaguuccugaacgggcgcgugcaguccaccgagcucugcgccggccaccuggcgggcgggaccgacagcugccagggcgacuccgggggcccccuggugugcuucgagaaggacaaguacauccuccagggggucacgagcuggggccugggcugcgcccggccgaacaagcccgggguguacgugcgcgucucccgguucgugaccuggaucgagggcgugaugcgcaacaacuga

SEQ ID NO: 34727 - RNA, 291 nt, Artificial Sequence
  derived and/or modified sequence opt1 from PLGLB2__Homo_sapiens__NP_002656
auggagcacaaggaggugguccugcuccugcugcuguuccucaagagcggccagggggagccccuggacgacuacgugaacacccagggcccgucccucuucagcgugaccaagaagcagcugggggccggcucccgcgaggagugcgccgcgaagugcgaggaggacaaggaguucacgugccgggccuuccaguaccacagcaaggagcagcagugcgucaucauggccgagaaccgcaaguccagcaucaucauccggaugcgcgacgccgugcuguucgagaaguga

SEQ ID NO: 34728 - RNA, 1569 nt, Artificial Sequence
  derived and/or modified sequence opt1 from PLIN1__Homo_sapiens__XP_005254991
auggccgugaacaagggccugacccuccuggacggggaccugcccgagcaggagaacguccuccagcgcgugcugcagcugccgguggucagcgggaccugcgagugcuuccagaagacguacaccuccaccaaggaggcccacccccucguggcgagcgugugcaacgccuacgagaaggggguccaguccgccagcucccuggccgccuggagcauggagcccguggugcggcgccuguccacccaguucacggcggccaacgagcucgccugccggggccuggaccaccuggaggagaagauccccgcccuccaguacccgcccgagaagaucgcgagcgagcugaaggacaccaucuccacccgccugcggagcgcccgcaacuccaucagcguccccaucgccuccaccagcgacaaggugcucggggccgcccuggcgggcugcgagcuggccuggggcguggcccgggacacggccgaguucgccgcgaacacccgcgccgggcggcucgccuccggcggggccgaccuggcccugggcagcaucgagaaggucguggaguaccuccugcccccggacaaggaggaguccgcgcccgcccccgggcaccagcaggcccagaagucccccaaggccaagccgagccugcucagccgcgugggcgcccugaccaacacccugagccgguacacgguccagaccauggcgcgcgcccucgagcagggccacaccguggccauguggauccccgggguggucccccuguccagccuggcccaguggggcgcguccguggccaugcaggccgugagccggcgccgguccgagguccgcgugcccuggcuccacagccuggccgccgcgcaggaggaggaccacgaggaccagaccgacacggagggggaggacaccgaggaggaggaggagcuggagaccgaggagaacaaguucuccgagguggccgcccucccgggcccccggggccugcugggcggcgucgcccacacccuccagaagacgcugcagaccaccaucagcgccgugaccugggcgcccgccgccguccuggggauggccggccgcgugcuccaccugacgcccgccccggcgguguccagcaccaaggggcgggccaugucccugagcgacgcccucaagggcgucaccgacaacgugguggacaccgucgugcacuacgugccccugccccgccugucccucauggagcccgagagcgaguuccgggacaucgacaacccgcccgccgaggucgagcgccgcgaggcggagcggcgcgccuccggcgcccccagcgccgggcccgagccggcgccccggcuggcccagccccgccggucccugcgcagcgcccaguccccgggcgccccgcccgggcccggccucgaggacgagguggccacgcccgccgcgccccggcccggguuccccgccgugccgcgcgagaagcccaagcggcgcgucagcgacagcuucuuccggcccuccgugauggagcccauccugggccgcacccacuacagccagcugcggaagaaguccuga

SEQ ID NO: 34729 - RNA, 1314 nt, Artificial Sequence
  derived and/or modified sequence opt1 from PLIN2__Homo_sapiens__NP_001113
auggccagcguggccgucgacccccagccguccguggugacccgcgucgugaaccugccccucgugagcuccaccuacgaccugaugagcuccgcguaccugagcacgaaggaccaguaccccuaccucaaguccgucugcgagauggccgagaacggcgugaagaccaucaccagcguggccaugaccuccgcccugcccaucauccagaagcuggagccgcagaucgccgucgcgaacacguacgccugcaaggggcucgaccggaucgaggagcgccugcccauccugaaccagcccagcacccagaucguggccaacgccaagggcgcggugaccggggccaaggacgccgucaccacgaccgugaccggcgccaaggacuccguggccagcaccaucacgggggucauggacaagaccaagggcgcggugaccggcuccguggagaagaccaagagcgucguguccgggagcaucaacacggugcucggcucccggaugaugcagcuggucagcuccgggguggagaacgcccugaccaagagcgagcuccugguggagcaguaccugccccucaccgaggaggagcuggagaaggaggccaagaaggucgagggcuucgaccuggugcagaagccgagcuacuacguccgccucgggucccugagcaccaagcugcacucccgggccuaccagcaggcccucagccgcgugaaggaggcgaagcagaagucccagcagacgaucagccagcugcacuccaccgugcaccugaucgaguucgcccggaagaacgucuacagcgccaaccagaagauccaggacgcccaggacaagcucuaccuguccuggguggaguggaagcgcagcaucggcuacgacgacaccgacgagucccacugcgccgagcacaucgagagccggacccuggcgaucgcccgcaaccucacgcagcagcugcagacgaccugccacacccugcucuccaacauccagggcgugccccagaacauccaggaccaggccaagcacaugggggucauggccggcgacaucuacagcguguuccggaacgccgcguccuucaaggaggugagcgacucccugcugaccagcuccaaggggcagcuccagaagaugaaggagagccuggacgacgucauggacuaccuggugaacaacacgccccucaacuggcuggugggccccuucuacccgcagcugaccgagagccagaacgcccaggaccagggcgccgagauggacaaguccagccaggagacccagcgcuccgagcacaagacccacuga

SEQ ID NO: 34730 - RNA, 1269 nt, Artificial Sequence
  derived and/or modified sequence opt1 from PLIN3__Homo_sapiens__NP_001157666
augagcgccgacggcgccgaggcggacggguccacccaggugaccgucgaggagcccgugcagcagccgagcguggucgaccgcguggccuccaugccccugaucagcuccacgugcgacauggugagcgccgccuacgccuccaccaaggagagcuacccccacaucaagaccgucugcgacgcggccgagaagggcgugcggacccucacggccgccgcgguguccggggcccagcccauccugagcaagcuggagccgcagaucgccuccgccagcgaguacgcccaccgcggccucgacaagcuggaggagaaccugcccauccuccagcagcccaccgagaaggucuccggggcgcaggagauggugagcuccgccaaggacaccguggccacccagcugagcgaggccgucgacgccacgcggggcgcggugcaguccggcguggacaagaccaagagcgucgugaccgggggcgugcaguccgucauggggagccgccugggccagauggugcucagcgggguggacaccguccugggcaaguccgaggagugggccgacaaccaccucccccugacggacgccgagcuggcccggaucgccaccagccuggacggcuucgacguggcguccgugcagcagcagcgccaggagcagagcuacuucguccggcucgggucccugagcgagcgccugcggcagcacgccuacgagcacucccucggcaagcugcgcgccaccaagcagcgggcccaggaggcccugcuccagcugagccaggugcugucccucauggagaccgucaagcaggggguggaccagaagcugguggagggccaggagaagcugcaccagauguggcucagcuggaaccagaagcagcugcagggcccggagaaggagccgcccaagcccgagcaggucgagucccgcgcgcugacgauguuccgggacaucgcccagcagcuccaggcgaccugcaccagccugggguccagcauccagggccugcccaccaacgugaaggaccaggugcagcaggcccgccggcaggucgaggaccuccaggccacguucuccagcauccacuccuuccaggaccugagcuccagcauccuggcccagagccgcgagcggguggccuccgcccgcgaggcccucgaccacaugguggaguacgucgcgcagaacacccccgugaccuggcugguggggcccuucgcccccggcaucaccgagaaggccccggaggagaagaaguga

SEQ ID NO: 34731 - RNA, 4074 nt, Artificial Sequence
  derived and/or modified sequence opt1 from PLIN4__Homo_sapiens__NP_001073869
augcagacccugggcagcuucuucgggucccuccccggcuucagcuccgcccgcaaccugguggccaacgcgcacagcuccgcccgggcccgcccggccgccgaccccaccggggcgcccgccgccgaggccgcgcagccccaggcccaggucgccgcccacccggagcagacggcccccuggaccgagaaggagcugcagcccagcgagaagcagaugguguccggcgcgaaggaccucgugugcagcaagaugucccgggccaaggacgccgucagcuccgggguggccagcguggucgacguggccaagggcgugguccagggcgggcuggacaccacccgcuccgcgcugacgggcaccaaggagguggugagcuccggggucaccggcgccauggacauggccaagggggccgugcagggcggccucgacaccagcaaggccgugcugacggggaccaaggacaccgucuccaccggccugacgggggcggugaacguggccaagggcaccguccaggccggcguggacaccaccaagacggugcucaccgggaccaaggacaccgucacgaccggcgugaugggggccgugaaccuggccaagggcaccguccagaccgggguggagacgagcaaggcgguccugaccggcaccaaggacgccguguccaccggccucacgggggccgugaacgucgcccggggcagcauccagaccgggguggacaccagcaagaccgugcugacgggcaccaaggacaccgucugcuccggggugaccggcgcgaugaacguggccaagggcacgauccagaccggggucgacaccagcaagaccgugcugaccggcacgaaggacaccgugugcuccggggucaccggcgccaugaacguggccaaggggaccauccagacgggcguggacaccagcaagaccguccucaccggcacgaaggacaccgugugcuccggggugaccggcgccaugaacgucgcgaaggggaccauccagacgggcguggacaccaccaagaccgugcugacgggcaccaagaacaccgucugcagcggggugaccggcgccgugaaccuggccaaggaggccauccagggcgggcucgacacgaccaaguccauggucauggggaccaaggacaccaugagcacgggccugaccggcgccgcgaacguggccaagggggccaugcagaccggccugaacaccacgcagaacaucgccaccgggaccaaggacaccgugugcuccggcgucacgggggccaugaaccucgcgcgcggcaccauccagaccggcguggacaccacgaagaucgugcugaccgggaccaaggacaccgucugcagcggcgugaccggggccgccaacguggccaagggcgcgguccagggcgggcuggacacgaccaaguccgugcucaccggcaccaaggacgccgugagcacggggcugaccggcgccgucaacguggccaaggggaccgugcagaccggcgucgacacgaccaagaccgugcugaccgggacgaaggacaccgugugcuccggcgucaccagcgccgugaacguggcgaagggcgccguccagggcgggcucgacaccacgaaguccguggugaucgggaccaaggacaccaugagcaccggccugacgggcgccgccaacgucgccaagggggcggugcagaccggcguggacaccgccaagaccguccugacggggaccaaggacaccgugaccacgggccucgucggggccgugaacguggccaagggcaccguccagaccggcauggacaccacgaagaccgugcugaccgggaccaaggacacgaucuacuccggcgugaccagcgccgucaacguggcgaagggggccgugcagaccggccugaagaccacccagaacaucgccacggggaccaagaacaccuucggcuccggcgucaccagcgccgugaacguggcgaagggggccgcccagacgggcgucgacaccgccaagaccgugcucaccgggacgaaggacaccgugaccaccggccugaugggggccgucaacguggcgaagggcacggugcagaccagcgucgacaccaccaagacggugcugaccggcaccaaggacaccgugugcuccggggucacgggcgccgccaacguggccaagggggccauccagggcggccucgacaccaccaagagcgugcugaccgggacgaaggacgcggucuccaccggccugaccggggccgugaagcucgccaagggcaccgugcagacggggauggacaccaccaagaccguccugacgggcaccaaggacgccgugugcagcggcgugaccggggccgcgaacgucgccaagggcgccgugcagauggggguggacaccgccaagacgguccugaccggcaccaaggacaccgugugcuccggggugacgggcgccgcgaacgucgccaagggcgccgugcagaccgggcucaagaccacccagaacaucgccaccggcacgaagaacacccuggggagcggcgugaccggggcggccaaggucgccaagggcgccgugcagggcgggcuggacaccacgaaguccgugcucaccggcaccaaggacgccgucagcaccgggcugacgggcgcggugaaccuggccaaggggaccgugcagaccggcgucgacaccuccaagacggugcucaccggcaccaaggacaccgugugcagcggggucacgggcgccgugaacguggccaaggggaccguccagaccggcguggacaccgccaagacgguccuguccggcgcgaaggacgccgugaccaccggggugaccggcgccgucaacguggccaaggggacggugcagaccggcgucgacgccagcaaggcggugcugauggggaccaaggacaccguguucuccggcgucacgggcgccaugagcauggccaagggggccgugcagggcgggcuggacaccaccaagaccgugcucacgggcaccaaggacgcggucuccgccgggcugaugggcagcggcaacguggccaccggggccacccacacgggccuguccaccuuccagaacuggcuccccagcaccccggccaccagcuggggcgggcugaccuccagccggacgaccgacaacgggggcgagcagaccgcgcugagcccccaggaggcccccuucuccggcaucuccacgcccccggacgugcucagcgucgggcccgagcccgccugggaggccgccgcgaccaccaagggccuggccaccgacguggccaccuucacgcagggggccgcccccggccgcgaggacaccgggcugcucgcgaccacccacggcccggaggaggcgccccggcuggccaugcugcagaacgagcucgagggccugggggacaucuuccaccccaugaacgccgaggagcaggcccagcuggccgccucccagcccggcccgaaggugcucagcgccgagcagggguccuacuucguccgccugggcgaccugggccccagcuuccggcagcgcgccuucgagcacgcggugucccaccuccagcacgggcaguuccaggcccgggacacgcuggcccagcugcaggacugcuuccgccucaucgagaaggcccagcaggcccccgagggccagccccggcuggaccaggggagcggcgcguccgccgaggacgccgccgugcaggaggagcgcgacgccgggguccugagccgggugugcggccuccugcgccagcugcacaccgcguacuccggccucgugagcucccugcaggggcugccggccgagcuccagcagcccgucggccgggcccgccacagccugugcgagcuguacgggaucguggccuccgccggcagcguggaggagcuccccgcggagcggcugguccagagccgcgagggggugcaccaggccuggcagggccuggagcagcuccuggagggccugcagcacaacccgccccucuccuggcugguggggcccuucgcccugcccgccggcgggcaguga

SEQ ID NO: 34732 - RNA, 1392 nt, Artificial Sequence
  derived and/or modified sequence opt1 from PLIN5__Homo_sapiens__NP_001013728
augagcgaggaggaggccgcccagaucccccgcuccagcgugugggagcaggaccagcagaacgucgugcagcggguggucgcgcugccgcucgugcgcgcgaccugcaccgccgugugcgacgucuacuccgccgccaaggaccggcacccccugcugggcagcgccugccgccucgccgagaacugcgugugcgggcugacgacccgggcccuggaccacgcccagccccuccuggagcaccuccagccccagcuggcgaccaugaacucccuggccugccgcggccuggacaagcucgaggagaagcugccguuccugcagcagcccagcgagaccguggucacguccgccaaggacgugguggccagcuccgucaccggggugguggaccucgcccggcgcggccggcgcuggagcgucgagcugaagcgguccgugagccacgcgguggacgucgugcuggagaaguccgaggagcucguggaccacuuccugcccaugaccgaggaggagcuggccgcccucgccgccgaggcggaggggcccgaggucggcagcguggaggaccagcgccggcagcagggcuacuucgugcgccuggggucccugagcgcccggauccgccaccucgccuacgagcacuccgucggcaagcugcggcagagcaagcaccgcgcccaggacacccuggcccagcuccaggagacgcuggagcugaucgaccacaugcagugcggggugaccccgaccgcgcccgccugccccggcaagguccacgagcucuggggcgagugggggcagcggcccccggagucccgccggcgcagccaggccgagcuggagacccuggugcucagccgcucccugacgcaggagcugcagggcaccguggaggcccucgagagcuccguccgggggcugcccgccggcgcgcaggagaagguggccgaggugcgccggagcgucgacgcccugcagaccgccuucgcggacgcccgcugcuuccgggacgugcccgccgccgcccucgcggaggggcgcggccggguggcccacgcccacgccugcgucgacgagcugcuggagcucguggugcaggccgucccccugccguggcuggugggccccuucgcgcccauccucguggagcgccccgagccgcugcccgaccuggccgaccucgucgacgaggugaucgggggccccgacccccggugggcccaccuggacuggccggcccagcagcgcgccugggaggcggagcaccgggacggguccggcaacggggacggcgaccgcaugggcguggccggggacaucugcgagcaggagcccgagacccccagcugccccgucaagcacacgcugaugccggagcuggacuucuga

SEQ ID NO: 34733 - RNA, 1812 nt, Artificial Sequence
  derived and/or modified sequence opt1 from PLK1__Homo_sapiens__NP_005021
augagcgccgccgugaccgcgggcaagcuggcccgcgcccccgccgacccggggaaggccggcguccccgggguggcggcccccggcgcccccgccgcggccccgcccgccaaggagauccccgaggugcucgucgacccccggucccgccggcgcuacgugcgggggcgcuuccugggcaagggcggguucgccaagugcuucgagaucagcgacgccgacaccaaggagguguucgcgggcaagaucgucccgaagucccugcuccugaagccccaccagcgggagaagaugagcauggagaucuccauccaccgcagccuggcccaccagcacguggugggguuccacggcuucuucgaggacaacgacuucgucuucguggugcucgagcugugccggcgccggucccugcucgagcugcacaagcgccggaaggcccugacggagcccgaggcccgcuacuaccuccggcagaucguccuggggugccaguaccugcaccgcaaccgggugauccaccgcgaccucaagcugggcaaccuguuccucaacgaggaccuggaggugaagaucggcgacuucgggcuggccaccaaggucgaguacgacggcgagcggaagaagacccucugcgggacccccaacuacaucgcgccggaggugcugagcaagaagggccacuccuucgagguggacgucuggagcaucggcugcaucauguacacgcugcucguggggaagccgcccuucgagaccuccugccugaaggagaccuaccugcgcaucaagaagaacgaguacagcauccccaagcacaucaaccccguggccgccucccucauccagaagaugcugcagaccgaccccacggcccggcccaccaucaacgagcugcucaacgacgaguucuucaccagcggcuacauccccgcccgccugccgaucacgugccugaccaucccgccccgcuucuccaucgcgcccagcucccucgaccccagcaaccggaagccccugaccguccugaacaaggggcucgagaacccccugcccgagcgcccgcgggagaaggaggagcccguggugcgcgagaccggcgaggucguggacugccaccuguccgacaugcuccagcagcugcacagcgucaacgccagcaagcccuccgagcgggggcuggugcgccaggaggaggccgaggacccggccugcauccccaucuucugggugagcaagugggucgacuacuccgacaaguacggccucggcuaccagcugugcgacaacagcgugggggugcuguucaacgacuccacccggcucauccuguacaacgacggcgacagccugcaguacaucgagcgcgacgggacggaguccuaccucaccgucagcucccaccccaacagccugaugaagaagaucacccugcugaaguacuuccggaacuacauguccgagcaccuccugaaggccggcgcgaacaucacgccccgcgagggggacgagcuggcccggcucccguaccugcgcaccugguuccggacccgcagcgccaucauccugcaccucuccaacggcagcgugcagaucaacuucuuccaggaccacaccaagcugauccugugcccccucauggccgcggugaccuacaucgacgagaagcgggacuuccgcacguaccggcugucccugcucgaggaguacggcugcugcaaggagcuggccagccgccugcgguacgcccgcaccauggucgacaagcuccuguccagccgcuccgccagcaaccggcugaaggccagcuga

SEQ ID NO: 34734 - RNA, 2016 nt, Artificial Sequence
  derived and/or modified sequence opt1 from PLK2__Homo_sapiens__NP_001239155
auggagcugcuccgcaccaucaccuaccagcccgccgccagcacgaagaugugcgagcaggcgcugggcaaggggugcggcgccgacuccaagaagaagcggccgccccagccgcccgaggagagccagccgccccagucccaggcccaggugccgcccgccaucagccgcaucaucgucgaccccaccaccgggaagcgguacugccgcggcaaggugcuggggaagggcggcuucgccaagugcuacgagaugaccgaccucacgaacaacaagguguacgcggccaagaucaucccccacucccgggucgccaagccccaccagcgcgagaagaucgacaaggagaucgagcugcaccggauccugcaccacaagcacguggugcaguucuaccacuacuucgaggacaaggagaacaucuacauccuccuggaguacugcagccgccgguccauggcccacauccugaaggcgcgcaagguccucaccgagcccgaggugcgguacuaccugcgccagaucgugagcgggcugaaguaccuccacgagcaggagauccugcaccgggaccugaagcucggcaacuucuucaucaacgaggccauggagcugaaggucggggacuucggccuggccgcccgccucgagccccuggagcaccggcgccggaccaucugcgggacccccaacuaccugucccccgaggugcucaacaagcagggccacggcugcgagagcgacaucugggcccuggggugcgugauguacacgaugcugcucggccggcccccguucgagaccaccaaccugaaggagaccuaccgcugcauccgcgaggcgcgguacacgaugcccuccagccugcucgcccccgccaagcaccugaucgccuccaugcugagcaagaaccccgaggaccgcccgucccucgacgacaucauccgccacgacuucuuccugcagggguucacccccgaccggcugagcuccagcugcugccacaccguccccgacuuccaccucuccagccccgccaagaacuucuucaagaaggcggccgccgcccuguucggcggcaagaaggacaaggcccgcuacaucgacacccacaaccgggugagcaaggaggacgaggacaucuacaagcugcgccacgaccucaagaagacguccaucacccagcagccgagcaagcaccggaccgacgaggagcugcagccgcccaccacgaccguggcgcgcuccgggacccccgccgucgagaacaagcagcagaucggcgacgccauccggaugaucgugcgcgggacccugggcagcugcuccagcuccagcgagugccucgaggacuccacgauggggagcguggccgacaccgucgcccgggugcugcgcggcugccuggagaacaugcccgaggcggacugcauccccaaggagcagcucuccaccagcuuccagugggugaccaagugggucgacuacuccaacaaguacggcuucggguaccagcugagcgaccacacggugggcgugcuguucaacaacggggcccacaugucccuccugcccgacaagaagaccguccacuacuacgccgagcugggccagugcagcguguucccggccaccgacgcgcccgagcaguucaucucccaggucaccgugcucaaguacuucagccacuacauggaggagaaccugauggacgggggcgaccugcccuccgugacggacauccggcgcccccggcuguaccuccugcaguggcucaagagcgacaaggcccugaugaugcuguucaacgacggcaccuuccaggucaacuucuaccacgaccacaccaagaucaucaucugcagccagaacgaggaguaccugcucaccuacaucaacgaggaccgcaucuccacgaccuuccggcugaccacccugcucaugagcgggugcuccagcgagcugaagaaccgcauggaguacgcccugaacaugcuccugcagcggugcaacuga

SEQ ID NO: 34735 - RNA, 2817 nt, Artificial Sequence
  derived and/or modified sequence opt1 from PLK4__Homo_sapiens__NP_001177728
auggcgaccugcaucggcgagaagaucgaggacuucaagguggggaaccugcucggcaaggggagcuucgccggcgucuaccgcgccgaguccauccacaccgggcuggagguggccaucaagaugcuguacaacuacuucgaggacagcaacuacguguaccucguccuggagaugugccacaacggcgagaugaaccgguaccugaagaaccgcgugaagcccuucuccgagaacgaggcccggcacuucaugcaccagaucaucacgggcaugcucuaccugcacagccacgggauccugcaccgcgaccucacccuguccaaccugcuccugacccggaacaugaacaucaagaucgccgacuucggccuggccacccagcucaagaugccgcacgagaagcacuacacgcugugcgggacccccaacuacaucagccccgagaucgcgacccgcuccgcccacggccuggagagcgacguguggucccucgggugcauguucuacacccugcugaucggccggcccccguucgacacggacaccgucaagaacacccucaacaagguggugcuggccgacuacgagaugcccagcuuccuguccaucgaggccaaggaccucauccaccagcugcugcgccggaaccccgcggaccgccucagccuguccagcguccuggaccaccccuucaugucccggaacagcuccaccaagagcaaggaccucggcacgguggaggacuccaucgacagcgggcacgccaccaucagcaccgccaucaccgccuccagcuccacgagcaucuccggcagccuguucgacaagcgccggcugcucaucgggcagccgcugcccaacaagaugaccguguuccccaagaacaaguccagcaccgacuucuccagcuccggcgacggcaacagcuucuacacccagugggggaaccaggagacguccaacagcggccgcgggcgggucauccaggacgccgaggagcgcccccacucccgguaccugcgccgggcguacagcuccgaccgcagcggcaccuccaacagccagagccaggccaagaccuacaccauggagcggugccacuccgccgagaugcucagcguguccaagcgcagcgggggcggcgagaacgaggagcgcuacuccccgacggacaacaacgccaacaucuucaacuucuucaaggagaagaccagcuccagcuccgggagcuucgagcggcccgacaacaaccaggcccuguccaaccaccugugccccggcaagacccccuucccguucgcggaccccacgccccagaccgagaccgugcagcagugguucgggaaccuccagaucaacgcccaccuccgcaagaccaccgaguacgacagcaucucccccaaccgggacuuccagggccacccggaccugcagaaggacacgagcaagaacgccuggaccgacaccaaggucaagaagaacuccgacgccagcgacaacgcccacuccgugaagcagcagaacaccaugaaguacaugacggcgcugcacagcaagcccgagaucauccagcaggagugcguguucgggagcgacccccuguccgagcagagcaagacccgcggcauggagcccccguggggcuaccagaaccggacccugcgcuccaucaccagcccccucgucgcccaccggcugaagcccauccgccagaagaccaagaaggccgugguguccauccuggacagcgaggaggucugcguggagcucgugaaggaguacgccucccaggaguacgucaaggaggugcugcagaucagcuccgacgggaacacgaucaccaucuacuaccccaacggcgggcggggcuucccgcuggccgaccgcccgcccagccccaccgacaacaucucccgguacagcuucgacaaccugcccgagaaguacuggcgcaaguaccaguacgcgucccgguucguccagcucgugcgcagcaagucccccaagaucaccuacuucacgcgguacgccaagugcauccugauggagaacagccccggggccgacuucgaggugugguucuacgacggcgucaagauccacaagaccgaggacuucauccaggugaucgagaagaccggcaaguccuacacccucaagagcgaguccgaggugaacagccugaaggaggagaucaagauguacauggaccacgccaacgaggggcaccgcaucugccuggcgcuggagagcaucaucuccgaggaggagcggaagacgcgcagcgccccguucuuccccaucaucaucggccggaagcccggguccaccagcucccccaaggcccucagcccgccgcccuccgucgacagcaacuaccccacccgcgagcgcgccuccuucaaccggauggugaugcacagcgccgcgucccccacccaggcccccauccugaaccccagcauggugacgaacgagggccugggccucaccaccaccgccuccgggacggacaucagcuccaacagccugaaggacugccugcccaaguccgcccagcuccucaagagcgucuucgugaagaacgugggcugggccacccagcugaccuccggggcggucugggugcaguucaacgacggcagccagcuggugguccaggccggggugagcuccaucagcuacaccuccccgaacggccagacgacccgcuacggcgagaacgagaagcugcccgacuacaucaagcagaagcugcagugccucagcuccauccugcugauguucagcaaccccacccccaacuuccacuga

SEQ ID NO: 34736 - RNA, 1011 nt, Artificial Sequence
  derived and/or modified sequence opt1 from PLK5__Homo_sapiens__NP_001230008
auguacaccgugcugaccggcacgcccccguucauggccagcccccucuccgagauguaccagaacauccgcgaggggcacuaccccgagcccgcccaccugagcgcgaacgcccggcgccugaucguccaccuccuggccccgaaccccgccgagcggcccucccuggaccaccuccugcaggacgacuucuucacccagggcuucacccccgaccgccugccggcccacagcugccacuccccgcccaucuucgcgaucccgccgccccucgggcggaucuuccgcaaggugggccagcggcugcugacccagugccgcccgcccugccccuucacgcccaaggaggccagcgggcccggcgagggcgggcccgaccccgacuccauggagugggacggcgagagcucccucagcgccaaggaggugcccugccuggaggggcccauccaccuggucgcccagggcacccuccaguccgaccuggcggggcccgagggcagccggcgccccgagguggaggccgcccugcggcaccuccagcugugccuggacgugggcccgcccgccacccaggacccccucggggagcagcagcccauccugugggcccccaagugggucgacuacuccagcaaguacggcuucggguaccagcugcucgacggcggccgcaccgggcggcacccccacggcccggcgacgccccgccgggaggggacccugcccacccccgugccgcccgccggccccgggcugugccuccugcgcuuccuggccuccgagcacgcccuccugcuccuguucagcaacggcauggugcaggucuccuucagcggcgugcccgcccagcuggugcuguccggggagggcgaggggcuccagcugacccugugggagcagggcagcccggggacgagcuacucccucgacgucccccggagccacggcugcgcgcccaccaccggccagcaccuccaccacgcccugcgcaugcugcaguccaucuga

SEQ ID NO: 34737 - RNA, 549 nt, Artificial Sequence
  derived and/or modified sequence opt1 from PLLP__Homo_sapiens__NP_057077
auggccgaguuccccagcaagguguccacccgcaccagcuccccggcccagggcgcggaggccagcgucuccgcccugcggcccgaccucggguucgugcgcagccggcugggcgcccugaugcuccugcagcuggugcucgggcugcuggucugggcccucaucgcggacacgcccuaccaccuguaccccgccuacggcugggugauguucguggccgucuuccuguggcucgugaccaucgugcuguucaaccuguaccucuuccagcugcacaugaagcuguacauggucccguggccccucgugcugaugaucuucaacaucuccgccaccgugcuguacaucaccgcguucaucgccugcagcgccgccgucgaccucacgucccugcgcgggacccggcccuacaaccagcgcgccgcggccagcuucuucgccugccuggugaugaucgccuacggcguguccgccuucuucagcuaccaggcguggcggggcgucggguccaacgccgccaccagccagauggccggcggguacgccuga

SEQ ID NO: 34738 - RNA, 159 nt, Artificial Sequence
  derived and/or modified sequence opt1 from PLN__Homo_sapiens__NP_002658
auggagaaggugcaguaccugacccgcagcgccauccggcgcgccuccaccaucgagaugccccagcaggcgcggcagaagcuccagaaccuguucaucaacuucugccugauccucaucugccugcugcucaucugcaucaucgucaugcugcuguga

SEQ ID NO: 34739 - RNA, 2214 nt, Artificial Sequence
  derived and/or modified sequence opt1 from PLOD2__Homo_sapiens__NP_000926
augggcgggugcaccgugaagccccagcugcuccugcuggcccucguccugcacccguggaaccccugccugggcgccgacagcgagaagcccuccagcauccccaccgacaagcuccuggugaucacgguggcgaccaaggaguccgacggguuccaccgcuucaugcagagcgccaaguacuucaacuacaccgucaaggugcugggccagggggaggaguggcggggcggcgacgggaucaacuccaucggcgggggccagaaggugcgccucaugaaggaggucauggagcacuacgccgaccaggacgaccugguggugauguucaccgagugcuucgacgucaucuucgccgggggcccggaggaggugcugaagaaguuccagaaggccaaccacaagguggucuucgcggccgacggcauccucuggcccgacaagcggcuggccgacaaguaccccguggugcacaucgggaagcgcuaccugaacagcggcggguucaucggcuacgcccccuacgucaaccggaucgugcagcaguggaaccuccaggacaacgacgacgaccagcuguucuacacgaagguguacaucgacccgcugaagcgcgaggcgaucaacaucacccucgaccacaagugcaagaucuuccagacccugaacggcgccgucgacgagguggugcugaaguucgagaacgggaaggcccgggccaagaacaccuucuacgagacgcuccccgucgccaucaacggcaacgggcccaccaagauccugcugaacuacuucggcaacuacgugcccaacuccuggacccaggacaacgggugcacccucugcgaguucgacacgguggaccugagcgcggucgacgugcacccgaacgucuccaucggcguguucaucgagcagcccacccccuuccugccccgcuuccucgacauccugcugacccucgacuacccgaaggaggcccugaagcuguucauccacaacaaggagguguaccacgagaaggacaucaaggucuucuucgacaaggccaagcacgagaucaagaccaucaagaucgugggccccgaggagaaccucagccaggccgaggcccggaacauggggauggacuucugccgccaggacgagaagugcgacuacuacuucuccguggacgcggacgucgugcugacgaacccccggacccugaagauccucaucgagcagaaccgcaagaucaucgcgccccuggugacccggcacggcaagcuguggagcaacuucuggggcgcccucuccccggacggguacuacgcccgcagcgaggacuacgucgacaucgugcaggggaaccgggugggcgucuggaacgugcccuacauggccaacguguaccugaucaagggcaagacccugcgcuccgagaugaacgagcggaacuacuucguccgcgacaagcucgaccccgacauggcccugugccggaacgcccgcgagauggggguguucauguacaucagcaaccggcacgaguucggccgccugcucuccacggccaacuacaacaccagccacuacaacaacgaccuguggcagaucuucgagaaccccguggacuggaaggagaaguacaucaaccgcgacuacuccaagaucuucaccgagaacaucgucgagcagccgugccccgacguguucugguuccccaucuucagcgagaaggccugcgacgagcugguggaggagauggagcacuacgggaaguggagcggcgggaagcaccacgacucccggaucagcggcggcuacgagaacguccccaccgacgacauccacaugaagcaggucgaccucgagaacguguggcugcacuucauccgcgaguucaucgccccggugacgcugaagguguucgcgggguacuacaccaagggcuucgcccugcucaacuucguggucaaguacucccccgagcggcagcgcagccugcggccccaccacgacgccuccaccuucaccaucaacaucgcccugaacaacgugggggaggacuuccagggcggcgggugcaaguuccuccgcuacaacugcagcaucgaguccccgcggaagggcuggagcuucaugcaccccgggcgccugacgcaccuccacgagggccugcccgugaagaacgggacccgguacaucgcggucuccuucaucgaccccuga

SEQ ID NO: 34740 - RNA, 834 nt, Artificial Sequence
  derived and/or modified sequence opt1 from PLP1__Homo_sapiens__NP_000524
augggccugcucgagugcugcgcccgcugccuggugggggcccccuucgcgagccuggucgccaccggccucugcuucuucgggguggcccuguucugcggcugcgggcacgaggcccugaccggcacggagaagcucaucgagaccuacuucuccaagaacuaccaggacuacgaguaccugaucaacgugauccacgccuuccaguacgucaucuacggcaccgcgagcuucuucuuccuguacggggcccuccugcuggccgagggcuucuacaccacgggggccgugcggcagaucuucggcgacuacaagaccaccaucugcgggaagggccucuccgcgaccgugacgggcgggcagaagggccgcgggagccggggccagcaccaggcccacucccuggagcgcgucugccacugccugggcaaguggcucgggcacccggacaaguucgugggcaucaccuacgcccugaccguggucuggcugcucguguucgccugcagcgccgugcccgucuacaucuacuucaacaccuggacgaccugccaguccaucgcguuccccagcaagaccuccgccagcaucgggucccugugcgccgacgcccggauguacggcgugcugcccuggaacgccuucccggggaaggugugcggcagcaaccuccuguccaucugcaagaccgcggaguuccagaugacguuccaccuguucaucgccgccuucgucggcgccgccgcgacccucgugagccugcugaccuucaugaucgccgccaccuacaacuucgccgugcucaagcugauggggcgcggcacgaaguucuga

SEQ ID NO: 34741 - RNA, 459 nt, Artificial Sequence
  derived and/or modified sequence opt1 from PLP2__Homo_sapiens__NP_002659
auggccgacagcgagcgccuguccgcccccggcugcugggcggccugcaccaacuucagccggacccgcaaggggauccuccuguucgccgagaucauccugugccucgugauccugaucugcuucuccgccagcacgccgggcuacuccagccuguccgucaucgagaugauccucgccgcgaucuucuucgugguguacaugugcgaccugcacaccaagauccccuucaucaacuggcccuggagcgacuucuuccggacccugaucgccgccauccucuaccugaucaccuccaucgucgugcugguggagcgcgggaaccacagcaagaucgucgccggcgugcucgggcugaucgcgacgugccuguucggcuacgacgccuacgugaccuuccccguccggcagccgcgccacaccgccgcccccaccgaccccgccgacggccccguguga

SEQ ID NO: 34742 - RNA, 1518 nt, Artificial Sequence
  derived and/or modified sequence opt1 from PLRG1__Homo_sapiens__NP_001188493
augguggaggagguccagaagcacagcgugcacacccugguguuccgcucccucaagcggacccacgacauguucgucgccgacaacggcaagcccgugccgcuggacgaggagagccacaagcgcaagauggccaucaagcugcggaacgaguacgggcccgugcuccacaugcccacguccaaggagaaccugaaggagaagggcccccagaacgcgaccgacagcuacguccacaagcaguacccggccaaccaggggcaggagguggaguacuucguggccggcgucgcccugaccgccgacaccaagauccagcgcaugcccuccgagagcgcggcccagucccucgccguggcccugccccugcagacgaaggcggacgccaaccggaccgcccccagcggguccgaguaccgccacccgggcgccagcgaccggccccagcccaccgccaugaacuccaucgugauggagaccggcaacacgaagaacagcgcgcucauggccaagaaggcccccaccaugccgaagccccaguggcacccgcccuggaagcuguaccgcgucaucuccgggcaccugggcugggugcggugcaucgccguggagcccgggaaccagugguucgucaccggcagcgccgaccgcaccaucaagaucugggaccucgcguccgggaagcugaagcugagccucacgggccacaucuccaccgugcggggcgugaucgucagcacccgcucccccuaccuguucagcugcggggaggacaagcaggucaagugcugggaccuggaguacaacaaggugauccggcacuaccacggccaccucagcgccguguacgggcuggaccugcaccccaccaucgacgugcucgugacgugcucccgcgacagcaccgcccggaucugggacguccgcaccaaggccuccgugcacacccugagcggccacacgaacgccgucgcgaccgugcggugccaggccgccgagccccagaucaucaccggcucccacgacaccacgauccgccugugggaccucguggccgggaagacccgggucacccugaccaaccacaagaaguccgugcgcgccgugguccugcacccgcggcacuacacguucgcgagcggcagccccgacaacaucaagcaguggaaguuccccgacggguccuucauccagaaccucagcggccacaacgccaucaucaacacccugaccgugaacuccgacggggugcuggucagcggcgccgacaacggcaccaugcaccucugggacuggcgcacgggguacaacuuccagcgcgugcacgccgcggugcagcccggcucccuggacagcgaguccgggaucuucgccugcgccuucgaccagagcgagucccggcugcucaccgccgaggccgacaagaccaucaaggucuaccgcgaggacgacaccgcgacggaggagacccacccggugagcuggaagcccgagaucaucaagcggaagcgcuucuga

SEQ ID NO: 34743 - RNA, 1890 nt, Artificial Sequence
  derived and/or modified sequence opt1 from PLS1__Homo_sapiens__NP_001138791
auggagaacagcaccaccacgaucucccgcgaggagcuggaggagcuccaggaggccuucaacaagaucgacaucgacaacagcggcuacguguccgacuacgagcugcaggaccuguucaaggaggccagccucccccugccgggguacaagguccgggagaucguggagaagauccuguccguggcggacagcaacaaggacggcaagaucuccuucgaggaguucgucagccucaugcaggagcugaaguccaaggacaucagcaagaccuuccgcaagaucaucaacaagcgggaggggaucaccgccaucggcgggaccuccacgaucagcuccgagggcacccagcacagcuacuccgaggaggagaagguggccuucgugaacuggaucaacaaggcccuggagaacgaccccgacugcaagcaccucauccccaugaaccccaacgacgacagccuguucaagucccuggccgacggcauccuccugugcaagaugaucaaccugagcgagccggacaccaucgacgagcgcgcgaucaacaagaagaagcucacccccuucacgaucuccgagaaccugaaccuggcccucaacagcgccagcgccaucgggugcaccgucgugaacaucggcgcguccgaccugaaggaggggaagccccaccuggugcucggccugcuguggcagaucaucaaggucgggcuguucgccgacaucgagaucagccggaacgaggcccugaucgcccugcucaacgagggcgaggagcuggaggagcugaugaagcucucccccgaggagcugcugcuccgcugggugaacuaccaccugaccaacgccggcuggcacaccaucagcaacuucucccaggacaucaaggacagccgggcguacuuccaccuccucaaccagaucgccccgaagggcggggaggacgggcccgccaucgccaucgaccuguccggcaucaacgagacgaacgaccugaagcgcgccggccucaugcugcaggaggcggacaagcuggggugcaagcaguucgugacccccgccgacgucgugagcggcaaccccaagcucaaccuggccuucguggccaaccuguucaacaccuacccgugccuccacaagcccaacaacaacgacaucgacaugaaccugcuggagggggaguccaaggaggagcggaccuuccgcaacuggaugaacagccucggcgucaaccccuacaucaaccaccuguacuccgaccuggccgacgcgcuggugaucuuccagcucuacgagaugauccgggugcccgucaacuggagccacgugaacaagccgcccuaccccgcccucgggggcaacaugaagaagaucgagaacugcaacuacgccguggagcugggcaagaacaaggccaaguucucccuggucgggaucgccggccaggaccugaacgaggggaacagcacgcugacccucgcgcugguguggcagcugaugcgccgguacacccucaacgugcuguccgaccugggcgagggggagaaggucaacgacgagaucaucaucaagugggugaaccagacccucaagagcgccaacaagaagacguccaucagcuccuucaaggacaagagcaucagcaccucccugcccguccuggaccucaucgacgccaucgccccgaacgcggugcgccaggagaugauccggcgcgagaaccugagcgacgaggacaagcugaacaacgccaaguacgccaucuccguggcccggaagaucggcgcccgcaucuacgcgcuccccgacgaccuggucgaggugaagcccaagauggugaugaccgucuucgccugccugaugggcaaggggcucaaccggaucaaguga

SEQ ID NO: 34744 - RNA, 1854 nt, Artificial Sequence
  derived and/or modified sequence opt1 from PLS3__Homo_sapiens__NP_001269266
auggaggaccugaacagcaacggcuucaucugcgacuacgagcuccacgagcuguucaaggaggccaacaugccccugccgggguacaaggugcgcgagaucauccagaagcucaugcuggacggcgaccggaacaaggacgggaagaucuccuucgacgaguucgucuacaucuuccaggaggucaagagcuccgacaucgccaagaccuuccgcaaggcgaucaaccggaaggagggcaucugcgcccucgggggcaccagcgagcuguccagcgagggcacgcagcacuccuacagcgaggaggagaaguacgccuucgugaacuggaucaacaaggcccuggagaacgaccccgacugccgccacgugauccccaugaaccccaacaccgacgaccuguucaaggccgugggggacggcaucgugcucugcaagaugaucaaccuguccgucccggacaccaucgacgagcgggcgaucaacaagaagaagcugacccccuucaucauccaggagaaccucaaccuggcccugaacagcgccuccgccaucgggugccacguggugaacaucggcgcggaggaccuccgcgccgggaagccccaccugguccugggccuccuguggcagaucaucaagaucggccuguucgccgacaucgagcucagccggaacgaggcccuggccgcgcugcuccgcgacggggagacgcuggaggagcugaugaagcucucccccgaggagcugcugcuccggugggccaacuuccaccuggagaacagcggcuggcagaagaucaacaacuucuccgccgacaucaagcugaucgacuucagcaacuccgugaaggacagcaaggccuacuuccaccuccugaaccagaucgccccgaaggggcagaaggagggcgagccccgcaucgacaucaacauguccggcuucaacgagaccgacgaccugaagcgggcggagagcaugcuccagcaggccgacaagcuggggugccgccaguucgugacccccgccgacgucgugagcggcaaccccaagcugaaccucgccuucguggccaaccuguucaacaaguacccggcgcugaccaagcccgagaaccaggacaucgacuggacgcuccuggagggggagacccgggaggagcgcaccuuccggaacuggaugaacucccugggcgucaacccccacgugaaccaccucuacgccgaccugcaggacgcccuggugauccuccagcuguacgagcgcaucaagguccccguggacuggagcaaggugaacaagccgcccuaccccaagcugggggccaacaugaagaagcuggagaacugcaacuacgccgucgagcucggcaagcaccccgcgaaguucucccuggugggcaucgggggccaggaccugaacgacgggaaccagacccucacgcuggcccugguguggcagcucaugcggcgcuacacccugaacguccuggaggaccucggcgacgggcagaaggccaacgacgacaucaucgugaacugggucaaccggacccugagcgaggccggcaaguccaccagcauccaguccuucaaggacaagacgaucagcuccagccuggcggugguggaccucaucgacgccauccagccgggcugcaucaacuacgaccuggucaaguccgggaaccugaccgaggacgacaagcacaacaacgccaaguacgccgugagcauggcccgccggaucggcgcgcgcguguacgcccuccccgaggaccuggucgaggugaagcccaagauggugaugaccgucuucgccugccugauggggcgcggcaugaagcggguguga

SEQ ID NO: 34745 - RNA, 957 nt, Artificial Sequence
  derived and/or modified sequence opt1 from PLSCR1__Homo_sapiens__NP_066928
auggacaagcagaacagccagaugaacgccucccaccccgagaccaaccugccggugggcuacccgccccaguacccgcccaccgccuuccaggggccgcccggcuacagcggguaccccggcccccaggucuccuacccgcccccgcccgcggggcacagcggccccggccccgccggguuccccgugcccaaccagcccguguacaaccagcccgucuacaaccagcccgugggcgccgccggggugcccuggaugcccgcgccccagcccccgcucaacugcccgcccggccuggaguaccugucccagaucgaccagauccucauccaccagcagaucgagcugcuggagguccucacgggguucgagaccaacaacaaguacgagaucaagaacagcuucggccagcgcguguacuucgccgccgaggacaccgacugcugcacccggaacugcugcggccccagccgccccuucacgcugcggaucaucgacaacauggggcaggaggugaucacccuggagcgcccccuccggugcagcuccugcugcugccccugcugccugcaggagaucgagauccaggccccgcccggcguccccaucggguacgugauccagaccuggcaccccugccugccgaaguucaccauccagaacgagaagcgcgaggacgugcucaagaucagcggccccugcgucgugugcuccugcugcggcgacguggacuucgagaucaagagccuggacgagcagugcgucguggggaagaucuccaagcacuggacgggcauccugcgggaggccuucaccgacgcggacaacuucgggauccaguucccccucgaccuggacgugaagaugaaggccgucaugaucggcgccugcuuccugaucgacuucauguucuucgagagcaccgggucccaggagcagaaguccggcgugugguga

SEQ ID NO: 34746 - RNA, 888 nt, Artificial Sequence
  derived and/or modified sequence opt1 from PLSCR3__Homo_sapiens__NP_065093
auggccggcuaccugcccccgaagggguacgcccccagcccgccgccgcccuaccccgugacccccggcuaccccgagcccgcgcuccaccccgggcccggccaggcccccguccccgcccaggugcccgcccccgccccgggguucgcgcuguuccccucccccggccccguggcccugggcagcgccgccccguuccucccccugcccgggguccccuccggccuggaguuccucgugcagaucgaccagauccugauccaccagaaggcggagcgcguggagaccuuccuggggugggagacgugcaaccgguacgagcuccgcagcggcgccgggcagccgcugggccaggccgccgaggaguccaacugcugcgcccggcugugcugcggcgcgcgccggccccuccgcguccggcuggccgaccccggggaccgcgaggugcugcggcuccugcgcccccugcacugcggcugcagcugcugcccgugcgggcuccaggagauggaggugcaggccccgcccggcaccaccaucggccacguccugcagaccuggcaccccuuccugcccaaguucuccauccaggacgccgaccggcagacggugcuccgcguggucgggcccugcuggaccugcggcugcgggaccgacaccaacuucgaggugaagacgcgggacgagagccgcuccgugggccggaucagcaagcaguggggcgggcugguccgcgaggcccugaccgacgcggacgacuucggccuccaguucccccuggaccuggacgugcgggugaaggccguccuccugggggccaccuuccugaucgacuacauguucuucgagaagcgcggcggggccggcccguccgccgugaccagcuga

SEQ ID NO: 34747 - RNA, 720 nt, Artificial Sequence
  derived and/or modified sequence opt1 from PLSCR4__Homo_sapiens__NP_001121778
augagcggcgugguccccaccgccccggagcagcccgccggggagauggagaaccagaccaagccgcccgacccccgccccgacgcgccgcccgaguacaacucccacuuccugcccggcccgcccgggacggccgugcccccgcccaccggcuaccccgggggccuccccaugggcuacuacagcccccagcagcccuccaccuucccccuguaccagcccgucgggggcauccacccggugcgguaccagcccgggaaguaccccaugcccaaccagagcgugccgaucaccuggaugcccggccccacgcccauggccaacugcccgcccgggcuggaguaccucgugcagcuggagguccagugcccgcccggcgugaccaucggcuucguggccgagcacuggaaccugugccgcgccgucuacuccauccagaacgagaagaaggagaacgugaugcgggugcgcgggcccugcagcaccuacggcugcggguccgacagcgucuucgaggugaagucccucgacggcaucagcaacaucggcuccaucauccggaaguggaacgggcugcugagcgcgauggccgacgccgaccacuucgacauccacuucccccucgaccuggacgugaagaugaaggccaugaucuucggcgcgugcuuccugaucgacuucauguacuucgagcgcagcccgccccagcggucccgcuga

SEQ ID NO: 34748 - RNA, 816 nt, Artificial Sequence
  derived and/or modified sequence opt1 from PLSCR5__Homo_sapiens__NP_001078889
auggccagcaaggacgcccagaaccagcgccggggccugcccggguuccucccgggcgcgcccgaccccgaccagucccugcccgccagcuccaacccggggaaccaggccuggcagcugagccucccccugcccuccagcuuccugcccaccgugucccucccgcccggccuggaguaccugagccagcucgaccugaucaucauccaccagcaggucgagcugcucgggaugauccugggcaccgagacguccaacaaguacgagaucaagaacagccugggccagcgcaucuacuucgccguggaggaguccaucugcuucaaccggaccuucugcagcacccuccgcuccugcacccugcggaucacggacaacagcgggcgcgaggugaucaccgucaaccggccccugcgcugcaacuccugcuggugccccugcuaccuccaggagcuggagauccaggccccgcccggcaccaucgugggguacgugacccagaagugggaccccuuccugcccaaguucacgauccagaacgcgaacaaggaggacauccucaagaucgucggcccgugcgugaccugcgggugcuucggcgacguggacuucgaggucaagaccaucaacgagaagcugaccaucggcaagaucagcaaguacugguccggguucgugaacgacguguucacgaacgccgacaacuucggcauccacguccccgccgaccuggacgugaccgugaaggccgcgaugaucggggccugcuuccucuucgacuucauguucuucgagcacagccuggccggccuguga

SEQ ID NO: 34749 - RNA, 1197 nt, Artificial Sequence
  derived and/or modified sequence opt1 from PLTP__Homo_sapiens__NP_001229849
auggcccuguucggcgcccucuuccuggcgcugcucgccggggcccacgccgaguuccccggcugcaagauccgcgugaccagcaaggcccuggagcuggucaagcaggaggggcuccgguuccuggagcaggagcuggagaccaucacgaucccggaccuccgcggcaaggaggggcacuucuacuacaacaucuccgagaagguguacgacuuccugagcaccuucaucaccuccggcaugcgguuccugcucaaccagcagaucugccccgugcuguaccacgcgggcaccguccugcucaacagccugcuggacacggugcccgugcgcuccagcgucgacgagcucguggggaucgacuacucccugaugaaggaccccguggccagcaccuccaaccuggacauggacuuccggggcgccuucuucccgcucaccgagcgcaacuggagccugcccaaccgggccgucgagccccagcugcaggaggaggagcgcaugguguacguggcguucuccgaguucuucuucgacagcgccauggaguccuacuuccgggccggggcccuccagcugcugcucgucggcgacaaggugccccacgaccuggacaugcugcuccgcgccaccuacuucgggagcaucgugcugcuguccccggcggucaucgacagcccccucaagcuggagcugcgggugcucgccccgccccgcugcacgaucaagcccuccggcaccaccaucagcgugaccgccuccgucacgaucgcccuggugccgcccgaccagcccgaggugcagcugagcagcaugaccauggacgcccggcucuccgcgaagauggcccugcgcggcaaggcccugcggacccagcucgaccugcgccgguuccgcaucuacagcaaccacuccgcccuggagagccucgcccugaucccccugcaggcgccccucaagaccaugcugcagaucggggucaugcccaugcugaacgagcggacguggcgcggcgugcagaucccccugccggaggggaucaacuucgugcacgaggucgugaccaaccacgccggcuuccucaccaucggcgccgaccugcacuucgccaaggggcugcgggaggucaucgagaagaaccgccccgccgacgugcgcgcguccaccgcccccacgcccagcaccgccgccguguga

SEQ ID NO: 34750 - RNA, 1329 nt, Artificial Sequence
  derived and/or modified sequence opt1 from PLVAP__Homo_sapiens__NP_112600
augggccuggccauggagcacgggggcagcuacgcccgcgccgggggcuccagccgggggugcugguacuaccuccgcuacuucuuccuguucgugucccugauccaguuccucaucauccugggccugguccucuucaugguguacggcaacgugcacgucagcaccgaguccaaccugcaggcgaccgagcggcgcgccgaggggcuguacagccagcuccugggccugaccgccucccagagcaaccucaccaaggagcugaacuucaccacccgggccaaggacgcgaucaugcagauguggcugaacgcccgccgggaccucgaccgcaucaacgccuccuuccggcagugccagggggaccgcgugaucuacacgaacaaccagcgguacauggccgcgaucauccugagcgagaagcagugccgcgaccaguucaaggacaugaacaaguccugcgacgcccuccuguucaugcugaaccagaaggugaagacccuggaggucgagaucgccaaggagaagaccaucugcaccaaggacaaggagagcgugcuccugaacaagcggguggccgaggagcagcuggucgagugcgugaagacgcgcgagcuccagcaccaggagcggcagcuggccaaggagcagcugcagaaggugcaggcgcucugccugccccuggacaaggacaaguucgagauggaccuccgcaaccuguggcgggacuccaucaucccgcgcagccuggacaaccucggcuacaaccuguaccacccccugggguccgagcucgccagcauccggcgcgccugcgaccacaugcccucccugaugagcuccaaggucgaggagcuggcccggagccuccgcgccgacaucgagcgcguggcgcgggagaacagcgaccugcagcgccagaagcuggaggcccagcagggccuccgggccucccaggaggccaagcagaagguggagaaggaggcccaggcgcgcgaggccaagcugcaggccgagugcagccggcagacccagcuggcccucgaggagaaggccguccugcgcaaggagcgggacaaccuggcgaaggagcucgaggagaagaagcgcgaggccgagcagcugcggauggagcuggccauccgcaacuccgcccuggacacgugcaucaagaccaagagccagcccaugaugccggugucccggcccaugggccccgugcccaacccgcagcccaucgaccccgcgagccucgaggaguucaagcgcaagauccuggagucccagcggcccccggccgggauccccgucgcccccagcuccggcuga

SEQ ID NO: 34751 - RNA, 1503 nt, Artificial Sequence
  derived and/or modified sequence opt1 from PLXDC1__Homo_sapiens__NP_065138
augcgcggcgagcuguggcuccuggugcugguccuccgggaggccgcccgcgcgcugagcccccagccgggggccggccacgacgaggggcccggcuccgggugggccgccaagggcaccgugcggggcuggaaccgccgggcccgcgagagccccgggcacguguccgagcccgaccggacccagcugagccaggaccucggcgggggcacgcuggcgauggacacccugccggacaaccgcacccgggucguggaggacaaccacuccuacuacgugagccgccucuacgggcccuccgagccccacagccgggagcugugggucgacguggccgaggccaaccgcucccaggugaagauccacaccauccugagcaacacgcaccggcaggccucccgcgucgugcucagcuucgacuuccccuucuacggccacccgcugcggcagaucaccaucgcgaccggcggguucaucuucaugggcgacgugauccaccgcaugcugaccgccacgcaguacgucgcgccccucauggccaacuucaaccccggguacuccgacaacagcaccgugguguacuucgacaacggcaccgucuucguggugcagugggaccacgucuaccugcagggcugggaggacaagggguccuucaccuuccaggccgcccugcaccacgacggccggaucguguucgccuacaaggagauccccaugagcgugccggagaucuccagcucccagcaccccgucaagacggggcucagcgacgccuucaugauccugaaccccagccccgacgugccggagucccgccggcgcagcaucuucgaguaccaccggaucgagcuggaccccuccaaggugaccagcauguccgccgucgaguucacgccccucccgaccugccugcagcaccgcagcugcgacgccugcauguccagcgaccugaccuucaacugcuccuggugccacgugcuccagcgcugcagcuccggcuucgaccgguaccgccaggaguggauggacuacgggugcgcgcaggaggccgagggccggaugugcgaggacuuccaggacgaggaccacgacagcgccucccccgacaccagcuucucccccuacgacggcgaccugaccaccacgagcuccagccuguucaucgacucccucaccaccgaggacgacaccaagcugaaccccuacgccgggggcgacgggcugcagaacaaccucagccccaagacgaagggcaccccgguccaccuggggaccaucgugggcaucgugcuggccguccuccugguggcggccaucauccuggccggcaucuacaucaacgggcaccccaccagcaacgccgcccucuucuucaucgagcgccggccccaccacuggcccgcgaugaaguuccgcucccacccggaccacagcacguacgccgagguggagcccuccggccacgagaaggagggguucauggaggccgagcagugcuga

SEQ ID NO: 34752 - RNA, 1443 nt, Artificial Sequence
  derived and/or modified sequence opt1 from PLXDC2__Homo_sapiens__NP_001269665
auggcccgcuuccccaaggccgaccuggcggccgccggcgugaugcuccugugccacuucuucaccgaccaguuccaguucgccgacgggaagccgggcgaccagauccuggacuggcaguacggggucacccaggccuucccccacacggaggaggagguggagguggacagccacgcguacucccaccgguggaagcgcaaccucgacuuccugaaggccgucgacaccaaccgggccagcgugggccaggacucccccgagccccgcagcuucaccgaccugcuccuggacgacgggcaggacaacaacacccagaucgagcgggugaaccuguccuucgacuucccguucuacggccacuuccuccgcgagaucacggucgccaccggcggguucaucuacaccggcgagguggugcaccggaugcugaccgcgacgcaguacaucgcgccccugauggccaacuucgaccccagcgucucccgcaacagcaccgugcgguacuucgacaacgggaccgcccucgugguccagugggaccacgugcaccuccaggacaacuacaaccugggcuccuucaccuuccaggccacgcugcugauggacgggcgcaucaucuucggcuacaaggagauccccgugcuggucacccagaucagcuccaccaaccacccggugaaggugggccucagcgacgccuucgucguggugcaccggauccagcagauccccaacguccgccggcgcaccaucuacgaguaccaccggguggagcugcagauguccaagaucacgaacaucagcgccguggagaugacgccccugccgaccugccuccaguucaaccgcugcgggcccugcgucuccagccagaucggcuucaacugcuccuggugcagcaagcugcagcggugcuccagcggguucgaccgccaccggcaggacuggguggacagcggcugccccgaggaguccaaggagaagaugugcgagaacaccgagcccgucgagaccagcucccgcaccaccaccacggugggcgccaccaccacccaguuccgggugcugacgaccacccgccgcgccgucaccagccaguuccccacgucccucccgaccgaggacgacaccaagaucgcccugcaccugaaggacaacggggcgagcaccgacgacuccgccgccgagaagaagggcgggacgcuccacgccggccugaucaucgggauccugauccucgugcugaucguggccaccgcgauccuggucaccguguacauguaccaccaccccaccagcgccgccuccaucuucuucaucgagcggcgccccagccgguggcccgccaugaaguuccgccggggcuccggccacccggccuacgcggagguggagcccgucggggagaaggagggcuucaucgugagcgagcagugcuga

SEQ ID NO: 34753 - RNA, 5691 nt, Artificial Sequence
  derived and/or modified sequence opt1 from PLXNA1__Homo_sapiens__NP_115618
augccccugccgccccgcagccuccaggugcugcugcuccugcugcuccugcugcuccugcugcccggcaugugggccgaggccgggcucccccgggcgggcgggggcagccagccgcccuuccgcaccuucagcgccuccgacugggggcugacccaccugguggugcacgagcagaccggcgagguguacgugggcgccgugaaccggaucuacaagcucagcgggaaccugacccugcuccgcgcccacgugaccggccccgucgaggacaacgagaagugcuacccgccgcccuccgugcagagcugcccccacgggcugggcuccaccgacaacgugaacaagcugcuccugcuggacuacgccgcgaaccggcuccuggccugcgggagcgccucccagggcaucugccaguuccugcgccucgacgaccuguucaagcugggcgagccccaccaccggaaggagcacuaccucagcuccguccaggaggccgggagcauggcgggcgugcugaucgccgggccgcccggccagggccaggccaagcuguucguggggacgcccaucgacggcaaguccgaguacuuccccacccucagcucccgccggcugauggccaacgaggaggacgccgacauguucggguucgucuaccaggacgaguucgugagcucccagcugaagauccccagcgacacccucuccaaguuccccgcguucgacaucuacuacguguacagcuuccgcagcgagcaguucgucuacuaccugacccugcagcucgacacgcagcugaccucccccgacgccgccggcgagcacuucuucaccagcaagaucgugcggcugugcguggacgaccccaaguucuacuccuacgucgaguuccccaucgggugcgagcaggccggcguggaguaccgccucgugcaggacgccuaccugagccggcccggccgcgcgcuggcccaccagcucgggcuggccgaggacgaggacguccuguucaccguguucgcccagggccagaagaaccgggugaagccgcccaaggaguccgcccucugccuguucacgcugcgcgcgaucaaggagaagaucaaggagcggauccagagcugcuaccgcggggagggcaagcugucccuccccuggcugcugaacaaggagcucgggugcaucaacagcccccugcagaucgacgacgacuucugcggccaggacuucaaccagccccugggcgggaccgucaccaucgagggcacgccccuguucguggacaaggacgacgggcugacggccgucgccgccuacgacuaccggggccgcaccgugguguucgccgggacccgguccggccgcauccgcaagauccuggucgaccucagcaacccgggcgggcggcccgcgcuggccuacgaguccgugguggcccaggagggcagccccauccugcgcgaccucguccuguccccgaaccaccaguaccuguacgccaugaccgagaagcaggucacgcgggugcccgucgagagcugcgugcaguacaccuccugcgagcucugccuggggagccgcgacccccacugcggcuggugcgugcugcacuccaucugcagccggcgcgacgcgugcgagcgggccgacgagccccagcgcuucgccgccgaccuccugcagugcguccagcugaccgugcagccgcggaacguguccgucaccaugagccaggugccccucgugcugcaggccuggaacguccccgaccugagcgcgggcgugaacugcuccuucgaggacuucacggagagcgaguccgugcucgaggacgggcgcauccacugccggagccccuccgcccgcgaggucgccccgaucacccggggccagggggaccagcgcguggugaagcuguaccucaagagcaaggagaccggcaagaaguucgccuccgucgacuucguguucuacaacugcagcgugcaccaguccugccucagcugcgucaacggguccuuccccugccacuggugcaaguaccggcacgugugcacccacaacguggccgacugcgcguuccuggagggccgcgucaacgugagcgaggacugcccccagauccugcccuccacgcagaucuacgugcccgucggcguggugaagcccaucacccucgccgcccggaaccugccccagccccagagcgggcagcgcggcuacgagugccuguuccacaucccggggucccccgcccgggucaccgcccuccgcuucaacagcuccagccugcagugccagaacagcuccuacagcuacgagggcaacgacguguccgaccugcccgugaaccucagcgucguguggaacgggaacuucgugaucgacaacccccagaacauccaggcgcaccuguacaagugcccggcccugcgcgaguccugcggccucugccugaaggccgacccccgguucgagugcggcuggugcgucgccgagcgccggugcagccugcgccaccacugcgcggccgacacccccgccuccuggaugcacgcccggcacgggagcucccgcugcacggaccccaagauccucaagcugagcccggagaccggcccccggcagggcgggacccgccugaccaucacgggggagaaccucggccugcgguucgaggacgugcgccugggcgugcgggucgggaaggugcucugcucccccguggagagcgaguacaucuccgccgagcagaucgucugcgagaucggcgacgcgagcuccgugcgcgcccacgacgcccugguggaggucugcgugcgggacugcagcccgcacuaccgcgcccugucccccaagcgguucaccuucgucacccccaccuucuaccgcgugagccccucccgggggccgcucagcggcgggaccuggaucggcaucgagggcagccaccugaacgccggguccgacguggcggucagcgugggcgggcgccccugcuccuucagcuggcggaacucccgcgagauccggugccugacgccgcccggccagagcccgggcuccgcccccaucaucaucaacaucaaccgcgcccagcucaccaaccccgaggugaaguacaacuacaccgaggaccccaccauccugcgcaucgacccggaguggagcaucaacuccgggggcacgcugcucaccgucaccgggaccaaccuggccacggugcgggagccccgcauccgggccaaguacggcgggaucgagcgcgagaacggcugccugguguacaacgacaccaccauggucugccgggcgcccagcguggccaaccccgugcgcuccccgcccgagcucggcgagcggcccgacgagcugggguucgucauggacaacgugcgcagccugcucgugcugaacuccaccagcuuccuguacuaccccgacccgguccucgagccccugucccccacgggccugcucgagcugaagcccagcuccccgcugauccucaaggggcggaaccugcugccgcccgcccccggcaacagccgccucaacuacaccgugcugaucggguccaccccgugcacccugacggugagcgagacccagcuccugugcgaggcccccaaccugaccggccagcacaaggucaccgugcgggcgggcggguucgaguucagccccggcacgcuccagguguacuccgacagccugcugacccucccggccaucgucgggaucggcgggggcggcgggcugcugcuccuggugaucguggccguccugaucgccuacaagcgcaagucccgggacgccgaccgcacccucaagcggcugcagcugcagauggacaaccucgagagccgcguggcgcuggagugcaaggaggccuucgccgagcugcagaccgacauccacgagcugacgaacgaccucgacggcgccgggauccccuuccuggacuaccggaccuacgccaugcgcgugcuguuccccggcaucgaggaccaccccguccucaaggagauggaggugcaggcgaacguggagaagucccugacccuguucggccagcuccugaccaagaagcacuuccugcucacguucauccggacccuggaggcccagcgcagcuucuccaugcgcgaccgggggaacgucgccagccugaucaugaccgcccuccagggcgagauggaguacgccaccggggugcugaagcagcugcucuccgaccugaucgagaagaaccuggagagcaagaaccacccgaagcuccugcugcgccggacggaguccguggcggagaagaugcucaccaacugguucaccuuccugcuguacaaguuccucaaggagugcgccggcgagccccuguucaugcuguacugcgccaucaagcagcagauggagaaggggcccaucgacgccaucaccggcgaggcccgcuacagccucuccgaggacaagcugauccggcagcagaucgacuacaagacgcugacccucaacugcgucaaccccgagaacgagaacgcgccggaggugcccgugaagggccuggacugcgacaccgucacccaggccaaggagaagcugcucgacgccgccuacaagggggugcccuacagccagcgccccaaggcggccgacauggaccuggaguggcggcagggccgcauggcccggaucauccugcaggacgaggacgugaccacgaagaucgacaacgacuggaagcgccucaacacccuggcccacuaccaggucaccgacggguccagcguggcccuggugccgaagcagaccuccgcguacaacaucagcaacuccagcacguucaccaagagccucucccgguacgagagcaugcugcgcaccgccuccagccccgacucccugcggagccgcacccccaugaucacgcccgaccucgaguccggcaccaagcuguggcaccuggucaagaaccacgaccaccucgaccagcgggagggggaccgcggcagcaagaugguguccgagaucuaccugacccggcugcucgccaccaagggcacgcugcagaaguucguggacgaccuguucgagaccaucuucagcaccgcccaccgcggguccgcccucccgcuggcgaucaaguacauguucgacuuccuggacgagcaggccgacaagcaccagauccacgacgccgacguccggcacaccuggaaguccaacugccucccccugcgcuucugggugaacgugaucaagaacccccaguucgucuucgacauccacaagaacuccaucacggacgccugccugagcgugguggcccagaccuucauggacuccugcagcaccuccgagcacaagcucggcaaggacagccccuccaacaagcugcuguacgcgaaggacaucccgaacuacaagagcugggucgagcgguacuacgccgacaucgccaagaugcccgccaucagcgaccaggacauguccgcguaccucgccgagcagagccgccugcaccugucccaguucaacagcauguccgcccuccacgagaucuacagcuacaucaccaaguacaaggacgagauccuggccgcccuggagaaggacgagcaggcgcgccggcagcgccuccgguccaagcuggagcaggucgucgacacgauggcccugagcuccuga

SEQ ID NO: 34754 - RNA, 5685 nt, Artificial Sequence
  derived and/or modified sequence opt1 from PLXNA2__Homo_sapiens__NP_079455
auggagcagcgccggcccuggccccgcgcccuggagguggacucccgguccguggugcuccugagcguggugugggugcugcucgcgccgcccgcggccggcaugccccaguucuccaccuuccacagcgagaaccgcgacuggaccuucaaccaccugaccgugcaccaggggaccggcgccgucuacgugggggccaucaaccggguguacaagcugaccggcaaccucaccauccaggucgcccacaagacggggccggaggaggacaacaaguccugcuacccgccccucaucgugcagcccugcagcgaggugcugacccucaccaacaacgucaacaagcugcugaucaucgacuacuccgagaaccgccuccuggccugcggcagccuguaccagggcgugugcaagcuccugcggcuggacgaccucuucauccugguggagcccucccacaagaaggagcacuaccugagcuccgucaacaagaccgggacgauguacggcgugaucgugcgcagcgagggggaggacggcaagcuguucaucgggaccgccgucgacggcaagcaggacuacuuccccacccuguccagccggaagcugccccgcgaccccgaguccagcgccaugcucgacuacgagcugcacuccgacuucgugagcucccugaucaagauccccagcgacacccucgcccuggugagccacuucgacaucuucuacaucuacggcuucgcguccgggggcuucgucuacuuccugacggugcagcccgagacccccgaggggguggccaucaacagcgccggcgaccucuucuacaccucccggaucguccgccugugcaaggacgaccccaaguuccacagcuacgugucccugcccuucggcugcacccgggccggggucgaguaccgccuccugcaggccgcguaccuggccaagcccggcgacagccucgcccaggccuucaacaucacgucccaggacgacgugcuguucgccaucuucagcaaggggcagaagcaguaccaccacccgcccgacgacuccgcgcugugcgccuuccccauccgggccaucaaccuccagaucaaggagcgccugcagagcugcuaccagggcgaggggaaccuggagcucaacuggcugcugggcaaggacgugcagugcaccaaggcccccguccccaucgacgacaacuucugcggccucgacaucaaccagccccugggcggcuccaccccgguggaggggcugacccucuacacgaccagccgggaccgcaugaccuccguggccagcuacgucuacaacggcuacuccgugguguucgucgggaccaagagcggcaagcugaagaagauccgggcggacgggccgccccacgggggcgugcaguacgagaugguguccguccugaaggacgggagccccauccugcgcgacauggccuucuccaucgaccagcgguaccucuacgugaugagcgagcgccaggugacgcgcguccccguggagagcugcgagcaguacacgaccugcggcgagugccuguccagcggggacccccacugcggcuggugcgcccugcacaacaugugcucccggcgcgacaagugccagcaggccugggagcccaaccgguucgccgcgagcaucucccagugcgugagccucgccguccacccguccagcaucuccgugagcgagcacucccgccugcugagccucguggucuccgacgcccccgaccugagcgccggcaucgcgugcgccuucgggaaccugaccgagguggagggccagguguccgggagccaggucaucugcaucucccccggccccaaggacgugccggugaucccccucgaccaggacugguucggccuggagcugcagcuccggagcaaggagacggggaagaucuucgucagcaccgaguucaaguucuacaacugcuccgcccaccagcugugccugagcugcgugaacuccgccuuccgcugccacuggugcaaguaccggaaccucugcacccacgaccccaccacgugcagcuuccaggagggccgcaucaacaucuccgaggacugcccccagcuggugccgaccgaggagauccugauccccgucggggaggugaagcccaucacccucaaggcccggaaccugccccagccgcagagcggccagcgcggguacgagugcgugcugaacauccagggcgcgauccaccggguccccgcccuccgcuucaacuccagcuccgugcagugccagaacagcuccuaccaguacgacggcauggacaucagcaaccuggccguggacuucgccgucguguggaacgggaacuucaucaucgacaacccccaggaccugaaggugcaccucuacaagugcgccgcgcagcgggaguccugcggccugugccugaaggccgaccgcaaguucgagugcggguggugcagcggcgagcggcgcugcacccuccaccagcacugcacgucccccagcuccccguggcuggacuggagcucccacaacgucaagugcagcaacccccagaucaccgagauccugaccgugagcgggccgcccgagggcggcacccgggugaccauccacggggucaaccucggccuggacuucuccgagaucgcccaccacguccagguggccggggucccgugcacgccccugcccggcgaguacaucaucgccgagcagaucgugugcgagauggggcacgcgcucgugggcaccaccagcggccccguccgccugugcaucggggagugcaagccggaguucaugaccaagucccaccagcaguacacguucgugaaccccagcgugcugucccucaaccccauccggggcccggagagcgggggcaccauggucaccaucaccgggcacuaccugggcgccggcuccagcguggccgucuaccuggggaaccagacgugcgaguucuacggccgcuccaugagcgagaucgugugcgugagcccgcccagcuccaacgggcucggccccgucccggugagcguguccgucgaccgcgcccacguggacagcaaccugcaguucgaguacaucgacgacccccgggugcagcgcaucgagcccgagugguccaucgcgagcggccacacgccccugaccaucaccggguucaaccucgacgucauccaggagccgcggauccgcgugaaguucaacggcaaggaguccgugaacgucugcaagguggugaacacgaccacccugaccugccuggcccccagccucacgaccgacuaccggcccgggcuggacaccgucgagcgccccgacgaguucggcuucguguucaacaacgugcagagccugcucaucuacaacgacaccaaguucaucuacuacccgaaccccacguucgagcugcugucccccaccgggguccucgaccagaagcccggcagcccgaucauccugaagggcaagaaccugugcccgcccgccuccgggggcgccaagcucaacuacaccgugcugaucggggagacccccugcgccgugacggucagcgagacccagcugcucugcgagccgcccaaccugaccggccagcacaaggugauggugcacgucgggggcaugguguucucccccggcagcguguccgucaucagcgacucccugcucacccugcccgcgaucgugagcaucgccgccgggggcucccugcuccugaucaucgugaucaucguccugaucgccuacaagcgcaagagccgggagaacgaccucacgcugaagcggcugcagaugcagauggacaaccucgagucccgcguggcccuggagugcaaggaggcguucgccgagcugcagaccgacaucaacgagcucaccagcgaccuggaccgguccgggaucccguaccuggacuaccgcaccuacgccaugcggguccucuuccccggcaucgaggaccaccccguccugcgcgagcuggaggugcaggggaacggccagcagcacguggagaaggcccucaagcuguucgcccagcugaucaacaacaaggucuuccuccugacguucauccggacccuggagcuccagcgcagcuucuccaugcgggaccgcggcaacguggcgagccugaucaugaccgggcugcagggccggcucgaguacgccaccgacgugcugaagcagcugcucuccgaccugaucgacaagaaccuggagaacaagaaccaccccaagcuccugcugcgccggacggagagcgucgccgagaagaugcugaccaacugguucgccuuccuccugcacaaguuccugaaggagugcgcgggggagccccucuucaugcuguacugcgccaucaagcagcagauggagaagggccccaucgacgccaucaccggcgaggcccgcuacagccuguccgaggacaagcucauccgccagcagaucgaguacaagacccugauccugaacugcgugaaccccgacaacgagaacagcccggagauccccgugaagguccucaacugcgacaccaucacccaggugaaggagaagauccuggacgccguguacaagaacguccccuacucccagcggccccgcgcgguggacauggaccuggaguggcggcaggggcgcaucgcccgggugguccuccaggacgaggacaucaccaccaagaucgagggcgacuggaagcgccugaacacccugaugcacuaccaggugagcgaccgguccguggucgcccucgugccgaagcagacgagcuccuacaacauccccgccagcgccuccaucagccgcaccuccaucagccgguacgacuccagcuuccgcuacaccgggucccccgacagccugcggucccgcgcgcccaugaucaccccggaccuggagagcggcgucaagguguggcaccucgugaagaaccacgaccacggggaccagaaggagggcgaccggggcuccaagauggucagcgagaucuaccugacgcgccugcucgccaccaaggggacccugcagaaguucguggacgaccuguucgagacccucuucagcacggugcaccggggcuccgcccugccccuggccaucaaguacauguucgacuuccucgacgagcaggccgaccgccacagcauccacgacaccgacguccggcacaccuggaaguccaacugccugccccugcgcuucugggugaacgugaucaagaacccccaguucgucuucgacauccacaaggggagcaucaccgacgcgugccucuccgugguggcccagacguucauggacagcugcuccaccagcgagcaccggcugggcaaggacuccccgagcaacaagcugcucuacgccaaggacauccccuccuacaagagcugggucgagcgcuacuacgccgacaucgccaagcugcccgcgaucuccgaccaggacaugaacgccuaccuggccgagcagagccgccuccacgccguggaguucaacaugcuguccgcgcugaacgagaucuacagcuacguguccaaguacagcgaggagcucaucggggcccuggagcaggacgagcaggcccggcgccagcggcuggccuacaaggucgagcagcucaucaacgccauguccaucgagagcuga

SEQ ID NO: 34755 - RNA, 5616 nt, Artificial Sequence
  derived and/or modified sequence opt1 from PLXNA3__Homo_sapiens__NP_059984
augcccagcgugugccugcugcugcuccuguuccuggccgucggcggggcccugggcaaccgcccguuccgggcguucguggugaccgacaccacgcucacccaccuggccguccaccgcgugaccggggagguguucgucggcgccgugaaccggguguucaagcuggcccccaaccucaccgagcugcgcgcccacgucaccgggcccguggaggacaacgcgcggugcuacccgccgcccuccaugcgcgugugcgcccaccggcuggcccccgucgacaacaucaacaagcuccugcugaucgacuacgccgcgcgccggcucguggccugcggcagcaucuggcagggcaucugccaguuccugcgccuggacgaccucuucaagcugggggagccccaccaccggaaggagcacuaccuguccggcgcccaggagcccgacagcauggccggggugaucgucgagcagggccaggggcccuccaagcuguucgugggcaccgccguggacggcaagagcgaguacuuccccacccuguccagccgcaagcugaucuccgacgaggacagcgcggacauguucucccucgucuaccaggacgaguucgugagcucccagaucaagauccccagcgacacccugucccuguaccccgccuucgacaucuacuacaucuacggguucgugagcgccuccuucgucuacuuccucacgcugcagcuggacacccagcagacccuccuggacaccgccggcgagaaguucuucaccagcaagaucgugcggaugugcgccggggacuccgaguucuacagcuacguggaguuccccaucggcugcagcuggcgcggcgucgaguaccggcuggugcaguccgcgcaccucgccaagcccgggcugcugcucgcccaggcccugggcguccccgccgacgaggacgugcuguucaccaucuucagccaggggcagaagaaccgcgcguccccgccccggcagaccauccucugccuguucacccugagcaacaucaacgcccacauccgccggcgcauccaguccugcuaccggggcgaggggacgcucgcccugcccuggcugcucaacaaggagcugcccugcaucaacaccccgaugcagaucaacggcaacuucugcggccuggugcucaaccagccccucggcgggcugcacgucaucgaggggcugccccuccuggccgacagcaccgacgggauggccuccguggcggccuacaccuaccgccagcacagcguggucuucaucgggacgcgcuccggcagccugaagaaggugcggguggacggcuuccaggacgcccaccucuacgagaccguccccgugguggacggguccccgauccugcgcgaccuccuguucagccccgaccaccggcacaucuaccugcuguccgagaagcaggucagccagcuccccguggagaccugcgagcaguaccaguccugcgccgcgugccugggcagcggggacccccacugcggcuggugcgugcugcgccaccggugcugccgcgagggggccugccucggcgccuccgccccgcacggcuucgccgaggagcugagcaagugcguccaggugcgggugcgccccaacaacgucuccgugaccagccccggggugcagcugacggucacccuccacaacgugccggaccugagcgcgggcguguccugcgccuucgaggccgccgccgagaacgaggcgguccugcuccccagcggggagcugcugugccccucccccagccuccaggagcugcgggcccugacccgcggccacggcgccacccggacggugcgccuccagcugcuguccaaggagaccggggugcgguucgccggcgccgacuucgucuucuacaacugcagcgugcuccaguccugcaugagcugcgugggguccccguaccccugccacuggugcaaguaccgccacacgugcaccagccggccccacgagugcuccuuccaggagggccgcguccacagccccgaggggugcccggagauccugcccuccggcgaccugcucauccccgugggcgugaugcagccccugacgcugcgggcgaagaaccucccgcagccccagagcgggcagaagaacuacgagugcgucgugcgcgugcagggccggcagcagcgcguccccgccgugcgcuucaacuccagcuccgugcagugccagaacgccagcuacagcuacgagggggacgagcacggcgacaccgagcuggacuucuccgucgugugggacggggacuuccccaucgacaagccgcccagcuuccgggcccugcucuacaagugcugggcgcagcgccccuccugcggccugugccugaaggccgacccccgguucaacugcggcuggugcaucagcgagcaccgcugccagcuccggacccacugcccggcccccaagaccaacuggaugcaccugucccagaaggggacgcgcugcagccacccccggaucacccagauccacccccuggugggcccgaaggagggcggcacccgcgucaccaucgugggggagaaccucggccugcugucccgggaggugggccuccgcgucgccggggugcggugcaacagcauccccgccgaguacaucuccgcggagcgcaucgugugcgagauggaggagagccugguccccuccccgccgcccggccccguggagcugugcgugggggacugcagcgccgacuuccggacccaguccgagcaggucuacagcuucgugacgccgaccuucgaccaggucucccccagccgcggccccgccuccgggggcacccggcucaccaucagcggcuccagccuggacgccgggagccgcgugacggugaccguccgggacuccgagugccaguucgugcgccgggacgccaaggcgaucgugugcaucagcccccuguccacccucggcccgagccaggcccccaucacccuggccaucgaccgcgccaacaucuccagccccgggcugaucuacacguacacccaggaccccaccgucacccggcucgagccgacgugguccaucaucaacggcagcaccgccaucaccguguccggcacccaccuccugacggugcaggagccccgcguccgcgcgaaguaccgggggaucgagaccaccaacacgugccaggugaucaacgacacggccaugcucugcaaggcccccggcaucuuccuggggcgcccccagccgcgggcccagggcgagcaccccgacgaguucggguuccugcucgaccacgugcagaccgcgcgcagccugaaccgguccagcuucaccuacuaccccgaccccuccuucgagccgcugggccccagcggcguccucgacgugaagcccgggucccacgugguccugaagggcaagaaccugauccccgccgccgccgggagcucccgccucaacuacaccgugcugaucggcgggcagccgugcagccugacgguguccgacacccagcuccugugcgacagccccagccagaccggccggcagcccgucauggugcuggugggcgggcucgaguucuggcugggcacccugcacaucuccgccgagcgcgcgcucacgcugcccgccaugauggggcuggccgccggcgggggccuccugcugcucgccaucaccgcgguccugguggccuacaagcggaagacccaggacgccgaccgcacccugaagcggcuccagcugcagauggacaaccuggagagccgcguggcccucgagugcaaggaggccuucgcggagcugcagacggacaucaacgagcugaccaaccacauggacgagguccagaucccguuccucgacuaccggaccuacgccgugcgcgugcuguuccccggcaucgaggcccaccccguccugaaggagcucgacaccccgcccaacguggagaaggcccugcggcuguucgggcagcugcuccacucccgcgccuucgugcugacguucauccacacccuggaggcgcagagcuccuucagcaugcgggaccgcggcaccgucgccucccucaccaugguggcccugcagagccggcuggacuacgccaccgggcuccugaagcagcugcucgcggaccugaucgagaagaaccuggaguccaagaaccaccccaagcuccugcugcgccgcacggagagcguggccgagaagaugcucaccaacugguucaccuuccugcugcacaaguuccucaaggagugcgccggcgagccccuguuccugcucuacugcgccaucaagcagcagauggagaagggcccgaucgacgccaucaccggggaggcgcgguacucccugagcgaggacaagcugauccgccagcagaucgacuacaagacgcucacccugcacugcgucugccccgagaacgagggcuccgcccaggugcccgugaagguccugaacugcgacagcaucacccaggccaaggacaagcuccuggacaccguguacaaggggauccccuacucccagcggccgaaggccgaggacauggaccuggaguggcgccagggccggaugacgcgcaucauccuccaggacgaggacgugaccaccaagaucgagugcgacuggaagcggcugaacagccuggcccacuaccaggucaccgacgggucccucguggcgcuggugcccaagcaggucagcgccuacaacauggccaacuccuucacguucacccgcagccugagccgguacgagucccuccugcgcaccgccagcucccccgacagccugcggucccgcgcccccaugaucaccccggaccaggagacgggcaccaagcucuggcaccuggugaagaaccacgaccacgcggaccaccgggagggcgaccgcgggagcaagaugguguccgagaucuaccugacccggcuccuggccaccaagggcacgcugcagaaguucgucgacgaccucuucgagaccguguucagcaccgcccaccgcggguccgcccugccccuggcgaucaaguacauguucgacuuccucgacgagcaggccgaccagcggcagaucagcgaccccgacgugcgccacaccuggaaguccaacugccugccccugcgguucugggucaacgugaucaagaacccgcaguucguguucgacauccacaagaacagcaucacggacgccugccucuccgucguggcccagaccuucauggacagcugcuccaccagcgagcaccgccugggcaaggacucccccagcaacaagcugcucuacgccaaggacauccccaacuacaaguccugggucgagcgguacuaccgcgacaucgcgaagauggccagcaucagcgaccaggacauggacgccuaccugguggagcagucccgccugcacgccagcgacuucuccgugcucagcgcccugaacgagcuguacuucuacgucaccaaguaccggcaggagauccucacggcgcuggaccgcgacgccuccugccggaagcacaagcugcgccagaagcucgagcagaucaucagccugguguccagcgacuccuga

SEQ ID NO: 34756 - RNA, 1479 nt, Artificial Sequence
  derived and/or modified sequence opt1 from PLXNA4__Homo_sapiens__NP_001099013
augaaggccaugcccuggaacuggaccugccugcucagccaccuccugauggugggcaugggguccagcacccugcugacgcgccagccggcgccccugucccagaagcagcggagcuucgucaccuuccgcggcgagcccgccgagggguucaaccaccucgugguggacgagcggaccggccacaucuaccugggggccgucaaccgcaucuacaagcuguccagcgaccucaaggugcuggugacccacgagacgggccccgacgaggacaacccgaagugcuacccgccccggaucguccagaccugcaacgagccccugaccaccacgaacaacgugaacaagaugcuccugaucgacuacaaggagaaccgccugaucgccugcggcucccucuaccaggggaucugcaagcugcugcggcucgaggaccuguucaagcugggcgagcccuaccacaagaaggagcacuaccucagcggggugaacgaguccggcagcgucuucggggugaucguguccuacagcaaccuggacgacaagcuguucaucgccaccgccgucgacggcaagcccgaguacuuccccaccaucuccagccgcaagcucaccaagaacuccgaggcggacggcauguucgccuacguguuccacgacgaguucguggccagcaugaucaagauccccuccgacacguucaccaucaucccggacuucgacaucuacuacgucuacggguucagcuccggcaacuucguguacuuccugacccugcagcccgagauggugagcccgcccgggagcaccacgaaggagcaggucuacaccuccaagcucgugcggcugugcaaggaggacaccgccuucaacagcuacguggagguccccaucggcugcgagcgcuccggcguggaguaccggcugcuccaggcggccuaccugagcaaggccggggccgugcugggccgcacccucgggguccaccccgacgacgaccugcuguucacgguguucuccaagggccagaagcggaagaugaagucccucgacgagagcgcccugugcaucuucauccugaagcagaucaacgaccgcaucaaggagcggcuccagagcugcuaccgcggggagggcacccuggaccuggcguggcucaaggucaaggacauccccugcuccagcgcccugcugaccaucgacgacaacuucugcggccucgacaugaacgcgccccuggggguguccgacauggugcggggcaucccggucuucaccgaggaccgcgaccggaugacgagcgugaucgccuacguguacaagaaccacucccuggccuucgucgggaccaagagcggcaagcucaagaagaugcccgggaccucccugugccccacccuggagcugcagacgggcccccgcagccaccgggccaccgugacccucgagcugcuguucuccagcugcuccagcaacuga

SEQ ID NO: 34757 - RNA, 6408 nt, Artificial Sequence
  derived and/or modified sequence opt1 from PLXNB1__Homo_sapiens__NP_001123554
augcccgcccugggccccgcccuccugcaggcccugugggccgggugggugcucacccugcagccccugccgcccaccgccuucacccccaacggcaccuaccuccagcaccuggcccgcgaccccaccuccgggacccuguaccucggcgccacgaacuuccuguuccagcugucccccgggcuccagcuggaggcgaccgucagcaccggccccgugcuggacucccgggacugccucccgcccgugaugcccgacgagugcccccaggcccagcccaccaacaaccccaaccagcugcugcucgucucccccggcgcccugguggugugcggguccguccaccagggcgugugcgagcagcgccggcuggggcagcucgagcagcugcugcuccgccccgagcggccgggcgacacgcaguacguggccgccaacgaccccgccgucuccaccguggggcugguggcccagggccuggccggcgagccccuccuguucgucgggcgcggcuacaccucccgcggggucggcggcgggaucccgcccaucaccacgcgcgcccuguggccgcccgacccccaggcggccuucagcuacgaggagaccgccaagcucgccgugggccggcuguccgaguacagccaccacuucgucuccgccuucgcgcgcggggccagcgccuacuuccuguuccuccggcgcgaccugcaggcccagucccgggccuuccgcgcguacgugagccgggugugccugcgcgaccagcacuacuacuccuacgucgagcucccccuggccugcgagggcgggcgguacggccugauccaggccgccgccguggcgaccagccgcgagguggcccacggcgagguccucuucgccgccuucuccagcgcggcgccgcccaccguggggcggcccccguccgccgccgccggcgcgagcggggccagcgcccugugcgccuucccccuggacgagguggaccgccucgccaaccggacgcgcgacgcgugcuacacccgcgagggccgggccgaggacgggaccgaggucgccuacaucgaguacgacgugaacuccgacugcgcccagcugcccgucgacacccuggacgccuacccgugcggcagcgaccacacgcccucccccauggcgagccgcgugccccucgaggccaccccgauccuggaguggcccggcauccagcugaccgccguggccgucaccauggaggacgggcacacgaucgcguuccucggcgacucccaggggcagcugcaccggguguaccugggccccgggagcgacggccaccccuacuccacccagagcauccagcagggcuccgccgugagccgcgaccugaccuucgacgggaccuucgagcaccucuacgucaugacgcaguccacccugcugaaggugccgguggccagcugcgcccagcaccucgacugcgccuccugccuggcgcaccgggaccccuacugcggcuggugcguccugcucgggcgcugcagccggcgcuccgagugcagccggggccagggccccgagcaguggcugugguccuuccagcccgagcuggggugccuccagguggccgccaugagcccggccaacaucucccgcgaggagacccgggagguguuccugagcguccccgaccugccgccccucuggccgggcgagagcuacuccugccacuucggggagcaccagagccccgcccugcugaccggcuccggggugaugugccccagccccgacccguccgaggcgcccgugcucccccgcggcgccgacuacgucagcguguccguggagcugcgguucggcgccgucgugaucgccaagacgagccuguccuucuacgacugcguggccgucaccgagcuccgccccagcgcgcagugccaggccugcguguccagccggugggggugcaacuggugcguguggcagcaccugugcacccacaaggccuccugcgacgccggcccgauggucgcgagccaccagagcccccucgugagccccgacccgcccgcccgcgggggccccucccccagcccgcccaccgcccccaaggcccucgccacgcccgcgccggacacccugcccguggagcccggggcccccagcaccgccaccgccuccgacaucagcccgggcgccucccccagccugcucucccccuggggccccugggcggggagcggcuccaucagcuccccggggagcaccggcagcccccugcacgaggagcccuccccgcccagcccccagaacgggcccggcacggccguccccgcccccaccgacuuccggcccagcgccacccccgaggaccugcucgccagcccccugagcccguccgagguggcggccgugccgcccgccgacccgggccccgaggcccugcaccccaccgucccccucgaccugccgcccgccacggugcccgcgaccaccuuccccggggccaugggcagcgugaagccggcccuggacuggcucacccgcgagggcggggagcugcccgaggccgacgaguggaccggcggggacgcgcccgccuucuccaccagcacccugcucagcggggacggggacuccgccgagcuggagggcccgcccgcgccccugauccuccccagcucccuggacuaccaguacgacacccccgggcugugggagcucgaggaggccacgcugggcgcgagcuccugccccugcgucgagagcgugcagggcuccacccugaugcccgugcacgucgagcgggagauccgccuccuggggcgcaaccugcaccucuuccaggacggccccggggacaacgagugcgugauggagcuggagggccuggagguggucguggaggcccggguggagugcgagcccccgcccgacacccagugccacgugaccugccagcagcaccagcucagcuacgaggcccugcagcccgagcugcgcgugggccucuuccugcggcgcgccggccggcugcgcguggacuccgccgagggccuccacgucgugcuguacgacugcagcguggggcacggcgacugcucccggugccagacggcgaugccccaguacgggugcgucuggugcgagggcgagcgcccgcggugcgugacccgcgaggccugcggggaggccgaggccguggccacccagugccccgcgccccugauccacagcgucgagccccucaccggcccgguggacggcgggacgcgggucaccauccgcggcuccaaccuggggcagcacgugcaggacgugcugggcauggucaccguggccggggugcccugcgccgucgacgcccaggaguacgaggugagcuccagccucgugugcaucaccggcgcguccggcgaggaggucgccggggccacggccguggaggugcccggccgggggcgcggcgucagcgagcacgacuucgccuaccaggacccgaaggugcacuccaucuuccccgcgcggggcccccgcgccgggggcacccggcugacccugaacgggagcaagcuccugaccggccgccuggaggacauccggguggucgugggggaccagcccugccaccuccugccggagcagcagagcgagcagcugcgcugcgagacgagcccccggcccacccccgccacccucccgguggccgucugguucggcgccaccgagcgccgccugcagcggggccaguucaaguacacgcuggaccccaacaucaccagcgcggggcccaccaaguccuuccucagcggcgggcgcgagaucugcgugcggggccagaaccuggacgugguccagacgccccggauccgggugacgguggucucccgcaugcugcagccgagccaggggcucggccggcgccggcgcguggugcccgagaccgccugcucccugggccccagcugcuccagccagcaguucgaggagcccugccacgucaacuccagccagcugaucacgugccggaccccggcccuccccgggcugcccgaggaccccugggugcgcguggaguucauccuggacaaccucgucuucgacuucgccacccugaacccgacgcccuucuccuacgaggccgaccccacccugcagccccucaacccggaggaccccaccaugcccuuccggcacaagccgggcagcguguucuccguggagggggagaaccuggaccuggcgaugagcaaggaggaggucguggccaugaucggcgacgggcccugcguggucaagacccucacgcgccaccaccuguacugcgagccgcccguggagcagccgcugccccggcaccacgcccuccgcgaggcccccgacucccugcccgaguucaccgugcagaugggcaaccugcgguucagccugggccacguccaguacgacggggaguccccgggcgcguuccccguggccgcccagguggggcucggcgucgggaccagccugcuggcccucggcgugaucaucaucgugcugauguaccgccggaaguccaagcaggcccugcgcgacuacaagaagguccagauccagcucgagaaccuggaguccagcgugcgcgaccggugcaagaaggaguucaccgaccugaugacggagaugaccgaccucaccuccgaccugcugggcagcgggauccccuuccucgacuacaagguguacgcggagcgcaucuucuuccccggccaccgggaguccccgcugcaccgcgaccuggggguccccgagagccggcgccccaccguggagcagggccucggccagcuguccaaccugcucaacagcaagcuguuccugacgaaguucauccacacccucgagucccagcggaccuucagcgcccgcgaccgggccuacguggccucccugcugaccgucgcccuccacgggaagcuggaguacuucacggacauccugcgcacccuccugagcgaccugguggcgcaguacgucgccaagaaccccaagcucaugcugcggcgcaccgagaccgugguggagaagcugcucacgaacuggauguccaucugccuguacaccuucguccgggacagcgugggcgagccgcuguacaugcuguuccgcgggaucaagcaccagguggacaagggccccgucgacuccgugaccgggaaggccaaguacacccugaacgacaaccggcugcuccgcgaggacguggaguaccggccccugacgcugaacgcccuccuggccgucggccccggcgcgggggaggcccagggcgugccggugaagguccuggacugcgacaccaucagccaggccaaggagaagaugcucgaccagcuguacaagggggugccccugacccagcgccccgacccccggacccucgacguggaguggcgcuccggcgucgccgggcaccugauccugagcgacgaggacgugacguccgaggugcagggccucuggcggcgccugaacacccugcagcacuacaaggucccggacggcgccaccguggcgcucgugcccugccugaccaagcacguccugcgcgagaaccaggacuacgugcccggggagcggacgcccaugcucgaggacguggacgagggcgggauccgcccguggcaccuggucaagcccagcgacgagcccgagccgccccggccccgccggggcagccugcgcgggggcgagcgggagcgcgccaaggccauccccgagaucuaccucacccggcugcuguccaugaagggcacccuccagaaguucguggacgaccuguuccaggugauccugagcaccucccgcccggucccccucgccgugaaguacuucuucgaccugcuggacgagcaggcgcagcagcacgggaucagcgaccaggacacgauccacaucuggaagaccaacucccucccccugcgguucuggaucaacaucaucaagaacccccaguucguguucgacguccagaccagcgacaacauggacgccgugcugcucgugaucgcccagaccuucauggacgccugcacccuggccgaccacaagcugggccgcgacuccccgaucaacaagcuccuguacgcgcgggacaucccccgcuacaagcggauggucgagcgcuacuacgccgacauccggcagacggugcccgccagcgaccaggagaugaacuccgugcuggccgagcucagcuggaacuacuccggggaccugggcgcccgcgucgcgcugcacgagcucuacaaguacaucaacaaguacuacgaccagaucaucaccgcccuggaggaggacgggaccgcccagaagaugcagcugggcuaccggcuccagcagaucgccgccgcgguggagaacaaggugaccgaccuguga

SEQ ID NO: 34758 - RNA, 5799 nt, Artificial Sequence
  derived and/or modified sequence opt1 from PLXNB3__Homo_sapiens__NP_001156729
auggagcugacccccgccagcagccugaccugcagccugcuguccccgcgccuccccggcagcuucccccagcugcggcgcgugcccccgugcucccggcccuggcugcccaaggcccccgugauggcccgguggccgcccuucgggcucugccugcugcuccugcugcucuccccgccgccccugccccugaccggcgcccaccgguucuccgcccccaacaccacccucaaccaccuggcccuggcccccgggcgcggcacccucuacgugggggccgugaaccggcuguuccagcugagccccgagcuccagcuggaggccgucgccgugacgggccccgugaucgacucccccgacugcguccccuuccgcgacccggccgagugcccccaggcgcagcugaccgacaacgccaaccagcuccugcuggugagcucccgggcccaggagcucguggccugcggccagguccgccagggggugugcgagacccggcgccugggcgacguggccgagguccuguaccaggcggaggaccccggggacggccaguucguggccgccaacacccccgggguggccacggucggccucguggugccgcugcccggccgggaccugcuccuggucgcccgcgggcuggcgggcaagcucagcgccggggugccgccccucgccauccggcagcuggccggcucccagccguucagcuccgagggccucgggcgccugguggucggcgacuucagcgacuacaacaacuccuacgugggggccuucgcggacgcccggagcgccuacuucguguuccgccggcgcggcgcccgggcccaggcggaguaccgcuccuacgucgcccgcgugugccugggggacaccaaccucuacagcuacgucgaggugccccuggccugccagggccagggccugauccaggccgcguuccucgcccccgggacccugcugggcguguucgccgccgggccgcggggcacccaggccgcgcucugcgccuuccccauggucgagcugggggccagcauggagcaggcccgccggcugugcuacacggccggcggccgcgggcccuccggcgcggaggaggccaccguggaguacggggugaccagccggugcgucacccugccccucgacuccccggagagcuaccccugcggcgacgagcacacgcccucccccaucgccgggcgccagccgcuggaggugcagccccugcucaagcugggccagcccgugagcgccgucgccgcgcugcaggccgacggccacaugaucgccuuccucggggacacccagggccagcuguacaagguguuccugcacgggucccagggccagguguaccacagccagcaggucggcccgcccggguccgccaucagccccgaccuccugcuggacuccagcggcucccaccucuacgugcugaccgcgcaccagguggaccggauccccgucgccgccugcccccaguuccccgacugcgccagcugccugcaggcccaggacccccucugcggguggugcgugcugcagggccgcugcacccggaaggggcagugcggccgcgcgggccagcugaaccaguggcucugguccuacgaggaggacagccacugccugcacauccagucccugcuccccgggcaccacccccggcaggagcagggccaggugacgcugagcgucccgcgccugcccauccucgacgccgacgaguacuuccacugcgccuucggggacuacgacucccuggcccacguggagggcccccacguggccugcgucacgccgccccaggaccaggugccccugaacccgcccgggaccgaccacgugaccgucccccucgcgcugauguucgaggacgugacgguggccgccaccaacuucagcuucuacgacugcagcgccguccaggcccuggaggcggccgcccccugccgggccugcgugggcuccaucuggcgcugccacuggugcccccagagcucccacugcguguacggcgagcacugccccgagggggagcggaccaucuacagcgcgcaggaggucgacauccaggugcgcggccccggggccugcccccagguggagggccucgccgggccccaccuggucccggugggcugggagucccaccuggcccuccgggugcgcaaccugcagcacuuccggggccugcccgccagcuuccacugcuggcucgagcugcccggggagcugcgcggccuccccgcgacccuggaggagacggccggggacuccggccugauccacugccaggcccaccaguucuacccgagcaugucccagcgcgagcuccccguccccaucuacgugacccagggggaggcccagcggcuggacaacacccacgcccuguacgugauccucuacgacugcgcgaugggccaccccgacugcagccacugccaggccgccaaccgcucccugggcugccuguggugcgccgacgggcagccggccugccgguacggcccccucugcccgcccggggcggucgagcugcugugcccggcccccagcaucgacgccguggagccccucaccggcccgcccgagggcgggcuggcccugacgauccucggcuccaaccuggggcgcgccuucgcggacgugcaguacgccgucagcguggccucccggcccugcaaccccgagcccagccuguaccgcaccuccgcccggaucgugugcgucaccagccccgcgcccaacggcaccacggggcccgugcgcguggccaucaagagccagccgcccggcaucuccagccagcacuucaccuaccaggaccccguccuccugucccugagcccccgguggggcccgcaggccgggggcacccagcucaccauccgcgggcagcaccuccagaccggcgggaacacguccgccuucgugggcggccagcccugccccauccuggagcccgugugcccggaggccaucgucugccggacccgcccccaggcggcccccggggaggccgccgugcucgucguguucggccacgcccagcggacccugcuggcgagccccuuccgcuacaccgccaacccgcagcucguggccgccgagcccuccgccagcuuccgcgggggcgggcgccugauccggguccgcggcacgggccuggacguggugcagcggccccuccuguccgucuggcuggaggcggacgccgaggugcaggccagccgcgcccagccccaggacccgcagccccggcgcuccugcggggcgcccgccgccgacccccaggccugcauccagcucggcgggggccugcugcagugcagcaccgugugcuccgucaacagcuccagccuccugcugugccgcuccccggccgugcccgaccgggcgcacccccagcgcguguucuucacccucgacaacguccagguggacuucgccagcgccuccggcgggcagggcuuccuguaccagcccaacccgcggcuggcgccccucagccgcgaggggcccgcccggcccuaccgccugaagccgggccacgugcuggacgucgagggggagggccucaaccugggcaucagcaaggaggaggugcgggugcacaucgggcgcggcgagugccuggucaagacccucacgcggacccaccuguacugcgagccgcccgcgcacgccccgcagcccgccaacggguccggccugccccaguucguggugcagauggggaacguccagcucgcccugggccccgugcaguacgaggccgagccgccccugagcgcguuccccguggaggcccaggccggcgucgggaugggcgccgcggugcucaucgccgccgugcugcugcugacccucauguaccgccacaaguccaagcaggcccugcgggacuaccagaagguccuggugcagcucgagagccuggagaccggggugggcgaccagugccgcaaggaguucacggaccugaugaccgagaugaccgaccucuccagcgaccuggagggguccggcauccccuuccuggacuaccggaccuacgccgagcgcgcguucuucccgggccacgggggcugcccccuccagcccaagcccgaggggccgggcgaggacgggcacugcgccacgguccggcagggccugacccagcugagcaaccuccugaacuccaagcuguuccuccugacccugauccacacccucgaggagcagcccagcuucucccagcgcgaccggugccacguggccagccugcugucccucgcccugcacggcaagcuggaguaccucacggacaucaugcgcacccugcugggggaccucgccgcgcacuacgugcaccggaaccccaagcugaugcugcgccgcaccgagaccauggucgagaagcuccugacgaacuggcugagcaucugccucuacgccuuccugcgggagguggccggcgagccccuguacaugcuguuccgcgccauccaguaccagguggacaaggggccggucgacgccgugaccggcaaggcgaagcggacccugaacgacucccgccugcuccgggaggacguggaguuccagccccugacccugaugguccucgugggccccggggccggcggggccgccggcagcuccgagaugcagcgcgugcccgcccggguccuggacacggacaccaucacccaggugaaggagaaggugcuggaccaggucuacaaggggaccccguucagccagcgccccuccgugcacgcgcucgaccuggaguggcggagcggccuggccggccaccucacgcugagcgacgaggaccugaccuccgugacccagaaccacuggaagcgccucaacacccugcagcacuacaagguccccgacggggccacggugggccuggugccccagcuccaccgggggagcaccaucucccagagccuggcccagcgcugcccgcugggcgagaacauccccacccucgaggacggggaggagggcggcgucugccuguggcaccuggugaaggcgaccgaggagcccgagggggccaagguccggugcuccagccuccgcgagcgggagccggcccgcgccaaggccauccccgagaucuaccugacccggcugcucuccaugaagggcacgcugcagaaguucguggacgacaccuuccaggcgauccugagcgugaaccgccccauccccaucgccgucaaguaccucuucgaccugcuggacgagcucgccgagaagcacgggaucgaggacccgggcacccugcacaucuggaagaccaacucccugcuccugcgguucugggugaacgcccugaagaacccccagcucaucuucgacgugcgcgucagcgacaacguggacgccauccuggcggugaucgcccagacguucaucgacuccugcaccaccagcgagcacaaggucgggcgggacucccccgugaacaagcugcucuacgcccgcgagaucccccgcuacaagcagaugguggagcgguacuacgccgacauccgccagagcuccccggccagcuaccaggagaugaacuccgcgcuggccgagcugagcggcaacuacaccuccgcgccccacugccucgaggcccugcaggagcuguacaaccacauccaccgguacuacgaccagaucaucagcgcgcucgaggaggaccccgucggccagaagcugcagcuggccugccgccuccagcaggucgccgcccugguggagaacaaggucacggaccuguga

SEQ ID NO: 34759 - RNA, 4707 nt, Artificial Sequence
  derived and/or modified sequence opt1 from PLXNC1__Homo_sapiens__NP_005752
auggaggugagccgccggaaggccccgccccgcccgccccggcccgccgcgccccugccccuccuggccuaccugcucgcccuggccgcccccggccgcggggcggacgagcccgucuggcgguccgagcaggccaucggcgccaucgccgcgagccaggaggacgggguguucguggccuccggcagcugccuggaccagcucgacuacucccuggagcacagccugucccgccucuaccgggaccaggccgggaacugcaccgagccggucagccuggccccgcccgcccgcccccggcccggcuccagcuucuccaagcugcuccugcccuaccgcgagggcgcggccgggcugggcgggcuccugcugaccggcuggacguucgaccgcggggccugcgaggugcggccccucggcaaccugagccggaacucccugcgcaacggcaccgagguggucagcugccacccccagggguccaccgccggcgugguguaccgggccgggcgcaacaaccggugguaccucgcggucgccgccaccuacgugcugccggagcccgagacggccagccgcugcaaccccgccgcguccgaccacgacaccgccaucgcccugaaggacaccgagggccggagccucgccacccaggagcugggccgccugaagcucugcgagggggccggcucccugcacuucguggacgcguuccuguggaacgggagcaucuacuuccccuacuacccguacaacuacacgagcggcgccgccaccggguggcccuccauggcccggaucgcgcagagcaccgagguccucuuccagggccaggccucccuggacugcggccacgggcaccccgacggccgccgccugcuccugagcuccagccugguggaggcccucgacgugugggccggggucuucuccgccgcggccggcgaggggcaggagcggcgcagccccaccacgaccgcccugugccuguuccggauguccgagauccaggcccgcgccaagcgggugagcugggacuucaagaccgcggagucccacugcaaggagggcgaccagccggagcgcgugcagcccaucgccagcuccacccucauccacagcgaccugacguccgucuacggcaccguggugaugaaccggaccguccuguuccucgggaccggcgacgggcagcugcugaaggugauccucggcgagaaccugacgagcaacugccccgaggugaucuacgagaucaaggaggagacccccgucuucuacaagcuggugccggaccccgucaagaacaucuacaucuaccucaccgccgggaaggaggugcgccggauccgcguggccaacugcaacaagcacaaguccugcagcgagugccugaccgccacggacccccacugcggcuggugccacucccugcagcggugcaccuuccagggcgacugcguccacagcgagaaccuggagaacuggcucgacaucagcuccggggcgaagaagugcccgaagauccagaucauccgcagcuccaaggagaagaccaccgugacgauggugggcagcuucagcccccggcacuccaagugcauggugaagaacguggacuccagccgcgagcugugccagaacaagucccagcccaaccggaccugcacgugcagcauccccacccgcgccaccuacaaggacguguccgucgugaacgugauguucagcuucggguccuggaaccugagcgaccgguucaacuucaccaacugcuccagccucaaggagugcccggccugcgucgagaccggcugcgccuggugcaaguccgcgcgccggugcauccaccccuucaccgccugcgaccccagcgacuacgagcgcaaccaggagcagugccccguggccguggagaagacgagcggcgggggccgcccgaaggagaacaaggggaaccggaccaaccaggcccugcaggucuucuacaucaaguccaucgagccccagaaggugagcacccugggcaaguccaacgugaucgucaccggggccaacuucacccgcgcgagcaacaucacgaugauccucaagggcaccagcacgugcgacaaggacgugauccaggugucccacguccugaacgacacccacaugaaguucucccugcccagcucccggaaggagaugaaggacgugugcauccaguucgacggcgggaacugcagcuccgugggcagccucuccuacaucgcccugccccacugcagccugaucuucccggccaccaccuggaucuccgggggccagaacaucaccaugauggggcgcaacuucgacgucaucgacaaccucaucaucagccacgagcugaagggcaacaucaacguguccgaguacugcguggccaccuacugcggcuuccuggcccccagccucaaguccagcaagguccggacgaacgugaccgugaagcugcgcguccaggacaccuaccuggacugcgggacccuccaguaccgggaggacccccgcuucacgggcuaccggguggagagcgagguggacaccgagcuggaggucaagauccagaaggagaacgacaacuucaacaucuccaagaaggacaucgagaucacccuguuccacggggagaacggccagcucaacugcagcuucgagaacaucacccgcaaccaggaccugacgaccauccugugcaagaucaaggggaucaagaccgcguccaccaucgccaacagcuccaagaaggugcgggugaagcucggcaaccuggagcuguacgucgagcaggagagcgugcccuccacgugguacuuccucaucgugcugccgguccugcucgugaucgugaucuucgccgccgucggcgugacccgccacaagagcaaggagcugucccggaagcagagccagcagcuggagcuccuggaguccgagcugcgcaaggagauccgggacggguucgccgagcuccagauggacaagcuggacguggucgacagcuucggcaccgugcccuuccuggacuacaagcacuucgcgcuccgcaccuucuuccccgaguccgggggcuucacgcacaucuucaccgaggacaugcacaaccgggacgccaacgacaagaacgagagccugaccgcccuggacgcccucaucugcaacaaguccuuccuggugaccgucauccacacgcuggagaagcagaagaacuucagcgugaaggaccgcugccucuucgcguccuuccugaccaucgcccugcagaccaagcucguguaccugaccagcauccuggagguccucacgcgggaccugauggagcagugcuccaacaugcagcccaagcugaugcuccgccggaccgagagcguggucgagaagcugcugaccaacuggaugagcgugugccucuccggguuccugcgcgagaccgugggcgagccguucuaccugcucgucacgacccugaaccagaagaucaacaagggccccguggacgugaucacgugcaaggcccuguacacccucaacgaggacuggcugcuguggcagguccccgaguucagcaccguggcccucaacguggucuucgagaagauccccgagaacgaguccgccgacgugugccgcaacaucagcgugaacguccuggacugcgacaccaucgggcaggcgaaggagaagaucuuccaggccuuccuguccaagaacggcagcccguacgggcuccagcugaacgagaucggccuggagcuccagaugggcacccggcagaaggagcugcuggacaucgacuccagcuccgugauccucgaggacgggaucaccaagcugaacaccaucggccacuacgagaucagcaacggguccacgaucaagguguucaagaagaucgccaacuucaccagcgacgucgaguacuccgacgaccacugccaccugauccuccccgacagcgaggccuuccaggacgugcagggcaagcgccaccgggggaagcacaaguucaaggugaaggagauguaccugaccaagcugcucuccaccaaggucgccauccacagcgugcuggagaagcuguuccgcuccaucuggagccuccccaacucccgggcgccguucgccaucaaguacuucuucgacuuccuggacgcccaggccgagaacaagaagaucacggaccccgacgugguccacaucuggaagaccaacagccugccccuccgcuucugggugaacauccugaagaacccccaguucguguucgacaucaagaagaccccgcacaucgacggcugccugagcgucaucgcccaggcguucauggacgccuucucccucaccgagcagcagcugggcaaggaggcccccacgaacaagcugcucuacgccaaggacauccccaccuacaaggaggaggucaagagcuacuacaaggccauccgggaccugcccccgcuguccagcuccgagauggaggaguuccugacccaggagagcaagaagcacgagaacgaguucaacgaggagguggcgcucaccgagaucuacaaguacaucgugaaguacuucgacgagauccugaacaagcuggagcgcgagcgggggcucgaggaggcccagaagcagcugcugcacgugaagguccucuucgacgagaagaagaagugcaaguggauguga

SEQ ID NO: 34760 - RNA, 5778 nt, Artificial Sequence
  derived and/or modified sequence opt1 from PLXND1__Homo_sapiens__NP_055918
auggcgccccgcgccgccggcggggccccgcuguccgcccgggccgccgcggccagcccgccgcccuuccagaccccgccccgcugccccgugccccuccugcugcuccugcugcucggcgccgcccgggcgggggcccuggagauccagcgccgguuccccagccccacccccacgaacaacuucgcccuggacggcgccgccgggaccguguaccucgcggccgugaaccgccuguaccagcuguccggcgccaaccucucccuggaggccgaggccgcggugggccccguccccgacagcccccugugccacgcgccccagcucccccaggccagcugcgagcacccccggcgccugaccgacaacuacaacaagauccugcagcucgaccccgggcagggccuggugguggucugcggguccaucuaccagggcuucugccagcugcggcgccgggggaacaucagcgccguggccgugcgcuucccgcccgcggccccgcccgccgagcccgucaccguguuccccuccaugcucaacguggccgccaaccaccccaacgcgagcaccgucggccuggugcugccgcccgccgccggcgccgggggcucccggcuccuggugggggcgaccuacaccggcuacggcagcuccuucuucccccgcaaccggagccuggaggaccaccgcuucgagaacacccccgagaucgccauccggucccucgacacgcgcggggaccuggccaagcuguucaccuucgaccucaaccccagcgacgacaacauccugaagaucaagcagggcgccaaggagcagcacaagcugggguucgucuccgccuuccuccaccccagcgacccgccgcccggcgcgcaguccuacgccuaccuggcccugaacagcgaggcccgggccggggacaaggagagccaggcgcgcucccuccuggcccggaucugccugccccacggcgccggcggggacgccaagaagcucaccgagagcuacauccagcugggccugcagugcgccgggggcgcggggcgcggcgaccucuacucccgccuggugagcguguucccggcccgggagcgccuguucgccgucuucgagcggccccagggcucccccgccgcgcgcgccgcccccgccgcccucugcgcguuccgguucgccgacgugcgcgccgccauccgggccgcgcgcaccgccugcuucguggagccggcccccgacgucguggccgugcuggacagcgucgugcaggggacgggccccgccugcgagcggaagcugaacauccagcuccagcccgagcagcuggacugcggggcggcccaccuccagcacccgcuguccauccuccagccccugaaggccacccccgucuuccgcgcccccggccugaccagcguggcgguggccuccgucaacaacuacaccgccguguuccucgggacggugaacggccggcugcugaagaucaaccucaacgagagcaugcaggucgugucccgccggguggucaccguggccuacggcgagccggugcaccacgucaugcaguucgaccccgccgacagcggguaccuguaccugaugaccucccaccagauggcgcgcgugaagguggccgccugcaacguccacuccacgugcggcgacugcgugggggccgccgacgcguacugcggcuggugcgcccucgagacccggugcacccugcagcaggacugcaccaacuccagccagcagcacuucuggaccuccgccagcgagggccccucccgcugccccgccaugacggugcugccgagcgagaucgacguccggcaggaguaccccgggaugauccuccagaucagcggcucccugcccagccuguccgggauggagauggccugcgacuacggcaacaacauccgcaccguggcgcgggugcccgggccggccuucggccaccagaucgccuacugcaaccuccugccccgcgaccaguucccgcccuucccgcccaaccaggaccacgucaccguggagaugagcgugcgcgucaacggccggaacaucgugaaggccaacuucaccaucuacgacugcucccgcacggcccagguguacccccacaccgcgugcaccagcugccuguccgcccaguggcccugcuucuggugcagccagcagcacuccugcgucagcaaccagucccggugcgaggccagccccaaccccaccagcccccaggacugcccgcgcacgcuccugagcccccuggcccccgugcccaccgggggcucccagaacauccucgugccgcuggcgaacaccgccuucuuccagggggccgcccuggagugcagcuucggccucgaggagaucuucgaggccgucugggugaacgaguccgugguccggugcgaccagguggugcugcacaccacgcgcaagagccaggucuucccccugagccuccagcugaaggggcggcccgcgcgcuuccuggacucccccgagccgaugaccgugaugguguacaacugcgccaugggcagccccgacugcucccagugccucggccgggaggaccuggggcaccugugcauguggagcgacggcugccgccuccgggggccccugcagcccauggccgggaccugcccggcccccgagauccgcgccaucgagccccuguccgggccccucgacggcggcacccugcugaccauccgggggcgcaaccucggccggcgccugagcgacgucgcgcacgggguguggaucggcgggguggccugcgagccgcugcccgaccgguacacggucuccgaggagaucgugugcgugaccggccccgcccccggcccgcucagcggggucgugaccgugaacgccuccaaggagggcaagagccgcgaccgguucuccuacguccugccccuggugcacagccucgagcccaccauggggccgaaggccggcggcacgcgcaucaccauccacgggaacgaccugcacgugggcuccgagcugcagguccucgugaacgacaccgaccccugcaccgagcugaugcggacggacaccagcaucgcgugcaccaugcccgagggggcccugcccgccccgguccccgugugcgugcgcuucgagcgccggggcugcguccacgggaaccucaccuucugguacaugcagaaccccgugaucacggccaucagcccccgccggagcccgguguccggcggccgcaccaucaccgucgcgggggagcgguuccacauggugcagaacgugagcauggccguccaccacaucggccgcgagcccacccugugcaaggugcugaacuccacgcucaucacgugccccagccccggggcccugagcaacgccuccgccccgguggacuucuucaucaacggccgggcguacgccgacgaggucgccguggccgaggagcugcucgaccccgaggaggcccagcgcgggagccgguuccgccuggacuaccugcccaacccccaguucuccaccgcgaagcgggagaaguggaucaagcaccacccgggcgagccccucacccuggugauccacaaggagcaggacagccugggccuccagucccacgaguaccgcgucaagaucggccaggugagcugcgacauccagaucguguccgaccggaucauccacugcagcgucaacgagucccugggcgccgccguggggcagcugcccaucacgauccaggugggcaacuucaaccagaccaucgccacccuccagcucgggggcagcgagaccgccaucaucgucuccaucgugaucugcagcgugcugcuccugcuguccgucguggcccuguucguguucugcaccaagucccgccgggccgagcgcuacuggcagaagacccugcugcagauggaggagauggagucccagauccgggaggagauccgcaagggcuucgccgagcuccagaccgacaugaccgaccugacgaaggagcugaaccggagccaggggauccccuuccucgaguacaagcacuucgucacccgcaccuucuucccgaagugcuccagccuguacgaggagcgcuacgugcugcccucccagacccucaacagccagggcagcucccaggcccaggagacgcacccccugcugggggaguggaagauccccgagagcugccggccgaacauggaggagggcaucucccucuucagcucccugcugaacaacaagcacuuccucaucguguucguccacgcgcuggagcagcagaaggacuucgccgugcgcgaccggugcagccuggccucccuccugaccaucgcccugcacggcaagcucgaguacuacaccagcaucaugaaggagcugcugguggaccugaucgacgccuccgcggccaagaaccccaagcucaugcugcgccggaccgagagcgucguggagaagaugcugacgaacuggauguccaucugcauguacagcugccuccgcgagaccgugggggagcccuucuuccugcugcucugcgccaucaagcagcagaucaacaagggcuccaucgacgccaucaccgggaaggcccgguacacccugaacgaggaguggcugcuccgcgagaacaucgaggcgaagccccggaaccugaacgucagcuuccagggcugcgggauggacucccugagcgugcgcgccauggacaccgacacgcucacccaggugaaggagaagauccuggaggccuucugcaagaacgucccguacucccaguggccccgggccgaggacguggaccuggagugguucgccagcuccacccagagcuacauccuccgcgaccuggacgacaccagcguggucgaggacggccggaagaagcugaacacgcucgcgcacuacaagauccccgagggcgccucccuggccaugagccugaucgacaagaaggacaacacccucgggcgcgugaaggaccuggacaccgagaaguacuuccaccuggugcucccgaccgacgagcuggccgagcccaagaagucccaccggcagagccaccgcaagaagguccugcccgagaucuaccucacgcggcugcuguccaccaagggcacccuccagaaguuccuggacgaccuguucaaggccauccucagcauccgcgaggacaagcccccgcuggcggugaaguacuucuucgacuuccuggaggagcaggccgagaagcgggggaucuccgaccccgacacccuccacaucuggaagacgaacagccugccccugcgcuucugggugaacauccucaagaacccccaguucgucuucgacaucgacaagaccgaccacaucgacgccugccuguccgugaucgcccaggcguucaucgacgccugcagcaucuccgaccugcagcucggcaaggacagcccgaccaacaagcugcuguacgccaaggagauccccgaguaccggaagaucgugcagcgcuacuacaagcagauccaggacaugacgccccuguccgagcaggagaugaacgcccaccuggccgaggagagccgcaaguaccagaacgaguucaacacgaacgucgcgauggccgagaucuacaaguacgccaagcgguaccgcccccagaucauggccgcccuggaggcgaacccgaccgcccggcgcacccagcuccagcacaaguucgagcaggucgucgcccugauggaggacaacaucuacgagugcuacuccgaggccuga

SEQ ID NO: 34761 - RNA, 1509 nt, Artificial Sequence
  derived and/or modified sequence opt1 from PM20D1__Homo_sapiens__NP_689704
auggcccagcgcugcgugugcguccuggcccucguggcgaugcugcugcucguguuccccaccgucagccgguccaugggcccgcgcagcggggagcaccagcgggccucccgcauccccagccaguucuccaaggaggagcggguggccaugaaggaggcccugaagggcgccauccagauccccaccgugacguucagcuccgagaaguccaacaccaccgcgcuggccgaguucgggaaguacauccacaaggucuuccccaccguggugagcacgagcuucauccagcacgaggucguggaggaguacucccaccucuucaccauccagggcagcgacccgucccugcagcccuaccugcucauggcccacuucgacgugguccccgcccccgaggaggggugggaggugccgcccuucagcggccuggagcgcgacggcaucaucuacgggcggggcacccuggacgacaagaacuccgugauggcgcuccugcaggcccuggagcuccugcugauccgcaaguacaucccccggcgcagcuucuucaucucccucgggcacgacgaggagagcuccggcaccggggcccagcggaucagcgcccugcugcagagccgcggcguccagcucgccuucaucguggacgagggcggguucauccuggacgacuucauccccaacuucaagaagccgaucgcgcugaucgccguguccgagaagggcagcaugaaccucaugcugcaggucaacaugacguccgggcacagcuccgccccgcccaaggagaccagcaucggcauccuggccgccgcggugucccggcucgagcagacccccaugcccaucaucuucggcagcgggaccguggucacggugcugcagcagcuggccaacgaguuccccuuccccgugaacaucauccucuccaaccccuggcuguucgagccgcugaucagccgcuucauggagcggaacccccucaccaacgccaucauccgcaccaccacggcccugaccaucuucaaggccggcgucaaguucaacgugaucccgcccgucgcgcaggccaccgugaacuuccggauccaccccgggcagaccgugcaggagguccuggagcucacgaagaacaucguggccgacaaccgcgugcaguuccacguccuguccgccuucgacccccugcccgugagccccuccgacgacaaggcccucggcuaccagcugcugcggcagaccgugcagagcgucuucccggaggugaacaucaccgcgcccgugaccuccaucgggaacacggacagccgcuucuucaccaaccucaccaccggcaucuaccgguucuaccccaucuacauccagccggaggacuucaagcgcauccacggcgucaacgagaagaucuccgugcaggccuacgagacccaggugaaguucaucuucgagcugauccagaacgccgacacggaccaggagcccgucagccaccuccacaagcuguga

SEQ ID NO: 34762 - RNA, 165 nt, Artificial Sequence
  derived and/or modified sequence opt1 from PMAIP1__Homo_sapiens__NP_066950
augcccggcaagaaggcccgcaagaacgcccagccgagccccgcgcgggcccccgccgagcuggagguggagugcgccacccagcuccgccgguucggggacaagcugaacuuccgccagaagcugcucaaccugaucuccaagcuguucugcagcggcaccuga

SEQ ID NO: 34763 - RNA, 498 nt, Artificial Sequence
  derived and/or modified sequence opt1 from PMCH__Homo_sapiens__NP_002665
auggccaagaugaaccugagcuccuacauccucauccugaccuucagccuguucucccagggcauccuccugagcgccuccaagagcauccgcaaccuggacgacgacaugguguucaacaccuuccggcucgggaagggcuuccagaaggaggacacggcggagaaguccgugaucgcccccagccuggagcaguacaagaacgacgaguccagcuucaugaacgaggaggagaacaagguguccaagaacaccgggagcaagcacaacuuccugaaccacggccucccgcugaaccuggccaucaagcccuaccucgcccugaagggguccguggccuuccccgcggagaacggcguccagaacaccgagagcacccaggagaagcgcgagaucggcgacgaggagaacuccgccaaguuccccaucgggcggcgcgacuucgacaugcugcggugcaugcucggccgcguguaccggccgugcuggcaggucuga

SEQ ID NO: 34764 - RNA, 1728 nt, Artificial Sequence
  derived and/or modified sequence opt1 from PMEL__Homo_sapiens__NP_001186982
auggaccuggugcucaagcgcugccugcugcaccucgccgucaucggcgcccugcuggcggugggggccaccaagggcagccagguguggggcgggcagcccgucuacccgcaggagaccgacgacgccugcaucuuccccgacgggggccccugccccuccggcagcuggucccagaagcggagcuucguguacguguggaagacgugggggcaguacuggcagguccucggcgggccgguguccggccugagcaucgggaccggccgcgccaugcugggcacccacaccauggaggugacggucuaccaccggcgcgggucccggagcuacgugccccucgcccacuccagcuccgcguucaccaucaccgaccaggugcccuucagcgucuccgugagccagcugcgcgcccuggacggcgggaacaagcacuuccuccggaaccagccccugaccuucgcccugcagcuccacgacccguccggcuaccuggccgaggcggaccugagcuacacgugggacuucggcgacuccagcgggacccucaucucccgcgcccugguggucacccacaccuaccuggagcccggccccgugacggcccaggugguccuccaggccgccaucccccugaccagcugcgggagcuccccggugcccggcaccaccgacgggcaccggcccacggcggaggcccccaacaccaccgccggccaggugccgaccacggaggucgugggcaccacccccgggcaggcccccaccgccgagcccagcggcacgaccuccgugcaggucccgaccaccgaggugaucagcacggcgcccguccagaugcccaccgccgaguccaccgggaugacccccgagaaggugccggugagcgaggucaugggcacgacccuggccgagauguccacccccgaggccaccgggaugacgcccgccgaggugagcaucgugguccucuccggcaccaccgcggcccaggugaccaccacggaguggguggagaccaccgcccgcgagcugcccaucccggagcccgagggccccgacgccagcuccaucaugagcaccgaguccaucacggggagccugggcccgcuccuggacgggaccgccacccugcggcucgucaagcgccaggugccccuggacugcgugcuguaccgguacggcuccuucagcgucacccucgacaucgugcaggggaucgaguccgcggagauccugcaggccgugcccagcggcgagggcgacgccuucgagcugacggucuccugccagggcgggcuccccaaggaggccugcauggagaucagcagcccggggugccagccgcccgcgcagcgccugugccagcccgugcugcccucccccgccugccagcucgugcugcaccagauccugaagggcggcagcgggaccuacugccucaacgucucccuggccgacaccaacagccuggccgugguguccacccagcucaucaugcccggccaggaggccgggcugggccaggucccccugaucguggggauccuccuggugcugauggcggucgugcuggccagccucaucuaccggcgccggcugaugaagcaggacuucuccgugccgcagcugccccacagcuccagccacuggcuccgccugccccggaucuucugcuccugccccaucggcgagaacagcccgcugcucuccggccagcaggucuga

SEQ ID NO: 34765 - RNA, 780 nt, Artificial Sequence
  derived and/or modified sequence opt1 from PMEPA1__Homo_sapiens__NP_001242905
augcccgccaucccggcccacggcgcggagcuggaguucgugcagaucaucaucaucgucguggugaugauggucauggugguggucaucaccugccuccugagccacuacaagcuguccgcccgcagcuucaucucccggcacagccaggggcgccggcgcgaggacgcccucuccagcgagggcugccuguggcccuccgagagcaccguguccgggaacggcauccccgagccccagguguacgccccgccccggcccacggaccgccuggccguccccccguucgcgcagcgggagcgcuuccaccgguuccagcccaccuaccccuaccuccagcacgagaucgaccugcccccgaccaucagccuguccgacggggaggagcccccccccuaccagggcccgugcacccuccagcugcgcgaccccgagcagcagcuggagcucaaccgggagagcgugcgcgccccccccaaccggacgaucuucgacuccgaccugauggacagcgcccgccugggcgggccgugcccccccuccagcaacuccggcaucagcgccaccugcuacggguccggcgggcggauggagggccccccgcccaccuacagcgaggugaucggccacuaccccgggagcuccuuccagcaccagcagagcuccggccccccgagccuccuggaggggacccgccugcaccacacgcacaucgcgccccucgaguccgccgccaucuggagcaaggagaaggacaagcagaagggccacccccuguga

SEQ ID NO: 34766 - RNA, 663 nt, Artificial Sequence
  derived and/or modified sequence opt1 from PMF1-BGLAP__Homo_sapiens__NP_001186590
auggccgaggccagcuccgcgaaccugggcagcgggugcgaggagaagcgccacgagggcuccagcuccgagagcgugcccccggggaccaccaucucccgggucaagcuccuggacacgaugguggacaccuuccugcagaagcucguggccgccggcagcuaccagcgcuucaccgacugcuacaagugcuucuaccagcugcagcccgccaugacccagcagaucuacgacaaguucaucgcccagcugcagacguccauccgggaggagaucagcgacaucaaggaggaggggaaccucgaggcgguccugaacgcccuggacaagaucguggaggagggcaaggugcgcaaggagcccgccugcaacggcacccccugcggggccaugugccggaaccgccggccgcgcaccuccagcuggcagaugcccuccuggcagggcgggggccgguggcgcagcugcuccuaccggagccgccccuccagccggcccgggcgcugcgaggcgcagcggugccgcguccagcagcggugcucccucugcgugcaggccggcggccagcgcgggagcgaggagacccaggcccugccggugagcauggccggcucccccagcccccugcccggguccccgggcgcccaggagggcggggucuga

SEQ ID NO: 34767 - RNA, 543 nt, Artificial Sequence
  derived and/or modified sequence opt1 from PMF1__Homo_sapiens__NP_001186582
auggccgaggccagcuccgcgaaccugggcagcgggugcgaggagaagcgccacgagggcuccagcuccgagagcgugcccccggggaccaccaucucccgggucaagcuccuggacacgaugguggacaccuuccugcagaagcucguggccgccggcagcuaccagcgcuucaccgacugcuacaagugcuucuaccagcugcagcccgccaugacccagcagaucuacgacaaguucaucgcccagcugcagacguccauccgggaggagaucagcgacaucaaggaggaggggaaccucgaggcgguccugaacgcccuggacaagaucguggaggagggcaaggugcgcaaggagcccgccugcaacggcacccccugcggggccaugugccggaaccgccggccgcgcaccuccagcuggcagaugcccuccuggcagggcgggggccgguggcgcagcugcuccuaccggagccgccccuccagccggcccgggcgccucuacaccgagaaccggggcuccuggcugcugugcuga

SEQ ID NO: 34768 - RNA, 1902 nt, Artificial Sequence
  derived and/or modified sequence opt1 from PML__Homo_sapiens__NP_002666
auggagcccgccccggcccgcagcccccggccccagcaggaccccgcgcgcccgcaggagcccaccaugcccccgcccgagacccccuccgagggccggcagcccagccccuccccgagccccacggagcgcgcccccgccuccgaggaggaguuccaguuccugcggugccagcagugccaggccgaggccaagugccccaagcuccugccgugccugcacacccucugcagcgggugccuggaggcguccggcaugcagugccccaucugccaggcccccuggccccugggggccgacaccccggcccucgacaacguguucuucgagagccugcagcgccggcuguccgucuaccgccagaucguggacgcgcaggccgugugcacccggugcaaggagagcgccgacuucuggugcuucgagugcgagcagcuccugugcgccaagugcuucgaggcccaccagugguuccugaagcacgaggcgcgcccccucgccgagcugcggaaccaguccguccgcgaguuccuggacggcacgcggaagaccaacaacaucuucugcagcaaccccaaccaccgcacccccacccucacguccaucuacugccgggggugcagcaagccgcugugcugcuccugcgcccugcucgacagcucccacagcgagcugaagugcgacaucuccgccgagauccagcagcgccaggaggagcuggacgccaugacccaggcgcuccaggagcaggacagcgccuucggcgccgugcacgcccagaugcacgccgcggugggccagcuggggcgggcccgcgccgagaccgaggagcugauccgggagcgcguccgccaggugguggcccacguccgggcccaggagcgcgagcuccuggaggcgguggacgcccgguaccagcgcgacuacgaggagauggccagccggcugggccgccucgacgccgugcugcagcggauccgcaccggguccgcgcugguccagcggaugaagugcuacgccagcgaccaggaggugcucgacaugcacggcuuccugcgccaggcccugugccggcuccgccaggaggagccccagucccugcaggccgccgugcggacggacggguucgacgaguucaagguccgccugcaggaccucagcuccugcaucacccagggcaaggacgcggccgugagcaagaaggccucccccgaggccgccagcacgccccgggacccgaucgacguggaccugcccgaggaggcggagcgcgucaaggcccaggugcaggcccugggccucgccgaggcccagcccauggcggugguccaguccgugccgggggcccaccccgugcccgucuacgccuucagcaucaagggccccuccuacggggaggacgugagcaacaccaccaccgcccagaagcggaagugcucccagacccagugcccgcgcaaggucaucaagauggagagcgaggagggcaaggaggcgcggcuggcccgcuccagccccgagcagccccggcccuccaccagcaaggccguguccccgccccaccuggacggcccgcccagcccccgcagccccgugaucggguccgaggucuuccuccccaacagcaaccacguggccuccggcgccggggaggcggaggagcgcguggucgugaucagcuccagcgaggacuccgacgccgagaacagcuccagccgggagcuggacgacuccagcuccgagagcuccgaccugcagcucgagggccccagcacgcugcgcgugcuggacgagaaccucgccgacccgcaggccgaggaccggccccuggucuucuucgaccugaagaucgacaacgaguccggguucagcuggggcuacccccaccccuuccugaucuga

SEQ ID NO: 34769 - RNA, 789 nt, Artificial Sequence
  derived and/or modified sequence opt1 from PMM1__Homo_sapiens__NP_002667
auggccgugaccgcccaggcggcccgccggaaggagcgcguccugugccucuucgacguggacggcacccugacgcccgcccggcagaagaucgacccggagguggccgccuuccugcagaagcuccgcucccggguccagaucgggguggugggcggguccgacuacugcaagaucgcggagcagcugggcgacggggacgaggucaucgagaaguucgacuacguguucgccgagaacggcaccgugcaguacaagcacggccgccugcucagcaagcagaccauccagaaccaccugggggaggagcugcuccaggaccugaucaacuucugccuguccuacauggcccuccugcggcugcccaagaagcgcggcaccuucaucgaguuccggaacgggaugcucaacaucagccccaucggccgcuccugcacgcuggaggagcggaucgaguucagcgagcuggacaagaaggagaagauccgcgagaaguucgucgaggcccucaagaccgaguucgcggggaagggccugcgguucucccgcggcgggaugaucagcuucgacguguuccccgagggcugggacaagcgguacugccuggacucccucgaccaggacagcuucgacaccauccacuucuucgggaacgagaccuccccgggcggcaacgacuucgagaucuucgccgacccccgcacgguggggcacagcgucgugagcccccaggacaccgugcagcggugccgcgagaucuucuuccccgagaccgcccacgaggccuga

SEQ ID NO: 34770 - RNA, 741 nt, Artificial Sequence
  derived and/or modified sequence opt1 from PMM2__Homo_sapiens__NP_000294
auggccgcccccggcccggcgcugugccucuucgacguggacgggacccugaccgcgccccgccagaagaucacgaaggagauggacgacuuccugcagaagcuccggcagaagaucaagaucggcgucgucgggggcagcgacuucgagaaggugcaggagcagcuggggaacgacgugguggagaaguacgacuacguguuccccgagaacggccuggucgccuacaaggacggcaagcuccugugccgccagaacauccagucccaccugggggaggcccucauccaggaccugaucaacuacugccugagcuacaucgccaagaucaagcuccccaagaagcggggcaccuucaucgaguuccgcaacgggaugcugaacguguccccgaucggccggagcugcucccaggaggagcgcaucgaguucuacgagcuggacaagaaggagaacauccggcagaaguucguggccgaccuccgcaaggaguucgccgggaagggccugaccuucagcaucggcgggcagaucuccuucgacgucuuccccgacggcugggacaagcgguacugccugcgccacguggagaacgacggguacaagaccaucuacuucuucggcgacaagacgaugcccggcgggaacgaccacgagaucuucaccgacccccggaccaugggcuacagcgugaccgccccggaggacacgcgccggaucugcgagcuccuguucuccuga

SEQ ID NO: 34771 - RNA, 483 nt, Artificial Sequence
  derived and/or modified sequence opt1 from PMP22__Homo_sapiens__NP_000295
augcugcuccugcugcucagcaucaucgugcugcacgucgccgugcuggugcuccuguucgucuccaccaucgugagccaguggaucgugggcaacgggcacgccaccgaccuguggcagaacugcuccacgagcuccagcggcaacguccaccacugcuucuccagcucccccaacgaguggcuccagagcgugcaggcgaccaugauccuguccaucaucuucagcauccugucccucuuccuguucuucugccagcuguucacccucaccaagggcgggcgcuucuacaucacggggaucuuccagauccuggccggccugugcgugaugagcgccgccgccaucuacaccguccggcacccggaguggcaccucaacuccgacuacagcuacggcuucgcguacauccuggccuggguggccuucccccuggcccuccuguccggggugaucuacgucauccugcgcaagcgggaguga

SEQ ID NO: 34772 - RNA, 1185 nt, Artificial Sequence
  derived and/or modified sequence opt1 from PMPCA__Homo_sapiens__NP_001269873
augaagcgcaacacccugguggagcuccugaccuucuggaagaacuggcacuuccggcugcuccuggaccugacggccaagaugaaguucugccuccgcuggaaguccaugggcgucagcgugaccgcccggcaccaggacgaggagguggagaugacccgcauggcgguccaguucgagcuggaggaccugaaccuccggcccgacccggagccccugcugaccgagaugauccacgaggccgccuaccgcgagaacacgguggggcuccaccgguucugccccaccgagaacguggccaagaucaaccgcgagguccugcacagcuaccugcggaacuacuacacccccgaccgcauggugcucgccggcgugggggucgagcacgagcaccugguggacugcgcgcggaaguaccugcucggcgugcagccggccuggggguccgccgaggccgucgacaucgaccgcagcguggcgcaguacaccggcggcaucgccaagcuggagcgggacauguccaacgugagccuggggcccacgcccauccccgagcucacccacaucauggucggccuggaguccugcagcuuccuggaggaggacuucaucccguucgccgugcucaacaugaugaugggcgggggcggguccuucagcgccggcgggcccggcaaggggauguucucccgccuguaccugaacgugcucaaccggcaccacuggauguacaacgccaccagcuaccaccacuccuacgaggacaccggccugcugugcauccacgcgagcgccgacccccgccagguccgggagaugguggagaucaucacgaaggaguucauccucaugggcgggaccguggacaccgucgagcuggagcgcgccaagacccagcugacguccaugcucaugaugaaccuggagagccggcccgugaucuucgaggacgugggccgccagguccuggccacccggucccgcaagcucccgcacgagcugugcacccugauccgcaacgugaagcccgaggacgucaagcggguggccagcaagaugcuccgcgggaagcccgcgguggccgcccugggcgaccugaccgaccuccccacguacgagcacauccagaccgcccuguccagcaaggacgggcggcugccgcgcaccuaccgccucuuccgguga

SEQ ID NO: 34773 - RNA, 1470 nt, Artificial Sequence
  derived and/or modified sequence opt1 from PMPCB__Homo_sapiens__NP_004270
auggccgccgcggccgcccgcgugguccugagcuccgccgcccggcgccggcucuggggcuucagcgagucccugcugauccgcggggcggccggccggagccucuacuucggggagaaccgccugcgguccacccaggccgccacccagguggugcugaacguccccgagacgcgcgugaccugccucgagagcggccugcggguggcguccgaggacagcgggcuguccacgugcaccgucggccucuggaucgacgccggcagccgcuacgagaacgagaagaacaacgggaccgcccacuuccuggagcacauggccuucaagggcaccaagaagcggucccagcuggaccucgagcuggagaucgagaacaugggggcccaccugaacgcguacaccagccgcgagcagaccguguacuacgccaaggccuucuccaaggaccucccgcgggccguggagauccuggccgacaucauccagaacagcacgcugggcgaggcggagaucgagcgcgagcgcggggucauccuccgggagaugcaggagguggagaccaaccugcaggagguggucuucgacuaccugcacgccaccgccuaccagaacaccgcccucggccggacgauccugggccccaccgagaacaucaaguccaucagccgcaaggaccugguggacuacaucaccacccacuacaaggggccccggaucgugcucgccgcggccggcggggucucccacgacgagcugcuggaccucgccaaguuccacuucggcgacagccugugcacgcacaagggcgagauccccgcccugccgcccugcaaguucaccggguccgagauccgcgugcgggacgacaagaugccccucgcccaccuggcgaucgccguggaggccgucggcugggcccaccccgacaccaucugccugaugguggcgaacacccucaucgggaacugggaccgcagcuucggcgggggcaugaaccugagcuccaagcuggcccagcucacgugccacggcaaccugugccacagcuuccaguccuucaacaccagcuacaccgacaccgggcuguggggccucuacauggugugcgaguccagcacggucgccgacaugcugcacguggugcagaaggaguggaugcgccugugcaccuccgucaccgagagcgagguggcccgggcccgcaaccuccugaagaccaacaugcugcuccagcuggacggguccacgccgaucugcgaggacaucggccggcagaugcugugcuacaaccgccggauccccauccccgagcucgaggcgcgcaucgacgccgucaacgccgagaccauccgggaggugugcaccaaguacaucuacaaccgcagccccgccaucgccgcgguggggccgaucaagcagcugcccgacuucaagcagauccgguccaacaugugcuggcugcgcgacuga

SEQ ID NO: 34774 - RNA, 2799 nt, Artificial Sequence
  derived and/or modified sequence opt1 from PMS1__Homo_sapiens__NP_000525
augaagcagcugcccgccgccaccgugcgccuccugagcuccagccagaucaucaccuccgucgugagcguggucaaggagcugaucgagaacucccucgacgcgggcgccacgagcguggacgugaagcuggagaacuacggguucgacaagaucgagguccgggacaacggcgaggggaucaaggccguggacgccccggugauggccaugaaguacuacaccuccaagaucaacagccacgaggaccuggagaaccucaccaccuacggcuuccgcggggaggcgcugggcuccaucugcugcaucgccgagguccugaucacgacccggaccgccgccgacaacuucagcacccaguacgugcucgacggcuccgggcacauccugagccagaagcccucccaccugggccaggggacgaccgugaccgcgcuccgccuguucaagaaccugcccguccggaagcaguucuacagcaccgccaagaagugcaaggacgagaucaagaagauccaggaccuccugauguccuucggcauccugaagcccgaccuccgcaucguguucgugcacaacaaggccgucaucuggcagaagucccgggugagcgaccacaagauggcccugaugagcgugcuggggacggccgucaugaacaacauggaguccuuccaguaccacagcgaggagagccagaucuaccucuccggcuuccugccgaagugcgacgcggaccacagcuucaccucccugagcacccccgagcgcuccuucaucuucaucaacagccggcccgugcaccagaaggacauccucaagcugauccgccaccacuacaaccugaagugccucaaggaguccacccggcuguaccccguguucuuccugaagaucgacgucccgacggccgacguggacgugaaccucacccccgacaagagccagguccugcugcagaacaaggaguccgugcucaucgcccuggagaaccugaugacgaccugcuacggcccccuccccagcaccaacuccuacgagaacaacaagaccgacgucagcgccgccgacaucgugcuguccaagaccgcggagaccgacgugcuguucaacaaggucgagagcuccgggaagaacuacagcaacguggacacguccgugaucccguuccagaacgacaugcacaacgacgagagcggcaagaacaccgacgacugccucaaccaccagaucuccaucggggacuucggcuacggccacugcagcagcgagaucuccaacaucgacaagaacaccaagaacgccuuccaggacaucagcauguccaacgucagcugggagaacucccagaccgaguacagcaagacgugcuucaucuccagcgugaagcacacccaguccgagaacgggaacaaggaccacaucgacgagagcggcgagaacgaggaggaggccgggcuggagaacuccagcgagaucuccgccgacgaguggagccgcggcaacauccugaagaacuccgugggggagaacaucgagcccgucaagauccucgugcccgagaagucccugcccugcaaggugagcaacaacaacuacccgauccccgagcagaugaaccugaacgaggacagcugcaacaagaaguccaacgucaucgacaacaagagcggcaaggugaccgccuacgaccuccugagcaaccgggugaucaagaagcccauguccgcgagcgcccuguucguccaggaccaccgcccccaguuccucaucgagaacccgaagaccucccuggaggacgccacgcugcagaucgaggagcuguggaagacccucagcgaggaggagaagcugaaguacgaggagaaggccaccaaggaccuggagcgguacaacucccagaugaagcgcgccaucgagcaggagagccagaugucccucaaggacggccggaagaagaucaagcccaccagcgcguggaaccuggcccagaagcacaagcugaagacgucccucagcaaccagcccaagcuggacgagcugcuccagucccagaucgagaagcgccggagccagaacaucaagauggugcagauccccuucuccaugaagaaccugaagaucaacuucaagaagcagaacaagguggaccuggaggagaaggacgagccgugccucauccacaaccugcgcuuccccgacgccuggcugaugaccagcaagaccgaggucaugcuccugaaccccuaccggguggaggaggcccuccuguucaagcgccugcuggagaaccacaagcuccccgcggagccgcuggagaagcccaucaugcugaccgagucccucuucaacgggagccacuaccuggacgugcuguacaagaugaccgccgacgaccagcgcuacuccggcagcacguaccucagcgacccccggcugaccgccaacggguucaagaucaagcugaucccgggcgucuccaucaccgagaacuaccucgagaucgaggggauggccaacugccugcccuucuacggcguggccgaccugaaggagauccucaacgcgauccugaaccgcaacgccaaggagguguacgagugccggccccgcaaggucaucagcuaccuggagggcgaggccgugcggcucucccgccagcugcccauguaccugagcaaggaggacauccaggacaucaucuaccggaugaagcaccaguucgggaacgagaucaaggagugcgugcacggccgcccguucuuccaccaccucaccuaccugcccgagacgaccuga

SEQ ID NO: 34775 - RNA, 2589 nt, Artificial Sequence
  derived and/or modified sequence opt1 from PMS2__Homo_sapiens__NP_000526
auggagcgcgccgagagcuccagcaccgagcccgccaaggcgaucaagccgaucgaccggaaguccgugcaccagaucugcagcggccaggucgugcugucccucagcaccgccgugaaggagcuggucgagaacucccuggacgccggggccacgaacaucgaccucaagcugaaggacuacggcguggaccugaucgaggugagcgacaacgggugcggcgucgaggaggagaacuucgaggggcucacccugaagcaccacaccuccaagauccaggaguucgccgaccugacccagguggagacguucggcuuccgcggcgaggcgcucagcucccugugcgcccugagcgacgugaccaucuccacgugccacgccagcgccaaggucgggacccggcucauguucgaccacaacggcaagaucauccagaagacccccuacccccgcccccgggggaccaccguguccgugcagcagcuguucagcacccugccgguccgccacaaggaguuccagcggaacaucaagaaggaguacgcgaagaugguccaggugcuccacgccuacugcaucaucuccgccggcauccgcgugagcugcacgaaccagcuggggcagggcaagcggcagcccguggugugcaccggcgggucccccagcaucaaggagaacaucggcagcgucuucgggcagaagcagcugcagucccucauccccuucgugcagcugccgcccagcgacuccgugugcgaggaguacggccugagcugcuccgacgcccuccacaaccuguucuacaucagcggcuucaucucccagugcacccacggggucggccgcagcuccaccgaccggcaguucuucuucaucaaccgccggcccugcgaccccgccaaggugugccgccuggugaacgaggucuaccacauguacaaccggcaccaguacccguucgugguccucaacaucagcguggacuccgagugcguggacaucaacgucacgcccgacaagcgccagauccugcugcaggaggagaagcuccugcuggcggugcucaagaccagccugaucgggauguucgacuccgacgugaacaagcugaacgucagccagcagccccuccuggacguggagggcaaccugaucaagaugcacgccgccgaccucgagaagcccaugguggagaagcaggaccaguccccgagccugcggaccggggaggagaagaaggacgucuccaucagccgccugcgggaggccuucucccuccgccacaccacggagaacaagccccacagccccaagacccccgagccgcggcgcagcccccugggccagaagcgcggcaugcuguccagcuccaccagcggggccaucuccgacaagggcgugcuccggccccagaaggaggcggugagcuccagccacgggcccuccgacccgaccgaccgcgccgaggucgagaaggacagcggccacggguccacgagcguggacuccgagggcuucagcauccccgacaccggcucccacugcagcuccgaguacgccgccagcagccccggggaccggggcucccaggagcacguggacagccaggagaaggcccccaagaccgacgacuccuucagcgacgucgacugccacuccaaccaggaggacaccgggugcaaguuccgcgugcugccgcagcccacgaaccuggcgacccccaacaccaagcgguucaagaaggaggagauccucagcuccagcgacaucugccagaagcuggugaacacccaggacauguccgccagccaggucgacguggccgugaagaucaacaagaaggucgugccgcuggacuucuccaugagcucccucgccaagcgcaucaagcagcugcaccacgaggcccagcagagcgagggcgagcagaacuaccggaaguuccgcgcgaagaucugccccggggagaaccaggccgccgaggacgagcugcggaaggagaucuccaagacgauguucgccgagauggagaucaucggccaguucaaccugggcuucaucaucaccaagcucaacgaggacaucuucaucguggaccagcacgcgaccgacgagaaguacaacuucgagaugcugcagcagcacaccguccugcaggggcagcgccucaucgcgccccagacgcugaaccugaccgccgugaacgaggccgugcucaucgagaaccuggagaucuuccggaagaacggcuucgacuucgucaucgacgagaacgcccccgugaccgagcgcgccaagcugaucagccucccgaccuccaagaacuggaccuucgggccccaggacguggacgagcugaucuucaugcugagcgacucccccggcgucaugugccggcccagccgcgugaagcagauguucgccagccgggccugccgcaaguccgugaugaucggcacggcccucaacaccagcgagaugaagaagcugaucacccacaugggggagauggaccacccguggaacugcccccacggccggcccaccaugcgccacaucgccaaccugggggucaucucccagaacuga

SEQ ID NO: 34776 - RNA, 579 nt, Artificial Sequence
  derived and/or modified sequence opt1 from PMVK__Homo_sapiens__NP_006547
auggcgccccugggcggggccccgcgccucgugcugcuguucagcggcaagcggaaguccgggaaggacuucgucaccgaggcccuccagagccgccugggcgccgacgugugcgccgugcugcggcucuccgggccccugaaggagcaguacgcccaggagcacggccugaacuuccagcgccuccuggacaccagcacguacaaggaggccuuccggaaggacaugauccgcuggggcgaggagaagcggcaggcggaccccggguucuucugccgcaagaucgucgagggcaucucccagcccaucuggcuggugagcgacacccggcgcguguccgacauccagugguuccgggaggccuacggggccgucacccagaccgugcgcguggucgcccucgagcagagccggcagcagcgcggcuggguguucacgccggggguggacgacgcggaguccgagugcggccuggacaacuucggcgacuucgacugggucaucgagaaccacgggguggagcagcggcuggaggagcagcucgagaaccugaucgaguucauccgcagccggcuguga

SEQ ID NO: 34777 - RNA, 1281 nt, Artificial Sequence
  derived and/or modified sequence opt1 from PNCK__Homo_sapiens__NP_001034671
auggaggccgccuucggccagguggcggggagcgccugcccccgccggggcggggagggccgcgacuggaaggccgagucccuggccgaccucuggcccaagagcucccccggggacagccaccgguggugcaagggccccggcgccgggcccgcgggcccccagcugcgcgaggccgcccgggccuccagcgggcugggcgggggcggccgccaccccucccggauccccgcgaucgcccuccaggacaugcugcugcucaagaagcacaccgaggacaucagcuccgucuacgagauccgcgagcggcuggggagcggcgccuucuccgagguggugcuggcccaggagcgcgggagcgcccaccucgucgcgcugaagugcauccccaagaaggcccugcggggcaaggaggcccucguggagaacgagaucgccgugcugcgccggaucucccacccgaacaucgucgcccuggaggacgugcacgagagccccucccaccucuaccuggcgauggagcuggugaccggcggggagcuguucgaccgcaucauggagcggggcagcuacacggagaaggacgccucccaccuggucggccaggugcugggggccgugagcuaccuccacucccuggggaucguccaccgcgaccugaagcccgagaaccuccuguacgccacccccuucgaggacagcaagaucauggugagcgacuucggccuguccaagauccaggccggcaacaugcucgggaccgcgugcggcaccccgggguacguggcccccgagcugcuggagcagaagcccuacggcaaggccgucgacgugugggcccucggggugaucagcuacauccugcugugcggcuacccgccguucuacgacgaguccgaccccgagcuguucagccagauccuccgggccuccuacgaguucgacagccccuucugggacgacaucuccgagagcgcgaaggacuucauccgccaccuccucgagcgggacccccagaagcgcuucacgugccagcaggcccugcggcaccuguggaucuccggcgacaccgccuucgaccgcgacauccucgggagcgucuccgagcagauccgcaagaacuucgcccggacccacuggaagcgcgcguucaacgccaccagcuuccugcggcacauccgcaagcugggccagaucccggagggggagggcgccuccgagcaggggauggcccggcacagccacuccggccuccgcgccggccagccgcccaagugguga

SEQ ID NO: 34778 - RNA, 429 nt, Artificial Sequence
  derived and/or modified sequence opt1 from PNKD__Homo_sapiens__NP_001070867
auggccgccguggucgcggccaccgcccugaagggccgcggggcccggaacgcccgcgugcuccggggcauccuggcgggggccaccgccaacaaggccagccacaaccgcacgcgggcgcugcagucccacagcucccccgagggcaaggaggagccggagccccucagccccgagcuggaguacaucccccgcaagcgggggaagaacccgaugaaggccgugggccuggccugggccaucggcuuccccugcgggauccuccuguucauccugaccaagcgcgaggucgacaaggaccgggugaagcagaugaaggcccgccagaacaugcggcucuccaacaccggcgaguacgagagccagcgcuuccgggcguccagccaguccgcccccagccccgacgugggguccggcguccagaccuga

SEQ ID NO: 34779 - RNA, 1566 nt, Artificial Sequence
  derived and/or modified sequence opt1 from PNKP__Homo_sapiens__NP_009185
augggcgagguggaggcccccgggcgccuguggcucgagagcccgcccggcggggccccgcccaucuuccugcccuccgacggccaggcgcugguccucgggcggggcccccugacccaggugaccgaccgcaagugcagccggacccagguggagcuggucgccgaccccgagacccgcaccguggccgugaagcagcucggcgucaaccccuccaccacggggacccaggagcugaagccgggccuggaggggagccucggcgugggggacacccuguaccuggugaacggccuccacccccugacccugcggugggaggagacgcgcacccccgagucccagcccgacaccccgcccggcacgccccucgucagccaggacgagaagcgggacgccgagcugcccaagaagcgcaugcggaaguccaacccggggugggagaaccuggagaagcuccugguguucacggccgcgggcgugaagccccaggggaaggucgccggcuucgaccuggacggcacccucaucaccacccgcagcgggaagguguuccccacgggccccuccgacuggcggauccuguacccggagaucccccgcaagcugcgggagcucgaggccgagggguacaagcuggugaucuucaccaaccagaugagcaucggccgcgggaagcugcccgccgaggaguucaaggcgaaggucgaggccgugguggagaagcucggcguccccuuccaggugcugguggccacccacgccggccuguaccggaagccggucaccgggaugugggaccaccuccaggagcaggccaacgacggcacgcccaucuccaucggggacagcaucuucgugggcgacgcggccgggcgccccgccaacugggcccccggccggaagaagaaggacuucuccugcgccgaccgccuguucgcgcugaaccucggccugccguucgccacccccgaggaguucuuccugaaguggcccgccgccggguucgagcucccggccuucgacccccggaccgugagccgcuccggcccccugugccugcccgagagccgggcgcuccuguccgccagcccggaggucguggucgccgugggguuccccggcgccgggaaguccaccuuccugaagaagcaccucgugagcgccggcuacguccacgugaaccgcgacacgcugggcagcuggcagcgcugcgugacgaccugcgagaccgcgcugaagcaggggaagcgggucgccaucgacaacaccaaccccgacgccgccucccgcgcgcgguacgugcagugcgcccgcgccgccggcgugcccugccggugcuuccucuucaccgccacccuggagcaggcgcgccacaacaaccgguuccgcgagaugaccgacagcucccacaucccggucagcgacauggugauguacggguaccggaagcaguucgaggcccccacgcuggccgagggcuucuccgccauccucgagauccccuuccgccuguggguggagccccggcugggccgccuguacugccaguucagcgagggguga

SEQ ID NO: 34780 - RNA, 1596 nt, Artificial Sequence
  derived and/or modified sequence opt1 from PNLDC1__Homo_sapiens__NP_001258791
auggacgugggcgccgacgaguucgaggagagccugccccuccugcaggagcugguccaggaggccgacuucguggggcucgacaucgaguucaccggccugcgcuccaaccugagcgggccgcagcagaucucccucuucgaccugcccagcgagugguaccugaagacccggcaguccgugcagcaguucacggucugccagaucggccucagcguguucuccgcgaucgagggggaggccaacaaguacaucgcccacagcugcaacuucuaccuguuccccaccaccuucggcauccuggacuccgaguucagcuuccaggccuccagcgugcaguuccucaaccaguacggcuucaacuacaacaaguuccugaagaacgggauccccuacaugaacgaggagcaggagaagaagauccgccacgacauccugaccggcaacuggcggguccgcuccagcccggacaaggaccagaucaagguggugaucgacgaggucacgcgguggcucgagcuggccaaggagggggacuggaugacccugcccggcaucaccggguuccaggcguucgaggugcagcucgugcugcgccaggcccugcccaacaucuggaccguccucaaggacgagggcgugguggucaagaagguguccaagcagcaccggugguaccugcagaacacgagcugcgaccgcgaguccugcuggaaggagaacauccugcucagcgcccggggcuucuccguguucuuccagaugcuggucaaggcccagaagccccugguggggcacaacaugaugauggaccuccugcaccuccacgagaaguucuuccgcccgcugcccgagagcuacgaccaguucaagcagaacauccacagccuguuccccgugcugaucgacaccaaguccgucaccaaggacaucuggaaggagaugaacuucccccgggugagcaaccucuccgagguguacgagguccugaacagcgaccugaacccgaccaagaacuccggccccgagaucgugcacgcgagccgcugcgagaaguacgucgagacgaagugcccccacgaggccgccuacgacgccuuccucugcggguccgugcugcugaagguggcccaccuccugcugcagaagaucuaccacaucgaccccgucccggagagcuccuucccccaguaccucgacgugcuggcgcccuacgugaaccaggucaaccugauccgggccggcgugcccaagaucaacuucagcggcccggacuaccccuccauccgcccgcccauccucauccugagcgugaagcgguggcccggggucuccgagcagcaggucuaccacaaguuccagaaccugugcaaguucgacgugcgccggcucacccgcagccaguuccugcugcugaccaacaaguucaaggacgcccggaacauccucaaggaguaccgcgaccaccccacccugugcaucucccuguaccgguacuggcgccacagccccaacgugaacugccuccuccaggugugcggcaucgugacggccugggcccugcuggcguucauccuggggcgcuccggcaccuga

SEQ ID NO: 34781 - RNA, 1398 nt, Artificial Sequence
  derived and/or modified sequence opt1 from PNLIP__Homo_sapiens__NP_000927
augcugccccucuggacccugagccugcuccugggcgccguggccgggaaggaggucugcuacgagcgccugggcugcuucuccgacgacagcccgugguccgggaucaccgagcggccccuccacauccugcccuggagccccaaggacgugaacacgcgcuuccugcucuacaccaacgagaacccgaacaacuuccaggagguggcggccgacuccagcuccaucagcggcuccaacuucaagaccaaccggaagacccgcuucaucauccacggguucaucgacaagggcgaggagaacuggcuggccaacgucugcaagaaccuguucaagguggagagcgugaacugcaucugcgucgacuggaagggcgggucccggacgggcuacacccaggccagccagaacauccgcaucgugggggccgagguggcguacuucgucgaguuccuccaguccgccuucggcuacagccccuccaacgugcacgugaucgggcacagccugggcgcccacgccgcgggcgaggccgggcggcgcaccaacggcaccaucgggcggaucacgggccuggaccccgccgagcccugcuuccagggcaccccggagcucguccgccuggaccccuccgacgccaaguucguggacgugauccacaccgacggggcccccaucguccccaaccugggcuucgggaugagccagguggugggccaccucgacuucuucccgaacgggggcgucgagaugcccggcugcaagaagaacauccugucccagaucguggacaucgacgggaucugggagggcacccgggacuucgcggccugcaaccaccuccgcagcuacaaguacuacacggacagcaucgugaaccccgacggguucgccggcuuccccugcgccuccuacaacgucuucaccgccaacaagugcuucccgugccccagcgggggcugcccccagaugggccacuacgcggaccgguaccccgggaagaccaacgacgugggccagaaguucuaccuggacaccggggacgccuccaacuucgcccgcuggcgguacaaggugagcgucacgcuguccggcaagaaggugaccgggcacauccuggucagccucuucggcaacaagggcaacuccaagcaguacgagaucuucaaggggacccugaagccggacagcacccacuccaacgaguucgacagcgacguggacgugggcgaccugcagauggucaaguucaucugguacaacaacgugaucaaccccacgcucccccgcgugggggccuccaagaucaucgucgagaccaacgugggcaagcaguucaacuucugcagccccgagaccgugcgggaggagguccugcugacccucacgccgugcuga

SEQ ID NO: 34782 - RNA, 1413 nt, Artificial Sequence
  derived and/or modified sequence opt1 from PNLIPRP2__Homo_sapiens__NP_005387
augaugcugcccccguggacccucggccugcugcuccuggccaccgugcgcgggaaggaggucugcuacggccagcuggggugcuucagcgacgagaagcccugggccggcacgcuccagcggcccgugaagcugcugcccugguccccggaggacaucgacacccgcuuccuccuguacaccaacgagaaccccaacaacuuccagcugaucaccgggacggagcccgacaccaucgaggcgagcaacuuccagcucgaccggaagacccgcuucaucauccacggcuuccuggacaaggccgaggacuccuggcccagcgacaugugcaagaagauguucgagguggagaaggucaacugcaucugcguggacuggcggcacggcucccgcgccauguacacccaggccgugcagaacauccgggucgugggggccgagacggcguuccugauccaggcccucagcacccagcugggcuacucccuggaggacgugcacgucaucgggcacagccucggcgcccacaccgccgcggaggccgggcgccggcugggcggccgcguggggcggaucaccggccuggacccggccgggcccugcuuccaggacgagcccgaggaggugcgccucgaccccuccgacgccgucuucguggacgugauccacacggacagcuccccgaucguccccagccugggcuucggcaugucccagaagguggggcaccuggacuucuuccccaacggcgggaaggagaugcccggcugcaagaagaacgugcucagcaccaucaccgacaucgacgggaucugggagggcaucggcggguucgucuccugcaaccaccuccggagcuucgaguacuacuccagcuccgugcugaacccggacggcuuccugggguaccccugcgccagcuacgacgaguuccaggagagcaagugcuuccccugccccgcggagggcugcccgaagauggggcacuacgccgaccaguucaagggcaagaccuccgccguggagcagacguucuuccugaacaccggcgagagcgggaacuucaccuccuggcgcuacaaggucagcgugacccuguccggcaaggagaaggugaacggguacauccggaucgcccucuacggcagcaacgagaacuccaagcaguacgagaucuucaaggggagccugaagcccgacgccucccacacgugcgcgaucgacgucgacuucaacgugggcaagauccagaaggucaaguuccuguggaacaagcgcggcaucaaccucagcgagcccaagcugggggccucccagaucaccgugcagagcggcgaggacgggaccgaguacaacuucugcuccagcgacaccguggaggagaacguccugcagucccucuaccccugcuga

SEQ ID NO: 34783 - RNA, 1062 nt, Artificial Sequence
  derived and/or modified sequence opt1 from PNMA1__Homo_sapiens__NP_006020
auggccaugacccugcucgaggacuggugccgcggcauggacgugaacagccagcgggcccugcuggucugggggauccccgugaacugcgacgaggcggagaucgaggagacccuccaggccgccaugccccagguguccuaccgcaugcugggccggauguucuggcgcgaggagaacgccaaggccgcgcugcucgagcugacgggggccgucgacuacgccgccaucccgcgggagaugcccggcaagggcgggguguggaaggugcuguucaagcccccgaccagcgacgcggaguuccucgagcgccugcaccuguuccucgcccgggagggcuggaccguccaggacguggcccgcgugcugggguuccagaaccccacccccacgcccggcccggagaugcccgccgagaugcugaacuacauccucgacaacgucauccagccccugguggaguccaucugguacaagcggcugacccucuucagcgggcgcgacauccccggcccgggggaggagaccuucgaccccuggcuggagcacaccaacgaggugcuggaggaguggcaggucuccgacguggagaagcggcgccggcucauggagagccugcgcggccccgccgcggacgugauccggauccugaaguccaacaaccccgccaucacgaccgccgagugccucaaggcccuggagcaggucuucggcagcguggaguccagccgcgacgcccagaucaaguuccugaacaccuaccagaacccgggggagaagcucuccgcguacgugauccggcuggagccccugcuccagaaggucguggagaagggcgccaucgacaaggacaacgugaaccaggcccgccuggagcaggucaucgccggggccaaccacagcggcgcgauccggcgccagcuguggcucaccggcgccggggagggccccgcccccaaccuguuccagcugcucgugcagauccgggaggaggaggccaaggaggaggaggaggaggccgaggcgacgcugcugcagcucgggcuggagggccacuucuga

SEQ ID NO: 34784 - RNA, 1095 nt, Artificial Sequence
  derived and/or modified sequence opt1 from PNMA2__Homo_sapiens__NP_009188
auggcccuggcccuccuggaggacuggugccgcaucaugagcguggacgagcagaagucccugauggucaccggcauccccgcggacuucgaggaggccgagauccaggaggugcuccaggagacccucaagagccuggggcgguaccgccugcugggcaagaucuuccggaagcaggagaacgccaacgccgugcugcucgagcugcuggaggacacggacgucuccgccauccccagcgaggugcaggggaagggcgggguguggaaggucaucuucaagacccccaaccaggacaccgaguuccucgagcgccugaaccuguuccucgagaaggagggccagaccguguccggcauguuccgggcgcuggggcaggagggcgugagccccgccacgguccccugcaucuccccggagcugcucgcccaccuccuggggcaggccauggcgcacgcgccccagccccugcugcccaugcgcuaccggaagcugcgcguguucagcggcuccgccgugccggcccccgaggaggagagcuucgaggucuggcucgagcaggccaccgagaucgugaaggaguggcccgugaccgaggccgagaagaagcgguggcuggccgagucccugcgcgggcccgcccucgaccugaugcacaucguccaggccgacaacccgagcaucuccguggaggagugccuggaggccuucaagcaggucuucggcagccucgagucccggcgcaccgcccaggugcgguaccugaagacguaccaggaggagggcgagaaggugagcgcguacgugcugcgccucgagacccugcugcggcgcgccgucgagaagcgggccaucccccgccggaucgccgaccaggugcgccucgagcaggucauggcgggggccacccugaaccagaugcuguggugccggcuccgcgagcugaaggaccagggcccgccgcccuccuuccuggagcucaugaaggugauccgcgaggaggaggaggaggaggccagcuucgagaacgaguccaucgaggagcccgaggagcgggacggguacggccgcuggaaccacgagggcgacgacuga

SEQ ID NO: 34785 - RNA, 849 nt, Artificial Sequence
  derived and/or modified sequence opt1 from PNMT__Homo_sapiens__NP_002677
augagcggcgccgaccgcucccccaacgccggggcggccccggacagcgcccccggccaggccgccguggcguccgccuaccagcgguucgagccccgcgccuaccugcggaacaacuacgcgcccccgcgcggggaccugugcaaccccaacggcgucgggcccuggaagcugcggugccuggcccagaccuucgccaccggcgaggugagcggccgcacgcucaucgacaucggguccggccccaccguguaccagcugcugagcgccugcucccacuucgaggacaucaccaugaccgacuuccucgaggucaaccggcaggagcuggggcgcuggcugcaggaggagccgggcgccuucaacuggagcauguacucccagcacgccugccucaucgaggggaagggcgagugcuggcaggacaaggagcggcagcugcgcgcgcgggugaagcgcgugcugcccaucgacguccaccagccccagccccucggcgccgggagcccggcgccccugcccgccgacgcccugguguccgccuucugccucgaggccgugagccccgaccuggccuccuuccagcgggcccuggaccacaucacgacccuccugcgcccgggcgggcaccuccugcugaucggcgcccuggaggagagcugguaccucgcgggcgaggcccggcugaccgucgugcccguguccgaggaggagguccgcgaggcccuggugcggagcggguacaaggugcgcgaccuccggaccuacaucaugcccgcccaccuccagacgggcgucgacgacgugaaggggguguucuucgccugggcgcagaaggucggccuguga

SEQ ID NO: 34786 - RNA, 2154 nt, Artificial Sequence
  derived and/or modified sequence opt1 from PNN__Homo_sapiens__NP_002678
auggccguggccguccgcacccugcaggagcagcucgagaaggcgaaggagagccugaagaacguggacgagaacauccggaagcugaccggccgcgaccccaacgacgugcggccgauccaggcccgccuccuggcccuguccgggcccggcgggggccgggggcgcggcagccuccugcugcggcgcggcuucuccgacagcgggggcgggccgcccgccaagcagcgggaccucgagggcgccgucucccgccucgggggcgagcggcgcacgcggcgcgagagccggcaggaguccgaccccgaggacgacgacgugaagaagcccgcgcugcagagcuccguggucgccaccagcaaggagcgcacccggcgcgaccugauccaggaccagaacauggacgagaagggcaagcagcggaaccgccggaucuucgggcugcugaugggcacccuccagaaguucaagcaggaguccacgguggccaccgagcgccagaagcgccggcaggagaucgagcagaagcuggaggugcaggccgaggaggagcgcaagcaggucgagaacgagcggcgcgagcuguucgaggagcggcgcgcgaagcagaccgagcuccggcugcuggagcagaagguggagcucgcccagcugcaggaggaguggaacgagcacaacgccaagaucaucaaguacauccgcaccaagacgaagccccaccuguucuacauccccgggcggaugugcccggccacccagaagcucaucgaggagagccagcgcaagaugaacgcccuguucgagggccggcgcaucgaguucgcggagcagaucaacaagauggaggcccggccccgccggcaguccaugaaggagaaggagcaccaggugguccgcaacgaggagcagaaggccgagcaggaggagggcaagguggcccagcgggaggaggagcuggaggagaccgggaaccagcacaacgacguggagaucgaggaggccggcgaggaggaggagaaggagaucgcgaucguccacagcgacgccgagaaggagcaggaggaggaggagcagaagcaggagauggaggugaagauggaggaggagaccgaggugcgcgaguccgagaagcagcaggacagccagcccgaggaggucauggacgugcucgagaugguggagaacgucaagcacgugaucgccgaccaggaggugauggagacgaaccgggucgaguccguggagcccagcgagaacgaggccuccaaggagcuggagccggagauggaguucgagaucgagcccgacaaggagugcaagagccugagccccgggaaggagaacgucuccgcccucgacauggagaaggagagcgaggagaaggaggagaaggaguccgagccccagccggagcccguggcgcagccccagccccagagccagccgcagcugcagcugcagucccagagccagcccgugcuccagucccagccgcccagccagcccgaggaccugucccuggccguccuccagcccacgccccaggugacccaggagcagggccaccuccugcccgagcgcaaggacuucccgguggagagcgucaagcugaccgaggugcccguggagcccguccugaccgugcacccggaguccaagagcaagaccaagacccgcucccggagccgcgggcgggcccgcaacaagaccuccaagagccggucccgcagcuccagcagcuccagcuccagcuccagcuccacgagcuccagcuccggcagcuccagcuccagcggcuccagcagcucccggagcuccagcuccagcuccagcuccaccagcggguccagcucccgcgacagcuccagcuccaccagcuccagcagcgagucccggagccgcucccggggccgcgggcacaaccgggaccgcaagcaccggcgcagcguggaccggaagcgccgggacaccuccggccuggagcgcagccacaaguccagcaagggcggguccagccgggacacgaagggcuccaaggacaagaacagccgcuccgaccgcaagcggagcaucuccgagagcucccgcagcgggaagcgguccagccgcagcgagcgggaccgcaaguccgaccggaaggacaagcgccgguga

SEQ ID NO: 34787 - RNA, 759 nt, Artificial Sequence
  derived and/or modified sequence opt1 from PNO1__Homo_sapiens__NP_064528
auggagagcgagauggagacccaguccgcccgcgccgaggagggcuucacccaggugacgcggaagggcgggcgccgggcgaagaagcgccaggccgagcagcugagcgccgccggggagggcggggacgccggccggauggacaccgaggaggcgcgccccgccaagcggccggucuucccgccccucugcggcgacgggcugcuguccggcaaggaggagacccgcaagauccccgugcccgccaaccgguacacgccccucaaggagaacuggaugaagaucuucacccccaucguggagcaccuggggcugcagauccgcuucaaccucaagagccggaacgucgagauccggaccugcaaggagaccaaggacguguccgcccugaccaaggcggccgacuucgugaaggccuucauccugggcuuccaggucgaggacgcccucgcccugauccgccuggacgaccucuuccuggagagcuucgagaucacggacgugaagccccugaagggggaccaccucucccgcgcgaucggccggaucgccggcaagggcgggaagaccaaguucaccaucgagaacgugacccgcacgcggaucguccuggccgacgugaaggugcacauccuggggagcuuccagaacaucaagauggcccgcaccgccaucugcaaccucauccugggcaacccgcccuccaaggucuacggcaacauccgggcgguggccagccgcuccgccgaccgguucuga

SEQ ID NO: 34788 - RNA, 531 nt, Artificial Sequence
  derived and/or modified sequence opt1 from PNOC__Homo_sapiens__NP_006219
augaaggugcugcucugcgaccugcugcuccugagccuguucuccagcgucuucuccagcugccagcgcgacugccugaccugccaggagaagcugcaccccgcccuggacuccuucgaccucgaggugugcauccuggagugcgaggagaagguguucccgagcccccuguggacccccugcacgaaggucauggcccgguccagcuggcagcucucccccgcggccccggagcacguggccgccgcccuguaccagccccgcgcgagcgagaugcagcaccuccggcgcaugccccgggugcgcucccucuuccaggagcaggaggagcccgagccgggcauggaggaggccggggagauggagcagaagcagcugcagaagcgguucggcggguucaccggcgcccgcaagagcgcccggaagcuggcgaaccagaagcgcuucuccgaguucaugcggcaguaccucguccugagcaugcaguccagccagcgccggcgcacccugcaccagaacgggaacguguga

SEQ ID NO: 34789 - RNA, 870 nt, Artificial Sequence
  derived and/or modified sequence opt1 from PNP__Homo_sapiens__NP_000261
auggagaacggcuacaccuacgaggacuacaagaacaccgccgaguggcugcucagccacacgaagcaccgcccccagguggccaucaucugcggguccggccucgggggccugaccgacaagcugacccaggcgcagaucuucgacuacggggagaucccgaacuucccccggagcaccguccccggccacgccggccgccugguguucggguuccugaacggccgggccugcgugaugaugcaggggcgcuuccacauguacgagggcuacccccucuggaaggucacguucccggugcggguguuccaccuccugggggucgacacccugguggugaccaacgccgccggcggccugaaccccaaguucgaggucggggacaucaugcugauccgcgaccacaucaaccuccccggcuucuccgggcagaacccccugcggggcccgaacgacgagcgcuucggcgaccgguuccccgcgaugagcgacgccuacgaccgcaccaugcggcagcgcgcccuguccacguggaagcagaugggggagcagcgggagcuccaggagggcaccuacgugaugguggccgggcccagcuucgagaccgucgcggagugccgcgugcugcagaagcugggcgccgacgccguggggauguccaccguccccgaggugaucguggcccggcacugcggccuccgcgucuucggcuucagccugaucacgaacaaggugaucauggacuacgagucccuggagaaggccaaccacgaggaggugcucgcggccgggaagcaggccgcccagaagcuggagcaguucgucagcauccugauggccuccaucccgcuccccgacaaggcgagcuga

SEQ ID NO: 34790 - RNA, 1341 nt, Artificial Sequence
  derived and/or modified sequence opt1 from PNPLA1__Homo_sapiens__NP_001139188
auggugcagaugaugcgccaguuccuguaccggguccuccccgaggacagcuacaaggugaccaccggcaagcugcacgugucccugacgcgccucaccgacggggagaacgucguggugagcgaguucaccuccaaggaggagcugaucgaggcccuguacugcagcugcuucgucccgguguacugcggccucaucccgcccaccuaccgcggggugugggccuuccugacgcugccgccccagcgguacaucgacggcggguucaccggcaugcagcccugcgcguucuggaccgacgccaucaccaucuccacguucagcggccagcaggacaucugcccccgggacugccccgccaucuuccacgacuuccgcauguucaacugcuccuuccaguucagccucgagaacaucgcccggaugacccacgcccuguucccgcccgaccuggucauccuccacgacuacuacuaccgcggguacgaggacgcggugcuguaccugcggcgccucaacgccguguaccugaacuccagcuccaagcgggucaucuucccccgcguggagguguacugccagaucgagcuggcccucggcaacgagugccccgagcggagccagcccucccugcgcgcccggcaggcgagccuggagggggccacccagccccacaaggaguggguccccaagggcgacgggcgcggcucccacgggcccccggugagccagcccgugcagacccucgaguucacgugcgagucccccgucagcgcccccguguccccgcuggagcagccgcccgcccagccccuggccagcagcacgccccucucccugagcggcaugccgcccguguccuuccccgcgguccacaagccgcccagcuccacccccggcagcucccugcccaccccgccgcccgggcucagcccccugagcccccagcagcagguccagcccuccggcucccccgcccggagccugcacucccaggcccccaccagcccccgccccucccucggccccagcaccgugggggccccgcagacccugccccgguccagccuguccgccuuccccgcgcagcccccgguggaggagcucggccaggagcagccccaggccguggcccugcuggucagcagcaagcccaaguccgccgugccccucgugcacgucaaggagaccgugagcaagccguacgugacggagucccccgccgaggacagcaacugggucaacaagguguucaagaagaacaagcagaagaccuccgggacccgcaagggcuucccccggcacagcggguccaagaagcccagcuccaaggugcaguga

SEQ ID NO: 34791 - RNA, 1515 nt, Artificial Sequence
  derived and/or modified sequence opt1 from PNPLA2__Homo_sapiens__NP_065109
auguucccccgcgagaagaccuggaacaucagcuucgccggcugcggguuccugggcguguacuacgucgggguggccuccugccuccgggagcacgcgccguuccugguggccaacgccacccacaucuacggcgccagcgccggggcgcugacggccaccgcccucgucaccggcgugugccugggcgaggccggggcgaaguucaucgagguguccaaggaggcccgcaagcgguuccugggcccccuccaccccagcuucaaccuggucaagaucauccgcuccuuccugcucaaggugcugcccgccgacagccacgagcacgccuccgggcggcugggcaucagccucacccgcguguccgacggggagaacgucaucaucagccacuucaacuccaaggacgagcugauccaggccaacgugugcagcggcuucaucccgguguacugcggccugaucccgcccucccuccaggggguccgguacguggacggcgggaucagcgacaaccugccccuguacgagcucaagaacacgaucaccgugucccccuucagcggcgaguccgacaucugcccccaggacagcuccaccaacauccacgagcugcgcgucaccaacacgagcauccaguucaaccugcggaaccucuaccgccugagcaaggcgcuguucccgcccgagccccucgugcugcgggagaugugcaagcagggcuaccgcgacgggcugcgguuccuccagcgcaacggccugcugaaccggcccaacccccuccuggcccugcccccggcccgcccccacgggcccgaggacaaggaccaggccguggaguccgcccaggcggaggacuacagccagcuccccggcgaggaccacauccuggagcaccucccggcccggcugaacgaggcccugcuggaggccugcgucgagcccaccgaccuccugaccacccuguccaacaugcuccccgugcgccuggccacggcgaugauggugcccuacacccugccgcucgagagcgcccuguccuucaccauccggcugcucgaguggcugcccgacguccccgaggacauccgcuggaugaaggagcagaccgggagcaucugccaguaccuggugaugcgggccaagcgcaagcugggccgccaccuccccucccggcugccggagcaggucgagcugcgccgggugcagagccuccccuccgugccccugagcugcgccgccuaccgcgaggcgcugccgggcuggaugcggaacaaccucucccugggggacgcccuggccaagugggaggagugccagcgccagcuccugcugggccucuucugcacgaacgucgccuucccgcccgaggcgcugcggaugcgcgcccccgccgaccccgcccccgcccccgcggaccccgccagcccgcagcaccagcuggccgggcccgcgccccuccuguccacccccgccccggaggcccggcccgugaucggcgcccuggggcucuga

SEQ ID NO: 34792 - RNA, 1446 nt, Artificial Sequence
  derived and/or modified sequence opt1 from PNPLA3__Homo_sapiens__NP_079501
auguacgacgccgagcgcggcuggagccuguccuucgccgggugcggcuuccucggguucuaccacgugggcgcgacccggugccugagcgagcacgcgccccaccuccugcgcgacgcccggaugcuguucggggccuccgccggcgcccugcacugcgucggcgugcucagcgggaucccgcuggagcagacccuccaggugcuguccgaccugguccgcaaggcccggagccgcaacaucggcaucuuccaccccuccuucaaccugagcaaguuccuccggcaggggcugugcaagugccugcccgccaacgugcaccagcucaucuccggcaagaucgggaucagccugacgcgcguguccgacggcgagaacguccuggugagcgacuuccgguccaaggacgagguggucgacgcccucgugugcagcugcuucauccccuucuacuccggccugaucccgcccagcuuccgcggggugcgguacgucgacggcgggguguccgacaacgugcccuucaucgacgcgaagaccaccaucaccgucagccccuucuacggcgaguacgacaucugcccgaaggugaaguccacgaacuuccugcacguggacaucaccaagcucagccugcgccugugcaccggcaaccucuaccugcugagccgggccuucgucccgcccgaccucaaggugcugggggagaucugccugcgcggcuaccucgacgccuuccgguuccuggaggagaaggggaucugcaaccgcccccagcccggccugaaguccagcuccgaggggauggaccccgagguggccaugcccagcugggccaacaugucccucgacagcucccccgagagcgcggcccuggccguccggcuggagggcgacgagcuccuggaccaccuccgccuguccauccugccgugggacgagagcauccuggacacccucagcccccggcuggccacggcccugagcgaggagaugaaggacaagggcggguacauguccaagaucugcaaccuccugcccauccgcaucaugagcuacgugaugcugcccugcacccucccgguggaguccgcgaucgccaucguccagcggcuggugaccuggcugcccgacaugcccgacgacguccuguggcuccagugggugaccagccagguguucacgcgcguccugaugugccugcuccccgccucccgcagccagaugccgguguccagccagcaggccagccccugcacccccgagcaggacuggcccugcuggaccccgugcucccccaagggcugccccgccgagaccaaggcggaggccacgccgcggagcauccugcgcuccagccugaacuucuuccucgggaacaaggugcccgccggcgccgaggggcuguccaccuuccccagcuucucccuggagaagucccucuga

SEQ ID NO: 34793 - RNA, 501 nt, Artificial Sequence
  derived and/or modified sequence opt1 from PNPLA4__Homo_sapiens__NP_001166143
auggcccgccugcggagcggcauggaguccauccucccgcccagcgcccacgagcuggcgcagaaccgccugcacguguccaucaccaacgccaagacccgggagaaccaccucgucagcacguucuccagccgcgaggaccugaucaaggugcugcucgccuccagcuucgugcccaucuacgccgggcugaagcuggucgaguacaagggccagaaguggguggacgggggccucaccaacgcccugcccauccugcccguggggcggaccgucaccaucucccccuucagcggccgccucgacaucagcccccaggacaagggccagcuggaccuguacgugaacaucgcgaagcaggacaucaugcucucccuggccaaccuggugcggcucaaccaggcccuguucccgcccuccaagcgcaagauggagagccuguaccagugcggguucgacgacacggucaaguuccuccugaaggagaacugguucgaguga

SEQ ID NO: 34794 - RNA, 948 nt, Artificial Sequence
  derived and/or modified sequence opt1 from PNPLA5__Homo_sapiens__NP_001171146
augggcuuccuggaggaggaggggcgcuggaaccucuccuucuccggcgccggguaccugggcgcccaccacgugggggcgaccgagugccugcggcagcgcgcgccccggcuccugcagggcgcccgccggaucuacggcagcuccagcggggcccugaacgccgucuccaucgugugcggcaagagcguggacugcccguccaccaucacggucagccccuuccacgggaccguggacaucugcccccaguccaccagccccaaccuccacgagcugaacguguucaacuucuccuuccagaucagcaccgagaacuucuuccugggccucaucugccugaucccgcccucccuggaggucguggccgacaacugccgccagggguaccucgacgcccugcgguuccuggagcgccggggccucacgaaggagcccgugcuguggacccuggucagcaaggagcccccggcccccgccgacggcaacugggacgcggggugcgaccagcgcuggaagggcgggcucucccugaacuggaaggugccccacgugcaggucaaggacgugcccaacuucgagcagcugagcccggagcucgaggccgcccugaagaaggccugcacccgggaccccucccgcugggcccgguucuggcacagcggccccggccaggugcugaccuaccuccugcugcccugcacgcucccguucgaguacaucuacuuccgcucccggcgccuggucguguggcugcccgacgugcccgcggaccucugguggaugcaggggcugcugcggaacauggcccucgaggucuucagccgcaccaaggcccagcugcugggccccaucagcccgcccgccacccgggugcucgagaccagcccccugcagccccagaucgccccgcaccgcgaggagcuggggcccacgcaccaggcguga

SEQ ID NO: 34795 - RNA, 4128 nt, Artificial Sequence
  derived and/or modified sequence opt1 from PNPLA6__Homo_sapiens__NP_001159583
auggaggcgccccugcagaccggcaugauggggaccagcucccacggccucgccacgaacagcuccggggccaagguggccgagcgcgacggcuuccaggacguccuggccccgggggagggcagcgccggccggaucugcggggcccagcccgugcccuucgugccccagguccugggcgugaugaucggggcgggcguggccgucguggugaccgccguccucauccugcugguggugcgccggcuccgcgucccgaagacccccgcccccgacgggccccgguaccgcuuccggaagcgcgacaaggugcuguucuacggccggaagaucaugcgcaaggugucccagagcaccuccagccuggucgacacguccgugagcgcgaccucccggccgcgcaugcggaagaagcucaagaugcugaacaucgccaagaagauccugcgcauccagaaggagacccccacccuccagcggaaggagccgccgcccgccgugcuggaggccgaccugacggagggcgaccucgccaacagccaccuccccuccgagguccuguacaugcucaagaacgugcgcgugcuggggcacuucgagaagccccuguuccucgagcugugccggcacauggucuuccagcgccugggccagggggacuacguguuccggcccggccagcccgacgcgagcaucuacgugguccaggacggccuccuggagcugugccuccccgggcccgacggcaaggagugcguggucaaggagguggugcccggggacuccgucaacagccugcuguccauccucgacgugaucaccggccaccagcacccgcagcgcaccgugagcgcccgggccgcccgcgacuccaccguccugcgccugcccguggaggccuucagcgcgguguucacgaaguaccccgagagccucguccggguggugcagaucaucaugguccgccugcagcgggugaccuuccuggcccuccacaacuaccuggggcugaccaacgagcuguucucccacgagauccagccccugcgccuguucccgagccccggccuccccacccggacgucccccgugcgcggcagcaagcggauggucuccaccagcgccaccgacgagccgcgcgagacccccgggcggcccccggaccccacgggcgcgccccugcccgggccgaccggcgaccccgugaagcccaccucccuggagacccccagcgccccgcuccugucccgcugcgugagcaugcccggggacaucuccggccugcagggcgggccccggagcgacuucgacauggccuacgagcgcggccggaucuccgucagccuccaggaggaggccuccgggggcagccuggccgcccccgcccgcacgccgacccaggagccccgggagcagcccgcgggggccugcgaguacuccuacugcgaggacgagagcgccaccggcggcugccccuucgggccguaccagggccgccagaccuccagcaucuucgaggccgcgaagcaggagcuggccaagcugaugcggaucgaggaccccagccuccugaacucccgcgugcugcuccaccacgccaaggccgggacgaucaucgcccggcagggcgaccaggacgugagccugcacuucguccuguggggcugccuccacguguaccagcgcaugaucgacaaggcggaggacgugugccuguucgucgcccagcccggggagcuggugggccagcucgccgugcugaccggggagccccugaucuucacccuccgcgcccagcgggacugcaccuuccugcgcaucuccaagagcgacuucuacgagaucaugcgggcccagccguccgucgugcugagcgcggcccacacgguggccgcccgcaugucccccuucguccggcagauggacuucgccaucgacuggaccgcgguggaggccggccgcgcccucuaccggcagggggaccgcagcgacugcaccuacaucgugcugaacggccggcugcgcuccgucauccagcggggcagcgggaagaaggagcucgugggcgaguacgggcgcggcgaccugaucgggguggucgaggcccugacccggcagccccgcgcgacgaccgugcacgccgugcgggacaccgagcucgccaagcugcccgagggcacccugggccacaucaagcgccgguacccgcaggucgugacccgccucauccaccuccugucccagaagauccuggggaaccugcagcagcugcagggccccuuccccgccgggagcggccucggggugccgccccacuccgagcugacgaaccccgccagcaaccuggcgaccgucgccauccuccccgugugcgccgaggugccgauggucgccuucacccuggagcugcagcacgcccuccaggcgaucggccccacccugcugcucaacuccgacaucauccgggcccgccugggcgccagcgcccuggacuccauccaggaguuccggcucagcggguggcuggcccagcaggaggacgcgcaccgcaucgugcuguaccagacggacgccagccucacccccuggaccgugcgcugccugcggcaggccgacugcauccugaucgucggccucggggaccaggagcccacccugggccagcuggagcagaugcucgagaacacggccgugcgcgcgcugaagcagcuggugcuccugcaccgggaggagggggccggcccgacccgcaccgucgaguggcugaacaugcgguccuggugcagcggccaccuccaccuccgcugcccccggcgccuguucucccggcgcagccccgccaagcugcacgagcuguacgagaagguguucucccggcgcgccgaccggcacagcgacuucucccgccuggcccggguccucaccgggaacacgaucgcgcuggugcugggcgggggcggcgcccgcgggugcagccacaucggcgugcucaaggcccuggaggaggccgggguccccguggaccuggugggcgggaccuccaucggcagcuucaucggcgcccucuacgcggaggagcgguccgccagccgcaccaagcagcgggcccgcgagugggccaaguccaugaccagcguccuggagccggugcuggaccucacguaccccgugaccuccauguucaccgggagcgccuucaaccgcuccauccaccgggucuuccaggacaagcagaucgaggaccuguggcugcccuacuucaacgugaccacggacaucaccgcgagcgccaugcgcgugcacaaggacggcucccucuggcgguacguccgcgccagcaugacccugagcggguaccugcccccgcucugcgaccccaaggacggccaccuccugauggacgggggcuacaucaacaaccugcccgccgacaucgcccgguccaugggcgcgaagaccgugaucgccaucgacguggggagccaggacgagacggaccuguccaccuacggcgacagccuguccgggugguggcuccuguggaagcgccugaaccccugggccgacaaggucaaggugccggacauggccgagauccagagccggcucgcguacguguccugcguccgccagcuggagguggucaagagcuccagcuacugcgaguaccugcggccgcccaucgacugcuucaagaccauggacuucggcaaguucgaccagaucuacgacgugggguaccaguacggcaaggccguguucggcggguggucccgcggcaacgugaucgagaagaugcucaccgaccggcgcagcacggaccugaacgagucccggcgcgccgacguccuggccuuccccagcuccggguucaccgaccucgccgagaucgugagccggaucgagccgcccaccuccuacgugagcgacggcugcgcggacggcgaggaguccgacugccugaccgaguacgaggaggacgccgggcccgacugcagccgcgacgagggcgggagccccgagggcgccucccccagcacggccuccgagauggaggaggagaaguccauccugcggcagcgccggugccugccccaggagcccccggggagcgccaccgacgcguga

SEQ ID NO: 34796 - RNA, 2349 nt, Artificial Sequence
  derived and/or modified sequence opt1 from PNPLA8__Homo_sapiens__NP_001242937
augagcaucaaccugaccguggacaucuacaucuaccuccuguccaacgcccgcagcgucugcggcaagcagcgguccaagcagcuguacuuccucuucagccccaagcacuacuggcgcaucucccacaucagccugcagcggggguuccacaccaacaucauccgcugcaaguggacgaaguccgaggcccacagcugcuccaagcacugcuacagcccguccaaccacggccugcacaucgggauccucaagcugagcaccuccgcgcccaagggccugaccaaggugaacaucugcaugagccggaucaaguccacccucaacagcguguccaaggccgucuucgggaaccagaacgagaugaucagccgccuggcccaguucaagcccuccagccagauccugcggaaggugagcgacuccggcuggcucaagcagaagaacaucaagcaggccaucaagagccugaagaaguacuccgacaagagcgccgagaagucccccuucccggaggagaagucccacaucaucgacaaggaggaggacaucggcaagcgcagccuguuccacuacacgagcuccaucaccaccaaguucggggacagcuucuacuuccucuccaaccacaucaacagcuacuucaagcggaaggagaagaugucccagcagaaggagaacgagcacuuccgcgacaagagcgagcuggaggacaagaagguggaggagggcaagcugcggucccccgaccccgggauccucgcguacaagcccggcagcgaguccguccacaccguggacaagccgacgagccccuccgccauccccgacgugcugcaggucagcaccaagcagagcaucgccaacuuccugucccgccccaccgagggggugcaggcccucgugggcggcuacaucgggggccuggucccgaagcugaaguacgacagcaagucccagagcgaggagcaggaggagcccgcgaagaccgaccaggccguguccaaggaccggaacgccgaggagaagaagcgccucagccugcagcgggagaagaucaucgcccgcguguccaucgacaaccggacgcgcgcccugguccaggcgcuccggcgcaccaccgaccccaagcugugcaucacccggguggaggagcugacguuccaccuccuggaguuccccgaggggaagggcguggccgucaaggagcgcaucaucccguaccugcuccgccugcggcagaucaaggacgagacccugcaggccgccgugcgcgagauccucgcccugaucggcuacguggaccccgucaaggggcggggcauccgcauccugagcaucgacgggggcgggacccggggcgugguggcgcuccagacccugcgcaagcuggucgagcucacgcagaagcccgugcaccagcuguucgacuacaucugcggcgucuccaccggggccauccuggccuucaugcucggccuguuccacaugccccuggacgagugcgaggagcucuaccggaagcuggggagcgacguguucucccagaacgugaucgucggcaccgugaagaugagcuggucccacgccuucuacgacagccagaccugggagaacauccugaaggaccgcaugggguccgcccugaugaucgagacggcgcggaacccgaccugccccaagguggccgccgucagcaccaucgugaaccgcggcaucacccccaaggccuucguguuccggaacuacggccacuuccccgggaucaacucccacuaccucggcgggugccaguacaagauguggcaggccauccgcgcgagcagcgccgccccgggcuacuucgccgaguacgcgcuggggaacgaccugcaccaggacggcggccuccugcugaacaaccccuccgcccucgccaugcacgagugcaagugccuguggcccgacgucccccuggagugcaucgugagccucgggacgggccgguacgaguccgacgugcgcaacaccgucaccuacaccagccugaagacgaagcuguccaacgugaucaacagcgccaccgacaccgaggaggugcacaucaugcucgacgggcugcugccgcccgacaccuacuuccgguucaaccccgucaugugcgagaacaucccgcucgacgagucccgcaacgagaagcuggaccagcugcagcucgagggccugaaguacaucgagcggaacgagcagaagaugaagaagguggccaagauccugagccaggagaagacgacccuccagaagaucaacgacuggaucaagcugaagaccgacauguacgagggccugcccuucuucuccaagcucuga

SEQ ID NO: 34797 - RNA, 786 nt, Artificial Sequence
  derived and/or modified sequence opt1 from PNPO__Homo_sapiens__NP_060599
augaccugcuggcugcgcggcgugaccgccacguucgggcggcccgccgaguggccgggcuaccucagccaccugugcgggcgcuccgcggccauggaccugggccccaugcggaaguccuaccgcggggaccgggaggccuucgaggagacccaccucaccagccuggaccccgucaagcaguucgccgccugguucgaggaggcggugcagugccccgacaucggcgaggccaacgccaugugccuggcgaccugcacgcgcgacggcaagccgagcgcccggaugcuccugcugaagggguucggcaaggacggguuccgcuucuucaccaacuucgagucccggaagggcaaggagcucgacagcaaccccuucgccucccugguguucuacugggagccccugaaccgccagguccggguggaggggcccgugaagaagcucccggaggaggaggccgagugcuacuuccacagccgccccaaguccagccagaucggcgccgucgugucccaccagagcuccgugauccccgaccgggaguaccugcgcaagaagaacgaggagcuggagcagcucuaccaggaccaggagguccccaagcccaagagcuggggcggguacgugcuguacccccaggugauggaguucuggcagggccagaccaaccggcugcacgaccgcaucgucuuccggcgcgggcuccccaccggcgacuccccgcugggcccgaugacgcaccgcggggaggaggacuggcuguacgagcggcucgcccccuga

SEQ ID NO: 34798 - RNA, 2352 nt, Artificial Sequence
  derived and/or modified sequence opt1 from PNPT1__Homo_sapiens__NP_149100
auggccgccugccgcuacugcugcagcugccugcggcuccgcccccuguccgacggcccguuccugcucccccggcgcgaccgggcgcugacccagcuccaggugcgcgcccuguggagcuccgccgggagccgggccgucgccguggaccugggcaaccgcaagcuggagaucuccagcgggaagcucgcgcgguucgccgacggcuccgccgugguccagagcggggacaccgccgugauggugacggcggucuccaagaccaagcccagccccucccaguucaugccgcuggugguggacuaccgccagaaggccgccgccgccggccggauccccaccaacuaccugcgccgggagaucggcaccagcgacaaggagauccucacgucccgcaucaucgaccggagcauccgcccccuguuccccgcgggguacuucuacgacacccagguccugugcaaccuccuggccguggacggcgugaacgagccggacguccuggccaucaacggggccuccguggcccucagccuguccgacauccccuggaacggccccgugggggcgguccggaucggcaucaucgacggcgaguacguggugaaccccacccgcaaggagaugagcuccagcacccugaaccucgucguggccggggcccccaagagccagaucgugaugcuggaggccuccgccgagaacauccugcagcaggacuucugccacgcgaucaaggucggcgugaaguacacgcagcagaucauccaggggauccagcagcucgugaaggagaccggcgucaccaagcggacgccccagaagcuguucacccccagccccgagaucgugaaguacacccacaagcuggccauggagcgccucuacgccgucuucaccgacuacgagcacgacaaggugucccgggacgaggccgugaacaagauccgccuggacaccgaggagcagcugaaggagaaguucccggaggccgaccccuacgagaucaucgagagcuucaacgucguggcgaaggagguguuccgcuccaucguccucaacgaguacaagcggugcgacggccgcgaccugacgagccugcggaacguguccugcgagguggacauguucaagacccuccacgggagcgcccuguuccagcgcggccagacccagguccugugcaccgugacguucgacucccucgagagcgggaucaaguccgaccaggugaucaccgccaucaacggcaucaaggacaagaacuucaugcugcacuacgaguucccgcccuacgccaccaacgagaucgggaaggucaccggccugaaccggcgcgagcucggccacggggcgcuggccgagaaggcccuguacccggugaucccccgggacuuccccuucacgauccgcgugaccagcgagguccucgaguccaacggcagcuccagcauggccuccgccugcgggggcagccuggcgcugauggacuccggggugcccaucagcagcgccguggccggcgucgccaucggccucgugaccaagaccgacccggagaagggggagaucgaggacuaccggcugcugacggacauccucggcaucgaggacuacaacggggacauggacuucaagaucgccggcaccaacaaggggaucaccgcgcugcaggccgacaucaagcugcccggcauccccaucaagaucgugauggaggccauccagcaggccuccgucgccaagaaggagauccugcagaucaugaacaagaccaucagcaagccccgcgcgucccggaaggagaacggcccggugguggagacgguccaggugccccucagcaagcgcgccaaguucguggggcccggcggguacaaccugaagaagcugcaggccgagaccggcgucaccaucucccagguggacgaggagaccuucagcguguucgccccgacgcccuccgcgaugcacgaggcccgggacuucaucaccgagaucugcaaggacgaccaggagcagcagcucgaguucggcgccgucuacaccgccaccaucaccgagauccgcgacacgggggugauggugaagcuguaccccaacaugaccgccguccugcuccacaacacccagcuggaccagcggaagaucaagcaccccaccgcgcugggccucgagguggggcaggagauccaggugaaguacuucggccgcgacccggccgacgggcggaugcgccugagccggaagguccugcagucccccgccacgaccguggugcgcacccucaacgaccgcagcuccaucgucaugggcgagcccaucagccaguccagcuccaacagccaguga

SEQ ID NO: 34799 - RNA, 984 nt, Artificial Sequence
  derived and/or modified sequence opt1 from PNRC1__Homo_sapiens__NP_006804
augaccguggucagcgugccccagcgcgagccccuggugcucggcgggcggcuggcgccccucggcuucuccagccgcggguacuucggcgcccugcccauggucaccacggcgcccccgccccugccccggauccccgacccgcgcgcccugccgcccacccucuuccugccccacuuccucgggggcgacggccccugccugacgccccagccccgggcccccgccgcccugccgaaccgcucccuggcgguggccgggggcacgccccgggccgcccccaagaagcgccggaagaagaaggugcgcgcgagccccgccgggcagcucccgucccgguuccaccaguaccagcagcaccgccccagccuggagggcgggcggucccccgccaccggccccagcggcgcccaggaggucccggggcccgccgccgcccuggcccccucccccgccgccgcggccggcaccgagggggccagcccggaccucgcgccccugcgccccgccgccccgggccagacgccccugcggaaggaggugcucaaguccaagaugggcaagagcgagaagaucgcccugccccacgggcagcuggugcacggcauccaccucuacgagcagcccaagaucaaccgccagaaguccaaguacaaccugccgcugaccaagaucaccagcgccaagcggaacgagaacaacuucuggcaggacuccgucagcuccgaccgcauccagaagcaggagaagaagcccuucaagaacaccgagaacaucaagaacagccaccucaagaaguccgccuuccugaccgaggugagccagaaggagaacuacgccggggcgaaguucagcgacccgcccucccccagcgugcugcccaagccgcccucccacuggaugggcagcaccgucgagaacuccaaccagaaccgggagcucauggccgugcaccugaagacccugcucaaggugcagaccuga

SEQ ID NO: 34800 - RNA, 1080 nt, Artificial Sequence
  derived and/or modified sequence opt1 from POC1A__Homo_sapiens__NP_001155052
auggccgcccccugcgcggaggaccccagccuggagcgccacuucaagggccaccgggacgccgugaccugcgucgacuucuccaucaacaccaagcagcucgccagcggguccauggacagcugccugaugguguggcacaugaagccccagucccgcgccuaccgguucacgggccacaaggacgccgugaccugcgucaacuucagccccuccgggcaccuccuggcgagcggcucccgcgacaagaccgugcggaucugggugcccaacgucaagggggagagcaccguguuccgcgcccacacggccaccgugcgguccguccacuucugcagcgacggccaguccuucgugaccgccagcgacgacaagaccgugaaggucugggcgacgcaccgccagaaguuccuguucucccugagccagcacaucaacugggugcggugcgccaaguucuccccggacggccgccucaucgugagcgccuccgacgacaagaccgucaagcugugggacaagagcagccgggagugcgugcacuccuacugcgagcacgggggcuucgugaccuacgucgacuuccaccccagcgggaccugcaucgccgccgcgggcauggacaacacggugaaggugugggacguccgcacccaccggcugcuccagcacuaccagcugcacuccgccgccgugaacgggcugagcuuccaccccuccggcaacuaccucaucaccgccagcuccgacagcacccugaagauccuggaccucauggagggccgccugcuguacacgcuccacgggcaccagggccccgccaccaccguggcguucucccggaccggggaguacuucgccagcggcggcuccgacgagcaggucaugguguggaaguccaacuucgacaucgucgaccacggggaggugacgaaggugccgcgcccgcccgccacccuggccagcagcaugggcaaccugaccgucuccauccucgagcagcggcugacccugacggaggacaagcucaagcagugccuggagaaccagcagcugaucaugcagcgcgccacccccuga

SEQ ID NO: 34801 - RNA, 1311 nt, Artificial Sequence
  derived and/or modified sequence opt1 from POC1B__Homo_sapiens__NP_001186706
augcuguggaacuucaagccccacgcccgcgccuaccgguacgugggccacaaggacgucgugaccagcgugcaguucagcccgcacgggaaccuccuggcgagcgccucccgcgaccggaccguccgccuguggauccccgacaagcggggcaaguucagcgaguucaaggcccacacggcccccgugcgcuccguggacuucagcgccgacgggcaguuccucgcgaccgccuccgaggacaagagcaucaaggucugguccauguaccggcagcgcuuccuguacagccuguaccggcacacccacugggugcgcugcgccaaguucucccccgacggccggcucaucgugagcugcuccgaggacaagaccaucaagaucugggacacgaccaacaagcagugcgucaacaacuucagcgacuccgugggguucgccaacuucguggacuucaacccgagcgggaccugcaucgcguccgccggcagcgaccagaccgucaaggugugggacgugcgcgucaacaagcugcugcagcacuaccaggugcacuccgggggcgugaacugcaucagcuuccaccccagcgggaacuaccucaucacggccuccagcgacggcacccugaagauccuggaccuccuggaggggcggcugaucuacacccuccagggccacaccggccccgucuucacgguguccuucagcaagggcggcgagcuguucgccuccgggggcgccgacacccaggugcugcucuggcgcaccaacuucgacgagcugcacugcaagggccugaccaagcggaaccucaagcgccugcacuucgacagcccgccccaccuccucgacaucuacccccggacgccccacccccacgaggagaaggucgagaccguggagaucaacccgaagcuggaggugaucgaccugcagaucuccaccccgcccgucauggacauccucagcuucgacuccaccacgaccaccgagaccagcgggcgcacgcugcccgacaagggcgaggaggcgugcggguacuuccugaaccccucccucaugagccccgagugccugcccaccaccaccaagaagaagacggaggacauguccgaccugcccugcgagagccagcgguccaucccgcucgccgugaccgacgcccuggagcacaucauggagcagcugaacguccucacccagaccgugagcauccuggagcagcgccugacgcucaccgaggacaagcugaaggacugccuggagaaccagcagaagcuguucuccgccgugcagcagaaguccuga

SEQ ID NO: 34802 - RNA, 1728 nt, Artificial Sequence
  derived and/or modified sequence opt1 from POC5__Homo_sapiens__NP_001092741
augagcuccgacgaggagaaguacagccugcccgugguccagaacgacuccagccgcggcuccagcguguccagcaaccuccaggaggaguacgaggagcugcugcacuacgccaucgugaccccgaacaucgagcccugcgccucccagagcucccaccccaagggggagcucguccccgacgugcggaucagcaccauccacgacauccugcacucccagggcaacaacagcgaggugcgcgagacggcgaucgaggucgggaagggcugcgacuuccacaucuccagccacuccaagaccgacgagagcuccccggugcugagcccccggaagcccagccaccccgugauggacuucuucuccagccaccuccuggccgacuccagcuccccggccaccaacagcucccacaccgacgcccacgagauccuggucagcgacuuccucguguccgacgagaaccugcagaagauggagaacgugcuggaccucuggagcuccgggcugaagacgaacaucaucagcgagcuguccaaguggcgccucaacuucaucgacuggcaccggauggagaugcgcaaggagaaggagaagcacgccgcgcaccugaagcagcugugcaaccagaucaacgagcucaaggagcugcagaagaccuucgagaucagcaucggccggaaggacgaggucaucuccagccugucccacgccaucggcaagcagaaggagaagaucgagcucaugcgcaccuucuuccacuggcggaucgggcacgugcgcgcccggcaggacguguacgagggcaagcuggccgaccaguacuaccagcgcacccugcucaagaaggucuggaagguguggcggagcgugguccagaagcaguggaaggacgugguggagcgcgcgugccaggcccgggccgaggaggucugcauccagaucuccaacgacuacgaggccaagguggccaugcugagcggggcgcuggagaacgccaaggccgagauccagcgcaugcagcacgagaaggagcacuucgaggacagcaugaagaaggccuucaugcggggcgugugcgcccucaaccuggaggcgaugacgaucuuccagaaccgcaacgacgccgggaucgacuccaccaacaacaagaaggaggaguacggccccggcguccaggggaaggagcacagcgcccaccuggaccccuccgcgcccccgaugccccuccccgugaccagcccccugcugccguccccgcccgccgccgucggcggggccagcgccaccgccgugcccuccgccgcgagcaugacguccacccgggccgccagcgccuccagcgugcacguccccguguccgcgcucggcgccggcagcgccgccaccgccgcguccgaggagauguacgugccccgcgucgugaccagcgcccagcagaaggccgggcggacgaucaccgcccgcaucaccggccgcugcgacuucgccuccaagaaccggaucagcagcucccuggcgaucaugggggugagcccgcccauguccagcgucgugguggagaagcaccaccccgucaccgugcagacgaucccccaggccaccgccgccaaguacccccgcaccauccaccccgaguccagcaccuccgccagccggucccugggcacgcgcagcgcgcacacccagucccucaccagcgugcacuccaucaaggucguggacuga

SEQ ID NO: 34803 - RNA, 1677 nt, Artificial Sequence
  derived and/or modified sequence opt1 from PODXL__Homo_sapiens__NP_001018121
augcgcugcgcccuggcccucagcgcgcugcugcuccugcuguccacgcccccgcuccugcccagcucccccagccccuccccgagccccucccagaacgccacccagaccaccaccgacagcuccaacaagaccgcccccacgcccgccagcuccgugaccaucauggccaccgacaccgcgcagcagagcacggucccgaccuccaaggccaacgagauccuggccagcgugaaggccaccacccucggcguguccagcgacucccccgggacgaccacccuggcgcagcaggucagcggccccgugaacaccacgguggcccgcgggggcggguccggcaaccccaccaccaccaucgagagccccaagagcacgaaguccgccgacaccaccaccgucgccacgagcaccgccaccgcgaagcccaacaccacguccagccagaacggcgccgaggacaccaccaacuccgggggcaagagcucccacagcgugaccacggaccugaccuccaccaaggccgagcaccucaccacgccccaccccaccagcccgcugagcccccggcagcccaccuccacccaccccguggccaccccgacguccagcgggcacgaccaccugaugaagaucuccagcuccagcuccaccgucgccauccccggcuacaccuucaccagccccgggaugacgaccacccuccuggagaccguguuccaccacgugagccaggcgggccuggagcuccugacguccggcgaccugcccacccucgccagccaguccgccgggaucaccgccagcuccgucaucagccagcggacccagcagacguccagccagaugccggccuccagcaccgcgcccuccagccaggagaccgugcagcccaccucccccgccacggcccugcgcaccccgacccugcccgagaccaugagcuccagccccacggccgccuccaccacccaccgguacccgaagacccccagccccacgguggcgcacgagagcaacugggccaagugcgaggaccucgagacccagacccaguccgagaagcagcugguccugaaccucaccggcaacacgcugugcgccgggggcgccagcgacgagaagcugaucucccucaucugccgcgcggugaaggccaccuucaaccccgcccaggacaagugcggcauccggcuggccagcgugccggggucccagaccgucguggugaaggagaucaccauccacacgaagcugcccgccaaggacgucuacgagcgccucaaggacaagugggacgagcugaaggaggcgggcgugagcgacaugaagcugggggaccagggcccgcccgaggaggccgaggaccgguucuccaugccgcucaucaucaccaucgugugcauggccagcuuccugcugcucgucgccgcccuguacgggugcugccaccagcgccugucccagcggaaggaccagcagcgccucaccgaggagcugcagaccguggagaacggcuaccacgacaaccccacgcuggaggucauggagaccagcuccgagaugcaggagaagaagguggugagccucaacggcgagcugggggacuccuggaucgucccccuggacaaccucaccaaggacgaccuggacgaggaggaggacacccaccuguga

SEQ ID NO: 34804 - RNA, 1770 nt, Artificial Sequence
  derived and/or modified sequence opt1 from POF1B__Homo_sapiens__NP_079197
augagcuccagcuacugguccgagaccagcuccagcuccugcggcacccagcagcugcccgaggugcuccagugccagccgcagcacuaccacugcuaccaccagagcucccaggcccagcagccgcccgagaagaacgucguguacgagcgcgugcggaccuacagcgggcccaugaacaaggucgugcaggcccuggaccccuucaacucccgcgaggugcugagcccccucaagaccaccuccagcuaccagaaccuggucugguccgaccacagccaggagcugcacucccccacccucaagaucagcacgugcgcgcccuccacccugcacaucacccagaacaccgagcaggagcugcacagcccgacggugaagcucaccaccuacccccagaccacgauccggaaguacgugguccagaaccccgagcaggagccccugagccaguuccugcgcggcucccacuucuucccggggaacaacgugaucuacgagaagaccauccggaagguggagaagcucaacaccgaccagggcugccacccccaggcccagugccaccaccacaucauccagcagccccaggucauccacagcgcccacuggcagcagcccgacuccagccagcagauccaggccaucaccgggaacaacccgaucuccacgcacaucggcaacgagcugugccacagcggcuccagccagaucugcgagcaggucaucauccaggacgacgggcccgagaagcuggacccccgcuacuucggcgagcuccuggccgaccugucccggaagaacaccgaccucuaccacugccugcuggagcaccuccagcgcaucgggggcagcaagcaggacuucgaguccaccgacgagagcgaggacaucgagucccugauccccaaggggcugagcgaguucaccaagcagcagauccgguacauccuccagaugcgcggcauguccgacaagagccugcggcuggugcucuccacguucagcaacauccgcgaggagcugggccaccuccagaacgacaugaccucccuggagaacgacaagaugcggcuggagaaggaccugagcuucaaggacacccagcucaaggaguacgaggagcugcuggcgagcgugcgcgccaacaaccaccagcagcagcaggggcuccaggacuccagcuccaagugccaggcccuggaggagaacaaccugagccuccggcacacccuguccgacauggaguaccgccugaaggagcucgaguacugcaagcggaaccuggagcaggagaaccagaaccugcgcaugcaggucagcgagacgugcaccggcccgaugcuccaggccaagauggacgagaucgggaaccacuacaccgagauggugaagaaccugcggauggagaaggaccgcgagaucugccggcugcgcucccagcucaaccaguaccacaaggacgugagcaagcgcgagggcuccugcagcgacuuccaguucaagcugcacgagcugaccucccugcucgaggagaaggacagccugaucaagcggcaguccgaggagcugagcaagcuccgccaggagaucuacuccagccacaaccagcccuccacgggcgggcggaccaccaucaccacgaagaaguaccgcacccaguaccccauccugggccugcucuacgacgacuacgaguacaucccgcccgggagcgagacccagaccaucgugaucgagaagacggaggacaaguacacgugccccuga

SEQ ID NO: 34805 - RNA, 1167 nt, Artificial Sequence
  derived and/or modified sequence opt1 from POFUT1__Homo_sapiens__NP_056167
augggcgccgccgcgugggcccgcccccugagcguguccuuccuccugcugcuccugccgcugcccgggaugcccgccggcagcugggaccccgccggguaccuccuguacugcccgugcaugggccgguucgggaaccaggccgaccacuuccugggcucccucgcguucgccaagcugcugaaccgcacccucgccgucccgcccuggaucgaguaccagcaccacaagccgcccuucaccaaccugcacgugagcuaccagaaguacuucaagcuggagccccuccaggccuaccaccgggugaucucccuggaggacuucauggagaagcuggcgcccacgcacuggcccccggagaagcgcgucgccuacugcuucgagguggccgcccagcggagccccgacaagaagaccugccccaugaaggagggcaaccccuucgggcccuucugggaccaguuccacguguccuucaacaagagcgagcuguucaccggcaucuccuucagcgccuccuaccgcgagcaguggagccagcgguucucccccaaggagcaccccguccucgcgcugcccggggccccggcccaguuccccgugcucgaggagcaccgcccccugcagaaguacaugguguggagcgacgagauggucaagaccggcgaggcccagauccacgcccaccuggugcggcccuacguggggauccaccuccgcaucggcuccgacuggaagaacgcgugcgccaugcugaaggacggcacggccgggagccacuucauggccuccccgcagugcgucggcuacagccgguccaccgccgcgccccugaccaugaccaugugccuccccgaccugaaggagauccagcgcgccgugaagcugugggugcggagccucgacgcccagagcgucuacguggccacggacuccgagagcuacgugcccgagcugcagcagcuguucaaggggaaggucaagguggugucccucaagccggaggucgcccagguggaccuguacauccugggccaggcggaccacuucaucggcaacugcgugagcuccuucaccgccuucgucaagcgcgagcgggaccuccaggggcgccccagcuccuucuucggcauggaccggcccccgaagcugcgcgacgaguucuga

SEQ ID NO: 34806 - RNA, 1275 nt, Artificial Sequence
  derived and/or modified sequence opt1 from POFUT2__Homo_sapiens__NP_056042
auggccacccugagcuucguguuccuccugcugggcgccgucuccuggcccccggcgagcgccuccgggcaggaguucuggcccggccagagcgccgccgacauccucuccggggccgcgagccgccggcgcuaccugcuguacgacgugaacccgcccgagggcuucaaccuccggcgcgacguguacauccggaucgccucccugcugaagacccuccugaagacggaggaguggguccuggugcucccgcccugggggcgccuguaccacuggcagagccccgacauccaccaggugcggauccccugguccgaguucuucgaccugcccagccucaacaagaacauccccgucaucgaguacgagcaguucaucgccgaguccggcggccccuucaucgaccagguguacgugcugcagagcuacgccgagggguggaaggagggcaccugggaggagaaggucgacgagcgccccugcaucgaccagcugcucuacucccaggacaagcacgaguacuaccgggggugguucuggggcuacgaggagacccgcgggcugaacgugagcugccuguccgugcagggcagcgcguccaucgucgccccgcuccugcugcggaacaccagcgcccgcuccgugaugcucgaccgggccgagaaccugcugcacgaccacuacggcgggaaggaguacugggacacgcgccggagcaugguguucgcccgccaccuccgggaggucggcgacgaguuccgcagccggcaccugaacuccaccgacgacgcggaccgcauccccuuccaggaggacuggaugaagaugaaggugaagcuggggagcgcccucggcggccccuaccugggggugcaccuccggcgcaaggacuucaucuggggccaccgccaggacguccccucccuggagggggccgugcggaagauccgcagccugaugaagacccaccggcuggacaagguguucgucgccaccgacgccgugcgcaaggaguacgaggagcucaagaagcugcugccggagauggugcgguucgagcccacgugggaggagcucgagcuguacaaggacggcggggucgcgaucaucgaccaguggaucugcgcccacgcccgcugccugcccaccucccucagcgccgaguccggcagcggcggguuccagcgguucuucugccccaaguacuccgugagcgagcagauggucgccugcgugcacuccggccacuuccacaccgugugccugcuggucuga

SEQ ID NO: 34807 - RNA, 1830 nt, Artificial Sequence
  derived and/or modified sequence opt1 from POGK__Homo_sapiens__NP_060012
auggagagcaccgccuacccccugaaccucucccugaaggaggaggaggaggaggaggagauccagagccgcgagcuggaggacggcccggccgacaugcagaaggugcggaucugcuccgagggcggguggguccccgcccucuucgacgagguggcgaucuacuucagcgacgaggagugggaggugcugaccgagcagcagaaggcccuguaccgcgaggucaugcggaugaacuacgagacggugcucucccuggaguuccccuuccccaagccggacaugaucacccgccuggagggggaggaggagagccagaacuccgacgaguggcagcuccagggcgggaccagcgccgagaacgaggaguccgacgugaagccgcccgacuggcccaaccccaugaacgccaccagccaguucccccagccccagcacuucgacuccuucggccugcggcugccccgcgacaucacggagcucccggaguggagcgagggcuaccccuucuacauggcgaugggguuccccggcuacgaccuguccgccgacgacaucgccgggaaguuccaguucagccggggcaugcgccgguccuacgacgccggguucaagcugauggucguggaguacgcggagagcaccaacaacugccaggccgccaagcaguucggcgugcucgagaagaacguccgcgacuggcggaaggugaagccccagcugcagaacgcccacgccaugcgccgggcguuccgcggcccgaagaacgggcgguucgcccugguggaccagcgcgucgccgaguacgugcgguacaugcaggccaagggcgaccccaucacccgcgaggccaugcagcucaaggcgcuggagaucgcccaggagaugaacauccccgagaagggguucaaggccucccugggcuggugccggcgcaugaugcggcgcuacgaccucagccugcgccacaaggugcccgucccgcagcaccuccccgaggaccugaccgagaagcuggugacguaccagcgguccgugcuggcccuccgccgggcccacgacuacgaggucgcgcagaugggcaacgccgacgagacccccaucugccuggaggugcccagccgcgugaccgucgacaaccagggggagaagccggugcuggugaagacccccggccgggagaagcucaagaucacggccaugcuggggguccuggccgacggccgcaagcucccgcccuacaucauccugcgggggaccuacaucccgcccggcaaguuccccagcggcauggagauccgcugccaccgguacggguggaugaccgaggaccugaugcaggacuggcucgagguggucuggcgccggcgcaccggcgccgugcccaagcagcgggggaugcugauccugaacggcuuccgcgggcacgcgacggacuccgugaagaacagcauggaguccaugaacaccgacauggucaucauccccggcggccucaccagccagcuccaggugcuggacguggucguguacaagccccugaacgacuccgugcgggcccaguacagcaacuggcugcuggccgggaaccucgcccugucccccaccggcaacgcgaagaagccgccccugggccucuuccuggagugggucaugguggccuggaacagcaucuccagcgaguccaucgugcagggguucaagaagugccacaucagcuccaaccuggaggaggaggacgacguccugugggagaucgagagcgagcuccccgggggcggcgagcccccgaaggacugcgacacggaguccauggccgagagcaacuga

SEQ ID NO: 34808 - RNA, 1179 nt, Artificial Sequence
  derived and/or modified sequence opt1 from POGLUT1__Homo_sapiens__NP_689518
auggaguggugggccagcagcccccugcgccucuggcugcuccuguuccugcugccgagcgcccagggccggcagaaggaguccgggagcaaguggaagguguucaucgaccagaucaaccgcucccucgagaacuacgagcccugcagcucccagaacugcagcugcuaccacggcgucaucgaggaggaccugacccccuuccgcgggggcaucucccggaagaugauggcggagguggugcggcgcaagcuggggacccacuaccagaucaccaagaaccggcucuaccgcgagaacgacugcauguuccccagccggugcuccggcgucgagcacuucauccuggaggugaucggccgccugccggacauggagauggugaucaacguccgggacuacccccaggugcccaaguggauggagcccgccaucccgguguucagcuucuccaagaccagcgaguaccacgacaucauguaccccgccuggaccuucugggagggcgggcccgccgucuggcccaucuacccgaccgggcucggccgcugggaccuguuccgggaggaccuggugcgcuccgccgcgcaguggcccuggaagaagaagaacagcacggccuacuuccgggggucccgcaccagccccgagcgggacccccucauccugcugucccgcaagaacccgaagcucguggacgccgaguacaccaagaaccaggccuggaaguccaugaaggacacccugggcaagcccgcggccaaggacguccaccugguggaccacugcaaguacaaguaccucuucaacuuccggggcguggccgccagcuuccgcuucaagcaccuguuccugugcgggucccucgucuuccacgugggcgacgaguggcuggaguucuucuacccccagcugaagcccugggugcacuacaucccggucaagacggaccucagcaacgugcaggagcugcugcaguucgugaaggccaacgacgacgucgcgcaggagaucgccgagcgggggucccaguucauccgcaaccaccuccagauggacgacaucacgugcuacugggagaaccugcugagcgaguacuccaaguuccucagcuacaacgugacccgccggaagggcuacgaccagaucauccccaagaugcugaagaccgagcuguga

SEQ ID NO: 34809 - RNA, 4389 nt, Artificial Sequence
  derived and/or modified sequence opt1 from POLA1__Homo_sapiens__NP_058633
auggcccccgugcacggcgacgacagccuguccgacagcggguccuucgucagcucccgcgcccggcgcgagaagaagagcaagaagggccggcaggaggcgcucgagcgccugaagaaggccaaggccggggagaaguacaaguacgagguggaggacuucaccggcguguacgaggaggucgacgaggagcaguacuccaagcuggugcaggcccggcaggacgacgacuggaucguggacgacgacgggaucggcuacgucgaggacggccgcgagaucuucgacgacgaccucgaggacgacgcccuggacgcggacgagaaggggaaggacggcaaggcccggaacaaggacaagcgcaacgugaagaagcuggccgugaccaagccgaacaacaucaagagcauguucaucgccugcgcggggaagaagacggccgacaaggccgucgaccucuccaaggacggccugcugggggacauccuccaggaccugaacaccgagaccccccagaucaccccccccccggugaugauccugaagaagaagcggagcaucggcgccucccccaaccccuucagcgugcacacggccaccgcgguccccuccggcaagaucgccagcccggugucccgcaaggagcccccccucacccccgugccgcugaagcgggccgaguucgccggggacgacguccagguggagagcaccgaggaggagcaggaguccggcgccauggaguucgaggacggggacuucgacgagcccauggagguggaggaggucgaccuggagcccauggcggccaaggccugggacaaggagagcgagcccgccgaggaggugaagcaggaggccgacuccggcaagggcacggugagcuaccucgggagcuuccugccggacgucuccugcugggacaucgaccaggagggcgacagcuccuucagcgugcaggaggugcaggucgacuccagccaccugccccucgugaagggggcggacgaggagcaggucuuccacuucuacuggcuggacgccuacgaggaccaguacaaccagcccggcgugguguuccuguucgggaaggucuggaucgaguccgccgagacccacgugagcugcugcgugauggucaagaacaucgagcgcacccucuacuuccugccccgggagaugaagaucgaccugaacaccggcaaggagacgggcaccccgaucuccaugaaggacguguacgaggaguucgacgagaagaucgccaccaaguacaagaucaugaaguucaagagcaagcccguggagaagaacuacgccuucgagauccccgacguccccgagaaguccgaguaccucgaggugaaguacagcgcggagaugccgcagcugccccaggaccugaagggggagaccuucucccacguguucggcacgaacaccagcucccucgagcuguuccugaugaaccgcaagaucaaggggcccugcuggcucgaggucaagagcccccagcugcugaaccagccgguguccuggugcaagguggaggccauggcccucaagcccgaccuggucaacgugaucaaggacgugagccccccgccccuggucgugauggccuucuccaugaagaccaugcagaacgcgaagaaccaccagaacgagaucaucgccauggccgcccucgugcaccacagcuucgcccuggacaaggcggcccccaagcccccguuccagagccacuucugcgucguguccaagcccaaggacugcaucuuccccuacgccuucaaggaggugaucgagaagaagaacgucaagguggagguggccgccaccgagcggacgcugcucggcuucuuccuggcgaagguccacaagaucgaccccgacaucaucguggggcacaacaucuacggcuucgagcuggaggugcuccugcagcgcaucaacgucugcaaggccccgcacuggagcaagaucggccggcugaagcgcuccaacaugcccaagcucgggggccggagcggguucggcgagcgcaacgccaccugcgggcggaugaucugcgacguggagaucuccgccaaggagcugauccgcugcaagagcuaccaccuguccgagcucgugcagcagauccugaagaccgagcgcgucgugauccccauggagaacauccagaacauguacagcgaguccagccagcugcuguaccuccuggagcacaccuggaaggacgccaaguucauccugcagaucaugugcgagcucaacgugcugccccuggcgcuccagaucacgaacaucgccggcaacaucaugucccggacccugaugggcgggcgcagcgagcggaacgaguuccugcuccugcacgccuucuacgagaacaacuacaucgucccggacaagcagaucuuccgcaagccccagcagaagcugggcgacgaggacgaggagaucgacggggacaccaacaaguacaagaagggccggaagaaggccgcguacgccggcgggcucgugcuggaccccaaggugggcuucuacgacaaguucauccugcuccuggacuucaacucccuguaccccagcaucauccaggaguucaacaucugcuucaccacgguccagcgcguggccuccgaggcccagaaggugaccgaggacggggagcaggagcagaucccggagcuccccgaccccagccuggagaugggcauccugccccgggagauccgcaagcucgucgagcggcgcaagcaggugaagcagcugaugaagcagcaggaccugaacccggaccucauccugcaguacgacauccggcagaaggcccugaagcucaccgcgaacuccauguacgggugccugggcuucagcuacagccgcuucuacgccaagccccuggccgcccucgugaccuacaagggccgggagauccugaugcacacgaaggagaugguccagaagaugaaccuggaggugaucuacggggacaccgacuccaucaugaucaacaccaacagcaccaaccucgaggagguguucaagcugggcaacaaggucaaguccgaggugaacaagcuguacaagcuccuggagaucgacaucgacgggguguucaagagccugcuccugcugaagaagaagaaguacgccgcgcucgucguggagcccacguccgacggcaacuacgucaccaagcaggagcugaaggggcuggacaucgugcgccgggacuggugcgaccucgccaaggacaccggcaacuucgugaucggccagauccugagcgaccagucccgcgacaccaucgucgagaacauccagaagcggcugaucgagaucggggagaacgugcucaacggcagcgugcccgucucccaguucgagaucaacaaggcccugaccaaggacccgcaggacuaccccgacaagaagagccugccccacgugcacguggcccucuggaucaacucccaggggggccgcaaggucaaggccggggacacggugagcuacgugaucugccaggacggcuccaaccugaccgcgagccagcgggccuacgccccggagcagcugcagaagcaggacaaccucaccaucgacacccaguacuaccuggcccagcagauccaccccgucguggcgcgcaucugcgagcccaucgacggcaucgacgccgugcugaucgccacguggcucgggcuggaccccacccaguuccgcguccaccacuaccacaaggacgaggagaacgacgcccugcucggcgggccggcccagcugaccgacgaggagaaguaccgggacugcgagcgcuucaagugccccugccccaccugcggcacggagaacaucuacgacaacguguucgacggguccggcaccgacauggagcccagccuguaccggugcuccaacaucgacugcaaggcgagcccgcucaccuucaccgugcagcuguccaacaagcugaucauggacauccgccgguucaucaagaaguacuacgacggcuggcucaucugcgaggagcccacgugccgcaaccggacccgccaccugccccugcaguucagccggaccgggccccucugcccggccugcaugaaggccacccugcagcccgaguacagcgacaagucccuguacacgcagcucugcuucuaccgcuacaucuucgacgccgagugcgcccuggagaagcugaccaccgaccacgagaaggacaagcucaagaagcaguucuucacccccaagguccugcaggacuaccggaagcugaagaacacggcggagcaguuccucagccgcuccggcuacagcgaggugaaccuguccaagcuguucgccgggugcgccgugaagagcuga

SEQ ID NO: 34810 - RNA, 1797 nt, Artificial Sequence
  derived and/or modified sequence opt1 from POLA2__Homo_sapiens__NP_002680
augagcgccuccgcccagcagcuggcggaggagcuccagaucuucggccuggacugcgaggaggcccugaucgagaagcucguggagcugugcguccaguacgggcagaacgaggagggcauggugggggagcugaucgccuucugcaccagcacccacaaggugggccucacguccgagauccugaacagcuucgagcacgaguuccuguccaagcgccucagcaaggcccggcacuccacgugcaaggacagcgggcacgccggcgcgcgcgacaucgucuccauccaggagcugaucgagguggaggaggaggaggagauccugcucaacagcuacaccacccccuccaagggcagccagaagcgggccaucuccaccccggagacgccccugaccaagcgcagcguguccacccggagcccccaccagcugcucucccccagcuccuucagcccgagcgccacccccucccagaaguacaacagccgcuccaaccggggcgaggucgugaccagcuucgggcuggcccaggggguguccuggagcggccgcgggggcgcgggcaacaucucccugaagguccucgggugccccgaggcccugaccggcagcuacaaguccauguuccagaagcugcccgacauccgggaggugcugaccugcaagaucgaggagcucgggagcgagcugaaggagcacuacaagaucgaggccuucacgccgcuccuggcccccgcccaggagcccgugacccugcucggccagaucggcugcgacuccaacgggaagcugaacaacaagagcgucauccuggagggcgaccgcgagcacuccagcggggcgcagauccccguggaccucuccgagcugaaggaguacagccuguucccgggccagguggucaucauggaggggaucaacaccaccggccggaagcucguggccacgaagcuguacgagggcgugccccugcccuucuaccagcccaccgaggaggacgccgacuucgagcaguccaugguccucguggccugcgggccguacaccaccagcgacuccaucacguacgacccccugcuggaccucaucgccgugaucaaccacgaccgccccgacgucugcauccuguucggccccuuccuggacgcgaagcacgagcaggucgagaacugccuccugaccagcccguucgaggacaucuucaagcagugccugcggaccaucaucgaggggacccgcagcuccggcagccaccucguguucgugcccucccugcgggacgugcaccacgagcccgucuacccccagccgcccuucagcuacuccgaccugagccgcgaggacaagaagcagguccaguucguguccgagcccugcagccucuccaucaacggggugaucuucggccugacgagcaccgaccugcuguuccaccucggcgccgaggagaucuccagcuccagcgggaccuccgaccgguucagccgcauccugaagcacauccugacccagcgguccuacuacccccucuacccgccccaggaggacauggccaucgacuacgagagcuucuacguguacgcccagcugcccgugacgccggacguccugaucauccccagcgagcuccgcuacuucgugaaggacgugcugggcugcgucugcgugaaccccgggcggcugaccaagggccaggugggcgggaccuucgcccgccucuaccugcgccggcccgcggccgacggcgccgagcgccaguccccgugcaucgccguccagguggugcggaucuga

SEQ ID NO: 34811 - RNA, 1008 nt, Artificial Sequence
  derived and/or modified sequence opt1 from POLB__Homo_sapiens__NP_002681
augagcaagcgcaaggcgccccaggagacccugaacggcgggaucaccgacaugcucacggagcuggccaacuucgagaagaacgugucccaggccauccacaaguacaacgccuaccggaaggccgccagcgucaucgccaaguacccgcacaagaucaaguccggcgcggaggccaagaagcugcccggggugggcaccaagaucgccgagaagaucgacgaguuccucgccaccgggaagcugcgcaagcuggagaagauccggcaggacgacaccagcuccagcaucaacuuccucacgcgcguguccggcaucggccccagcgcggcccggaaguucgucgacgaggggaucaagacccuggaggaccugcgcaagaacgaggacaagcucaaccaccaccagcggaucggccugaaguacuucggggacuucgagaagcgcaucccccgggaggagaugcugcagaugcaggacaucgugcucaacgaggugaagaaggucgacuccgaguacaucgccaccgugugcggcagcuuccgccgcggggccgaguccagcggcgacauggacgugcugcugacccacccguccuucacgagcgaguccaccaagcagcccaagcuccugcaccaggucguggagcagcugcagaaggugcacuucaucaccgacacccucagcaagggcgagacgaaguucaugggggucugccagcugcccuccaagaacgacgagaaggaguacccccaccggcggaucgacauccgccugaucccgaaggaccaguacuacugcggcgugcucuacuucaccgggagcgacaucuucaacaagaacaugcgggcccacgcgcuggagaagggcuucaccaucaacgaguacaccauccgcccccugggcgugacgggggucgccggcgagccccuccccguggacuccgagaaggacaucuucgacuacauccaguggaaguaccgggagccgaaggaccgcagcgaguga

SEQ ID NO: 34812 - RNA, 3324 nt, Artificial Sequence
  derived and/or modified sequence opt1 from POLD1__Homo_sapiens__NP_001243778
auggacggcaagcgccggcccgggccgggccccggggugccgcccaagcgcgcccggggcgggcugugggacgacgacgacgccccgcgccccagccaguucgaggaggaccucgcgcugauggaggagauggaggccgagcaccggcugcaggagcaggaggaggaggagcuccaguccguccuggagggcguggccgacggccaggugccgcccagcgccaucgacccccgcuggcugcggcccaccccgcccgcccucgacccccagaccgagccccugaucuuccagcagcuggagaucgaccacuacgucgggcccgcgcagcccgugccgggcgggcccccgcccucccgcggcagcgugcccguccuccgggccuucggggugacggacgagggcuucuccgugugcugccacauccacggcuucgcccccuacuucuacacccccgccccgcccggguucggccccgagcacaugggggaccugcagcgcgagcugaaccucgcgaucagccgggacucccgcggcggccgggagcugaccgggcccgccguccuggccguggagcucugcagccgcgaguccauguucggcuaccacgggcacggccccagccccuuccugcggaucaccguggcccugccccgccucgucgcccccgcgcggcgccugcuggagcaggggauccggguggccggccucggcacgccguccuucgcccccuacgaggccaacguggacuucgagauccgcuucauggucgacaccgacaucguggggugcaacuggcuggagcugcccgccggcaaguacgcgcuccggcugaaggagaaggccacccagugccagcuggaggccgacgugcucuggagcgacgucgugucccacccgcccgaggggcccuggcagcgcaucgcgccccugcgcgugcugagcuucgacaucgagugcgccggccggaaggggaucuuccccgagccggagcgcgaccccgucauccagaucugcucccucggccugcgguggggcgagcccgagcccuuccugcgccucgcccugacccugcggccgugcgcccccauccucggggccaaggugcagagcuacgagaaggaggaggaccugcugcaggccugguccacguucauccgcaucauggaccccgacgugaucaccggcuacaacauccagaacuucgaccuccccuaccugaucagccgggcccagacccugaagguccagaccuucccguuccucgggcgcguggcgggccugugcuccaacauccgggacagcagcuuccaguccaagcagacggggcgccgggacaccaaggucgugagcauggugggccgcguccagauggacaugcuccaggugcugcugcgggaguacaagcugcgcuccuacacccucaacgccgugagcuuccacuuccugggcgagcagaaggaggacguccagcacuccaucaucaccgaccugcagaacgggaacgaccagacgcggcgccggcuggccguguacugccucaaggacgccuaccugccccugcgccuccuggagcggcugauggugcucgucaacgcgguggagauggcccgcgugaccggcgucccccugagcuaccugcucucccgcgggcagcaggucaagguggugagccagcugcugcggcaggccaugcacgagggccuccugaugcccguggugaaguccgagggcggggaggacuacaccggcgccaccgucaucgagccgcugaagggguacuacgacgugcccaucgccacgcucgacuucagcucccuguaccccagcaucaugauggcgcacaaccugugcuacaccacccuccugcgccccggcaccgcccagaagcuggggcucacggaggaccaguucauccggaccccgaccggcgacgaguucgugaagaccuccguccgcaagggccugcugccccagauccucgagaaccugcugagcgcccggaagcgcgccaaggccgagcucgcgaaggagacggacccccugcggcgccaggugcuggacgggcggcagcucgcccugaagguguccgccaacagcgucuacggcuucaccggggcccaggugggcaagcugccgugccucgagaucucccagagcgugaccggguucggccgccagaugaucgagaagaccaagcagcuggucgaguccaaguacacgguggagaacggcuacagcaccagcgccaagguggucuacggggacaccgacuccgugaugugccgguucggcgugagcuccgucgcggaggccauggcccuggggcgcgaggccgcggacugggugagcggccacuuccccucccccauccggcucgaguucgagaagguguacuuccccuaccugcugaucagcaagaagcgcuacgccgggcuccuguucuccagccggccggacgcccacgaccgcauggacugcaagggccuggaggccguccggcgcgacaacugcccccucguggccaaccuggugaccgcgucccugcggcgccuccugaucgaccgggaccccgagggcgccgucgcccacgcccaggacgugaucagcgaccugcucugcaaccgcaucgacaucucccagcuggugaucacgaaggagcugacccgcgccgcgagcgacuacgccgggaagcaggcccacgucgagcucgccgagcggaugcgcaagcgggaccccggcuccgccccgagccugggggaccgcgugcccuacgugaucaucuccgcggccaagggcgucgccgccuacaugaaguccgaggacccccuguucgugcucgagcacagccugcccaucgacacccaguacuaccuggagcagcagcucgcgaagccgcugcugcggaucuucgagcccauccucggggagggccgcgccgaggccgugcugcugcggggcgaccacacccgcugcaagaccguccucacggggaaggugggcgggcugcuggccuucgccaagcggcgcaacugcugcaucggcugccggaccgugcucagccaccagggcgcggucugcgaguucugccagccccgcgagagcgagcuguaccagaaggaggugucccaccugaacgcccucgaggagcgguucagccgccuguggacccagugccagcggugccaggggucccugcacgaggacgucaucugcaccagccgcgacugccccaucuucuacaugcggaagaaggugcgcaaggaccucgaggaccaggagcagcugcugcggcgcuucggcccgcccgggcccgaggccugguga

SEQ ID NO: 34813 - RNA, 1410 nt, Artificial Sequence
  derived and/or modified sequence opt1 from POLD2__Homo_sapiens__NP_001243808
auguucagcgagcaggccgcccagcgcgcgcacacccugcucuccccgcccagcgccaacaacgccaccuucgcccgggugcccgucgccacguacaccaacuccagccagcccuuccgccugggcgagcgguccuucagccgccaguacgcgcacaucuacgccacccggcugauccagaugcgccccuuccucgagaaccgggcccagcagcacuggggguccggcgugggggugaagaagcugugcgagcugcagccggaggagaagugcugcgucgugggcacccucuucaaggccaugccccugcagcccagcauccugcgcgagguguccgaggagcacaaccuccugccccagccgccccggagcaaguacauccaccccgacgacgagcugguccucgaggacgagcugcagcgcaucaagcugaaggggacgaucgacguguccaagcucgugaccggcaccguccuggcgguguucggcagcgugcgggacgacgggaaguuccuggucgaggacuacugcuucgccgaccucgcgccccagaagccggccccgccccuggacaccgaccgcuucgugcugcucguguccggccuggggcugggcgggggcggcggggagagccuccugggcacgcagcugcucgucgacguggugaccgggcagcugggcgacgagggcgagcagugcuccgccgcccacgucagccgggugauccuggccgggaaccuccugucccacagcacccagucccgcgacagcaucaacaaggccaaguaccugaccaagaagacgcaggccgccagcguggaggcggucaagaugcucgacgagauccugcugcagcucuccgccagcgugcccguggacgucaugcccggcgaguucgaccccaccaacuacacccugccccagcagccccugcacccgugcauguucccccucgccaccgccuacuccacgcugcagcuggugaccaaccccuaccaggccaccaucgacgggguccgguuccucggcaccagcgggcagaacguguccgacaucuuccgcuacagcuccauggaggaccaccuggagauccuggaguggacgcuccgggugcgccacaucagccccaccgcgccggacacccugggcugcuaccccuucuacaagaccgaccccuucaucuuccccgagugcccgcacgucuacuucugcggcaacacgcccuccuucgggagcaagaucauccggggccccgaggaccagaccgugcugcucgugaccgucccggacuucuccgccacccagacggccugccuggugaaccugcgcagccuggccugccagcccaucuccuucagcggguucggcgccgaggacgacgaccucgggggccugggccuggggcccuga

SEQ ID NO: 34814 - RNA, 1401 nt, Artificial Sequence
  derived and/or modified sequence opt1 from POLD3__Homo_sapiens__NP_006582
auggccgaccagcuguaccucgagaacaucgacgaguucgugaccgaccagaacaagaucgucaccuacaaguggcugagcuacacgcugggcgugcacgugaaccaggccaagcagaugcucuacgacuacgucgagcgcaagcggaaggagaacuccggggcgcagcugcacgugaccuaccuggugagcggcucccucauccagaacgggcacagcugccacaaggucgccguggugcgcgaggacaagcuggaggccgucaaguccaagcuggccgugaccgccagcauccacguguacuccauccagaaggcgaugcucaaggacagcggcccccuguucaacaccgacuacgacauccugaaguccaaccuccagaacugcagcaaguucuccgccauccagugcgccgccgcggucccccgggcccccgccgagagcuccagcuccagcaagaaguucgagcagucccaccuccacaugagcuccgagacgcaggccaacaacgagcugaccaccaacgggcacggcccgcccgccagcaagcaggucagccagcagcccaagggcaucauggggauguucgcguccaaggccgccgccaagacccaggagacgaacaaggagaccaagaccgaggccaaggaggugaccaacgcgagcgccgccggcaacaaggcccccgggaagggcaacaugauguccaacuucuucgggaaggccgcgaugaacaaguucaaggugaaccuggacagcgagcaggccgugaaggaggagaagaucguggagcagcccacggucuccgugaccgagcccaagcuggccacccccgccggccugaagaaguccuccaagaaggccgagcccgugaagguccuccagaaggagaagaagcgcggcaagcggguggcgcugagcgacgacgagaccaaggagacggagaacaugcgcaagaagcggcgccggaucaagcugcccgaguccgacagcuccgaggacgagguguuccccgacagcccgggggccuacgaggccgagucccccagcccgccgcccccgcccagcccgccccucgagcccguccccaagaccgagcccgagccgcccagcgugaaguccagcuccggcgagaacaagcgcaagcggaagcgcguccucaagagcaagaccuaccuggacggggagggcugcaucgugaccgagaagguguacgagagcgaguccugcacggacagcgaggaggagcugaacaugaagaccuccagcguccaccggccgcccgccaugaccgugaagaaggagccccgcgaggagcggaagggccccaagaaggggaccgcggcccugggcaaggccaaccgccagguguccaucacgggguucuuccagcggaaguga

SEQ ID NO: 34815 - RNA, 240 nt, Artificial Sequence
  derived and/or modified sequence opt1 from POLD4__Homo_sapiens__NP_001243799
augggccgcaagcggcugaucaccgacagcuaccccguggucaagcgccgggaggggccggccggccacuccaagggggagcucgcccccgagcugggcgaggagccccagccccgcgacgaggaggaggccgagcuggagcuccugcggcaguucgaccuggccuggcaguacgggccgugcaccgugagcggcaucuccauccccuacgaggcgccccgcaagacgagcugccccuga

SEQ ID NO: 34816 - RNA, 1317 nt, Artificial Sequence
  derived and/or modified sequence opt1 from POLDIP3__Homo_sapiens__NP_001265586
auggccgacaucagccuggacgagcucauccgcaagcggggcgccgcggccaaggggcgccugaacgcccggcccggcgucgggggcgugcgcucccggguggggauccagcagggccugcucagccaguccacccgcaccgccacguuccagcagcgguucgacgcccgccagaagaucggccugagcgacgcgcggcugaagcucggggugaaggacgcccgcgagaagcugcugcagaaggacgcccgguuccgcaucaagggcaagguccaggacgcccgggagaugcucaacucccgcaagcagcagaccaccgugccgcagaagccccgccagguggcggacgcccgggagaagaucagccugaagcgguccagccccgccgccuucaucaacccgcccaucgggaccgucacgcccgcccugaagcucaccaagaccauccagcgcaugcacguggaccccgugggcuggauccugaccacggagugcuuccaggucccccagcagaaggcgauggccccgcugcacccccaccccgccgggaugcggaucaacguggugaacaaccaccaggccaagcagaaccucuacgaccuggacgaggacgacgacggcaucgccuccguccccaccaagcagaugaaguucgcggccagcggcggguuccugcaccacauggccggccucuccagcuccaagcugagcauguccaaggcccugccgcucaccaagguggugcagaacgacgccuacaccgcgcccgcccugcccagcuccauccgcacgaaggcccugaccaacaugagccggacccucgucaacaaggaggagcccccgaaggagcugcccgccgccgagcccgugcugagcccccucgaggggaccaagaugacggugaacaaccugcacccgcgcgucaccgaggaggacaucguggagcuguucugcgugugcggcgcgcucaagcgcgcccggcugguccaccccggcguggccgagguggucuucgugaagaaggacgacgccaucaccgcguacaagaaguacaacaaccgcugccuggacgggcagcccaugaagugcaaccuccacaugaacggcaacgucaucaccuccgaccagcccauccugcugcggcucagcgacuccccgagcaugaagaaggaguccgagcugccccgccgggugaacagcgccuccagcuccaacccgcccgccgagguggaccccgacacgauccugaaggcccucuucaagagcuccggggccagcgucaccacccagcccaccgaguucaagaucaagcuguga

SEQ ID NO: 34817 - RNA, 1506 nt, Artificial Sequence
  derived and/or modified sequence opt1 from POLE2__Homo_sapiens__NP_001184259
auggcccccgagcgccugcggagccgcgcccucuccgcguucaagcugcggggccugcuccugcgcggggaggccaucaaguaccugaccgaggcccuccagagcaucuccgagcuggagcuggaggacaagcucgagaagaucaucaacgccguggagaagcagccgcugagcuccaacaugaucgagcggagcgucguggaggccgcggugcaggagugcucccagagcgucgacgagaccauccugcucaugacgaaccaccccgcccccaaccuguucggcacgccccgcgacaaggccgagauguuccgggagcgcuacaccauccugcaccagcggacccaccgccacgagcuguucaccccgcccgugaucgggucccaccccgacgagagcggcuccaaguuccagcucaagaccaucgagacccugcucgggagcaccacgaagaucggcgacgccaucgugcugggcaugaucacccagcugaaggaggggaaguucuuccucgaggaccccaccggcaccguccagcuggaccuguccaaggcgcaguuccacagcgggcucuacacggaggccugcuucgugcuggccgagggcugguucgaggaccagguguuccacgucaacgccuucggguucccgcccaccgagcccuccagcaccacccgggccuacuacggcaacaucaacuucuucggcgggcccuccaacacgagcgugaagaccuccgcgaagcugaagcagcucgaggaggagaacaaggacgccauguucguguuccugagcgacgucuggcuggaccagguggaggugcucgagaagcugcgcaucauguucgccggcuacagcccggccccgccgaccugcuucauccugugcgggaacuucuccagcgcccccuacggcaagaaccagguccaggcgcucaaggacucccugaagacccuggccgacaucaucugcgaguaccccgacauccaccagagcucccgguucguguucgugcccggccccgaggaccccggguucggcagcauccucccccgcccgccccuggccgaguccaucacgaacgaguuccggcagcgcguccccuucagcguguucaccaccaaccccugccggauccaguacugcacccaggagaucacgguguuccgcgaggaccuggucaacaagaugugccggaacugcgugcgcuuccccuccagcaaccucgccauccccaaccacuucgugaagaccauccugucccaggggcaccugacgccccucccgcuguacgucugccccguguacugggccuacgacuacgcgcugcgggucuaccccgugccggaccuccuggugaucgccgacaaguacgaccccuucaccaccaccaacaccgagugccugugcaucaaccccggcagcuucccccgcuccggguucagcuucaaggucuucuacccguccaacaagaccguggaggacagcaagcuccagggcuucuga

SEQ ID NO: 34818 - RNA, 444 nt, Artificial Sequence
  derived and/or modified sequence opt1 from POLE3__Homo_sapiens__NP_059139
auggccgagcgccccgaggaccugaaccucccgaacgccgugaucacccggaucaucaaggaggcgcugcccgacggcgucaacaucagcaaggaggcccgcuccgccaucagccgggccgccuccguguucgugcuguacgcgaccagcugcgccaacaacuucgccaugaaggggaagcgcaagacccucaacgccuccgacguccugagcgcgauggaggagauggaguuccagcgguucgugacgccccugaaggaggcccucgaggccuaccgccgggagcagaagggcaagaaggaggccuccgagcagaagaagaaggacaaggacaagaagaccgacagcgaggagcaggacaagucccgcgacgaggacaacgacgaggacgaggagcggcuggaggaggaggagcagaacgaggaggaggagguggacaacuga

SEQ ID NO: 34819 - RNA, 354 nt, Artificial Sequence
  derived and/or modified sequence opt1 from POLE4__Homo_sapiens__NP_063949
auggccgccgcggccgccgccggcagcgggacgccccgcgaggaggagggcccggccggggaggcggccgccucccagccccaggcccccaccagcgugcccggcgcgcggcugucccgccucccgcuggcccgggucaaggcccuggugaaggccgaccccgacgugacccucgccgggcaggaggcgaucuucauccuggcccgcgccgccgagcuguucgucgagaccaucgccaaggacgcguacugcugcgcccagcagggcaagcggaagacccuccagcgccgggaccuggacaacgccaucgaggccguggacgaguucgccuuccuggagggcacccucgacuga

SEQ ID NO: 34820 - RNA, 6861 nt, Artificial Sequence
  derived and/or modified sequence opt1 from POLE__Homo_sapiens__NP_006222
augagccugcgcagcggcgggcggcgccgggccgaccccggcgccgacggggaggccagccgcgacgacggcgccaccuccagcguguccgcccucaagcggcuggagcgcagccaguggaccgacaagauggaccugcgguucggguucgagcgccucaaggagccgggcgagaagacgggcuggcugaucaacaugcaccccaccgagauccuggacgaggacaagcggcucggguccgccguggacuacuacuucauccaggacgacggcagccgcuucaagguggcccugcccuacaagcccuacuucuacaucgcgacccggaaggggugcgagcgcgagguguccagcuuccuguccaagaaguuccagggcaagaucgccaaggucgagaccgugcccaaggaggaccucgaccugcccaaccaccugguggggcucaagcggaacuacauccgccugagcuuccacacggucgaggaccuggugaaggugcggaaggagaucucccccgccgucaagaagaaccgcgagcaggaccacgccagcgacgcguacaccgcccuccuguccagcgugcugcagcggggcggcgugaucaccgacgaggaggagaccuccaagaagaucgccgaccagcucgacaacaucgucgacaugcgcgaguacgacgugcccuaccacauccggcugagcaucgaccugaagauccacguggcccacugguacaacguccgcuaccgggggaacgccuucccgguggagaucacgcgccgcgacgaccucguggagcggcccgaccccgucgugcuggcguucgacaucgagaccaccaagcugccccucaaguucccggacgccgagaccgaccagaucaugaugaucuccuacaugaucgacggccagggguaccugaucacgaaccgcgagaucgugagcgaggacaucgaggacuucgaguucacccccaagcccgaguacgagggccccuucugcgucuucaacgagccggacgaggcccaccugauccagcggugguucgagcacgugcaggagaccaagcccaccaucauggugacguacaacggcgacuucuucgacuggcccuucgucgaggcccgcgccgcggugcacgggcucagcaugcagcaggagaucggcuuccagaaggacucccagggggaguacaaggcgccccagugcauccacauggacugccugcggugggucaagcgcgacagcuaccugccggugggcucccacaaccucaaggccgccgccaaggcgaagcugggguacgaccccguggagcuggaccccgaggacaugugccggauggccaccgagcagccccagacccucgccaccuacagcgucuccgacgccguggccacguacuaccuguacaugaaguacgugcacccguucaucuucgcgcugugcaccaucauccccauggagcccgacgagguccuccgcaagggcagcggcacccugugcgaggcccugcucauggugcaggccuuccacgccaacaucaucuuccccaacaagcaggagcaggaguucaacaagcugaccgacgacgggcacgugcuggacuccgagacguacgucggcgggcacguggaggcgcucgagagcggcguguuccgguccgacaucccgugccgcuuccggaugaaccccgccgccuucgacuuccugcugcagcgcgucgagaagacccuccggcacgcccuggaggaggaggagaaggugcccguggagcaggucaccaacuucgaggaggugugcgacgagaucaagagcaagcuggccucccucaaggacgugccgagccgcaucgagugcccccugaucuaccaccuggacgucggggcgauguaccccaacaucauccugaccaaccggcuccagcccuccgccaugguggacgaggccacgugcgccgccugcgacuucaacaagccgggcgcgaacugccagcgcaagauggccuggcaguggcggggcgaguucaugcccgccagccgcuccgaguaccaccggauccagcaccagcuggagagcgagaaguucccgccccucuucccggaggggcccgcccgcgccuuccacgagcucucccgcgaggagcaggcgaaguacgagaagcggcgccuggccgacuacugccggaaggccuacaagaagauccacaucaccaagguggaggagcgccugaccaccaucugccagcgggagaacagcuucuacgucgacacggugcgcgccuuccgggaccgccgguacgaguucaagggccuccacaagguguggaagaagaagcuguccgcggccgucgaggugggggacgccgccgaggugaagcgcugcaagaacauggagguccuguacgacagccuccagcuggcccacaagugcauccugaacagcuucuacggcuacgugaugcggaagggggcgcgcugguacuccauggagauggccggcaucgugugcuucaccggcgccaacaucaucacccaggcccgggagcucaucgagcagaucgggcgcccccuggagcuggacaccgacggcaucuggugcguccuccccaacagcuucccggagaacuucguguucaagacgaccaacgugaagaagcccaaggucaccaucuccuaccccggggccaugcugaacaucauggugaaggagggcuucaccaacgaccaguaccaggagcuggcggagcccagcucccucaccuacgugacgcggagcgagaacuccaucuucuucgaggucgacggcccguaccuggccaugauccugcccgccagcaaggaggaggggaagaagcucaagaagcgcuacgccguguucaacgaggacggcucccuggccgagcugaagggguucgaggugaagcggcgcggcgagcuccagcugaucaagaucuuccagagcuccgucuucgaggcguuccugaaggggagcacccucgaggagguguacggcuccguggccaaggucgccgacuacuggcuggacgugcuguacagcaaggccgcgaacaugcccgacuccgagcuguucgagcugaucagcgagaaccgguccaugagccgcaagcuggaggacuacggcgagcagaaguccaccuccaucagcaccgccaagcggcucgccgaguuccugggggaccagauggugaaggacgccggccuguccugccgcuacaucaucagccgcaagcccgagggguccccggucacggagcgggccaucccccucgcgaucuuccaggccgagcccaccgugcgcaagcacuuccugcggaaguggcucaagagcuccagccuccaggacuucgacauccgcgccauccuggacugggacuacuacaucgagcggcugggcuccgccauccagaagaucaucaccauccccgccgcgcuccagcaggucaagaacccggucccccgcgugaagcaccccgacuggcugcacaagaagcugcucgagaagaacgacguguacaagcagaagaagaucagcgagcuguucacccuggaggggcggcgccaggucacgauggccgaggccuccgaggacagcccgcggcccuccgcccccgacauggaggacuucggccucgugaagcugccccacccggccgcgcccgucaccgugaagcgcaagcgggugcugugggagagccaggaggagucccaggaccucacccccaccguccccuggcaggagauccugggccagccgcccgcccuggggacgagccaggaggaguggcucguguggcugcgcuuccacaagaagaaguggcagcugcaggcccggcagcgccucgcccggcgcaagcggcagcgccuggaguccgccgagggcgugcugcggcccggggcgauccgcgacggccccgccaccgggcucggcagcuuccugcgccggaccgcccgcuccauccuggaccucccguggcagaucguccagaucagcgagaccagccaggccggccuguuccggcugugggcgcucgugggguccgaccugcacugcauccgccugagcaucccccggguguucuacgucaaccagcgcguggccaaggccgaggagggcgccuccuaccggaaggugaaccgcguccucccccggagcaacaugguguacaaccuguacgaguacuccgugcccgaggacauguaccaggagcacaucaacgagaucaacgccgagcugagcgcgccggacaucgagggggucuacgagacccaggugccccuccuguuccgcgcccuggugcaccucggcugcgucugcguggugaacaagcagcugguccggcaccuguccgggugggaggccgagaccuucgcccucgagcaccuggagaugcgcagccuggcccaguucuccuaccucgagcccggcagcauccggcacaucuaccuguaccaccacgcgcaggcccacaaggcccuguucggcaucuucauccccucccagcgccgggccagcguguucgugcucgacaccguccgcuccaaccagaugccgagccugggggcccuguacuccgcggagcacggccuccugcuggagaagguggggcccgagcuccugccgccgcccaagcacaccuucgaggugcgggccgagacggaccugaagaccaucugccgcgccauccagcgguuccuccuggccuacaaggaggagcgccggggccccacccugaucgcgguccagagcuccugggagcugaagcgccucgccagcgagauccccgugcuggaggaguucccccuggugcccaucugcgucgccgacaagaucaacuacggcgugcucgacuggcagcgccacggggcccggcgcaugauccggcacuaccugaaccuggacacgugccucucccaggccuucgagaugagccgcuacuuccacauccccaucggcaaccugcccgaggacaucagcacguucggguccgaccuguucuucgcgcggcaccuccagcgccacaaccaccuccuguggcucagcccgaccgcccggcccgaccugggcgggaaggaggccgacgacaacugccuggugauggaguucgacgaccaggccaccgucgagaucaacuccagcggcugcuacuccaccgugugcguggagcucgaccugcagaaccuggccgucaacacgauccuccagagccaccacgugaacgacauggagggcgcggacuccauggggaucagcuucgacgugauccagcaggccucccuggaggacaugaucaccggcgggcaggccgccagcgcccccgcguccuacgacgagaccgcccugugcagcaacaccuuccgcauccucaaguccauggucgugggcugggugaaggagaucacgcaguaccacaacaucuacgccgacaaccaggucaugcacuucuaccgguggcugcgcagccccuccagccugcuccacgacccggcccugcaccggacccugcacaacaugaugaagaagcuguuccugcagcugaucgcggaguucaagcgccucggguccagcgugaucuacgccaacuucaaccggaucauccugugcaccaagaagcgccggguggaggacgccaucgccuacgucgaguacaucaccuccagcauccacagcaaggagacguuccacucccugaccaucagcuucucccgcugcugggaguuccuccuguggauggaccccagcaacuacggcggcaucaaggggaagguguccagccggauccacugcggccugcaggacucccagaaggccgggggcgcggaggacgagcaggagaacgaggacgacgaggaggagcgcgacggggaggaggaggaggaggccgaggagagcaacguggaggaccuccuggagaacaacuggaacauccugcaguuccucccccaggccgccuccugccagaacuacuuccugaugaucgucagcgccuacaucguggcgguguaccacugcaugaaggacggccugcggcgcuccgcccccggcagcaccccgguccgccggcgcggggccucccagcucagccaggaggccgagggcgccgugggggcgcugcccggcaugaucaccuucucccaggacuacgucgccaacgagcugacccagagcuucuucacgaucacccagaagauccagaagaaggugaccggcucccggaacagcaccgagcucuccgagauguuccccgugcugcccgggagccaccuccugcugaacaacccggcccuggaguucaucaaguacgucugcaaggugcugagccuggacacgaacaucaccaaccaggugaacaagcugaaccgcgaccuccugcggcuggucgacgugggcgaguucuccgaggaggcccaguuccgcgaccccugccggagcuacgugcuccccgaggucaucugccgcuccugcaacuucugccgggaccuggaccugugcaaggacagcuccuucagcgaggacggggccgugcucccccaguggcugugcuccaacugccaggcgccguacgacagcuccgccaucgagaugacccugguggagguccuccagaagaagcugauggccuucacccugcaggaccucgugugccugaagugccgcggcgugaaggagacgagcaugcccgucuacugcuccugcgccggggacuucgcgcugaccauccacacccagguguucauggagcagaucggcaucuuccggaacaucgcccagcacuacggcaugagcuaccuccuggagacccuggaguggcuccugcagaagaacccccagcuggggcacuga

SEQ ID NO: 34821 - RNA, 1458 nt, Artificial Sequence
  derived and/or modified sequence opt1 from POLG2__Homo_sapiens__NP_009146
augcgcagccggguggccguccgcgccugccacaaggugugccggugccugcucuccggcuucgggggccgcguggacgcggggcagcccgagcugcugaccgagcggagcuccccgaagggcgggcacgucaagagccacgccgagcucgagggcaacggcgagcaccccgaggcccccggguccggcgaggggagcgaggcccugcuggagaucugccagcgccggcacuuccucuccggcagcaagcagcagcugucccgcgacagccugcucuccgggugccaccccggcuucggcccgcuggggguggagcugcggaagaaccucgccgcggagugguggaccagcguggucguguuccgcgagcaggucuuccccguggacgcccugcaccacaagcccggcccccugcucccgggggacuccgccuuccggcuggugagcgccgagacgcugcgcgagauccuccaggacaaggagcuguccaaggagcagcugguggcguuccucgagaacguccugaagaccagcggcaagcugcgggagaaccuccugcacggcgcccuggagcacuacgugaacugccucgaccuggugaacaagcgccugcccuacgggcucgcccagaucggcgucugcuuccaccccguguucgacaccaagcagauccggaacggggugaaguccaucggcgagaagaccgaggccagccuggucugguucacgcccccgcgcaccuccaaccaguggcuggacuucuggcuccggcaccgccugcagugguggcggaaguucgccaugagccccagcaacuucuccagcuccgacugccaggacgaggaggggcgcaagggcaacaagcuguacuacaacuuccccuggggcaaggagcucaucgagacccuguggaaccugggggaccacgagcuccugcacauguaccccggcaacgugagcaagcugcacgggcgggacggccgcaagaacguggucccgugcgugcucuccgugaacggggaccuggaccgcggcaugcuggcguaccucuacgacagcuuccagcugaccgagaacuccuucacgcggaagaagaaccugcaccgcaagguccucaagcugcaccccugccuggcccccaucaagguggcccuggacgucggccgggggcccacccucgagcugcgccaggugugccagggccuguucaacgagcuccuggagaacgggaucagcguguggccgggcuaccuggagaccaugcaguccagccucgagcagcuguacuccaaguacgacgagaugagcauccuguucaccguccucgugacggagaccacccuggagaacgggcugauccaccuccggucccgcgacaccacgaugaaggagaugaugcacaucagcaagcugaaggacuuccugaucaaguacaucuccagcgccaagaacguguga

SEQ ID NO: 34822 - RNA, 3720 nt, Artificial Sequence
  derived and/or modified sequence opt1 from POLG__Homo_sapiens__NP_002684
augagccgccugcucuggcggaagguggccggcgccaccgucgggcccggcccggugcccgcgcccgggcgcuggguguccagcuccguccccgccagcgacccguccgacggccagcggcgccggcagcagcagcagcagcagcagcagcagcagcagcagcagccccagcagccccaggugcugagcuccgagggcgggcagcugcgccacaacccccucgacauccagaugcugagccggggccugcacgagcagaucuucgggcagggcggggagaugccgggcgaggccgccgugcgccgguccgucgagcaccuccagaagcacgggcuguggggccagcccgccgugccccugcccgacguggagcuccgccugccgccccuguacggcgacaaccucgaccagcacuuccggcugcuggcgcagaagcagagccuccccuaccuggaggccgccaaccugcuccugcaggcccagcugcccccgaagccgcccgcgugggccugggccgagggguggacccgcuacggccccgagggggaggccguccccguggccauccccgaggagcgggcgcucguguucgacgucgaggugugccuggccgagggcacgugccccacccuggccguggccaucucccccagcgccugguacuccuggugcagccagcgccucgucgaggagcgguacuccuggaccagccagcuguccccggcggaccugaucccccucgaggugcccaccggcgccagcucccccacgcagcgcgacuggcaggagcagcugguggucgggcacaacgugagcuucgaccgggcccacauccgcgagcaguaccugauccagggcagccggaugcgcuuccucgacaccauguccaugcacauggccaucagcgggcuguccagcuuccagcggucccuguggaucgccgcgaagcagggcaagcacaaggugcagccgcccaccaagcaggggcagaagucccagcgcaaggcccgccggggccccgccaucagcagcugggacuggcucgacaucuccagcgucaacucccuggccgaggugcaccgccuguacgugggcgggccgccccucgagaaggagccccgggagcuguucgucaagggcaccaugaaggacauccgcgagaacuuccaggaccugaugcaguacugcgcccaggacgugugggcgacgcacgaggucuuccagcagcagcucccccuguuccuggagcggugcccgcaccccgugacccucgccgggaugcuggagaugggcgugagcuaccugcccgucaaccagaacugggagcgcuaccucgccgaggcccaggggaccuacgaggagcugcagcgggagaugaagaagucccugauggaccucgcgaacgacgccugccagcugcugagcggcgagcgcuacaaggaggaccccuggcugugggaccucgagugggaccugcaggaguucaagcagaagaaggccaagaaggugaagaaggagccggccaccgccuccaagcugcccaucgagggcgcgggggcccccggcgaccccauggaccaggaggaccucgggccgugcagcgaggaggaggaguuccagcaggacgugauggcccgggccugccugcagaagcugaagggcacgaccgagcuccugcccaagcgcccccagcaccuccccgggcacccgggcugguaccggaagcucugcccccgccuggacgaccccgccuggacccccggcccgucccugcucagccugcagaugcgggucacccccaagcugauggcgcucacgugggacggguucccccugcacuacuccgagcgccacggcuggggguaccuggugcccggccggcgcgacaaccucgccaagcugccgaccggcaccacccuggagagcgccgggguggucugccccuaccgggccaucgagagccucuaccgcaagcacugccuggagcagggcaagcagcagcugaugccccaggaggccgggcucgcggaggaguuccugcugacggacaacuccgccaucuggcagaccguggaggagcucgacuaccuggagguggaggccgaggccaagauggagaaccugcgggcggccgucccgggccagccccucgcccugaccgcccgcgggggccccaaggacacccagcccagcuaccaccacggcaacgggccguacaacgacguggacauccccggcugcugguucuucaagcugccccacaaggacgggaacuccugcaacgugggcagccccuucgccaaggacuuccucccgaagauggaggacgggacgcugcaggcgggccccggcggggccuccggcccccgcgcccuggagaucaacaagaugaucagcuucuggcggaacgcccacaagcgcaucuccagccagauggucguguggcucccccgguccgcccugccgcgcgcggugauccggcaccccgacuacgacgaggaggggcuguacggcgccauccucccccaggucgugaccgccgggaccaucacccgccgggccguggagcccacguggcugaccgccagcaacgcgcgcccggaccgggucggcuccgagcugaaggccauggugcaggccccgcccggcuacacccucgugggggccgacgucgacagccaggagcuguggaucgcggccgugcugggcgacgcccacuucgccgggaugcacggcugcaccgccuucggguggaugacgcuccagggccgcaagucccggggcaccgaccugcacagcaagaccgcgaccacgguggggaucucccgcgagcacgccaagaucuucaacuacggccggaucuacggggccggccagcccuucgccgagcgccugcucaugcaguucaaccaccggcugacccagcaggaggccgcggagaaggcccagcagauguacgccgccaccaagggccugcgcugguaccggcucagcgacgagggggaguggcugguccgcgagcugaaccuccccguggaccggaccgagggcggguggaucucccugcaggaccugcgcaaggugcagcgggagaccgcccgcaagagccaguggaagaagugggaggucguggcggagcgcgccuggaagggcgggacggagagcgagauguucaacaagcucgaguccaucgccaccagcgacaucccccggacccccgugcugggcugcugcaucucccgcgcccuggagcccagcgccguccaggaggaguucaugaccucccgggugaacugggugguccagagcuccgcgguggacuaccuccaccugaugcugguggccaugaaguggcuguucgaggaguucgccaucgacggccgcuucugcaucagcauccacgacgagguccgguaccuggugcgcgaggaggaccgguaccgcgccgcgcuggcccuccagaucacgaaccugcugacccggugcauguucgccuacaagcucgggcugaacgaccugccgcaguccguggccuucuucagcgccgucgacaucgaccgcugccuccggaaggaggugaccauggacugcaagacccccuccaaccccacgggcauggagcgccgguacgggaucccccagggcgaggcgcuggacaucuaccagaucaucgagcugaccaaggggagccucgagaagcgcucccagccgggccccuga

SEQ ID NO: 34823 - RNA, 1245 nt, Artificial Sequence
  derived and/or modified sequence opt1 from POLH__Homo_sapiens__NP_001278899
auggccaccggccaggaccgcguggucgcccugguggacauggacugcuucuucgugcaggucgagcagcggcagaacccccaccuccgcaacaagccgugcgcgguggugcaguacaagagcuggaagggcggcgggaucaucgccgucuccuacgaggcccgggccuucggggugacccgcagcaugugggccgacgacgcgaagaagcugugccccgaccugcuccuggcccaggugcgggagucccgcgggaaggccaaccugacgaaguaccgggaggccagcgucgaggugauggagaucaugucccgcuucgcggugaucgagcgggccagcaucgacgaggccuacgucgaccucaccuccgccgugcaggagcgccugcagaagcugcagggccagcccaucagcgccgaccuccugcccuccaccuacaucgagggccugccgcaggggcccaccacggcggaggagaccgugcagaaggagggcaugcggaagcagggccucuuccaguggcuggacagccugcagaucgacaaccucaccucccccgaccugcagcugaccgucggggccgugaucguggaggagaugcgcgccgccaucgagcgggagacgggguuccagugcagcgccggcaucucccacaacaagguccucgcgaagcuggccugcggccugaacaagcccaaccgccagacccucgugagccacggguccgugccgcagcuguucagccagaugcccauccggaagauccgcucccugggcgggaagcucggcgccagcgucaucgagauccugggcaucgaguacaugggggagcugacccaguucaccgagucccagcuccagagccacuucggcgagaagaacgggagcuggcuguacgccaugugccggggcaucgagcacgaccccgugaagccccgccagcugccgaagacgaucgggugcuccaagaacuuccccggcaagaccgcccucgcgacccgggagcagguccagugguggcugcugcagcucgcccaggagcuggaggagcgccugaccaaggaccggaacgacaacgaccgcguggccacgcagcucguggucagcauccgcgugcagggcgacaagcggcuguccagccugcgccggugcugcgcccucacccgcuacgacgcccacaagaugucccacgacgcguucaccgugaucaagaacugcaacaccagcgggauccagacggaguga

SEQ ID NO: 34824 - RNA, 2223 nt, Artificial Sequence
  derived and/or modified sequence opt1 from POLI__Homo_sapiens__NP_009126
auggagaagcugggcguggagcccgaggaggagggcggcggggacgacgacgaggaggacgccgaggccugggcgauggagcucgccgacgucggcgccgccgccagcucccagggggugcacgaccaggugcugccgacccccaacgcgagcucccgcgucaucgugcacguggaccuggacugcuucuacgcccaggucgagaugaucagcaaccccgagcucaaggacaagccccugggcgugcagcagaaguaccugguggugaccugcaacuacgaggcccggaagcucggcgugaagaagcugaugaacgugcgcgacgccaaggagaagugcccgcagcugguccucgugaacggggaggaccugacgcgguaccgcgagauguccuacaaggugaccgagcugcucgaggaguucagccccgucguggagcggcugggcuucgacgagaacuucguggaccugaccgagauggucgagaagcgccuccagcagcugcaguccgacgagcugagcgcggugaccguguccgggcacgucuacaacaaccagagcaucaaccuccuggacgugcugcacauccggcuccuggugggcucccagaucgccgccgagaugcgcgaggccauguacaaccagcuggggcucacgggcugcgccggcgucgcgagcaacaagcugcuggccaagcucguguccggggucuucaagcccaaccagcagaccgugcugcugcccgagagcugccagcaccucauccacucccugaaccacaucaaggagaucccgggcaucggguacaagaccgccaagugccuggaggcccucggcaucaacagcgugcgggaccugcagaccuucucccccaagauccuggagaaggagcucggcaucagcgucgcccagcgcauccagaagcuguccuucggggaggacaacagccccgugauccugagcgggcccccgcaguccuucagcgaggaggacuccuucaagaagugcagcuccgagguggaggcgaagaacaagaucgaggagcuccuggccagccugcucaaccgggucugccaggacgggcgcaagccccacacggugcggcugaucauccgccgguacuccagcgagaagcacuacggccgcgagucccggcagugccccauccccagccacgugauccagaagcuggggaccggcaacuacgacgucaugaccccgaugguggacauccucaugaagcuguuccgcaacauggugaacgucaagaugcccuuccaccugacccuccuguccgugugcuucugcaaccugaaggcccugaacacggccaagaagggccucaucgacuacuaccugaugcccagccuguccaccaccagccgguccgggaagcacagcuucaagaugaaggacacccacauggaggacuuccccaaggacaaggagacgaaccgcgacuuccucccguccggccggaucgagagcacccgcacccgcgagagcccccuggacaccacgaacuucuccaaggagaaggacaucaacgaguucccccugugcagccuccccgaggggguggaccaggaggucuucaagcagcugccgguggacauccaggaggagauccuguccggcaagagccgggagaaguuccaggggaagggcuccgugagcugcccccuccacgccucccgcggcguccugagcuucuucuccaagaagcagaugcaggacauccccaucaacccccgggaccaccugagcuccagcaagcaggucuccagcguguccccgugcgagcccgggaccagcggcuucaacuccagcuccagcagcuacauguccagccagaaggacuacuccuacuaccucgacaaccgccugaaggacgagcggaucagccaggggcccaaggagccgcagggcuuccacuucaccaacuccaaccccgcggucagcgccuuccacuccuuccccaaccugcagagcgagcagcuguucucccgcaaccacaccacggacagccacaagcagaccguggccaccgacucccacgaggggcucaccgagaaccgggagcccgacagcguggacgagaagaucacguucccguccgacaucgacccccaggucuucuacgagcugcccgaggccgugcagaaggagcuccuggccgaguggaagcgcgcgggcagcgacuuccacaucggccacaaguga

SEQ ID NO: 34825 - RNA, 2613 nt, Artificial Sequence
  derived and/or modified sequence opt1 from POLK__Homo_sapiens__NP_057302
auggacagcaccaaggagaagugcgacuccuacaaggacgaccugcuccugcgcaugggccugaacgacaacaaggccgggauggagggccucgacaaggagaagaucaacaagaucaucauggaggccaccaaggggagccgguucuacggcaacgagcugaagaaggagaagcaggucaaccagcgcaucgagaacaugaugcagcagaaggcgcagaucacgucccagcagcugcggaaggcccagcuccagguggaccgcuucgccauggagcuggagcagagccggaaccuguccaacaccaucgugcacaucgacauggacgccuucuacgccgcgguggagaugcgcgacaaccccgagcucaaggacaagccgaucgccgucgggagcauguccaugcugagcaccuccaacuaccacgcccggcgcuucggcgugcgggccgcgaugcccggcuucaucgccaagcgccugugcccccagcucaucaucgugcccccgaacuucgacaaguaccgggccgucagcaaggaggugaaggagauccuggccgacuacgaccccaacuucauggccaugucccuggacgaggcguaccucaacaucaccaagcaccuggaggagcgccagaacuggcccgaggacaagcggcgcuacuucaucaagauggggagcuccguggagaacgacaaccccggcaaggaggucaacaagcugagcgagcacgagcgguccaucagcccgcuccuguucgaggagucccccagcgacgugcagccgcccggggaccccuuccaggugaacuucgaggagcagaacaacccccagauccugcagaacuccgucguguucggcacgagcgcccaggagguggucaaggagauccgcuuccggaucgagcagaagaccacccucaccgccagcgccgggaucgcccccaacacgaugcuggcgaaggugugcuccgacaagaacaagcccaacggccaguaccagauccugccgaaccgccaggccgugauggacuucaucaaggaccuccccauccggaaggucagcggcaucgggaaggugaccgagaagaugcugaaggcccugggcaucaucacgugcaccgagcucuaccagcagcgcgcccugcugucccuccuguucagcgagaccuccuggcacuacuuccugcacaucagccucgggcugggcuccacccaccugacccgggacggcgagcgcaagagcauguccguggagcgcaccuucagcgagaucaacaaggccgaggagcaguacucccucugccaggagcugugcagcgagcuggcgcaggaccuccagaaggagcggcugaaggggcgcacggucaccaucaagcugaagaacgugaacuucgaggugaagacccgggccuccaccgucagcuccguggucagcacggccgaggagaucuucgccaucgccaaggagcuccugaagaccgagaucgacgcggacuucccccacccccugcgccuccggcugaugggcgugcgcaucuccagcuucccgaacgaggaggaccggaagcaccagcagcgcuccaucaucggguuccugcaggccggcaaccaggcccucagcgccaccgagugcacccuggagaagacggacaaggacaaguucgugaagccccuggagaugagccacaagaaguccuucuucgacaagaagcggagcgagcgcaaguggucccaccaggacaccuucaagugcgaggcggucaacaagcagagcuuccagaccucccagcccuuccaggugcugaagaagaagaugaacgagaaccucgagaucagcgagaacuccgacgacugccagauccugaccugccccgugugcuuccgggcccaggggugcaucagccuggaggcccucaacaagcacgucgacgagugccuggacggcccguccaucagcgagaacuucaagauguucuccugcagccacguguccgccacgaaggugaacaagaaggagaacguccccgccagcucccugugcgagaagcaggacuacgaggcgcaccccaagaucaaggagaucagcuccguggacugcaucgcccucguggacaccaucgacaacagcagcaaggccgaguccaucgacgcccugagcaacaagcacuccaaggaggagugcagcucccugcccagcaaguccuucaacaucgagcacugccaccagaacagcuccagcaccgucucccucgagaacgaggacgugggcagcuuccgccaggaguaccggcagccguaccugugcgaggugaagaccgggcaggcccuggucugccccgugugcaacguggagcagaagacguccgaccucacccuguucaacguccacguggacgugugccugaacaagagcuucauccaggagcuccgcaaggacaaguucaaccccgucaaccagccgaaggaguccagccgguccaccggcagcuccagcggggugcagaaggcggugacccgcacgaagcggcccggccugaugaccaaguacagcaccuccaagaagaucaagcccaacaaccccaagcacacccuggacaucuucuucaaguga

SEQ ID NO: 34826 - RNA, 1728 nt, Artificial Sequence
  derived and/or modified sequence opt1 from POLL__Homo_sapiens__NP_001167555
auggacccccgcggcauccugaaggccuucccgaagcggcagaagauccacgccgacgcgagcuccaaggugcucgccaagaucccccgccgggaggagggggaggaggccgaggaguggcugagcucccugcgcgcccacgucgugcggaccggcaucgggcgcgcccgggcggagcuguucgagaagcagaucgugcagcacggcgggcagcugugccccgcccagggccccggcgucacccacaucgugguggacgaggggauggacuacgagcgcgcccugcggcuccugcgccugccgcagcucccgcccggcgcccagcuggucaagagcgcguggcugucccucugccugcaggagcggcgccugguggacguggccggguucagcaucuucauccccucccgguaccucgaccacccccagcccagcaaggccgagcaggacgccuccaucccgcccggcacgcacgaggcccugcugcagaccgcgcucagcccgcccccgccgcccacccgccccgucuccccgccccagaaggccaaggaggcccccaacacccaggcccagcccaucagcgacgacgaggccuccgacggggaggagacccaggugagcgcggccgaccucgaggcccugaucuccggccacuaccccacgagccucgagggcgacugcgagcccucccccgcccccgccgugcuggacaagugggucugcgcgcagcccagcucccagaaggccaccaaccacaaccugcacaucaccgagaagcucgaggugcuggccaaggccuacagcgugcagggggacaaguggcgggcccugggcuacgcgaaggccaucaacgcccucaagagcuuccacaagcccgucacguccuaccaggaggccugcagcauccccgggaucggcaagcgcauggcggagaagaucaucgagauccuggaguccggccaccuccgcaagcuggaccacaucagcgaguccgugcccgugcuggagcuguucagcaacaucuggggcgccgggaccaagaccgcccagaugugguaccagcagggguuccggucccucgaggacauccggagccaggccucccugaccacgcagcaggccaucggccugaagcacuacagcgacuuccucgagcgcaugccccgggaggaggcgaccgagaucgagcagaccguccagaaggccgcccaggccuucaacuccgggcugcugugcguggccugcggcagcuaccgccgcggcaaggcgaccugcggggacguggacguccucaucacgcacccggacggccggucccaccgcgggaucuucagccggcugcuggacucccuccgccaggagggcuuccugaccgacgaccuggugagccaggaggagaacgggcagcagcagaaguaccucggcgugugccggcugcccggccccgggcgccggcaccgccggcuggacaucaucgucgugcccuacuccgaguucgccugcgcccuccuguacuucaccggcagcgcccacuucaaccgcuccaugcgggcccuggcgaagaccaaggggaugagccugagcgagcacgcccucuccacggccgucgugcgcaacacccacggcugcaagguggggccgggccggguccugcccacccccaccgagaaggacguguuccgccugcucggccugcccuaccgggagccggccgagcgcgacugguga

SEQ ID NO: 34827 - RNA, 1527 nt, Artificial Sequence
  derived and/or modified sequence opt1 from POLM__Homo_sapiens__NP_001271259
augcugcccaagcgccggcgcgcccgggugggcagcccguccggggacgccgcgagcuccaccccgcccagcacccgcuuccccggcgucgccaucuaccucguggagccccggauggggcgcucccggcgcgccuuccugacgggccuggcccggagcaagggguuccgcgugcucgacgccugcuccagcgaggcgacccacgucgugauggaggagaccuccgccgaggaggccgugagcuggcaggagcggcgcauggccgcggccccgcccggcugcaccccgcccgcccugcuggacaucuccuggcucacggagagccugggcgccgggcagcccguccccguggagugccggcaccgccuggagguggccggcccccggaaggggccccucucccccgcguggaugcccgccuacgccugccagcgccccaccccgcugacccaccacaacaccggccugagcgaggcccucgagauccuggccgaggcggccggguucgagggcuccgagggccggcugcucacguucugccgcgccgccagcguccugaaggcccugcccucccccgugaccacccucagccagcugcaggggcugccccacuucggcgagcacuccagccgggugguccaggagcuccuggagcacggggugugcgaggagguggagcgcguccggcgcagcgagcgcgcgccggccccgcccggccccgagcaccccucccccgccgugcggugccgcugccccgccgccggcgggggcgggagcugcggcgcggggcccgccuggggccaccggcacgccgaccgccggcugccgcagggccucauccuguaccaccagcaccagcacuccugcugcgagagccccacccgccuggcccagcagucccacauggacgcguucgagcggagcuucugcaucuuccgccucccccagccgcccggggccgccgugggcggguccacgcggcccugccccagcuggaaggccguccgcguggaccugguggucgccccggugucccaguuccccuucgcgcugcucggcuggaccgggagcaagcuguuccagcgggagcugcgccgguucucccgcaaggagaagggccucuggcugaacagccacggccuguucgaccccgagcagggguccagcuccggcaagacgccccggagccgcaaguccugcuucugcugccggcgccacuucagcaagcggcuccagcgcaagaccuccagcgacaccugggcccugagcaccuuccugcagucccgcgagaccccggagcccgccugcgugccccacuuccacagcgggaacugggccgcccccaaccucgcgaccgagugccugcaggccgacaugcugccgcccgacccccaccuccaccccuccccgccccggcccggcagcuccgggggccagcugugccugcaggaccagcucagccccugcuggugcgccgccggcugcgacgaggucggggcccuguccgcgagccugaucacgguguga

SEQ ID NO: 34828 - RNA, 2703 nt, Artificial Sequence
  derived and/or modified sequence opt1 from POLN__Homo_sapiens__NP_861524
auggagaacuacgaggcccuggugggcuucgaccucugcaacacgccccugagcuccgucgcccagaagaucaugagcgcgaugcacuccggggaccugguggacagcaagaccuggggcaaguccaccgagaccauggaggugaucaacaagagcuccgucaaguacagcgugcagcucgaggaccgcaagacccaguccccggagaagaaggaccucaagagccugcggucccagaccagccgcggguccgccaagcucagcccccaguccuucagcgugcggcugacggaccagcuguccgccgaccagaagcagaaguccaucagcagccucacccugagcuccugccugaucccccaguacaaccaggaggccagcguccuccagaagaagggccacaagcgcaagcacuuccugauggagaacaucaacaacgagaacaagggguccaucaaccugaagcggaagcacaucaccuacaacaaccucagcgagaagaccuccaagcagauggcccuggaggaggacacggacgacgcggagggcuaccugaacagcggcaacuccggggcccucaagaagcacuucugcgacauccgccaccuggacgacugggccaagagccagcugaucgagaugcucaagcaggccgcggcccuggugaucaccgugauguacaccgacggcuccacccagcugggggccgaccagacgcccgucagcuccgugcggggcaucgugguccucgugaagcgccaggccgagggcgggcacggcugcccggacgcccccgcgugcgggcccgugcuggagggcuucgucagcgacgaccccugcaucuacauccagaucgagcacuccgccaucugggaccaggagcaggaggcccaccagcaguucgcccggaacgugcuguuccagaccaugaagugcaagugcccggugaucugcuucaacgccaaggacuucguccgcaucgugcuccaguucuucgggaacgacggcagcuggaagcacguggcggacuucaucggccuggacccccggaucgccgccuggcugaucgaccccuccgacgccacccccagcuucgaggaccucgucgagaaguacugcgagaaguccaucaccgugaaggugaacagcacguacgggaacuccagccgcaacaucgucaaccagaacgugcgggagaaccugaagacccuguaccgccucaccauggaccugugcagcaagcugaaggacuacggccucuggcagcuguuccggacccuggagcucccgcugauccccauccuggccgucauggagucccacgcgauccaggugaacaaggaggagauggagaagacgagcgcccuccugggggcccgccugaaggagcucgagcaggaggcccacuucguggccggcgagcgguuccugaucaccuccaacaaccagcugcgcgagauccucuucgggaagcugaagcugcaccuccugagccagcggaacucccugccccgcaccggccugcagaaguaccccagcaccuccgaggcgguccucaacgcccugcgggaccugcacccgcuccccaagaucauccuggaguaccgccaggugcacaagaucaagagcacguucguggacggccugcucgccugcaugaagaagggguccaucagcuccaccuggaaccagaccggcaccgucacggggcgccugagcgccaagcaccccaacauccagggcaucuccaagcaccccauccagaucaccaccccgaagaacuucaaggggaaggaggacaagauccugaccaucagcccccgggcgauguucguguccagcaagggccacacguuccucgccgccgacuucucccagaucgagcugcgcauccugacccaccucagcggcgaccccgagcugcugaagcuguuccaggagagcgagcgggacgacguguucuccacccugaccagccaguggaaggacguccccguggagcaggucacgcacgccgaccgcgagcagaccaagaaggugguguacgccguggucuacggggcgggcaaggagcggcuggccgccugccucggggugccgauccaggaggccgcccaguuccuggaguccuuccugcagaaguacaagaagaucaaggacuucgcgcgcgccgccaucgcccagugccaccagaccggcugcguggucagcaucauggggcggcgccggccccucccccgcauccacgcccacgaccagcagcugcgggcgcaggccgagcgccaggccgugaacuucgugguccagggcuccgccgcggaccugugcaagcucgccaugauccacguguucaccgccguggccgccagccacacccugacggcgcggcuggucgcccagauccacgacgagcuccuguucgagguggaggacccccagaucccggagugcgccgcccuggugcgccggaccauggagucccucgagcagguccaggcccuggagcugcagcuccaggugccccugaaggugagccuguccgcgggccgcagcugggggcaccucgucccccugcaggaggccuggggcccgccgcccgggcccugccggaccgagucccccagcaacucccuggccgcccccggcagccccgccuccacccagcccccgccccuccacuucagccccuccuucugccuguga

SEQ ID NO: 34829 - RNA, 7773 nt, Artificial Sequence
  derived and/or modified sequence opt1 from POLQ__Homo_sapiens__NP_955452
augaaccugcuccgccggagcggcaagcgccggcgcuccgagagcggguccgacagcuucuccggcagcgggggcgacuccagcgccagcccccaguuccugagcggguccgugcugagcccgccgcccggccucggccggugccugaaggccgccgccgccggggagugcaagcccaccgugcccgacuacgagcgcgacaagcugcuccuggccaacuggggccugcccaaggccgugcucgagaaguaccacuccuucggggugaagaagauguucgaguggcaggcggagugccugcugcucggccaggugcuggaggggaagaaccugguguacagcgcccccaccuccgccggcaagacgcucguggccgagcugcugauccucaagcggguccuggagaugcgcaagaaggcgcuguucauccuccccuucgugagcguggccaaggagaagaaguacuaccugcagucccuguuccaggaggucggcaucaagguggacggguacaugggcagcaccucccccagccggcacuucagcucccucgacaucgccgugugcaccaucgagcgcgccaacgggcugaucaaccggcugaucgaggagaacaagauggaccuccugggcauggucgugguggacgagcugcacaugcucggcgacagccaccgcggguaccugcuggagcuccugcugaccaagaucugcuacaucacgcggaaguccgccagcugccaggcggaccucgccuccagccuguccaacgccguccagaucgugggcaugagcgccacccugcccaaccucgagcugguggccuccuggcugaacgcggagcucuaccacaccgacuuccgccccgucccccugcuggagagcgugaagguggggaacuccaucuacgacagcuccaugaagcucguccgggaguucgagccgaugcuccaggugaagggcgacgaggaccacguggucagccugugcuacgagaccaucugcgacaaccacuccgugcuccuguucugccccagcaagaaguggugcgagaagcuggccgacaucaucgcccgcgaguucuacaaccugcaccaccaggccgaggggcucgucaagcccuccgagugcccgcccgugauccuggagcagaaggagcugcucgaggugauggaccagcugcggcgccugcccagcggccucgacuccguccugcagaagacggugcccuggggcguggccuuccaccacgcggggcugaccuucgaggagcgggacaucaucgagggcgccuuccgccaggggcucauccggguccuggccgccaccagcacccugagcuccggcgugaaccuccccgcccgccgcgugaucauccggacgcccaucuucgggggccgcccccuggacauccugaccuacaagcagauggucggccgggcggggcgcaagggcguggacaccgugggggagagcauccucaucugcaagaacuccgagaaguccaagggcaucgcccugcugcaggggucccucaagcccguccggagcugccugcagcgccgggagggcgaggaggugaccggcuccaugauccgcgccauccuggagaucaucgucggcggggucgccagcacgucccaggacaugcacaccuacgcggccugcaccuuccucgccgccagcaugaaggaggggaagcaggggauccagcggaaccaggaguccgugcagcugggcgccaucgaggcgugcgugauguggcugcucgagaacgaguucauccagagcaccgaggccuccgacgggacggagggcaaggucuaccaccccacccaccuggggagcgccacccuguccagcucccucagcccggccgacacccuggacaucuucgccgaccugcagcgcgcgaugaagggcuucgugcucgagaacgaccugcacauccuguaccucgugacgcccauguucgaggacuggaccaccaucgacugguaccgguucuucugccugugggagaagcugcccaccagcaugaagcgcgucgccgagcucguggggguggaggagggcuuccuggcccggugcgucaagggcaaggugguggcccgcacggagcggcagcaccgccagauggccauccacaagcgguucuucaccucccugguccuccuggaccugaucagcgaggugccccuccgcgagaucaaccagaaguacgggugcaaccggggccagauccagucccugcagcagagcgcggccguguacgccgggaugaucaccgucuucuccaaccgccugggcuggcacaacauggagcuccugcugagccaguuccagaagcgccucaccuucgggauccagcgggagcugugcgaccuggugcgcgugucccuccugaacgcccagcgggcgcgcguccuguacgccagcggcuuccacacgguggccgaccucgcccgggccaacaucguggaggucgaggugauccugaagaacgcggugccguucaaguccgcccgcaaggccgucgacgaggaggaggaggccguggaggagcggcgcaacaugcggaccaucugggugaccggccgcaaggggcugaccgagcgggaggccgcggcccucaucgucgaggaggcccgcaugauccugcagcaggaccugguggagaugggcgugcaguggaaccccugcgcccuccugcacagcuccacgugcagccugacccacuccgagagcgaggucaaggagcacaccuucaucucccagaccaagagcuccuacaagaagcucaccagcaagaacaaguccaacacgaucuucagcgacagcuacaucaagcacucccccaacaucgugcaggaccugaacaagagccgggagcacaccuccagcuucaacugcaacuuccagaacgggaaccaggagcaccagaccugcuccaucuuccgcgcccggaagcgcgcgagccuggacaucaacaaggagaagccgggcgccucccagaacgaggggaagaccagcgacaagaaggugguccagacguucucccagaagaccaagaaggcgccccugaacuucaacagcgagaagaugucccggagcuuccgcuccuggaagcggcgcaagcaccugaagcggagccgcgacuccagcccccugaaggacuccggcgccugccgcauccaccuccagggccagacccugagcaaccccucccugugcgaggacccguucacccucgacgagaagaagacggaguuccggaacagcgggcccuucgcgaagaacgugagccuguccggcaaggagaaggacaacaagaccagcuucccccugcagaucaagcagaacugcuccuggaacaucacccucaccaacgacaacuucguggagcacaucgucacggggagccaguccaagaacgugaccugccaggccaccagcgucguguccgagaagggccgcgggguggccgucgaggccgagaagaucaacgaggugcugauccagaacggcagcaagaaccagaacguguacaugaagcaccacgacauccaccccaucaaccaguaccugcggaagcagucccacgagcagaccagcacgaucaccaagcagaagaacaucaucgagcgccagaugccgugcgaggccgucuccagcuacaucaaccgggacuccaacgugaccaucaacugcgagcgcaucaagcucaacaccgaggagaacaagcccagccacuuccaggcgcugggcgacgacaucucccggacggugauccccagcgagguccugcccuccgccggggccuucagcaaguccgagggccagcacgagaacuuccucaacaucagccgccugcaggagaagaccgggaccuacaccacgaacaagaccaagaacaaccacgugagcgaccugggccucgugcugugcgacuucgaggacuccuucuaccuggacacccagagcgagaagaucauccagcagauggccaccgagaacgccaagcucggcgcgaaggacacgaaccuggccgccgggaucaugcagaagucccugguccagcagaacagcaugaacuccuuccagaaggagugccacaucccguuccccgccgagcagcacccccucggcgccaccaagaucgaccaccuggaccugaagaccguggggaccaugaagcagagcuccgacagccacggcguggacauccucacgcccgaguccccgaucuuccacagccccauccugcuggaggagaacgggcuguuccucaagaagaacgaggucuccgugaccgacagccagcugaacuccuuccugcagggcuaccagacccaggagaccgugaagcccgucauccuccugaucccccagaagcggacgccgaccggcguggagggggagugccugcccgugcccgagaccagccucaacauguccgacagccugcuguucgacuccuucagcgacgacuaccucgucaaggagcagcugcccgacaugcagaugaaggagccgcugcccuccgaggugaccagcaaccacuucagcgacucccucugccugcaggaggaccugaucaagaaguccaacgugaacgagaaccaggacacccaccagcagcucacgugcuccaacgacgagagcaucaucuucuccgagauggacagcguccagaugguggaggcgcuggacaacguggacaucuuccccguccaggagaagaaccacaccgugguguccccgcgcgcccuggagcucagcgaccccguccuggacgagcaccaccagggcgaccaggacgggggcgaccaggacgagcgggccgagaaguccaagcugaccgggacccgccagaaccacagcuucaucugguccggcgccagcuucgaccucucccccggccugcagcggauccuggacaaggugagcagcccccucgagaacgagaagcugaaguccaugacgaucaacuucuccagccugaaccgcaagaacaccgagcucaacgaggagcaggaggugaucuccaaccuggagaccaagcagguccaggggaucagcuucagcuccaacaacgaggucaagagcaagaucgagaugcuggagaacaacgccaaccacgacgagaccuccagccuccugccgcggaaggaguccaacaucguggacgacaacggccugaucccgcccacgcccaucccgaccagcgcguccaagcucaccuuccccgggauccuggagacccccgucaaccccuggaagacgaacaacgugcugcagccgggcgagagcuaccucuucgggucccccagcgacaucaagaaccacgaccugucccccggcagccgcaacggcuucaaggacaacucccccaucagcgacaccuccuucagccugcagcucucccaggacgggcugcagcugaccccggccagcagcuccagcgagucccucagcaucaucgacguggccuccgaccagaaccuguuccagaccuucaucaaggaguggcggugcaagaagcgcuucagcaucucccuggccugcgagaagauccggagccucacguccagcaagaccgcgaccaucggcucccgcuucaagcaggccagcagcccccaggagauccccauccgcgacgacggguuccccaucaagggcugcgacgacacccuggucgugggccuggccgugugcuggggcgggcgggacgccuacuacuucagccuccagaaggagcagaagcacuccgagaucagcgccucccuggucccgcccagccuggaccccucccucacgcugaaggaccgcaugugguaccugcagagcugccuccggaaggagagcgacaaggagugcuccguggugaucuacgacuucauccagagcuacaagauccugcugcucuccugcgggaucagccuggagcaguccuacgaggaccccaaggucgcgugcuggcugcucgacccggacagccaggagcccacccugcacuccaucgugaccagcuuccugccccacgagcucccccugcuggagggcauggagaccucccaggggauccagagccucggccugaacgccggcuccgagcacagcgggcgcuaccgggccuccguggagagcauccugaucuucaacuccaugaaccagcucaacagccugcugcagaaggagaaccuccaggacgucuuccgcaagguggagaugccgucccaguacugccuggcccugcucgagcugaacggcaucggguucagcacggccgagugcgagucccagaagcacaucaugcaggcgaagcuggacgccaucgagacccaggccuaccagcucgccggccacagcuucagcuucaccuccagcgacgacaucgccgaggugcuguuccuggagcucaagcugccgcccaaccgggagaugaagaaccagggguccaagaagacccugggcagcacgcgccggggcaucgacaacgggcgcaagcuccggcugggccgccaguucuccaccagcaaggacguccugaacaagcucaaggcgcugcacccgcugcccgggcucauccuggaguggcggcgcaucaccaacgccaucaccaagguggucuucccccugcagcgggagaagugccucaaccccuuccugggcauggagcgcaucuacccggugucccagagccacacggccaccgggcggaucaccuucaccgagcccaacauccagaacgugccccgcgacuucgagaucaagaugcccacgcuggucggcgaguccccgcccagccaggccgugggcaaggggcuccugcccaugggccgggggaaguacaagaagggcuucuccgugaacccccgcugccaggcgcagauggaggagcgggccgccgaccgcgggaugccguucagcaucuccaugcgccacgccuucguccccuuccccggcggcagcauccuggccgcggacuacucccagcucgagcugcggauccuggcccaccugagccacgaccgccggcucauccaggugcugaacaccggggccgacguguuccgcuccaucgccgccgaguggaagaugaucgagcccgagagcgucggcgacgaccugcggcagcaggcgaagcagaucugcuacgggaucaucuacggcaugggcgccaagucccucggggagcagaugggcaucaaggagaacgacgccgccugcuacaucgacagcuucaagagccgcuacaccgggaucaaccaguucaugaccgagaccgugaagaacugcaagcgggacggcuucgugcagacgauccuggggcgccggcgcuaccugccgggcaucaaggacaacaaccccuaccggaaggcccacgcggagcgccaggccaucaacaccaucguccagggcuccgccgccgacaucgugaagaucgcgaccgugaacauccagaagcagcucgagaccuuccacagcacguucaagucccacgggcaccgggagggcaugcugcagagcgaccagaccgggcugucccgcaagcggaagcuccagggcauguucugccccauccgcgggggcuucuucauccugcagcugcacgacgagcuccuguacgaggucgccgaggaggacguggugcaggucgcccagaucgugaagaacgagauggagagcgccgugaagcuguccgucaagcucaaggugaaggugaagaucggcgccagcuggggcgagcugaaggacuucgacgucuga

SEQ ID NO: 34830 - RNA, 5163 nt, Artificial Sequence
  derived and/or modified sequence opt1 from POLR1A__Homo_sapiens__NP_056240
augcugaucagcaagaacaugcccuggcgccggcuccaggggaucagcuucgggauguacagcgccgaggagcugaagaagcugagcgucaagagcaucaccaacccccgcuaccucgacagccugggcaaccccagcgccaacgggcuguacgaccucgcgcugggccccgccgacuccaaggaggugugcuccacgugcgugcaggacuucuccaacugcagcgggcaccugggccacaucgagcucccccugaccguguacaacccgcuccuguucgacaagcuguaccugcuccugcggggcuccugccugaacugccacaugcugaccugcccccgcgccgugauccaccuccugcucugccagcugcgggugcuggaggugggggcccuccaggccgucuacgagcuggagcgcauccugaaccgguuccucgaggagaaccccgaccccagcgcguccgagauccgcgaggagcuggagcaguacaccaccgagaucgugcagaacaaccugcucggcagccagggggcccacgugaagaacgucugcgaguccaagagcaagcugaucgcccuguucuggaaggcccacaugaacgcgaagcggugcccgcacugcaagaccggccgcuccguggugcggaaggagcacaacagcaagcucaccaucaccuuccccgccaugguccaccgcaccgccgggcagaaggacuccgagccccugggcaucgaggaggcccagaucggcaagcggggguaccugacccccaccagcgcccgcgagcaccucagcgcgcuguggaagaacgagggcuucuuccugaacuaccucuucuccgggauggacgacgacggcauggagagccgguucaaccccuccguguucuuccuggacuuccugguggugccgcccagccgcuaccggcccgugucccgccucggcgaccagauguucaccaacgggcagaccgugaaccugcaggccgucaugaaggacguggugcugauccggaagcuccuggcccugauggcccaggagcagaagcucccggaggaggucgccacgcccaccaccgacgaggagaaggacagccugaucgcgaucgaccgcuccuuccugagcacccugcccggccagucccucaucgacaagcuguacaacaucuggauccggcugcagagccacgugaacaucguguucgacuccgagauggacaagcucaugauggacaaguaccccgggauccgccagauccuggagaagaaggagggccuguuccgcaagcacaugauggggaagcgggucgacuacgccgcccgcagcgugaucugcccggacauguacaucaacacgaacgagaucggcauccccauggucuucgccaccaagcucaccuacccccagcccgugaccccguggaacgugcaggagcugcggcaggccgucaucaacggccccaacgugcaccccggggcguccauggugaucaacgaggacggcagccgcacggcccuguccgccgucgacaugacccagcgggaggccguggccaagcagcuccugacccccgcgaccggggccccgaagccccagggcacgaagaucgugugccgccacgucaagaacggggacauccugcuccugaaccggcagcccacccugcaccgcccgagcauccaggcccaccgggcccgcauccuccccgaggagaaggugcugcggcugcacuacgcgaacugcaaggccuacaacgccgacuucgacggcgacgagaugaacgcccacuucccccaguccgagcucggccgcgccgaggcguacgugcuggccugcaccgaccagcaguaccugguccccaaggacgggcagccgcucgccggccugauccaggaccacauggugagcggggccuccaugaccacgcggggcugcuucuucacccgcgagcacuacauggagcugguguaccgggggcucaccgacaaggucggccgcgugaagcugcugagccccagcauccucaagcccuucccccuguggaccggcaagcaggucgucuccacgcugcucaucaacaucaucccggaggaccacaucccccugaaccugagcgggaaggccaagaucaccggcaaggcgugggugaaggagacgccccgguccgugcccggguucaacccggacagcaugugcgagucccaggucaucauccgcgagggcgagcuccugugcggcgugcuggacaaggcccacuacgggagcuccgccuacggccucgugcacugcugcuacgagaucuacgggggcgagaccagcgggaagguccugacgugccuggcccgccuguucaccgccuaccugcagcuguaccgcggcuucacccucggcguggaggacauccuggugaagcccaaggcggacgucaagcgccagcggaucaucgaggaguccacccacugcgggccccaggccgugcgcgccgcccugaaccuccccgaggcggccagcuacgacgaggugcggggcaaguggcaggacgcccaccuggggaaggaccagcgcgacuucaacaugaucgaccugaaguucaaggaggaggucaaccacuacuccaacgagaucaacaaggccugcaugccguucggccuccaccggcaguuccccgagaacagccugcagaugauggugcaguccggggccaagggcagcaccgugaacacgaugcagaucuccugccugcucggccagaucgagcuggaggggcgccggccgccccugauggcgagcggcaagucccucccgugcuucgagcccuacgaguucacgccccgggccgggggcuucgucaccgggcgguuccugaccggcaucaagcccccggaguucuucuuccacugcauggccggccgcgaggggcugguggacacggccgugaagaccagccggagcggcuaccuccagcgcugcaucaucaagcaccuggaggggcuggucgugcaguacgaccucaccgugcgggacuccgacggcagcgucgugcaguuccuguacggggaggacggccuggacauccccaagacccaguuccuccagcccaagcaguucccguuccuggccuccaacuacgaggugaucaugaagucccagcaccuccacgagguccucucccgcgcggaccccaagaaggcccugcaccacuuccgggccaucaagaaguggcagagcaagcaccccaacacgcugcuccgccggggcgccuuccuguccuacagccagaagauccaggaggccgugaaggcgcugaagcucgaguccgagaaccgcaacgggcggagccccggcacccaggagaugcugcgcaugugguacgagcuggacgaggagucccggcgcaaguaccagaagaaggccgccgccugcccggaccccagccucuccguguggcgccccgacaucuacuucgcgagcgucuccgagaccuucgagaccaagguggacgacuacagccaggagugggccgcccagacggagaaguccuacgagaaguccgagcugucccuggaccggcuccgcacccugcugcagcucaaguggcagcggagccugugcgagcccggggaggccgugggccugcucgccgcgcagagcaucggcgagccguccacccagaugacccugaacacguuccacuucgccgggcgcggcgagaugaacgucacccuggggaucccccggcuccgcgagauccugaugguggccagcgccaacaucaagacccccaugauguccgugcccguccugaacaccaagaaggcccucaagcgggucaagagccugaagaagcagcugacgcgcgucugccucggcgaggugcugcagaagaucgacgugcaggaguccuucugcauggaggagaagcagaacaaguuccaggucuaccagcugcgguuccaguuccugccgcacgcguacuaccagcaggagaagugccuccgccccgaggacauccugcgguucauggagacccgcuucuucaagcugcucauggagagcaucaagaagaagaacaacaaggccuccgccuuccggaacgugaacacccgccgggccacccagcgcgaccuggacaacgccggggagcugggccggagccgcggcgagcaggagggggacgaggaggaggagggccacaucguggacgcggaggccgaggagggggacgccgacgccuccgacgccaagcggaaggagaagcaggaggaggaggucgacuacgagagcgaggaggaggaggagcgcgagggcgaggagaacgacgacgaggacaugcaggaggagcgcaacccccaccgggagggggcgcgcaagacgcaggagcaggacgaggaggugggccucggcaccgaggaggaccccucccugccggcccugcucacccagccccggaagcccacccacagccaggagccccaggggccggaggccauggagcgccgggugcaggccguccgcgagauccaccccuucaucgacgacuaccaguacgacacggaggagucccuguggugccaggugaccgugaagcugccccucaugaagaucaacuucgacaugagcucccuggucgugagccuggcgcacggcgccgugaucuacgccaccaaggggaucacccggugccuccugaacgagacgaccaacaacaagaacgagaaggagcugguccucaacaccgagggcaucaaccugcccgagcuguucaaguacgccgaggugcucgaccugcgccggcuguacuccaacgacauccacgccaucgcgaacaccuacgggaucgaggccgcccuccgcgugaucgagaaggagaucaaggacgucuucgccguguacggcaucgccguggacccgcggcaccugagccuggucgcggacuacaugugcuucgagggcguguacaagccccucaaccgcuucgggauccgguccaacagcagcccccugcagcagaugacguucgagaccuccuuccaguuccugaagcaggccaccaugcucggcagccacgacgagcugcgcucccccagcgccugccugguggucgggaagguggugcggggcggcaccggccucuucgagcugaagcagccgcugcgcuga

SEQ ID NO: 34831 - RNA, 3240 nt, Artificial Sequence
  derived and/or modified sequence opt1 from POLR1B__Homo_sapiens__NP_001131076
auggaccccggcagccgcuggcggaaccugccguccgggcccagccucaagcaccugaccgaccccuccuacggcaucccccgcgagcagcagaaggccgcccugcaggagcucacccgggcgcacguggagagcuucaacuacgccguccacgaggggcugggccuggccgugcaggccgacaucaacugggccgugaacgggaucuccaagggcaucaucaagcaguuccucggcuacgucccgaucauggugaaguccaagcugugcaaccugcgcaaccucccgccccaggcgcugaucgagcaccacgaggaggccgaggagaugggcggguacuucaucaucaacgggaucgagaaggugauccggaugcugaucaugccccgccggaacuuccccaucgccaugauccgccccaaguggaagacgcggggccccggguacacccaguacggcgucuccaugcacugcgugcgcgaggagcacagcgccgugaacaugaaccuccacuaccuggagaacggcaccgucaugcugaacuucaucuaccggaaggagcuguucuuccucccccugggguucgcgcucaaggcccugguguccuucagcgacuaccagaucuuccaggagcugaucaagggcaaggaggacgacuccuuccuccgcaacagcgugucccagaugcugcggaucgucauggaggaggggugcagcacccagaagcagguccugaacuaccucggcgagugcuuccgcgugaagcugaacgugccggacugguaccccaacgagcaggccgccgaguuccuguucaaccagugcaucugcauccaccucaaguccaacacggagaaguucuacaugcugugccugaugacccggaagcuguucgcccucgcgaagggcgagugcauggaggacaaccccgacagccuggugaaccaggaggugcucacccccgggcagcuguuccugauguuccucaaggagaagcuggagggcuggcuggucuccaucaagaucgccuucgacaagaaggcccagaagaccagcguguccaugaacacggacaaccucaugcgcaucuucaccauggggaucgaccugaccaagccguucgaguaccuguucgccaccggcaaccuccggagcaagacggggcugggccugcuccaggacagcggccugugcguggucgccgacaagcugaacuucauccgcuaccucucccacuuccggugcgugcaccgcggggcggacuucgccaagaugcggaccaccaccgugcgccgccugcugcccgagagcuggggcuuccugugccccguccacacgcccgacggggagccgugcggccucaugaaccaccugaccgccgugugcgaggucgugacccaguucguguacaccgccuccauccccgcccugcucugcaaccugggggucacgcccaucgacggcgcgccccaccggagcuacuccgagugcuacccggugcugcucgacggcgugauggucggguggguggacaaggaccuggcccccggcaucgccgacagccugcgccacuucaaggugcuccgggagaagcgcaucccgcccuggauggaggucgugcugauccccaugaccgggaagcccucccuguaccccggccucuuccuguucaccaccccgugccggcuggugcgccccguccagaaccucgcccuggggaaggaggagcugaucggcacgauggagcagaucuucaugaacguggccaucuucgaggacgagguguucgcgggcgucaccacccaccaggagcuguucccccacagccuccuguccgugaucgccaacuucauccccuucagcgaccacaaccaguccccgcggaacauguaccagugccagauggggaagcagaccaugggcuucccccuccugacguaccaggaccgcagcgacaacaagcuguaccggcuccagacgccccagagcccccuggugcgcccgagcauguacgacuacuacgacauggacaacuaccccaucgggaccaacgccaucgucgccgugaucuccuacaccggcuacgacauggaggacgcgaugaucgugaacaaggccagcugggagcggggcuucgcccacggguccgucuacaagagcgaguucaucgaccuguccgagaagaucaagcagggcgacagcagccucguguucgggaucaagcccggcgacccccgcgugcugcagaagcuggacgacgacgggcucccguucaucggcgccaagcugcaguacggcgaccccuacuacuccuaccugaaccucaacaccggggagagcuucgucauguacuacaaguccaaggagaacugcgugguggacaacaucaaggucugcagcaacgacaccggcuccgggaaguucaagugcgugugcaucaccaugcgggugccccgcaaccccaccaucggcgacaaguucgccagccggcacgggcagaagggcauccugucccgccuguggccggcggaggacaugcccuucacggagagcggcaugguccccgacauccucuucaacccccacggguucccgucccggaugaccaucggcaugcugaucgagagcauggccgggaaguccgccgcccugcacggccucugccacgacgccacccccuucaucuucagcgaggagaacuccgcgcuggaguacuucggggagaugcugaaggccgccggcuacaacuucuacggcaccgagcgccucuacagcgggaucuccggccuggagcuggaggccgacaucuucaucggggugguguacuaccagcggcuccgccacauggucagcgacaaguuccaggugcgcaccacgggcgcccgggaccgcgugaccaaccagcccaucgggggccggaacguccagggcgggauccgcuucggcgagauggagcgggacgcgcugcuggcccacgggaccuccuuccuccugcacgaccgccuguucaacugcagcgaccggagcguggcccacgugugcgucaagugcggcucccuccugagcccccugcucgagaagccgccgcccuccuggagcgccaugcgcaaccggaaguacaacugcacccugugcucccgcagcgacacgaucgacaccguguccgugcccuacgucuuccgguacuucguggcggagcuggccgccaugaacaucaaggugaagcucgacgucguguga

SEQ ID NO: 34832 - RNA, 1041 nt, Artificial Sequence
  derived and/or modified sequence opt1 from POLR1C__Homo_sapiens__NP_976035
auggccgccagccaggcgguggaggagaugcgcucccgggucgugcugggcgaguucggggugcgcaacguccacaccaccgacuuccccggcaacuacagcggguacgacgacgccugggaccaggaccgguucgagaagaacuuccgcguggacgugguccacauggacgagaacucccucgaguucgacauggugggcaucgacgccgccaucgccaacgcguuccggcgcauccugcuggccgaggugcccacgauggccgucgagaaggugcucguguacaacaacaccagcaucguccaggacgagauccuggcccaccggcuggggcucauccccauccacgcggacccccgccuguucgaguaccggaaccagggcgacgaggagggcaccgagaucgacacccugcaguuccgccuccaggugcggugcacgcgcaacccccacgccgccaaggacuccagcgacccgaacgagcuguacgugaaccacaaggucuacacccggcacaugaccuggaucccccuggggaaccaggccgaccucuuccccgagggcaccauccgccccgugcacgacgacauccugaucgcccagcugcggccggggcaggagaucgaccuccugaugcacugcgugaagggcaucgggaaggaccacgcgaaguucucccccgucgccacggccagcuaccgccugcuccccgacaucacccugcuggagcccguggagggcgaggccgccgaggagcucucccggugcuucagcccgggcgugaucgagguccaggaggugcaggggaagaagguggcgcgcgucgccaacccccggcuggacaccuucucccgcgagaucuuccggaacgagaagcugaagaaggugguccgccucgcccgcgugcgggaccacuacaucuucagcguggaguccaccggcguccugccgcccgacgugcuggugagcgaggccaucaagguccucauggggaagugccgccgguuccuggacgagcuggacgccgugcagauggacuga

SEQ ID NO: 34833 - RNA, 402 nt, Artificial Sequence
  derived and/or modified sequence opt1 from POLR1D__Homo_sapiens__NP_057056
auggaggaggaccaggagcuggagcgcaagaucagcggccucaagaccuccauggccgagggggagcggaagaccgcccuggagauggugcaggcggccggcacggaccgccacugcgucaccuucgugcugcacgaggaggaccacacccucgggaacagccugcgguacaugaucaugaagaaccccgagguggaguucugcggcuacaccacgacccacccguccgagagcaagaucaaccugcgcauccagacccgggggacccuccccgccgucgagcccuuccagcgcggccugaacgagcugaugaacgugugccagcacgugcucgacaaguucgaggccuccaucaaggacuacaaggaccagaaggccagccggaacgaguccacguucuga

SEQ ID NO: 34834 - RNA, 5913 nt, Artificial Sequence
  derived and/or modified sequence opt1 from POLR2A__Homo_sapiens__NP_000928
augcacggcggcgggcccccgagcggggacuccgccugcccccugcgcaccaucaagcgggugcaguucgggguccugagccccgacgagcugaagcggaugagcgugaccgagggcgggaucaaguaccccgagaccaccgagggcgggcggccgaagcugggcgggcugauggacccccgccagggcgugaucgagcggaccgggcgcugccagaccugcgccggcaacaugacggagugccccggccacuucgggcacaucgagcuggcgaagcccgucuuccacgugggcuuccuggugaagaccaugaagguccuccggugcgugugcuucuucugcagcaagcugcugguggacuccaacaacccgaagaucaaggacauccucgccaagagcaaggggcagcccaagaagcgccugacccacgucuacgaccugugcaagggcaagaacaucugcgagggcggggaggagauggacaacaaguucggcguggagcagcccgagggggacgaggaccucaccaaggagaagggccacgggggcugcggccgguaccagccccgcauccggcgcuccgggcuggagcuguacgccgaguggaagcacgugaacgaggacagccaggagaagaagauccuccuguccccggagcggguccacgagaucuucaagcgcaucagcgacgaggagugcuucgugcugggcauggagccccgguacgcccgccccgaguggaugaucgugacgguccuccccgugccgccccuguccgugcggcccgccgucgugaugcaggggagcgcgcgcaaccaggacgaccugacccacaagcucgccgacaucgugaagaucaacaaccagcugcggcgcaacgagcagaacggcgccgccgcgcacgucaucgccgaggacgugaagcugcuccaguuccacguggccaccauggucgacaacgagcugcccgggcugccgcgggccaugcagaaguccggccgcccccucaagagccugaagcagcgccugaagggcaaggaggggcgggugcgcggcaaccucauggggaagcgggucgacuucuccgcccgcaccgugaucacgcccgaccccaaccugagcaucgaccaggugggcgucccgcgguccaucgcggccaacaugaccuucgccgagaucgugacccccuucaacaucgaccgccugcaggagcucgugcggcgcgggaacagccaguaccccggcgccaaguacaucauccgggacaacggcgaccgcaucgaccugcgguuccaccccaagccguccgaccugcaccuccagaccggguacaaggucgagcgccacaugugcgacggcgacaucgugaucuucaaccggcagcccacgcugcacaagaugagcaugauggggcaccgcgugcggauccugcccuggagcaccuuccgccucaaccuguccgucaccaccccguacaacgccgacuucgacggcgacgagaugaaccugcaccucccccagagccuggagacgcgggcggagauccaggagcuggccauggugccccgcaugaucgugacgccccaguccaaccggccggucaugggcaucgugcaggacacccucaccgccgugcgcaaguucacgaagcgcgacgucuuccuggagcgcggggaggugaugaaccugcucauguuccugagcaccugggacggcaaggugccccagcccgccauccugaagccccgcccgcuguggaccgggaagcagaucuucucccucaucauccccggccacaucaacugcauccggacccacagcacgcaccccgacgacgaggacuccgggcccuacaagcacaucagcccgggcgacaccaaggucgugguggagaacggcgagcugaucauggggauccugugcaagaagucccucggcaccagcgccgggucccugguccacaucagcuaccuggagaugggccacgacaucacccgccucuucuacuccaacauccagacggugaucaacaacuggcugcugaucgaggggcacaccaucggcaucggcgacagcaucgcggacuccaagaccuaccaggacauccagaacaccaucaagaaggccaagcaggacgugaucgaggucaucgagaaggcccacaacaacgagcucgagcccacgcccgggaacacccugcggcagaccuucgagaaccaggugaaccgcauccugaacgacgcccgggacaagaccggcagcuccgcccagaagucccucuccgaguacaacaacuucaagagcaugguggucagcggggcgaagggcuccaagaucaacaucagccaggugaucgccguggucgggcagcagaacguggagggcaagcgcauccccuucggcuucaagcaccggacccugccgcacuucaucaaggacgacuacgggcccgagucccgcggcuucguggagaacagcuaccuggccgggcucacgcccaccgaguucuucuuccacgccaugggcgggcgggagggccugaucgacaccgcggucaagaccgccgagacgggcuacauccagcgccggcugaucaaguccauggagagcgugauggugaaguacgacgccaccguccgcaacuccaucaaccagguggugcagcuccgguacggggaggacggccuggccggggagagcgucgaguuccagaaccuggccacccucaagcccuccaacaaggcguucgagaagaaguuccgcuucgacuacaccaacgagcgggcccugcgccggacgcugcaggaggaccucgugaaggacgugcugagcaacgcccacauccagaacgagcuggagcgcgaguucgagcggaugcgcgaggaccgcgagguccuccgggugaucuucccgaccggcgacuccaaggugguccugcccugcaaccugcuccgcaugaucuggaacgcccagaagaucuuccacaucaacccccggcugcccagcgaccugcacccgaucaaggugguggagggcgucaaggagcucuccaagaagcuggugaucgugaacggggacgacccccugagccgccaggcccaggagaacgcgacccuccuguucaacauccaccuccgguccacccucugcagccgccggauggccgaggaguuccgccuguccggcgaggccuucgacuggcugcucggggagaucgagagcaaguucaaccaggccaucgcccaccccggcgagauggucggggcgcuggccgcccagagccugggcgagccggccacgcagaugacccucaacaccuuccacuacgcgggcguguccgccaagaacgucacccugggggugccccggcugaaggagcucaucaacaucagcaagaagcccaagacgcccucccugaccguguuccugcucggccagagcgcccgcgacgccgagcgggccaaggacauccugugccgccuggagcacaccacccuccggaaggucacggcgaacaccgccaucuacuacgacccgaacccccaguccaccgugguggccgaggaccaggagugggucaacguguacuacgagaugcccgacuucgacguggcccgcaucagccccuggcugcugcgggucgagcucgaccgcaagcacaugaccgaccggaagcugacgauggagcagaucgccgagaagaucaacgcgggguucggcgacgaccugaacugcaucuucaacgacgacaacgccgagaagcucgugcugcgcauccggaucaugaacuccgacgagaacaagaugcaggaggaggaggagguggucgacaagauggacgacgacguguuccugcgcugcaucgagagcaacaugcucaccgacaugacccugcaggggaucgagcagaucuccaagguguacaugcaccucccgcagaccgacaacaagaagaagaucaucaucacggaggacggcgaguucaaggcccuccaggaguggauccuggagaccgacggcgucagccugaugcgcgugcucuccgagaaggacguggaccccguccggaccaccagcaacgacaucguggagaucuucacggugcuggggaucgaggccguccgcaaggcccuggagcgggagcucuaccacgugaucuccuucgacggcagcuacgugaacuaccgccaccuggcgcugcucugcgacaccaugaccugccgggggcaccugauggccaucacccgccacggcgucaaccggcaggacacggggccccugaugaagugcuccuucgaggagaccguggacgugcucauggaggccgccgcgcacggcgagagcgaccccaugaagggcgucuccgagaacaucaugcuggggcagcuggccccggccggcaccgggugcuucgaccuccugcuggacgccgagaagugcaaguacggcauggagauccccaccaacauccccggccucggggccgcgggccccaccgggauguucuucggcagcgccccgucccccaugggcggcaucagccccgccaugacgcccuggaaccagggcgccaccccggccuacggggcguggagccccuccgugggcagcgggaugacccccggcgccgccggguucucccccagcgccgccuccgacgcgagcggcuucuccccgggcuacagccccgccuggucccccacccccgggagcccgggcucccccgggcccagcuccccguacauccccagccccggcggggccaugucccccagcuacuccccgacgagccccgccuacgagccccgcucccccggcggcuacaccccgcagagccccagcuacucccccaccagccccuccuacagcccgaccucccccagcuacucccccacgagccccaacuacuccccgaccagccccuccuacagccccaccucccccagcuacuccccgaccagccccuccuacagccccacgucccccagcuacagcccgaccucccccagcuacucccccaccagccccuccuacagcccgaccucccccagcuacucccccacgagcccguccuacagccccaccucccccagcuacucccccaccagcccguccuacagccccaccucccccagcuacagccccacguccccgagcuacucccccaccagccccuccuacagccccaccuccccgagcuacucccccaccagccccuccuacagccccacguccccgaacuacagccccaccucccccaacuacacccccaccagcccguccuacagccccacgucccccagcuacagccccaccuccccgaacuacacccccaccagccccaacuacuccccgacgagccccuccuacagccccaccucccccagcuacuccccgaccagccccuccuacagccccuccagcccccgguacaccccgcagucccccacguacacccccagcucccccagcuacagcccguccagccccuccuacagccccaccucccccaaguacaccccgaccagccccuccuacagccccuccagccccgaguacacgccgaccucccccaaguacagccccaccucccccaaguacagcccgaccucccccaaguacagccccacgucccccaccuacagcccgaccacccccaaguacucccccacgagcccgaccuacagccccaccucccccguguacacccccacgagcccgaaguacucccccaccagccccaccuacucccccaccagcccgaaguacucccccacgagccccaccuacucccccaccagcccgaagggguccaccuacagccccacgucccccggcuacagccccaccuccccgaccuacagccugaccucccccgccaucagccccgacgacuccgacgaggagaacuga

SEQ ID NO: 34835 - RNA, 3525 nt, Artificial Sequence
  derived and/or modified sequence opt1 from POLR2B__Homo_sapiens__NP_000929
auguacgacgccgacgaggacaugcaguacgacgaggacgacgacgagaucacccccgaccuguggcaggaggccugcuggaucgugaucagcuccuacuucgacgagaagggccucguccgccagcagcuggacagcuucgacgaguucauccagauguccgugcagcggaucguggaggacgcgccgcccaucgaccugcaggccgaggcccagcacgccagcggggaggucgaggagccgccccgcuaccuccugaaguucgagcagaucuaccuguccaagcccacccacugggagcgggacggcgcccccagccccaugaugcccaacgaggcgcgccuccggaaccugacguacuccgccccgcuguacguggacaucaccaagaccgugaucaaggagggggaggagcagcuccagacccagcaccagaagacguucaucggcaagauccccaucaugcugcgcagcaccuacugccugcucaacgggcugaccgaccgggaccugugcgagcucaacgagugcccccuggaccccggcggcuacuucaucaucaacggguccgagaagguccugaucgcccaggagaagauggccaccaacacgguguacguguucgcgaagaaggacagcaaguacgccuacaccggcgagugccgcuccugccucgagaacagcucccggccgaccagcaccaucugggucuccaugcuggcccgcgggggccagggggccaagaaguccgccaucggccagcggaucguggcgacgcugcccuacaucaagcaggaggugcccaucaucaucgucuuccgcgcccucggcuucgugagcgaccgggacauccuggagcacaucaucuacgacuucgaggaccccgagaugauggagauggugaagccgagccuggacgaggccuucgucauccaggagcagaacguggcccucaacuucaucgggucccgcggcgccaagcccggggugaccaaggagaagcggaucaaguacgcgaaggagguccugcagaaggagaugcugccccacgugggcgugagcgacuucugcgagaccaagaaggccuacuuccucggcuacaugguccaccgccugcugcucgccgcccuggggcggcgcgagcuggacgaccgggaccacuacggcaacaagcgccucgaccuggccgggccccugcucgcguuccuguuccggggcauguucaagaaccugcucaaggaggugcgcaucuacgcccagaaguucaucgaccgcgggaaggacuucaaccuggagcuggccaucaagacccggaucaucagcgacggccucaaguacucccuggccacgggcaacuggggcgaccagaagaaggcccaccaggcgcgcgccggggugagccagguccugaaccggcucaccuucgccuccacccugagccaccuccgccggcucaacuccccgaucgggcgcgacggcaagcuggccaagccccggcagcugcacaacacccugugggggauggugugccccgcggagacgcccgagggccacgccgucggccucgugaagaaccuggcccugauggccuacaucagcguggggucccagccgagccccauccucgaguuccuggaggagugguccauggagaaccuggaggagaucagccccgccgcgaucgccgacgccaccaagaucuucgucaacggcugcuggguggggauccacaaggaccccgagcagcucaugaacacccugcgcaagcugcggcgccagauggacaucaucguguccgaggucagcaugauccgggacauccgcgagcgggagauccgcaucuacaccgacgccggccggaucugccgcccgcuccugaucguggagaagcagaagcugcuccugaagaagcggcacaucgaccagcugaaggagcgcgaguacaacaacuacuccuggcaggaccucguggccagcggggucguggaguacaucgacacgcuggaggaggagaccgugaugcuggcgaugacccccgacgaccuccaggagaaggaggucgccuacugcuccaccuacacgcacugcgagauccaccccagcaugauccugggcgugugcgccuccaucaucccguuccccgaccacaaccagagcccccggaacaccuaccaguccgccaugggcaagcaggccauggggguguacaucaccaacuuccacguccgcauggacacccuggcgcacgugcucuacuacccccagaagccgcuggugacgacccgcagcauggaguaccugcgguuccgcgagcuccccgccggcaucaacagcaucgucgccaucgccuccuacaccggguacaaccaggaggacagcgugaucaugaaccgguccgcgguggaccgcggcuucuuccggagcgucuucuaccgcuccuacaaggagcaggagagcaagaagggcuucgaccaggaggagguguucgagaagcccacccgggagacgugccaggggaugcgccacgccaucuacgacaagcuggacgacgacggccugaucgcccccggggugcgggucuccggcgacgacgugaucaucgggaagaccgugacccucccggagaacgaggacgagcuggagagcaccaaccgccgguacaccaagcgcgacugcuccacguuccugcggaccagcgagaccggcaucgucgaccaggugauggugacccucaaccaggagggcuacaaguucugcaagauccgcguccgguccgugcgcaucccccagaucggggacaaguucgccagccggcacggccagaaggggacgugcggcauccaguaccgccaggaggacaugcccuucacgugcgaggggaucacccccgacaucaucaucaacccgcacgccauccccucccggaugaccaucggccaccugaucgagugccugcagggcaaggugagcgcgaacaagggggagaucggcgacgccacccccuucaacgacgccgucaacgugcagaagaucuccaaccuccugagcgacuacggguaccaccuccgcggcaacgaggugcuguacaacggguucaccggccggaagaucaccucccagaucuucaucggccccaccuacuaccagcgccugaagcacauggucgacgacaagauccacagccgcgcccgggggccgauccagauccugaaccgccagcccauggagggccggagccgcgacgggggccuccgguucggggagauggagcgcgacugccagaucgcccacggcgcggcccaguuccugcgggagcgccuguucgaggccuccgaccccuaccaggugcacgugugcaaccucugcggcaucauggccaucgccaacacgcggacccacaccuacgagugccgcgggugccggaacaagacccagaucagccugguccgcaugcccuacgcgugcaagcugcuguuccaggagcugauguccaugagcaucgccccgcggaugauguccguguga

SEQ ID NO: 34836 - RNA, 828 nt, Artificial Sequence
  derived and/or modified sequence opt1 from POLR2C__Homo_sapiens__NP_116558
augcccuacgccaaccagccgaccgugcgcaucaccgagcugacggacgagaacgucaaguucaucaucgagaacaccgaccucgccguggcgaacagcauccggcgcguguucaucgccgagguccccaucaucgccaucgacugggugcagaucgacgccaacuccagcgugcugcacgacgaguucaucgcccaccggcugggccucaucccccugaucuccgacgacaucgucgacaagcugcaguacagccgcgacugcacgugcgaggaguucugccccgagugcuccguggaguucacccucgacgugcggugcaacgaggaccagacccgccacgucaccagccgggaccugaucuccaacagcccgcgcgugauccccgugaccucccggaaccgcgacaacgaccccaacgacuacgucgagcaggacgacauccugaucgugaagcuccggaaggggcaggagcugcgccugcgggcguacgccaagaagggcuucgggaaggagcacgccaaguggaaccccaccgccggcguggcguucgaguacgacccggacaacgcccuccgccacacggucuaccccaagcccgaggaguggcccaagagcgaguacuccgagcuggacgaggacgagagccaggccccguacgaccccaacgggaagcccgagcgguucuacuacaacguggaguccugcggcagccugcgccccgagaccaucgugcucuccgcccugagcggccugaagaagaagcucuccgaccugcagacccagcugagccacgagauccaguccgacguccucaccaucaacuga

SEQ ID NO: 34837 - RNA, 429 nt, Artificial Sequence
  derived and/or modified sequence opt1 from POLR2D__Homo_sapiens__NP_004796
auggccgccggcgggagcgacccccgcgcgggcgacguggaggaggacgccucccagcugaucuucccgaaggaguucgagaccgccgagacccuccugaacagcgagguccacaugcugcucgagcaccggaagcagcagaacgaguccgccgaggacgagcaggagcugagcgagguguucaugaagacgcugaacuacaccgcccgcuucucccgguucaagaaccgcgagaccaucgcgagcgugcggucccuccugcugcagaagaagcuccacaaguucgagcuggccugccuggccaaccucugccccgagaccgccgaggagagcaaggcgcugauccccucccuggaggggcgcuucgaggacgaggagcuccagcagauccuggacgacauccagacgaagcggagcuuccaguacuga

SEQ ID NO: 34838 - RNA, 633 nt, Artificial Sequence
  derived and/or modified sequence opt1 from POLR2E__Homo_sapiens__NP_002686
auggacgacgaggaggagaccuaccgccuguggaagauccggaagaccaucaugcagcucugccacgaccgcggcuaccuggugacgcaggacgagcuggaccagacccucgaggaguucaaggcccaguucggggacaagcccagcgagggccggccgcgccggaccgaccugaccguccugguggcccacaacgacgaccccacggaccagauguucguguucuuccccgaggagcccaaggucgggaucaagaccaucaagguguacugccagcgcaugcaggaggagaacaucacccgggcgcucaucgugguccagcagggcaugaccccguccgccaagcagagccugguggacauggcccccaaguacauccuggagcaguuccuccagcaggagcugcugaucaacaucacggagcacgagcucgugcccgagcacgucgugaugaccaaggaggaggugaccgagcugcuggcccgcuacaagcuccgggagaaccagcugccccgcauccaggccggggacccggucgcgcgguacuucggcaucaagcgcggccagguggugaagaucauccggcccuccgagaccgccgggcgcuacaucacguaccggcugguccaguga

SEQ ID NO: 34839 - RNA, 357 nt, Artificial Sequence
  derived and/or modified sequence opt1 from POLR2F__Homo_sapiens__NP_001288058
auggugagcaucuccugccuggucauccggcccccgcgcccgcccaaggugcucggccugcaggaggggcaggagaacguggagauccugcccagcggcgagcgcccccaggccaaccagaagcggaucaccacccccuacaugacgaaguacgagcgcgcccggguccucgggacccgcgcgcugcagaucgccaugugcgcccccgugaugguggagcuggagggcgagaccgacccccuccugaucgccaugaaggagcugaaggcccggaagaucccgaucaucauccgccgguaccuccccgacggguccuacgaggacuggggcgucgacgagcugaucaucaccgacuga

SEQ ID NO: 34840 - RNA, 519 nt, Artificial Sequence
  derived and/or modified sequence opt1 from POLR2G__Homo_sapiens__NP_002687
auguucuaccacaucagccuggagcacgagauccuccugcacccccgcuacuucggcccgaaccugcucaacaccgugaagcagaagcuguucaccgaggucgaggggacgugcaccggcaaguacggguucgugaucgccgugaccaccaucgacaacaucggcgccggggucauccagcccggccggggcuucgugcuguaccccgugaaguacaaggcgaucgucuuccgccccuucaagggggaggugguggacgccgucgugacccaggugaacaaggucggccucuucacggagaucgggccgauguccugcuucaucagccggcacuccauccccagcgagauggaguucgaccccaacuccaacccgcccugcuacaagaccauggacgaggacaucgugauccagcaggacgacgagauccgccugaagaucgugggcacccgggucgacaagaacgacaucuucgccaucgggagccugauggacgacuaccucggccugguguccuga

SEQ ID NO: 34841 - RNA, 369 nt, Artificial Sequence
  derived and/or modified sequence opt1 from POLR2H__Homo_sapiens__NP_001265643
auggccggcauccuguucgaggacaucuucgacgugaaggacaucgaccccgaggggaagaaguucgaccgcgucagccggcuccacugcgaguccgagagcuucaagauggaccugauccuggacgugaacauccagaucuacccgguggaccucggcgacaaguuccgccuggucaucgccuccacccuguacgaggacgggacccucgacgacggcgaguacaaccccacggacgaccggcccagcuccagcgcguacguguccuacgggggccugcugaugcgccuccagggcgacgccaacaaccugcacggguucgagguggacagccgggucuaccugcucaugaagaagcuggccuucuga

SEQ ID NO: 34842 - RNA, 354 nt, Artificial Sequence
  derived and/or modified sequence opt1 from POLR2J__Homo_sapiens__NP_006225
augaacgcgcccccggccuucgagagcuuccuccuguucgagggcgagaagaagaucaccaucaacaaggacaccaaggugcccaacgccugccuguucacgaucaacaaggaggaccacacccuggggaacaucaucaagucccagcuccugaaggacccccagguccuguucgccggcuacaaggugccccacccgcucgagcacaagaucaucauccgcgugcagaccacccccgacuacagcccccaggaggccuucacgaacgccaucaccgaccugaucuccgagcugagccuccuggaggagcgguuccgcgucgccaucaaggacaagcaggaggggaucgaguga

SEQ ID NO: 34843 - RNA, 177 nt, Artificial Sequence
  derived and/or modified sequence opt1 from POLR2K__Homo_sapiens__NP_005025
auggacacccagaaggacgugcagcccccgaagcagcagcccaugaucuacaucugcggcgagugccacaccgagaacgagaucaagagccgcgaccccauccggugccgcgagugcggguaccggaucauguacaagaagcgcacgaagcggcuggucguguucgacgcccgcuga

SEQ ID NO: 34844 - RNA, 636 nt, Artificial Sequence
  derived and/or modified sequence opt1 from POLR2M__Homo_sapiens__NP_001018112
augugcagccugccccgcggcuucgagccgcaggcccccgaggaccucgcccagcggucccugguggagcugcgcgagaugcucaagcggcaggagcgccugcugcggaacgagcuccagcgcaucaccaucgcggaccagggggagcagcagagcgaggagaacgccuccaccaagaaccugacgggccugagcuccgggaccgagaagaagccccacuacauggagguccucgagaugcgggccaagaaccccgugccgcagcugcgcaaguucaagaccaacgugcugcccuuccggcagaacgacagcuccagccacugccagaaguccggcagccccaucuccagcgaggagcgccggcgccgggacaagcagcaccucgacgacaucaccgccgcccgccugcugccccuccaccacaugccgacgcagcugcuguccaucgaggagagccucgcgcugcagaagcagcagaagcagaacuacgaggagaugcaggccaagcuggccgcccagaagcucgcggagcggcugaacaucaagaugcgcuccuacaaccccgagggggagagcuccggccgguaccgcgagguccgggacgaggacgacgacuggagcuccgacgaguucuga

SEQ ID NO: 34845 - RNA, 4173 nt, Artificial Sequence
  derived and/or modified sequence opt1 from POLR3A__Homo_sapiens__NP_008986
auggugaaggagcaguuccgcgagaccgacgucgccaagaagaucagccacaucugcuucggcaugaagucccccgaggagaugcggcagcaggcccacauccagguggugagcaagaaccuguacucccaggacaaccagcacgcgccgcuccuguacgggguccuggaccaccgcaugggcaccagcgagaaggaccggcccugcgagacgugcgggaagaaccucgccgacugccugggccacuacggguacaucgaccuggagcuccccugcuuccacgugggcuacuuccgcgccgugaucggcauccugcagaugaucugcaagaccugcugccacaucaugcugucccaggaggagaagaagcaguuccucgacuaccugaagcggcccgggcugaccuaccuccagaagcgcggccugaagaagaagaucagcgacaagugccggaagaagaacaucugccaccacugcggggccuucaacggcaccgucaagaagugcgggcugcucaagaucauccacgagaaguacaagacgaacaagaaggugguggacccgaucgucuccaacuuccugcagagcuucgagaccgccaucgagcacaacaaggagguggagccccugcucggccgcgcgcaggagaaccugaacccccuggugguccucaaccuguucaagcggauccccgccgaggacgugccgcugcuccugaugaaccccgaggccggcaagcccuccgaccugauccucacccgccugcuggugcccccgcucugcauccggcccagcgucguguccgaccugaaguccgggaccaacgaggacgaccugacgaugaagcucaccgagaucaucuuccugaacgacgugaucaagaagcaccgcaucuccggcgccaagacccagaugaucauggaggacugggacuuccugcagcuccagugcgcgcuguacaucaacagcgagcuguccgggaucccccucaacauggcccccaagaaguggacccggggcuucguccagcgccugaagggcaagcaggggcgguuccgcggcaaccugagcgggaagcggguggacuucuccggccgcacggugaucagcccggaccccaaccuccggaucgacgaggucgccgugcccgugcacgucgccaagauccugaccuuccccgagaaggugaacaaggccaacaucaacuuccugcgcaagcucguccagaacgggccggaggugcaccccggcgcgaacuucauccagcagcggcacacccagaugaagcgcuuccugaaguacggcaaccgcgagaagauggcccaggagcugaaguacggggacaucguggagcggcaccucaucgacggcgacgucgugcuguucaaccgccagcccucccugcacaagcugagcaucauggcccaccucgcccgggugaagccccaccgcaccuuccgguucaacgagugcgucugcacgccguacaacgccgacuucgacggggacgagaugaaccugcaccucccccagaccgaggaggcgaaggccgaggcccuggugcugaugggcaccaaggccaaccuggugacgccccgcaacggggagccccucaucgccgcgauccaggacuuccugaccggcgccuaccugcucacccugaaggacaccuucuucgaccgggccaaggccugccagaucaucgccagcauccuggucggcaaggacgagaagaucaaggugcgccucccgccgcccaccauccugaagcccgugacgcuguggaccgggaagcagaucuucuccgucauccuccggcccagcgacgacaaccccgugcgcgcgaaccugcggaccaagggcaagcaguacugcgggaagggcgaggaccugugcgccaacgacuccuacgugaccauccagaacagcgagcucauguccgggagcauggacaagggcacgcugggcuccgggagcaagaacaacaucuucuacauccugcuccgcgacuggggccagaacgaggccgccgacgcgaugucccggcuggcccgccuggcccccgucuaccucagcaaccggggguucuccaucggcaucggcgacgugaccccggggcagggccugcugaaggccaaguacgagcuccugaacgccggguacaagaagugcgacgaguacaucgaggcgcugaacaccggcaagcuccagcagcagcccgggugcaccgccgaggagacgcuggaggcccugauccucaaggagcugagcgugauccgcgaccacgccggcuccgccugccugcgggagcucgacaagagcaacagcccccugaccauggcgcugugcggcagcaagggguccuucaucaacaucagccagaugaucgccugcgucggccagcaggccaucuccgggagccgcgugcccgacggcuucgagaaccggagccucccgcacuucgagaagcacuccaagcugcccgccgccaagggguucguggcgaacagcuucuacuccggccugacccccaccgaguucuucuuccacacgauggccggccgcgaggggcucgucgacaccgccgugaagaccgccgagaccggcuacaugcagcgccggcuggucaagagccuggaggaccucugcucccaguacgaccugaccgugcgcagcuccacgggggacaucauccaguucaucuacggcggggacggccuggaccccgcggccauggagggcaaggacgagccgcucgaguucaagcgggugcuggacaacaucaaggccguguuccccugccccagcgagcccgcccuguccaagaacgagcucauccugaccaccgagagcaucaugaagaaguccgaguuccugugcugccaggacagcuuccuccaggagaucaagaaguucaucaagggggucuccgagaagaucaagaagacccgcgacaaguacggcaucaacgacaacgggacgaccgagccgcgggugcuguaccagcuggaccgcaucacccccacccagguggagaaguuccucgagacgugccgggacaaguacaugcgcgcccagauggagcccggcagcgcggucggggcccugugcgcccaguccaucggcgagcccggcacccagaugacccugaagaccuuccacuucgccgggguggccagcaugaacaucacgcucggcgugccgcggaucaaggagaucaucaacgcguccaaggccaucagcacccccaucaucaccgcccagcuggacaaggacgacgacgccgacuacgcccgccuggucaaggggcggaucgagaagacccuccugggcgagaucagcgaguacaucgaggagguguuccugcccgacgacugcuucauccucgugaagcugucccuggagcgcauccggcuccugcgccuggaggucaacgcggagacggugcgguacagcaucugcaccuccaagcuccgcgugaagcccggcgacgucgccgugcacggggaggccguggucugcgugaccccgcgggagaacagcaaguccagcauguacuacgugcugcaguuccugaaggaggaccuccccaaggucguggugcagggcauccccgaggucucccgcgccgugauccacaucgacgagcagagcgggaaggagaaguacaagcugcugguggagggcgacaaccuccgggcggucauggccacccacggggugaagggcacgcgcaccaccuccaacaacaccuacgaggucgagaagacgcugggcaucgaggccgcccggaccaccaucaucaacgagauccaguacaccauggugaaccacgggaugagcaucgaccgccgccacgugaugcugcucuccgaccugaugacguacaagggcgagguccuggggaucacccgguucggccucgccaagaugaaggagagcgugcugaugcuggcguccuucgagaagaccgccgaccaccucuucgacgccgccuacuucgggcagaaggacagcgugugcggcgucuccgagugcaucaucaugggcaucccgaugaacaucgggaccggccuguucaagcugcuccacaaggccgaccgcgaccccaacccgcccaagcggccccugaucuucgacacgaacgaguuccacaucccccuggugaccuga

SEQ ID NO: 34846 - RNA, 3228 nt, Artificial Sequence
  derived and/or modified sequence opt1 from POLR3B__Homo_sapiens__NP_001154180
augaaggccaacgagaaggugaccagcgacgccgaccccaugugguaccugaaguaccucaacaucuacgucggccugccggacguggaggaguccuucaacgugacccgccccgucagcccccacgagugccggcugcgcgacaugacguacuccgcgcccaucaccguggacaucgaguacacccgggggagccagcgcaucauccggaacgcccucccgaucggccgcaugcccaucaugcugcgguccagcaacugcgugcugaccgggaagacgcccgccgaguucgccaagcucaacgagugcccccuggacccgggcggguacuucaucgucaagggcguggagaaggugauccugauccaggagcagcucuccaagaaccgcaucaucgucgaggccgaccggaagggcgcggugggggccagcgugaccuccagcacccacgagaagaagucccgcaccaacauggccgucaagcagggccgguucuaccugcgccacaacacgcugagcgaggacauccccaucgugaucaucuucaaggccauggggguggaguccgaccaggagaucguccagaugaucggcaccgaggagcacgugauggcggccuucgggcccagccucgaggagugccagaaggcccagaucuucacccagaugcaggcccugaaguacaucggcaacaaggugcggcgccagcggauguggggcgggggccccaagaagaccaagaucgaggaggcccgcgagcugcucgcguccacgauccugacccacgucccggugaaggaguucaacuuccgggccaagugcaucuacaccgccgugaugguccgccgggugauccuggcccagggggacaacaagguggacgaccgcgacuacuacggcaacaagcggcucgagcuggccggccagcugcucagccugcuguucgaggaccucuucaagaaguucaacuccgagaugaagaagaucgcggaccaggucauccccaagcagcgcgccgcccaguucgacguggucaagcacaugcgccaggaccagaucaccaacgggauggugaacgccaucagcacgggcaacuggucccugaagcgguucaagauggaccgccagggggugacccagguccugagccggcucagcuacaucuccgcccugggcaugaugacccgcaucagcucccaguucgagaagacccggaaggugagcgggccccgcucccugcagcccagccaguggggcaugcucugcccguccgacacgcccgagggcgaggcgugcgggcuggugaagaaccuggcccucaugacccacaucaccaccgacauggaggacggccccaucgucaagcuggccagcaaccuggggguggaggacgugaaccuccugugcggcgaggagcuguccuaccccaacgucuuccucguguuccugaacgggaacauccugggcgugauccgggaccacaagaagcucgucaacacguuccgccugaugcggcgcgccggcuacaucaacgaguucgugagcaucuccaccaaccugaccgaccggugcguguacaucagcuccgacgggggccgccucugccggccguacaucaucgucaagaagcagaagcccgccgugaccaacaagcacauggaggagcuggcgcagggguaccgcaacuucgaggacuuccugcacgagagccucguggaguaccuggacgucaacgaggagaacgacugcaacaucgcccuguacgagcacacgaucaacaaggacaccacccaccuggagaucgagcccuucacccuccugggcgugugcgccgggcugauccccuacccgcaccacaaccagagcccccggaacacguaccagugcgccaugggcaagcaggcgaugggcaccaucggguacaaccagcgcaaccggaucgacacccucauguaccugcuggccuacccccagaagcccauggugaagaccaagacgaucgagcucaucgaguucgagaagcugccggccggccagaacgccaccgucgccgugauguccuacuccggguacgacaucgaggacgcgcuggugcucaacaaggccagccuggaccgcggcuucggccggugccuggucuacaagaacgccaagugcacccucaagcgcuacaccaaccagaccuucgacaaggugauggggcccaugcuggacgccgccacgcgcaagcccaucuggcggcacgagauccuggacgcggacggcaucugcuccccgggggagaagguggagaacaagcagguccucgugaacaagagcaugcccaccgugacccagaucccccuggagggcagcaacgucccccagcagccgcaguacaaggacgugcccaucaccuacaagggggccacggacuccuacaucgagaaggugaugaucagcuccaacgccgaggacgccuuccugaucaagaugcuccugcgccagacccggcgccccgagaucggcgacaaguucagcucccggcacggccagaagggggucugcggccugaucgugccccaggaggacaugccguucugcgacagcgggaucugccccgacaucaucaugaacccccacggcuuccccucccgcaugaccguggggaagcucaucgagcugcuggccggcaaggcgggcguccucgacgggcgguuccacuacggcaccgccuucgggggcagcaaggugaaggacgugugcgaggaccugguccgccacggguacaacuaccugggcaaggacuacgugacguccggcaucaccggggagccgcucgaggccuacaucuacuucggccccguguacuaccagaagcugaagcacaugguccuggacaagaugcacgcccgggcgcgcgggccccgggccgugcucacccgccagcccaccgagggccggagccgcgacgggggccugcggcugggcgagauggagcgcgacugccucaucggguacggcgccuccaugcugcugcucgagcggcugaugaucagcuccgacgccuucgagguggacgucugcgggcagugcggccugcucggcuacagcggguggugccacuacugcaaguccagcugccacguguccagccugcgcaucccguacgccugcaagcuccuguuccaggagcugcagagcaugaacaucaucccccggcugaagcucuccaaguacaacgaguga

SEQ ID NO: 34847 - RNA, 2064 nt, Artificial Sequence
  derived and/or modified sequence opt1 from POLR3E__Homo_sapiens__NP_001244962
auggccaacgaggaggacgaccccgugguccaggagaucgacguguaccuggccaagagccucgcggagaagcuguaccuguuccaguaccccgugcgccccgccuccaugaccuacgacgacaucccccaccucagcgccaagaucaagcccaagcagcagaaggucgagcuggagauggccaucgacacccugaacccgaacuacugccgguccaagggcgagcagaucgcccucaacguggacggggcgugcgccgacgagacgagcaccuacuccagcaagcugauggacaagcagaccuucugcuccagccagaccacguccaacaccagccgcuacgccgccgcgcuguaccggcagggcgagcuccaccugacgccccugcacgggauccuccagcugcgccccuccuucagcuaccuggacaaggccgacgccaagcaccgggagcgcgaggccgccaacgaggcgggcgacuccagccaggacgaggccgaggacgacgugaagcagaucaccguccgguucucccgccccgagagcgagcaggcccggcagcgccgggugcaguccuacgaguuccuccagaagaagcacgccgaggagccgugggugcaccuccacuacuacgggcugcgcgacagccgguccgagcacgagcgccaguaccugcugugccccggcagcagcggcgucgagaacaccgagcuggugaagucccccagcgaguaccucaugaugcugaugcccccgucccaggaggaggagaaggacaagcccguggcccccagcaacguccuguccauggcgcagcuccggacccugccccuggccgaccagaucaagauccucaugaagaacgugaaggugaugccguucgccaaccugaugagccugcucgggcccuccaucgacagcgucgccgugcugcgcggcauccagaagguggccaugcugguccaggggaacuggguggugaaguccgacauccucuaccccaaggacagcuccagcccccacuccggcgucccggcggaggugcugugccgggggcgcgacuucgugauguggaaguucacccagagccggugggucgugcgcaaggaggucgccaccgugacgaagcugugcgccgaggacgugaaggacuuccucgagcacauggccgucgugcggaucaacaagggcugggaguucauccugcccuacgacggcgaguucaucaagaagcaccccgacgugguccagcgccagcacaugcuguggaccgggauccaggccaagcucgagaagguguacaaccuggugaaggagaccaugcccaagaagccggacgcgcaguccggccccgccgggcuggucugcggcgaccagcgcauccagguggccaagaccaaggcccagcagaaccacgcgcuccuggagcgggagcugcagcgccggaaggagcagcuccgcgugcccgccgugcccccgggcguccggaucaaggaggagcccgugagcgaggagggggaggaggacgaggagcaggaggccgaggaggagcccauggacacguccccgagcggccugcacuccaagcuggccaacgggcucccccugggccgcgccgcggggaccgacagcuucaacggccacccgccccagggcugcgccagcacccccgucgcccgggagcugaaggccuucguggaggccaccuuccagcgccaguucgugcugacgcucuccgagcugaagcggcuguucaaccuccaccuggcgagccugccgcccgggcacacccucuucuccggcaucagcgaccgcaugcugcaggacaccguccuggccgccgggugcaagcagauccucgugcccuucccgccccagaccgccgccucccccgacgagcagaagguguucgcgcugugggagagcggcgacauguccgaccagagccggcugacgcaggagugcggggaggaccucuccaagcaggaggucgacaaggugcugaaggacugcugcgugagcuacggcggcaugugguaccugaaggggaccguccaguccuga

SEQ ID NO: 34848 - RNA, 327 nt, Artificial Sequence
  derived and/or modified sequence opt1 from POLR3K__Homo_sapiens__NP_057394
augcuccuguucugccccggcugcgggaacggccugaucguggaggaggggcagcgcugccaccgguucgccugcaacacgugcccguacguccacaacaucacccgcaaggugaccaaccggaaguaccccaagcugaaggagguggacgacguccucggcggggccgcggccugggagaacguggacagcaccgccgaguccugccccaagugcgagcacccccgcgccuacuucaugcagcugcagacccggagcgccgacgagccgaugaccacguucuacaagugcugcaacgcgcagugcggccaccgcuggcgggacuga

SEQ ID NO: 34849 - RNA, 3693 nt, Artificial Sequence
  derived and/or modified sequence opt1 from POLRMT__Homo_sapiens__NP_005026
augagcgcccugugcuggggccgcggggccgcgggccucaagcgggcccugcgccccugcgggcggccgggccugcccgggaaggagggcaccgccggcggggugugcggcccccgccgguccagcuccgccagcccccaggagcaggaccaggaccgccggaaggacugggggcacgucgagcuccuggaggugcugcaggcccgcgugcggcagcuccaggcggaguccgucagcgaggugguggucaaccgcguggacguggcccggcugccggagugcggcuccggggacggcagccugcagcccccccgcaagguccagaugggcgccaaggacgccacccccgugccgugcgggcggugggcgaagauccucgagaaggacaagcgcacgcagcagaugcggaugcagcgccugaaggccaagcugcagaugcccuuccaguccggcgaguucaaggcccucacccggcgccugcagguggagccccggcugcucagcaagcagauggccgggugccuggaggacugcacccgccaggcccccgaguccccgugggaggagcagcuggcgcggcuccugcaggaggcccccggcaagcugagccucgacgucgagcaggcccccuccggccagcacagccaggcccagcuguccgggcagcagcagcgccugcucgccuucuucaagugcugccugcugaccgaccagcucccccuggcgcaccaccugcucguggugcaccacggccagcgccagaagcggaagcugcugacgcucgacauguacaacgccgucaugcuggggugggcccgccagggcgccuucaaggagcugguguacgugcucuucauggucaaggacgccgggcugaccccggaccugcucagcuacgcggccgcccugcagugcaugggccggcaggaccaggacgccggcaccaucgagcgcugccuggagcagaugucccaggaggggcucaagcugcaggcccuguucaccgcggugcuccugagcgaggaggaccgggccacggugcugaaggccguccacaaggugaagcccaccuucucccuccccccccagcugccgccccccgugaacaccagcaagcugcugcgcgacgucuacgccaaggacggccgggugagcuaccccaagcuccaccugccgcugaagacccuccagugccuguucgagaagcagcugcacauggagcucgcgucccgcgucugcguggugagcgucgagaagcccacgcugcccuccaaggaggugaagcacgcccggaagacccugaagacccuccgcgaccagugggagaaggcccugugccgggcccugcgcgagaccaagaaccggcucgagcgcgagguguacgaggggcgguucagccuguaccccuuccugugccuccuggacgagcgcgaggucgugcggaugcugcuccaggugcugcaggcccugccggcgcagggcgaguccuucacgacccucgcccgcgagcugagcgcccggaccuucucccgccacgucgugcagcgccagcgggugagcgggcagguccaggcccugcagaaccacuaccgcaaguaccucugccugcuggccuccgacgcggaggugcccgagcccugccucccgcggcaguacugggaggagcugggcgcccccgaggcccugcgcgagcagcccuggccccucccggugcagauggagcugggcaagcugcucgccgagaugcugguccaggccacccagaugcccugcagccuggacaagccccaccgguccagccgccucgugcccgugcuguaccacgucuacuccuuccggaacgugcagcagaucgggauccugaagccgcaccccgcguacgugcagcuccuggagaaggccgccgagcccacgcugaccuucgaggccgucgacgugcccaugcucugcccgccccugcccuggaccagcccccacuccggcgcguuccugcucagcccgaccaagcugaugcgcacgguggagggggccacccagcaccaggagcugcucgagaccugcccccccaccgcccugcacggcgcccuggacgcccucacgcagcuggggaacugcgcguggcgggucaacggccgcgugcuggaccucgugcugcagcuguuccaggccaagggcugcccccagcucggggucccggccccccccuccgaggccccccagccgcccgaggcccaccugccccacagcgcggccccggcccggaaggccgagcugcgccgggagcucgcccacugccagaagguggcgcgcgagaugcacucccugcgggccgaggcccuguaccgccucagccuggcccagcaccugcgggaccgcguguucuggcucccccacaacauggacuuccggggccgcaccuaccccugccccccgcacuucaaccaccuggggagcgacgucgcgcgggcccugcucgaguucgcccagggccgcccccugggcccccacgggcuggacuggcucaagauccaccuggugaaccugaccggccucaagaagcgcgagccccugcggaagcgccuggccuucgccgaggaggugauggacgacauccucgacuccgcggaccagccgcugaccgggcggaagugguggaugggcgccgaggagcccuggcagacgcuggccugcugcauggaggucgccaacgccgugcgcgcgagcgaccccgccgccuacgugucccaccuccccguccaccaggacgggagcugcaacggccugcagcacuacgccgcccugggccgggacuccgugggggcggccagcgugaaccucgagccguccgacgucccccaggacguguacagcggcguggccgcccaggucgagguguuccgccggcaggacgcccagcgcgggaugcggguggcgcagguccuggagggcuucaucacccgcaagguggugaagcagaccgucaugaccgugguguacggggucacgcgguacggcggccgccugcagaucgagaagcggcuccgcgagcuguccgacuucccccaggaguucgugugggaggccagccacuaccugguccggcagguguucaagucccuccaggagauguucagcgggacccgcgccauccagcacuggcugaccgaguccgcccggcugaucagccacaugggcuccguggucgagugggugaccccccucggggugccggucauccagcccuaccgccuggacagcaaggugaagcagaucggcgggggcauccaguccaucaccuacacgcacaacggcgacaucagccggaagcccaacacccgcaagcagaagaacggguuccccccgaacuucauccacagccuggacuccagccacaugaugcugaccgcgcuccacugcuaccgcaagggccugaccuucguguccguccacgacugcuacuggacgcacgccgccgacgugagcgugaugaaccaggucugccgggagcaguucgugcgccugcacuccgagcccauccuccaggaccugagccgguuccuggugaagcgcuucugcuccgagccccagaagauccucgaggccagccagcugaaggagacccugcaggccguccccaagccgggggcguucgaccucgagcaggugaagcgguccaccuacuucuucagcuga

SEQ ID NO: 34850 - RNA, 3000 nt, Artificial Sequence
  derived and/or modified sequence opt1 from POM121__Homo_sapiens__NP_001244119
auggugugcagccccgucaccgugcgcaucgccccgcccgaccggcgcuucucccggagcgccauccccgagcagaucaucuccagcacccuguccagccccuccagcaacgcgccggaccccugcgccaaggagacggugcucuccgcccugaaggagaaggagaagaagcgcaccgucgaggaggaggaccagaucuuccuggacggccaggagaacaagcggcgccggcacgacagcuccgggagcggccacuccgccuucgagccccucguggccaacggggugcccgcgagcuucgucccgaagcccggcucccugaagcgcgggcugaacagccaguccagcgacgaccaccucaacaagcggucccgcagcagcuccaugagcucccugaccggcgccuacgccagcggcauccccuccagcucccggaacgccaucaccagcuccuacagcuccacgcgcgggaucagccagcuguggaagcggaacggccccuccagcuccccguucagcucccccgcgagcucccgcagccagacccccgagcggcccgccaagaagauccgcgaggaggagcucugccaccacagcuccagcuccaccccgcuggccgccgaccgggagagccagggggagaaggccgcggacaccacgccccgcaagaagcagaacuccaacagccaguccacccccggcagcuccgggcagcggaagcgcaaggugcagcugcuccccagccggcgcggcgagcagcugacccugccgccccccccccagcucggcuacuccaucaccgccgaggaccuggaccuggagaagaaggccagccuccagugguucaaccaggcccuggaggacaaguccgacgccgcgagcaacuccgugacggagaccccgcccaucacccagcccagcuucaccuucacgcugcccgccgccgccccggccuccccccccaccagccuccuggcgccgagcaccaacccccugcucgagucccugaagaagaugcagaccccccccagccugccgcccugccccgaguccgccggggccgccacgaccgaggcccucagccccccgaagacccccucccugcugcccccccucggccugagccaguccgggccgcccggccugcuccccagccccuccuucgacagcaagccgcccaccacgcugcugggccucauccccgcgcccuccauggucccggccaccgacaccaaggccccccccacccugcaggccgagacggcgaccaagccccaggccaccagcgccccgucccccgcccccaagcagagcuuccuguucgggacccagaacacguccccgagcucccccgccgcgcccgccgccagcuccgcccccccgauguucaagcccaucuucaccgccccccccaagagcgagaaggagggcccgaccccccccgggcccagcgugaccgcgacggccccguccagcuccagccuccccaccaccaccuccaccacggcccccaccuuccagcccguguucagcuccaugggcccgcccgccagcgucccccugcccgccccguucuucaagcagaccaccacgcccgcgaccgcccccaccaccacggccccccuguucaccgggcucgccuccgcgaccagcgccguggccccgaucaccuccgccagccccuccacggacagcgccuccaagcccgcguucggcuucggcaucaacagcguguccagcuccagcgucagcaccaccaccuccacggccaccgccgccagccagcccuuccuguucggggccccgcaggcguccgccgccagcuucacccccgccaugggcuccaucuuccaguucgggaagcccccggcccugcccaccacgaccaccgugaccacguucagccagucccuccacaccgcggugcccaccgccaccagcuccagcgccgccgacuucuccggcuucgggagcacgcuggcgaccuccgcccccgccaccagcucccagccgacccugacguucagcaacaccuccacccccaccuucaacauccccuucggcagcuccgccaagagcccccucccgagcuaccccggcgccaacccccagcccgcguucggggccgccgagggccagccgcccggggccgccaagcccgcgcuggcccccuccuucggcagcuccuucacguucgggaacagcgccgccccggccgcggcccccacccccgcccccccguccaugaucaaggucgugcccgccuacgugcccacccccauccacccgaucuucggcggcgccacccacagcgcguucgggcugaaggccaccgccuccgccuucggcgcgcccgccagcucccagcccgccuucgggggcagcacggccgucuucuucggcgccgcgaccuccagcggguucggcgccaccacccagacggccuccagcggguccagcuccagcguguucggcuccaccacccccagcccguucaccuucgggggcagcgccgcccccgcgggcuccgggagcuucggcaucaacguggccacgcccggguccagcaccaccaccggcgccuucuccuucggggccggccagagcggcuccacggccaccagcaccccguucgcggggggccuggggcagaacgcccucggcaccacggggcaguccacccccuucgccuucaacgucagcuccaccaccgagagcaagcccguguucggcggcacggccacccccaccuucgggcugaacaccccggcgcccggcgucgggacguccggcagcucccugagcuucggggccuccagcgcccccgcccagggcuucgugggcguggcccccuucgggaacaccuucgcgcaccagcaggagcacuccccgcgcaagggccccaacaaccucagcaagcggaagcugcugcccgccguccgcgcccaggggcucccccggcgcggccaggccagcuccuucccgacccggaaggaguga

SEQ ID NO: 34851 - RNA, 804 nt, Artificial Sequence
  derived and/or modified sequence opt1 from POMC__Homo_sapiens__NP_001306134
augccccgcagcugcugcucccggagcggcgcccugcuccuggcccugcuccugcaggcguccauggaggugcgcggguggugccuggagagcucccagugccaggaccucaccaccgagagcaaccugcuggagugcauccgggccugcaagccggaccucuccgccgagacgcccauguuccccggcaacggggacgagcagccccugaccgagaacccgcgcaaguacgucaugggccacuuccggugggaccgcuucgggcggcgcaacagcuccagcuccggcagcuccggcgccgggcagaagcgggaggacgugagcgccggcgaggacugcgggccccugcccgagggcgggcccgagccgcgcuccgacggcgcgaagcccggcccccgggaggggaagcgcagcuacuccauggagcacuuccgguggggcaagcccguggggaagaagcgccggccggucaagguguaccccaacggcgccgaggacgagagcgccgaggccuucccccucgaguucaagcgcgagcugaccggccagcggcugcgcgagggggacggccccgacgggccggcggacgacggcgccggggcccaggccgaccucgagcacucccugcugguggccgcggagaagaaggacgagggccccuaccggauggagcacuuccgcuggggcagcccgcccaaggacaagcgguacgggggcuucaugaccagcgagaagucccagacgccccucgucacccuguucaagaacgccaucaucaagaacgccuacaagaagggggaguga

SEQ ID NO: 34852 - RNA, 1554 nt, Artificial Sequence
  derived and/or modified sequence opt1 from POMGNT1__Homo_sapiens__NP_001277059
auggccaagcgcguguucgacaccuacagcccccacgaggacgaggccaugguccuguuccucaacaugguggcgccgggccgggugcugaucugcaccgucaaggacgagggguccuuccaccugaaggacacggccaaggcccuccugcgcagccugggcucccaggccgggcccgcccucggcuggcgggacaccugggcguucguggggcgcaagggcggccccguguucggggagaagcacagcaagucccccgcccugagcuccuggggcgacccgguccugcucaagaccgacgugccccugagcuccgccgaggaggccgagugccacugggcggacaccgagcugaaccggcgccggcgccgguucugcagcaagguggagggguacggcuccgucugcagcugcaaggaccccacgcccaucgaguucuccccggacccccuccccgacaacaaggugcugaacgugcccgucgccgugaucgccgggaaccgcccgaacuaccuguaccggaugcuccgcagccugcuguccgcccagggcgugagcccccagaugaucaccgucuucaucgacggcuacuacgaggagcccauggacgugguggcccucuucgggcugcggggcauccagcacacccccaucuccaucaagaacgcgcgcgucagccagcacuacaaggccucccugaccgccacguucaaccucuucccggaggccaaguucgccguggugcuggaggaggaccuggacaucgcggucgacuucuucagcuuccucagccaguccauccaccuccuggaggaggacgacagccuguacugcaucuccgccuggaacgaccagggguacgagcacaccgccgaggaccccgcccugcuguaccggguggagaccaugcccggccucggcugggugcugcgccggagccuguacaaggaggagcucgagcccaaguggccgacccccgagaagcugugggacugggacauguggaugcgcaugcccgagcagcggcgcgggcgggagugcaucauccccgacgucucccgcagcuaccacuucggcaucguggggcugaacaugaacggcuacuuccacgaggccuacuucaagaagcacaaguucaacacggucccgggggugcagcuccgcaacguggacucccugaagaaggaggcguacgaggucgaggugcaccggcugcucagcgaggccgaggugcuggaccacuccaagaaccccugcgaggacagcuuccugcccgacaccgagggccacaccuacgucgccuucauccgcauggagaaggacgacgacuucaccacguggacccagcucgccaagugccugcacaucugggaccuggacgugcggggcaaccaccgcgggcucuggcggcuguuccgcaagaagaaccacuuccugguggucggcgugcccgccuccccguacagcgugaagaagccgcccuccgucacccccaucuuccucgagcccccgcccaaggaggagggggcgcccggcgcccccgagcagaccuga

SEQ ID NO: 34853 - RNA, 1743 nt, Artificial Sequence
  derived and/or modified sequence opt1 from POMGNT2__Homo_sapiens__NP_116195
augcaccugagcgccguguucaacgcccuccuggucuccgugcuggcggccgugcucuggaagcacguccgccugcgggagcacgccgccacccuggaggaggagcucgcccugagccgccaggcgaccgagcccgccccggcccugcggaucgacuaccccaaggcccuccagauccugauggagggcgggacgcacauggugugcaccggccgcacccacaccgaccggaucugccgcuucaaguggcugugcuacuccaacgaggcggaggaguucaucuucuuccacgggaacacgagcgugaugcuccccaaccugggcucccggcgcuuccagcccgcccugcucgaccugagcaccgucgaggaccacaacacccaguacuucaacuucguggagcugccggccgccgcccuccgguucaugcccaagcccguguucguccccgacguggcgcugaucgccaaccgcuucaacccggacaaccugaugcacguguuccacgacgaccuccugccccuguucuacacccuccggcaguuccccgggcuggcccacgaggcccgccuguucuucauggagggcuggggcgagggggcccacuucgaccucuacaagcugcugucccccaagcagccgcuccugcgggcgcagcugaagacgcucggccgccugcugugcuucagccacgccuucgucgggcucuccaagaucaccaccugguaccaguacggcuucgugcagccccaggggcccaaggccaacauccuggugagcggcaacgagauccggcaguucgcccgcuucaugaccgagaagcugaacgucucccacacgggcgugccccucggggaggaguacauccugguguucagccggacccagaaccgccugauccucaacgaggccgagcugcugcucgcgcuggcccaggaguuccagaugaagaccgucaccgugucccuggaggaccacacguucgccgacgugguccggcucgugagcaacgccuccaugcuggugagcaugcacggcgcccagcuggucaccacccuguuccucccgcgcggggcgaccguggucgagcuguuccccuacgccgugaaccccgaccacuacacgcccuacaagacccuggccaugcucccgggcauggaccugcaguacguggccuggcggaacaugaugcccgagaacaccgucacccaccccgagcgccccugggaccagggcgggaucacgcaccuggaccgcgcggagcaggcccggauccuccagucccgcgaggugccgcggcaccugugcugccgcaaccccgaguggcuguuccggaucuaccaggacaccaagguggacauccccagccucauccagaccauccgccgggucgugaagggccgccccgggccgcggaagcagaaguggaccgugggccuguaccccgggaagguccgcgaggcccggugccaggccuccgugcacggcgccagcgaggcgcgccugacggugagcuggcagauccccuggaaccucaaguaccugaagguccgggaggugaaguacgagguguggcugcaggagcagggcgagaacaccuacgucccguacauccucgcccugcagaaccacaccuucaccgagaacaucaagcccuucacgaccuaccuggugugggugcgcugcaucuucaacaagauccuccuggggcccuucgccgacguccuggugugcaacaccuga

SEQ ID NO: 34854 - RNA, 1053 nt, Artificial Sequence
  derived and/or modified sequence opt1 from POMK__Homo_sapiens__NP_115613
auggagaagcagccccagaacagccgccggggccuggccccgcgcgaggugccgcccgccgucgggcuccugcugaucauggcgcucaugaacacccugcuguaccucugccuggaccacuucuucaucgcgccccggcaguccaccguggaccccacgcacugccccuacggccacuuccgcaucgggcagaugaagaacugcagccccuggcuguccugcgaggagcuccggaccgaggugcgccagcugaagcgggucggcgagggggccgugaagcgcguguuccugagcgaguggaaggagcacaaggucgcccucucccagcugaccagccuggagaugaaggacgacuuccuccacggccugcagaugcugaagucccuccagggcacccacguggugacgcugcugggguacugcgaggacgacaacaccaugcucaccgaguaccacccccugggcagccuguccaaccucgaggagacccugaaccugagcaaguaccagaacgucaacacguggcagcaccggcucgagcuggccauggacuacguguccaucaucaacuaccugcaccacagcccgguggggacccgcgucaugugcgacuccaacgaccuccccaagacccugagccaguaccugcucaccuccaacuucagcauccuggccaacgaccuggacgcccucccccuggugaaccacuccagcggcaugcuggugaagugcgggcaccgggagcuccacggcgacuucgucgcccccgagcagcuguggccguacggcgaggacgugcccuuccacgacgaccugaugcccuccuacgacgagaagaucgacaucuggaagauccccgacaucagcagcuuccuccuggggcacaucgagggcuccgacauggugcgcuuccaccuguucgacauccacaaggccugcaagagccagacgccguccgagcggcccaccgcgcaggacguccucgagaccuaccagaaggugcuggacacccugcgcgacgccaugaugagccaggcccgggagaugcucuga

SEQ ID NO: 34855 - RNA, 426 nt, Artificial Sequence
  derived and/or modified sequence opt1 from POMP__Homo_sapiens__NP_057016
augaacgcccgcggccuggggagcgagcucaaggacuccauccccgugaccgagcugagcgccuccggcccguucgagagccacgaccugcuccggaagggguucuccugcgucaagaacgagcugcugcccagccacccccucgagcuguccgagaagaacuuccagcugaaccaggacaagaugaacuucagcacccuccgcaacauccagggccuguucgcgccccugaagcuccagauggaguucaaggccgugcagcagguccagcggcugccguuccuguccagcuccaaccucagccuggacgugcugcgcgggaacgacgagacgaucggcuucgaggacauccucaacgaccccucccagagcgaggugaugggcgagccccaccugaugguggaguacaagcuggggcuccuguga

SEQ ID NO: 34856 - RNA, 2016 nt, Artificial Sequence
  derived and/or modified sequence opt1 from POMT1__Homo_sapiens__NP_001070834
augaagcagaucuucuuccuggacgacagcgggcccccguucggccacauggugcucgcccugggcggguaccugggcggguucgacggcaacuuccucuggaaccgcaucggcgccgaguacuccagcaacguccccguguggucccugcggcugcuccccgcgcuggccggggcccugagcgugcccauggccuaccagaucguccucgagcugcacuucucccacugcgccgcgaugggcgccgcccugcucaugcugaucgagaacgcccugaucacccagagccgccucaugcugcuggaguccgugcucaucuucuucaaccugcuggcggugcucagcuaccugaaguucuucaacugccagaagcacuccccguucagccuguccuggugguucuggcucacccugacgggggucgccugcagcugcgccgugggcaucaaguacauggggguguucaccuacguccuggugcucggcguggccgccguccacgcguggcaccuccugggcgaccagacccuguccaacgugugcguguucugccaccuccuggcccgggccgucgcccugcuggugauccccgugguccuguaccuccuguucuucuacgugcaccugauccucguguuccgcagcgggccccacgaccagaucauguccagcgccuuccaggcgucccuggagggcgggcuggcccggaucacccagggccagccccucgaggucgccuucggcagccaggugacgcugcgcaacguguucgggaagccgguccccugcuggcugcacucccaccaggacaccuaccccaugaucuacgagaacggccgggggagcagccaccagcagcaggucacgugcuaccccuucaaggacgugaacaacugguggaucgugaaggacccgcgccggcaccagcucguggucuccagcccgccccgccccgugcggcacggcgacauggugcagcugguccacgggaugaccacccgcucccugaacacccacgacguggccgcgccccucagcccccacucccaggaggugagcugcuacaucgacuacaacaucuccaugcccgcccagaaccuguggcggcuggagaucgucaaccgcggcagcgacaccgacguguggaagaccauccuguccgaggugcgguucguccacgugaacacgagcgccgugcucaagcuguccggcgcccaccuccccgacuggggguaccgccagcuggagaucgucggcgagaagcugagccggggguaccacggcuccaccguguggaacguggaggagcaccgcuacggggccagccaggagcagcgggagcgcgagcgggagcugcacuccccggcccaggucgacgugagccgcaaccucuccuucauggcgcgcuucagcgagcugcaguggcggaugcuggcccuccgcuccgacgacagcgagcacaaguacagcuccagcccccuggagugggugacccuggacaccaacaucgccuacuggcuccacccccggacguccgcccagauccaccuccugggcaacaucgucaucugggugagcggcucccuggcgcuggccaucuacgcccugcucagccugugguaccugcuccgccggcgccggaacgugcacgaccugccccaggacgccuggcugcgcuggguccucgccggggcgcugugcgccggcgggugggccgugaacuaccugccguucuuccucauggagaagacccuguuccuguaccacuaccuccccgcccugaccuuccagauccugcuccugcccgugguccugcagcacaucuccgaccaccucugccggagccagcugcagcgcuccaucuucagcgcccuggugguggcgugguacuccagcgccugccacgucuccaacacccuccggccccugacguacggcgacaagagccuguccccgcacgagcucaaggcccugcgcuggaaggacagcugggacauccugauccggaagcacuga

SEQ ID NO: 34857 - RNA, 2253 nt, Artificial Sequence
  derived and/or modified sequence opt1 from POMT2__Homo_sapiens__NP_037514
augcccccggccaccggcgggggccuggccgagagcgagcuccgcccccggcgcgggcggugcggcccccaggcggcccgcgccgccgggcgggacguggccgcggaggccgucgcccgcucccccaagcggccggccuggggcagccgccgguucgaggcggugggcuggugggcccugcuggcccucgugacccugcuguccuucgccacgcgcuuccaccggcucgacgagccgccccacaucugcugggacgagacccacuucgggaagaugggcagcuacuacaucaaccgcaccuucuucuucgacguccacccgccccuggggaagaugcugaucggccucgccggguaccuguccggcuacgacggcaccuuccuguuccagaagcccggggacaaguacgagcaccacagcuacaugggcaugcggggguucugcgcguuccucggcuccuggcuggugcccuucgccuaccugacggugcucgaccugagcaagucccugagcgccgcccuccugaccgccgcgcugcucaccuucgacaccggcugccugacgcugucccaguacauccuccuggaccccauccugauguucuucaucauggccgccaugcucagcauggucaaguacaacuccugcgccgaccgccccuucagcgcccccuggugguucuggcugucccugaccggggugagccucgcgggcgcccugggggugaaguucgucggccuguucaucauccuccagguggggcugaacaccaucgccgaccugugguaccucuucggcgaccugucccugagccucgugaccgucggcaagcaccugacggcccgggugcugugccucaucgugcugccccuggcccucuacaccgcgaccuucgccguccacuucauggugcuguccaagagcgggcccggcgacggguucuucagcuccgccuuccaggcccgccugagcggcaacaaccuccacaacgcguccaucccggagcaccuggccuacgggagcgugaucaccgucaagaaccugcggauggccaucggcuaccugcacucccaccgccaccucuaccccgagggcaucggggcccggcagcagcaggucacgaccuaccugcacaaggacuacaacaaccuguggaucaucaagaagcacaacaccaacagcgacccccucgaccccuccuucccgguggaguucgugcgccacggcgacaucauccggcuggagcacaaggagaccagccgcaaccugcacucccacuaccacgaggcccccaugacgcgcaagcacuaccaggugaccggguacggcaucaacgggaccggcgacagcaacgacuucuggcggaucgagguggucaaccgcaaguucggcaaccggaucaaggugcuccgcucccggauccgcuucauccaccuggucaccgggugcgugcugggcagcuccgggaaggugcuccccaaguggggcugggagcagcuggaggucacgugcacccccuaccugaaggagacccucaacagcaucuggaacguggaggaccacaucaacccgaagcugcccaacaucucccuggacgugcuccagcccagcuuccccgagauccugcuggagucccacauggucaugauccggggcaacagcgggcucaagccgaaggacaacgaguucaccuccaagcccuggcacuggcccaucaacuaccagggccugcgcuucagcggggugaacgacacggacuuccggguguaccugcucggcaacccggucgugugguggcugaaccugcucagcaucgcgcuguaccugcucuccgggagcaucaucgccguggccaugcagcgcggcgcccggcugcccgccgaggucgcgggccugucccaggugcuccugcgcgggggcggccaggugcugcucggguggacccugcacuacuuccccuucuuccugauggggcggguccucuacuuccaccacuacuuccccgccaugcuguucagcuccaugcugaccggcauccucugggacacccugcugcgccucugcgccuggggccuggccagcuggccgcuggcccgggggauccacguggcgggcauccucucccugcugcucgggacggccuacagcuucuaccuguuccacccccuggccuacggcaugguggggccccucgcccaggacccccaguccccgauggcgggccugcgcuggcuggacagcugggacuucuga

SEQ ID NO: 34858 - RNA, 564 nt, Artificial Sequence
  derived and/or modified sequence opt1 from POMZP3__Homo_sapiens__NP_036362
auggugugcagccccgucacccugcgcaucgccccgcccgaccggcgcuucucccggagcgccauccccgagcagaucaucuccagcacccucuccagccccuccagcaacgcgccggaccccugcgccaaggagacggugcuguccgcccugaaggagaagaagaagaagcgcaccguggaggaggaggaccagaucuuccucgacggccaggagaacaagcggagcugccuggucgacgggcugaccgacgccuccagcgccuucaaggugccccgccccggcccggacacccuccaguucacgguggacgucuuccacuucgcgaacgacucccggaacaugaucuacaucacgugccaccugaaggugacccuggccgagcaggaccccgacgagcucaacaaggccugcagcuucuccaagcccagcaacuccugguuccccguggaggggcuggccgacaucugccagugcugcaacaagggcgacugcgggaccccgagccacucccgccggcagccccgcgucgugagccaguggagcaccuccgcgagccuguga

SEQ ID NO: 34859 - RNA, 1068 nt, Artificial Sequence
  derived and/or modified sequence opt1 from PON1__Homo_sapiens__NP_000437
auggccaagcugaucgcccucacccugcugggcauggggcucgcgcuguuccgcaaccaccagagcuccuaccagacccggcugaacgcccuccgcgaggugcagcccgucgagcugccgaacugcaaccuggugaagggcaucgagacggggagcgaggaccucgagauccugcccaacggccuggccuucaucuccagcgggcucaaguaccccggcaucaaguccuucaaccccaacagcccgggcaagauccugcugauggaccucaacgaggaggaccccaccgugcuggagcuggggaucaccggcuccaaguucgacgucagcuccuucaacccccacgggaucagcaccuucacggacgaggacaacgccauguaccuccugguggugaaccaccccgacgccaaguccaccgucgagcuguucaaguuccaggaggaggagaagucccuccugcaccugaagaccauccggcacaagcuccugccgaaccugaacgacaucguggcggugggccccgagcacuucuacgggaccaacgaccacuacuuccucgaccccuaccugcagagcugggagauguaccugggccucgccuggagcuacgucguguacuacucccccagcgaggugcgcgucguggccgagggcuucgacuucgccaacgggaucaacaucuccccggacggcaaguacguguacaucgcggagcugcuggcccacaagauccacgucuacgagaagcacgccaacuggacgcucacgccccucaagagccuggacuucaacacccugguggacaacaucuccguggaccccgagaccggggaccugugggucggcugccaccccaacggcaugaagaucuucuucuacgacagcgagaacccgcccgccagcgaggugcugcggauccagaacauccucaccgaggagcccaaggugacccaggucuacgccgagaacgggaccgugcugcagggcuccaccguggcgagcgucuacaaggggaagcugcucaucggcacgguguuccacaaggcccuguacugcgagcuguga

SEQ ID NO: 34860 - RNA, 1065 nt, Artificial Sequence
  derived and/or modified sequence opt1 from PON2__Homo_sapiens__NP_000296
augggccgccugguggccgucgggcuccugggcaucgcccuggcgcuccugggggagcggcugcucgcccugcgcaaccggcugaaggccagccgcgagguggaguccguggaccucccccacugccaccugaucaagggcaucgaggccgggagcgaggacaucgacauccugccgaacggccucgccuucuucuccgucggccugaaguuccccgggcugcacagcuucgcgcccgacaagcccggcgggauccucaugauggaccugaaggaggagaagccgcgggcccgcgagcugcggaucucccgcggcuucgaccucgccagcuucaacccccacgggaucuccaccuucaucgacaacgacgacaccguguaccuguucguggucaaccaccccgaguucaagaacacgguggagaucuucaaguucgaggaggccgagaacagccugcuccaccugaagaccgugaagcacgagcugcuccccuccgucaacgacaucaccgcggugggcccggcccacuucuacgccaccaacgaccacuacuucagcgaccccuuccugaaguaccuggagacguaccucaaccugcacugggccaacguggucuacuacucccccaacgaggugaagguggucgccgagggcuucgacagcgcgaacgggaucaacaucucccccgacgacaaguacaucuacguggccgacauccuggcccacgagauccacgugcucgagaagcacaccaacaugaaccugacccagcugaagguccucgagcuggacacccugguggacaaccucagcaucgacccguccagcggcgacaucuggguggggugccaccccaacggccagaagcuguucgucuacgaccccaacaacccgcccuccagcgaggugcugcggauccagaacauccucuccgagaagcccacggugaccaccgucuacgccaacaacggcagcgugcugcaggggagcuccgucgccagcguguacgacggcaagcugcucaucgggacccuguaccaccgcgcgcuguacugcgagcucuga

SEQ ID NO: 34861 - RNA, 1065 nt, Artificial Sequence
  derived and/or modified sequence opt1 from PON3__Homo_sapiens__NP_000931
augggcaagcugguggcccucguccugcugggggugggccucagccuggugggggagauguuccuggccuuccgcgagcgggucaacgcgucccgcgagguggagcccguggagccggagaacugccaccucaucgaggagcuggagagcggcuccgaggacaucgacauccugcccagcgggcucgccuucaucuccagcggccugaaguaccccggcaugcccaacuucgccccggacgagcccgggaagaucuuccugauggaccucaacgagcagaacccccgggcccaggcccuggagaucuccggcggguucgacaaggagcuguucaacccccacggcaucagcaucuucaucgacaaggacaacaccgucuaccucuacguggugaaccacccgcacaugaaguccaccgucgagaucuucaaguucgaggagcagcagcgcagccugguguaccugaagacgaucaagcacgagcuccugaaguccgugaacgacaucgucgugcuggggcccgagcaguucuacgcgacccgggaccacuacuucaccaacagccuccuguccuucuucgagaugauccuggaccuccgcuggaccuacgugcuguucuacagcccccgggaggucaaggugguggccaagggcuucugcuccgccaacggcaucacggucagcgccgaccagaaguacguguacguggcggacgucgccgccaagaacauccacaucauggagaagcacgacaacugggaccugacccagcucaaggugauccagcuggggacccugguggacaaccucaccgucgaccccgccacgggcgacauccuggccgggugccacccgaaccccaugaagcugcucaacuacaaccccgaggacccgcccggcuccgaggugcugcgcauccagaacguccugagcgagaagccccggguguccaccguguacgcgaacaacggcagcguccuccaggggaccagcguggccuccguguaccacggcaagauccugaucgggaccgucuuccacaagacgcuguacugcgagcucuga

SEQ ID NO: 34862 - RNA, 3075 nt, Artificial Sequence
  derived and/or modified sequence opt1 from POP1__Homo_sapiens__NP_001139332
augagcaacgccaaggagcgcaagcacgccaagaagaugcggaaccagcccaccaacgugacccuguccagcggcuucgucgcggaccgcggggugaagcaccacuccggcggggagaagcccuuccaggcccagaagcaggagccccaccccggcacgagccggcagcgccagacccgggugaacccccacucccucccggaccccgaggucaacgagcagagcuccagcaaggggauguuccgcaagaagggcggcuggaaggccgggcccgagggcaccucccaggagauccccaaguacaucaccgccagcacguucgcccaggcgcgggccgccgagaucuccgccaugcugaaggcggugacccagaaguccagcaacagccugguguuccagacccucccgcgccacaugcggcgccgggccaugucccacaacgucaagcgccugccccggcgccugcaggagaucgcccagaaggaggccgagaaggccgugcaccagaagaaggagcacagcaagaacaagugccacaaggcgcggcgcugccacaugaaccggacccucgaguucaaccgccggcagaagaagaacaucuggcuggagacgcacaucuggcacgccaagcgcuuccacauggugaagaaguggggguacugccugggcgagcggcccaccgucaagucccaccgcgccugcuaccgcgccaugaccaaccggugccuccugcaggaccugagcuacuacugcugccucgagcugaaggggaaggaggaggagauccugaaggcccucuccggcaugugcaacaucgacaccggccugacguucgcggccgugcacugccugagcgggaagcgccagggcagccucgugcuguaccgggucaacaaguacccccgcgagaugcuggggccggugaccuucaucuggaagucccagcggacccccggcgaccccagcgagucccgccagcucuggaucuggcugcaccccacccugaagcaggacauccucgaggagaucaaggccgccugccagugcguggagccgaucaagagcgccgucugcaucgcggacccccugcccacgcccucccaggagaagucccagaccgagcugccggacgagaagaucggcaagaagcggaagcgcaaggacgacggggagaacgccaagcccaucaagaagaucaucggcgacgggacccgggaccccugccuccccuacagcuggaucagcccgaccacgggcaucaucaucuccgaccugaccauggagaugaaccgcuuccggcugaucgggccccucagccacuccauccugaccgaggccaucaaggccgccagcgugcacaccgugggcgaggacacggaggagacgccccaccgcugguggaucgagaccugcaagaagcccgacuccgucagccugcacugccggcaggaggcgaucuucgagcuccugggcgggaucaccuccccggccgagauccccgccggcaccauccuggggcucaccgugggcgacccccgcaucaaccugccgcagaagaaguccaaggcccugcccaaccccgagaagugccaggacaacgagaaggugcggcagcuccugcuggaggggguccccguggagugcacccacagcuucaucuggaaccaggacaucugcaagagcgugaccgagaacaagaucuccgaccaggaccucaaccgcaugcggagcgagcugcuggucccgggcagccagcucauccugggcccccacgaguccaagauccccauccugcucauccagcagcccgggaaggugacgggcgaggaccgccugggguggggcagcgggugggacguccugcugccgaagggcuggggcauggcguucuggauccccuucaucuaccgcggggugcgggugggcgggcucaaggaguccgccguccacagccaguacaagcgcucccccaacgugcccggcgacuucccggacugccccgccggcaugcuguucgccgaggagcaggccaagaaccugcucgagaaguacaagcggcgcccgcccgcgaagcggcccaacuacgugaagcuggggacccuggcccccuucugcugccccugggagcagcucacccaggacugggagagccgcguccaggccuacgaggagcccuccguggccagcuccccgaacggcaaggagagcgaccugcggcgcuccgaggugcccugcgcccccaugcccaagaagacccaccagccgagcgacgaggucgggacguccaucgagcacccccgggaggcggaggaggugauggacgccggcugccaggagagcgccgggcccgagcgcaucaccgaccaggaggccuccgagaaccacguggccgcgaccggcagccaccugugcguccuccggucccgcaagcugcugaagcagcucagcgccuggugcggcccgagcuccgaggacagccgcgggggccggcgggcccccgggcgcggccagcaggggcugacccgggaggccugccuguccauccucggccacuucccccgcgcgcuggugugggugagccugucccuccugagcaagggcucccccgagccgcacaccaugaucugcguccccgccaaggaggacuuccugcagcuccacgaggacuggcacuacugcgggccccaggagagcaagcacuccgaccccuuccggagcaagauccugaagcagaaggagaagaagaagcgcgagaagcggcagaagccgggccgcgccuccagcgacgggcccgccggcgaggagcccguggccgggcaggaggcgcugacgcucggccugugguccggcccccugccgcgggugacccuccacugcagccgcacccugcugggguucgucacccagggcgacuucuccauggccguggggugcggcgaggcccucggguucgugagccugacgggccugcucgacaugcuguccagccagcccgccgcccagcgcggccugguccuccugcggccgcccgcgucccugcaguaccgcuucgcccggaucgccaucgagguguga

SEQ ID NO: 34863 - RNA, 663 nt, Artificial Sequence
  derived and/or modified sequence opt1 from POP4__Homo_sapiens__NP_006618
augaaguccgugaucuaccacgcccugucccagaaggaggccaacgacagcgacguccagcccuccggcgcgcagcgcgccgaggccuucgugcgggccuuccucaagcgcagcaccccgcggaugagcccccaggcccgcgaggaccagcugcagcggaaggcggugguccuggaguacuucacccgccacaagcggaaggagaagaagaagaaggccaaggggcucagcgcccgccagcggcgcgagcugcggcuguucgacaucaagcccgagcagcagcgcuacucccucuuccugccccugcacgagcucuggaagcaguacauccgggaccugugcagcggccugaagccggacacgcagccccagaugauccaggccaagcuccugaaggcggaccugcacggggccaucaucuccgugaccaagagcaagugccccuccuacgugggcaucaccgggauccuccugcaggagaccaagcacaucuucaagaucaucacgaaggaggaccgccugaaggucauccccaagcucaacugcguguucaccguggagaccgacggcuucaucagcuacaucuacggcuccaaguuccagcugcggagcuccgagcgcagcgccaagaaguucaaggccaaggggaccaucgaccuguga

SEQ ID NO: 34864 - RNA, 876 nt, Artificial Sequence
  derived and/or modified sequence opt1 from POPDC3__Homo_sapiens__NP_071756
auggagcgcaacagcucccuguggaagaaccucaucgacgagcaccccgugugcaccaccuggaagcaggaggccgagggcgccaucuaccaccuggcgagcauccuguucgucgugggguucaugggcggguccggcuucuucgggcuccuguacguguucagccugcucggccugggcuuccugugcuccgccgucugggccuggguggacgugugcgccgccgacaucuucagcuggaacuucguccucuucgugaucugcuucaugcaguucgugcacaucgcguaccagguccgguccaucacguucgcccgcgaguuccaggugcuguacagcucccuguuccagccgcucgggaucagccugcccguguuccggaccaucgcccuguccagcgaggucgugacccucgagaaggagcacugcuacgccaugcagggcaagaccuccaucgacaagcugagccugcucguguccgggcgcauccgggucacgguggacggcgaguuccugcacuacaucuucccccugcaguuccucgacagccccgagugggacucccugcgcccgaccgaggaggggaucuuccaggugacccugaccgcggagacggacugccgguacgucagcuggcgccggaagaagcucuaccugcuguucgcccagcaccgcuacaucucccgccucuucagcgugcugaucggcagcgacaucgccgacaagcuguacgcccucaacgaccggguguacaucggcaagcgguaccacuacgacauccgccugcccaacuucuaccagauguccacccccgagauccggcgcagcccccugacccagcacuuccagaacucccggcgcuacugcgacaaguga

SEQ ID NO: 34865 - RNA, 1140 nt, Artificial Sequence
  derived and/or modified sequence opt1 from PORCN__Homo_sapiens__NP_001269096
auggugugggucgugcugcucagccugcugugcuaccucgugcuguuccugugccgccacuccagccaccggggcgucuuccucuccgugaccauccugaucuaccugcucaugggggagaugcacaugguggacaccgucacguggcacaagaugcgcggcgcccagaugaucguggccaugaaggcggugagccugggguucgaccuggaccggggcgaggucgggaccgugcccucccccguggaguucaugggcuaccucuacuucgucggcaccaucguguucgggcccuggaucagcuuccacuccuaccugcaggccgugcagggccgcccccugagcugccgguggcuccagaaggucgcccgcucccuggcccuggcccuccugugccuggugcucagcacgugcguggggcccuaccuguucccguacuucaucccccugaacggcgaccggcuccugcgcaaguggcugcgggcguacgaguccgccgucagcuuccacuucuccaacuacuucgugggguuccucagcgaggccaccgccacccuggcgggcgccggcuucaccgaggagaaggaccaccuggagugggaccucaccguguccaagccccugaacgucgagcugccccgcagcaugguggagguggucacguccuggaaccucccgaugagcuacuggcugaacaacuacguguucaagaacgcccugcggcucgggaccuucuccgccguccuggugaccuacgccgcgagcgcccugcuccacggcuucagcuuccaccuggccgccgugcugcucucccuggccuucaucaccuacgucgagcacgugcugcgcaagcggcucgcgcgcauccugagcgccugcgugcuguccaagcggugcccgcccgacugcagccaccagcaccgccucgggcugggcguccgggcccugaaccuccuguucggcgcccuggccaucuuccaccuggcguaccucgggucccuguucgacguggacguggacgacacgaccgaggagcagggcuacgggauggccuacaccguccacaaguggagcgagcuguccugggccagccacugggugaccuucggcugcuggaucuucuaccgccucaucggguga

SEQ ID NO: 34866 - RNA, 2043 nt, Artificial Sequence
  derived and/or modified sequence opt1 from POR__Homo_sapiens__NP_000932
augaucaacaugggcgacagccacguggacaccuccagcaccgucuccgaggccguggccgaggaggugagccuguucuccaugacggacaugauccucuucagccugaucgucgggcugcucaccuacugguuccuguuccgcaagaagaaggaggaggugcccgaguucaccaagauccagacccugacguccagcgugcgggaguccagcuucgucgagaagaugaagaagaccggccgcaacaucaucguguucuacgggucccagaccggcaccgcggaggaguucgccaaccggcucagcaaggacgcccaccgcuacgggaugcggggcauguccgccgacccggaggaguacgaccuggccgaccugagcucccuccccgagaucgacaacgcgcugguggucuucugcauggccacguacggcgagggggaccccaccgacaacgcccaggacuucuacgacuggcugcaggagaccgacguggaccucagcggcgugaaguucgccgucuucgggcugggcaacaagaccuacgagcacuucaacgcgauggggaaguacguggacaagcgccuggagcagcucggcgcccagcggaucuucgagcugggccugggggacgacgacggcaaccucgaggaggacuucaucacguggcgcgagcaguucuggcccgccgugugcgagcacuucggggucgaggccaccggcgaggaguccagcauccggcaguacgagcugguggugcacaccgacaucgacgccgcgaaggucuacaugggcgagauggggcgccugaaguccuacgagaaccagaagccgcccuucgacgccaagaaccccuuccucgccgccgugaccacgaaccggaagcugaaccagggcaccgagcgccaccugaugcaccucgagcuggacaucagcgacagcaagauccgguacgaguccggggaccacguggccgucuaccccgcgaacgacagcgcccuggugaaccagcucggcaagauccugggggccgaccuggacguggucaugucccucaacaaccuggacgaggagagcaacaagaagcacccguuccccugccccaccuccuaccgcaccgcccugacguacuaccucgacaucaccaacccgccccggaccaacgugcuguacgagcuggcccaguacgcgagcgagcccuccgagcaggagcuccugcgcaagauggccagcuccagcggcgagggcaaggagcuguaccucuccugggucguggaggcccggcgccacauccuggccauccugcaggacugccccagccuccggcccccgaucgaccaccugugcgagcugcucccccgccugcaggcccgguacuacuccaucgcgagcuccagcaaggugcaccccaacuccguccacaucugcgccgugguggucgaguacgagaccaaggccgggcgcaucaacaagggcguggccacgaacuggcugcgcgcgaaggagcccgccggggagaacggcgggcgggcccucgugccgauguucguccgcaagagccaguuccggcugcccuucaaggccaccacccccgugaucauggugggccccggcaccggggucgccccguucaucggcuucauccaggagcgcgcguggcugcggcagcaggggaaggaggugggcgagacgcugcucuacuacgggugccgccgguccgacgaggacuaccuguaccgcgaggagcuggcccaguuccaccgggacggcgcccucacccagcugaacguggccuucagccgcgagcagagccacaaggucuacgugcagcaccuccugaagcaggaccgggagcaccuguggaagcugaucgagggcggggcccacaucuacgugugcggcgacgcgcgcaacauggcccgggacguccagaacaccuucuacgacaucguggccgagcucggggccauggagcacgcccaggcgguggacuacaucaagaagcugaugaccaagggccgcuacucccuggacgucuggagcuga

SEQ ID NO: 34867 - RNA, 2340 nt, Artificial Sequence
  derived and/or modified sequence opt1 from POSTN__Homo_sapiens__NP_001129406
augauccccuuccugccgauguucagccuccugcugcuccugaucgugaaccccaucaacgccaacaaccacuacgacaagauccuggcccacucccgcauccggggccgcgaccaggggcccaacgucugcgcgcuccagcagauccugggcaccaagaagaaguacuucagcacgugcaagaacugguacaagaaguccaucugcgggcagaagaccaccgugcuguacgagugcugccccggcuacaugcggauggaggggaugaagggcugcccggccgugcuccccaucgaccacgucuacggcacccuggggaucgugggcgccaccacgacccagcgcuacagcgacgccuccaagcugcgggaggagaucgaggggaagggcagcuucaccuacuucgcccccuccaacgaggcgugggacaaccucgacagcgacauccgccgggggcuggaguccaacgugaacgucgagcugcucaacgcccugcacagccacaugaucaacaagcgcaugcugaccaaggaccucaagaacggcaugaucauccccuccauguacaacaaccugggccuguucaucaaccacuacccgaacgggguggugacggucaacugcgcccggaucauccacggcaaccagaucgccaccaacgggguggugcacgucaucgaccgcgugcucacccagaucggcaccagcauccaggacuucaucgaggcggaggacgaccuguccagcuuccgggccgccgccaucacguccgacauccuggaggcccucggccgcgacgggcacuucacccuguucgcgcccaccaacgaggccuucgagaagcugccccggggcgugcucgagcgcaucaugggggacaaggucgccagcgaggcccugaugaaguaccacauccugaacacccuccagugcuccgagagcaucaugggcggggccguguucgagacgcuggagggcaacaccaucgagaucggcugcgacggggacuccaucaccgugaacggcaucaagauggucaacaagaaggacaucgugaccaacaacggggugauccaccugaucgaccagguccucauccccgacagcgcgaagcaggucaucgagcuggccggcaagcagcagacgaccuucaccgaccugguggcccagcucgggcuggccagcgcccugcggccggacggcgaguacacccuccuggcgcccgugaacaacgccuucuccgacgacacgcugagcauggaccagcgccuccugaagcugauccuccagaaccacauccugaaggugaaggucggccugaacgagcucuacaacgggcagauccuggagaccaucggcgggaagcagcugcggguguucguguaccgcaccgccgucugcaucgagaacuccugcauggagaagggcagcaagcaggggcggaacggcgccauccacaucuuccgcgagaucaucaagcccgccgagaagucccugcacgagaagcucaagcaggacaagcgguucagcaccuuccugucccugcucgaggcggccgaccugaaggagcugcucacgcagcccggcgacuggacccuguucgugccgaccaacgacgccuucaaggggaugaccagcgaggagaaggagauccugauccgcgacaagaacgcccuccagaacaucauccuguaccaccugacgcccggcguguucaucgggaagggcuucgagcccggcgucaccaacauccucaagaccacccagggguccaagaucuuccugaaggaggugaacgacacgcugcucgugaacgagcucaagagcaaggaguccgacaucaugaccaccaacggcgucauccacgugguggacaagcugcuguaccccgcggacaccccggucgggaacgaccagcugcuggagauccucaacaagcugaucaaguacauccagaucaaguucgugcgcggcagcaccuucaaggagauccccgugacggucuacaagcccaucaucaagaaguacaccaagaucaucgacggggugcccguggagaucaccgagaaggagacccgggaggagcgcaucaucacgggcccggagaucaaguacacccggaucuccaccggcgggggcgagaccgaggagacgcugaagaagcuccugcaggaggaggucaccaaggugaccaaguucaucgagggcggggacgggcaccuguucgaggacgaggagaucaagcgccuccugcagggcgacacccccgugcggaagcugcaggccaacaagaagguccagggcagccgccggcgccuccgggaggggcgcucccaguga

SEQ ID NO: 34868 - RNA, 1905 nt, Artificial Sequence
  derived and/or modified sequence opt1 from POT1__Homo_sapiens__XP_006715980
augagccuggugcccgccaccaacuacaucuacacgccccucaaccagcugaagggcgggaccaucgucaacguguacggcguggucaaguucuucaagccgcccuaccuguccaaggggaccgacuacugcagcguggugaccaucgucgaccagaccaacgugaagcucacgugccugcuguucuccggcaacuacgaggcccuccccaucaucuacaagaacggggacaucgugcgcuuccaccggcugaagauccaggucuacaagaaggagacccagggcaucaccagcuccggcuucgcgagccugaccuucgaggggacgcucggcgcccccaucaucccccgcaccuccagcaaguacuucaacuucaccaccgaggaccacaagaugguggaggcccugcgggugugggccuccacgcacaugagccccuccuggacccugcucaagcugugcgacguccagcccaugcaguacuucgaccugaccugccagcuccuggggaaggccgagguggacggcgcgagcuuccugcucaaggugugggacgggacccgcacgccguuccccuccuggcggguccugauccaggaccuggugcucgagggcgaccugagccacauccaccgccugcagaaccucaccaucgacauccugguguacgacaaccacguccacguggcccggucccugaaggugggcagcuuccuccgcaucuacucccugcacaccaagcugcagagcaugaacuccgagaaccagaccaugcucagccuggaguuccaccuccacgggggcacgagcuacgggcggggcauccgcguccugcccgaguccaacagcgacguggaccagcugaagaaggaccuggaguccgccaaccucaccgccaaccagcacagcgacgugaucugccaguccgagcccgacgacagcuucccguccagcggcuccgucagccuguacgagguggagcggugccagcagcuguccgcgaccauccucaccgaccaccaguaccuggagcgcacgccccugugcgccauccucaagcagaaggcgccccagcaguaccggauccgcgccaagcugcggagcuacaagccccgccggcuguuccaguccgucaagcuccacugcccgaagugccaccuccugcaggaggugccccacgagggggaccuggacaucaucuuccaggacggcgccaccaagacccccgacgugaagcugcagaacaccagccuguacgacuccaagaucuggacgaccaagaaccagaaggggcgcaaggucgccgugcacuucgugaagaacaacggcauccugccccucagcaacgagugccugcugcucaucgagggcgggacccuguccgagaucugcaagcugagcaacaaguucaacuccgucaucccggugcggagcggccacgaggaccucgagcugcuggaccucagcgcccccuuccugauccaggggaccauccaccacuacggcugcaagcagugcuccagccugcgcuccauccagaaccucaacagccugguggacaagacguccuggauccccagcuccgucgccgaggcccuggggaucgugccccuccaguacguguucgucaugaccuucacccuggacgacggcaccggggugcuggaggccuaccucauggacagcgacaaguucuuccagaucccggcguccgaggugcugauggacgacgaccugcagaaguccgucgacaugaucauggacauguucugcccgcccggcaucaagaucgacgccuaccccuggcucgagugcuucaucaagagcuacaacgugacgaacggcaccgacaaccagaucugcuaccagaucuucgacaccaccguggccgaggacgucaucuga

SEQ ID NO: 34869 - RNA, 1755 nt, Artificial Sequence
  derived and/or modified sequence opt1 from POTED__Homo_sapiens__NP_778146
augguggccgaggucugcagcaugcccaccgccuccaccgugaagaagccguucgaccugcgcagcaagaugggcaaguggugccaccaccgguuccccugcugccgcggguccggcaagagcaacauggggacguccggcgaccacgacgacagcuucaugaagaugcuccgguccaagauggggaagugcugccgccacugcuuccccugcugccggggcagcggcaccuccaacguggggaccagcggcgaccacgagaacuccuucaugaagaugcugcgcagcaagauggggaaguggugcugccacugcuuccccugcugccggggcuccggcaagagcaacgucggggcguggggcgacuacgaccacuccgccuucauggagccgcgcuaccacauccggcgcgaggaccuggacaagcuccaccgggccgccuggugggggaaggugccccgcaaggaccugaucgugaugcugcgggacaccgacaugaacaagcgcgacaaggagaagcggacggcccuccaccuggcgagcgccaacggcaacuccgaggucgugcagcugcuccuggaccgccggugccagcugaacgugcucgacaacaagaagcgcaccgcccugaucaaggccauccagugccaggaggacgagugcguccugaugcuccuggagcacggggcggaccggaacauccccgacgaguacggcaacaccgcccugcacuacgccaucuacaacgaggacaagcucauggccaaggcccugcugcucuacggcgcggacaucgagagcaagaacaagugcgggcugacgccccugcuccugggcgugcacgagcagaagcagcaggucgugaaguuccugaucaagaagaaggccaaccucaacgugcuggaccgcuacgggcggaccgcccugauccucgccgugugcugcggcuccgccagcaucgucaaccugcugcucgagcagaacguggacgugagcucccaggaccugagcgggcagaccgcgcgcgaguacgccgucuccagccaccaccacgugaucugcgagcugcucuccgacuacaaggagaagcagaugcugaagaucagcuccgagaacagcaacccggagcaggaccugaagcucaccuccgaggaggagagccagcgccugaagguguccgagaacagccagcccgagaagaugucccaggagcccgagaucaacaaggacugcgaccgggaggucgaggaggagaucaagaagcacggcagcaaccccgugggccugccggagaaccucaccaacggggccuccgccggcaacggggacgacggccugaucccccagcgccggagccgcaagcccgagaaccagcaguuccccgacacggagaacgaggaguaccacuccgacgagcagaacgacacccggaagcagcugagcgaggagcagaacaccgggaucucccaggacgagauccucaccaacaagcagaagcagaucgagguggccgagcagaagaugaacagcgagcugagccugucccacaagaaggaggaggaccuccugcgcgagaacagcguccugcaggaggagaucgcgaugcugcggcucgagcuggacgagacgaagcaccagaaccagcugcgcgagaacaagauccucgaggagaucgaguccgugaaggagaagaccgacaagcugcugcgggccaugcagcucaacgaggaggcccugaccaagaccaacaucuga

SEQ ID NO: 34870 - RNA, 3228 nt, Artificial Sequence
  derived and/or modified sequence opt1 from POTEF__Homo_sapiens__NP_001093241
augguggucgagguggacagcaugcccgccgccuccagcgugaagaagcccuucggccugcgcuccaagauggggaaguggugcugccggugcuuccccugcugccgcgagagcggcaaguccaacgucgggaccagcggcgaccacgacgacuccgcgaugaagacccuccggagcaagauggggaaguggugccgccacugcuuccccugcugccggggcuccggcaagagcaacgugggggccuccggcgaccacgacgacagcgccaugaagacgcugcgcaacaagauggggaaguggugcugccacugcuuccccugcugccggggcuccagcaaguccaaggugggggccuggggcgacuacgacgacagcgccuucauggagccgcgcuaccacguccggggcgaggaccuggacaagcuccaccgcgcggccuggugggggaaggugccccggaaggaccugaucgugaugcugcgcgacaccgacgucaacaagcaggacaagcagaagcggaccgcccuccaccuggccuccgcgaacggcaacagcgagguggugaagcugcuccuggaccgccggugccagcugaacguccucgacaacaagaagcgcaccgcccugaucaaggccgugcagugccaggaggacgagugcgcccugaugcuccuggagcacgggacggaccccaacauccccgacgaguacggcaacaccacccugcacuacgccaucuacaacgaggacaagcucauggcgaaggcccugcugcucuacggcgccgacaucgaguccaagaacaagcacgggcugaccccgcugcuccugggcgugcacgagcagaagcagcaggucgugaaguuccugaucaagaagaaggccaaccucaacgcccuggaccgguacgggcgcacggcgcugauccucgccgugugcugcggcagcgccagcaucgucucccugcugcucgagcagaacaucgacgugagcucccaggaccugagcgggcagaccgcccgggaguacgccguguccagccaccaccacgucaucugccagcugcucuccgacuacaaggagaagcagaugcugaagaucagcuccgagaacagcaaccccgagcaggaccugaagcucaccuccgaggaggagagccagcgcuucaagggcuccgagaacagccagcccgagaagaugucccaggagcccgagaucaacaaggacggcgaccgggagguggaggaggagaugaagaagcacgagagcaacaacguggggcugcuggagaaccucaccaacggcgucacggcggggaacggcgacaacgggcugaucccgcagcgcaagucccgcacccccgagaaccagcaguuccccgacaacgagagcgaggaguaccaccggaucugcgagcugcucuccgacuacaaggagaagcagaugcccaaguacagcagcgagaacuccaacccggagcaggaccugaagcugaccagcgaggaggagucccagcgccucaagggcagcgagaacggccagcccgagaagcggucccaggagcccgagaucaacaaggacggggaccgcgagcuggagaacuucauggccaucgaggagaugaagaagcaccggagcacccacgugggcuuccccgagaaccugacgaacggggccaccgccggcaacggggacgacggccugaucccgccccgcaagucccggacccccgagagccagcaguuccccgacaccgagaacgaggaguaccacuccgacgagcagaacgacacgcagaagcaguucugcgaggagcagaacaccggcauccuccacgacgagauccugauccacgaggagaagcagaucgaggucguggagaagaugaacagcgagcugucccucagcugcaagaaggagaaggacauccugcacgagaacuccacccugcgcgaggagaucgccaugcuccggcuggagcuggacaccaugaagcaccagagccagcuccgcgagaagaaguaccuggaggacaucgaguccgugaagaagcggaacgacaaccugcucaaggcgcugcagcugaacgagcucacgauggacgacgacaccgccguccuggugaucgacaacgggagcggcaugugcaaggccggguucgccggcgacgacgcgccgcgcgccguguuccccuccaucgucggccggccccgccagcaggggaugaugggcgggaugcaccagaaggagagcuacgugggcaaggaggcccagagcaagcgggggauccugacccucaaguaccccauggagcacggcaucaucaccaacugggacgacauggagaagaucuggcaccacacguucuacaacgagcugcgcguggccccggaggagcaccccguccugcucaccgaggccacccugaaccccaaggcgaaccgggagaagaugacccagaucauguucgagacguucaacaccccggccauguacguggccauccaggccgugcugucccucuacaccagcggccgcaccacggggaucgucauggacuccggcgacggggugacccacaccgugcccaucuacgagggcaacgcccugccccacgcgacccugcggcucgaccuggccgggcgcgagcugcccgacuaccucaugaagauccugaccgagcacggcuaccgcuucacgaccauggccgagcgggagaucguccgcgacaucaaggagaagcugugcuacguggcccucgacuucgagcaggagauggccaccguggcgagcuccagcucccuggagaaguccuacgagcugccggacggccaggucaucaccaucgggaacgagcgguuccgcugccccgaggcccucuuccagcccugcuuccugggcauggagagcugcgggauccacgagacgaccuucaacagcaucaugaaguccgacguggacauccggaaggaccuguacaccaacaccgugcucagcggcgggacgaccauguaccccggcauggcccaccgcaugcagaaggagaucgccgcgcuggccccguccaugaugaagauccggaucaucgccccgcccaagcgcaaguacagcgucugggugggcggguccauccuggccagccucuccaccuuccagcagauguggaucagcaagcaggaguacgacgaguccggccccagcaucgugcaccggaagugccuguga

SEQ ID NO: 34871 - RNA, 1527 nt, Artificial Sequence
  derived and/or modified sequence opt1 from POTEG__Homo_sapiens__NP_001005356
augguggccgaggccggcagcaugcccgcggccuccagcgucaagaagccguucgggcugcgcuccaagaugggcaaguggugccggcacugcuuccccuggugccgcgggagcggcaaguccaacguggggaccagcggcgaccacgacgacuccgccaugaagacccuccggagcaagaugggcaaguggugccgccacugcuuccccuggugccggggguccagcaaguccaacgugggcacgagcggggaccacgacgacuccgccaugaagacccugcgcagcaagaugggcaaguggugcugccacugcuuccccugcugccggggguccggcaagagcaaggucggcccguggggcgacuacgacgacuccgccuucauggagccccgcuaccacgugcggcgcgaggaccuggacaagcuccaccgggcggccuggugggggaaggugccccgcaaggaccugaucgucaugcugaaggacaccgacaugaacaagaaggacaagcagaagcggaccgcccuccaccuggccagcgcgaacgggaacuccgagguggugaagcugcuccuggaccgccggugccagcugaacauccucgacaacaagaagcgcacggcccugaccaaggccguccagugccgggaggacgagugcgcccugaugcuccuggagcacggcaccgaccccaacaucccggacgaguacggcaacaccgcccugcacuacgcgaucuacaacgaggacaagcucauggccaaggcccugcugcucuacggggccgacaucgagagcaagaacaagcacggccugacgccccugcuccugggggugcacgagcagaagcagcaggucgugaaguuccugaucaagaagaaggccaaccucaacgcgcuggaccgcuacggccggaccgcccugauccucgccgugugcugcgggagcgccuccaucgugagccugcugcucgagcagaacaucgacgucuccagccaggaccuguccggccagaccgcccgcgaguacgcggugagcucccaccacaacgugaucugccagcugcucagcgacuacaaggagaagcagaugcugaaggucuccagcgagaacuccaaccccgagcaggaccugaagcucaccagcgaggaggagucccagcggcugaagggcagcgagaacucccagcccgaggagaugagccaggagccggagaucaacaagggcggggaccgcaagguggaggaggagaugaagaagcacggguccacgcacaugggcuuccccgagaaccugcccaacggggccaccgccgacaacggcgacgacggccucaucccgccccgcaagagccggacccccgagucccagcaguuccccgacaccgagaacgagcaguaccacagcgacgagcagaacgacacgcagaagcagcugagcgaggagcagaacaccgggauccugcaggacgagauccucauccacgaggagaagcagaucgagguggccgagaacgaguucuga

SEQ ID NO: 34872 - RNA, 1638 nt, Artificial Sequence
  derived and/or modified sequence opt1 from POTEH__Homo_sapiens__NP_001129685
augguggccgaggccggcagcaugcccgcggccuccagcgucaagaagccguucgggcugcgcuccaagaugggcaaguggugccggcacugcuucgccuggugccgcgggagcggcaaguccaacguggggaccagcggcgaccacgacgacuccgccaugaagacccuccggagcaagaugggcaaguggugcugccacugcuuccccuggugccgcggguccggcaagagcaacguggggacguccggcgaccacgacgacagcgccaugaagacccugcgguccaagauggggaaguggugcugccacugcuuccccugcugccgcggcagcggcaaguccaacgucgggaccagcggcgaccacgacgacuccgcgaugaagacccugcggagcaagauggggaaguggugcugccacugcuuccccugcugccgcggcuccggcaagaacaagguggggccguggggcgacuacgacgacagcgccuucauggagccccgguaccacgugcgccgggaggaccucgacaagcugcaccgcgccgccuggugggggaaggucccccggaaggaccugaucgugaugcucaaggacacggacaugaacaagaaggacaagcagaagcgcaccgcgcugcaccuggccagcgccaacggcaacuccgagguggucaagcuccugcuggaccggcgcugccagcucaacauccuggacaacaagaagcggaccgcccugaccaaggccgugcagugccaggaggacgagugcgcgcucaugcugcuggagcacgggacggaccccaacaucccggacgaguacggcaacaccgcccuccacuacgccaucuacaacgaggacaagcugauggccaaggcccugcuccuguacggcgcggacaucgagagcaagaacaagcacgggcugacgccccuccugcugggcgugcacgagcagaagcagcaggucgugaaguuccucaucaagaagaaggccaaccugaacgcccuggaccgcuacgggcggaccgcccucauccuggccgugugcugcggcuccgcgagcaucgucucccugcuccuggagcagaacaucgacgugagcucccaggaccugagcgggcagaccgcccgcgaguacgccguguccagccggcacaacgucaucugccagcuccuguccgacuacaaggagaagcagauccugaaggugagcuccgagaacagcaaccccgagcaggaccucaagcugaccuccgaggaggagagccagcgccugaagggcuccgagaacagccagcccgaggagaugucccaggagccggagaucaacaagggcggggaccgcaagguggaggaggagaugaagaagcacggcagcacccacaugggguuccccgagaaccucaccaacggcgccacggccgacaacggggacgacggccugaucccgccccgcaagagccggacccccgagucccagcaguuccccgacaccgagaacgagcaguaccacagcgacgagcagaacgacacccagaagcagcuguccgaggagcagaacacgggcauccuccaggacgagauccugauccacgaggagaagcagaucgaggucgcggagaacgaguucuga

SEQ ID NO: 34873 - RNA, 1527 nt, Artificial Sequence
  derived and/or modified sequence opt1 from POTEM__Homo_sapiens__NP_001138914
augguggccgaggccggcagcaugcccgcggccuccagcgucaagaagccguucgggcugcgcuccaagaugggcaaguggugccggcacugcuuccccuggugccgcgggagcggcaaguccaacguggggaccagcggcgaccacgacgacuccgccaugaagacccuccggagcaagaugggcaaguggugccgccacugcuuccccuggugccggggguccggcaagagcaacguggggacguccggcgaccacgacgacagcgccaugaagacccugcgcuccaagauggggaaguggugcugccacugcuuccccugcugccggggcagcggcaaguccaaggucgggccguggggcgacuacgacgacagcgccuucauggagccccgcuaccacgugcggcgcgaggaccuggacaagcuccaccgggcggccuggugggggaaggugccccgcaaggaccugaucgucaugcugaaggacaccgacaugaacaagaaggacaagcagaagcggaccgcccuccaccuggccuccgcgaacggcaacagcgagguggugaagcugcuccuggaccgccggugccagcugaacauccucgacaacaagaagcgcacggcccugaccaaggccguccagugccaggaggacgagugcgcccugaugcuccuggagcacggcaccgaccccaacaucccggacgaguacgggaacaccgcccugcacuacgcgaucuacaacgaggacaagcucauggccaaggcccugcugcucuacggcgccgacaucgaguccaagaacaagcacgggcugacgccccugcuccugggcgugcacgagcagaagcagcaggucgugaaguuccugaucaagaagaaggccaaccucaacgcgcuggaccgguacgggcgcaccgugcugauccucgccgugugcugcggcagcgccagcaucgucucccugcugcucgagcagaacaucgacgugagcucccaggaccugagcggccagaccgcccgggaguacgccguguccagccgccacaacgucaucugccagcugcucuccgacuacaaggagaagcagauccugaaggugagcuccgagaacagcaaccccgagcaggaccugaagcucaccuccgaggaggagagccagcggcugaagggguccgagaacagccagcccgaggagaugucccaggagccggagaucaacaagggcggggaccgcaagguggaggaggagaugaagaagcacggcagcacgcacaugggguuccccgagaaccugcccaacggcgcgaccgccgacaacggcgacgacgggcucaucccgccccgcaagucccggacccccgagagccagcaguuccccgacaccgagaacgagcaguaccacuccgacgagcagaacgacacgcagaagcagcugagcgaggagcagaacaccggcauccugcaggacgagauccucauccacgaggagaagcagaucgaggucgccgagaacgaguucuga

SEQ ID NO: 34874 - RNA, 876 nt, Artificial Sequence
  derived and/or modified sequence opt1 from POU1F1__Homo_sapiens__NP_000297
augagcugccaggccuucaccuccgccgacaccuucaucccccugaacagcgacgcguccgccacgcucccgcugaucaugcaccacagcgccgccgagugccugcccguguccaaccacgccaccaacgucaugagcaccgcgaccggccuccacuacuccgugcccagcugccacuacgggaaccagcccuccacguacggcgugauggccgggagccugaccccgugccuguacaaguuccccgaccacacccucucccacggcuucccgcccauccaccagccccugcuggccgaggaccccaccgccgcggacuucaagcaggagcuccgccgcaagagcaagcuggucgaggagcccaucgacauggacucccccgagauccgggagcuggagaaguucgccaacgaguucaaggugcggcgcaucaagcucggguacacgcagaccaacgugggcgaggcccuggccgccguccacggcagcgaguucucccagaccaccaucugccgguucgagaaccugcagcucagcuucaagaacgcgugcaagcugaaggccauccuguccaaguggcucgaggaggccgagcaggucggggcccuguacaacgagaaggugggcgccaacgagcgcaagcggaagcgccggacgaccaucagcaucgcggccaaggacgcccuggagcgccacuucggggagcagaacaagccguccagccaggagaucaugcggauggccgaggagcucaaccuggagaaggagguggugcgcgugugguucugcaaccggcgccagcgggagaagcgcgucaagaccagccugaaccagucccucuucagcaucuccaaggagcaccuggagugccgguga

SEQ ID NO: 34875 - RNA, 771 nt, Artificial Sequence
  derived and/or modified sequence opt1 from POU2AF1__Homo_sapiens__NP_006226
augcuguggcagaagcccaccgccccggagcaggcccccgcgcccgcccgccccuaccagggcgugcgggucaaggagccggugaaggagcuccugcgccggaagcgcgggcacgccagcuccggcgccgcccccgcgcccaccgccgugguccugccccaccagccgcucgccacguacaccaccguggggcccagcugccuggacauggagggcuccgugagcgccgucaccgaggaggcggcccugugcgccggguggcucucccagcccacgcccgccacccugcagccgcuggcccccuggacccccuacaccgaguacgugccccacgaggcggugagcugcccguacuccgccgacauguacguccagcccgugugccccagcuacacgguggucggccccuccagcgugcucaccuacgccuccccgccccugaucaccaacgugaccacgcggagcuccgccacccccgccgucgggcccccgcuggagggccccgagcaccaggcgccccucaccuacuuccccuggccgcagccccugagcacccugcccacguccacccuccaguaccagccgcccgcccccgcccugcccggcccgcaguucgugcagcugcccaucagcauccccgagcccgugcuccaggacauggaggacccgcgccgggccgccuccagccugaccaucgacaagcugcuccuggaggaggaggacuccgacgcguacgcccugaaccacacccucagcgucgagggguucuga

SEQ ID NO: 34876 - RNA, 2268 nt, Artificial Sequence
  derived and/or modified sequence opt1 from POU2F1__Homo_sapiens__NP_001185712
augcuggacugcagcgacuacgugcucgacucccgcaugaacaaccccagcgagaccuccaagccgagcauggaguccggcgacgggaacaccggcacgcagaccaacgggcuggacuuccagaagcagcccguccccgugggcggggccaucagcaccgcccaggcgcaggccuuccugggccaccuccaccaggugcagcuggccggcaccucccugcaggccgccgcgcagagccucaacguccaguccaagagcaacgaggaguccggggacagccagcagcccucccagccgagccagcagcccuccgugcaggccgccaucccccagacgcagcugaugcuggccggcgggcagaucaccggccucacccugacccccgcgcagcagcagcugcuccugcagcaggcccaggcccaggcccagcugcucgccgcggccgugcagcagcacagcgccucccagcagcacagcgccgccggggcgacgaucuccgccagcgccgccaccccgaugacccagaucccccugagccagcccauccagaucgcccaggaccugcagcagcuccagcagcugcagcagcagaaccugaaccuccagcaguucguccuggugcaccccaccacgaaccugcagccggcgcaguucaucaucucccagacgccccagggccagcagggccuccugcaggcccagaaccugcucacccagcugccccagcagagccaggccaaccugcuccagucccagcccagcaucacccugaccucccagccggccacccccacccggaccaucgccgcgacgcccauccagacccugccccagagccaguccaccccgaagcgcaucgacacccccagccucgaggagcccuccgaccuggaggagcuggagcaguucgccaagacguucaagcagcggcgcaucaagcucggguucacccagggcgacguggggcuggccaugggcaagcuguacggcaacgacuucagccagaccaccaucucccgguucgaggcccucaaccugagcuucaagaacaugugcaagcugaagccccuccuggagaaguggcugaacgacgcggagaaccucuccagcgacuccagccuguccagcccguccgcccugaacagccccgggaucgagggccucagccgccggcgcaagaagcggacguccaucgagaccaacauccgcgucgcccuggagaaguccuuccuggagaaccagaagcccaccuccgaggagaucaccaugaucgccgaccagcugaacauggagaaggaggugauccgggugugguucugcaaccgccggcagaaggagaagcgcaucaacccgcccagcuccgggggcacgagcuccagccccaucaaggccaucuuccccuccccgaccagccucgucgcgaccacccccucccuggugacgagcuccgccgccaccacccugaccgugagccccguccucccccugaccuccgccgccgugacgaaccugagcgugaccgggaccuccgacaccacgagcaacaacaccgcgaccgucaucagcaccgccccgcccgccuccagcgccgugacgucccccagccucucccccagcccguccgccagcgcguccaccagcgaggccuccagcgccuccgagaccagcaccacgcagaccaccuccacgccccugagcagcccccugggcaccagccaggugauggucaccgccuccggccuccagaccgcggccgccgccgcccugcagggggcggcccagcugcccgccaacgccagccucgccgcgauggccgccgccgccggccugaacccgagccugauggcgcccucccaguucgccgccgggggcgcccuccugagccugaaccccgggacccucuccggcgcgcugagccccgcccugauguccaacagcacgcucgccaccauccaggcccuggccuccggcgggagccugccgaucaccucccucgacgcgaccggcaaccugguguucgccaacgccgggggcgcccccaacaucgugacggcgccccuguuccucaacccccagaaccugagccugcucaccuccaacccggucagccugguguccgccgccgccgccagcgccgggaacuccgcgcccgucgccagccugcacgccaccuccaccagcgccgaguccauccagaacagccucuucacgguggccagcgcguccggcgccgccagcaccaccaccacggccuccaaggcgcaguga

SEQ ID NO: 34877 - RNA, 1440 nt, Artificial Sequence
  derived and/or modified sequence opt1 from POU2F2__Homo_sapiens__NP_001193954
auggugcacagcuccaugggcgcccccgagauccgcaugagcaagccccuggaggccgagaagcaggggcucgacucccccagcgagcacaccgacaccgagcggaacggccccgacacgaaccaccagaacccccagaacaagaccucccccuucagcgucucccccaccgggcccagcaccaagaucaaggcggaggaccccuccggcgacagcgccccggccgcgccccugccgccccagccggcccagccccaccucccccaggcccagcugaugcugacggggucccagcuggccggcgacauccagcagcuccugcagcugcagcagcucgugcuggugcccggccaccaccuccagccgcccgcccaguuccugcugccccaggcccagcagagccagcccgggcugcucccgacccccaaccuguuccagcugccccagcagacccagggcgcgcuccugaccucccagccccgcgccgggcugccgacgcaggccgucacccggcccacccuccccgacccccaccugagccacccgcagccgcccaagugccuggagccgcccucccaccccgaggagcccagcgaccucgaggagcuggagcaguucgcccgcaccuucaagcagcggcgcaucaagcugggcuucacgcagggggacgugggccucgccaugggcaagcuguacgggaacgacuucucccagaccaccaucagccgguucgaggcgcugaaccucuccuucaagaacaugugcaagcugaagccgcugcucgagaaguggcugaacgacgccgagaccaugagcguggacagcucccugcccagccccaaccagcucuccagccccucccugggcuucgacgggcugccgggccgccggcgcaagaagcggacgagcaucgagaccaacguccgcuucgcccucgagaaguccuuccuggccaaccagaagcccaccagcgaggagauccugcucaucgccgagcagcugcacauggagaaggaggugauccgggugugguucugcaaccgccggcagaaggagaagcgcaucaaccccugcuccgcggcccccaugcugccgagccccggcaagcccgccuccuacagcccccacauggucaccccgcagggcggggccgggacgcucccccugucccaggccagcuccagccuguccaccaccgugaccacgcucagcuccgcggugggcacccugcaccccagccggaccgccgggggcggcgggggcgggggcggggccgccccgccccugaacagcauccccuccgucaccccgccgccgcccgccacgaccaacagcaccaaccccagcccccagggcucccacuccgcgaucggccugagcgggcucaaccccuccaccggccccgggcugugguggaaccccgcccccuaccagcccuga

SEQ ID NO: 34878 - RNA, 1317 nt, Artificial Sequence
  derived and/or modified sequence opt1 from POU2F3__Homo_sapiens__NP_001231611
auggagagcccccgcaccgccaagggcgggcgggacaucaagauguccggcgacguggccgacagcaccgacgcgcgcuccacgcugagccaggucgagccggggaacgaccggaacggccucgacuucaaccgccagaucaagaccgaggaccuguccgacagccugcagcagacccucucccaccggcccugccaccugagccaggggcccgccaugauguccggcaaccagaugagcggccugaacgccucccccugccaggacauggccagccuccacccgcugcagcagcuggugcucgugcccgggcaccuccaguccgucagccaguuccugcugucccagacccagcccggccagcaggggcugcagcccaaccugcucccguucccccagcagcagagcggccugcugcucccccagacggggcccggccuggccucccaggcguucggccacccggggcugcccggcagcucccucgagccccaccuggaggccagccagcaccuccccgugccgaagcaccuccccagcuccgggggcgccgacgagcccagcgaccuggaggagcuggagaaguucgccaagaccuucaagcagcgccggaucaagcugggcuucacccagggggacgugggccuggcgauggggaagcuguacggcaacgacuucucccagaccacgaucagccgcuucgaggcccucaaccuguccuucaagaacaugugcaagcugaagccccuccuggagaaguggcugaacgacgccgagagcuccccgagcgaccccuccgucagcacccccuccagcuaccccucccucagcgagguguucgggcggaagcgcaagaagcggaccuccaucgagaccaacauccgccugacgcuggagaagcgguuccaggacaacccgaagcccagcuccgaggagaucagcaugaucgccgagcagcucuccauggagaaggaggugguccgcgugugguucugcaaccggcgccagaaggagaagcggaucaacugccccguggccacccccaucaagccgcccgucuacaacagccgccuggugagccccuccggcagccugggcccgcucuccgugccgcccguccacagcaccaugcccgggaccgugacguccagcugcucccccggcaacaacagccggcccuccagccccggguccggccugcacgcgagcucccccaccgccagccagaacaacuccaaggccgccgugaacagcgccuccagcuucaacagcuccgggagcugguaccgcuggaaccacuccaccuaccugcacuga

SEQ ID NO: 34879 - RNA, 1332 nt, Artificial Sequence
  derived and/or modified sequence opt1 from POU3F2__Homo_sapiens__NP_005595
auggccaccgccgcgagcaaccacuacucccugcucaccagcuccgccagcaucgugcacgccgagcccccgggcgggaugcagcagggcgccgggggcuaccgcgaggcccagucccugguccagggggacuacggcgcgcugcagagcaacggccacccccucucccacgcccaccaguggaucaccgcccugagccacgggggcgggggcgggggcggcgggggcgggggcggcgggggcgggggcgggggcggcgggggcgacgggucccccuggagcaccagcccccugggccagccggacaucaagcccuccguggugguccagcagggcgggcggggcgacgagcuccacgggcccggcgcccugcagcagcagcaccagcagcagcagcagcagcagcagcagcagcagcagcagcagcagcagcagcagcagcagcagcggcccccgcaccuggugcaccacgcggccaaccaccaccccgggcccggcgccuggcgcuccgccgccgcggccgcccaccucccgcccagcaugggggccuccaacggcggccugcuguacagccagcccuccuucaccgugaacgggaugcucggcgccgggggccagcccgcgggccugcaccaccacgggcugcgcgacgcccacgacgagccccaccacgccgaccaccacccccacccccacagccacccccaccagcagcccccgcccccgcccccgccccagggcccgcccgggcaccccggcgcccaccacgacccccacuccgacgaggacacccccacgagcgacgaccucgagcaguucgccaagcaguucaagcagcggcgcaucaagcugggguucacccaggcggacgucggccuggcccucggcacccuguacgggaacguguucagccagaccacgaucugccgguucgaggcccugcagcucuccuucaagaacaugugcaagcugaagccgcugcucaacaaguggcuggaggaggccgacagcuccagcggcucccccaccagcaucgacaagaucgccgcgcaggggcgcaagcggaagaagcgcaccuccaucgaggugagcgucaagggcgcccuggagucccacuuccucaagugccccaagcccagcgcccaggagaucaccucccuggccgacagccugcagcucgagaaggagguggugcgggucugguucugcaaccgccggcagaaggagaagcgcaugacgccgcccgggggcacccugcccggcgcggaggacguguacgggggcucccgggacacgcccccgcaccacggggugcagacccccguccaguga

SEQ ID NO: 34880 - RNA, 1503 nt, Artificial Sequence
  derived and/or modified sequence opt1 from POU3F3__Homo_sapiens__NP_006227
auggccaccgccgcgagcaaccccuaccugccgggcaacucccuccuggccgccgggagcaucgugcacuccgacgccgccggcgcggggggcgggggcggcgggggcgggggcgggggcggcgggggcgccgggggcggcgggggcgggaugcagcccggcagcgccgccgucaccuccggggcguaccgcggcgaccccagcuccgugaagauggugcagagcgacuucaugcagggcgccauggccgccuccaacgggggccacaugcugagccacgcccaccagugggucacggcgcucccccacgccgccgccgccgcggccgccgccgccgcggccgccguggaggccuccagcccgugguccgggagcgccgugggcauggcgggguccccccagcagcccccccagccgcccccccccccgccccagggccccgacgucaagggcggggccggccgggacgaccugcacgccgggaccgcccugcaccaccgcggccccccgcaccucgggcccccccccccgcccccccaccagggccaccccggcggguggggcgcggccgccgccgccgcggccgccgccgccgcggccgccgccgccgcgcaccugccgagcauggccgggggccagcagccccccccccagucccugcucuacagccagccgggcggguucaccgugaacggcaugcuguccgccccccccgggccgggcgggggcggcgggggcgccgggggcggggcgcagagccuggugcaccccggccucguccggggcgacacccccgagcuggccgagcaccaccaccaccaccaccaccacgcccacccccacccgccccacccccaccacgcccaggggcccccgcaccacggcgggggcgggggcggcgccgggcccggccugaacagccacgacccccacuccgacgaggacacgcccaccagcgacgaccucgagcaguucgcgaagcaguucaagcagcgccggaucaagcugggguucacccaggccgacgugggccuggcccucgggacccuguacggcaacguguucucccagacgaccaucugccgcuucgaggcccugcagcucagcuucaagaacaugugcaagcugaagccgcugcucaacaaguggcuggaggaggccgacuccagcaccggcucccccaccagcaucgacaagaucgcggcccaggggcggaagcgcaagaagcggacguccaucgaggucagcgugaagggcgcccuggagucccacuuccucaagugccccaagcccagcgcccaggagaucaccaaccuggccgacucccugcagcucgagaaggaggugguccgcgugugguucugcaaccggcgccagaaggagaagcggaugaccccgcccgggauccagcagcagacccccgacgacguguacagccaggucggcacgguguccgcggacacccccccgccccaccacggccugcagaccagcgugcaguga

SEQ ID NO: 34881 - RNA, 1086 nt, Artificial Sequence
  derived and/or modified sequence opt1 from POU3F4__Homo_sapiens__NP_000298
auggccaccgccgcgagcaaccccuacuccauccugagcuccaccagccucgugcacgccgacuccgccggcaugcagcaggggagcccguuccgcaacccccagaagcugcugcaguccgacuaccuccagggcguccccagcaacgggcacccccugggccaccacugggugacgucccugagcgacgggggcccgugguccagcacccucgccaccagcccccuggaccagcaggacgugaagcccggccgggaggaccugcagcucggggccaucauccaccaccgcagcccccacgucgcgcaccacuccccgcacaccaaccaccccaacgccuggggcgccagccccgcccccaacccguccaucacguccuccgggcagccccugaacguguacagccagcccggcuucaccgugagcgggaugcuggagcacggcggccucacgcccccgcccgcggccgccuccgcccagagccugcaccccguccugcgggagcccccggaccacggggagcucggcucccaccacugccaggaccacagcgacgaggagacccccaccuccgacgagcuggagcaguucgccaagcaguucaagcagcgccggaucaagcugggguucacccaggcggacgugggccucgcccugggcacccuguacgggaacguguucagccagaccacgaucugccgcuucgaggcccuccagcuguccuucaagaacaugugcaagcugaagccccuccugaacaaguggcuggaggaggccgacagcuccaccggcagccccaccuccaucgacaagaucgccgcgcaggggcggaagcgcaagaagcggaccagcaucgaggucuccgugaagggcgugcucgagacgcacuuccugaagugcccgaagcccgccgcccaggagaucagcucccuggccgacagccuccagcuggagaaggaggucgugcgcgugugguucugcaaccggcgccagaaggagaagcggaugaccccgcccggggaccagcagccccacgaggucuacucccacaccgugaagaccgacacgagcugccacgaccuguga

SEQ ID NO: 34882 - RNA, 1260 nt, Artificial Sequence
  derived and/or modified sequence opt1 from POU4F1__Homo_sapiens__NP_006228
augaugagcaugaacuccaagcagccccacuucgccaugcacccgacccugcccgagcacaaguaccccagccuccacuccagcuccgaggccauccgccgggcgugccugcccaccccgccccugcagagcaaccucuucgccucccuggacgagacgcugcucgcccgcgccgaggcccuggcggccguggacaucgccgucagccagggcaagucccaccccuucaagcccgacgccaccuaccacaccaugaacagcgugccgugcaccuccacgagcaccgugccccuggcgcaccaccaccaccaccaccaccaccaccaggcccucgagcccggggaccugcuggaccacaucuccagccccucccucgcccugauggccggcgccgggggcgcgggggccgccgccggcggcgggggcgcccacgacgggccgggcgggggcggcgggcccggcgggggcggcgggcccggcgggggccccgggggcggcgggggcgggggccccgggggcggcgggggcgggccgggcgggggccugcucggcgggagcgcgcacccccacccccacaugcacucccugggccaccugagccacccggccgccgccgccgcgaugaacaugcccuccgggcucccccaccccggccuggucgccgccgccgcccaccacggcgcggccgccgccgcggccgccgccgccgcgggccagguggccgccgccagcgccgcggccgccguggucggggccgccgggcuggcgagcaucugcgacuccgacaccgacccgcgggagcucgaggccuucgccgagcgcuucaagcagcggcgcaucaagcugggcgugacccaggccgacguggggagcgcgcuggccaaccucaagauccccggcgucggcucccugagccaguccacgaucugccgguucgagagccugacccucucccacaacaacaugaucgcccugaagcccauccugcaggccuggcucgaggaggccgagggggcgcagcgcgagaagaugaacaagcccgagcuguucaacggcggggagaagaagcggaagcgcaccagcaucgccgccccggagaagcggucccuggaggccuacuucgccgugcagccccgccccagcuccgagaagaucgcggccaucgccgagaagcucgaccugaagaagaacgugguccgggugugguucugcaaccagcgccagaagcagaagcggaugaaguucagcgccaccuacuga

SEQ ID NO: 34883 - RNA, 1230 nt, Artificial Sequence
  derived and/or modified sequence opt1 from POU4F2__Homo_sapiens__NP_004566
augaugaugaugagccugaacuccaagcaggccuucagcaugccccacggcgggucccuccacguggagccgaaguacagcgcccugcacuccaccagccccggcuccagcgcgcccaucgcccccuccgccagcuccccgagcuccagcuccaacgccgggggcgggggcggcgggggcgggggcgggggcggcgggggcgggcgcagcuccagcuccagcagcuccggcagcuccggcgggggcgggagcgaggccaugcggcgcgcgugccugcccaccccgcccuccaacaucuucggcgggcucgacgagagccugcuggcccgggccgaggcccucgcggccgucgacaucgugucccagagcaagucccaccaccaccacccgccccaccacagccccuucaagcccgacgccacguaccacaccaugaacaccauccccugcaccuccgccgccagcuccagcuccgugcccaucagccaccccuccgcgcuggccggcacgcaccaccaccaccaccaccaccaccaccaccaccaccagccccaccaggcccuggagggcgagcuccuggagcaccugagcccggggcucgcccugggcgccauggcggggcccgacggcgccgucguguccacccccgcccacgcgccccacauggccaccaugaacccgaugcaccaggccgcccugagcauggcccacgcccacgggcuccccagccacaugggcugcauguccgacguggacgccgacccccgcgaccuggaggcguucgccgagcgguucaagcagcgccggaucaagcugggcgucacccaggccgacguggggagcgcccucgcgaaccugaagauccccggcguggggucccugagccaguccacgaucugccgcuucgagagccucacccugucccacaacaacaugaucgcccugaagccgauccuccaggccuggcuggaggaggccgagaagucccaccgggagaagcugaccaagcccgagcuguucaacggcgccgagaagaagcgcaagcggaccagcaucgcggcccccgagaagcgcagccucgaggccuacuucgccauccagccccggccguccagcgagaagaucgccgcgaucgccgagaagcuggaccucaagaagaacgucgugcgcgugugguucugcaaccagcggcagaagcagaagcgcaugaaguacuccgccgggaucuga

SEQ ID NO: 34884 - RNA, 1017 nt, Artificial Sequence
  derived and/or modified sequence opt1 from POU4F3__Homo_sapiens__NP_002691
augauggccaugaacagcaagcagcccuucggcaugcacccggugcugcaggagcccaaguucuccagccuccacuccgggagcgaggccaugcgccgggucugccugcccgcgccccagcugcagggcaacaucuucggguccuucgacgagagccuccuggcccgcgccgaggcccuggccgcgguggacaucgugucccacggcaagaaccacccguucaagcccgacgccaccuaccacaccaugagcuccguccccugcacgagcaccuccagcaccgugcccaucucccacccggccgcccucaccagccacccccaccacgcggugcaccaggggcuggagggcgaccugcucgagcacaucucccccacgcugagcgucuccggccugggggcccccgagcacagcgugaugccggcccagauccacccccaccaccucggcgccauggggcaccuccaccaggccaugggcaugucccacccccacaccguggcgccccacagcgccaugccggccugccugagcgacgucgaguccgacccccgggagcuggaggccuucgccgagcgcuucaagcagcggcgcaucaagcugggggugacccaggcggacgugggcgccgcccuggccaaccucaagauccccggcgucgggagccugucccagagcaccaucugccgguucgagucccugacgcucagccacaacaacaugaucgcccugaagcccgugcugcaggcguggcucgaggaggccgaggccgccuaccgcgagaagaacuccaagccggagcuguucaacggcagcgagcggaagcgcaagcggaccuccaucgccgcgcccgagaagcgcagccuggaggccuacuucgccauccagccccggcccuccagcgagaagaucgccgcgaucgccgagaagcucgaccugaagaagaacgugguccgcgugugguucugcaaccagcggcagaagcagaagcgcaugaaguacuccgccgugcacuga

SEQ ID NO: 34885 - RNA, 1080 nt, Artificial Sequence
  derived and/or modified sequence opt1 from POU5F1B__Homo_sapiens__NP_001153014
auggccggccaccuggccagcgacuucgcguucagcccgccgcccgggggcgggggcgacgggcccuggggcgccgagcccggcuggguggacccccucaccuggcuguccuuccaggggccgcccggcgggcccggcaucgggcccggcgucggccccggguccgagguguggggcaucccgcccugcccgccgcccuacgagcugugcgggggcauggccuacugcggcccccaggugggggucggccucgugccccagggcgggcuggagaccagccagcccgaguccgaggccggggugggcgucgagagcaacuccaacggcgccagccccgagcccugcacggugccgcccggggcggugaagcuggagaaggagaagcucgagcagaaccccgagaagucccaggacaucaaggcccugcagaaggagcuggagcaguucgccaagcuccugaagcagaagcgcaucacccugggcuacacccaggccgacgucgggcucauccugggcgugcuguucgggaagguguucagccagaagaccaucugccgguucgaggcgcuccagcuguccuucaagaacaugugcaagcugcgcccccuccugcagaagugggucgaggaggccgacaacaacgagaaccugcaggagaucugcaaggccgagacgcucaugcaggcccggaagcgcaagcggaccagcaucgagaaccgcgugcggggcaaccuggagaaccuguuccuccagugccccaagcccacccugcagaucucccacaucgcccagcagcugggccucgagaaggacgugguccgcgugugguucugcaaccggcgccagaaggggaagcggagcuccagcgacuacgcgcagcgcgaggacuucgaggccgccggcucccccuucagcgggggccccguguccuucccgcccgcccccgggccccacuucggcacccccggcuacgggagcccccacuucacggcccuguacagcuccguccccuucccggagggcgagguguucccgcccgugagcgucaucacccuggggucccccaugcacagcaacuga

SEQ ID NO: 34886 - RNA, 495 nt, Artificial Sequence
  derived and/or modified sequence opt1 from POU5F1__Homo_sapiens__NP_001272915
augugcaagcugcgcccccuccugcagaaguggguggaggaggccgacaacaacgagaaccugcaggagaucugcaaggccgagacccucguccaggcgcggaagcgcaagcggaccagcaucgagaaccgcgugcggggcaaccuggagaaccuguuccuccagugcccgaagcccacgcugcagcagaucucccacaucgcccagcagcuggggcucgagaaggacgugguccgcgugugguucugcaaccggcgccagaagggcaagcggagcuccagcgacuacgcccagcgcgaggacuucgaggccgccgggucccccuucagcggcgggcccguguccuucccgcuggcgcccggcccccacuucggcacccccggguacggcagcccgcacuucaccgcccuguacuccagcguccccuuccccgagggggaggccuucccgcccguguccgugaccacgcucggcagccccaugcacuccaacuga

SEQ ID NO: 34887 - RNA, 906 nt, Artificial Sequence
  derived and/or modified sequence opt1 from POU6F1__Homo_sapiens__NP_002693
augcccggcaucagcucccagauccugaccaacgcccagggccaggugaucgggacccucccgugggucgugaacagcgccuccguggcggcccccgcccccgcccagagccugcagguccaggccgugacgccccagcugcuccugaacgcgcagggccaggugaucgccacccuggccuccagcccgcucccgccgcccgucgccgugcgcaagcccuccacccccgagagccccgcgaaguccgaggugcagcccauccagcccacccccacggucccccagcccgccguggugaucgccagcccggcccccgccgcgaagcccuccgccagcgcccccaucccgaucacgugcuccgagacccccaccgucagccagcugguguccaagccccacacccccagccuggacgaggacgggaucaaccucgaggagauccgggaguucgccaagaacuucaagauccgccggcugucccuggggcucacccagacccaggugggccaggcccugaccgcgacggagggcccggccuacagccaguccgccaucugccgcuucgagaagcuggacaucacccccaagagcgcccagaagcucaagcccguccuggagaaguggcugaacgaggccgagcuccggaaccaggaggggcagcagaaccugauggaguucgugggcggggagcccagcaagaagcgcaagcggcgcaccuccuucaccccgcaggcgaucgaggcccugaacgccuacuucgagaagaacccccuccccacgggccaggagaucaccgagaucgccaaggagcugaacuacgaccgggaggugguccgcgugugguucugcaaccggcgccagacccugaagaacaccagcaagcucaacguguuccagaucccguga

SEQ ID NO: 34888 - RNA, 1968 nt, Artificial Sequence
  derived and/or modified sequence opt1 from POU6F2__Homo_sapiens__NP_001159490
augagcgcccugcuccaggaccccaugaucgccggccagguguccaagccgcugcugagcguccgcuccgagaugaacgcggagcuccgcggggaggacaaggccgccaccagcgacuccgagcugaacgagccccugcucgcccccguggagagcaacgacuccgaggacacccccagcaagcuguucggcgcccgggggaacccggcgcuguccgaccccggcacgcccgaccagcaccaggccagccagacccacccgcccuuccccguggggccccagccccuccugaccgcccagcagcuggccuccgcggucgccggcgugaugccgggcgggccgcccgcccucaaccagcccauccugauccccuucaacauggccggccagcucgggggccagcaggggcuggugcugacccugcccacggccaaccucaccaacauccagggccuggucgcggccgccgccgccggcgggaucaugacccugccccuccagaaccugcaggcgaccagcucccugaacagccagcuccagcagcugcagcugcagcuccagcagcagcagcagcagcagcagcagcagcccccgcccuccacgaaccagcacccccagcccgccccgcaggcccccagccagucccagcagcagccccugcagcccaccccgccccagcagcccccgcccgccagccagcagccgcccgcccccaccucccagcugcagcaggcgccccagccccagcagcaccagccccacagccacagccagaaccagaaccagccgucccccacccagcagagcuccagcccgccccagaagcccucccagagccccggccacgggcuccccagcccccugacgccgcccaacccccugcagcucgugaacaacccccuggccucccaggccgccgccgcggccgccgccauguccagcaucgcguccagccaggccuucggcaacgcccuguccagccuccagggcgugaccgggcagcuggucaccaacgcccagggccagaucaucgggaccaucccgcugaugcccaaccccggccccuccagccaggccgcguccgggacgcagggccuccaggugcagccgaucacgccccagcugcugaccaacgcccagggccagaucaucgccaccgugaucgggaaccagauccuccccgucaucaacacccagggcaucacccugagcccgaucaagcccgggcagcagcugcaccagcccucccagaccagcgugggccaggccgccagccaggggaaccuccugcaccuggcgcacucccaggccagcaugucccagagccccgugcggcaggccuccagcuccagcuccagcuccagcuccagcuccgcccucagcgucggccagcugguguccaacccgcagaccgccgcgggcgagguggacggggucaaccuggaggagauccgcgaguucgccaaggccuucaagauccggcgccugagccucggccugacgcagacccagguggggcaggcccugagcgcgaccgagggccccgccuacucccagagcgccaucugccgguucgagaagcucgacaucacccccaaguccgcccagaagaucaagcccgugcuggagcgcuggauggccgaggcggaggcccggcaccgcgccgggaugcagaaccugacggaguucaucggcagcgagccguccaagaagcggaagcgccggaccagcuucacgccccaggcccucgagauccugaacgcccacuucgagaagaacacccaccccuccggccaggagaugaccgagaucgcggagaagcugaacuacgaccgcgaggucgugcgggugugguucugcaacaagcgccaggcccucaagaacaccaucaagcggcugaagcagcacgagcccgccaccgccgucccgcuggagccccucaccgacagccuggaggagaacuccuga

SEQ ID NO: 34889 - RNA, 870 nt, Artificial Sequence
  derived and/or modified sequence opt1 from PPA1__Homo_sapiens__NP_066952
augagcggcuucuccaccgaggagcgcgccgcccccuucagccuggaguaccggguguuccucaagaacgagaaggggcaguacaucuccccguuccacgacauccccaucuacgcggacaaggacgucuuccacauggugguggaggucccccgcuggagcaacgccaagauggagaucgccaccaaggacccccugaacccgaucaagcaggacgugaagaagggcaagcugcgguacguggccaaccucuuccccuacaagggguacaucuggaacuacggcgccaucccccagacgugggaggaccccgggcacaacgacaagcacaccggcugcugcggcgacaacgacccgaucgacgucugcgagaucggguccaaggugugcgcgcgcggcgagaucaucggggugaagguccugggcauccuggccaugaucgacgagggggagaccgacuggaaggugaucgccaucaacguggacgaccccgacgccgcgaacuacaacgacaucaacgacgucaagcggcucaagcccggcuaccuggaggccaccguggacugguuccgccgguacaaggugcccgacggcaagccggagaacgaguucgccuucaacgccgaguucaaggacaaggacuucgccaucgacaucaucaagagcacgcacgaccacuggaaggcgcuggucaccaagaagaccaacgggaagggcaucuccugcaugaacaccacgcucagcgagucccccuucaagugcgaccccgacgccgcccgcgccaucguggacgcccugcccccgcccugcgagagcgcgugcaccgugcccaccgacgucgacaagugguuccaccaccagaagaacuga

SEQ ID NO: 34890 - RNA, 918 nt, Artificial Sequence
  derived and/or modified sequence opt1 from PPA2__Homo_sapiens__NP_008834
augagcgcccugcuccgccugcugcggaccggcgcccccgcggccgccugccuccgccuggggaccuccgccggcacggggagccggcgcgccauggcgcuguaccacaccgaggagcggggccagccgugcucccagaacuaccgccucuucuucaagaacgugaccgggcacuacaucagccccuuccacgacaucccccugaaggucaacuccaaggaggagaacggcauccccaugaagaaggcccggaacgacgaguacgagaaccuguucaacaugaucguggagaucccgcgcuggaccaacgccaagauggagaucgccacgaaggagcccaugaaccccaucaagcaguacgugaaggacggcaagcuccgguacgucgcgaacaucuuccccuacaagggguacaucuggaacuacggcacccugccgcagauccugagcugcggggaggugauccacgugaagauccucggcauccuggcccugaucgacgagggggagaccgacuggaagcucaucgccaucaacgccaacgaccccgaggccuccaaguuccacgacaucgacgacgucaagaaguucaagcccggcuaccuggaggcgacccugaacugguuccgccucuacaaggugcccgacggcaagccggagaaccaguucgccuucaacggggaguucaagaacaaggccuucgcccuggaggugaucaagagcacgcaccagugcuggaaggcccugcucaugaagaagugcaacggcggggcgaucaacugcaccaacguccagaucuccgacagccccuuccggugcacccaggaggaggcccgcucccugguggagagcguguccagcucccccaacaaggagagcaacgaggaggagcaggucuggcacuuccugggcaaguga

SEQ ID NO: 34891 - RNA, 855 nt, Artificial Sequence
  derived and/or modified sequence opt1 from PPAP2A__Homo_sapiens__NP_003702
auguucgacaagacccgccugcccuacguggcccucgacguccugugcgugcugcucgccggccugccguucgcgauccugaccagccggcacacgcccuuccagcgcgggguguucugcaacgacgaguccaucaaguaccccuacaaggaggacaccauccccuacgcccuccugggcgggaucaucaucccguucagcaucaucgucaucauccugggcgagacccucuccguguacugcaaccugcugcacagcaacuccuucauccggaacaacuacaucgccaccaucuacaaggccaucgggacguuccucuucggcgccgcggccagccagucccugaccgacaucgccaaguacagcaucggccgccugcggccccacuuccucgacgugugcgaccccgacugguccaagaucaacugcagcgacggguacaucgaguacuacaucugccgcggcaacgccgagcgggucaaggaggggcgccuguccuucuacagcggccacuccagcuucuccauguacugcaugcuguucguggcgcucuaccugcaggcccggaugaagggggacugggcccgccugcuccggcccacccugcaguucggccugguggccgucagcaucuacgugggccucucccgcgugagcgacuacaagcaccacugguccgacguccugaccgggcugauccagggcgcccucguggcgauccugguggccgucuacgugagcgacuucuucaaggagcggacgagcuucaaggagcgcaaggaggaggacucccacaccacccugcacgagaccccgacgaccgggaaccacuaccccagcaaccaccagcccuga

SEQ ID NO: 34892 - RNA, 867 nt, Artificial Sequence
  derived and/or modified sequence opt1 from PPAP2C__Homo_sapiens__NP_003703
augcagcgccgguggguguucguccugcucgacgugcugugccugcucguggccagccugcccuucgccauccugacccucgucaacgcgccguacaagcgcggcuucuacugcggggacgacuccauccgguaccccuaccgccccgacaccaucacgcacggccugauggccggggugaccaucaccgccaccgugauccuggucagcgccggcgaggccuaccucguguacacggaccggcuguacucccgcagcgacuucaacaacuacguggcggccgucuacaaggugcuggggaccuuccucuucggcgccgccgugucccagagccugaccgaccuggcgaaguacaugaucggccggcuccgccccaacuuccuggccgucugcgacccggacuggucccgggugaacugcagcguguacguccagcuggagaaggugugccgcgggaaccccgccgacgugaccgaggcccggcucuccuucuacagcggccacuccagcuucgggauguacugcauggucuuccuggcccuguacgugcaggcgcgccucugcuggaagugggcccggcugcugcgccccacggugcaguucuuccucgucgccuucgcccuguacgugggcuacacccggguguccgacuacaagcaccacuggagcgacguccugguggggcuccugcagggcgcccuggucgcggcccucaccgugugcuacaucuccgacuucuucaaggcccggcccccgcagcacugccugaaggaggaggagcuggagcgcaagcccagccucucccugacccugacgcucggcgaggccgaccacaaccacuacggguacccccacagcuccagcuga

SEQ ID NO: 34893 - RNA, 795 nt, Artificial Sequence
  derived and/or modified sequence opt1 from PPAPDC1B__Homo_sapiens__NP_001096029
augggcaaggccgccgcggccguggccuucggggccgaggucggcgugcgccuggcccucuucgcggccuuccuggugaccgagcugcugcccccguuccagcggcucauccagcccgaggagauguggcuguaccgcaaccccuacgucgaggccgaguacuuccccaccaagccgauguucgugaucgccuuccucagcccccugucccugaucuuccucgcgaaguuccugaagaaggccgacacgcgggacagccgccaggccugccuggccgccucccucgcgcuggcccugaacgggguguucaccaacaccaucaagcucaucgucggccggccccgccccgacuucuucuaccggugcuucccggacgggcuggcccacagcgaccugaugugcaccggcgacaaggacguggugaacgagggccgcaaguccuuccccagcgggcacuccagcuucgccuucgccggccucgcguucgccuccuucuaccuggccgggaagcugcacugcuucacgccccagggccgggggaaguccuggcgcuucugcgccuuccucagcccccugcuguucgccgcggucaucgcccucagccggaccugcgacuacaagcaccacuggcaggacgugcuggugggcuccaugaucggcaugaccuucgccuacgucugcuaccgccaguacuacccgccccugaccgacgccgagugccacaagcccuuccaggacaagcucgugcugagcacggcccagaagcccggggacuccuacugcuucgacaucuga

SEQ ID NO: 34894 - RNA, 888 nt, Artificial Sequence
  derived and/or modified sequence opt1 from PPAPDC2__Homo_sapiens__NP_982278
augcccagcccgcgccgguccauggagggccgcccccugggggugagcgccuccagcuccagcuccagccccggcucccccgcccacgggggcgggggcggcgggagccgguucgaguuccagucccuccugagcucccgcgcgaccgccgucgacccgaccugcgcccggcugcgcgccagcgagucccccgugcaccggcgcggcagcuucccccucgccgcggccgggcccucccagagcccggccccgccccugcccgaggaggaccggauggaccugaaccccuccuuccucggcaucgcccugcgcagccugcucgcgaucgaccuguggcugagcaagaagcucggggugugcgccggcgaguccagcuccuggggcagcguccggccccugaugaagcugcucgagaucuccgggcacggcauccccuggcugcuggggacgcucuacugccugugccgcagcgacuccugggccggccgggaggugcugaugaaccuccuguucgcccugcuccuggaccugcuccugguggcccugaucaagggccucguccgccggcgccggcccgcgcacaaccagauggacauguucgugacccugagcguggacaaguacuccuucccgagcgggcacgccacccgcgccgcccugaugucccgguucauccucaaccaccugguccuggccaucccccuccgcgugcuggugguccugugggcguucgugcucggccugagccgggugaugcuggggcgccacaacgucaccgacguggccuucggcuucuuccucggguacaugcaguacuccaucguggacuacugcuggcugagcccccacaacgcccccguccuguuccuccuguggucccagcgcuga

SEQ ID NO: 34895 - RNA, 816 nt, Artificial Sequence
  derived and/or modified sequence opt1 from PPAPDC3__Homo_sapiens__NP_116117
augcccgccagccagucccgcgcccgggcgcgcgaccggaacaacgugcugaaccgcgccgaguuccucagccugaaccagccgcccaagggcgggcccgagccccgguccagcggccgcaaggccuccgggccgagcgcccagcccccgcccgccggcgacggggcgcgggagcgccggcagucccagcagcugcccgaggaggacugcaugcagcucaaccccagcuucaagggcaucgccuucaacucccugcuggccaucgacaucugcaugagcaagcgccucggcgucugcgccgggcgggcggccuccugggccagcgcccgcuccauggugaagcugaucggcaucaccgggcacggcauccccuggaucgggggcaccauccugugccucgucaagagcuccacccuggccggccaggaggugcugaugaaccuccugcuggcgcuccugcuggacaucaugaccguggccggggugcagaagcucaucaagcggcgcggccccuacgagaccagcccgucccugcuggacuaccucaccauggacaucuacgccuuccccgccgggcacgccagccgggcggccauggucuccaaguucuuccugagccaccuggugcucgccgugccccugcgcguccugcucgugcugugggcccugugcgugggccucagccgggucaugaucggccgccaccacgugacggacgugcuguccggguucgucaucggcuaccugcaguuccggcucguggagcugguguggaugcccagcuccacgugccagaugcugaucagcgccugguga

SEQ ID NO: 34896 - RNA, 1407 nt, Artificial Sequence
  derived and/or modified sequence opt1 from PPARA__Homo_sapiens__XP_011528545
augguggacaccgagagcccccugugcccgcucuccccgcuggaggccggcgaccuggagagcccccucuccgaggaguuccugcaggagauggggaacauccaggagaucagccaguccaucggcgaggacagcuccgggagcuucggcuucaccgaguaccaguaccugggguccugccccggcagcgacggcuccgucaucacggacacccucagccccgccuccagccccuccagcgugaccuaccccgugguccccggguccguggacgagagcccguccggcgcgcugaacaucgagugccgcaucugcggggacaaggccagcggcuaccacuacggggugcacgccugcgagggcugcaagggcuucuuccggcgcaccauccggcugaagcucgucuacgacaagugcgaccgcagcugcaagauccagaagaagaaccggaacaagugccaguacugccgcuuccacaagugccuguccguggggaugagccacaacgccauccgguucggccgcaugccccgguccgagaaggccaagcugaaggcggagauccucacgugcgagcacgacaucgaggacagcgagaccgccgaccugaagucccuggccaagcgcaucuacgaggccuaccucaagaacuucaacaugaacaaggugaaggcgcgggucauccugagcgggaaggccuccaacaacccgcccuucgugauccacgacauggagacccugugcauggccgagaagacccucguggccaagcuggucgccaacggcauccagaacaaggaggcggaggugcgcaucuuccacugcugccagugcacgagcguggagaccgucaccgagcugaccgaguucgccaaggccauccccggcuucgccaaccucgaccugaacgaccaggugacgcugcucaaguacgggguguacgaggccaucuucgcgaugcuguccagcgucaugaacaaggacggcaugcugguggccuacgggaacggcuucaucacccgggaguuccucaagucccugcgcaagcccuucugcgacaucauggagcccaaguucgacuucgccaugaaguucaacgcccuggagcucgacgacagcgacaucucccuguucguggccgcgaucaucugcugcggggaccggcccggccugcucaacgucggccacaucgagaagaugcaggaggggaucgugcacgugcugcgccugcaccuccagagcaaccacccggacgacaucuuccuguuccccaagcugcuccagaagauggccgaccugcggcagcuggucaccgagcacgcccagcucgugcagaucaucaagaagaccgaguccgacgccgcccugcacccccugcuccaggagaucuaccgcgacauguacuga

SEQ ID NO: 34897 - RNA, 1209 nt, Artificial Sequence
  derived and/or modified sequence opt1 from PPARD__Homo_sapiens__NP_001165290
augcaccagcgcgaccugagccgguccagcuccccgcccagccuccuggaccagcugcagaugggcugcgacggggccuccugcggcagccucaacauggagugccgcgugugcggggacaaggccuccggcuuccacuacgggguccacgcgugcgagggcugcaagggcuucuuccggcgcaccauccggaugaagcuggaguacgagaagugcgagcgcagcugcaagauccagaagaagaaccggaacaagugccaguacugccgcuuccagaagugccuggcccucgggaugucccacaacgccauccgguucggccgcaugcccgaggccgagaagcggaagcugguggccgggcugaccgcgaacgagggcagccaguacaacccccagguggccgaccucaaggccuucuccaagcacaucuacaacgccuaccugaagaacuucaacaugacgaagaagaaggcgcgcagcauccugaccgggaaggccucccacaccgcccccuucgucauccacgacaucgagacccucuggcaggccgagaagggccugguguggaagcagcuggugaacggccucccgcccuacaaggagaucagcguccacguguucuaccggugccagugcacgaccguggagaccguccgcgagcugaccgaguucgccaaguccauccccagcuucuccagccuguuccucaacgaccaggugacgcugcugaaguacggggugcacgaggcgaucuucgccaugcucgccuccaucgucaacaaggacggccugcugguggccaacgggagcggcuucgugacccgggaguuccuccgcagccugcggaagcccuucuccgacaucaucgagccgaaguucgaguucgccgucaaguucaacgcgcuggagcucgacgacagcgaccuggcccuguucaucgccgccaucauccucugcggcgaccgccccgggcugaugaacgugccccggguggaggccauccaggacaccauccugcgcgcgcucgaguuccaccuccaggccaaccaccccgacgcccaguaccuguucccgaagcugcugcagaagauggccgaccugcggcagcucgucaccgagcacgcccagaugaugcagcgcaucaagaagacggagaccgagaccucccugcacccccugcuccaggagaucuacaaggacauguacuga

SEQ ID NO: 34898 - RNA, 2397 nt, Artificial Sequence
  derived and/or modified sequence opt1 from PPARGC1A__Homo_sapiens__NP_037393
auggccugggacaugugcaaccaggacagcgaguccguguggagcgacaucgagugcgccgcgcuggucggcgaggaccagccccucugcccggaccugcccgagcuggaccucuccgagcuggacgugaacgaccuggacaccgacagcuuccucgggggccugaaguggugcuccgaccagagcgagaucaucuccaaccaguacaacaacgagcccagcaacaucuucgagaagaucgacgaggagaacgaggccaaccugcucgccgugcugaccgagacgcuggacucccuccccgucgacgaggacgggcugccgagcuucgacgcccugaccgacggcgacgugaccaccgacaacgaggccucccccagcuccaugcccgacgggacgcccccgccccaggaggcggaggagcccagccuccugaagaagcugcuccuggcccccgccaacacccagcuguccuacaacgagugcagcggccucuccacccagaaccacgccaaccacaaccaccgcauccggaccaacccggcgaucgugaagacggagaacagcugguccaacaaggccaagagcaucugccagcagcagaagccccagcgccggcccugcagcgagcugcugaaguaccucaccaccaacgacgacccgccccacaccaagcccacggagaaccgcaacuccagccgggacaagugcaccuccaagaagaagucccacacccagucccagagccagcaccuccaggccaagcccaccacgcugucccucccccugaccccggagagccccaacgaccccaagggcucccccuucgagaacaagaccaucgagcgcacccugagcgucgagcucuccgggacggccggccugaccccgcccaccaccccgccccacaaggccaaccaggacaaccccuuccgggcgagccccaagcugaaguccagcugcaagacgguggugcccccgcccuccaagaagccccgcuacagcgaguccagcgggacccagggcaacaacuccaccaagaaggggcccgagcagagcgagcucuacgcccagcugagcaaguccagcguccugaccggcggccacgaggagcggaagacgaagcgcccgucccuccggcuguucggggaccacgacuacugccagagcaucaacuccaagaccgagauccugaucaacaucagccaggagcuccaggacucccgccagcuggagaacaaggacgugagcuccgacuggcagggccagaucugcagcuccaccgacagcgaccagugcuaccugcgggagacccucgaggccuccaagcaggucagccccugcuccacgcgcaagcagcugcaggaccaggagauccgggccgagcugaacaagcacuucgggcaccccagccaggccguguucgacgacgaggcggacaagaccggcgagcuccgcgacuccgacuucagcaacgagcaguucagcaagcugcccauguucaucaacuccggccuggccauggacgggcuguucgacgacagcgaggacgaguccgacaagcugagcuacccgugggacggcacccaguccuacagccuguucaacgugucccccagcugcuccagcuucaacucccccugccgggacagcgugagcccgcccaagucccuguucagccagcgcccccagcggaugcgcagccggucccgcagcuucucccgccaccggagcugcagccgcucccccuacagccggucccgcagccggucccccgggagccgcuccagcucccggagcugcuacuacuacgaguccagccacuaccgccaccggacccaccgcaacuccccgcucuacguccggagccgcucccggagccccuacucccgccggccccgcuacgacagcuacgaggaguaccagcacgagcggcugaagcgcgaggaguaccggcgcgaguacgagaagcgcgaguccgagcgggccaagcagcgcgagcggcagcgccagaaggccaucgaggagcggcgcgugaucuacgugggcaagauccggcccgacacgacccgcaccgagcugcgggaccgcuucgaggucuucggggagaucgaggagugcaccgugaaccuccgggacgacggcgacagcuacggcuucaucaccuaccgcuacacgugcgacgccuucgcggcccuggagaacggguacacccugcggcgcagcaacgagaccgacuucgagcucuacuucugcggccggaagcaguucuucaaguccaacuacgccgaccuggacagcaacuccgacgacuucgacccggccagcaccaaguccaaguacgacagccuggacuucgacucccuccugaaggaggcccagcgcagccugcggcgcuga

SEQ ID NO: 34899 - RNA, 2955 nt, Artificial Sequence
  derived and/or modified sequence opt1 from PPARGC1B__Homo_sapiens__NP_001166169
auggccggcaacgacugcggggcccugcucgacgaggagcugagcuccuucuuccugaacuaccucgcggacacccagggcgggggcagcggggaggagcagcuguacgccgacuuccccgagcuggaccucucccagcuggacgccagcgacuucgacuccgcgaccugcuucggcgagcugcaguggugcccggagaacagcgagacggagcccaaccaguacucccccgacgacagcgagcuguuccagaucgacuccgagaacgaggcccugcuggcggagcucaccaagacccuggacgacauccccgaggacgacgugggccuggccgccuucccggcccucgacgggggcgacgcgcugagcugcaccuccgccagccccgcccccuccagcgcgcccccgucccccgcccccgagaagcccagcgccccggcccccgaggucgacgagcugucccucgccgacagcacgcaggacaagaaggcccccaugaugcagucccagagccgcagcugcaccgagcugcacaagcaccugaccuccgcccagugcugccuccaggaccgggggcugcagcccccgugccugcagagcccccgccuccccgcgaaggaggacaaggagcccggcgaggacugcccgagcccccagcccgcccccgccuccccgcgggacucccuggcccuggggcgcgccgaccccggcgcgcccgugagccaggaggacaugcaggccauggugcagcucauccgguacaugcacaccuacugccugccccagcgcaagcugccgccccagacgcccgagccgcuccccaaggccugcuccaaccccagccagcagguccggucccgccccuggagccggcaccacuccaaggccagcugggccgaguucuccauccugcgcgagcugcucgcgcaggacgugcugugcgacgugagcaagccguaccggcuggccacccccgucuacgccucccucacgccccgcagccggccccgcccgcccaaggacucccaggccagccccggccggcccuccagcguggaggaggugcgcaucgccgccagcccgaaguccaccgggccccggcccagccuccgcccccugcggcucgaggucaagcgcgaggugcggcgcccggcccgccugcagcagcaggaggaggaggacgaggaggaggaggaggaggaggaggaggaggagaaggaggaggaggaggaguggggccggaagcgccccgggcggggccugcccuggaccaagcucggccgcaagcuggaguccagcgugugccccguccggcgcucccggcgccugaacccggagcucgggcccuggcugaccuucgccgacgagccccuggugcccagcgagccgcagggcgcccuccccucccugugccuggcgcccaaggccuacgacguggagcgggagcuggggagcccgaccgacgaggacuccggccaggaccagcagcuccugcgcgggccccagauccccgcccuggagagccccugcgaguccggcugcggcgacauggacgaggacccgagcugcccccagcucccgccccgggacagcccccgcugccugaugcuggcccucucccaguccgaccccaccuucgggaagaaguccuucgagcagacgcugaccgucgagcugugcggcaccgccgggcucaccccgcccacgaccccgcccuacaagcccaccgaggaggaccccuucaagcccgacaucaagcacagccugggcaaggagaucgcgcugagccuccccagccccgaggggcugucccugaaggccacccccggcgccgcccacaagcucccgaagaagcaccccgagcggagcgagcugcugucccaccuccgccacgccacggcgcagcccgccagccaggccggccagaagcggcccuucuccugcagcuucggggaccacgacuacugccaggugcugcgcccggagggcgugcugcagcggaagguccuccgcuccugggagcccagcggggugcaccuggaggacuggccccagcagggcgcccccugggcggaggcccaggccccggggcgggaggaggaccgcuccugcgacgccggcgccccgcccaaggacagcacccugcuccgcgaccacgagauccgggcgucccugaccaagcacuucggccugcucgagaccgcccuggaggaggaggaccuggccagcugcaagucccccgaguacgacacgguguucgaggacagcuccagcuccagcggggaguccagcuuccuccccgaggaggaggaggaggagggcgaggaggaggaggaggacgacgaggaggaggacagcggggucuccccgaccugcagcgaccacugccccuaccaguccccgcccagcaaggccaaccgccagcugugcucccggagccgcuccagcuccggcagcucccccugccacagcuggucccccgccacccggcgcaacuuccggugcgagagccgcggccccugcuccgaccggacccccagcauccgccacgcgcggaagcgccgggagaaggccaucggggagggccgcgugguguacauccagaaccuguccagcgacauguccagccgggagcucaagcgccgguucgaggucuucggggagaucgaggagugcgaggugcugacgcgcaaccggcgcggcgagaaguacggguucaucaccuaccggugcagcgagcacgccgcccugucccucaccaagggcgccgcgcugcgcaagcgcaacgagcccagcuuccagcuguccuacggcgggcuccggcacuucugcuggccccgcuacaccgacuacgacagcaacuccgaggaggcccugccggccagcggcaaguccaaguacgaggccauggacuucgacagccugcucaaggaggcgcagcagucccugcacuga

SEQ ID NO: 34900 - RNA, 1434 nt, Artificial Sequence
  derived and/or modified sequence opt1 from PPARG__Homo_sapiens__NP_005028
augaccaugguggacaccgagaugcccuucuggccgacgaacuucggcaucagcuccgucgaccugagcgugauggaggaccacucccacagcuucgacaucaagcccuucaccaccguggacuucuccagcaucuccacgccccacuacgaggacauccccuucacccgcaccgacccggucguggccgacuacaaguacgaccucaagcugcaggaguaccagagcgccaucaagguggagcccgcguccccgcccuacuacagcgagaagacccagcuguacaacaagccccacgaggagcccuccaacagccucauggccaucgagugccgggucugcggggacaaggccuccggcuuccacuacggggugcacgccugcgagggcugcaagggguucuuccgccggaccauccgccugaagcugaucuacgaccggugcgaccucaacugccgcauccacaagaagucccggaacaagugccaguacugccgcuuccagaagugccuggccgugggcaugagccacaacgcgauccgguucggccgcaugccccaggccgagaaggagaagcugcucgccgagaucagcuccgacaucgaccagcugaaccccgagagcgccgaccugcgggcgcucgccaagcaccuguacgacuccuacaucaagagcuucccgcugacgaaggccaaggcccgcgccauccucaccgggaagaccaccgacaagagccccuucgucaucuacgacaugaacucccugaugaugggcgaggacaagaucaaguucaagcacaucacgccccugcaggagcagagcaaggagguggcgauccggaucuuccaggggugccaguuccgcuccguggaggccguccaggagaucaccgaguacgccaagagcauccccggcuucgugaaccucgaccugaacgaccaggugacccugcucaaguacgggguccacgagaucaucuacaccaugcuggccucccugaugaacaaggacggcgugcucaucagcgagggccagggguucaugacgcgggaguuccugaagucccugcgcaagccguucggcgacuucauggagcccaaguucgaguucgccgugaaguucaacgcgcucgagcuggacgacagcgaccuggccaucuucaucgccgucaucauccucuccggggaccggcccggccugcugaacgugaagcccaucgaggacauccaggacaaccuccugcaggcccuggagcuccagcugaagcugaaccacccggagagcucccagcuguucgccaagcugcugcagaagaugaccgaccuccgccagaucgugaccgagcacguccagcugcuccaggugaucaagaagaccgagacggacaugagccuccacccccugcugcaggagaucuacaaggaccucuacuga

SEQ ID NO: 34901 - RNA, 1554 nt, Artificial Sequence
  derived and/or modified sequence opt1 from PPAT__Homo_sapiens__NP_002694
auggagcuggaggagcucggcauccgcgaggagugcgggguguucggcugcaucgccagcggggaguggcccacccagcuggacgucccgcacgugaucacccugggccucguggggcugcagcaccggggccaggaguccgccggcaucgucacgagcgacggguccagcgugcccaccuucaagucccacaagggcauggggcuggugaaccacgucuucaccgaggacaaccucaagaagcuguacgugagcaaccugggcaucgggcacacccgcuacgcgacgaccggcaagugcgagcucgagaacugccagcccuucguggucgagacccugcacggcaagaucgccguggcccacaacggggagcuggugaacgccgcccggcuccgcaagaagcugcugcggcacggcaucgggcucuccaccagcuccgacagcgagaugaucacgcagcugcuggcguacacgcccccgcaggagcaggacgacacccccgacugggucgcccgcaucaagaaccucaugaaggaggcccccaccgccuacucccugcugaucaugcaccgggacgugaucuacgcggugcgcgaccccuacggcaaccggccgcucugcaucggccgccugauccccgucagcgacaucaacgacaaggagaagaagaccuccgagaccgagggguggguggugagcuccgagagcugcuccuuccugagcaucggcgcccgguacuaccgcgagguccuccccggggagaucguggagaucucccggcacaacgugcagacccuggacaucaucagccgcagcgagggcaaccccgucgccuucugcaucuucgaguacguguacuucgcccggccggacuccauguucgaggaccagaugguguacaccguccgcuaccggugcgggcagcagcuggccaucgaggcgcccguggacgccgaccucgucagcacggugcccgaguccgccacccccgccgcccuggcguacgccggcaagugcggccugccguacguggagguccucugcaagaaccgcuacguggggcggaccuucauccagcccaacaugcgccugcggcagcugggcguggccaagaaguucgggguccucagcgacaacuucaagggcaagcgcaucgugcugguggacgacuccaucguccgcgggaacaccaucagccccaucaucaagcugcucaaggaguccggcgccaaggaggugcacauccggguggccagcccgcccaucaaguaccccugcuucaugggcaucaacauccccacgaaggaggagcugaucgcgaacaagcccgaguucgaccaccuggccgaguaccucggggccaacuccgucguguaccugagcguggagggccuggucuccagcgugcaggaggggaucaaguucaagaagcagaaggagaagaagcacgacaucaugauccaggagaacggcaacgggcucgagugcuucgagaaguccggccacugcaccgccugccugaccggcaaguacccgguggagcuggagugguga

SEQ ID NO: 34902 - RNA, 387 nt, Artificial Sequence
  derived and/or modified sequence opt1 from PPBP__Homo_sapiens__NP_002695
augagccugcgccucgacaccacccccuccugcaacagcgcccggccgcugcacgcccuccaggugcugcugcugcucucccugcugcucacggcgcuggccagcuccaccaagggccagaccaagcgcaaccuggccaaggggaaggaggagagccucgacuccgaccuguacgccgagcugcggugcaugugcaucaagaccacgagcggcauccaccccaagaacauccagucccucgaggucaucgggaagggcacccacugcaaccagguggaggugaucgccacccugaaggacgggcgcaagaucugccuggaccccgacgcgccccggaucaagaagaucguccagaagaagcucgccggcgacgagagcgccgacuga

SEQ ID NO: 34903 - RNA, 246 nt, Artificial Sequence
  derived and/or modified sequence opt1 from PPCDC__Homo_sapiens__NP_001288034
augcgcgccugggaccggagcaagccccuccuguucugcccggccaugaacaccgcgaugugggagcaccccaucaccgcccagcaggucgaccagcugaaggccuucggcuacguggagauccccugcguggccaagaagcuggugugcggggacgagggccucggggccauggcggaggucggcacgaucguggacaaggugaaggagguccuguuccagcacuccggguuccagcagagcuga

SEQ ID NO: 34904 - RNA, 1776 nt, Artificial Sequence
  derived and/or modified sequence opt1 from PPEF1__Homo_sapiens__NP_689412
augggcugcagcuccagcuccaccaagacccgccggagcgacacgucccugcgcgccgcccucaucauccagaacugguaccggggguacaaggcgcgccugaaggcccggcagcacuacgcccugaccaucuuccagagcaucgaguacgccgacgagcagggccagaugcagcucuccaccuucuucagcuucaugcuggagaacuacacccacauccacaaggaggagcuggagcuccgcaaccagucccuggagagcgagcaggacaugcgggaccgcugggacuacguggacuccaucgacguccccgacagcuacaacgggccgcggcugcaguucccccucacgugcaccgacaucgaccugcugcucgaggccuucaaggagcagcagauccugcacgcgcacuacgugcuggagguccucuucgagaccaagaaggugcugaagcagaugcccaacuucacccacauccagacgucccccagcaaggaggugaccaucugcggcgaccugcacgggaagcucgacgaccuguuccugaucuucuacaagaacggccucccguccgagcgcaaccccuacguguucaacggcgacuucgucgaccgggggaagaacagcaucgagauccugaugauccugugcguguccuuccucguguaccccaacgaccugcaccugaaccgcggcaaccacgaggacuucaugaugaaccuccgguacggguucaccaaggagauccugcacaaguacaagcugcacggcaagcgcauccuccagauccuggaggaguucuacgccuggcugcccaucgggaccaucgucgacaacgagauccucgugauccacggcggcaucagcgagacgaccgaccugaaccugcuccaccggguggagcgcaacaagaugaaguccguccugaucccgcccaccgagaccaaccgggaccacgacacggacagcaagcacaacaaggugggggugaccuucaacgcccacggccgcaucaagaccaacgggagccccaccgagcaccugacggagcacgagugggagcaggucgugaccaucuucuccgccagcaacuacuacgaggagggcuccaaccggggcgcguacaucaagcucugcagcgggaccacgccccgcuucuuccaguaccaggugaccaaggcgaccugcuuccagccgcugcggcagcgcgucgacaccauggagaacuccgccaucaagauccugcgcgagcgggugaucagccgcaaguccgaccucacccgggccuuccagcugcaggaccaccgcaagagcggcaagcuguccgugagccagugggccuucugcauggagaacauccucgggcugaaccugcccuggcggucccucagcuccaaccuggucaacaucgaccagaacggcaacguggaguacaugagcuccuuccagaacauccgcaucgagaagcccgugcaggaggcccacagcacgcuggucgagacccuguaccgguaccgcuccgaccucgagaucaucuucaacgccaucgacaccgaccacagcgggcugaucuccguggaggaguuccgggccauguggaagcuguucagcagccacuacaacguccacaucgacgacucccaggugaacaagcucgccaacaucauggaccugaacaaggacggcagcaucgacuucaacgaguuccugaaggccuucuacgugguccaccgcuacgaggaccucaugaagcccgacgugaccaaccugggcuga

SEQ ID NO: 34905 - RNA, 2262 nt, Artificial Sequence
  derived and/or modified sequence opt1 from PPEF2__Homo_sapiens__XP_011530341
augggcagcgggaccuccacccagcaccacuucgccuuccagaacgccgagcgcgcguucaaggccgccgcccugauccagcggugguaccgccgguacguggcccgccucgagaugcggcgccggugcacguggagcaucuuccaguccaucgaguacgcgggccagcaggaccaggucaagcugcacgacuucuucagcuaccugauggaccacuucauccccuccagccacaacgaccgcgacuuccucacccggaucuucaccgaggaccgcuucgcccaggacuccgagaugaagaagugcagcgacuacgaguccaucgaggugccggacagcuacaccgggccccggcuguccuucccccugcuccccgaccacgccacggcccugguggaggcguuccgccugaagcagcagcuccacgcccgguacguccugaaccugcucuacgagaccaagaagcaccuggugcagcugccgaacaucaaccgcgugagcacgugcuacuccgaggagaucaccgucugcggcgaccuccacgggcagcuggacgaccugaucuucaucuucuacaagaacggccuccccagccccgagcgguccuacguguucaacggcgacuucguggaccgcgggaaggacagcgucgagauccugaugauccuguucgccuucaugcucguguaccccaaggaguuccaccugaaccggggcaaccacgaggaccacauggugaaccugcgcuacggguucaccaaggaggucaugaacaaguacaaggugcacggcaaggagauccuccggacccugcaggacguguucugcuggcugccgcucgccacccugaucgacgagaagguccugauccuccacgggggcguguccgacaucaccgaccuggagcugcucgacaagaucgagcgcagcaagaucguguccacgaugcggugcaagacccgccagaaguccgagaagcagauggaggagaagcgccgggccaaccagaaguccagcgcgcagggccccauccccugguuccugcccgagagccgcucccugccgagcagcccccuccggcuggggagcuacaaggcccagaagaccucccgcagcuccagcauccccugcuccggcagccuggacgggcgggagcucucccgccagguccggagcuccguggagcuggagcuggagcgcugccggcagcaggccggccuccuggugaccggcgagaaggaggagcccagccgcuccgccagcgaggccgacuccgaggcgggggagcugcggaagccgacgcaggaggaguggcgccaggucguggacauccucuggagcgaccccauggcccaggagggcugcaaggccaacaccauccgcgggggcgggugcuacuucggccccgacgugacccagcagcugcugcagaaguacaacaugcaguuccucauccggagccacgagugcaagcccgagggcuacgaguucugccacaaccggaagguccugaccaucuucuccgccagcaacuacuacgaggugggguccaaccgcggcgccuacgucaagcuggggccggcgcugacgccccacaucgugcaguaccaggccaacaaggugacccacacccucaccaugcggcagcgcaucagccgggucgaggaguccgcccugcgcgcccugcgcgagaagcuguucgcccacagcuccgaccuccugagcgaguucaagaagcacgacgcggacaaggugggccucaucacgcuguccgacugggccgccgccguggagagcguccugcaccucgggcugcccuggcggaugcugcgcccccagcucgugaacuccagcgcggacaacaugcuggaguacaaguccuggcugaagaaccucgccaaggagcagcugagccgggagaacauccaguccagccugcucgagacccuguaccgcaaccgguccaaccuggagaccaucuuccgcaucaucgacagcgaccacagcggcuucaucucccucgacgaguuccggcagaccuggaagcuguucagcucccacaugaacaucgacaucacggacgacugcaucugcgaccuggcccgcagcaucgacuucaacaaggacggccacaucgacaucaacgaguuccucgaggccuuccggcugguggagaaguccugcccggagggggacgccagcgagugcccccaggcgaccaacgccaaggacuccggcugcagcucccccggggcccacuga

SEQ ID NO: 34906 - RNA, 3609 nt, Artificial Sequence
  derived and/or modified sequence opt1 from PPFIA1__Homo_sapiens__NP_003617
augaugugcgaggugaugcccaccaucagcgaggccgagggcccgcccgggggcgggggcgggcacggcuccggcagccccucccagcccgacgccgacagccacuucgagcagcugauggucuccaugcucgaggagcgcgaccggcugcuggacacccuccgcgagacgcaggagacccuggcgcugacccaggggaagcuccacgaggugggccacgagcgggacagccugcagcgccagcugaacaccgcccucccgcaggaguucgccgcccugacgaaggagcugaacgugugccgggagcagcuccuggagcgcgaggaggagaucgccgagcugaaggcggagcggaacaacacccgccuccugcuggagcaccucgagugccuggucucccggcacgagcgcagccugcggaugaccguggugaagcgccaggcccagucccccgccggggucagcuccgagguggaggugcucaaggcccucaagagccuguucgagcaccacaaggcgcuggacgagaagguccgggagcgccugcggguggcccuggagcgcugcucccuccuggaggaggagcugggcgccacccacaaggagcucaugauccugaaggagcagaacaaccagaagaagacgcugaccgacggggugcucgacaucaaccacgagcaggagaacacccccagcaccuccggcaagcggagcuccgacggcagccugucccacgaggaggaccuggccaaggucaucgagcuccaggagaucaucagcaagcagagccgcgagcagucccagaugaaggagcggcuggccagccuguccagccacgugacggagcucgaggaggaccuggacaccgcgcgcaaggaccugaucaaguccgaggagaugaacaccaagcuccagcgggacgugcgcgaggccauggcccagaaggaggacauggaggagcgcaucaccacgcuggagaagcgguaccuggccgcccagcgcgaggcgaccagcguccacgaccucaacgacaagcuggagaacgagaucgccaacaaggacuccaugcaccggcagaccgaggacaagaaccgccagcugcaggagcggcucgagcuggccgagcagaagcugcagcagacccugcgcaaggccgagacgcuccccgagguggaggccgagcuggcgcagcggguggccgcccugagcaaggccgaggagcgccacgggaacaucgaggagcggcuccgccagauggaggcccagcuggaggagaagaaccaggagcugcagcgggcgcgccagcgggagaagaugaacgaggagcacaacaagcgccucuccgacaccgucgacaagcugcugagcgaguccaacgagcggcuccagcugcaccugaaggagcgcauggccgcccucgaggacaagaacagccugcugcgggagguggaguccgccaagaagcagcucgaggagacccagcacgacaaggaccagcuggugcugaacaucgaggcgcuccgcgccgagcuggaccacaugcggcugcgcggcgccagccuccaccacgggcgcccgcaccugggcuccguccccgacuuccgguuccccauggccgacggccacaccgacagcuacuccacgagcgccgugcugcgccggccccagaaggggcgccucgcggcccugcgggacgagccguccaaggugcagacccugaacgagcaggacugggagcgcgcccagcaggccagcguccucgccaacguggcgcaggccuucgagagcgacgccgacgucuccgacggcgaggacgaccgggacacccugcugagcuccguggaccuccugagccccuccgggcaggccgacgcccacacccuggcgaugaugcuccaggagcagcuggacgccaucaacaaggagauccgccugauccaggaggagaaggagaacacggagcagcgggccgaggagaucgagagccgcgugggcuccgggagccucgacaaccugggccgguuccgcuccaugagcuccaucccgcccuaccccgccagcucccuggcgagcuccagcccgcccggcuccgggcggagcacgccccgccggaucccccacagccccgcccgcgaggucgaccggcucggcgugaugacccugcugccgcccucccgcgaggaggugcgggacgacaagaccaccaucaagugcgagaccagcccgcccuccagcccccgcgcccuccggcuggaccgccugcacaagggggcccuccacaccgucucccacgaggacauccgcgacauccggaacagcaccggcucccaggacgggcccgugagcaaccccuccagcuccaacagcucccaggacagccugcacaaggcccccaagaagaagggcaucaaguccagcaucggccgccuguucgggaagaaggagaagggccggcccgggcagacgggcaaggaggcgcucgggcaggccggcguguccgagaccgacaacagcucccaggacgcccugggccugagcaagcucgggggccaggccgagaagaaccgcaagcugcagaagaagcacgagcugcucgaggaggcccggcgccaggggcugccguucgcgcagugggacggccccaccgucgugguguggcuggagcucugggucggcaugcccgccugguacguggccgccugccgggccaacgucaagagcggggcgaucauguccgcccugagcgacaccgagauccagcgcgagaucggcaucuccaacccccugcaccggcucaagcugcgccuggccauccaggagaucaugagccucaccuccccgagcgccccgcccacgucccggaccacccuggcguacggggacaugaaccacgaguggaucggcaacgaguggcugcccagccucgggcugccccaguaccgcuccuacuucauggagugccugguggacgcccggaugcucgaccaccugaccaagaaggaccugcgcggccagcucaagaugguggacagcuuccaccggaacuccuuccagugcggcaucaugugccugcgccggcugaacuacgaccgcaaggagcucgagcggaagcgcgaggagagccaguccgagaucaaggacgugcuggucuggagcaacgaccgcgugauccgguggauccuguccaucgggcucaaggaguacgccaacaaccugaucgagagcggcgugcacggggcccugcucgcccuggacgagacguucgacuucuccgcgcuggcccuccugcugcagauccccacccagaacacccaggcccgcgccguccucgagcgggaguucaacaaccugcuggugaugggcaccgaccgccgguucgacgaggacgacgacaagagcuuccgccgggcccccuccuggcgcaagaaguuccggcccaaggacauccgcgggcucgcggccggcagcgccgagacgcugccggccaacuuccgggugaccagcuccaugagcucccccagcaugcagcccaagaagaugcagauggacggcaacgucuccgggacccagcgccuggacagcgccaccgugcggacguacuccugcuga

SEQ ID NO: 34907 - RNA, 3744 nt, Artificial Sequence
  derived and/or modified sequence opt1 from PPFIA2__Homo_sapiens__NP_001207402
augaugugcgaggugaugcccaccaucaacgaggacaccccgaugagccagcgcggcucccagagcuccgggagcgacuccgacagccacuucgagcagcugauggucaacaugcucgacgagcgggaccgccugcuggacacgcuccgggagacccaggagucccugagccuggcccagcagcgccuccaggacgugaucuacgaccgggacucccugcagcgccagcugaacagcgcccucccccaggacaucgagucccugaccggcgggcuggcgggcagcaagggggccgacccgcccgaguucgccgcccucaccaaggagcugaacgccugccgggagcagcugcucgagaaggaggaggagaucuccgagcugaaggcggagcgcaacaacacgcggcugcuccuggagcaccuggagugccucgugagccgccacgagcggucccugcgcaugaccgucgugaagcggcaggcccagagccccuccggcgugagcuccgaggucgaggugcugaaggcccucaagagccuguucgagcaccacaaggcccuggacgagaaggugcgcgagcggcuccgcgucagccuggagcggguguccgcgcuggaggaggagcucgccgccgccaaccaggagaucguggcccugcgcgagcagaacguccacauccagcggaagauggcgagcuccgagggcagcaccgaguccgagcaccuggaggggauggagcccggccagaaggugcacgagaagcgccucagcaacggguccaucgacagcaccgacgagacgucccagaucguggagcugcaggagcugcucgagaagcagaacuacgagauggcccagaugaaggagcggcuggccgcccugagcucccgcgucggcgagguggagcaggaggccgagaccgcgcgcaaggaccucaucaagaccgaggagaugaacaccaaguaccagcgggacauccgcgaggccauggcccagaaggaggacauggaggagcggaucacgacccuggagaagcgcuaccugagcgcccagcgggaguccaccagcauccacgacaugaacgacaagcucgagaacgagcuggccaacaaggaggcgauccugcgccagauggaggagaagaaccggcagcuccaggagcgccuggagcuggccgagcagaagcuccagcagaccaugcggaaggccgagacgcugcccgagguggaggccgagcuggcccagcgcaucgcggcccugaccaaggccgaggagcggcacgggaacaucgaggagcgcaugcggcaccucgagggccagcuggaggagaagaaccaggagcugcagcgcgcccggcagcgcgagaagaugaacgaggagcacaacaagcggcucuccgacaccgucgaccgccugcugaccgagagcaacgagcggcuccagcugcaccugaaggagcgcauggcggcccucgaggagaagaacgugcugauccaggaguccgagacguuccgcaagaaccuggaggagagccuccacgacaaggagcggcuggccgaggagaucgagaagcugcgcuccgagcucgaccagcugaagaugcggaccggcagccugaucgagcccaccaucccgcgcacccaccucgacacgagcgccgagcugcgguacuccguggggagccuggucgacucccagagcgacuaccgcaccaccaaggugauccggcgcccccggcgcggccggaugggggugcgccgggacgagcccaaggucaagucccucggcgaccacgaguggaaccgcacccagcagaucggcgugcugagcucccaccccuucgagagcgacacggagauguccgacaucgacgacgacgaccgggagaccaucuucagcuccauggaccugcucagcccguccgggcacagcgacgcccagacccuggcgaugaugcugcaggagcagcucgacgccaucaacaaggagauccgccugauccaggaggagaaggaguccaccgagcugcgggccgaggagaucgagaaccgcgucgccagcgugucccucgagggccugaaccuggcccgggugcaccccgggacgagcaucaccgcgagcgucaccgccuccagccucgccuccagcuccccgcccagcggccacuccacccccaagcugacgccccgcagccccgcccgggagauggaccgcaugggggugaugacccugcccuccgaccuccgcaagcaccggcgcaagaucgccguggucgaggaggacggccgggaggacaaggcgaccaucaagugcgagaccagcccgccgcccacgccccgcgcccugcggaugacccacacccugcccuccagcuaccacaacgacgcccgcuccagccucuccgugagccuggagcccgagucccugggccucgggagcgccaacuccagccaggacagccugcacaaggcgcccaagaagaagggcaucaaguccagcaucgggcggcuguucggcaagaaggagaaggcccgccucgggcagcugcggggcuucauggagaccgaggccgccgcccaggagucccugggccucgggaagcugggcacccaggcggagaaggaccgccggcugaagaagaagcacgagcuccuggaggaggcccgccggaaggggcugcccuucgcccagugggacggcccgacgguggucgccuggcucgagcuguggcuggggaugcccgccugguacguggcggccugccgcgccaacgucaagagcggcgccaucauguccgcccucagcgacaccgagauccagcgggagaucggcaucuccaacccccugcaccgccugaagcuccggcuggcgauccaggagauggugagccugaccuccccgagcgccccgcccaccucccgcacgcccagcgggaacgugugggugacccacgaggagauggagaaccucgccgcccccgcgaagaccaaggaguccgaggagggcagcugggcccagugccccgucuuccugcagacccuggccuacggggacaugaaccacgaguggaucggcaacgaguggcuccccucccugggccugccccaguaccggagcuacuucauggagugccucguggacgcccgcaugcuggaccaccugacgaagaaggaccuccgcgugcaccugaagauggucgacuccuuccaccggaccagccugcaguacgggaucaugugccucaagcgccugaacuacgaccggaaggagcuggagcgccggcgcgaggccucccagcacgagaucaaggacgugcucguguggagcaacgaccgggucauccgcuggauccaggcgaucggccugcgggaguacgccaacaacauccuggagagcggggugcacggcucccucaucgcccuggacgagaacuucgacuacagcucccuggcccuccugcugcagaucccgacccagaacacccaggcccgccagauccucgagcgggaguacaacaaccugcuggcgcucgggacggagcgccggcuggacgagagcgacgacaagaacuuccgccggggcuccaccuggcgccggcaguucccgccccgcgaggugcacggcaucagcaugaugcccggguccagcgagacccugcccgccggcuuccggcucaccacgaccuccgggcagagccgcaagaugaccaccgacgacggcgucuucuccguguacagcacguga

SEQ ID NO: 34908 - RNA, 3624 nt, Artificial Sequence
  derived and/or modified sequence opt1 from PPFIA4__Homo_sapiens__NP_001291260
augugcgaggugaugcccaccaucaacgagggcgaccgccuggggccgccccacggcgccgacgccgacgcgaacuucgagcagcucauggucaacaugcuggacgagcgggagaagcugcucgagagccugcgcgagucccaggagacccuggccgccacgcagagccggcuccaggacgccauccacgagcgcgaccagcugcagcggcaccugaacuccgcccucccccaggaguucgcgacccugacccgcgagcugagcaugugccgggagcagcuccuggagcgcgaggaggagaucuccgagcugaaggccgagcggaacaacacccgccuccugcuggagcaccucgagugccuggugagccggcacgagcgcucccugcggaugacgguggucaagcgccaggcccagagccccuccggggugagcuccgagguggagguccucaaggcccugaagucccuguucgagcaccacaaggcgcucgacgagaaggugcgggagcgccugcgggccgcccuggagcgcgugaccacccucgaggagcagcuggccggcgcccaccagcaggucuccgcgcugcagcagggggccggcgugcgggacggcgccgccgaggaggaggggaccguggagcucggccccaagcgccuguggaaggaggacacggggcgggucgaggagcugcaggagcuccuggagaagcagaacuucgagcugagccaggcccgcgagcgccucgugacccugaccaccacggugaccgagcuggaggaggaccucggcaccgcgcggcgcgaccugaucaaguccgaggagcugagcuccaagcaccagcgggaccuccgcgaggcccuggcccagaaggaggacauggaggagcggaucaccacgcuggagaagcgcuaccucgccgcccagcgggaggcgaccagcauccacgaccugaacgacaagcuggagaacgagcucgccaacaaggagucccugcaccgccagugcgaggagaaggcccggcaccuccaggagcugcucgaggucgccgagcagaagcugcagcagaccaugcgcaaggccgagacccugcccgagguggaggcggagcucgcccagcggaucgccgcccugacgaaggcggaggagcgccacgggaacaucgaggagcaccuccgccagcucgagggccagcuggaggagaagaaccaggagcuggcccgggugcggcagcgcgagaagaugaacgaggaccacaacaagcggcugagcgacaccgucgaccgccugcugagcgagagcaacgagcggcugcagcugcaccugaaggagcgcauggccgcccucgaggagaagaacacccugauccaggagcuggagagcucccagcgccagaucgaggagcagcaccaccacaagggccggcucagcgaggagaucgagaagcugcgccaggagguggaccagcugaaggggcggggcgggcccuucguggacggcguccacucccgcagccacaugggcuccgccgcggacgugcgguucagccucgggaccacgacccacgcgccgcccggcgugcaccgccgguacuccgcccugcgcgaggagagcgccaaggacugggagaccagcccccugcccgggaugcucgcccccgccgccggccccgccuucgacuccgaccccgagaucuccgacgucgacgaggacgagcccgggggccuggugggcagcgccgacgucgugucccccagcgggcacuccgacgcccagacccuggcgaugaugcuccaggagcagcuggacgccaucaacgaggagauccggaugauccaggaggagaaggagagcacggagcugcgcgccgaggagaucgagacccgggugaccuccggcagcauggaggcccucaaccugaagcagcugcgcaagcgggggagcaucccgaccucccucacggcgcugagccuggccuccgccagcccgccccucuccggccgcagcacccccaagcugaccucccggagcgccgcccaggaccuggaccgcaugggggucaugacccuccccuccgaccugcggaagcaccgccggaagcugcucagccccgugucccgcgaggagaaccgggaggacaaggcgacgaucaagugcgagaccagcccgcccuccagcccccgcacccugcgccuggagaagcucggccaccccgcccugucccaggaggagggcaagagcgcccuggaggaccagggguccaaccccagcagcuccaacagcucccaggacagccuccacaagggcgccaagcggaaggggaucaaguccagcaucggccgccuguucgggaagaaggagaagggccggcugauccagcucucccgcgacggcgccaccgggcacgugcugcugaccgacagcgaguucuccaugcaggagcccauggucccggcgaagcucggcacgcaggccgagaaggaccggcgccugaagaagaagcaccagcugcucgaggacgcccggcgcaaggggaugcccuucgcccagugggacggccccaccguggugagcuggcuggagcugugggucggcaugccggccugguacguggcggccugccgggccaacgugaaguccggggccaucaugagcgcgcucuccgacaccgagauccagcgcgagaucggcaucagcaacgcccugcaccggcugaagcuccgccuggccauccaggagauggucucccugaccagccccuccgccccgcccacgagccggaccuccagcgggaacgugugggugacccacgaggagauggagacccucgagacgagcaccaagaccgacuccgaggagggcagcugggcccagacccuggcguacggggacaugaaccacgaguggaucggcaacgaguggcugcccucccucggccugccccaguaccgcagcuacuucauggagugccuggucgacgcccggaugcucgaccaccugacgaagaaggaccugcgcgugcaccucaagaugguggacuccuuccaccggaccagccugcaguacgggaucaugugccugaagcgccucaacuacgaccggaaggagcuggagaagcgccgcgaggagucccagcacgagaucaaggacguccugguguggaccaacgaccaggugguccacugggugcagagcaucggccuccgggacuacgccgggaaccugcacgaguccggcgugcacggggcccugcucgcccuggacgagaacuucgaccacaacacccuggcgcucauccugcagauccccacgcagaacacccaggcccgccaggucauggagcgggaguucaacaaccugcucgcccugggcaccgaccgcaagcuggacgacggcgacgacaagguguuccggcgcgcccccagcuggcggaagcgcuuccggccgcgcgagcaccacgggcggggcgggaugcucuccgccagcgcggagacccugcccgccggcuuccgcguguccacgcuggggacccugcagccgccgcccgccccgcccaagaagaucaugcccgaggcccacagccacuaccucuacggccacaugcuguccgccuuccgggacuga

SEQ ID NO: 34909 - RNA, 2577 nt, Artificial Sequence
  derived and/or modified sequence opt1 from PPFIBP1__Homo_sapiens__NP_001185844
augcugcagcaggagcuccugagccgcaccucccuggagacccagaagcucgaccugauggccgagaucagcaaccugaagcucaagcugacggccguggagaaggaccggcuggacuacgaggacaaguuccgcgacaccgagggccucauccaggagaucaacgaccugcggcugaaggucuccgagauggacagcgagcgccuccaguacgagaagaagcugaaguccaccaagagccugauggcgaagcucuccagcaugaagaucaagguggggcagaugcaguacgagaagcagcggauggagcagaagugggagucccugaaggacgagcuggccagccucaaggagcagcuggaggagaaggaguccgaggugaagcgccugcaggagaagcucgucugcaagaugaagggcgaggggguggagaucguggaccgggacaucgagguccagaagaugaagaaggccguggagagccugauggccgccaacgaggagaaggaccgcaagaucgaggaccugcggcagugccucaaccgcuacaagaagaugcaggacaccgugguccuggcgcagggcaaggacggggaguacgaggagcugcucaacuccagcuccaucagcucccugcuggacgcccagggcuucagcgaccucgagaagucccccagcccgacgcccgugaugggcagccccuccugcgaccccuucaacaccagcgugccggaggaguuccacaccaccauccugcaggucuccauccccagccugcuccccgccacgguguccauggagaccagcgagaaguccaagcugacccccaagccggagaccagcuucgaggagaacgacgggaacaucauccugggcgccacgguggacacccagcucugcgacaagcugcugaccuccagccuccagaaguccagcucccuggggaaccugaagaaggagaccagcgacggcgagaaggagacgauccagaagaccuccgaggaccgggcgcccgccgagagccgccccuucgggacccugcccccgcggccgcccggccaggacaccuccauggacgacaaccccuucggcacgcgcaagguccggagcuccuucgggcgcggcuucuucaagaucaagagcaacaagcggaccgccagcgcccccaaccucgccgagaccgagaaggagaccgcggagcaccuggaccucgccggggccuccagccgccccaaggacucccagcggaacagccccuuccagaucccgccgcccucccccgacagcaagaagaagucccgcggcaucaugaagcuguucggcaagcugcggcgcagccaguccacgaccuucaaccccgacgacaugagcgagcccgaguucaagcgcgggggcacccgggccaccgccgggccccgccucggcuggucccgggaccuggggcagagcaacuccgaccuggacaugcccuucgcgaaguggacgaaggagcaggucugcaacuggcugauggagcagggccucggcagcuaccugaacuccgggaagcacuggaucgccagcggccagacccugcuccaggccucccagcaggaccuggagaaggagcuggggaucaagcacagccuccaccgcaagaagcugcagcuggcccuccaggcccugggcagcgaggaggagaccaaccacgggaagcuggacuucaacugggugacccgguggcucgacgacaucggccugccccaguacaagacgcaguucgacgagggccgcguggacgggcggaugcugcacuacaugaccguggacgaccuccugucccugaagguggucagcgugcuccaccaccuguccaucaagcgcgcgauccaggugcugcggaucaacaacuucgagccgaacugccuccgccggcgccccagcgacgagaacaccaucgcccccuccgagguccagaaguggaccaaccaccgggugauggaguggcugcgcagcgucgaccuggccgaguacgccccgaaccuccggggcuccggggugcacggcgggcugauggugcuggagccccgcuucaacgucgagacgauggcccagcuccugaacaucccgcccaacaagacccugcuccggcgccaccuggcgacccacuucaaccugcucaucggcgccgaggcccagcaccagaagcgggacgccauggagcugcccgacuacgugcugcucaccgcgaccgccaaggugaagcccaagaagcuggccuucagcaacuucggcaaccugcgcaagaagaagcaggaggacggggaggaguacgucugccccauggagcucggccaggccuccgggagcgccuccaagaagggcuucaagcccggccuggacaugcgccuguacgaggaggacgaccucgaccggcuggagcagauggaggacagcgaggggacggugcgccagaucggcgcguucuccgaggggaucaacaaccugacccacaugcucaaggaggacgacauguucaaggacuucgccgcccggagcccguccgccagcaucaccgacgaggacuccaacguguga

SEQ ID NO: 34910 - RNA, 2295 nt, Artificial Sequence
  derived and/or modified sequence opt1 from PPFIBP2__Homo_sapiens__NP_001243497
augagcuccgagcaguggccccgccugccgggcaaggugagcguccucaccgaccagguggaggcccagggggagaagauccgggaccuggaggugugccuggagggccaccaggucaagcucaacgccgcggaggagaugcugcagcaggagcugcucucccgcaccagccuggagacgcagaagcuggaccucaugaccgagguguccgagcugaagcugaagcucguggggauggagaaggagcagcgggagcaggaggagaagcagcgcaaggccgaggagcugcugcaggagcuccggcaccugaagaucaaggucgaggagcuggagaacgagcgcaaccaguacgaguggaagcucaaggccaccaaggccgagguggcccagcugcaggagcaggucgcgcugaaggacgccgagaucgagcggcuccacagccagcugucccgcaccgccgcccugcacagcgagucccacacggagcgggaccaggagauccagcgccucaagaugggcauggagacccugcugcucgcgaacgaggacaaggaccggcgcaucgaggagcugaccgggcugcucaaccaguaccggaaggugaaggagaucgugauggugacccagggccccagcgagcgcacgcuguccaucaacgaggaggagcccgagggcggguucagcaaguggaacgccaccaacaaggaccccgaggagcuguucaagcaggagaugccgccccggugcuccagccccaccgucgggcccccgccccucccccagaagucccuggagacccgcgcccagaagaagcugagcugcucccucgaggaccugcggagcgaguccguggacaagugcauggacggcaaccagcccuucccggugcuggagcccaaggacagccccuuccucgccgagcacaaguaccccacgcugccgggcaagcugagcggggccacccccaacggcgaggcggccaaguccccgcccaccaucugccagcccgacgccaccggcagcucccuccugcgccugcgggacacggagagcgggugggacgacaccgccgucgugaacgaccucuccagcaccuccagcggcaccgaguccgggccccagagcccccugacgcccgacggcaagcgcaacccgaagggcaucaagaaguucugggggaagauccggcgcacccaguccggcaacuucuacaccgacacccuggggauggccgaguuccgccggggcgggcuccgcgcgacggccggcccccggcugagccgcacccgggacuccaagggccagaaguccgacgccaacgcccccuucgcccaguggagcaccgagcgcgugugcgcguggcuggaggacuucgggcuggcccaguacgucaucuucgcccggcagugggugagcuccggccacacccuccugacggccacgccccaggacauggagaaggagcuggggaucaagcacccgcuccaccgcaagaagcuggugcuggccgucaaggcgaucaacaccaagcaggaggagaaguccgcccuccuggaccacaucugggugacccgguggcuggacgacaucggccucccccaguacaaggaccaguuccacgagagccgcguggacgggcggaugcugcaguaccugaccgucaacgaccuccuguuccugaaggugaccagccagcuccaccaccugagcaucaagugcgccauccacguccugcacgugaacaaguucaacccccacugccuccaccgccggccggccgacgaguccaaccugagccccuccgaggugguccaguggagcaaccaccgcgugauggaguggcugcgguccguggaccucgcggaguacgcccccaaccugcgcggcagcggcguccacgggggccugaucauccucgagccccgguucaccggggacacccuggccaugcugcucaacaucccgccccagaagacgcugcugcgccggcaccucaccaccaaguucaacgcccugaucggccccgaggccgagcaggagaagcgcgagaagauggcgucccccgccuacaccccgcugaccacgaccgccaaggugcgcccccggaagcucggguucagccacuucggcaacauccgcaagaagaaguucgacgaguccaccgacuacaucugccccauggagcccagcgacggcguguccgacagccaccgggucuacuccggguaccgcggccugagcccgcuggacgcccccgagcucgacgggcuggaccaggugggccagaucuccuga

SEQ ID NO: 34911 - RNA, 318 nt, Artificial Sequence
  derived and/or modified sequence opt1 from PPIA__Homo_sapiens__NP_001287910
augugccagggcggggacuucacccgccacaacggcaccgggggcaagagcaucuacggggagaaguucgaggacgagaacuucauccugaagcacacgggccccggcauccucuccauggccaacgccgggccgaacaccaacggcagccaguucuucaucugcaccgcgaagaccgaguggcuggacgggaagcacguggucuucggcaaggugaaggaggggaugaacaucguggaggccauggagcgguucggcucccgcaacggcaagacgagcaagaagaucaccaucgccgacugcgggcagcuggaguga

SEQ ID NO: 34912 - RNA, 651 nt, Artificial Sequence
  derived and/or modified sequence opt1 from PPIB__Homo_sapiens__NP_000933
augcugcgccucagcgagcggaacaugaaggugcugcuggccgccgcgcucaucgccggcuccgucuucuuccugcugcuccccgggccgagcgccgccgacgagaagaagaagggccccaaggugaccgugaaggucuacuucgaccugcgcaucggggacgaggacgugggccgggugaucuucgggcuguucggcaagaccguccccaagacgguggacaacuucguggcccucgcgaccggcgagaagggguucggcuacaagaacuccaaguuccaccgcgucaucaaggacuucaugauccagggcggggacuucacccgcggggacggcaccggcggcaagagcaucuacggggagcgguuccccgacgagaacuucaagcugaagcacuacgggccgggcuggguguccauggccaacgccggcaaggacacgaacgggagccaguucuucaucaccaccgugaagaccgccuggcuggacggcaagcacgucguguucgggaaggugcucgagggcauggaggucgugcggaagguggaguccacgaagaccgacagccgcgacaagccccugaaggacgucaucaucgcggacugcgggaagaucgagguggagaagcccuucgccaucgccaaggaguga

SEQ ID NO: 34913 - RNA, 639 nt, Artificial Sequence
  derived and/or modified sequence opt1 from PPIC__Homo_sapiens__NP_000934
augggccccgggccgcgccugcuccugccccuggugcucugcgucggccugggggcccugguguucagcuccggcgccgagggguuccggaagcgcggccccagcgugaccgcgaaggucuucuucgacgugcggaucggcgacaaggacguggggcgcaucgucaucggccucuucgggaagguggugcccaagaccgucgagaacuucguggcccuggccacgggcgagaagggguacggcuacaagggcuccaaguuccaccgggugaucaaggacuucaugauccagggcggggacaucaccaccggggacggcaccggcggggucagcaucuacggcgagacguucccggacgagaacuucaagcugaagcacuacgggaucggcuggguguccauggccaacgccgggcccgacaccaacggcagccaguucuucaucacccucaccaagcccacguggcuggacggcaagcacguggucuucgggaaggugaucgacggcaugaccgugguccacuccaucgagcugcaggcgaccgacgggcacgaccgcccccucaccaacugcagcaucaucaacuccggcaagaucgacgugaagacgccguucguggucgagaucgccgacugguga

SEQ ID NO: 34914 - RNA, 1113 nt, Artificial Sequence
  derived and/or modified sequence opt1 from PPID__Homo_sapiens__NP_005029
augagccaccccuccccgcaggccaagcccagcaaccccuccaacccccgcguguucuucgacgucgacaucggcggggagcgggugggccgcaucgugcuggagcuguucgccgacaucgucccgaagaccgcggagaacuuccgggcccucugcaccggggagaagggcaucgggcacacgaccggcaagccccugcacuucaagggcugccccuuccaccgcaucaucaagaaguucaugauccagggcggggacuucagcaaccagaacgggaccggcggggaguccaucuacggcgagaaguucgaggacgagaacuuccacuacaagcacgaccgggagggccuccugagcauggccaacgccgggcgcaacaccaacggcucccaguucuucaucacgaccgugcccaccccgcaccuggacgggaagcacguggucuucggccaggugaucaagggcaucgggguggcccggauccucgagaacgucgaggugaagggcgagaagcccgcgaagcugugcgugaucgccgagugcggggagcugaaggagggcgacgacgggggcaucuuccccaaggacggcagcggggacucccaccccgacuucccggaggacgccgacaucgaccucaaggacgucgacaagauccugcugaucaccgaggaccucaagaacaucggcaacacguucuucaagagccagaacugggagauggccaucaagaaguacgcggaggugcugcgcuacguggacuccagcaaggccgucaucgagaccgccgaccgggccaagcugcagcccaucgcccucuccugcgugcugaacaucggggcgugcaagcugaagaugagcaacuggcagggcgccaucgacuccugccucgaggcccuggagcuggaccccagcaacaccaaggcccucuaccgccgggcccagggguggcagggccugaaggaguacgaccaggcgcuggccgaccucaagaaggcccagggcaucgcccccgaggacaaggccauccaggcggagcugcugaaggugaagcagaagaucaaggcccagaaggacaaggagaaggccgucuacgccaagauguucgccuga

SEQ ID NO: 34915 - RNA, 624 nt, Artificial Sequence
  derived and/or modified sequence opt1 from PPIF__Homo_sapiens__NP_005720
augcuggcccuccgcugcggcagccgguggcuggggcugcucuccgugccccgcagcgucccgcugcggcugcccgccgcgcgcgccugcuccaagggcagcggggaccccuccagcuccagcuccagcggcaacccccucguguaccuggacguggacgccaacgggaagccgcugggccgggucgugcucgagcugaaggccgacgugguccccaagaccgccgagaacuuccgcgcgcugugcaccggcgagaagggguucggcuacaagggguccacguuccaccgggugauccccagcuucaugugccaggccggcgacuucaccaaccacaacgggaccggcggcaaguccaucuacgggagccgcuuccccgacgagaacuucacccucaagcacgugggcccggggguccuguccauggccaacgccggccccaacacgaacggcagccaguucuucaucugcaccaucaagaccgacuggcuggacgggaagcacgugguguucggccacgucaaggaggggauggacguggugaagaagaucgaguccuucggcagcaaguccgggcggaccagcaagaagaucgucaucacggacugcggccagcucagcuga

SEQ ID NO: 34916 - RNA, 2265 nt, Artificial Sequence
  derived and/or modified sequence opt1 from PPIG__Homo_sapiens__NP_004783
augggcaucaaggugcagcgcccccggugcuucuucgacaucgccaucaacaaccagcccgccgggcgcgucguguucgagcuguucagcgacgugugccccaagaccugcgagaacuuccggugccucugcaccggcgagaaggggacgggcaaguccacccagaagccccugcacuacaagagcugccuguuccaccgcgucgugaaggacuucauggugcagggcggggacuucuccgagggcaacgggcggggcggggagagcaucuacggcggguucuucgaggacgaguccuucgcggucaagcacaacaaggaguuccuccugagcauggccaaccgcggcaaggacaccaacggcucccaguucuucaucaccacgaagcccaccccgcaccuggacgggcaccacgugguguucggccaggucaucagcgggcaggagguggugcgggagaucgagaaccagaagaccgacgccgccuccaagcccuucgccgagguccgcauccucagcugcggcgagcugauccccaaguccaaggugaagaaggaggagaagaagcggcacaagagcuccagcuccagcuccagcuccagcagcgacuccgacagcuccagcgacucccagagcuccagcgacuccagcgacuccgagagcgcgaccgaggagaaguccaagaagcgcaagaagaagcaccggaagaacagccgcaagcacaagaaggagaagaagaagcggaagaaguccaagaaguccgccagcagcgaguccgaggccgagaaccuggaggcccagccccagagcacggugcgcccggaggagaucccgcccauccccgagaaccgguuccucaugcgcaagagcccgcccaaggcggacgagaaggagcggaagaaccgcgagcgggagcgcgagcgggagugcaacccgcccaacucccagcccgccagcuaccagcgccgccugcuggucacccgguccggccgcaagaucaaggggcggggcccccgccgguaccgcacccccagccggucccgcagccgggaccgcuuccggcgcuccgagaccccgccccacuggcggcaggagaugcagcgcgcccagcggaugcgcgugagcuccggggagcgguggaucaagggcgacaagagcgagcucaacgagaucaaggagaaccagcgcucccccgugcgggucaaggagcgcaagaucacggaccaccgcaacgugagcgagucccccaaccggaagaacgagaaggagaagaaggugaaggaccacaagagcaacuccaaggagcgcgacauccggcgcaacagcgagaaggacgacaaguacaagaacaaggucaagaagcgggccaaguccaagagccgcagcaaguccaaggagaaguccaagagcaaggagcgggacagcaagcacaaccgcaacgaggagaagcggaugcgcucccggagcaaggggcgcgaccacgagaacgugaaggagaaggagaagcaguccgacagcaagggcaaggaccaggagcggucccgcagcaaggagaaguccaagcagcuggagagcaaguccaacgagcacgaccacagcaaguccaaggagaaggaccggcgcgcccagagccggucccgcgagugcgacaucaccaagggcaagcacagcuacaacucccggacccgcgagcggagccgcagccgcgaccggucccgccgggugcgcagccggacccacgaccgcgaccggucccgcagcaaggaguaccaccgguaccgcgagcaggaguaccggcgccgggggcgcucccggagccgcgagcggcgcacgccgcccggccggucccgcagcaaggaccgccggcgccggcgccgggacucccgcagcuccgagcgggaggagagccagucccgcaacaaggacaaguaccggaaccaggagagcaaguccagccaccgcaaggagaacuccgagagcgagaagcggauguacuccaagagccgcgaccacaacagcuccaacaacagccgggagaagaaggcggaccgcgaccagucccccuucagcaagaucaagcaguccagccaggacaacgagcugaaguccagcaugcucaagaacaaggaggacgagaagauccgguccagcgucgagaaggagaaccagaaguccaaggggcaggagaacgaccacgugcacgagaagaacaagaaguucgaccacgagagcucccccggcaccgacgaggacaagagcggguga

SEQ ID NO: 34917 - RNA, 501 nt, Artificial Sequence
  derived and/or modified sequence opt1 from PPIL1__Homo_sapiens__NP_057143
auggccgccaucccgcccgacagcuggcagccgcccaacguguaccuggagaccuccaugggcaucaucguccucgagcuguacuggaagcacgcgcccaagaccugcaagaacuucgccgagcuggcccgccggggguacuacaacggcacgaaguuccaccgcaucaucaaggacuucaugauccagggcggggaccccaccgggaccggccggggcggggccagcaucuacggcaagcaguucgaggacgagcuccaccccgaccugaaguucaccggggccggcauccuggcgauggccaacgccgggcccgacacgaacggcucccaguucuucgugacccucgcccccacccaguggcuggacggcaagcacaccaucuucgggcgcgugugccagggcaucgggauggucaaccgggugggcaugguggagacgaacagccaggaccgcccggucgacgacgugaagaucaucaaggcguaccccuccggcuga

SEQ ID NO: 34918 - RNA, 1563 nt, Artificial Sequence
  derived and/or modified sequence opt1 from PPIL2__Homo_sapiens__NP_680480
augggcaagcgccagcaccagaaggacaagauguacaucacgugcgccgaguacacccacuucuacgggggcaagaagcccgaccugccgcagaccaacuuccggcgccuccccuucgaccacugcagccugucccugcagcccuucguguaccccgucugcaccccggacgggaucguguucgaccuccugaacaucgugcccuggcugaagaaguacggcaccaaccccagcaacggggagaagcucgacggccggucccugaucaagcugaacuucagcaagaacuccgagggcaaguaccacugccccguccucuucaccguguucacgaacaacacccacaucguggccguccgcaccaccgggaacguguacgcguacgaggccguggagcagcugaacaucaaggccaagaacuuccgggaccugcucacggacgagccguucagccgccaggacaucaucacccugcaggaccccaccaaccuggacaaguucaacgucuccaacuucuaccacgugaagaacaacaugaagaucaucgaccccgacgaggagaaggccaagcaggaccccagcuacuaccucaagaacaccaacgccgagacgcgggagacccugcaggagcuguacaaggaguucaagggcgacgagauccucgcggccaccaugaaggccccggagaagaagaagguggacaagcugaacgccgcgcacuacuccaccgggaaggucagcgccuccuucacgagcaccgccauggugcccgagaccacccacgaggccgccgcgaucgacgaggacgugcugcgcuaccaguucgucaagaagaagggcuacgugcggcuccacacgaacaagggggaccugaaccuggagcuccacugcgaccugacccccaagaccugcgagaacuucauccgccugugcaagaagcacuacuacgacggcaccaucuuccaccgguccauccgcaacuucgugauccagggcggggaccccacgggcaccgggaccggcggcgagagcuacugggggaagccguucaaggacgaguuccggcccaaccucucccacaccggccgcgggauccugagcauggccaacuccggccccaacagcaaccggucccaguucuucaucacguuccgcagcugcgccuaccuggacaagaagcacaccaucuucgggcgggucgugggcggcuucgacgugcucaccgccauggagaacgucgagagcgaccccaagaccgaccgcccgaaggaggagauccggaucgacgccacgaccguguucguggaccccuacgaggaggcggacgcccagaucgcccaggagcgcaagacccagcugaaggucgcccccgagaccaaggugaaguccagccagccccaggccgggucccagggcccgcagacguuccggcagggggucggcaaguacaucaaccccgcggccaccaagcgcgccgccgaggaggagcccagcaccuccgccaccgugcccaugagcaagaagaagccgucccgcggguucggcgacuucagcuccugguga

SEQ ID NO: 34919 - RNA, 498 nt, Artificial Sequence
  derived and/or modified sequence opt1 from PPIL3__Homo_sapiens__NP_115861
augagcgugacccugcacaccgacgucggcgacaucaagaucgagguguucugcgagcgcacgcccaagaccugcgagauggagucccggugcgugccgcaggccgggguccaguggcgcgaccucggcagccugcagcccccgccgcccggguucaagcaggucuucugccugucccucccccggaccggccgcgggggcaacagcaucuggggcaagaaguucgaggacgaguacuccgaguaccugaagcacaacgugcgcgggguggugagcauggccaacaacggccccaacaccaacgggucccaguucuucaucacguacggcaagcagccccaccuggacaugaaguacaccguguucgggaaggucaucgacggccucgagacccuggacgagcuggagaagcuccccgugaacgagaagaccuaccggccccugaacgacgugcacaucaaggacaucacgauccacgcgaaccccuucgcccaguga

SEQ ID NO: 34920 - RNA, 4302 nt, Artificial Sequence
  derived and/or modified sequence opt1 from PPIP5K1__Homo_sapiens__NP_001124330
auguggagccugaccgccuccgagggcgagagcaccacggcccacuucuuccucggggcgggcgacgaggggcugggcacccgcgggaucggcaugcggcccgaggaguccgacagcgagcugcucgaggacgaggaggacgaggugccgcccgagccccagaucaucgucggcaucugcgccaugaccaagaaguccaagagcaagcccaugacccagauccuggagcgccugugccgguucgacuaccucacgguggugauccugggggaggacgucauccugaacgagccgguggagaacuggcccuccugccacugccucaucagcuuccacuccaagggcuucccccuggacaaggccguggccuacagcaagcugcgcaaccccuuccucaucaacgaccuggccaugcaguacuacauccaggaccggcgcgaggucuaccggauccugcaggaggaggggaucgaccucccgcgcuacgcggugcugaaccgggaccccgcccgccccgaggagugcaaccugaucgagggcgaggaccagguggaggucaacggggccguguuccccaagccguucguggagaagcccgucuccgccgaggaccacaacguguacaucuacuaccccagcuccgcgggcggcgggagccagcgccucuuccgcaagaucggcucccggagcuccguguacagccccgaguccagcguccgcaagaccgggagcuacaucuacgaggaguucaugccgaccgacggcaccgacgugaagguguacacggucggccccgacuacgcccacgccgaggcccggaagucccccgcccuggacgggaagguggagcgcgacagcgagggcaaggagauccgguaccccgugaugcugaccgcgauggagaagcucgucgcccgcaaggugugcguggccuucaagcagaccgucugcggguucgaccugcugcgggccaacggccacuccuucgugugcgacgucaacggguucagcuucgugaagaacuccaugaaguacuacgacgacugcgccaagauccucggcaacaccaucaugcgcgagcuggcgccgcaguuccagauccccuggagcauccccacggaggccgaggacauccccaucgugccgaccaccuccggcaccaugauggagcugcggugcgucaucgccaucauccgccacggggaccgcacgcccaagcagaagaugaagauggaggugaagcacccccgguucuucgcccucuucgagaagcacggcggguacaagaccggcaagcugaagcugaagcgccccgagcagcuccaggaggugcuggacaucacccggcugcuccuggccgagcuggagaaggagcccgggggcgagaucgaggagaagaccggcaagcucgagcagcucaagagcguccuggagauguacgggcacuucuccggcaucaaccggaaggugcagcugacguacuacccccacggggugaaggcgagcaacgagggccaggacccccagcgggagacccuggccccgucccugcuccugguccugaaguggggcggggagcucacccccgccggccgcgugcaggccgaggagcuggggcgggccuuccgcugcauguaccccggcgggcagggcgacuacgcgggcuuccccgggugcggccugcuccggcugcacagcaccuuccgccacgaccugaagaucuacgccuccgacgaggggcgggugcagaugacggccgccgcguucgccaagggccugcucgcccuggagggggagcugaccccgauccucguccagauggucaagagcgccaacaugaacggccugcuggacuccgacggcgacagccucuccagcugccagcaccgcgugaaggcccggcugcaccacauccugcagcaggacgcgcccuucgggcccgaggacuacgaccagcucgcccccacccgcuccaccagccugcugaacagcaugacgaucauccagaacccggugaaggugugcgaccagguguucgcccucaucgagaaccugacccaccagauccgggagcgcaugcaggacccccgguccgucgaccugcagcucuaccacagcgagacccuggagcugaugcuccagcgcugguccaagcuggagcgggacuuccgccagaaguccggccgcuacgacaucagcaagauccccgacaucuacgacugcgugaaguacgacgugcagcacaacgggagccugggccuccaggggaccgccgagcugcugcggcucuccaaggcccuggcggacgucgugaucccccaggaguacggcaucagccgcgaggagaagcuggagaucgccgugggcuucugccucccgcugcugcggaagauccuccuggaccugcagcgcacgcacgaggacgaguccgucaacaagcuccacccccugugcuaccugcgguacagccgcggggugcucucccccggccggcacgugcgcacccggcuguacuucaccagcgagucccacguccacagccugcucuccguguuccgcuacgggggccugcuggacgagacccaggacgcccaguggcagcgggcccucgacuaccugagcgccaucuccgagcugaacuacaugacgcagaucgugaucaugcucuacgaggacaacacccaggacccccugagcgaggagcgcuuccacgucgagcugcacuucagcccgggggugaagggcguggaggaggagggcuccgcgcccgccgggugcggcuuccggcccgccagcuccgagaacgaggagaugaagaccaaccaggggagcauggagaaccucugccccggcaaggccuccgacgagccggaccgcgcgcugcagaccagcccccagccgcccgaggggccgggccugccccggcgcagcccccucauccggaaccgcaaggccggcuccauggagguccuguccgagaccagcuccagccggcccgggggcuaccgccuguucuccagcucccggccgcccacggagaugaagcagagcgggcucggcucccagugcaccggccuguucagcaccaccgugcucgggggcuccagcagcgcccccaaccugcaggacuacgcccgcucccacgggaagaagcugccgcccgccagccugaagcaccgcgacgagcuccuguucgugcccgcggucaagcgguucuccgugagcuucgccaagcaccccacgaacggcuucgaggggugcuccauggugccgaccaucuacccccuggagacccuccacaacgcccugagccugcgccaggucuccgaguuccucagccgggugugccagcgccacaccgacgcccaggcccaggcguccgccgcccuguucgacagcaugcacuccagccaggccuccgacaaccccuucagcccgccccggacgcugcacuccccgccccuccagcugcagcagcgcagcgagaagccgcccugguacuccagcggccccuccagcaccgugagcuccgccggccccagcucccccaccaccgucgacgggaacagccaguucggcuucuccgaccagcccagccugaacucccacguggcggaggagcaccaggggcucggccugcugcaggagacgcccgggagcggcgcccaggagcucuccaucgagggcgagcaggagcuguucgagcccaaccagagcccccaggugccgcccauggagaccucccagcccuacgaggaggucagccagcccugccaggaggugccggacaucucccagcccugccaggacaucagcgaggcccugucccagcccugccagaaggugccggacaucagccagcagugccaggagaaccacgacaacgggaaccacacgugccaggaggucccccacaucucccagcccugccagaaguccagccagcucugccagaaggugagcgaggaggugugccagcugugccuggagaacagcgaggaggucucccagcccugccagggcgugagcgucgagguggggaagcucgugcacaaguuccacgucggcguggggucccuggugcaggagacccuggucgaggugggcagcccggccgaggagauccccgaggaggugauccagcccuaccaggaguucuccgucgaggugggccggcucgcgcaggagaccagcgccaucaaccugcugucccaggggauccccgagaucgacaagccgagccaggaguuccccgaggagaucgaccuccaggcccaggaggugcccgaggagaucaacuga

SEQ ID NO: 34921 - RNA, 5271 nt, Artificial Sequence
  derived and/or modified sequence opt1 from PPL__Homo_sapiens__NP_002696
augaacagccuguuccgcaagcggaacaagggcaaguacucccccaccgugcagacccgcagcaucuccaacaaggagcucagcgagcugaucgagcagcugcagaagaacgccgaccaggucgagaagaacaucguggacacggaggccaagaugcaguccgaccucgcgcggcugcaggaggggcgccagccggagcaccgggacgugacccugcagaagguccucgacagcgagaagcugcuguacgugcucgaggccgacgccgccaucgccaagcacaugaagcacccccagggcgacaugaucgcggaggacauccgccagcugaaggagcgggugaccaaccugcgcgggaagcacaagcagaucuaccggcucgccgucaaggagguggacccccaggugaacugggccgcccuggucgaggagaagcuggacaagcucaacaaccaguccuucggcaccgaccugccccugguggaccaccagguggaggagcacaacaucuuccacaacgaggucaaggcgaucgggccgcaccucgccaaggacggcgacaaggagcagaacagcgagcugcgcgccaaguaccagaagcugcucgccgccucccaggcgcggcagcagcaccugagcucccugcaggacuacaugcagcgcugcacgaacgagcucuacuggcuggaccagcaggccaagggccggaugcaguacgacuggagcgaccgcaaccuggacuaccccucccggcgccggcaguacgagaacuucaucaaccgcaaccucgaggccaaggaggagcggaucaacaagcugcacagcgagggggaccagcugcucgccgccgagcaccccggccgcaacuccaucgaggcgcacauggaggccgugcacgccgacuggaaggaguaccugaaccugcucaucugcgaggagagccaccugaaguacauggaggacuaccaccaguuccacgaggacgugaaggacgcccaggagcugcuccggaaggucgacuccgaccugaaccagaaguacgggcccgacuucaaggaccgcuaccagaucgagcugcuccugcgcgagcuggacgaccaggagaaggugcucgacaaguacgaggacgugguccagggccugcagaagcgggggcagcagguggugccgcugaaguaccgccgggagaccccccucaagcccauccccgucgaggcccugugcgacuucgagggcgagcagggccugaucagccgcggguacuccuacacccuccagaagaacaacggcgagagcugggagcugauggacagcgcggggaacaagcugaucgccccggccgugugcuucgugaucccccccaccgaccccgaggcccuggcccucgcggacucccugggcagccaguaccgguccguccgccagaaggccgccggcagcaagcggacgcugcagcagcgcuacgaggugcucaagaccgagaacccgggggacgccuccgaccugcagggccggcagcugcucgcggggcuggacaaggucgccagcgaccuggaccgccaggagaaggccaucaccggcauccuccggcccccccuggagcaggggcgcgccgugcaggacuccgccgagcgggcgaaggaccugaagaacaucaccaacgagcuccugcgcaucgagcccgagaagacgcggagcaccgccgagggcgaggccuucauccaggcccugccgggcuccgggaccaccccccuccugcgcacgcggguggaggacaccaaccgcaaguacgagcaccugcuccagcugcuggaccucgcccaggagaaggucgacguggcgaaccggcuggagaagagccugcagcaguccugggagcuccuggccacccacgagaaccaccugaaccaggacgacaccgugcccgagagcucccgcguccucgacagcaagggccaggagcuggccgccauggccugcgagcugcaggcgcagaagucccuccugggggagguggagcagaaccugcaggccgccaagcagugcagcuccacgcucgccagccgcuuccaggagcacugccccgaccuggagcggcaggaggcggaggugcacaagcugggccagcgcuucaacaaccuccggcagcaggucgagcgccgggcccagucccugcagagcgccaaggccgccuacgagcacuuccaccgcgggcacgaccacgugcugcaguuccucgugagcaucccguccuacgagccccaggagaccgacagccugucccagauggagaccaagcugaagaaccagaagaaccuccuggacgagaucgcgagccgggagcaggagguccagaagaucugcgccaacucccagcaguaccagcaggccgugaaggacuacgagcuggaggccgagaagcuccgcagccugcuggaccucgagaacggccgguccagccacguguccaagcgcgcccggcugcagagccccgcgaccaaggucaaggaggaggaggccgcccuggccgccaaguucacggagguguacgcgaucaaccgccagcggcuccagaaccuggaguucgcccugaaccuccugcgccagcagcccgagguggaggucacccacgagacccugcagcggaaccgcccggacuccggcguggaggaggccuggaagauccggaaggagcucgacgaggagaccgagcgccggcgccagcuggagaacgaggugaagagcacgcaggaggagaucuggacccugcggaaccaggggccccaggaguccgucgugcgcaaggaggugcucaagaagguccccgacccggugcuggaggagagcuuccagcagcugcagcgcacccucgccgaggagcagcacaagaaccagcugcugcaggaggagcucgaggcgcugcagcugcagcuccgggcccuggagcaggagacccgcgacggcgggcaggaguacguggucaaggaggugcugcggaucgagcccgaccgcgcccaggccgacgaggugcuccagcugcgggaggagcuggaggcccuccgccggcagaagggcgcgcgcgaggccgagguccugcugcuccagcagcggguggccgcccuggccgaggagaagucccgcgcgcaggagaaggugacggagaaggaggucgugaagcugcagaacgacccccagcucgaggccgaguaccagcagcugcaggaggaccaccagcggcaggaccagcugcgcgagaagcaggaggaggagcucagcuuccugcaggacaagcugaagcggcucgagaaggagcgcgccauggccgaggggaagaucaccgugaaggagguccugaagguggagaaggacgccgcgaccgagcgggagguguccgaccugacccgccaguacgaggacgaggccgccaaggcccgggccagccagcgcgagaagacggagcuccugcggaagaucugggcgcuggaggaggagaacgccaaggucguggugcaggagaagguccgcgagaucgugcgccccgacccgaaggccgagagcgagguggccaaccuccggcuggagcuggucgagcaggagcgcaaguaccggggcgcggaggagcagcugcgcuccuaccagagcgagcucgaggcccugcggcgccggggcccccagguggaggugaaggaggucaccaaggaggugaucaaguacaagaccgaccccgagauggagaaggagcugcagcgccuccgggaggagaucguggacaagacccgccugaucgagcggugcgaccuggagaucuaccagcucaagaaggagauccaggcccugaaggacaccaagccccagguccagacgaaggaggugguccaggagauccugcaguuccaggaggacccgcagaccaaggaggagguggccucccuccgcgccaagcugagcgaggagcagaagaagcagguggaccuggagcgggagcgcgcgucccaggaggagcagaucgcccggaaggaggaggagcucagccgcgucaaggagcggguggugcagcaggaggucgugcgcuacgaggaggagcccgggcugcgggccgaggccuccgccuucgcggagagcaucgacguggagcugcgccagaucgacaagcuccgggccgagcugcgccgccugcagcggcgccggaccgagcucgagcgccagcuggaggagcuggagcgggagcgccaggcccggcgcgaggccgagcgggagguccagcgccuccagcagcggcuggccgcgcuggagcaggaggaggccgaggcccgcgagaaggugacccacacgcagaaggugguccuccagcaggacccccagcaggcccgggagcacgcgcugcugcgccuccagcuggaggaggagcagcaccggcgccagcugcucgagggcgagcuggagacccugcggcgcaagcucgccgcccuggagaaggccgaggugaaggagaaggugguccuguccgagagcgugcagguggagaagggggacaccgagcaggagauccagcggcucaaguccagccuggaggaggagucccgcagcaagcgcgagcuggacgucgaggugucccggcucgaggcccgccugagcgagcuggaguuccacaacuccaagagcuccaaggagcucgacuuccugcgggaggagaaccacaagcugcagcucgagcgccagaaccugcagcuggagacccggcgccuccagagcgagaucaacauggcggccacggagacccgggaccugcgcaacaugaccguggccgacagcggcaccaaccacgacucccggcuguggagccucgagcgcgagcuggacgaccugaagcggcucuccaaggacaaggaccuggagaucgacgagcugcagaagcgccucggcagcgucgccgugaagcgggagcagcgcgagaaccaccugcggcgcuccaucguggucauccaccccgacacggggcgggagcugagcccggaggaggcccaccgcgcgggccucaucgacuggaacauguucgugaagcugcggucccaggagugcgacugggaggagaucagcgugaaggggcccaacggcgaguccagcgucauccacgaccgcaaguccgggaagaaguucagcaucgaggaggcccugcaguccggccggcucacccccgcccaguacgaccgcuacgugaacaaggacaugagcauccaggagcuggccgugcuggucuccggccagaaguga

SEQ ID NO: 34922 - RNA, 1149 nt, Artificial Sequence
  derived and/or modified sequence opt1 from PPM1A__Homo_sapiens__NP_066283
augggcgccuuccuggacaagcccaagauggagaagcacaacgcccaggggcagggcaacgggcuccgcuacggccugagcuccaugcagggguggcggguggagauggaggacgcgcacaccgccgucaucggccugcccagcggccucgaguccuggagcuucuucgccguguacgacgggcacgccggcucccagguggccaaguacugcugcgagcaccuccuggaccacaucaccaacaaccaggacuucaaggggagcgcgggcgcccccuccgucgagaacgugaagaacgggauccgcacgggcuuccuggagaucgacgagcacaugcgggugaugagcgagaagaagcacggcgccgaccgcuccgggagcaccgccgucggcgugcugaucagcccccagcacaccuacuucaucaacugcggggacucccggggccugcucugccgcaaccggaaggugcacuucuucacccaggaccacaagcccuccaacccgcuggagaaggagcgcauccagaacgcgggcgggagcgucaugauccagcgggugaacggcucccuggccgugagccgcgcccucggggacuucgacuacaagugcguccacggcaaggggcccacggagcagcuggugucccccgagcccgaggugcacgacaucgagcggagcgaggaggacgaccaguucaucauccuggccugcgacggcaucugggacgucaugggcaacgaggagcucugcgacuucgugcgcucccggcuggaggugaccgacgaccuggagaaggucugcaacgaggugguggacacgugccucuacaaggggagccgcgacaacaugagcgucauccugaucugcuucccgaacgcccccaaggugucccccgaggcggugaagaaggaggccgagcuggacaaguaccucgagugccgggucgaggagaucaucaagaagcagggcgagggggugcccgaccugguccacgugaugcgcacccuggccagcgagaacaucccgucccucccgcccggcggggagcuggccagcaagcggaacgugaucgaggccgucuacaaccgccugaaccccuacaagaacgacgacaccgacuccaccagcaccgacgacaugugguga

SEQ ID NO: 34923 - RNA, 1143 nt, Artificial Sequence
  derived and/or modified sequence opt1 from PPM1B__Homo_sapiens__NP_001028729
augggcgccuuccuggacaagcccaagaccgagaagcacaacgcccacggggcgggcaacgggcuccgcuacggccugagcuccaugcagggguggcggguggagauggaggacgcccacaccgccgucgugggcaucccgcacggccuggaggacuggagcuucuucgccguguacgacgggcacgccggcucccgcgucgcgaacuacugcagcacccaccuccuggagcacaucaccaccaacgaggacuuccgggccgccgggaaguccggcagcgcccuggagcucuccguggagaacgugaagaacgggauccgcaccggcuuccugaagaucgacgaguacaugcggaacuucagcgaccugcgcaacggcauggaccgguccgggagcacggcggucggcgugaugaucucccccaagcacaucuacuucaucaacugcggggacagccgcgccgugcucuaccggaacggccaggucugcuucuccacccaggaccacaagcccugcaacccccgcgagaaggagcggauccagaacgccggcgggagcgugaugauccagcgcgugaacggcucccuggccgucagccgggcccugggggacuacgacuacaagugcguggacggcaaggggccgaccgagcagcucgugucccccgagcccgaggucuacgagauccugcgcgcggaggaggacgaguucaucauccuggccugcgacggcaucugggacgugaugagcaacgaggagcucugcgaguacgugaagucccggcuggaggucagcgacgaccuggagaacgugugcaacuggguggucgacacgugccuccacaagggcagccgcgacaacauguccaucgugcuggugugcuucagcaacgcccccaaggucuccgacgaggccgugaagaaggacagcgagcuggacaagcaccucgagucccgggucgaggagaucauggagaaguccggggaggagggcaugccggaccuggcccacgugaugcgcauccugagcgcggagaacauccccaaccucccgcccgggggcgggcuggccggcaagcggaacgugaucgaggccgucuacagccgccugaacccccaccgggaguccgacggccagaaguga

SEQ ID NO: 34924 - RNA, 1818 nt, Artificial Sequence
  derived and/or modified sequence opt1 from PPM1D__Homo_sapiens__NP_003611
auggccggccuguacagccucgggguguccgucuucagcgaccagggcgggcgcaaguacauggaggacgugacccagaucguggucgagcccgagccgaccgccgaggagaagcccagcccccggcgcucccugucccagccccugccgccccggcccagccccgcggcccucccgggcggggagguguccggcaagggccccgccguggccgcccgcgaggcgcgggacccccugcccgacgccggggccagcccggcccccucccgcugcugccggcgccggagcuccgucgcguucuucgccgugugcgacggccacgggggccgcgaggccgcccaguucgcccgggagcaccuguggggguucaucaagaagcagaagggcuucacgagcuccgagcccgcgaaggugugcgccgccauccgcaagggcuuccucgccugccaccuggccauguggaagaagcuggcggaguggcccaagaccaugaccgggcucccgagcaccuccggcacgaccgccagcgucgugaucauccgggggaugaagauguacguggcccacgucggcgacuccggcguggugcuggggauccaggacgaccccaaggacgacuucguccgcgccguggaggugacccaggaccacaagcccgagcugcccaaggagcgggagcgcaucgagggccucgggggcagcgucaugaacaaguccggggugaaccggguggucuggaagcgcccgcggcugacccacaacggccccgugcgccggagcacggugaucgaccagauccccuuccuggccgucgcgcgcgcccucggcgaccuguggagcuacgacuucuucuccggggaguucguggucagccccgagccggacaccuccgugcacacccuggacccccagaagcacaaguacaucauccucggcagcgacgggcuguggaacaugaucccgccccaggacgccaucuccaugugccaggaccaggaggagaagaaguaccugaugggcgagcacgggcagagcugcgccaagaugcucgugaaccgcgcccugggccgguggcgccagcggaugcugcgcgcggacaacaccuccgccaucgucaucugcaucagccccgagguggacaaccagggcaacuucacgaacgaggacgagcucuaccugaaccugaccgacucccccagcuacaacucccaggagaccugcgugaugacccccagcccgugcuccacgccgcccgucaagagccucgaggaggaccccuggccccgggugaacuccaaggaccacauccccgcccuggugcgcagcaacgccuucuccgagaacuuccuggaggucagcgcggagaucgcccgggagaacgugcaggggguggucauccccuccaaggaccccgagccgcucgaggagaacugcgccaaggcccugacccugcgcauccacgacagccucaacaacagccugcccaucggccuggugcccaccaacuccaccaacacggugauggaccagaagaaccucaagaugagcacccccgggcagaugaaggcccaggagaucgagcggaccccgcccaccaacuucaagcgcacgcuggaggaguccaacagcggcccccugaugaagaagcaccggcgcaacgggcucucccggagcuccggcgcgcagcccgccagccugccgaccaccucccagcgcaagaacagcgucaagcugaccaugcggcgccggcuccgcggccagaagaagaucgggaacccccugcugcaccagcaccggaagacggugugcgugugcuga

SEQ ID NO: 34925 - RNA, 2268 nt, Artificial Sequence
  derived and/or modified sequence opt1 from PPM1E__Homo_sapiens__NP_055721
auggccggcugcauccccgaggagaagaccuaccgccgguuccuggagcuguuccugggggaguuccgcggcccgugcgggggcggggagcccgagcccgagcccgagccggagcccgagcccgagcccgagagcgagccggagcccgagcccgagcugguggaggccgaggcggccgaggccuccgucgaggagcccggcgaggaggccgccaccguggcggccacggaggagggcgaccaggagcaggacccggagcccgaggaggaggccgccguggagggggaggaggaggaggagggcgcggccaccgccgccgccgcgcccgggcacagcgccgugcccccgcccccgccccagcucccgccccugccgccccugccccggccccucuccgagcgcaucacccgggaggaggucgagggcgagagccuggaccugugccuccagcagcuguacaaguacaacugccccuccuuccuggccgccgcccucgcgcgcgccaccagcgacgaggugcugcaguccgaccugagcgcccacuacauccccaaggagacggacgggaccgagggcaccgucgagaucgagaccgugaagcucgcccgguccguguucagcaagcugcacgagaucugcugcuccugggucaaggacuucccgcugcgccggcgcccccagcucuacuacgagacgagcauccacgccaucaagaacaugcggcgcaagauggaggacaagcacgugugcauccccgacuucaacaugcuguucaaccuggaggaccaggaggagcaggcguacuucgccguguucgacggccacgggggcgucgacgccgccaucuacgccuccauccaccuccacgugaaccuggugcggcaggagauguucccccacgaccccgcggaggcccugugccgcgccuuccgggucaccgacgagcgcuucgugcagaaggccgcgcgggagagccuccgcugcgggaccaccggcguggucacguucauccggggcaacaugcugcacguggccugggugggggacucccaggucaugcuggugcgcaagggccaggccguggagcucaugaagccccacaagcccgaccgggaggacgagaagcagcgcaucgaggcccucgggggcugcgucgugugguucggggccuggcgcgucaacggcagccuguccgugagccgggcgaucggcgacgccgagcacaagccguacaucugcggggacgccgacuccgccagcaccgugcucgacggcaccgaggacuaccugauccuggccugcgacggguucuacgacaccgucaaccccgacgaggcggugaagguggucagcgaccaccucaaggagaacaacggcgacuccagcaugguggcccacaagcugguggccuccgcccgcgacgccgggagcuccgacaacaucacggucaucgugguguuccugcgggacaugaacaaggcggucaacgugagcgaggaguccgacuggaccgagaacagcuuccagggcggccaggaggacgggggcgacgacaaggagaaccacggggagugcaagcgccccuggccccagcaccagugcuccgccccggccgaccucggcuacgacgggcggguggacagcuucaccgaccgcaccucccugagccccggcucccagaucaacguccuggaggaccccggcuaccucgaccugacgcagaucgaggccagcaagccccacuccgcgcaguuccugcucccgguggagauguucgggcccggcgcccccaagaaggccaaccugaucaacgagcugaugauggagaagaaguccgugcagagcagccuccccgagugguccggggccggcgaguucccgaccgccuucaaccugggcagcaccggggagcagaucuaccggaugcagagccugucccccgucugcagcggccucgagaacgagcaguucaagucccccgggaaccgcgugagccggcugucccaccuccgccaccacuacagcaagaaguggcaccgguuccgcuucaaccccaaguucuacuccuuccugagcgcgcaggagccgucccacaagaucggcaccagccuguccagccugacgggguccggcaagcggaaccgcauccggagcucccugcccuggcgccagaacagcuggaagggcuacuccgagaacaugcggaagcuccgcaagacccacgacauccccugccccgaccugccguggagcuacaagaucgaguga

SEQ ID NO: 34926 - RNA, 1365 nt, Artificial Sequence
  derived and/or modified sequence opt1 from PPM1F__Homo_sapiens__NP_055449
augagcuccggcgcgccccagaaguccagcccgauggccagcggggccgaggagacccccggcuuccuggacacccuccugcaggacuuccccgcccugcucaaccccgaggacccgcugcccuggaaggcccccgggacggugcugucccaggaggaggucgagggcgagcucgccgagcuggccaugggguuccugggcagccgcaaggcgcccccgccccucgccgccgcccuggcgcacgaggccgugucccagcugcuccagaccgaccugagcgaguuccggaagcugccccgcgaggaggaggaggaggaggaggacgacgacgaggaggagaaggcccccgugacccuccuggacgcccagucccuggcccagagcuucuucaaccggcucugggaggucgcgggccaguggcagaagcaggucccgcuggccgcccgcgccucccagcggcaguggcuggugagcauccacgccauccgcaacacccggcgcaagauggaggaccggcacgugucccuccccagcuucaaccagcuguucgggcuguccgaccccgugaaccgcgcguacuucgccguguucgacggccacgggggcgucgacgccgcccgguacgccgcggugcacgugcacacgaacgccgcccgccagcccgagcucccgaccgaccccgagggggcccugcgggaggccuuccgccggaccgaccagauguuccugcgcaaggcgaagcgggagcgccuccagagcggcaccacgggcgucugcgcccugaucgccggggccacccugcacguggcguggcucggcgacucccaggugauccugguccagcagggccagguggugaagcugauggagccccaccggcccgagcgccaggacgagaaggcccggaucgaggcccucgggggcuucgucagccacauggacugcuggcgcgugaacgggacccuggccgugucccgcgccaucggcgacgucuuccagaagccguacgugagcggggaggcggacgccgccagccgggcccugaccggcuccgaggacuaccuccugcuggccugcgacggguucuucgacguggucccccaccaggagguggucggccucgugcagagccaccugacgcgccagcagggcuccgggcugcggguggcggaggagcucgucgccgccgcccgcgagcggggcagccacgacaacaucaccgugaugguggucuuccugcgcgacccccaggagcugcucgagggcgggaaccagggggagggcgacccccaggccgagggccggcgccaggaccugccguccagccugcccgagcccgagacccaggcgcccccgcgguccuga

SEQ ID NO: 34927 - RNA, 1641 nt, Artificial Sequence
  derived and/or modified sequence opt1 from PPM1G__Homo_sapiens__NP_817092
augggcgccuaccugagccagcccaacaccgugaagugcuccggggacggcgucggggccccgcgccucccccugcccuacggcuucagcgcgaugcagggguggcggguguccauggaggacgcccacaacugcauccccgagcuggacagcgagaccgccauguucuccguguacgacggccacggcggggaggaggucgcccucuacugcgccaaguaccugccggacaucaucaaggaccagaaggcguacaaggagggcaagcugcagaaggcccucgaggacgccuuccuggccaucgacgcgaagcugacgaccgaggaggugaucaaggagcucgcccagaucgccgggcgccccaccgaggacgaggacgagaaggagaagguggccgacgaggacgacgucgacaacgaggaggccgcgcugcugcacgaggaggccaccaugacgaucgaggagcuccugacccgguacggccagaacugccacaaggggccgccccacagcaaguccggcggcgggaccggcgaggagcccgggagccagggccugaacggcgaggccgggcccgaggacuccacccgcgagacgcccagccaggagaacggccccaccgccaaggccuacaccggguucuccagcaacuccgagcggggcaccgaggcgggccaggugggggagccgggcauccccacgggggaggccggccccagcugcuccagcgccuccgacaagcucccccgcguggccaagagcaaguucuucgaggacuccgaggacgagagcgacgaggccgaggaggaggaggaggacagcgaggagugcuccgaggaggaggacggguacagcuccgaggaggcggagaacgaggaggacgaggacgacaccgaggaggccgaggaggacgacgaggaggaggaggaggagaugauggucccgggcauggaggggaaggaggagcccggcagcgacuccggcaccaccgccgugguggcccugauccgggggaagcagcugaucgucgccaacgcgggcgacagccgcugcgugguguccgaggccgggaaggcccucgacaugagcuacgaccacaagcccgaggacgaggucgagcuggcccggaucaagaacgcgggcgggaaggugacgauggacggccgcgugaacggcgggcugaaccucucccgggccaucggcgaccacuucuacaagcgcaacaagaaccugcccccggaggagcagaugaucagcgcccugcccgacaucaagguccucacccugaccgacgaccacgaguucauggugaucgccugcgacgggaucuggaacgugauguccagccaggaggucguggacuucauccaguccaagaucagccagcgggacgagaacggcgagcugcgccuccuguccagcaucguggaggagcugcucgaccagugccuggcccccgacaccuccggcgacgggacgggcugcgacaacaugaccugcaucaucaucugcuucaagccccggaacaccgcggagcugcagccggagagcgggaagcgcaagcucgaggagguccuguccaccgagggcgccgaggagaacgggaacagcgacaagaagaagaaggccaagcgggacuga

SEQ ID NO: 34928 - RNA, 1545 nt, Artificial Sequence
  derived and/or modified sequence opt1 from PPM1H__Homo_sapiens__NP_065751
augcugacccgcgucaagagcgccguggccaacuucaugggcgggaucauggcgggcuccagcggguccgagcacggcgggggcagcugcggcggguccgaccucccccugcgguucccguacggccgccccgaguuccuggggcucagccaggacgagguggagugcuccgccgaccacaucgcccggcccauccugauccugaaggagacccgccggcuccccugggccacgggcuacgccgaggugaucaacgcgggcaagagcacccacaacgaggaccaggccuccugcgagguccugaccgugaagaagaaggccggggccgugaccagcacgccgaaccgcaacuccagcaagcggcgcuccagccugcccaacggcgaggggcuccagcugaaggagaacuccgagagcgagggcgucuccugccacuacuggagccuguucgacgggcacgcgggcuccggcgccgccgugguggccagccggcuccugcagcaccacaucaccgagcagcugcaggacaucgucgacauccucaagaacagcgccgugcugcccccgaccugccugggggaggagcccgagaacacccccgcgaacucccgcacgcucacccgggccgccagccugcgcggcggggugggcgcccccgggucccccagcaccccgcccacccgguucuucacggagaagaagaucccccacgagugccuggucaucggcgcccucgaguccgcguucaaggagauggaccugcagaucgagcgcgagcggagcuccuacaacaucagcggcgggugcaccgcccugaucgugaucugccuccugggcaagcuguacguggccaacgccggggacucccgcgccaucaucauccggaacggcgagaucauccccaugagcuccgaguucaccccggagaccgagcgccagcggcuccaguaccuggcguucaugcagccccaccuccuggggaacgaguucacgcaccuggaguucccccgccggguccagcgcaaggagcugggcaagaagaugcucuaccgcgacuucaacaugaccggcugggccuacaagaccaucgaggacgaggaccugaaguucccccugaucuacggggagggcaagaaggcccgggugauggccaccaucggggugacgcgcggccucggggaccacgaccugaagguccacgacagcaacaucuacaucaagccguuccuguccagcgcccccgaggugcggaucuacgaccucuccaaguacgaccacggcagcgacgacgugcugauccuggcgaccgacggccucugggacguccuguccaacgaggagguggccgaggccaucacccaguuccugcccaacugcgaccccgacgacccgcaccgcuacacccucgccgcgcaggaccuggugaugcgggcccgcgggguccugaaggaccggggcuggcgcaucagcaacgaccggcucggguccggcgacgacaucagcguguacgucaucccccugauccacggcaacaagcugagcuga

SEQ ID NO: 34929 - RNA, 1119 nt, Artificial Sequence
  derived and/or modified sequence opt1 from PPM1K__Homo_sapiens__NP_689755
augagcaccgccgcccugaucacccucgugcgcuccggcgggaaccagguccggcgccgggugcugcugagcucccgccuccugcaggacgaccggcgcgugacgccgaccugccacagcuccaccagcgagccccggugcucccgcuucgaccccgacggcagcgggucccccgcgaccugggacaacuucggcaucugggacaaccggaucgacgagcccauccugcucccgcccagcaucaaguacgggaagcccauccccaagaucucccuggagaacgucggcugcgccagccagaucggcaagcgcaaggagaacgaggaccgguucgacuucgcccagcugacggacgaggugcucuacuucgccguguacgacgggcacggcgggccggccgcggccgacuucugccacacccacauggagaagugcaucauggaccugcugcccaaggagaagaaccucgagacccugcugacccucgccuuccuggagaucgacaaggccuucuccagccacgcgcgccuguccgccgacgccacgcuccugaccagcggcaccaccgccacggucgcccugcuccgggacgggaucgagcuggugguggcguccgucggcgacagccgcgccauccugugccggaagggcaagcccaugaagcucaccaucgaccacacccccgagcgcaaggacgagaaggagcggaucaagaagugcgggggcuucguggccuggaacucccuggggcagccgcacgugaacggccgccuggccaugacccggagcaucggcgaccucgaccugaagacgagcggggucaucgccgagcccgagaccaagcgcaucaagcugcaccacgcggacgacuccuuccucgugcugaccaccgacggcaucaacuucauggugaacagccaggagaucugcgacuucgucaaccagugccacgaccccaacgaggccgcccacgccgugacggagcaggccauccaguacgggaccgaggacaacuccaccgcgguggucgugcccuucggcgccugggggaaguacaagaacagcgagaucaacuucuccuucagccgguccuucgccagcuccggccgcugggccuga

SEQ ID NO: 34930 - RNA, 1083 nt, Artificial Sequence
  derived and/or modified sequence opt1 from PPM1L__Homo_sapiens__NP_640338
augaucgaggacaccaugacccugcucagccugcugggccgcaucaugcgguacuuccuccugcgccccgagacgcuguuccuccugugcaucucccuggcccucuggagcuacuucuuccacaccgacgaggugaagaccaucgucaaguccagccgggacgccgugaagauggugaaggggaaggucgcggagaucaugcagaacgaccgccugggcgggcuggacgugcucgaggccgaguucuccaagaccugggaguucaagaaccacaacguggccgucuacagcauccagggccggcgcgaccacauggaggaccgguucgaggugcugacggaccuggccaacaagacccacccguccaucuucgggaucuucgacggccacggcggggagaccgccgcggaguacgucaagagccgccuccccgaggcccugaagcagcaccuccaggacuacgagaaggacaaggagaacuccgugcugagcuaccagaccauccuggagcagcagauccuguccaucgaccgggagaugcucgagaagcugacggugagcuacgacgaggccggcacgaccugccugaucgcccuccuguccgacaaggaccugaccguggcgaacgucggggacagccgcggcgugcucugcgacaaggacgggaacgccaucccccugucccacgaccacaagcccuaccagcugaaggagcggaagcgcaucaagcgggccggcggcuucaucagcuucaacggguccuggcgcgugcagggcauccucgccaugagccggucccugggggacuacccgcugaagaaccucaacgucgugauccccgaccccgacauccugaccuucgaccuggacaagcuccagcccgaguucaugauccuggccagcgacggccugugggacgcguucagcaacgaggaggccgugcgcuucaucaaggagcggcucgacgagccgcacuucggcgccaaguccaucguccugcagagcuucuaccgcgggugccccgacaacaucaccgugaugguggucaaguuccggaacuccagcaagaccgaggagcaguga

SEQ ID NO: 34931 - RNA, 744 nt, Artificial Sequence
  derived and/or modified sequence opt1 from PPM1M__Homo_sapiens__NP_001116342
augggcgggugcaccgcccugguggccgucagccuccagggcaagcuguacauggcgaacgccggggacucccgcgccauccuggugcggcgcgacgagauccggccccucagcuucgaguucaccccggagacggagcgccagcggauccagcagcuggccuucguguaccccgagcugcucgccggcgaguucacccgccuggaguucccccggcgccugaagggggacgaccucggccagaagguccuguuccgggaccaccacauguccggcuggagcuacaagcgcguggagaaguccgaccugaaguacccccucauccacgggcagggccggcaggcgcgccugcuggggacccucgccgugagccggggccugggggaccaccagcugcgcguccucgacaccaacauccagcugaagccguuccugcucuccgugccccaggugacgguccuggacguggaccagcuggagcuccaggaggacgacguggucgugauggccaccgacggccugugggacgugcugagcaacgagcaggucgccuggcucgugcgguccuuccugcccggcaaccaggaggacccccaccgcuucagcaagcuggcgcagaugcucauccacuccacccaggggaaggaggacagccugaccgaggagggccagguguccuacgacgacgucagcguguucgugaucccgcugcacucccaggggcaggagagcuccgaccacuga

SEQ ID NO: 34932 - RNA, 1203 nt, Artificial Sequence
  derived and/or modified sequence opt1 from PPME1__Homo_sapiens__NP_001258522
augagcgcccuggagaaguccaugcaccucggccgccugcccagccggccgccccugcccggguccggcgggagccaguccggcgccaagaugcgcauggggcccggccggaagcgcgacuucagcccggugcccuggucccaguacuucgagagcauggaggacgucgagguggagaacgagaccggcaaggacaccuuccggguguacaaguccgggagcgagggccccguccuccugcugcuccacgggggcgggcacuccgcgcugagcugggccguguucacggccgccaucaucucccgcgugcagugccggaucgucgcccuggaccuccgcagccacggcgagaccaaggugaagaaccccgaggaccuguccgcggagaccauggccaaggacgugggcaacgucguggaggccauguacggggaccugccgccgcccaucaugcucaucggccacagcaugggcggggccaucgcggugcacaccgccuccagcaaccugguccccucccugcucggccugugcaugaucgacgugguggaggggacggccauggacgcccugaacagcaugcagaacuuccuccggggccgccccaagaccuucaagagccuggagaacgccaucgagugguccgucaagagcgggcagauccggaaccuggaguccgcgcgcgugagcauggugggccaggucaagcagugcgaggggaucaccucccccgagggcagcaaguccaucguggagggcaucaucgaggaggaggaggaggacgaggaggggagcgaguccaucagcaagcggaagaaggaggacgacauggagggccuccccuccgagacccagaaccugcuccuguuccugcagacgaagaaggaccaccccuacaccuggcgcaucgagcuggccaagaccgagaaguacugggacgggugguuccggggccucagcaaccuguuccuguccugcccgauccccaagcuccugcugcucgccgggguggaccgccuggacaaggaccugaccaucggccagaugcagggcaaguuccagaugcagguccucccccagugcgggcacgccgugcacgaggacgcccccgacaagguggcggaggccgucgccacguuccugauccggcaccgcuucgccgagccgaucggcggguuccagugcguguuccccggcugcuga

SEQ ID NO: 34933 - RNA, 1434 nt, Artificial Sequence
  derived and/or modified sequence opt1 from PPOX__Homo_sapiens__NP_001116236
augggccgcaccguggucgugcucgggggcgggaucagcggccuggccgccuccuaccaccugagccgggcgcccugcccgcccaaggugguccugguggaguccagcgagcgccucgggggcuggauccgguccgugcgcggccccaacggggccaucuucgagcugggcccccgggggauccgcccggccggcgcccugggggcccggacccuccugcuggucagcgagcucggccuggacuccgaggugcugcccgugcgcggcgaccaccccgcggcccagaaccgguuccucuacgucgggggcgcccugcacgcccugcccacggggcuccgcggccugcugcggccgagcccgcccuucuccaagccccucuucugggcgggccugcgcgagcugaccaagccccgggggaaggagcccgacgagaccgugcacagcuucgcccagcgccggcucggccccgagguggccucccuggccauggacagccugugccgcggggucuucgccggcaacucccgggagcucagcauccgcuccugcuuccccagccuguuccaggcggagcagacccaccgguccauccugcucgggcugcugcucggcgccggccgcacgccgcagcccgacagcgcccugauccggcaggcccuggccgagcgcuggucccaguggagccuccgcgggggccuggagaugcugccccaggcgcucgagacccaccugaccagccgcgggguguccgugcugcggggccagcccgucugcgggcucagccugcaggccgagggccgguggaaggugucccugcgcgacagcucccucgaggccgaccacgugaucagcgccaucccggccuccguccugagcgagcugcuccccgcggaggccgcgccccuggcccgggcccuguccgccaucaccgccgugagcguggccgucgugaaccuccaguaccagggcgcccaccuccccgugcagggguucggccaccuggucccguccagcgaggaccccggggugcugggcaucgucuacgacuccguggcguuccccgagcaggacgggagcccgcccggccugcgcgugacggucaugcugggcggguccuggcugcagacccucgaggccagcggcugcgugcugucccaggagcuguuccagcagcgggcccaggaggccgccgcgacccagcucgggcugaaggagaugcccagccacugccuggugcaccuccacaagaacugcaucccccaguacacccugggccacuggcagaagcuggaguccgcccgccaguuccucacggcccaccggcugccgcugacccucgccggcgccagcuacgagggggucgcggugaacgacugcaucgagagcggccgccaggccgccguguccguccuggggaccgagcccaacagcuga

SEQ ID NO: 34934 - RNA, 1026 nt, Artificial Sequence
  derived and/or modified sequence opt1 from PPP1CA__Homo_sapiens__NP_001008709
augagcgacuccgagaagcugaaccucgacagcaucaucggccgccugcuggaggggucccgggugcucacgccccacugcgccccgguccagggcagccgccccgggaagaacgugcagcugaccgagaacgagauccggggccugugccucaagucccgcgagaucuuccugagccagcccauccugcucgagcuggaggcgccccugaagaucugcggggacauccacggccaguacuacgaccuccugcggcuguucgaguacggcggguucccgcccgaguccaacuaccucuuccugggcgacuacguggaccgcgggaagcagagccuggagaccaucugccuccugcuggccuacaagaucaaguaccccgagaacuucuuccuccugcggggcaaccacgagugcgccuccaucaaccgcaucuacggguucuacgacgagugcaagcggcgcuacaacaucaagcuguggaagaccuucaccgacugcuucaacugccuccccaucgccgccaucgucgacgagaagaucuucugcugccacggcggccugagcccggaccugcaguccauggagcagauccggcgcaucaugcggcccaccgacgugcccgaccaggggcuccugugcgaccugcucuggagcgaccccgacaaggacgugcagggcuggggcgagaacgaccgcggggucuccuucacguucggcgccgaggugguggcgaaguuccugcacaagcacgaccuggaccucaucugccgggcccaccaggucguggaggacggguacgaguucuucgccaagcgccagcuggugacccuguucagcgccccgaacuacugcggcgaguucgacaacgcgggggccaugauguccgucgacgagacccucaugugcagcuuccagauccugaagcccgccgacaagaacaagggcaaguacgggcaguucuccggccugaaccccggcgggcggcccaucaccccgccccgcaacagcgccaaggccaagaaguga

SEQ ID NO: 34935 - RNA, 1014 nt, Artificial Sequence
  derived and/or modified sequence opt1 from PPP1CC__Homo_sapiens__NP_001231903
auggccgaccuggacaagcucaacaucgacagcaucauccagcgccugcuggaggugcggggcuccaagcccgggaagaacguccagcuccaggagaacgagauccgcggccugugccucaagagccgggagaucuuccugucccagccgauccugcuggagcucgaggcgccccugaagaucugcggggacauccacggccaguacuacgaccugcuccgccuguucgaguacgggggcuucccgcccgagagcaacuaccuguuccucggcgacuacguggaccgggggaagcagucccuggagaccaucugccugcuccuggccuacaagaucaaguaccccgagaacuucuuccugcuccgcggcaaccacgagugcgccagcaucaaccggaucuacggguucuacgacgagugcaagcgccgguacaacaucaagcuguggaagaccuucacggacugcuucaacugccugcccaucgccgccaucguggacgagaagaucuucugcugccacggcgggcucucccccgaccugcagagcauggagcagauccgccggaucaugcgccccaccgacgucccggaccagggccugcucugcgaccugcugugguccgaccccgacaaggacgugcucggcuggggcgagaacgaccgcggggugagcuucaccuucggggccgaggucguggcgaaguuccugcacaagcacgaccuggaccucaucugccgggcccaccagguggucgaggacggcuacgaguucuucgccaagcggcagcuggugacccuguucuccgcccccaacuacugcggcgaguucgacaacgcgggggccaugaugagcguggacgagacgcucaugugcuccuuccagauccugaagcccgccgagaagaagaagccgaacgccacccgccccgucaccccgccccggguggccagcggccugaaccccuccauccagaaggcgagcaacuaccgcaacaacaccgugcucuacgaguga

SEQ ID NO: 34936 - RNA, 2823 nt, Artificial Sequence
  derived and/or modified sequence opt1 from PPP1R10__Homo_sapiens__NP_002705
augggcagcgggcccaucgacccgaaggagcugcucaagggccuggacuccuuccugaaccgcgacggggaggugaagagcgucgacggcaucuccaagaucuucagccucaugaaggaggcccggaagauggugucccgcugcaccuaccugaacauccugcuccagacccggagccccgagauccuggugaaguucaucgacgucgggggcuacaagcugcucaacaacuggcugacguacuccaagaccaccaacaacaucccccugcuccagcagauccugcugacccuccagcaccugccccugacgguggaccaccucaagcagaacaacaccgccaagcuggugaagcagcugagcaaguccagcgaggacgaggagcuccgcaagcuggcguccguccuggugagcgacuggauggccgugauccggucccagagcuccacccagccggccgagaaggacaagaagaagcgcaaggacgagggcaagagccggaccacgcuccccgagcgcccccugaccgaggucaaggccgagacccgggccgaggaggcgcccgagaagaagcgcgagaagccgaagucccugcggaccacggcccccagccacgccaaguuccgcuccaccgggcucgagcuggagacccccagccuggugcccgugaagaagaacgccagcaccgucgugguguccgacaaguacaaccucaagccgaucccccugaagcggcagagcaacgucgcggcccccggcgacgccacgcccccggccgagaagaaguacaagccccugaacaccacccccaacgccaccaaggagaucaaggugaagaucauccccccgcagcccauggaggggcucggcuuccuggacgcgcugaacuccgcccccgugcccgggaucaagaucaagaagaagaagaagguccucagcccgacggccgccaagcccucccccuucgagggcaagaccagcaccgagcccuccaccgccaagccgagcucccccgagcccgcgccgcccagcgaggccauggacgccgaccgccccggcacgcccgugccgcccguggagguccccgagcugauggacaccgccucccuggagcccggggcccucgacgcgaagccgguggagagccccggcgaccccaaccagcugacccggaaggggcgcaagcggaaguccgugaccuggcccgaggagggcaagcugcgcgaguacuucuacuucgagcucgacgagacggagcgggucaacgugaacaagaucaaggacuucggcgaggccgccaagcgcgagauccugagcgaccggcacgccuucgagaccgcccgccgccugucccacgacaacauggaggagaaggucccgugggugugcccccggccccucgugcugcccagcccgcuggucacccccggguccaacagccaggagcgcuacauccaggcggagcgggagaagggcauccuccaggagcuguuccugaacaaggaguccccccacgagcccgacccggagcccuacgagcccauccccccgaagcugaucccccucgacgaggagugcagcauggacgagacccccuacguggagacgcuggagccggggggcagcgggggcucccccgacggcgccgggggcagcaagcugccccccgugcucgccaaccugaugggguccaugggcgccgggaagggcccgcagggccccgggggcgggggcaucaacguccaggagauccugaccagcaucauggggucccccaacagccaccccuccgaggagcuccugaagcagccggacuacagcgacaagaucaagcagaugcuggugccccacggccuccugggccccgggcccaucgcgaacggcuucccgcccgggggccccggcgggcccaagggcaugcagcacuucccgcccgggcccggcgggcccaugccgggcccccacggcgggcccggcgggcccgugggcccgcgccugcucgggcccccccccccgccccggggcggcgaccccuucugggacgggccgggcgaccccaugcgcgggggccccaugcgggggggccccggcccggggcccggccccuaccaccgcgggcggggcgggcgcggcggcaacgagcccccgcccccccccccgcccuuccggggggcccgcggcgggcgguccggcggcgggccccccaacggccgcgggggcccggggggcggcauggucgggggcgggggccaccggccccacgaggggcccggcggcgggaugggcaacagcuccgggcaccgcccccacgagggcccggggggcggcauggggagcggccaccggccccacgaggggcccggcggcuccauggggggcgggggcgggcaccgcccccacgagggcccgggcgggggcaucagcgggggcuccgggcaccggccccacgagggccccggcgggggcaugggggccggcgggggccaccgcccccacgagggcccggggggcagcauggggggcuccgggggccaccgcccccacgagggccccgggcacggcgggccgcacggccaccggccccacgacgugcccggccaccgcgggcacgaccaccggggccccccgccccacgagcaccgcgggcacgacggccccgggcacggcggcgggggccaccgggggcacgacggcgggcacagccacggcggcgacaugagcaaccgccccgugugccggcacuucaugaugaaggggaacugccgcuacgagaacaacugcgccuucuaccacccgggcgucaacgggcccccccugcccuga

SEQ ID NO: 34937 - RNA, 381 nt, Artificial Sequence
  derived and/or modified sequence opt1 from PPP1R11__Homo_sapiens__NP_068778
auggccgaggccggcgcggggcugagcgagaccgugaccgagacgaccgucaccgugaccacggagcccgagaaccgcucccucaccaucaagcugcggaagcgcaagccggagaagaagguggaguggaccagcgacaccgucgacaacgagcacaugggccggcgcuccagcaagugcugcugcaucuacgagaagccccgggccuucggggaguccagcacggaguccgacgaggaggaggaggagggcugcgggcacacccacugcgugcgcggccaccggaagggccgccggcgcgccacccuggggcccacccccacgaccccgccccagccgcccgaccccagccagcccccgcccggccccaugcagcacuga

SEQ ID NO: 34938 - RNA, 3093 nt, Artificial Sequence
  derived and/or modified sequence opt1 from PPP1R12A__Homo_sapiens__NP_001137357
augaagauggccgacgccaagcagaagcgcaacgagcagcugaagcgguggaucggcagcgagaccgaccucgagcccccgguggucaagcgccagaagaccaaggugaaguucgacgacggggcgguguuccuggccgccugcuccagcggcgacacggacgagguccugaagcuccugcaccgcggggccgacaucaacuacgccaacguggacggccugaccgcgcuccaccaggccugcaucgacgacaacguggacauggucaaguuccugguggagaacggggccaacaucaaccagcccgacaacgagggcuggaucccccugcacgccgcggccuccugcggcuaccucgacaucgccgaguuccugaucgggcagggcgcccacgugggggccgucaacagcgagggcgacacgccccuggacaucgcggaggaggaggccauggaggagcuccugcagaacgaggugaaccggcaggggguggacaucgaggccgcccggaaggaggaggagcgcaucaugcugcgggacgcccgccaguggcucaacuccggccacaucaacgacguccggcacgccaagagcggcgggaccgcgcugcacguggccgccgccaagggcuacaccgaggugcugaagcuccugauccaggcgggguacgacgucaacaucaaggacuacgacggcuggaccccgcugcacgccgccgcccacuggggcaaggaggaggccugccgcauccucguggacaaccugugcgacauggagauggugaacaaggucgggcagaccgcguucgacguggccgacgaggacauccugggcuaccucgaggagcugcagaagaagcagaaccugcuccacuccgagaagcgggacaagaaguccccgcugaucgagagcaccgccaacauggacaacaaccagagccagaagacguucaagaacaaggagacccugaucaucgagcccgagaagaacgccucccgcaucgagagccucgagcaggagaagguggacgaggaggaggaggggaagaaggacgaguccagcugcuccagcgaggaggacgaggaggacgacuccgagagcgaggcggagaccgacaagaccaagccccuggccuccgucacgaacgccaacaccagcagcacccaggccgcccccguggcggugaccacgcccaccgucuccagcggccaggccacccccaccucccccaucaagaaguucccgacgaccgccaccaagaucagccccaaggaggaggagcggaaggacgagucccccgccaccuggcgccuggggcuccggaagacgggcagcuacggcgcccuggcggagaucaccgccuccaaggaggggcagaaggagaaggacaccgccggcgugacccgcagcgccuccagcccccggcuguccagcucccucgacaacaaggagaaggagaaggacagcaaggggacgcgccuggccuacgucgcgccgaccaucccccggcgccuggccuccaccagcgacaucgaggagaaggagaaccgggacuccagcucccuccgcaccagcagcuccuacacgcgccggaagugggaggacgaccugaagaagaacagcuccgugaacgagggcagcaccuaccacaaguccugcagcuucgggcgccggcaggacgaccugaucuccagcuccgugcccagcaccaccuccacgcccaccgucaccagcgccgccggccuccagaagucccugcugagcuccaccagcaccacgaccaagaucaccaccggcuccagcagcgcggggacgcaguccagcaccuccaaccgccucugggccgaggacagcaccgagaaggagaaggacuccgugccgaccgccgugacgauccccgucgcccccaccguggugaacgccgcggccagcaccaccacgcugaccaccaccacggccggcaccgucuccagcaccaccgaggugcgggagcgccggcgcuccuaccugacgcccgugcgggacgaggagagcgagucccagcgcaaggcccggagccgccaggcccggcagucccgccggagcacccagggggucacccucaccgaccugcaggaggcggagaagacgaucggccgcucccggagcacccgcacccgggagcaggagaacgaggagaaggagaaggaggagaaggagaagcaggacaaggagaagcaggaggagaagaaggaguccgagaccagccgcgaggacgaguacaagcagaaguacucccgcacguacgacgagaccuaccagcgguaccgcccggugagcaccagcuccagcaccacgcccuccagcucccugagcaccauguccagcucccuguacgccagcucccagcucaaccggcccaacagccugguggggaucaccuccgccuacagccgcggcaucaccaaggagaacgagcgggagggcgagaagcgcgaggaggagaaggagggggaggacaagucccagcccaagagcauccgggagcgccggcgcccgcgggagaagcgccgguccacgggcgucagcuucuggacccaggacuccgacgagaacgagcaggagcagcagagcgacaccgaggaggggagcaacaagaaggagacccagaccgacuccaucagccgcuacgagacguccagcaccuccgccggcgaccgguacgacagccugcucggccgcuccgggagcuacuccuaccuggaggagcggaagcccuacagcucccgccuggagaaggacgacagcaccgacuucaagaagcucuacgagcagauccuggccgagaacgagaagcugaaggcgcagcuccacgacaccaacauggagcugacggaccugaagcuccagcuggagaaggccacccagcggcaggagcgcuucgccgaccggucccugcucgagauggagaagcgcgagcgccgggcccuggagcgccggaucagcgagauggaggaggagcugaagaugcuccccgaccugaaggcggacaaccagcgccugaaggacgagaacggcgcccucauccgggugaucuccaagcugagcaaguga

SEQ ID NO: 34939 - RNA, 1548 nt, Artificial Sequence
  derived and/or modified sequence opt1 from PPP1R12B__Homo_sapiens__NP_001161329
auggccgagcuggagcaccucggcgggaagcgcgccgagagcgcgcggaugcgccgggccgagcagcugcgccgguggcgcggcucccugaccgagcaggagcccgccgagcggcgcggggccggccggcagccgcucacccgccgggggagcccccgcgugcgguucgaggacggcgccgucuuccuggcggccugcuccagcggcgacacggacgaggugcgcaagcugcucgcccgcggggccgacaucaacaccgugaacgucgacggccugaccgcgcugcaccaggccugcaucgacgagaaccucgacauggugaaguuccugguggagaaccgggccaacgucaaccagcaggacaacgagggguggacgccccugcacgccgccgcguccugcggcuaccucaacaucgccgaguacuucaucaaccacggggccagcgugggcaucgugaacuccgagggcgagguccccagcgaccuggccgaggagccggccaugaaggaccugcuccuggagcaggucaagaagcaggggguggaccuggagcagucccggaaggaggaggagcagcagaugcuccaggacgcgcgccaguggcugaacagcggcaagaucgaggacgugcggcaggcccgcuccggggccaccgcccugcacguggccgcggccaagggcuacagcgaggugcuccggcugcugauccaggccggcuacgagcucaacguccaggacuacgacggguggacgccccugcacgccgccgcgcacuggggcgugaaggaggccugcuccauccuggccgaggcccucugcgacauggacauccgcaacaagcuggggcagacccccuucgacguggcggacgagggccuggucgagcaccucgagcugcugcagaagaagcagaacgugcuccgcagcgagaaggagacccggaacaagcugaucgaguccgaccugaacagcaagauccaguccggguucuucaagaacaaggagaagaugcucuacgaggaggagacccccaagagccaggagauggaggaggagaacaaggaguccagcagcuccagcuccgaggaggaggagggcgaggacgaggccagcgaguccgagaccgagaaggaggccgacaagaagccggaggccuucgugaaccacagcaacuccgagagcaaguccagcaucaccgagcagauccccgcccccgcgcagaacaccuucuccgccagcuccgcccgccgguucagcuccggccuguucaacaagcccgaggagccgaaggacgagagccccuccagcuggcgccuggggcuccggaagacgggcucccacaacaugcugagcgaggucgccaacagccgcgagcccauccgggaccgcggguccagcaucuaccgguccagcuccagcccccgcaucuccgcccugcucgacaacaaggacaaggugcaguucggccgggugugggggaacagcaaggcggucuucuucuuccacgagaacuccauccugggcaccaacgagaacaucuucuga

SEQ ID NO: 34940 - RNA, 2349 nt, Artificial Sequence
  derived and/or modified sequence opt1 from PPP1R12C__Homo_sapiens__NP_060077
augagcggcgaggacgggcccgccgccggcccgggggcggccgccgccgccgcgcgcgagcggcgccgggagcagcugcgccaguggggcgcccgggccggggccgagcccggccccggcgagcgccgggcgcgcaccgugcgguucgagcgcgccgccgaguuccucgccgccugcgcggggggcgaccuggacgaggcccggcugaugcuccgcgccgccgaccccgggccgggcgccgagcuggaccccgcggccccccccccggcccgggccguccuggacuccaccaacgccgacgggaucagcgcgcuccaccaggccugcaucgacgagaaccuggagguggugcgcuuccuggucgagcagggcgccacggugaaccaggccgacaacgagggcuggaccccccuccacguggccgcguccugcggguaccuggacaucgcccgguaccugcucagccacggcgccaacaucgccgcggucaacuccgacggggaccugccccuggaccucgccgagagcgacgccauggagggccugcugaaggccgagaucgcccgccggggcguggacguggaggcggccaagcgcgccgaggaggagcuccugcugcacgacacccggugcuggcucaacgggggcgccaugcccgaggcccgccacccgcggaccggggcguccgcccugcacgucgccgccgccaagggcuacaucgaggugaugcgccugcuccugcaggcgggguacgaccccgagcugcgcgacggcgacggcuggacgccccuccacgccgccgcccacugggggguggaggacgcgugccggcugcuggccgagcacggcgggggcauggacagccucacccacgccgggcagcgccccugcgaccuggccgacgaggagguccugucccuccuggaggagcuggcccggaagcaggaggaccuccgcaaccagaaggaggcgagccagucccggggccaggagccgcaggcccccagcuccagcaagcaccgccgguccagcgugugccgccuguccagccgggagaagaucucccugcaggaccucagcaaggagcgccggcccggcggggccggcgggcccccgauccaggacgaggacgagggcgaggaggggcccaccgagccccccccggccgagccccgcacccugaacggcgugagcucccccccccacccgagccccaagucccccguccagcuggaggaggccccguucagccggcgcuucggccuccugaagacgggguccagcggcgcgcuggggccccccgagcggcgcaccgccgagggcgcccccggcgccgggcuccagcgguccgccagcuccagcuggcuggagggcaccuccacccaggcgaaggagcugcgccucgcccggaucacgccgacccccagccccaagcugcccgagccguccgugcugagcgaggugaccaagcccccccccugccuggagaacuccagcccgcccucccgcauccccgagcccgagagcccggccaagcccaacguccccaccgccuccacggcgcccccggccgacagccgcgaccggcgccggagcuaccagaugcccgugcgcgacgaggaguccgagagccagcggaaggcccgcucccggcucaugcgccagagccggcgcuccacccagggggugacccugaccgaccugaaggaggccgagaaggccgcgggcaaggcccccgagagcgagaagcccgcccagucccucgacccgagccggcgcccccggguccccgggguggagaacuccgacagcccggcccagcgcgccgaggcgcccgacggccagggccccgggccccaggccgcccgggagcaccgcaaggugggcaaggaguggcgggggccggccgagggcgaggaggccgagcccgcggaccgcucccaggagagcuccacgcuggaggggggccccagcgcccggcgccagcgguggcagcgcgaccugaaccccgagccggagcccgaguccgaggagcccgacggcggguuccgcacccucuacgccgagcugcggcgcgagaacgagcggcugcgcgaggcccucaccgagaccacgcugcggcuggcccagcucaaggucgagcuggagcgcgcgacccagcggcaggagcgcuucgccgagcggcccgcccugcucgagcuggagcgcuucgagcggcgcgcccuggagcggaaggcggccgagcucgaggaggagcugaaggcccugagcgaccuccgcgccgacaaccagcggcugaaggacgagaacgccgcgcugauccgcgugaucuccaagcucagcaaguga

SEQ ID NO: 34941 - RNA, 3273 nt, Artificial Sequence
  derived and/or modified sequence opt1 from PPP1R13B__Homo_sapiens__NP_056131
augaugcccaugauccugaccguguuccucagcaacaacgagcagauccugaccgaggucccgaucacgcccgagacgaccugccgcgacgugguggaguucugcaaggagcccggcgagggguccugccaccuggccgaggucuggcggggcaacgagcgccccaucccguucgaccacaugauguacgagcaccuccagaagugggggccccggcgcgaggaggugaaguucuuccugcggcacgaggacagccccaccgagaacuccgagcagggcgggcgccagacccaggagcagcggacccagcgcaacgugaucaacguccccggcgagaagcggaccgagaacggcguggggaacccgcgcguggagcugacccucagcgagcugcaggacauggccgcgcggcagcagcagcagaucgagaaccagcagcagaugcuggucgccaaggagcagcgccuccacuuccugaagcagcaggagcggcgccagcagcaguccaucagcgagaacgagaagcugcagaagcucaaggagcggguggaggcccaggagaacaagcugaagaagauccgcgccaugcggggccagguggacuacuccaagaucaugaacgggaaccugagcgccgagaucgagcgcuucuccgcgauguuccaggagaagaagcaggagguccagacggccauccuccggguggaccagcugagccagcagcuggaggaccucaagaagggcaagcugaacggguuccaguccuacaacggcaagcugaccggccccgccgccguggagcucaagcgccuguaccaggagcugcagauccggaaccagcucaaccaggagcagaacagcaagcugcagcagcagaaggagcugcucaacaagcgcaacauggaggucgcgaugauggacaagcgcaucuccgagcugcgggagcgccuguacgggaagaagauccagcucaaccgggugaacggcaccagcuccccgcagagcccccuguccaccagcgggcgcguggccgccgucggccccuacauccaggugcccuccgccggcagcuuccccgugcugggggaccccaucaagccgcagagccucuccaucgccagcaacgcggcccacggccgguccaagagcgccaacgacgggaacuggcccacgcugaagcagaacuccagcuccagcgucaagcccguccagguggccggcgccgacuggaaggaccccuccguggaggggagcgugaagcagggcaccgucuccagccagccggugcccuucuccgcgcugggccccaccgagaagcccgggaucgagaucggcaaggugccgccgcccauccccggggucggcaagcagcucccgcccagcuacgggaccuaccccucccccacgccccugggccccggcagcaccuccagccuggagcgccggaaggaggggucccucccccgcccgagcgccggccugcccagccggcagcgccccacccugcuccccgccaccggguccacgccgcagcccggcagcucccagcagauccagcagcggaucagcgugccgcccucccccaccuacccgcccgccgggccgcccgccuuccccgcgggcgacagcaagcccgagcugccccugaccguggccauccgccccuuccucgccgacaagggcucccggccccagagcccccgcaaggggccccagaccgucaacuccagcuccaucuacagcauguaccugcagcaggccacgccgcccaagaacuaccagcccgccgcgcacuccgcccugaacaagagcgugaaggccguguacggcaagccgguccuccccuccgggagcaccucccccagcccccugccguuccugcacggcagccuguccaccggcacgccccagccccagcccccgagcgaguccaccgagaaggagcccgagcaggacgggcccgccgcgcccgccgacggcagcaccguggagucccucccgcggccccugagccccaccaagcugacccccaucgugcacuccccgcuccgcuaccagagcgacgccgaccuggaggcccugcggcgcaagcucgccaacgcgccccggccccugaagaagcgcuccagcaucacggagcccgaggggccgggcgggcccaacauccagaagcugcucuaccagcgcuucaacacccuggccggcggcauggaggggacccccuucuaccagcccuccccgagccaggacuucaugggcacccuggccgacgucgacaacgggaacacgaacgccaacggcaaccucgaggagcugccgcccgcccagcccaccgcgccccugcccgccgagcccgccccguccagcgacgccaacgacaacgagcuccccucccccgagcccgaggagcugaucugcccgcagaccacccaccagaccgccgagcccgcggaggacaacaacaacaacguggccacggugcccaccaccgagcagauccccagcccggucgccgaggcccccucccccggggaggagcaggucccgcccgcgccccugccgcccgccagccacccgcccgccaccuccacgaacaagcggaccaaccucaagaagcccaacagcgagcgcaccggccacggccugcgggugcgcuucaacccccuggcccuccugcuggacgccagccucgagggggaguucgaccuggugcagcggaucaucuacgagguggaggaccccuccaagcccaacgacgagggcaucaccccgcugcacaacgcggugugcgccgggcaccaccacaucgucaaguuccuccuggacuucggcgugaacgugaacgccgccgacagcgacggguggacgccccugcacugcgccgcguccugcaacagcguccaccucugcaagcagcugguggaguccggcgccgccaucuucgccagcaccaucuccgacaucgagaccgccgcggacaagugcgaggagauggaggagggcuacauccagugcagccaguuccuguacggggugcaggagaagcucggcgucaugaacaaggggguggccuacgcccugugggacuacgaggcccagaacuccgacgagcugagcuuccacgagggcgacgcgcucaccauccugcgccggaaggacgaguccgagacggagugguggugggcccgccugggggaccgggagggcuacgugcccaagaaccuccugggccuguacccccgcaucaagccccggcagcgcacccucgccuga

SEQ ID NO: 34942 - RNA, 2487 nt, Artificial Sequence
  derived and/or modified sequence opt1 from PPP1R13L__Homo_sapiens__NP_001135974
auggacagcgaggccuuccaguccgcccgcgacuuccuggacaugaacuuccagagccucgcgaugaagcacauggaccugaagcagauggagcuggacaccgccgccgccaagguggacgagcucaccaagcagcuggagucccuguggagcgacucccccgccccgcccgggccccaggcggggcccccgagccggccgccccgcuacuccagcuccagcauccccgagcccuucggcucccgggggagcccccgcaaggccgccacggacggcgccgacacccccuucgggcgguccgagagcgcgcccacccuccacccguacagcccccugucccccaagggccgccccuccagcccgcggacgccccuguaccuccagcccgacgccuacggcucccuggaccgcgccaccagcccccggccgcgcgccuucgacggggccggcagcucccuggggcgggcgcccagcccccgccccggcccggggccccuccggcagcagggcccgcccacccccuucgacuuccugggccgcgccggguccccgcggggcagcccccuggccgaggggccccaggccuucuuccccgagcgcggccccagcccccggccgcccgccaccgcguacgacgcccccgccuccgccuucggcuccagccuccugggguccggcgggagcgccuucgcgcccccgcugcgcgcccaggacgaccucacccugcggcgccggccgcccaaggccuggaacgaguccgaccuggacgucgccuacgagaagaagcccagccagacggccuccuacgagcgccucgacguguucgcgcgccccgccagccccucccugcagcugcuccccuggcgggagagcucccuggacggccucgggggcaccggcaaggacaaccugaccagcgccacccugccccgcaacuacaagguguccccgcuggccagcgaccggcgcagcgacgcgggguccuaccggcgcagccucggcuccgccgggcccagcggcacgcugccccgguccuggcagcccgucagccgcaucccgaugccgcccuccagcccccagccccgcggggcgccccggcagcggcccaucccgcuguccaugaucuucaagcuccagaacgccuucugggagcacggcgccagccgcgccaugcugcccggcagcccccuguucacccgggcgcccccgcccaagcuccagccccagccccagccgcagccccagccccagucccagccccagccgcagcugccgccccagccccagacccagccccagacccccacgcccgcgccccagcacccgcagcagaccuggccgcccgugaacgaggggccgcccaagccgcccaccgagcuggagcccgagcccgagaucgagggccuccugacccccgugcuggaggccggggacgucgacgagggccccguggcccgcccccucucccccacgcggcugcagcccgcccugcccccggaggcccagagcgugcccgagcucgaggaggucgcccgcgugcuggccgagaucccccggccccugaagcgccggggguccauggagcaggccccggccguggcccucccgcccacccacaagaagcaguaccagcagaucaucagccgccuguuccaccgccacggcggccccgggcccggcgggcccgagcccgagcugucccccaucaccgagggcagcgaggcccgggccggcccgcccgcgcccgcgcccccggcccccaucccgccgcccgcccccagccaguccagcccgcccgagcagccccaguccauggagaugcgcagcguccugcggaaggccgggagcccccgcaaggcccggcgcgcccggcucaacccccuggugcugcuccuggacgccgcccugaccggcgagcucgaggugguccagcaggccgugaaggagaugaacgaccccucccagcccaacgaggaggggaucacggcgcugcacaacgccaucugcggcgccaacuacuccaucguggacuuccugaucaccgccggggccaacgucaacagccccgacucccacggcuggacgccccuccacugcgcggccagcugcaacgacaccgugaucugcauggcccuggugcagcacggcgccgcgaucuucgccaccacccuguccgacggggccaccgccuucgagaagugcgacccguaccgcgagggcuacgccgacugcgcgaccuaccucgccgacgucgagcagagcauggggcugaugaacuccggcgccguguacgcccugugggacuacagcgccgaguucggggacgagcucuccuuccgggagggcgagagcgugacgguccugcgccgggacggccccgaggagaccgacugguggugggcggcccugcacgggcaggagggcuacgugccccgcaacuacuucggccucuucccccgggucaagccgcagcgcuccaagguguga

SEQ ID NO: 34943 - RNA, 363 nt, Artificial Sequence
  derived and/or modified sequence opt1 from PPP1R14A__Homo_sapiens__NP_001230876
auggccgcccagcgccugggcaagcgggugcucagcaagcugcagucccccagccgcgcgcgggggccgggcgggucccccggcgggcugcagaagcgccacgcccgggucaccgugaaguacgaccgccgggagcuccagcgccggcuggacguggagaaguggaucgacggccgccuggaggagcucuaccggggcauggggcugcucaagagcugcggcaagcccgucgaggacuucauccaggagcugcuggccaagcugcaggggcuccaccgccagcccggccugcggcagccgucccccagccacgacgggucccugagcccccuccaggaccgcgcccggaccgcccaccccuga

SEQ ID NO: 34944 - RNA, 444 nt, Artificial Sequence
  derived and/or modified sequence opt1 from PPP1R14B__Homo_sapiens__NP_619634
auggccgacagcggcaccgccgggggcgcggcccuggccgcccccgccccggggcccggcuccgggggccccggcccccgcguguacuuccagagcccgcccggggcggccggcgaggggcccggcggggccgacgacgagggccccguccggcgccagggcaaggugaccgugaaguacgaccggaaggagcuccgcaagcggcugaaccuggaggaguggauccucgagcagcugacccgccuguacgacugccaggaggaggagaucccggagcucgagaucgacgucgacgagcugcuggacauggaguccgacgacgcccgggcggcccgcgugaaggagcuccugguggacugcuacaagcccaccgaggccuucaucagcgggcugcucgacaagauccggggcaugcagaagcuguccacgccccagaagaaguga

SEQ ID NO: 34945 - RNA, 498 nt, Artificial Sequence
  derived and/or modified sequence opt1 from PPP1R14C__Homo_sapiens__NP_112211
augagcguggccaccggcuccagcgagaccgccgggggcgcguccgggggcggggcccgcgucuucuuccagagcccccggggcggcgccgggggcuccccggggagcuccagcggcuccgggagcucccgcgaggacagcgcccccguggccacggcggccgccgccggccaggugcagcagcagcagcagcggcgccaccagcagggcaaggucaccgugaaguacgaccggaaggagcugcgcaagcggcucgugcuggaggaguggaucgucgagcagcuggggcagcucuacggcugcgaggaggaggagaugcccgagguggagaucgacaucgacgaccugcuggacgcggacuccgacgaggagcgcgccagcaagcuccaggaggcccugguggacugcuacaagcccaccgaggaguucaucaaggagcugcucucccggauccgcgggaugcggaagcugagcccgccccagaagaaguccgucuga

SEQ ID NO: 34946 - RNA, 2025 nt, Artificial Sequence
  derived and/or modified sequence opt1 from PPP1R15A__Homo_sapiens__NP_055145
auggcccccggccaggccccgcaccaggcgacccccuggcgcgacgcccaccccuucuuccugcucagccccgugauggggcugcugucccgggccuggagccgccuccggggccuggggccgcuggagcccuggcucgucgaggccgugaagggcgccgcgcugguggaggccgggcuggagggcgaggcccgcacgccccucgccaucccccacaccccguggggccggcgccccgaggaggaggcggaggacuccgggggccccggggaggaccgggagacccugggccugaagaccagcuccagccuccccgaggccugggggcugcuggacgacgacgacggcauguacggcgagcgcgaggccaccuccgucccgcgggggcagggcagccaguucgccgacgggcagcgcgcgccccucucccccagccugcugauccggacgcuccagggcuccgacaagaaccccggcgaggagaaggccgaggaggaggggguggccgaggaggagggcgugaacaaguucagcuacccgcccucccaccgcgagugcugccccgccgucgaggaggaggacgacgaggaggccgugaagaaggaggcccaccggaccagcaccuccgcgcugagccccggguccaagccgagcaccuggguguccugccccggcgaggaggagaaccaggccacggaggacaagcgcaccgagcggagcaagggggcccgcaagaccagcgucagcccccgguccuccggcagcgacccccgcuccugggaguaccggagcggcgaggccuccgaggagaaggaggagaaggcccacaaggagaccgggaagggcgaggcggccccggggccccagagcuccgcccccgcccagcgcccccagcucaagagcugguggugccagccguccgacgaggaggagggcgaggugaaggcccugggggcggccgagaaggacggcgaggccgagugcccgcccugcaucccgccgcccagcgccuuccugaaggcguggguguacuggcccggcgaggacacggaggaggaggaggacgaggaggaggacgaggacuccgacagcggguccgacgaggaggagggcgaggccgaggccagcuccagcacccccgccaccggggucuuccugaaguccuggguguaccagcccggcgaggacaccgaggaggaggaggacgaggacagcgacacggggagcgccgaggacgagcgggaggcggagaccuccgccagcaccccgcccgccuccgccuuccucaaggccuggguguaccgccccggcgaggacaccgaggaggaggaggacgaggacgucgacagcgaggacaaggaggacgacuccgaggcggcccugggcgaggccgagagcgacccccaccccucccaccccgaccagcgcgcccacuuccggggguggggcuaccgccccgggaaggagacggaggaggaggaggccgcggaggacuggggcgaggccgagcccugccccuuccggguggccaucuacgugcccggcgagaagccgcccccgcccugggccccgccccgccugccccuccggcugcagcgccggcugaagcgccccgagacccccacccacgaccccgaccccgagaccccgcucaaggcgcggaagguccgcuucagcgagaaggugacggugcacuuccuggccgucugggccgggcccgcccaggccgcgcggcagggccccugggagcagcuggcccgcgaccggucccgcuucgcccggcgcaucacccaggcccaggaggagcucagccccugccugaccccggccgcgcgggcccgcgccugggcccggcugcgcaacccgccccucgcccccauccccgcgcugacccagacgcugcccuccagcuccgugcccagcucccccgugcagaccaccccgcucagccaggccgucgccacccccucccgcagcagcgccgcggccgccgccgcccuggaccuguccgggcggcgcggcuga

SEQ ID NO: 34947 - RNA, 2142 nt, Artificial Sequence
  derived and/or modified sequence opt1 from PPP1R15B__Homo_sapiens__NP_116222
auggagcccggcaccgggggcagccgcaagcggcuggggccgcgcgccggcuuccgguucuggccgcccuucuucccccgccggucccaggccgggagcuccaaguuccccacgccccucggccccgagaacagcggcaaccccacccugcuguccagcgcgcagccggagacccgcguguccuacuggaccaagcuccugagccagcugcucgcgccccugcccgggcugcuccagaagguccugaucuggucccagcuguucggcgggauguuccccacccgguggcucgacuucgccggcguguacagcgcccugcgcgcccugaaggggcgggagaagccggccgcccccacggcccagaagucccucagcucccugcagcuggacagcuccgaccccagcgugaccagcccccucgacuggcuggaggagggcauccacuggcaguacuccccgcccgaccugaagcucgagcugaaggccaagggcuccgcgcuggaccccgccgcccaggccuuccuccuggagcagcagcuguggggcgucgagcuccugcccagcagccugcagucccgccucuacagcaaccgggagcugggguccagcccguccgggccccugaacauccagcgcaucgacaacuucagcgugguguccuaccuccugaaccccagcuaccuggacugcuucccccggcucgaggucuccuaccagaacagcgacggcaacuccgagguggugggcuuccagacccugaccccggagagcuccugccugcgcgaggaccacugccacccccagccccucagcgccgagcugauccccgcguccuggcaggggugcccgccccugagcacggagggccuccccgagauccaccaccuccggaugaagcgccuggaguuccugcagcaggccuccaaggggcaggaccugccgacccccgaccaggacaacggcuaccacagccuggaggaggagcacucccuccugcggauggaccccaagcacugccgcgacaaccccacccaguucgucccggccgccggggacauccccggcaacacccaggagagcacggaggagaagaucgagcugcugaccaccgaggugccccucgcccuggaggaggagagccccuccgagggcugcccgagcuccgagauccccauggagaaggagcccggggagggccggaucagcguggucgacuacuccuaccuggagggggaccuccccaucagcgcgcgcccggccugcuccaacaagcugaucgacuacauccugggcggggccagcuccgaccucgagaccagcuccgaccccgagggcgaggacugggacgaggaggccgaggacgacggcuucgacagcgacuccagccuguccgacagcgaccuggagcaggaccccgaggggcuccaccuguggaacuccuucugcagcguggaccccuacaacccgcagaacuucacggccaccauccagaccgcggcccggaucgugcccgaggagcccagcgacuccgagaaggaccugagcggcaaguccgaccucgagaacagcucccagagcgggucccugcccgagaccccggagcacagcuccggcgaggaggacgacugggagagcuccgccgacgaggccgagagccugaagcucuggaacuccuucugcaacagcgacgaccccuacaacccccugaacuucaaggcccccuuccagacguccggggagaacgagaagggcugccgcgacagcaagaccccguccgagagcaucgucgcgaucuccgagugccacacccugcucagcugcaaggugcagcugcugggcagccaggaguccgagugccccgacagcgugcagcgcgacguccucuccgggggccggcacacccacgugaagcgcaagaaggugacguuccuggaggaggucaccgaguacuacaucagcggggacgaggaccggaagggccccugggaggaguucgcccgcgacggcugccgguuccagaagcgcauccaggagaccgaggacgccaucggguacugccugaccuucgagcaccgggagcgcauguucaaccggcuccagggcacgugcuucaaggggcugaacgugcugaagcagugcuga

SEQ ID NO: 34948 - RNA, 315 nt, Artificial Sequence
  derived and/or modified sequence opt1 from PPP1R17__Homo_sapiens__NP_001138595
augaugagcaccgagcagaugcagccccuggagcucuccgaggaccgccuggacaagcuggacccgcggugcagccaccucggcguguucuccgagcaccugaucaagcgcuacgacguccaggagcggcaccccaaggggaagaugauccccgugcugcacaacaccgaccucgagcagaagaagccccgccggaaggacacgccggcccugcacaugagccccuucgccgcgggcgugacccugcuccgcgacgagcggcccaaggccaucgucgaggacgacgagaaggacggggacaagaucgccaucuga

SEQ ID NO: 34949 - RNA, 1842 nt, Artificial Sequence
  derived and/or modified sequence opt1 from PPP1R18__Homo_sapiens__NP_001128342
auggccaccauccccgacuggaagcugcagcuccuggcccgccggcgccaggaggaggcgagcgugcggggccgcgagaaggccgagcgggagcgccugucccagaugccggccuggaagcgggggcuccuggagcgccggcgcgccaagcugggccucagccccggggagcccucccccguccugggcaccguggaggccgggccgcccgaccccgacgagagcgcggugcugcucgaggccaucggccccguccaccagaaccgguucauccgccaggagcggcagcagcagcagcagcagcagcagcgcuccgaggagcugcuggccgagcggaagccgggcccccucgaggcccgcgagcggcgccccagccccggggagaugcgggaccaguccccgaagggccgcgagagccgggaggagcgccugagcccccgcgagacgcgggagcgccggcuggggaucggcggggcgcaggagcucucccugcgcccccuggaggcccgggacuggcgccagucccccggcgaggugggcgaccggagcucccgccucagcgaggccuggaaguggcggcuguccccgggggagacccccgagcgcagccugcggcucgccgagucccgcgagcagagcccccggcgcaaggagguggagucccggcugagccccggcgagagcgccuaccagaagcuggggcucaccgaggcgcacaaguggcgcccggacucccgggagagccaggagcagucccugguccagcuggaggccaccgaguggcgccuccggagcggcgaggagcgccaggacuacuccgaggagugcggccgcaaggaggaguggcccgugcccgggguggcccccaaggagacggccgagcugagcgagacccugacccgggaggcccagggcaacuccagcgcgggggucgaggccgccgagcagcgcccgguggaggacggcgagcgggggaugaagcccaccgagggcuggaaguggacgcucaacuccggcaaggcccgcgaguggacgccccgggacaucgaggcccagacccagaagcccgagccgcccgagagcgcggagaagcugcuggagucccccgggguggaggccggcgagggggaggccgagaaggaggaggccggcgcccaggggcgcccgcuccgggcgcugcagaacugcugcagcguccccagcccccugcccccggaggacgccggcaccggcgggcuccgccagcaggaggaggaggccguggagcugcagcccccgccgcccgcgccccuguccccgcccccgcccgcccccaccgcgccccagccgcccggcgacccccucaugucccggcuguucuacggggugaaggccggccccggggucggcgcgccccgccggagcggccacaccuucaccgugaacccccgccgguccgugccgcccgccacccccgccacgcccaccagccccgccaccgucgacgccgccgugcccggggccggcaagaagcgcuaccccaccgccgaggagauccuggugcucgggggcuaccugcggcugucccgcagcugccucgccaagggcagccccgagcggcaccacaagcagcugaagaucuccuucagcgagacggcccuggagaccaccuaccaguaccccuccgagagcuccguccucgaggagcuggggccggagcccgaggugcccagcgcccccaacccgcccgccgcgcagcccgacgacgaggaggacgaggaggagcugcugcuccugcagcccgagcugcagggcgggcuccgcaccaaggcccugaucguggacgaguccugccggcgcuga

SEQ ID NO: 34950 - RNA, 516 nt, Artificial Sequence
  derived and/or modified sequence opt1 from PPP1R1A__Homo_sapiens__NP_006732
auggagcaggacaacagcccccgcaagauccaguucaccgugccccugcucgagccccaccuggaccccgaggccgccgagcagauccggcgccggcgccccaccccggcgacgcugguccucaccuccgaccagagcucccccgagaucgacgaggaccggauccccaacccccaccucaagagcacccuggccauguccccgcgccagcggaagaagaugacccgcaucacgcccaccaugaaggagcugcagaugaugguggagcaccaccugggccagcagcagcagggggaggagcccgagggcgccgccgagagcaccgggacccaggagucccggcccccgggcauccccgacacggagguggagagccgccuggggaccuccggcaccgccaagaagaccgcggagugcauccccaagacgcacgagcggggcagcaaggagcccuccaccaaggagccgagcacccacaucccgccccucgacuccaagggggccaacagcgucuga

SEQ ID NO: 34951 - RNA, 615 nt, Artificial Sequence
  derived and/or modified sequence opt1 from PPP1R1B__Homo_sapiens__NP_115568
auggaccccaaggaccgcaagaagauccaguucagcgugccggccccgcccucccagcuggacccccggcaggucgagaugauccgccggcgccggcccacccccgccaugcuguuccgccugagcgagcacuccagccccgaggaggaggcgagcccccaccagcgggccuccggcgaggggcaccaccugaaguccaagcgcccgaaccccugcgccuacaccccgcccagccucaaggccgugcagcggaucgccgagucccaccuccagagcaucuccaaccugaacgagaaccaggcgagcgaggaggaggacgagcucggcgagcugcgcgagcugggguacccccgggaggaggacgaggaggaggaggaggacgacgaggaggaggaggaggaggaggacucccaggccgaggugcucaaggucauccgccagagcgccggccagaagacgaccugcgggcagggccuggagggccccugggagcggcccccgccccuggacgaguccgagcgcgacgggggcagcgaggaccagguggaggaccccgcccucuccgagcccggggaggagccccagcggccgagccccuccgagcccggcaccuga

SEQ ID NO: 34952 - RNA, 618 nt, Artificial Sequence
  derived and/or modified sequence opt1 from PPP1R2__Homo_sapiens__NP_006232
auggccgccagcaccgcgucccaccgccccaucaagggcauccugaagaacaagaccagcacgaccuccagcaugguggccuccgccgagcagccgcgggggaacgucgacgaggagcucagcaagaagucccagaagugggacgagaugaacauccuggccaccuaccaccccgccgacaaggacuacggccugaugaagaucgacgagcccagcacccccuaccacuccaugaugggggacgacgaggacgcgugcagcgacacggaggccaccgaggccauggccccggacauccucgcgcgcaagcuggccgccgccgagggccuggagcccaaguaccggauccaggagcaggaguccagcggggaggaggacuccgaccucagccccgaggagcgcgagaagaagcggcaguucgagaugaagcgcaagcugcacuacaacgagggccugaacaucaagcucgcccggcagcugaucuccaaggaccugcacgacgacgacgaggacgaggagaugcucgagaccgcggacggcgagagcaugaacaccgaggaguccaaccaggggagcacgcccuccgaccagcagcagaacaagcugcgcagcagcuga

SEQ ID NO: 34953 - RNA, 3369 nt, Artificial Sequence
  derived and/or modified sequence opt1 from PPP1R3A__Homo_sapiens__NP_002702
auggagcccagcgaggugccgucccagaucagcaaggacaacuuccuggagguccccaaccucuccgacagccugugcgaggacgaggaggugaccuuccagcccggcuucagcccccagccgucccgccggggguccgacagcuccgaggacaucuaccuggacacccccagcuccggcacgcgccgggugagcuucgccgacuccuucggguucaaccucgucagcgugaaggaguucgacugcugggagcugcccuccgccagcaccaccuucgaccugggcaccgacaucuuccacacggaggaguacgugcucgcgccccuguucgaccugccguccagcaaggaggaccucaugcagcagcugcagauccagaaggccauccuggaguccaccgagagccuccuggggagcaccuccaucaagggcaucauccgcguccugaacgugagcuucgagaagcucguguacguccggaugucccuggacgacuggcagacccacuacgacauccuggccgaguacgugcccaacagcugcgacggcgagacggaccaguucuccuucaagaucgugcucgucccgcccuaccagaaggacgggagcaagguggaguucugcauccgcuacgagaccuccgugggcaccuucuggagcaacaacaacgggaccaacuacacguucaucugccagaagaaggagcaggagcccgagcccgucaagcccuggaaggaggugcccaaccggcagaucaagggcugccugaaggugaaguccagcaaggaggaguccagcgucaccuccgaggagaacaacuucgagaacccgaagaacaccgacaccuacauccccacgaucaucugcagccacgaggacaaggaggaccuggaggccuccaaccgcaacgugaaggacgugaaccgggagcacgacgagcacaacgagaaggagcucgagcugaugaucaaccagcaccugauccgcacccggagcaccgccucccgcgacgagcggaacaccuucagcacggaccccgucaacuuccccaacaaggcggaggggcucgagaagaagcagauccacggcgagaucugcaccgaccuguuccagcgcucccugagcccgagcuccagcgccgaguccagcgugaagggcgacuucuacugcaacgagaaguacuccagcggggacgacugcacccaccagcccuccgaggagaccacgagcaacaugggcgagaucaagcccucccucggggacaccagcuccgacgagcuggugcagcugcacaccggcagcaaggagguccucgacgacaacgccaaccccgcccacggcaacgggaccgugcagaucccgugccccuccagcgaccagcugauggcgggcaaccugaacaagaagcacgagggcggggccaagaacaucgaggucaaggaccucgggugccugcggcgcgacuuccacuccgacacgagcgccugccugaaggaguccaccgaggagggcagcagcaaggaggacuacuacggcaacgggaaggacgacgaggagcagcggaucuaccucggcgugaacgagaagcagcgcaagaacuuccagaccauccugcacgaccaggagcggaagauggggaaccccaagaucuccguggccggcaucggggccagcaaccgcgaccuggcgacccuccuguccgagcacacggccauccccacccgggccaucaccgccgacgucagccacuccccgcgcaccaaccugagcugggaggaggccgugcucacgcccgagcaccaccaccugaccuccgagggcagcgcgcugggcgggaucaccggccaggugugcuccagccgcaccgggaacguccuccggaacgacuaccuguuccagguggaggagaaguccggcgggaucaacagcgaggaccaggacaacagcccccagcacaagcaguccuggaacgugcuggagucccagggcaagagccgcgagaacaagaccaacaucacggagcacaucaagggccagaccgacugcgaggacgucugggggaagcgggacaacacccgcucccucaaggccaccacggaggagcuguucacgugccaggagaccgugugcugcgagcugagcucccuggccgaccacggcaucaccgagaaggccgaggccgggaccgcguacaucaucaagaccaccagcgagagcaccccggaguccaugagcgcccgggagaaggccaucaucgccaagcucccccaggagacggcccgcuccgaccggcccaucgaggugaaggagaccgcguucgacccccacgagggccgcaacgacgacagccacuacacccugugccagcgggacaccgucggcgugaucuacgacaacgacuucgagaaggagucccgccuggggaucugcaacgugcgggucgacgagauggagaaggaggagacgaugagcauguacaacccgcgcaagacccacgaccgggagaagugcggcaccgggaacaucaccuccguggaggagagcuccugggugaucacggaguaccagaaggccaccagcaagcucgaccugcagcugggcaugcuccccaccgacaagaccgucuucuccgagaaccgcgaccugcgccaggugcaggagcugagcaagaagacggacuccgacgccaucgugcacagcgccuucaacuccgacaccaaccgggcgccccagaacagcucccccuucagcaagcaccacaccgagaucuccgucagcaccaacgagcaggccaucgccguggagaacgccgugacgaccauggccagccagccgaucuccaccaagagcgagaacaucugcaacuccacccgggagauccaggggaucgagaagcaccccuaccccgagagcaagcccgaggaggucucccgcagcuccggcaucgugacgagcggcucccggaaggagcgcugcaucgggcagaucuuccagaccgaggaguacagcguggagaagucccucggcccgaugauccugaucaacaagccccuggagaacauggaggaggcgcgccacgagaacgaggggcucgucagcuccggccagagccuguacaccuccggggagaaggagagcgacuccagcgccuccaccagccugcccguggaggagagccaggcccagggcaacgagucccucuucagcaaguacacgaacuccaagauccccuacuuccugcuguuccucaucuuccugaucaccguguaccacuacgaccugaugaucggccucaccuucuacguccugagccuguccuggcucagcugggaggaggggcggcagaaggaguccgugaagaagaaguga

SEQ ID NO: 34954 - RNA, 858 nt, Artificial Sequence
  derived and/or modified sequence opt1 from PPP1R3B__Homo_sapiens__NP_078883
augauggccguggacaucgaguaccgcuacaacugcauggcccccagccugcggcaggagcgcuucgcguucaagaucuccccgaagcccagcaagccccuccggcccugcauccagcuguccagcaagaacgaggccuccggcauggucgccccggccgugcaggagaagaaggugaagaagcgcgucagcuucgccgacaaccaggggcuggcgcucaccauggugaagguguucuccgaguucgacgacccccuggacaugcccuucaacaucaccgagcugcucgacaacaucgucagccugacgaccgccgaguccgagagcuucgugcuggacuucucccagcccagcgccgacuaccucgacuuccggaaccgccugcaggccgaccacgugugccuggagaacugcguccucaaggacaaggcgaucgccggcaccgugaaggugcagaaccuggccuucgagaagaccgucaagauccggaugacguucgacaccuggaaguccuacaccgacuucccgugccaguacgugaaggacaccuacgccgggagcgaccgcgacacguucuccuucgacaucagccugcccgagaagauccaguccuacgagcggauggaguucgccguguacuacgagugcaacggccagaccuacugggacagcaaccgcgggaagaacuaccggaucauccgcgcggagcucaaguccacccagggcaugaccaagccccacagcggccccgaccuggggaucagcuucgaccaguucggcuccccgcggugcagcuacgggcuguuccccgaguggcccuccuaccucggcuacgagaagcuggggcccuacuacuga

SEQ ID NO: 34955 - RNA, 954 nt, Artificial Sequence
  derived and/or modified sequence opt1 from PPP1R3C__Homo_sapiens__NP_005389
augagcugcacccgcaugauccaggugcuggacccccggccgcucaccuccagcgucaugcccguggacguggccaugcgccugugccuggcccacuccccgcccgucaagagcuuccucggccccuacgacgaguuccagcggcgccacuucgugaacaagcugaagccccugaaguccugccucaacaucaagcacaaggccaagagccagaacgacuggaagugcucccacaaccaggccaagaagcggguggucuucgccgacagcaaggggcugucccugacggccauccacguguucagcgaccuccccgaggagcccgccugggaccugcaguucgaccugcucgaccugaacgacaucuccagcgcgcugaagcaccacgaggagaagaaccucauccuggacuucccgcagcccuccaccgacuaccugagcuuccgcucccacuuccagaagaacuucgugugccucgagaacugcagccugcaggagcggaccgucaccggcacggugaaggugaagaacgucuccuucgagaagaaggugcagauccgcaucaccuucgacagcuggaagaacuacaccgacguggacugcgucuacaugaagaacguguacgggggcaccgacuccgacacguucagcuucgccaucgaccugccgcccgugauccccaccgagcagaagaucgaguucugcaucagcuaccacgccaacgggcaggucuucugggacaacaacgacggccagaacuaccggaucgugcacgugcaguggaagcccgacggcguccagacccagauggcgccccaggacugcgcguuccaccagaccucccccaagacggagcucgagagcaccaucuucggguccccgcgccuggccagcggccuguuccccgaguggcaguccugggggcggauggagaaccucgccagcuaccgcuga

SEQ ID NO: 34956 - RNA, 687 nt, Artificial Sequence
  derived and/or modified sequence opt1 from PPP1R42__Homo_sapiens__NP_001013648
auggugcgccugacccucgaccugaucgcccggaacagcaaccugaagccccgcaaggaggagaccaucucccagugccucaagaagaucacgcacaucaacuucagcgacaagaacaucgacgccaucgaggaccugucccugugcaagaaccucagcguccuguaccuguacgacaacugcaucucccagaucaccaaccucaacuacgcgaccaaccugacccaccuguaccuccagaacaacugcaucagcugcaucgagaaccugcggucccugaagaagcucgagaagcuguaccugggcgggaacuacaucgccgugaucgagggccucgaggggcugggcgagcugcgcgagcuccacguggagaaccagcggcugccgcugggggagaagcuccuguucgacccccgcacgcugcacagccucgccaagucccugugcauccugaacaucagcaacaacaacaucgacgacaucaccgaccucgagcugcuggagaaccucaaccagcugaucgccgucgacaaccagcugcuccacgugaaggaccuggaguuccugcucaacaagcugaugaagcuguggaagaucgaccucaacggcaaccccgugugccugaagcccaaguaccgggaccgccugauccucgucuccaagagccugggcaccuaccuguacuga

SEQ ID NO: 34957 - RNA, 954 nt, Artificial Sequence
  derived and/or modified sequence opt1 from PPP1R7__Homo_sapiens__NP_001269338
auggccgccgagcgcggcgcggggcagcagcagagccaggagaugauggaggaggagcacgagcugcccguggacauggagaccaucaaccucgaccgggacgccgaggacgucgaccugaaccacuaccgcaucggcaagaucgagggguucgaggugcugaagaaggugaagacccucugccugcggcagaaccugaucaagugcaucgagaaccucgaggagcugcagucccugcgcgagcucgaccuguacgacaaccagaucaagaagaucgagaaccuggaggcccucacggagcuggagauccuggacaucagcuucaaccuccugcggaacaucgagggcgucgacaagcugacccgccucaagaagcuguuccuggugaacaacaagaucuccaagaucgagaaccucagcaaccugcaccagcugcagaugcucgagcugggguccaaccggauccgcgccaucgagaacaucgacacccugaccaaccucgagagccuguuccugggcaagaacaagaucacgaagcuccagaaccuggacgcccugaccaaccucaccgugcuguccaugcagagcaaccggcugaccaagaucgagggccuccagaaccuggucaaccugcgcgagcucuaccugucccacaacgggaucgaggugaucgagggccuggagaacaacaacaagcucacgaugcuggacaucgcgagcaaccggaucaagaagaucgagaacaucucccaccugaccgagcuccaggaguucuggaugaacgacaaccugcuggagagcugguccgaccucgacgagcugaagggggcccgcagccuggagaccguguaccuggagcggaacccgcuccagaaggacccccaguaccgccggaaggucaugcuggcccugcccuccgugcgccagaucgacgccaccuucgugcgguucuga

SEQ ID NO: 34958 - RNA, 4125 nt, Artificial Sequence
  derived and/or modified sequence opt1 from PPP1R9A__Homo_sapiens__NP_001159632
augcugaagaccgagagcuccggcgagcgcaccacgcuccggagcgccuccccgcaccgcaacgccuaccggaccgaguuccaggcgcugaaguccaccuucgacaagccgaaguccgacggggagcagaagaccaaggagggcgaggggagccagcagucccgcggccggaaguacgggagcaacgugaaccgcaucaagaaccuguucaugcagaugggcauggagcccaacgagaacgccgccgucaucgccaagacgcggggcaagggcgggcacuccagcccccagcgccggaugaagcccaaggaguuccucgagaagaccgacggguccguggugaagcuggagagcuccgucagcgagcgcaucucccgguucgacaccauguacgacggcccgagcuacuccaaguucaccgagacgcgcaagauguucgagcggagcgugcacgaguccgggcagaacaaccgcuacagccccaagaaggagaaggccggcggcagcgagccccaggacgaguggggcggguccaagagcaaccggggguccaccgacagccuggacucccucagcucccgcaccgaggcggugagccccaccgucucccagcugagcgccguguucgagaacacggacuccccgagcgccaucaucuccgagaaggccgagaacaacgaguacagcgugaccggccacuacccccugaaccuccccuccgucaccgugaccaaccuggacacguucggccaccugaaggacagcaacuccuggcccccgagcaacaagcgcgggguggacaccgaggacgcgcacaaguccaacgccacccccguccccgagguggccagcaagagcaccucccucgccagcauccccggcgaggagauccagcaguccaaggagccggaggacagcacguccaaccagcagacccccgacagcaucgacaaggacgggcccgaggagcccugcgccgaguccaaggcgaugcccaagagcgagauccccagcccccagagccagcugcuggaggacgccgaggccaaccucgugggccgggaggccgccaagcagcagcggaaggagcuggccgggggcgacuucaccucccccgacgcgagcgccuccagcugcggcaaggaggucccggaggacuccaacaacuucgacgggagccacguguacaugcacuccgacuacaacguguaccgcguccggagccgcuacaacagcgacuggggcgagaccgggacggagcaggacgaggaggaggacuccgacgagaacagcuacuaccagcccgacauggaguacuccgagaucgugggccugcccgaggaggaggagauccccgccaaccgcaagaucaaguucagcuccgccccgaucaagguguucaacaccuacagcaacgaggacuacgaccggcgcaacgacgaggucgaccccguggcggccuccgccgaguacgagcucgagaagcggguggagaagcuggagcuguuccccgucgagcucgagaaggacgaggacgggcugggcaucagcaucaucggcaugggggugggcgccgacgccgggcuggagaagcucggcaucuucgucaagaccgugaccgagggcggggcggcccagcgcgacggccggauccaggugaacgaccagaucgucgagguggacgggaucucccuggugggcgucacgcagaacuucgccgccaccgugcugcgcaacaccaaggggaacgugcgguucgucaucggccgcgagaagccgggccaggugagcgagguggcgcagcucaucucccagacccuggagcaggagcggcgccagcgggagcugcucgagcagcacuacgcccaguacgacgccgacgacgacgagaacacggucgccgagcugcaggggaugagcggcaacugcaacaacaacaacaacuacuuccugaagaccggggaguacgccaccgacgaggaggaggacgaggugggccccgugcuccccggguccgacauggcgaucgaggucuucgagcugcccgagaacgaggacauguucagcccguccgagcuggacaccagcaagcucucccacaaguucaaggagcugcagaucaagcacgccgugacggaggccgagauccagaagcugaagaccaagcuccaggccgccgagaacgagaaggugcgcugggagcuggagaagacccagcugcagcagaacaucgaggagaacaaggagcggaugcucaagcuggagagcuacuggaucgaggcgcagacccugugccacaccgucaacgagcaccucaaggagacgcagucccaguaccaggcccuggagaagaaguacaacaaggccaagaagcugaucaaggacuuccagcagaaggagcucgacuucaucaagcgccaggaggccgagcggaagaagaucgaggaccuggagaaggcccaccugguggaggugcagggccugcagguccgcauccgggaccucgaggcggagguguuccgccugcugaagcagaacggcacccaggugaacaacaacaacaacaucuucgagcggcgcaccagccucggggaggucagcaagggcgacaccauggagaaccuggacgggaagcagacguccugccaggacggccugagccaggaccucaacgaggccgugcccgagaccgagcgccuggacuccaaggcccugaagacccgggcccagcucagcgugaagaaccgccggcagcgccccucccggacccgccuguacgacagcgucuccagcacggacggggaggacucccuggagcggaagcccagcaacuccuucuacaaccacaugcacaucaccaagcuccugccgcccaagggccugcgcaccagcucccccgagagcgacuccggcgugcccccgcucacccccguggacagcaacguccccuucuccagcgaccacaucgcggaguuccaggaggagccccuggacccggagauggggccccuguccagcauguggggcgacacgagccucuucuccaccagcaaguccgaccacgacguggaggagagccccugccaccaccagaccaccaacaagaagauccugcgggagaaggacgacgccaaggaccccaagucccugcgcgccagcuccagccucgccgugcagggcgggaagaucaagcggaaguucgucgaccugggggccccgcugcgccggaacuccagcaagggcaagaaguggaaggagaaggagaaggaggcgucccgcuucagcgccggcucccggaucuuccgcgggcggcucgagaacuggacgcccaagcccugcagcaccgcccagaccuccacccgcagccccugcaugccguucuccugguucaacgacagccggaagggcuccuacagcuuccgcaaccugcccgcccccacgagcucccugcagccgagccccgagacccucaucuccgacaagaaggggagcaagguggagaacaccuggaucaccaaggccaacaagcggaaccccaaccccuccagcuccagcaucuucggccgccacucccagcugaugagcguggucuggauccaggagacgaacaacuucaccuucaacgacgacuucuccccgagcuccaccagcuccgcggaccugagcgggcucggcgccgagcccaagacccccggccugucccagagccuggcccucuccagcgacgagauccuggacgacgggcagagccccaagcacucccagugccagaaccgcgccgugcaggaguggagcgugcagcaggucucccacuggcugaugagccucaaccuggagcaguacguguccgaguucagcgcccagaacaucacgggcgagcagcugcuccagcuggacgggaacaagcugaaggcgcucggcaugaccgccucccaggaccgggccguggucaagaagaagcugaaggagaugaagaugagccuggagaaggcccgcaaggcgcaggagaagauggagaagcagcgggagaagcuccgccggaaggagcaggagcagaugcagcgcaaguccaagaagaccgagaagaugaccagcacgaccgccgagggcgccggggagcaguga

SEQ ID NO: 34959 - RNA, 930 nt, Artificial Sequence
  derived and/or modified sequence opt1 from PPP2CA__Homo_sapiens__NP_002706
auggacgagaagguguucaccaaggagcuggaccaguggaucgagcagcucaacgagugcaagcagcugagcgagucccaggucaagagccugugcgagaaggccaaggagauccucaccaaggaguccaacgugcaggaggugcgcugccccgucacggugugcggcgacgugcacgggcaguuccacgaccugauggagcuguuccggaucggcggcaagagcccggacaccaacuaccucuucaugggggacuacgucgaccgcggguacuacuccguggagaccgugacccugcuggucgcccucaaggugcgguaccgcgagcggaucacgauccugcgcggcaaccacgagagccggcagaucacccagguguacggcuucuacgacgagugccugcgcaaguacgggaacgcgaacgucuggaaguacuucaccgaccucuucgacuaccugccccugaccgcccucguggacggccagaucuucugccugcacgggggccugucccccagcaucgacacgcucgaccacauccgggcccuggaccgccugcaggaggugccccacgaggggccgaugugcgaccuccugugguccgaccccgacgaccggggcggcugggggaucagcccccgcggcgccggguacaccuucggccaggacaucuccgagaccuucaaccacgccaacggccugacccucgucagccgggcgcaccagcuggugauggagggguacaacuggugccacgaccgcaacguggucacgaucuucuccgcccccaacuacugcuaccggugcggcaaccaggccgccaucauggagcuggacgacacccucaaguacagcuuccugcaguucgacccggcgccccgccgcggggagccccacgugacccggcggacccccgacuacuuccuguga

SEQ ID NO: 34960 - RNA, 930 nt, Artificial Sequence
  derived and/or modified sequence opt1 from PPP2CB__Homo_sapiens__NP_001009552
auggacgacaaggccuucaccaaggagcuggaccaguggguggagcagcucaacgagugcaagcagcugaacgagaaccagguccgcacccugugcgagaaggccaaggagauccucacgaaggagagcaacgugcaggaggugcggugccccgucaccgugugcggcgacgugcacgggcaguuccacgaccugauggagcuguuccgcaucggcgggaaguccccggacaccaacuaccucuucaugggcgacuacgucgaccggggguacuacagcguggagaccgugacgcugcuggucgcccucaaggugcgcuaccccgagcggaucaccauccugcgcggcaaccacgagucccggcagaucacccagguguacggcuucuacgacgagugccugcgcaaguacgggaacgccaacgucuggaaguacuucaccgaccucuucgacuaccugccccugacggcccucguggacggccagaucuucugccugcacgggggccugagccccuccaucgacacccucgaccacauccgggcccuggaccgccugcaggaggugccgcacgaggggcccaugugcgaccuccuguggagcgaccccgacgaccggggcggcugggggaucagcccccgcggcgccggguacaccuucggccaggacaucuccgagaccuucaaccacgcgaacggccugacgcucgucucccgggcccaccagcuggugauggagggguacaacuggugccacgaccgcaacguggucaccaucuucagcgccccgaacuacugcuaccggugcggcaaccaggccgcgaucauggagcuggacgacacccucaaguacuccuuccugcaguucgaccccgcgccccgccgcggggagccccacgugacccggcggacgccggacuacuuccuguga

SEQ ID NO: 34961 - RNA, 1770 nt, Artificial Sequence
  derived and/or modified sequence opt1 from PPP2R1A__Homo_sapiens__NP_055040
auggccgccgcggacggcgacgacagccuguaccccaucgccgugcucaucgacgagcugcgcaacgaggacguccagcugcggcucaacuccaucaagaagcugagcaccaucgcccuggcccucgggguggagcgcacccgguccgagcugcugccguuccucacggacaccaucuacgacgaggacgaggugcugcuggcccucgcggagcagcugggcaccuucaccacgcuggucgggggccccgaguacgugcacugccuccugccgccccuggagagccucgccaccguggaggagaccgucgugcgcgacaaggccguggagucccugcgggccaucagccacgagcacucccccagcgaccuggaggcgcacuucgucccccucgugaagcgccuggccgggggcgacugguucaccucccggacgagcgccugcggccuguucuccgugugcuacccccgcgucagcuccgccgugaaggccgagcuccggcaguacuuccgcaaccugugcagcgacgacacccccauggugcggcgcgcggccgccuccaagcugggggaguucgccaagguccucgagcuggacaacgucaagagcgagaucaucccgauguucuccaaccuggccagcgacgagcaggacuccgugcggcuccuggcgguggaggccugcgugaacaucgcccagcugcucccccaggaggaccuggaggcccuggugaugcccacccuccgccaggccgcggaggacaagagcuggcggguccgcuacaugguggccgacaaguucaccgagcugcagaaggccgugggccccgagaucacgaagaccgaccuggucccggccuuccagaaccucaugaaggacugcgaggccgaggugcgggcggccgccagccacaaggucaaggaguucugcgagaaccuguccgccgacugccgcgagaacgugaucaugagccagauccugcccugcaucaaggagcucguguccgacgcgaaccagcacgucaagagcgcccuggccuccgugaucauggggcugagccccauccucggcaaggacaacaccaucgagcaccuccugccccuguuccuggcccagcugaaggacgagugcccggaggugcggcugaacaucaucuccaaccucgacugcgucaacgaggugaucgggauccgccagcugagccagucccugcuccccgccaucguggagcuggcggaggacgccaaguggcggguccgccuggccaucaucgaguacaugccccuccuggccggccagcugggcguggaguucuucgacgagaagcucaacagccugugcauggccuggcugguggaccacgucuacgcgauccgcgaggccgccaccuccaaccucaagaagcugguggagaaguucgggaaggagugggcccacgccacgaucauccccaaggugcuggcgaugagcggcgacccgaacuaccuccaccggaugaccacccuguucugcaucaacguccuguccgaggugugcgggcaggacaucaccacgaagcacaugcuccccaccgugcugcgcauggccggcgaccccgucgccaacgugcgguucaacguggccaagagccugcagaagaucggccccauccucgacaacuccacccugcagagcgaggucaagccgauccuggagaagcucacccaggaccaggacguggacgugaaguacuucgcgcaggaggcccugacgguccugucccucgccuga

SEQ ID NO: 34962 - RNA, 1671 nt, Artificial Sequence
  derived and/or modified sequence opt1 from PPP2R1B__Homo_sapiens__NP_001171033
auggccggcgccagcgagcuggggaccggccccggggcggccggcggggacggcgacgacucccucuacccgaucgccgugcugaucgacgagcugcgcaacgaggacguccagcuccggcugaacagcaucaagaagcuguccaccaucgcccucgcccugggcguggagcgcacgcggagcgagcugcuccccuuccugaccgacaccaucuacgacgaggacgaggugcugcucgcgcuggccgagcagcuggggaacuucaccggccucgucgggggccccgacuucgcccacugccugcugcccccgcucgagaaccuggccacgguggaggagaccgugguccgcgacaaggcgguggagucccugcggcagaucagccaggagcacacccccguggcccucgaggccuacuucgucccccuggugaagcgccuggccuccggggacugguucaccagccggacguccgccugcggccucuucagcgugugcuacccccgcgcguccaacgccgucaaggccgagauccggcagcaguuccgcagccugugcuccgacgacaccccgauggugcggcgcgccgccgcgagcaagcugggcgaguucgccaaggugcucgagcuggacuccgucaagagcgagaucgugccccuguucaccucccucgccagcgacgagcaggacuccgugcggcugcuggccgucgaggccugcgugagcaucgcgcagcuccugagccaggacgaccuggagacccucgugaugcccacgcugcgccaggccgccgaggacaaguccuggcggguccgcuacaugguggccgaccgguucagcgagcugcagaaggccauggggcccaagaucacccucaacgaccugaucccggcguuccagaaccugcucaaggacugcgaggccgaggugcgcgccgccgcggcccacaaggucaaggagcugggcgagaaccugcccaucgaggaccgggagaccaucaucaugaaccagauccuccccuacaucaagugccccgacgugcgccugaacaucaucuccaaccuggacugcgucaacgaggugaucgggauccggcagcucagccagucccugcugccggccaucguggagcuggccgaggacgccaaguggcgcguccgccucgcgaucaucgaguacaugccccugcuggccggccagcucggcguggaguucuucgacgagaagcugaacagccugugcauggccuggcucguggaccacgucuacgccauccgggaggccgcgaccaacaaccugaugaagcuggugcagaaguucgggacggagugggcccagaacaccaucgugcccaagguccucgugauggccaacgaccccaacuaccugcaccgcaugaccacccuguucugcaucaacgcccucuccgaggccugcggccaggagaucacgaccaagcagaugcugccgaucgugcugaagauggcgggggaccaggucgccaacgugcgguucaacguggccaagagccuccagaagaucggccccauccuggacaccaacgcccugcagggggaggucaagcccgugcuccagaagcugggccaggacgaggacauggacgugaaguacuucgcgcaggaggccaucuccguccuggcccucgccuga

SEQ ID NO: 34963 - RNA, 1374 nt, Artificial Sequence
  derived and/or modified sequence opt1 from PPP2R2A__Homo_sapiens__NP_001171062
auguuccccaaguucagccugcgcuccauguuccacggcgccgggggcgggaacgacauccaguggugcuucagccaggugaagggcgccgucgacgacgacguggcggaggccgacaucaucuccaccguggaguucaaccacagcggggagcuccuggccaccggcgacaagggcgggcgggucgugaucuuccagcaggagcaggagaacaagauccagucccacagccgcggcgaguacaacguguacuccacguuccagagccacgagccggaguucgacuaccugaagucccucgagaucgaggagaagaucaacaagauccgguggcugccccagaagaacgccgcccaguuccugcucagcaccaacgacaagaccaucaagcuguggaagaucuccgagcgcgacaagcggcccgagggguacaaccugaaggaggaggacggccgcuaccgggaccccaccacggucaccacccuccgcgugccgguguuccggcccauggaccugauggucgaggcgagcccccgccggaucuucgccaacgcccacaccuaccacaucaacuccaucagcaucaacuccgacuacgagacguaccugagcgccgacgaccuccgcaucaaccuguggcaccuggagaucaccgaccgguccuucaacaucguggacaucaagcccgcgaacauggaggagcucaccgaggugaucaccgccgccgaguuccacccgaacagcugcaacacguucgucuacuccagcagcaaggggaccauccgccugugcgacaugcgggccuccgcccugugcgaccgccacagcaagcuguucgaggagcccgaggaccccuccaaccggagcuucuucuccgagaucaucagcuccaucagcgacgugaaguucucccacagcggccgcuacaugaugacccgggacuaccucuccgugaagaucugggaccugaacauggagaaccgccccgucgagaccuaccaggugcacgaguaccuccggagcaagcugugcucccuguacgagaacgacugcaucuucgacaaguucgagugcugcuggaacggcagcgacuccguggucaugacggggagcuacaacaacuucuuccgcauguucgaccgcaacaccaagcgggacaucacccucgaggcgucccgcgagaacaacaagccgcggaccgugcugaagccccgcaaggugugcgccagcggcaagcggaagaaggacgagaucuccgucgacagccuggacuucaacaagaagauccuccacacggccuggcaccccaaggagaacaucaucgccguggccaccaccaacaaccuguacaucuuccaggacaaggugaacuga

SEQ ID NO: 34964 - RNA, 1350 nt, Artificial Sequence
  derived and/or modified sequence opt1 from PPP2R2B__Homo_sapiens__NP_001258828
augauccccggcaucgggacccugacccaggacacgcucuggugcuucagccaggugaagggcaccaucgagaucgggaccaccgaggccgacaucaucuccacggucgaguucaaccacaccggcgagcugcuggccaccggggacaagggcggccgcguggugaucuuccagcgggagcaggagagcaagaaccagguccaccgccgcggggaguacaacguguacuccaccuuccagagccacgagccggaguucgacuaccucaagucccuggagaucgaggagaagaucaacaagauccgguggcugccccagcagaacgcggccuacuuccuccugagcacgaacgacaagaccgugaagcuguggaaggucuccgagcgggacaagcgccccgagggcuacaaccucaaggacgaggaggggcggcugcgcgaccccgccaccaucaccacgcugcgggugccggugcuccgccccauggaccugauggucgaggccacgccccggcgcguguucgccaacgcgcacaccuaccacaucaacagcaucuccgugaacagcgacuacgagaccuacauguccgccgacgaccugcggaucaaccucuggaacuucgagaucaccaaccagagcuucaacaucgucgacaucaagcccgccaacauggaggagcugaccgaggugaucaccgccgcggaguuccacccgcaccacugcaacaccuucguguacuccagcuccaagggcacgauccgccugugcgacaugcgggccagcgcccucugcgaccgccacaccaaguucuucgaggagcccgaggaccccuccaaccggagcuucuucuccgagaucaucagcagcaucuccgacgucaaguucagccacuccgggcgcuacaucaugacccgggacuaccugaccgugaaggugugggaccugaacauggagaaccgccccaucgagacguaccagguccacgacuaccuccggagcaagcugugcucccuguacgagaacgacugcaucuucgacaaguucgagugcguguggaacggcagcgacuccgugaucaugaccggcagcuacaacaacuucuuccgcauguucgaccgcaacaccaagcgggacgucacccucgaggccucccgcgagaacagcaagccgcgggccauccugaagccccgcaaggugugcgucgggggcaagcggcgcaaggacgagaucuccguggacagccuggacuucuccaagaagauccuccacacggcguggcaccccagcgagaacaucaucgccguggccgccaccaacaaccuguacaucuuccaggacaaggucaacuga

SEQ ID NO: 34965 - RNA, 1323 nt, Artificial Sequence
  derived and/or modified sequence opt1 from PPP2R2C__Homo_sapiens__NP_001193924
augcgcgaggccgacacccugcggcccccgcagcucauggaggugagcgccgacaucaucuccaccgucgaguucaaccacacgggcgagcugcuggcgaccggggacaagggcgggcgcguggugaucuuccagcgggagcccgagagcaagaacgcgccccacucccagggcgaguacgacgucuacagcaccuuccagucccacgagcccgaguucgacuaccucaagagccuggagaucgaggagaagaucaacaagaucaaguggcugccgcagcagaacgccgcccacucccuccugagcaccaacgacaagacgaucaagcuguggaagaucaccgagcgcgacaagcggcccgagggguacaaccucaaggacgaggagggcaagcugaaggaccuguccaccgugaccagccuccaggugcccguccugaagcccauggaccugaugguggagguguccccgcgccggaucuucgccaacggccacacguaccacaucaacagcaucuccgucaacagcgacugcgagaccuacauguccgccgacgaccuccgcaucaaccuguggcaccuggccaucaccgaccggagcuucaacaucguggacaucaagcccgccaacauggaggaccucaccgaggugaucacggccuccgaguuccacccccaccacugcaaccuguucgucuacagcuccagcaaggggagccugcgccucugcgacaugcgggcggccgcccugugcgacaagcacuccaagcuguucgaggagcccgaggacccgagcaaccgcuccuucuucagcgagaucaucuccagcguguccgacgugaaguucagccacuccggccgguacaugcucacccgcgacuaccugaccgucaaggugugggaccugaacauggaggcccggcccaucgagaccuaccaggugcacgacuaccuccgcagcaagcugugcucccuguacgagaacgacugcaucuucgacaaguucgagugcgccuggaacgggagcgacuccgucaucaugacgggcgcguacaacaacuucuuccggauguucgaccgcaacaccaagcgggacgugacccucgaggccagccgcgaguccagcaagccccgggccgugcugaagccccgccgcgucugcgucgggggcaagcggcgccgggacgacaucuccguggacagccuggacuucaccaagaagauccuccacacggccuggcacccggccgagaacaucaucgcgaucgccgccaccaacaaccuguacaucuuccaggacaaggugaacuccgacaugcacuga

SEQ ID NO: 34966 - RNA, 1245 nt, Artificial Sequence
  derived and/or modified sequence opt1 from PPP2R3A__Homo_sapiens__NP_001177376
auggacaucgaggagcagaaggccgacaucuacgagaugggcaagaucgccaaggugugcgggugcccccuguacuggaaggcgccgauguuccgcgccgccggcggggagaagaccggcuucgucaccgcccagagcuucaucgccauguggcggaagcuccugaacaaccaccacgacgacgcguccaaguucaucugccugcucgccaagcccaacugcagcucccuggagcaggaggacuucaucccccugcuccaggacgugguggacacgcaccccgggcugaccuuccugaaggacgccccggaguuccacagccgcuacaucaccaccgucauccagcggaucuucuacacggugaaccgcuccuggagcggcaagaucaccuccaccgagauccgcaagagcaacuuccuccagacccuggcccugcucgaggaggaggaggacaucaaccagaucacggacuacuucuccuacgagcacuucuacgugaucuacugcaaguucugggagcuggacaccgaccacgaccuguacaucagccaggcggaccucucccgguacaacgaccaggccagcuccagccggaucaucgagcgcaucuucuccggcgccgucacccgggggaagaccauccagaaggagggccgcaugagcuacgccgacuucgugugguuccugaucuccgaggaggacaagcggaaccccacgagcaucgaguacugguuccgcugcauggacguggacggggacggcguccuguccauguacgagcucgaguacuucuacgaggagcagugcgagcggauggaggccauggggaucgagccccugcccuuccacgaccugcucugccagaugcuggaccuggugaagccggcgguggacggcaagaucacccuccgcgaccugaagcggugccgcauggcccacaucuucuacgacaccuucuucaaccuggagaaguaccucgaccacgagcagcgggaccccuucgccguccagaaggacguggagaacgacggccccgagcccagcgacugggaccgcuucgccgccgaggaguacgagacccugguggcggaggagagcgcccaggcccaguuccaggagggguucgaggacuacgagacggacgagccggccucccccagcgaguucggcaacaaguccaacaagauccugagcgccucccuccccgagaagugcgggaagcugcagagcgucgacgaggaguga

SEQ ID NO: 34967 - RNA, 1728 nt, Artificial Sequence
  derived and/or modified sequence opt1 from PPP2R3B__Homo_sapiens__NP_037371
augcccccgggcaaggugcugcagcccguccucaagaugaagguggacgagcuguuccuguacuggcucagcgaggccuccacccagcgcaugcugcaggacugccugcggcgcaucaaggcccccgggcgggaccagcccaccccgggcgacggggagcagcccggcgcguggcccacggcgccccucgccgccccgcgccccagcgggcuggagccgcccggcacccccggccccgggcccgcccugccccucggcgccgccuccagcccgcggaacgcgccccacgugcgcgggacccggcgcuccgccggcacccgggucgugcagacgcgcaaggaggagccccugcccccggccaccagccaguccauccccaccuucuacuucccccgggggcgcccccaggacagcgugaacgucgacgccgugaucuccaagaucgagagcaccuucgcccgguucccgcacgagcgcgccacgauggacgacaugggccugguggccaaggcgugcggcugcccccucuacuggaaggggccccuguucuacggcgccgggggcgagcggaccggcuccgucagcgugcacaaguucguggccauguggcgcaagauccugcagaacugccacgacgacgccgccaaguucguccaccuccugaugucccccgggugcaacuaccuggugcaggaggacuucgugccguuccuccaggacgucgugaacacccaccccggccugagcuuccugaaggaggcguccgaguuccacagccgguacaucaccacggugauccagcgcaucuucuacgccgucaaccgguccuggagcgggcgcaucacgugcgccgagcuccggcgcuccagcuuccugcagaacguggcccugcucgaggaggaggccgacaucaaccagcugaccgaguucuucagcuacgagcacuucuacgugaucuacugcaaguucugggagcuggacaccgaccacgaccuccugaucgacgcggacgaccuggcccgccacaacgaccacgcccucuccaccaagaugaucgaccggaucuucagcggcgccgucacccgcgggcggaaggugcagaaggagggcaagaucuccuacgccgacuucgugugguuccugaucagcgaggaggacaagaagacccccaccuccaucgaguacugguuccgcugcauggaccuggacggcgacggggcgcucagcauguucgagcuggaguacuucuacgaggagcagugccggcgccuggacuccauggccaucgaggcccucccguuccaggacugccugugccagaugcuggaccucgucaagccccggacggagggcaagaucacccugcaggaccugaagcgcugcaagcucgccaacguguucuucgacaccuucuucaacaucgagaaguaccuggaccacgagcagaaggagcagaucagccugcuccgggacggggacuccggcgggcccgagcugagcgacugggagaaguacgcggccgaggaguacgacauccuggucgccgaggagaccgccggcgagcccugggaggacggcuucgaggccgagcucuccccgguggagcagaagcugagcgcgcugcgcagcccccuggcccagcggcccuucuucgaggcccccuccccgcucggggccguggaccuguacgaguacgccugcggcgacgaggaccuggagccccucuga

SEQ ID NO: 34968 - RNA, 867 nt, Artificial Sequence
  derived and/or modified sequence opt1 from PPP2R4__Homo_sapiens__NP_001180326
augggcaaguggaagcgcagccaggccuacgccgacuacaucggguucauccugacccucaacgagggcgugaaggggaagaagcugaccuucgaguaccgggucuccgaggcgaucgagaagcugguggcccuccugaacacgcuggaccgcuggaucgacgagacgcccccgguggaccagcccagccgguucggcaacaaggccuaccgcaccugguacgccaagcucgacgaggaggccgagaaccuggucgcgaccguggugcccacccaccuggccgccgccguccccgagguggcgguguaccucaaggaguccgucgggaacagcacccggaucgacuacggcaccggccacgaggccgccuucgccgccuuccugugcugccugugcaagaucggggugcuccgcguggacgaccagaucgcgaucgucuucaagguguucaaccgguaccuggaggugaugcgcaagcugcagaagaccuaccggauggagccggccggcucccagggggucuggggccucgacgacuuccaguuccugcccuucaucugggggagcucccagcugaucgaccaccccuaccucgagccccgccacuucguggacgagaaggccgugaacgagaaccacaaggacuacauguuccuggagugcauccuguucaucacggagaugaagaccggcccguucgccgagcacagcaaccagcucuggaacaucuccgccguccccagcugguccaaggugaaccagggccugauccggauguacaaggcggagugccuggagaaguuccccgugauccagcacuucaaguucgggagccuccugcccauccacccggucaccuccggcuga

SEQ ID NO: 34969 - RNA, 1290 nt, Artificial Sequence
  derived and/or modified sequence opt1 from PPP2R5A__Homo_sapiens__NP_001186685
augaucaugaacgccaccagcaacgagcagcaggagcuguucugccagaagcuccagcagugcugcauccuguucgacuucauggacuccgugagcgaccugaaguccaaggagaucaagcgcgccacccucaacgagcuggucgaguacgugagcacgaaccggggcgugaucgucgaguccgcguacagcgacaucgugaagaugaucuccgccaacaucuuccgcacccugcccccgagcgacaaccccgacuucgaccccgaggaggacgagcccacccucgaggccuccuggccgcacauccagcugguguacgaguucuuccugcgguuccucgagagccccgacuuccagcccuccaucgccaagcgcuacaucgaccagaaguucguccagcagcugcuggagcuguucgacagcgaggacccccgggagcgcgacuuccucaagaccgugcugcaccggaucuacgggaaguuccucggccugcgcgccuucauccggaagcagaucaacaacaucuuccugcgcuucaucuacgagacggagcacuucaacgggguggcggagcuccuggagauccugggcuccaucaucaacggguucgcccucccgcugaaggccgagcacaagcaguuccugaugaagguccucauccccaugcacaccgccaagggccuggcgcuguuccacgcccagcucgccuacugcguggugcaguuccuggagaaggacaccacccugacggagcccgucauccggggccuccugaaguucuggcccaagaccugcagccagaaggaggugauguuccugggggagaucgaggagauccucgacgugaucgagccgacccaguucaagaagaucgaggagccccuguucaagcagaucuccaagugcgucagcuccagccacuuccagguggccgagcgcgcccuguacuucuggaacaacgaguacauccucucccugaucgaggagaacaucgacaagauccugcccaucauguucgcgagccucuacaagaucagcaaggagcacuggaaccccaccaucguggcccuggucuacaacgugcugaagacgcucauggagaugaacggcaagcuguucgacgaccugaccuccagcuacaaggccgagcggcagcgcgagaagaagaaggagcucgagcgggaggagcuguggaagaagcuggaggagcucaagcugaagaaggcccuggagaagcagaacuccgccuacaacaugcacagcauccuguccaacaccagcgcggaguga

SEQ ID NO: 34970 - RNA, 1494 nt, Artificial Sequence
  derived and/or modified sequence opt1 from PPP2R5B__Homo_sapiens__NP_006235
auggagaccaagcugcccccggccagcacccccacgucccccagcucccccggccucagcccggugcccccgcccgacaaggucgacggguucucccgccggagccugcgccgggcccgcccccggcgcucccacagcuccagccaguuccgguaccaguccaaccagcaggagcugacgccccucccccugcugaaggacgugcccgcgagcgagcuccacgagcugcugucccgcaagcucgcccagugcggcgugauguucgacuuccuggacugcgucgccgaccugaaggggaaggaggugaagcgggccgcccucaacgagcugguggagugcgucggcagcacccgcggggugcugaucgagccgguguaccccgacaucauccggaugaucuccgucaacaucuuccgcacccucccgcccagcgagaaccccgaguucgaccccgaggaggacgagcccaaccuggagcccuccuggccgcaccuccagcucguguacgaguucuuccugcgguuccuggagagccccgacuuccagcccuccguggcgaagcgcuacgucgaccagaaguucgugcucaugcugcuggagcuguucgacagcgaggacccccgggagcgcgaguaccugaagaccauccugcaccggguguacggcaaguuccucggccugcgcgccuacauccggaagcagugcaaccacaucuuccugcgcuucaucuacgaguucgagcacuucaacggggucgccgagcuccuggagauccugggcagcaucaucaacggguucgcccucccgcugaagaccgagcacaagcaguuccuggugcgggugcucaucccccugcacuccgucaagagccuguccguguuccacgcgcagcucgccuacugcgugguccaguuccuggagaaggacgccacccugaccgagcacgugauccgcggccuccugaaguacuggcccaagacgugcacccagaaggaggugauguuccugggggagauggaggagauccucgacgucaucgagcccagccaguucgugaagauccaggagccgcuguucaagcaggucgcccgcugcguguccagcccccacuuccagguggccgagcgggcgcuguacuucuggaacaacgaguacauccucucccugaucgaggacaacugccacaccguccugcccgccguguucggcacccuguaccaggugagcaaggagcacuggaaccagacgaucgucucccucaucuacaacgugcugaagaccuucauggagaugaacggcaagcuguucgacgagcucaccgccagcuacaagcuggagaagcagcaggagcagcagaaggcccaggagcgccaggagcuguggcaggggcucgaggagcugcggcugcgccggcuccagggcacccagggggccaaggaggcgccgcugcagcgccugacgccccagguggccgccuccggcggccagagcuga

SEQ ID NO: 34971 - RNA, 1668 nt, Artificial Sequence
  derived and/or modified sequence opt1 from PPP2R5C__Homo_sapiens__NP_001155197
augcccaacaagaacaagaaggagaaggagagcccgaaggccggcaaguccggcaagagcuccaaggaggggcaggacaccguggagagcgaggggaccucccccgaggagcccagcucccccaaggucccgccgccccugcuccccgagcugcuggugcucaucuucggcgggcugcagggccgcgacgugccgcccgccgaccaggagaagcuguucauccagaagcuccggcagugcugcguccuguucgacuucgugagcgacccccuguccgaccucaaguggaaggaggugaagcgcgcggcccugagcgagauggucgaguacaucacgcacaaccggaacgugaucaccgagcccaucuaccccgaggugguccacauguucgccgugaacauguuccgcacccugccgcccuccagcaaccccaccggcgccgaguucgaccccgaggaggacgagcccacgcucgaggccgcguggccccaccuccagcugguguacgaguucuuccuccgguuccuggagucccccgacuuccagccgaacaucgccaagaaguacaucgaccagaaguucguccugcagcuccuggagcuguucgacagcgaggacccccgcgagcgggacuuccucaagaccacccugcaccgcaucuacgggaaguuccugggccuccgggccuacauccgcaagcagaucaacaacaucuucuaccgguucaucuacgagaccgagcaccacaacgggaucgccgagcugcuggagauccucggcuccaucaucaacggguucgcgcugccccugaaggaggagcacaagaucuuccuccugaaggugcugcucccccugcacaaggucaagagccuguccguguaccacccgcagcucgccuacugcguggugcaguuccuggagaaggacagcacgcugaccgagcccgucgugauggcccuccugaaguacuggcccaagacccacucccccaaggaggugauguuccugaacgagcucgaggagauccuggacgucaucgagccgagcgaguucgugaagaucauggagccccuguuccgccagcucgccaagugcgugagcagcccccacuuccaggucgccgagcgggcgcuguacuacuggaacaacgaguacaucaugucccugaucuccgacaacgccgccaagauccucccgaucauguuccccagccuguaccgcaacuccaagacccacuggaacaagacgauccacggccugaucuacaacgcccugaagcuguucauggagaugaaccagaagcuguucgacgacugcacccagcaguucaaggccgagaagcugaaggagaagcucaagaugaaggagcgggaggaggcgugggugaagaucgagaaccuggccaaggccaacccccaguacaccgucuacagccaggccuccaccaugagcauccccguggccauggagacggacggcccgcuguucgaggacgugcagaugcuccgcaagaccgucaaggacgaggcgcaccaggcccagaaggaccccaagaaggaccggccccuggcccgccggaaguccgagcugccccaggacccgcacaccaagaaggcccucgaggcccacugccgcgcggacgagcuggccagccaggacgggcgguga

SEQ ID NO: 34972 - RNA, 1809 nt, Artificial Sequence
  derived and/or modified sequence opt1 from PPP2R5D__Homo_sapiens__NP_006236
augcccuacaagcugaagaaggagaaggagccgcccaagguggccaagugcaccgccaagcccagcuccagcggcaaggacgggggcggggagaacaccgaggaggcgcagccccagccgcagccccagccccagccccaggcccagucccagccgcccagcuccaacaagcgccccagcaacuccacgcccccgcccacccagcucagcaagaucaaguacuccggcgggccccagaucgucaagaaggagcggcgccagagcuccagccgguucaaccuguccaagaaccgcgagcugcagaagcuccccgcccugaaggacagcccgacccaggagcgggaggagcuguucauccagaagcuccgccagugcugcgugcuguucgacuucguguccgacccccugagcgaccucaaguucaaggaggucaagcgggccggccugaacgagaugguggaguacaucacccacucccgcgacguggucacggaggccaucuaccccgaggcggugaccauguucagcgugaaccuguuccggacccucccgcccuccagcaaccccaccggcgccgaguucgaccccgaggaggacgagcccacgcuggaggccgccuggccgcaccuccagcucgucuacgaguucuuccugcgcuuccuggagagccccgacuuccagcccaacaucgcgaagaaguacaucgaccagaaguucgugcucgcccugcuggaccucuucgacuccgaggacccccgggagcgcgacuuccugaagaccauccugcaccggaucuacgggaaguuccucggccugcgcgccuacauccggcgccagaucaaccacaucuucuaccgguucaucuacgagaccgagcaccacaacgggaucgccgagcugcucgagauccugggcagcaucaucaacggguucgcccugccgcucaaggaggagcacaagauguuccugauccgcgugcugcucccccugcacaaggucaagucccugagcguguaccacccccagcucgcguacugcgugguccaguuccuggagaaggaguccagccugaccgagccggugaucgugggccuccugaaguucuggcccaagacgcacucccccaaggaggucauguuccugaacgagcucgaggagauccuggacgugaucgagcccagcgaguucuccaaggugauggagccgcuguuccggcagcucgccaagugcgucagcagcccccacuuccagguggccgagcgcgcccuguacuacuggaacaacgaguacaucaugucccugaucuccgacaacgccgcgcgggugcuccccaucauguuccccgcccuguaccgcaacagcaagucccacuggaacaagaccauccacggccugaucuacaacgcccugaagcuguucauggagaugaaccagaagcuguucgacgacugcacccagcaguacaaggccgagaagcagaaggggcgcuuccggaugaaggagcgcgaggagauguggcagaagaucgaggagcuggcccggcucaacccgcaguaccccauguuccgcgcgcccccgccccugccgcccgucuacagcauggagaccgagacgcccaccgccgaggacauccagcugcucaagcggaccguggagaccgaggccguccagaugcugaaggacaucaagaaggagaaggugcugcuccgccggaaguccgagcugccccaggacguguacacgaucaaggcccuggaggcccacaagcgcgcggaggaguuccucaccgccagccaggaggcccuguga

SEQ ID NO: 34973 - RNA, 1389 nt, Artificial Sequence
  derived and/or modified sequence opt1 from PPP2R5E__Homo_sapiens__NP_001269109
augagcuccgcccccaccaccccgcccagcguggacaaggucgacggcuucucccgcaagagcgugcggaaggcccgccagaagcggucccagagcuccagccaguuccgcucccaggggaagcccaucgagcugacgccccucccgcugcugaaggacgugcccagcuccgagcagcccgagcuguuccugaagaagcugcagcagugcugcgucaucuucgacuucauggacacccucagcgaccugaagaugaaggaguacaagcgguccacccugaacgagcucguggacuacaucaccaucagccgcggcugccugacggagcagaccuaccccgaggugguccggaugguguccugcaacaucuuccgcacccugccgcccagcgacuccaacgaguucgaccccgaggaggacgagcccacccucgaggcgagcuggccgcaccuccagcugguguacgaguucuucauccgguuccucgagucccaggaguuccagcccagcaucgccaagaaguacaucgaccagaaguucguccugcagcugcucgagcuguucgacagcgaggacccccgcgagcgggacuaccugaagacggugcuccaccgcaucuacgggaaguuccugggccugcgggccuucauccgcaagcagaucaacaacaucuuccuccgguucguguacgagaccgagcacuucaacggggucgccgagcugcuggagauccucggcuccaucaucaacggcuucgcccugccccugaaggcggagcacaagcaguuccucgugaaggugcugaucccgcugcacaccguccgcagccucucccuguuccacgcccagcuggccuacugcaucgugcaguuccucgagaaggaccccagccugaccgagcccgugauccgggggcugaugaaguucuggcccaagacgugcucccagaaggaggucauguuccucggcgagcuggaggagauccuggacgugaucgagccgagccaguucgugaagauccaggagccccucuucaagcagaucgccaagugcgucuccagcccccacuuccagguggcggagcgcgcccuguacuacuggaacaacgaguacaucaugucccugaucgaggagaacagcaacgugauccuccccaucauguucuccagccuguaccggaucuccaaggagcacuggaacccggccaucgucgcccugguguacaacguccucaaggccuucauggagaugaacagcaccauguucgacgagcugaccgcgaccuacaacgagaagaagaaggagaaggagcgcgaggagcuguggaagaagcuggaggaccucgagcugaagcgggggcugcgccgcgacggcaucauccccacguga

SEQ ID NO: 34974 - RNA, 1566 nt, Artificial Sequence
  derived and/or modified sequence opt1 from PPP3CA__Homo_sapiens__NP_000935
augagcgagcccaaggccaucgacccgaagcuguccaccaccgaccgcguggucaaggccgugcccuucccgcccagccaccggcucacggcgaaggagguguucgacaacgacggcaagccccgcgucgacauccugaaggcccaccugaugaaggaggggcggcucgaggaguccguggcccugcgcaucaucaccgagggcgccagcauccugcggcaggagaagaaccuccuggacaucgacgcccccgugaccgucugcggggacauccacggccaguucuucgaccugaugaagcuguucgaggucgggggcucccccgcgaacacccgcuaccucuuccugggcgacuacguggaccggggguacuucagcaucgagugcgugcucuaccugugggcccugaagauccucuaccccaagacgcuguuccugcuccgcggcaaccacgagugccggcaccugaccgaguacuucaccuucaagcaggagugcaagaucaaguacuccgagcgcguguacgacgccugcauggacgccuucgacugccugccgcucgcggcccugaugaaccagcaguuccugugcgugcacgggggccucagccccgagaucaacacccuggacgacauccggaagcuggaccgcuucaaggagccgcccgccuacgggcccaugugcgacauccucugguccgacccccuggaggacuucggcaacgagaagacgcaggagcacuucacccacaacaccguccggggcugcagcuacuucuacuccuaccccgccgugugcgaguuccugcagcacaacaaccuccugagcauccugcgcgcccacgaggcgcaggacgccggguaccggauguaccgcaagucccagaccacgggcuuccccagccucaucaccaucuucuccgccccgaacuaccuggacguguacaacaacaaggccgccguccugaaguacgagaacaacgugaugaacauccggcaguucaacugcagcccccaccccuacuggcuccccaacuucauggacguguucaccuggucccugccguucgucggggagaaggugaccgagaugcuggugaacguccucaacaucugcagcgacgacgagcugggcuccgaggaggacggcuucgacggggcgacggccgccgcccgcaaggaggugauccggaacaagauccgcgccaucggcaagauggcgcggguguucagcguccugcgcgaggagagcgaguccgugcucacccugaaggggcugacccccaccggcaugcuccccagcgggguccuguccggcggcaagcagacgcugcagagcgccaccguggaggccaucgaggccgacgaggccaucaagggguucagcccccagcacaagaucaccuccuucgaggaggcgaagggccucgaccgcaucaacgagcggaugccgccccgccgggacgccaugcccuccgacgccaaccugaacagcaucaacaaggcccugaccuccgagacgaacgggaccgacagcaacggcuccaacagcuccaacauccaguga

SEQ ID NO: 34975 - RNA, 1578 nt, Artificial Sequence
  derived and/or modified sequence opt1 from PPP3CB__Homo_sapiens__NP_001135825
auggccgcccccgagcccgcgcgcgccgcgcccccgcccccgcccccgccgcccccgccgcccggcgccgaccggguggucaaggccgugcccuucccgcccacccaccgccugaccagcgaggagguguucgaccucgacgggaucccccgggucgacgugcugaagaaccaccuggugaaggagggccgcgucgacgaggagaucgcccuccggaucaucaacgagggggccgccauccugcgccgggagaagacgaugaucgagguggaggcccccaucaccgugugcggcgacauccacgggcaguucuucgaccugaugaagcuguucgaggucggcggcucccccgcgaacacccgcuaccuguuccugggggacuacguggaccggggcuacuucagcaucgagugcgugcucuaccuguggguccugaagauccucuaccccuccacccuguuccugcuccgcgggaaccacgagugccggcaccugacggaguacuucaccuucaagcaggagugcaagaucaaguacagcgagcgcguguacgaggccugcauggaggccuucgacucccucccccucgccgcccugcugaaccagcaguuccucugcgugcacggcgggcugagccccgagauccacacccuggacgacauccggcgccucgaccgguucaaggagccgcccgcguucggccccaugugcgaccugcugugguccgaccccagcgaggacuucggcaacgagaagucccaggagcacuucagccacaacaccguccgcgggugcuccuacuucuacaacuaccccgccgugugcgaguuccuccagaacaacaaccugcugagcaucauccgggcccacgaggcccaggacgccggcuaccgcauguaccggaagucccagacgaccggguuccccagccucaucaccaucuucuccgcgcccaacuaccuggacguguacaacaacaaggccgccguccugaaguacgagaacaacgugaugaacauccgccaguucaacugcagcccccaccccuacuggcuccccaacuucauggacguguucaccuggucccugcccuucgucggcgagaaggugacggagaugcuggugaacguccucagcaucugcuccgacgacgagcugaugaccgagggcgaggaccaguucgacguggggagcgccgccgcgcggaaggagaucauccgcaacaagauccgcgccaucggcaagauggcccgggucuucagcgugcugcgcgaggaguccgagagcgugcucacccugaaggggcugacccccacgggcaugcuccccuccgggguccuggccggcggccggcagacccugcagagcgccaccguggaggcgaucgaggccgagaaggccauccgcggguucagcccgccccaccggaucugcuccuucgaggaggccaagggccucgaccgcaucaacgagcggaugccgccccgcaaggacgcggugcagcaggacggguucaacucccugaacaccgcccacgccacggagaaccacggcaccgggaaccacaccgcccaguga

SEQ ID NO: 34976 - RNA, 1566 nt, Artificial Sequence
  derived and/or modified sequence opt1 from PPP3CC__Homo_sapiens__NP_001230903
augagcggccgccgguuccaccuguccaccaccgaccgcgugaucaaggccguccccuucccgcccacgcagcggcucaccuucaaggagguguucgagaacgggaagcccaagguggacguccugaagaaccaccuggugaaggagggccgccucgaggaggagguggcccugaagaucaucaacgacggggcggccauccugcggcaggagaagaccaugaucgaggucgacgcccccaucaccgugugcggcgacauccacgggcaguucuucgaccucaugaagcuguucgaggugggcggcagcccguccaacacgcgcuaccuguuccucggggacuacgucgaccggggcuacuucagcaucgagugcgugcuguaccuguggucccucaagaucaaccaccccaagacccuguuccugcuccgcgggaaccacgagugccggcaccugaccgacuacuucaccuucaagcaggagugccgcaucaaguacagcgagcaggucuacgacgccugcauggagacguucgacugccugccccucgccgcgcugcugaaccagcaguuccucugcgugcacggcgggaugucccccgagaucaccagccuggacgacauccggaagcuggaccgcuucaccgagccgcccgccuucggccccgugugcgaccuccugugguccgaccccagcgaggacuacggcaacgagaagacccuggagcacuacacgcacaacaccgugcgggggugcuccuacuucuacagcuacccggccgucugcgaguuccuccagaacaacaaccugcuguccaucauccgcgcccacgaggcgcaggacgccggcuaccggauguaccgcaagagccaggccaccggguuccccucccucaucaccaucuucagcgcccccaacuaccuggacguguacaacaacaaggccgcggugcugaaguacgagaacaacgucaugaacauccggcaguucaacugcagcccccacccguacuggcuccccaacuucauggacguguucacguggucccugcccuucgugggcgagaaggucaccgagaugcuggugaacgugcucaacaucugcuccgacgacgagcugaucagcgacgacgaggccgaggaccacuacauccccagcuaccagaagggcuccaccaccguccgcaaggagaucauccggaacaagauccgcgccaucgggaagauggcccggguguucagcauccugcgccaggaguccgagagcguccucacgcugaagggccugaccccgaccgggacccucccccugggcgugcuguccgggggcaagcagacgaucgagaccgccaccguggaggcggucgaggcccgcgaggccauccggggcuucagccuccagcacaagauccgcuccuucgaggaggcccgggggcuggaccgcaucaacgagcggaugccgccccgcaaggacagcauccacgccggcgggcccaugaaguccgugaccagcgcgcacucccacgccgcccaccggagcgaccagggcaagaaggcccacuccuga

SEQ ID NO: 34977 - RNA, 513 nt, Artificial Sequence
  derived and/or modified sequence opt1 from PPP3R1__Homo_sapiens__NP_000936
augggcaacgaggccagcuacccccuggagaugugcucccacuucgacgccgacgagaucaagcgccucgggaagcgguucaagaagcuggaccuggacaacagcggcucccucagcguggaggaguucaugucccugccggagcugcagcagaacccccucguccagcgcgugaucgacaucuucgacaccgacgggaacggcgagguggacuucaaggaguucaucgagggggucagccaguucuccgugaagggcgacaaggagcagaagcugcgguucgcguuccgcaucuacgacauggacaaggacggcuacaucagcaacggggagcuguuccaggugcucaagaugauggucggcaacaaccugaaggacacccagcugcagcagaucguggacaagacgaucaucaacgccgacaaggacggggacggccggaucuccuucgaggaguucugcgccguggucgggggccucgacauccacaagaagauggugguggacgucuga

SEQ ID NO: 34978 - RNA, 522 nt, Artificial Sequence
  derived and/or modified sequence opt1 from PPP3R2__Homo_sapiens__NP_671709
augagcaccaugggcaacgaggccuccuaccccgccgagaugugcagccacuucgacaacgacgagaucaagcgccuggggcggcgcuucaagaagcucgaccuggacaaguccggcagccuguccguggaggaguucaugagccucccggagcugcggcacaacccccugguccgccgggugaucgacguguucgacaccgacggggacggcgaggucgacuucaaggaguucauccucgggacgucccaguucagcgugaagggcgacgaggagcagaagcugcgcuucgcguucuccaucuacgacauggacaaggacggcuacaucagcaacggggagcuguuccaggugcucaagaugauggucggcaacaaccugaccgacuggcagcugcagcagcucguggacaagaccaucaucauccuggacaaggacggggacggcaagaucuccuucgaggaguucagcgccgugguccgggaccuggagauccacaagaagcucgugcugaucguguga

SEQ ID NO: 34979 - RNA, 924 nt, Artificial Sequence
  derived and/or modified sequence opt1 from PPP4C__Homo_sapiens__NP_002711
auggccgagaucagcgaccuggaccgccagaucgagcagcugcggcgcugcgagcugaucaaggaguccgaggugaaggcccugugcgcgaaggcccgggagauccucgucgaggagagcaacgugcagcgcguggacucccccgucaccgugugcggcgacauccacgggcaguucuacgaccugaaggagcuguuccgggugggcggggacgucccggagaccaacuaccucuucaugggcgacuucguggaccgcggguucuacagcguggagacguuccugcugcuccuggcccugaagguccgguaccccgaccgcaucacccucauccggggcaaccacgagucccgccagaucacccagguguacggcuucuacgacgagugccugcggaaguacgggagcgugaccgucuggcgcuacugcacggagaucuucgacuaccugucccucagcgccaucaucgacggcaagaucuucugcgugcacgggggccugucccccagcauccagacccuggaccagauccggaccaucgaccgcaagcaggaggugccccacgacgggccgaugugcgaccuccugugguccgaccccgaggacaccacgggcuggggcgucagcccccgcggggccggcuaccuguucggguccgacgugguggcgcaguucaacgccgccaacgacaucgacaugaucugccgggcccaccagcucgucauggagggcuacaaguggcacuucaacgagaccgugcugaccguguggagcgcgcccaacuacugcuaccggugcggcaacgucgccgccauccuggagcucgacgagcaccuccagaaggacuucaucaucuucgaggccgccccgcaggagacccgcgggauccccuccaagaagcccguggcggacuacuuccuguga

SEQ ID NO: 34980 - RNA, 2853 nt, Artificial Sequence
  derived and/or modified sequence opt1 from PPP4R1__Homo_sapiens__NP_001035847
auggccgaccugagccuccugcaggaggaccugcaggaggacgccgacggcuucgggguggacgacuacuccagcgaguccgacgucaucaucauccccagcgcgcucgacuucgugucccaggacgagaugcugaccccgcugggccgccucgacaaguacgccgccagcgagaacaucuucaaccggcagaugguggcccgcucccugcuggacacccuccgggaggucugcgacgacgagcgcgacugcaucgccgugcuggagcggaucagccgccuggcggacgacuccgagcccacggugcgggccgagcucauggagcaggucccccacaucgcccuguucugccaggagaaccgccccagcaucccguacgccuucuccaaguuccugcuccccaucguggugcgguaccuggcggaccagaacaaccagguccgcaagaccagccaggccgcccugcucgcccugcuggagcaggagcucaucgagcgguucgacguggagaccaaggugugccccguccugaucgagcugaccgcccccgacuccaacgacgacgugaagacggaggcgguggccaucaugugcaagauggccccgauggucgggaaggacaucaccgagcgccucauccugccccgguucugcgagaugugcugcgacugccgcauguuccacgugcggaaggugugcgccgccaacuucggcgacaucugcagcgucguggggcagcaggcgaccgaggagaugcugcucccccgcuucuuccagcugugcuccgacaacguguggggcguccggaaggccugcgccgagugcuucauggccgugagcugcgcgaccugccaggagauccgccggacgaagcuguccgcccucuucaucaaccugaucagcgaccccucccgcugggugcggcaggccgccuuccagagccugggcccguucaucagcaccuucgccaaccccuccagcuccgggcaguacuucaaggaggagagcaaguccagcgaggagauguccgucgagaacaagaaccgcacccgcgaccaggaggcccccgaggacgugcagguccggcccgaggacaccccgagcgaccucuccgugagcaacuccagcgugauccuggagaacacgauggaggaccacgcggccgaggccuccggcaagccccugggggagaucagcgucccccucgacuccagccugcugugcacccucuccagcgagucccaccaggaggccgcgagcaacgagaacgacaagaagcccggcaacuacaagagcaugcugcgcccggagguggggaccaccucccaggacagcgcccugcucgaccaggagcuguacaacuccuuccacuucuggcggacgccccugcccgagaucgaccucgacaucgagcuggagcagaacagcggcggcaagcccuccccggaggggcccgaggaggagagcgagggccccgugcccuccagcccgaacaucaccauggccacccgcaaggagcuggaggagaugaucgagaaccucgagccccacaucgacgaccccgacgucaaggcccagguggaggugcuguccgccgcgcugcgggccagcucccuggacgcccacgaggagaccaucagcaucgagaagcgcuccgaccuccaggacgagcuggacaucaacgagcugccgaacugcaagaucaaccaggaggacagcgucccccucaucuccgacgccguggagaacauggacagcacgcugcacuacauccacuccgacagcgaccugagcaacaacuccagcuucucccccgacgaggagcggcgcaccaaggugcaggacgucgugccccaggcccuccuggaccaguaccugagcaugaccgacccgucccgggcgcagaccguggacacggagaucgccaagcacugcgccuacagccuccccggggucgcccugacccugggccgccagaacuggcacugccuccgggagaccuacgagacccuggccuccgacaugcaguggaaggugcgccggacgcuggcguucagcauccacgagcucgccgugauccugggcgaccagcugaccgccgccgaccucguccccaucuucaacggguuccugaaggaccuggacgaggugcgcaucggcgugcucaagcaccuccacgacuuccugaagcugcugcacaucgacaagcggcgcgaguaccuguaccagcuccaggaguuccuggucaccgacaacucccggaacuggcgcuuccgggcggagcuggccgagcagcucauccugcugcucgagcuguacagcccccgcgacguguacgacuaccugcgcccgaucgcccucaaccugugcgccgacaagguguccagcguccgguggaucuccuacaagcuggugagcgagauggugaagaagcuccacgccgcgaccccgcccacguucggggucgaccugaucaacgagcugguggagaacuucggccgcugccccaagugguccgggcggcaggccuucguguucgucugccagaccgugaucgaggacgacugccuccccauggaccaguucgccgugcaccugaugccccaccuccugacccuggccaacgaccgcguccccaacgugcgggugcugcucgccaagacccugcgccagacgcugcucgagaaggacuacuuccuggcgagcgccuccugccaccaggaggccgucgagcagaccaucauggcccugcagauggaccgggacagcgacgugaaguacuucgccuccauccaccccgcgagcaccaagaucagcgaggacgccauguccaccgccagcuccaccuacuga

SEQ ID NO: 34981 - RNA, 1434 nt, Artificial Sequence
  derived and/or modified sequence opt1 from PPP5C__Homo_sapiens__NP_001191213
auggccauggccgagggcgagcgcaccgagugcgcggagcccccgcgggacgagccgcccgccgacggggcccugaagcgcgccgaggagcucaagacccaggccaacgacuacuucaaggcgaaggacuacgagaacgccaucaaguucuacagccaggccaucgagcugaaccccuccaacgccaucuacuacggcaaccggagccuggcguaccuccgcacggagugcuacggguacgcccugggcgacgccacccgggccaucgagcuggacaagaaguacaucaagggguacuaccgccgggccgcguccaacauggcccucggcaaguuccgcgccgcccugcgggacuacgagaccguggucaaggugaagccccacgacaaggacgccaagaugaaguaccaggagugcaacaagaucgugaagcagaaggcguucgagcgcgccaucgccggcgacgagcacaagcggagcgucguggacucccuggacaucgagagcaugaccaucgaggacgaguacuccgggcccaagcucgaggacggcaaggugacgaucagcuucaugaaggagcugaugcagugguacaaggaccagaagaagcugcaccgcaagugcgccuaccagaccgagaagaucaccgucugcggggacacccacggccaguucuacgaccuccugaacaucuucgagcugaacgggcuccccuccgagacgaaccccuacaucuucaacggcgacuucguggaccggggcagcuucuccguggaggucauccugacccuguucggguucaagcuccuguacccggaccacuuccaccuccugcgcggcaaccacgagaccgacaacaugaaccagaucuacggguucgagggcgaggugaaggccaaguacaccgcgcagauguacgagcuguucagcgagguguucgaguggcugccccucgcccagugcaucaacggcaagguccugaucaugcacgggggccuguucuccgaggacggggugacgcucgacgacauccggaagaucgagcgcaaccggcagccgcccgacagcggccccaugugcgaccugcugugguccgacccccagccccagaacgggcgcagcaucuccaagcggggcgugagcugccaguucggccccgacgucaccaaggccuuccucgaggagaacaaccuggacuacaucauccgcucccacgaggugaaggccgagggguacgagguggcccacggcgggcggugcgucaccguguucagcgcgccgaacuacugcgaccagaugggcaacaaggccagcuacauccaccuccagggguccgaccugcgcccccaguuccaccaguucaccgccgugccccaccccaacgucaagccgauggccuacgcgaacacgcugcugcagcucggcaugauguga

SEQ ID NO: 34982 - RNA, 1029 nt, Artificial Sequence
  derived and/or modified sequence opt1 from PPP6C__Homo_sapiens__NP_001116827
auggcgccccuggaccucgacaaguacguggagaucgcccgccugugcaaguaccugccggagaacgaccucaaggucagccccaucugcggccuggcccccuccgggugcggcgcccccgccgggcggccguuccugagccccgggcccccgcccguguuccacuuccuccgcuuccugaaggagcggcugugcgacuacgugugcgaccuccugcuggaggaguccaacguccagcccgugagcacccccgugaccgucugcggggacauccacggccaguucuacgaccucugcgagcuguuccgcacgggcggccaggugcccgacaccaacuacaucuucaugggcgacuucguggaccggggguacuacucccuggagaccuucaccuaccuccuggcccugaaggccaaguggccggaccgcaucacgcuccugcggggcaaccacgagagccgccagaucacccaggucuacggguucuacgacgagugccagaccaaguacggcaacgcgaacgccuggcgguacugcaccaagguguucgacaugcugacgguggccgcccucaucgacgagcagauccugugcguccacggcgggcugucccccgacaucaagacccucgaccagauccgcaccaucgagcggaaccaggagaucccccacaagggcgcguucugcgaccugguguggagcgaccccgaggacguggacaccugggccaucuccccgcgcggggccggcuggcuguucggcgccaaggucacgaacgaguucgugcacaucaacaaccucaagcugaucugccgggcccaccagcuggugcacgagggguacaaguucauguucgacgagaagcucgucaccguguggagcgcgcccaacuacugcuaccgcugcggcaacaucgccuccaucaugguguucaaggacgucaacacccgggagcccaagcuguuccgcgccgugcccgacagcgagcgggugaucccgccccgcaccacgacccccuacuuccuguga

SEQ ID NO: 34983 - RNA, 2802 nt, Artificial Sequence
  derived and/or modified sequence opt1 from PPP6R2__Homo_sapiens__NP_001229828
auguucuggaaguucgaccugaacaccaccagccacguggacaagcuccuggacaaggagcacgucacgcugcaggagcucauggacgaggacgacauccugcaggagugcaaggcccagaaccagaagcugcucgacuuccugugccgccagcagugcauggaggagcuggugucccucaucacccaggacccgccccuggacauggaggagaaggugcgguucaaguaccccaacaccgccugcgagcugcugaccugcgacgucccccagaucagcgaccgccugggcggggacgagucccugcucagccugcuguacgacuuccucgaccacgagcccccgcugaacccccugcucgcguccuucuucagcaagacgaucggcaaccugaucgcccggaagaccgagcaggucaucaccuuccugaagaagaaggacaaguucaucucccucgugcugaagcacaucgggaccagcgcccugauggaccuccugcugcgccucgucuccugcguggagcccgccggccugcggcaggacgugcugcacuggcucaacgaggagaaggucauccagcgccugguggagcugauccaccccagccaggacgaggaccggcaguccaacgccagccagacgcucugcgacaucgugcgccuggggcgggaccagggcucccagcugcaggaggcgcucgagccggacccccugcugaccgcccucgagagccgccaggacugcgucgagcagcugcugaagaacauguucgacggcgaccggaccgaguccugccucgugagcgggacccaggugcugcugacgcuccuggagacccgccgggucggcaccgaggggcugguggacuccuucagccagggccuggagcgcuccuacgccgugagcagcuccguccuccacgggaucgagccccggcucaaggacuuccaccagcugcuccugaacccgcccaagaagaaggccauccugaccacgaucggcgugcucgaggagccccugggcaacgcgcgccugcacggggcccggcucauggccgcccugcugcacaccaacacccccagcaucaaccaggagcucugccgccugaacaccauggaccugcuccuggaccuguucuucaaguacacguggaacaacuuccuccacuuccagguggagcugugcaucgccgcgauccugucccacgccgcccgggaggagcgcaccgaggccagcggcuccgagagccggguggagcccccgcacgagaacgggaaccgcucccucgagacgccccagcccgccgcgagccugcccgacaacaccauggugacccaccuguuccagaagugcugccucgugcagcgcauccuggaggccugggaggccaacgaccacacccaggccgccggcggcaugcggcgcgggaacaugggccaccugacccggaucgcgaacgccgucgugcagaaccucgagcgcgggccgguccagacccacaucuccgaggugauccggggccugcccgccgacugccgcgggcggugggagagcuucguggaggagacgcugaccgagaccaaccgccggaacaccgucgaccucgccuucuccgacuaccagauccagcagaugacggccaacuucguggaccaguucggcuucaacgacgaggaguucgcggaccaggacgacaacaucaacgcccccuucgaccgcaucgccgagaucaacuucaacaucgacgccgacgaggacagccccuccgcggcccuguucgaggccugcugcagcgaccggauccagccguucgacgacgacgaggacgaggacaucugggaggacuccgacacccgcugcgccgcccgggugauggcgcgcccccgguucggcgcgccccacgccagcgaguccugcagcaagaacgggcccgagcgcggcgggcaggacggcaaggccucccuggaggcccaccgggacgccccgggggccggcgccccgcccgcccccggcaagaaggaggccccgcccgucgagggggacagcgagggcgcgauguggaccgccguguucgacgagcccgccaacagcacccccacggcccccggggugguccgcgacgugggcuccagcgugugggcggccgggaccuccgcccccgaggagaagggcugggccaaguucaccgacuuccagcccuucugcugcagcgaguccggcccgcggugcagcucccccgucgacaccgagugcagccacgccgaggggucccgcagccagggccccgagaaggcguucucccccgccagcccgugcgccuggaacgugugcgugacccgcaaggcgccccuccuggccuccgacagcuccagcuccgggggcagccacagcgaggacggcgaccagaaggccgccuccgccauggacgccgucagccgggggcccggccgcgaggcgcccccgcugcccacgguggcccggaccgaggaggccguggggcgcgucggcugcgccgacucccggcuccugagccccgccugccccgcgccgaaggaggugaccgccgcccccgccguggccgucccgcccgaggcgaccguggccaucacgaccgcccuguccaaggccgggcccgccauccccacccccgcggugagcuccgcccucgccgucgccgugccgcugggccccaucauggccgugaccgcggcccccgccauggucgccacgcugggcaccgugaccaaggacgggaagaccgacgcgcccccggagggcgccgcccucaacgggcccguguga

SEQ ID NO: 34984 - RNA, 2640 nt, Artificial Sequence
  derived and/or modified sequence opt1 from PPP6R3__Homo_sapiens__NP_001157632
auguucuggaaguucgaccugcacagcuccagccacaucgacacccuccuggagcgcgaggacgugacccugaaggagcucauggacgaggaggacguccugcaggagugcaaggcccagaaccggaagcugaucgaguuccuccugaaggccgagugccuggaggaccucguguccuucaucaucgaggagcccccgcaggacauggacgagaagauccgcuacaaguaccccaacaucagcugcgagcugcugacguccgacgugagccagaugaacgaccggcucggcgaggacgagucccugcugaugaagcucuacagcuuccugcugaacgacagcccccucaacccccugcuggcgagcuucuucuccaagguccucagcauccugaucucccgcaagccggagcagaucguggacuuccugaagaagaagcacgacuucguggaccucaucaucaagcacaucgggaccagcgccaucauggaccugcugcuccggcugcugaccugcaucgagccgccccagccccgccaggacguccucaacuggcugaacgaggagaagaucauccagcggcugguggagaucgugcaccccucccaggaggaggaccgccacagcaacgccucccagagccucugcgagaucguccggcugucccgcgaccagaugcugcagauccagaacagcaccgagcccgacccccuccuggccacgcuggagaagcaggagaucaucgagcagcuccugagcaacaucuuccacaaggagaagaacgaguccgccaucgugagcgcgauccagauccugcucacccugcuggagacccggcgccccaccuucgagggccacaucgagaucugcccgcccgggaugucccacagcgccugcuccgugaacaagagcguccucgaggccauccggggccgccugggguccuuccacgagcugcuccuggagccgcccaagaaguccgugaugaagacgaccuggggcgugcuggacccgcccgucggcaacacccggcugaacgugauccgccucaucuccagccugcugcagaccaacacguccagcaucaacggggaccucauggagcugaacuccaucggcgugauccugaacauguucuucaaguacaccuggaacaacuuccuccacacccaggucgagaucugcaucgcccugauccuggcgagccccuucgagaacaccgagaacgccacgaucaccgaccaggacuccaccggggacaaccuccugcugaagcaccucuuccagaagugccagcugaucgagcggauccuggaggccugggagaugaacgagaagaagcaggccgagggcgggcgccggcacggcuacaugggccaccucacccgcaucgccaacugcaucgugcacagcacggacaaggggcccaacuccgcgcuggugcagcagcugaucaaggaccuccccgacgagguccgggagcgcugggagaccuucugcaccagcucccugggcgagaccaacaagcgcaacacgguggaccuggugacgaccugccacauccacagcagcuccgacgacgagaucgacuucaaggagaccggguucagccaggacuccagccuccagcaggccuucuccgacuaccagaugcagcagaugaccagcaacuucaucgaccaguucggcuucaacgacgagaaguucgccgaccaggacgacaucggcaacgucuccuucgaccgggugagcgacaucaacuucacccugaacaccaacgaguccgggaacaucgcccuguucgaggccugcugcaaggagcgcauccagcaguucgacgacggcgggagcgacgaggaggacaucugggaggagaagcacaucgcguucacccccgagucccagcggcgcagcuccagcggcuccacggacagcgaggaguccaccgacagcgaggaggaggacggggccaagcaggaccucuucgagcccagcuccgccaacaccgaggacaagauggaggucgaccugagcgagcccccgaacugguccgccaacuucgacgugcccauggagaccacgcacggcgcgccccuggacagcgugggcuccgacgucuggagcaccgaggagcccaugccgaccaaggagaccgggugggccuccuucagcgaguucaccuccagccucuccacgaaggacagccugcgguccaacagccccguggagauggagaccuccaccgagcccauggacccgcugacccccagcgccgccgcccucgccgugcagcccgaggcggccggcuccgucgccauggaggccagcuccgacggggaggaggacgcggagagcacggacaaggugaccgagaccgugaugaacggcgggaugaaggagacccugagccugacggucgacgccaagaccgagaccgccguguucaagcgcgugcucaaguccuaccgggaggagggcaagcugagcaccucccaggacgccgccugcaaggacgcggaggagugccccgagacggccgaggccaagugcgccgccccgcgcccgcccagcuccagccccgagcagcggaccggccagcccuccgcgcccggggacaccagcgucaacggccccguguga

SEQ ID NO: 34985 - RNA, 4203 nt, Artificial Sequence
  derived and/or modified sequence opt1 from PPRC1__Homo_sapiens__NP_001275656
auggccgcccgccggggccgccgggacgggguggcgcccccgcccagcggcgggcccggccccgacccggggggcggcgcccgcggguccggcugggggagccggucccaggcccccuacggcacccugggggccgucagcggcggcgagcaggugcuccugcacgaggaggccggggacuccggcuucgugagccugucccgccucgggcccagccugcgggacaaggaccuggagauggaggagcucaugcugcaggacgagacccugcucggcacgaugcaguccuacauggacgcgagccugaucucccugaucgaggacuucggcagccucggggagucccgccugagccuggaggaccagaacgaggucucccuccugaccgcccugaccgagauccucgacaacgccgacagcgagaaccugucccccuucgacagcaucccggacuccgagcugcucgugagcccccgggagggcagcucccugcacaagcugcucacccugagccgcacgccccccgagcgggaccugaucaccccgguggacccccucgggcccuccaccggcagcucccgcgggagcggcgucgagaugucccugcccgacccgagcugggacuucuccccccccagcuuccuggagaccuccagccccaagcucccguccuggcggcccccccgcagccggccccgcuggggccaguccccgcccccccagcagcggagcgacggggaggaggaggaggagguggccuccuucagcggccagauccuggcgggggagcuggacaacugcguguccagcauccccgacuucccgaugcaccucgccugccccgaggaggaggacaaggccacggccgccgagauggcgguccccgccgccggcgacgagagcaucuccagccuguccgagcuggugcgcgccaugcacccguacugccuccccaaccugacccaccuggccagccucgaggacgagcugcaggagcagcccgacgaccugacccuccccgaggggugcgugguccuggagaucgugggccaggcggccaccgccggcgacgaccuggagaucccgguggucgugcggcaggugucccccgggccccgccccguccuccuggacgacagccuggagacguccagcgcccuccagcugcugaugccgacccuggaguccgagaccgaggccgcggugcccaaggugacccucugcagcgagaaggagggccugucccugaacagcgaggagaagcucgacuccgccugccugcugaagccccgggaggucguggagcccguggucccgaaggagccccagaacccccccgccaacgccgccccggggagccagcgcgcgcgcaagggccggaagaagaaguccaaggagcagcccgccgccugcguggagggguacgcccgccggcuccgcagcuccagccggggccagagcacggucggcaccgaggugaccucccagguggacaaccugcagaagcagccccaggaggagcugcagaaggagagcgggccccuccagggcaaggggaagccgcgcgcgugggcccgggccugggccgccgcgcuggagaacuccagccccaagaaccuggagcgcuccgccggccagagcucccccgccaaggagggcccccucgaccuguacccgaagcuggccgacaccauccagacgaaccccauccccacccaccucagccuggucgacuccgcccaggcgagcccgaugcccguggacuccguggaggccgaccccaccgccgucgggcccgugcuggccggcccggugcccgucgaccccgggcucguggaccuggccagcaccuccagcgagcugguggagccccucccggcggagcccguccugaucaaccccgugcuggccgacuccgccgccguggaccccgcggucgugccgaucagcgacaaccucccccccguggacgccguccccuccggcccggcccccguggaccuggcccugguggaccccguccccaacgaccucacgccgguggaccccgugcuggucaagagccggcccaccgacccccgccggggggccguguccagcgcgcugggcggcagcgccccgcagcuccugguggaguccgagagccuggacccccccaagaccaucauccccgaggucaaggaggugguggacucccucaagaucgagagcgggaccuccgccacgacccacgaggcccgcccgcggccccugagccuguccgaguaccgccggcgccggcagcagcgccaggccgagaccgaggagcggagcccccagccgcccaccggcaaguggcccucccuccccgagacgccgaccgggcuggcggacauccccugccuggucaucccccccgccccggccaagaagaccgcccuccagcgcagccccgagaccccccuggagaucugccuggugcccgugggcccgucccccgccagccccucccccgagccgcccgucagcaagcccguggcguccagccccacggagcaggugccgucccaggagaugccccuccuggcccgccccagccccccgguccaguccgugagccccgccgugcccacccccccgagcauguccgccgcgcugcccuuccccgccgggggccucggcaugccgcccagccugccccccccgccccugcagccccccucccucccgcugagcauggggcccguccugcccgaccccuucacccacuacgccccgcuccccuccuggcccugcuacccccacgugagcccguccggcuaccccugccugccccccccgcccaccgugccccuggucagcgggacccccggcgccuacgccgugccgcccacgugcuccgugcccugggcgccgccccccgcccccgucagcccguacuccagcaccugcaccuacgggccccucggcuggggccccgggccccagcacgccccguucugguccaccgugcccccccccccgcugccccccgccagcaucggccgggccgugccccagccgaagauggagucccgcgggacgcccgcgggcccccccgagaacguccugccgcucagcauggcccccccccugucccuggggcuccccggccacggcgccccgcagaccgagcccaccaagguggaggugaagcccguccccgccagcccgcaccccaagcacaagguguccgcccugguccagagcccccagaugaaggcgcuggccugcgugagcgccgagggggugaccgucgaggagccggccuccgagcggcucaagcccgagacgcaggagacccgcccccgggagaagcccccgcugcccgccaccaaggcggugcccaccccccgccagagcacggugccgaagcugcccgccguccaccccgcccggcuccgcaagcuguccuuccugcccaccccgcggacccagggcagcgaggacguggugcaggccuucaucuccgagaucgggaucgaggcgagcgaccucuccagccugcuggagcaguucgagaaguccgaggccaagaaggagugccccccccccgccccggccgacagccucgccgucggcaacuccggcagcuccugcagcuccagcgggcgcucccggcgcugcagcuccagcagcuccagcuccagcuccagcuccagcuccagcuccagcuccagcuccagccggucccgcagccggucccccagcccccgccggcgcagcgaccggcgccggcgcuacuccagcuaccgcucccacgaccacuaccagcggcagcgcgugcugcagaaggagcgggcgaucgaggagcgccggguggucuucaucggcaagauccccgggcgcaugacccggagcgagcugaagcagcgcuucuccguguucggcgagaucgaggagugcacgauccacuuccgggugcagggggacaacuacggcuucgucaccuaccgcuacgccgaggaggccuucgccgccaucgagagcggccacaagcuccggcaggcggacgagcagccguucgaccugugcuucgggggccgccggcaguucugcaagcgcuccuacagcgaccuggacuccaaccgggaggacuucgaccccgcccccgugaagagcaaguucgacucccucgacuucgacacccugcugaagcaggcccagaagaaccuccgccgguga

SEQ ID NO: 34986 - RNA, 909 nt, Artificial Sequence
  derived and/or modified sequence opt1 from PPT2__Homo_sapiens__NP_001191032
augcugggccucugcgggcagcgccugcccgccgccugggugcugcuccugcugccguuccucccccugcugcuccuggcggcccccgcgccccaccgggccagcuacaagccggucaucguggugcacggccuguucgacuccagcuacuccuuccgccaccuccuggaguacaucaacgagacccaccccgggaccgucgugacggugcuggaccucuucgacggccgggagagccugcgcccccugugggagcagguccagggguuccgggaggccguggugcccaucauggccaaggccccgcagggcguccaccucaucugcuacucccagggcgggcuggugugccgcgcccugcucagcgugauggacgaccacaacgucgacuccuucaucagccuguccagcccccagaugggccaguacggggacaccgacuaccugaaguggcuguuccccaccuccaugcggagcaaccucuaccgcaucugcuacucccccuggggccaggaguucagcaucugcaacuacuggcacgacccgcaccacgacgaccuguaccucaacgccuccagcuuccuggcgcugaucaacggggagcgggaccaccccaacgccaccguguggcgcaagaacuuccuccgggugggccaccugguccugaucggcgggcccgacgacggcgugaucacgcccuggcaguccagcuucuucggguucuacgacgccaacgagaccgugcucgagauggaggagcagcuggucuaccugcgcgacuccuucggccucaagacccugcuggcccggggcgccaucgugcgcugcccgauggcggggaucagccacaccgccuggcacagcaaccggacgcucuacgagaccugcaucgagcccuggcuguccuga

SEQ ID NO: 34987 - RNA, 288 nt, Artificial Sequence
  derived and/or modified sequence opt1 from PPY__Homo_sapiens__NP_002713
auggccgccgcgcgccugugccucucccugcugcuccuguccacgugcguggcccugcuccugcagccccugcucggcgcccagggggccccgcuggagcccgucuaccccggcgacaacgccacccccgagcagauggcgcaguacgccgccgaccugcggcgcuacaucaacaugcucacccggccgcgcuacgggaagcggcacaaggaggacacccuggccuucagcgaguggggcagcccccacgcggccgugccccgcgagcugagcccccucgaccuguga

SEQ ID NO: 34988 - RNA, 498 nt, Artificial Sequence
  derived and/or modified sequence opt1 from PQBP1__Homo_sapiens__NP_001161464
augccccugccgguggcccuccagacccgccuggccaagcggggcauccugaagcaccucgagcccgagcccgaggaggagaucaucgcggaggacuacgacgacgaccccgucgacuacgaggccacccgccuggaggggcugccgcccagcugguacaagguguucgaccccuccugcggccuccccuacuacuggaacgccgaccgggaggaggggaaggagcgccggcaccaccgccgggaggagcuggccccguaccccaagagcaagaaggccgugucccgcaaggacgaggagcuggaccccauggaccccagcuccuacagcgacgcgccgcggggcacgugguccaccgggcuccccaagcgcaacgaggccaagaccggcgccgacaccacggccgcgggcccccuguuccagcagcggcccuacccgagccccggggccguccugcgcgccaacgccgaggccucccggaccaagcagcaggacuga

SEQ ID NO: 34989 - RNA, 567 nt, Artificial Sequence
  derived and/or modified sequence opt1 from PQLC3__Homo_sapiens__NP_001269639
auggaggccgcccugcucggccugugcaacuggagcacccugggggugugcgcggcccucaagcugccccagaucuccgccguccuggccgcccgcagcgcgcggggccucucccugccgagccugcuccuggagcuggccggguuccucguguuccugcgcuaccagugcuacuacggcuacccgccccugaccuaccucgaguaccccauccugaucgcccaggacgugauccugcuccugugcaucuuccacuucaacgggaacgucaagcaggccacgcccuacaucgcggugcugguguccagcugguucauccucgcccugcagaaguggaucaucgaccuggccaugaaccucugcaccuucaucuccgccgccagcaaguucgcgcagcugcagugccuguggaagacccgggacuccggcaccgucagcgcccucacguggucccugagcuccuacacgugcgccauccugcuccgcuucgugaucaugcuggcccugaacaucugggugaccgucaccgugcuccgguaccgcaagaccgccaucaaggcggaguga

SEQ ID NO: 34990 - RNA, 174 nt, Artificial Sequence
  derived and/or modified sequence opt1 from PRAC1__Homo_sapiens__NP_115767
augcugugcgcccacuucagcgaccagggccccgcccaccucaccaccuccaagagcgcguuccuguccaacaagaagacgagcacccugaagcaccuccugggggagacccgcuccgacggcagcgccugcaacuccgggaucagcggcgggcggggccgcaagaucccguga

SEQ ID NO: 34991 - RNA, 273 nt, Artificial Sequence
  derived and/or modified sequence opt1 from PRAC2__Homo_sapiens__XP_011523050
auggaccgccggcgcauggcccugcggcccggcagccgccggccgaccgccuucuucuuccacucccgcuggcucgugcccaaccugcuggccuucuuccucgggcugagcggcgccgggcccauccaccuccccaugccguggcccaacggccggcgccaccggguccuggacccccacacccagcuguccacgcacgaggcccccgggcgcuggaagccgguggcgccccggaccaugaaggccugcccccaggugcugcucgagugguga

SEQ ID NO: 34992 - RNA, 567 nt, Artificial Sequence
  derived and/or modified sequence opt1 from PRADC1__Homo_sapiens__NP_115695
auggugcccggcgccgccggguggugcugccugguccucuggcugcccgcgugcguggccgcccacggcuuccgcauccacgacuaccuguacuuccaggugcucagccccggggacauccgguacaucuucaccgccacccccgccaaggacuucggcgggaucuuccacacgcgcuacgagcagauccaccugguccccgcggagccgcccgaggccugcggcgagcuguccaacggcuucuucauccaggaccagaucgcccucguggagcgcgggggcugcagcuuccuguccaagacccgggugguccaggagcacgggggccgggccgugaucaucagcgacaacgcgguggacaacgacuccuucuacgucgagaugauccaggacagcacccagcgcaccgccgacauccccgcccuguuccuccuggggcgggacggcuacaugauccgccggucccuggagcagcacggccuccccugggccaucaucagcaucccggugaacgugacguccauccccaccuucgagcugcugcagccgcccuggaccuucugguga

SEQ ID NO: 34993 - RNA, 537 nt, Artificial Sequence
  derived and/or modified sequence opt1 from PRAF2__Homo_sapiens__NP_009144
augagcgaggugcgccugcccccgcuccgggcccuggacgacuucguccugggcuccgcccgccucgcggcccccgaccccugcgacccccagcgguggugccaccgcgugaucaacaaccugcuguacuaccagaccaacuaccuccugugcuucgggaucggccuggcccucgccggguacgugcggccgcugcacacccugcucagcgcccuggucguggcgguggcccugggcguccucgugugggccgccgagacgcgcgcggccgugcggcgcugccggcgcucccaccccgccgccugccuggccgcgguccuggccguggggcuccuggugcugugggucgccggcggcgccugcaccuuccucuucagcaucgccgggcccgugcugcugauccucgugcacgcgucccugcggcugcgcaaccucaagaacaagaucgagaacaagaucgagagcaucggccugaagcggacccccauggggcugcuccuggaggcccugggccaggagcaggaggccggguccuga

SEQ ID NO: 34994 - RNA, 2013 nt, Artificial Sequence
  derived and/or modified sequence opt1 from PRAM1__Homo_sapiens__NP_115528
auggcccaccaccuccccgccgcgauggagagccaccaggacuuccgcuccaucaaggccaaguuccaggccagccagccggagcccuccgaccuccccaagaagcccccgaagcccgaguucggcaagcugaagaaguucagccagcccgagcuguccgagcaccccaagaaggccccgcuccccgaguucggggccgugagccugaagccgcccccgcccgaggucaccgaccugcccaagaagcccccgccgcccgaggugaccgaccuccccaagaagcccccgccgcccgaggugacggaccugcccaagaagcccccgccgcccgaggucaccgaccugcccaagaagcccuccaagcucgagcugagcgaccuguccaagaaguucccccagcucggcgcgacccccuucccccggaagccccugcagcccgaggugggggaggcgccccugaaggccagccuccccgagcccggcgcccccgcccgcaagccccugcagcccgacgagcugucccaccccgcccggccgcccagcgagcccaaguccggggccuucccccgcaagcucuggcagccggaggccggcgaggccacgccccggagcccccagcccgagcuguccaccuucccgaagaagcccgcgcagcccgaguucaacguguaccccaagaagccgccccagccccaggucggcgggcugccgaagaaguccgugccccagcccgaguucagcgaggccgcccagacgccccuguggaagccgcagagcuccgagcccaagcgcgacagcagcgccuuccccaagaaggccucccagcccccgcugagcgacuuccccaagaagccgccccagcccgagcugggcgaccucacccggaccuccagcgagcccgagguguccguccugcccaagcgcccccggccggcggaguucaaggcccugagcaagaagccgccccagcccgagcucgggggccugccccgcaccuccagcgagcccgaguucaacucccugccccggaagcuccugcagcccgagcgccgggggccgccccgcaaguucagccagcccgagcccuccgccgugcugaagcggcacccgcagcccgaguucuucggcgaccucccccgcaagccgccccugcccagcuccgccagcgaguccagccugcccgccgcgguggccggcuucuccagccggcacccgcucucccccggguucggcgccgccgggacgccccgcuggcggagcggcggccugguccacagcgggggcgcccgccccgggcugcggccgucccacccgccccgccgccggccccucccgcccgcgagcucccugggccacccgcccgccaagccgccccugccgcccgggcccguggacaugcagagcuuccgccggcccuccgccgccagcaucgaccuccgccggacccgcuccgcggccggccugcacuuccaggaccggcagcccgaggacaucccccaggugcccgacgagaucuacgagcuguacgacgacgucgagccccgcgacgacagcucccccagccccaagggccgggacgaggcccccuccgugcagcaggccgcccgccggccgccccaggaccccgcgcuccgcaaggagaaggacccccagccccagcagcugcccccgauggaccccaagcugcucaagcagcugcggaaggccgagaaggccgagcgcgaguuccggaagaaguucaaguucgagggggagaucgugguccacaccaagaugaugaucgaccccaacgccaagacccgccggggcgggggcaagcaccuggggauccgccggggcgagauccuggaggugaucgaguucaccagcaacgaggagaugcucugccgcgaccccaagggcaaguacggguacgugccgcgcaccgcccugcugccccucgagaccgaggucuacgacgacguggacuucugcgacccccuggagaaccagccccugccgcucggccgguga

SEQ ID NO: 34995 - RNA, 1530 nt, Artificial Sequence
  derived and/or modified sequence opt1 from PRAME__Homo_sapiens__NP_996837
auggagcgccggcgccuguggggcagcauccagucccgguacaucagcauguccguguggaccagcccccgccggcucgucgagcuggccgggcagucccugcucaaggacgaggcccuggcgaucgccgcccuggagcuccugccgcgcgagcuguucccgccccucuucauggccgccuucgacggccggcacagccagacccugaaggcgauggugcaggccuggcccuucacgugccugccccucggggugcugaugaagggccagcaccuccaccuggagaccuucaaggccguccuggacgggcuggacgugcuccuggcccaggaggugcgcccccggcgcuggaagcugcagguccucgaccugcggaagaacucccaccaggacuucuggaccguguggagcggcaaccgcgcgucccuguacagcuuccccgagcccgaggccgcccagccgaugaccaagaagcggaagguggacggccucuccacggaggccgagcagcccuucauccccgucgaggugcugguggaccuguuccucaaggagggggccugcgacgagcuguucagcuaccugaucgagaaggucaagcgcaagaagaacgugcuccggcugugcugcaagaagcugaagaucuucgcgaugcccaugcaggacaucaagaugauccucaagauggugcagcuggacuccaucgaggaccuggaggugaccugcaccuggaagcucccgacccuggccaaguucagccccuaccugggccagaugaucaaccuccgccggcugcugcucucccacauccacgccagcuccuacaucagccccgagaaggaggagcaguacaucgcccaguucacgucccaguuccugagccugcagugccuccaggcccuguacgucgacagccuguucuuccuccgcgggcggcuggaccagcugcugcgccacgugaugaacccccucgagacccuguccaucaccaacugccggcugagcgagggcgacgucaugcaccucucccagagcccguccgugagccagcuguccgugcugagccucuccggggucaugcugaccgacgugagccccgagccccugcaggcgcuccuggagcgcgccuccgccacgcugcaggaccucguguucgacgagugcggcaucaccgacgaccagcugcuggcccuccugcccagccugucccacugcagccagcucaccacccuguccuucuacggcaacagcaucuccaucagcgcccugcagucccuccugcagcaccugaucgggcucagcaaccugacgcacguccuguacccggugccccucgagagcuacgaggacauccacggcacccugcaccuggagcgccucgcguaccugcacgcccggcugcgcgagcuccugugcgagcuggggcggcccuccauggucuggcucagcgccaaccccugcccgcacugcggcgaccgcaccuucuacgaccccgagcccauccugugccccugcuucaugccgaacuga

SEQ ID NO: 34996 - RNA, 429 nt, Artificial Sequence
  derived and/or modified sequence opt1 from PRAP1__Homo_sapiens__NP_001138673
augcgccggcugcuccuggugaccagccuggucguggugcuccugugggaggccggcgccguccccgcgccgaaggugcccaucaagaugcaggucaagcacuggcccuccgagcaggaccccgagaaggccuggggcgcccgcgugguggagccgcccgagaaggacgaccagcuggugguccucuuccccgugcagaagcccaagcugcugaccacggaggagaagccgcgggggaccaaggccuggauggagaccgaggacacccucgggcacgugcugagccccgagcccgaccacgacucccuguaccacccgccgcccgaggaggaccagggcgaggagcgcccccggcucugggucaugcccaaccaccaggugcugcuggggcccgaggaggaccaggaccacaucuaccacccccaguga

SEQ ID NO: 34997 - RNA, 996 nt, Artificial Sequence
  derived and/or modified sequence opt1 from PRB1__Homo_sapiens__NP_005030
augcugcucauccugcugagcguggcccuccuggcccuguccagcgcgcagaaccucaacgaggacgucucccaggaggagagccccucccugaucgccggcaacccgcaggggcccagcccccagggcgggaacaagccccagggcccgcccccccccccggggaagccccagggcccccccccgcagggcgggaacaagccccagggcccccccccgcccgggaagccccagggccccccgccccagggggacaagucccgcagcccccggucccccccgggcaagccccagggcccccccccgcaggggggcaaccagccccaggggcccccgcccccccccggcaagccgcagggcccccccccccaggggggcaaccgcccgcaggggcccccccccccgggcaagccccaggggccccccccgcagggcgacaagagccgguccccccgcagcccccccggcaagccgcaggggccccccccccagggcgggaaccagccgcagggcccccccccgccccccgggaagccccagggcccgcccccccagggcgggaagaagccccagggcccgcccccccccgggaagccgcagggcccccccccccagggggacaagucccggagcucccagagcccgcccggcaagccccagggccccccgccccaggggggcaaccagccccaggggcccccgcccccccccggcaagccgcagggcccccccccgcaggggggcaacaagccccaggggccccccccgcccggcaagccccaggggcccccggcccagggcggcuccaagagccaguccgcccgcagcccccccgggaagccccagggcccgccccagcaggaggggaacaacccccagggccccccgccccccgccgggggcaacccccagcagccgcaggcgccccccgccggccagccccaggggccgccccggcccccccagggcgggcgcccgagccggcccccccaguga

SEQ ID NO: 34998 - RNA, 1251 nt, Artificial Sequence
  derived and/or modified sequence opt1 from PRB2__Homo_sapiens__NP_006239
augcugcucauccugcugagcguggcccuccuggcccuguccagcgcgcagaaccucaacgaggacgucucccaggaggagagccccucccugaucgccggcaacccgcagggggcccccccccagggcgggaacaagccccagggcccgcccagcccccccgggaagccgcagggcccccccccccagggcgggaaccagccgcagggccccccccccccgcccgggaagccccagggccccccgccccaggggggcaacaagccccagggccccccgccccccgggaagccccagggcccgcccccccagggggacaagucccgcagcccgcgguccccccccggcaagccccagggcccgcccccccaggggggcaaccagccccaggggccgcccccccccccgggcaagccccaggggccccccccgcagggcggcaacaagccccaggggccccccccgcccggcaagccccaggggcccccgccccagggcgacaacaagagccgcuccagccggucccccccggggaagccccagggcccccccccgcagggcgggaaccagccccagggcccccccccgccccccgggaagccccagggcccgcccccccaggggggcaacaagccccagggcccgcccccccccgggaagccgcagggcccccccccccagggggacaacaagagccaguccgcccgcagcccgcccggcaagccccagggccccccgccccaggggggcaaccagccccaggggccgcccccccccccgggcaagccccaggggccccccccgcagggcggcaacaagccccaggggccccccccgcccggcaagccccaggggcccccgccccagggcggguccaagagccgguccagccgcagcccccccggcaagccgcagggcccccccccccaggggggcaaccagccgcaggggcccccccccccgcccggcaagccccaggggccgcccccccagggcggcaacaagccccaggggccgcccccccccggcaagccgcaggggccccccccccagggcggguccaagagccgguccgcccgcagcccgcccggcaagccccagggccccccgcagcaggaggggaacaacccccagggcccccccccgcccgcggggggcaacccccagcagccccaggccccgcccgccggccagccccaggggccgccccggcccccccagggcgggcgcccgucccggcccccccaguga

SEQ ID NO: 34999 - RNA, 930 nt, Artificial Sequence
  derived and/or modified sequence opt1 from PRB3__Homo_sapiens__NP_006240
augcugcucauccugcugagcguggcccuccuggcccuguccagcgcgcagucccucaacgaggacgucagccaggaggagucccccagcgugaucuccggcaagccggaggggcgccggccccagggcgggaaccagccccagcgcacccccccgccccccggcaagcccgaggggcggccgccccagggcggcaaccagagccaggggccccccccgcgccccggcaagcccgaggggcccccgccccagggcgggaaccagucccagggcccccccccgcggcccggcaagcccgaggggcagcccccgcagggcgggaaccagagccagggcccccccccccgcccgggcaagcccgaggggcccccgccccagggcgggaaccagucccagggcccccccccgcggcccgggaagcccgagggccccccgccccagggcgggaaccagagccagggcccccccccgcgccccgggaagcccgagggccccccgccccaggggggcaaccagucccagggcccccccccgcaccccgggaagcccgagggccccccgccccaggggggcaaccagagccaggggcccccgccccggcccggcaagcccgagggcccgcccccccaggggggcaaccagucccaggggcccccgccccgccccggcaagcccgagggcccgcccagccaggggggcaacaagccccaggggcccccgccccaccccggcaagccccaggggccgcccccccaggagggcaacaagccccagcggccgcccccccccggccgcccgcaggggccccccccgcccggcgggaacccccagcagccccugccgccccccgccggcaagccccaggggccgcccccccccccgcagggcggccggccccaccgccccccccaggggcagccgccccaguga

SEQ ID NO: 35000 - RNA, 537 nt, Artificial Sequence
  derived and/or modified sequence opt1 from PRB4__Homo_sapiens__NP_001248328
augcugcucauccugcugagcguggcccuccuggcccuguccagcgcggaguccagcuccgaggacgucagccaggaggagucccucuuccugaucagcggcaagcccgaggggcgccggccgcagggcgggaaccagccccagcgcccccccccgccccccggcaagccccaggggccgcccccccagggcggcaaccagucccaggggcccccgcccccccccggcaagccggaggggcggcccccccagggcgggaaccagagccagggccccccgccccaccccggcaagcccgagcgcccgcccccccaggggggcaaccagucccaggggaagccccagggcccgccccagcaggagggcaacaagccccaggggccgcccccccccggcaagccgcaggggcccccccccgccggcgggaacccgcagcagccccaggccccccccgccggcaagccgcagggccccccccccccgccccaggggggccggcccccccgcccggcccaggggcagcagcccccccaguga

SEQ ID NO: 35001 - RNA, 1578 nt, Artificial Sequence
  derived and/or modified sequence opt1 from PRC1__Homo_sapiens__NP_001254509
augcgccggagcgaggugcuggccgaggaguccaucgucugccuccagaaggcccugaaccaccuccgcgagaucugggagcugaucggcauccccgaggaccagcggcugcagcgcaccgagguggugaagaagcacaucaaggaggagggggagaccaccauccugcagcucgagaaggaccugcggacccaggucgagcugaugcgcaagcagaagaaggagcggaagcaggagcucaagcugcugcaggagcaggaccaggagcucugcgagauccugugcaugccgcacuacgacaucgacagcgcguccgugcccagccuggaggagcucaaccaguuccgccagcacgugaccacccugcgggagacgaaggccucccgccgggaggaguucgucagcaucaagcgccagaucauccugugcauggaggagcucgaccacacccccgacaccuccuucgagcgggacguggugugcgaggacgaggacgccuucugccugagccuggagaacaucgccacccuccagaagcugcugcgccagcucgagaugcagaagucccagaacgaggccgucugcgagggccugcggacgcagauccgcgagcugugggaccggcuccagauccccgaggaggagcgcgaggcgguggccaccaucaugagcggguccaaggccaaggugcggaaggcccugcagcuggaggucgaccgccucgaggagcugaagaugcagaacaugaagaaggugaucgaggcgauccggguggagcugguccaguacugggaccagugcuucuacagccaggagcagcgccaggccuucgccccguucugcgccgaggacuacaccgagucccuccugcagcugcacgacgccgagaucgugcgccucaagaacuacuacgaggugcacaaggagcuguucgagggcguccagaagugggaggagaccuggcggcuguuccucgaguucgagcgcaaggcgagcgaccccaaccgguucacgaaccgcgggggcaaccugcugaaggaggagaagcagcgggccaagcuccagaagaugcugcccaagcuggaggaggagcucaaggcccgcaucgagcugugggagcaggagcacuccaaggccuucauggugaacggccagaaguucauggaguacguggccgagcagugggagaugcaccggcuggagaaggagcgcgcgaagcaggagcggcagcucaagaacaagaagcagaccgagaccgagaugcuguacgggagcgcgccccgcaccccguccaagcggcgcggccuggcccccaacacgcccgggaaggcccggaagcugaacaccaccaccaugagcaacgccacggccaacuccagcauccgccccaucuucggcgggaccgucuaccacagcccggugucccggcucccgcccagcggcuccaagcccguggccgccagcacgugcuccggcaagaagacgccccgcaccgggcggcacggcgccaacaaggagaaccuggagcugaacgggagcauccucuccgcccgcaccuucaagggcuuccagaucuga

SEQ ID NO: 35002 - RNA, 1476 nt, Artificial Sequence
  derived and/or modified sequence opt1 from PRCC__Homo_sapiens__NP_005964
augagccugguggccuacgccuccagcgacgaguccgagcccgacgaggcggagccggagcccgaggaggaggaggccgucgcccccaccagcggccccgcccucgggggccuguucgccucccugccggcgcccaaggggcccgcccuccugcccccgccgccccagaugcuggcccccgccuucccgccgccccuccugcugcccccgcccaccggcgacccccgccuccagcccccgccgccccugcccuucgggcugggcggcuucccgcccccgcccggggugagccccgcggaggccgccggcgugggggagggccucgggcugggccugcccagcccccggggccccgggcucaaccugcccccgcccaucggcggggccggcccgccccugggccuccccaagcccaagaagcgcaaggagcccgucaagaucgccgcgcccgagcugcacaagggggacuccgacuccgaggaggacgagcccacgaagaagaagaccauccugcagggcagcuccgaggggaccggccucagcgcccugcugccccagcccaagaaccucaccgugaaggagacgaaccggcugcugcucccccacgccuucucccgcaagcccagcgacgggucccccgacaccaagcccagccggcuggccuccaagaccaagaccagcucccuggcccccguggucggcacgaccaccaccacgcccagccccagcgcgaucaaggccgccgccaaguccgccgcgcuccaggugaccaagcagaucacccaggaggaggacgacagcgacgaggagguggccccggagaacuucuucucccugcccgagaaggccgagccgcccggcgucgagcccuaccccuaccccaucccgaccgugcccgaggagcugccgcccgggacggagcccgagcccgccuuccaggacgacgccgcgaacgcgccccucgaguucaagauggccgccggcagcuccggggcccccuggaugccgaagcccggcgacgacuacagcuacaaccaguucuccaccuacggggacgccaacgccgccggcgccuacuaccaggacuacuacagcggcggguacuaccccgcgcaggaccccgcccuggugccgccccaggagaucgcccccgacgccuccuucaucgacgacgaggccuucaagcgccugcagggcaagcggaaccgcgggcgggaggagaucaacuucgucgagaucaagggcgacgaccagcucagcggggcgcagcaguggaugaccaagucccugaccgaggagaagacgaugaaguccuucagcaagaagaagggcgagcagcccaccggccagcagcgccggaagcaccagaucaccuaccugauccaccaggccaaggagcgcgagcucgagcugaagaacaccuggagcgagaacaagcugucccggcgccagacgcaggccaaguacggguucuga

SEQ ID NO: 35003 - RNA, 165 nt, Artificial Sequence
  derived and/or modified sequence opt1 from PRCD__Homo_sapiens__NP_001071088
augugcaccacccuguuccuccugagcacgcuggccaugcucuggcgccggcgcuucgccaaccgggugcagcccgagccguccgacgucgacggcgcggcccgcgggagcucccuggacgccgacccccagagcuccggccgggagaaggagccccugaaguga

SEQ ID NO: 35004 - RNA, 1491 nt, Artificial Sequence
  derived and/or modified sequence opt1 from PRCP__Homo_sapiens__NP_005031
augggccgccgggcccugcuccugcugcuccugagcuuccuggcccccugggcgaccaucgcccuccgcccggcccugcgggcccuggggucccuccaccuccccaccaaccccacgagccugcccgccguggcgaagaacuacuccguccuguacuuccagcagaagguggaccacuucggcuucaacaccgugaagaccuucaaccagcgcuaccuggucgccgacaaguacuggaagaagaacgggggcagcauccuguucuacaccgggaacgagggcgacaucaucugguucugcaacaacacgggcuucaugugggacguggccgaggagcucaaggccaugcugguguucgcggagcaccgguacuacggggagucccugccguucggcgacaacagcuucaaggacucccgccaccucaacuuccugaccagcgagcaggcccuggccgacuucgccgagcucaucaagcaccugaagcggaccauccccggggccgagaaccagcccgucaucgcgaucggcggguccuacggcggcaugcuggccgccugguuccgcaugaaguacccccacaugguggugggggcccucgccgcgagcgccccgaucuggcaguucgaggaccugguccccugcggcguguucaugaagaucgugaccacggacuuccggaaguccgggccccacugcagcgaguccauccaccgcagcugggacgccaucaaccggcuguccaacaccggcagcggccuccaguggcugaccggggcccugcaccucugcagcccccugaccucccaggacauccagcaccugaaggacuggaucuccgagacgugggucaaccucgccaugguggacuacccguacgcgagcaacuuccugcagccccugcccgccuggcccaucaagguggucugccaguaccucaagaacccgaacgugagcgacucccugcugcuccagaacaucuuccaggcccugaacguguacuacaacuacagcggccaggucaagugccugaacaucuccgagaccgccaccagcucccucgggacccugggcuggagcuaccaggccugcacggagguggugaugcccuucugcaccaacggggucgacgacauguucgagccccacuccuggaaccugaaggagcucagcgacgacugcuuccagcaguggggcgugcgcccccggccguccuggaucaccaccauguacggcgggaagaacaucagcucccacacgaacaucguguucagcaacggcgagcuggaccccugguccgggggcggggucaccaaggacaucaccgacacccugguggcggucacgaucagcgagggcgcccaccaccucgaccugcgcaccaagaacgcccuggaccccauguccgugcugcucgcccggagccuggaggugcgccacaugaagaacuggauccgggacuucuacgacuccgcgggcaagcagcacuga

SEQ ID NO: 35005 - RNA, 3483 nt, Artificial Sequence
  derived and/or modified sequence opt1 from PRDM10__Homo_sapiens__NP_064613
auggacagcaaggacgaguccagccacguguggcccaccuccgccgagcacgagcagaacgccgcgcagguccacuucgugccggacaccggcacgguggcccagaucgucuacaccgacgaccaggugcgcccgccccagcaggucgucuacaccgccgacggggccagcuacaccuccguggacggccccgagcacacgcugguguacauccaccccgucgaggccgcgcagacccucuucaccgaccccggccagguggccuacgugcagcaggacgccaccgcccagcaggcgagccugcccguccacaaccaggugcugcccuccaucgagagcguggacggcuccgacccgcucgccacgcugcagacgccccuggggcggcucgaggccaaggaggaggaggacgaggacgaggacgaggacaccgaggaggacgaggaggaggacggcgaggacaccgaccuggacgacugggagcccgacccgccccgccccuucgacccccacgaccuguggugcgaggagugcaacaacgcccacgccagcgucugccccaagcacggcccgcuccaccccauccccaaccggcccgugcugacccgcgcgcgggccucccugccgcucgugcuguacaucgaccgcuuccucgggggcgucuucagcaagcggcgcauccccaagcggacccaguucgggcccguggagggcccccuggugcgcggguccgagcugaaggacugcuacauccaccugaaggucagccucgacaagggcgaccggaaggagcgcgaccugcacgaggaccugugguucgagcucuccgacgagacccugugcaacuggaugauguucgugcggccggcccagaaccaccuggagcagaaccucguggccuaccaguacggccaccacgucuacuacaccacgaucaagaacguggagcccaagcaggagcugaaggucugguacgccgcgagcuacgccgaguucgugaaccagaagauccacgacaucuccgaggaggagcgcaaggugcugcgggagcaggagaagaacuggcccugcuacgagugcaaccgccgguucaucagcuccgagcagcuccagcagcaccugaacagccacgacgagaagcuggacgucuucagccgcacccgggggcgcgggcgggggcgcggcaagcgccgguucggccccgggcgccggccgggccgcccgcccaaguucauccggcucgagaucaccuccgagaacggggagaaguccgacgacggcacccaggaccugcugcacuuccccacgaaggagcaguucgacgaggccgagcccgccacccucaacgggcuggaccagcccgagcagaccaccauccccaucccgcagcugccccaggagacgcagagcagccucgagcacgagcccgagacccacacccugcaccuccagccccagcacgaggaguccguggugccgacccagagcacgcugaccgccgacgacaugcgccgggcgaagcgcauccggcuggagcugcagaacgccgcccuccagcaccuguucauccgcaaguccuuccggcccuucaagugccugcagugcggcaaggccuuccgcgagaaggacaagcucgaccagcaccuccgguuccacggccgcgaggggaacugcccccugaccugcgaccugugcaacaagggcuucaucagcuccaccagccuggagucccacaugaagcugcacagcgaccagaagacguacuccugcaucuucugccccgagagcuucgaccggcuggaccuccugaaggaccacguggccauccacaucaacgacggguacuucacgugcccgaccugcaagaagcgcuuccccgacuucauccaggugaagaagcacgugcgguccuuccacagcgagaagaucuaccagugcaccgagugcgacaaggcguucugccgccccgacaagcugcggcuccacaugcugcgccacuccgaccgcaaggacuuccugugcagcacgugcggcaagcaguucaagcggaaggacaagcuccgcgagcacaugcagcggaugcacaaccccgagcgcgaggccaagaaggccgaccggaucucccgcagcaagaccuucaagccgcggaucaccagcaccgacuacgacuccuucaccuucaagugccgccugugcaugaugggguuccggcgccggggcaugcuggucaaccaccucagcaagcgccaccccgacaugaagaucgaggaggugcccgagcugacccugcccaucaucaagccgaaccgggacuacuucugccaguacugcgacaagguguacaaguccgccagcaagcgcaaggcgcacauccucaagaaccaccccggcgccgagcugccgcccuccauccggaagcugcgccccgccgggcccggcgagcccgacccgaugcucagcacccacacccagcugaccgggacgaucgccaccccgcccgucugcugcccccacugcuccaagcaguacagcuccaagaccaagauggugcagcacauccggaagaagcaccccgaguucgcccagcugagcaacaccauccacacgccccucaccaccgcggugaucuccgccacccccgccguccugacgaccgacagcgccaccggcgagaccguggugacgaccgaccugcucacccaggccaugaccgagcugucccagacgcugaccaccgacuaccgcacgccccagggggacuaccagcggauccaguacaucccggucagccaguccgcgagcggccuccagcagccccagcacauccagcuccagguggugcaggucgccuccgccaccagcccccaccagagccagcaguccaccguggacgugggccagcugcacgacccccagccguacccccagcacgccauccagguccagcacauccaggugagcgagcccaccgccuccgcgcccagcuccgcccaggugagcgggcagccgcugucccccagcgcccagcaggcccagcagggccugucccccagccacauccagggguccagcuccacccagggccaggcgcugcagcagcagcagcagcagcagcagaacagcuccguccagcacacguaccuccccagcgccuggaacuccuuccgcggcuacagcuccgagauccagaugaugacccugccgcccgggcaguucgugaucaccgacagcggcguggccacccccgucacgaccggccaggugaaggccgugaccagcgggcacuacguccuguccgagagccaguccgagcucgaggagaagcagaccagcgcccuguccgggggcguccagguggagcccccggcgcacagcgacucccuggacccccagacgaacagccagcagcagaccacccaguacaucaucaccaccacgaccaacggcaacggguccagcgaggugcacaucaccaagcccuga

SEQ ID NO: 35006 - RNA, 1434 nt, Artificial Sequence
  derived and/or modified sequence opt1 from PRDM11__Homo_sapiens__NP_001243625
augaccgagaacaugaaggagugccuggcccagaccaacgccgcggugggcgacauggucacgguggugaagaccgaggucugcagcccccuccgcgaccaggaguacgggcagccgugcucccggcgccccgacagcuccgccauggagguggagcccaagaagcugaagggcaagcgggaccugaucgugcccaagagcuuccagcaggucgacuucugguucugcgaguccugccaggaguacuucguggacgagugcccgaaccacgggccgcccguguucgucagcgacacccccgugcccgugggcauccccgaccgcgccgcccucaccaucccccaggggauggaggucgugaaggacacguccggcgagagcgacgugcggugcgucaacgaggugauccccaagggccacaucuucgggccguacgagggccagaucuccacccaggacaagagcgccggguucuucuccuggcugaucguggacaagaacaaccgcuacaagagcaucgacggcuccgacgagaccaaggcgaacuggaugcgguacgucgugaucagccgcgaggagcgggagcagaaccugcucgccuuccagcacuccgagcgcaucuacuuccgggccugccgcgacauccggcccggggaguggcugcgcgugugguacagcgaggacuacaugaagcggcugcacuccaugagccaggagaccauccaccgcaaccucgcccggggcgagaagcgccugcagcgggagaaguccgagcagguccuggacaaccccgaggaccuccgcggccccauccaccugagcgugcugcggcagggcaagagcccguacaagcgcggguucgacgagggggacgugcacccccaggcgaagaagaagaagaucgaccucaucuucaaggacguccuggaggccucccuggagagcgccaagguggaggcccaccagcucgcccuguccacgagccuggucauccgcaaggugcccaaguaccaggacgacgcguacucccagugcgccaccaccaugacccacggcgugcagaacaucggccagacgcagggggagggcgacuggaaggucccccagggggugagcaaggagccgggccagcucgaggacgaggaggaggagcccuccagcuucaaggccgacucccccgccgaggccagccuggcguccgacccccacgagcugccgaccaccagcuucugccccaacugcauccggcucaagaagaaggugcgcgagcugcaggccgagcuggacaugcucaaguccgggaagcugcccgagcccccgguccugccgccccaggugcucgagcugcccgaguucagcgaccccgccggcaagcugguguggaugcggcuccuguccgagggccgcguccggagcgggcugugcggcggguga

SEQ ID NO: 35007 - RNA, 2124 nt, Artificial Sequence
  derived and/or modified sequence opt1 from PRDM13__Homo_sapiens__NP_067633
augcacggcgccgcccgcgcgcccgccaccagcguguccgccgacugcugcaucccggccgggcugcggcucggccccgugcccgggaccuucaagcugggcaaguaccugagcgaccgccgggagcccgggccgaagaagaaggugcgcauggugcggggcgagcucgucgacgaguccggcgggagcccccuggaguggaucggccugauccgcgccgcgcggaacucccaggagcagacgcucgaggccaucgccgaccugcccgggggccagaucuucuaccgcgcccugcgggacgugcagcccggggaggagcucaccgugugguacagcaacucccuggcgcagugguucgacaucccgaccaccgccacgcccacccacgacgagaagggcgaggagcgcuacaucugcugguacugcuggcggaccuuccgcuaccccaacagccugaaggcccaccuccgguuccacugcgucuucuccggcgggggcgggggcgccuuccugcaccacgagcacgccgcgcgccagggcgccgugcccgccgccgacgggcugggccucagcccgaagccgcccgcccccgacuucgcggcccccucccaggccgggacccugcggccccacccccuggggcccccgcccgugcaggccugcggcgcccgcgagggcaucaagcgggaggcgagcuccgcccccagcgccacgucccccaccccgggcaagugggggcagcccaagaagggcaaggagcagcucgaccgcgcccuggacaugagcggggccgcgcggggccaggggcacuuccugggcaucgucggcggguccagcgccggcguggggucccucgccuucuaccccggcgugcgcagcgccuucaagcccgcggggcuggcccgggccgccgccgcggcccacggcgacccguaccgcgaggagagcuccagcaagcagggcgccgggcuggcccucggccgccugcucgggggcggccgggccugcgggcgccccggcuccggggagaacagcgcggccggcggggccggccaccaccaccaccaccacgcccaccaccaccaccaccccaagugccugcuggccggcgacccgcccccgccgcccccgcccgggcugcccugcuccggcgcgcuccggggguucccccugcugagcgucccgcccgaggaggccuccgccuucaagcacguggagcgcgccccgcccgcggccgccgcccuccccggcgcccgguacgcgcagcugccgcccgcccccgggcugccccucgagcgcugcgcccugccgccccuggaccccggcggccucaaggccuaccccgggggcgagugcagccaccuccccgccgugaugcccgcguucaccgucuacaacggggagcugcuguacggcucccccgccaccacggccuacuacccccugaagcugcacuucgggggccuccugaaguaccccgagagcaucuccuacuucagcggccccgccgccgcggcccugucccccgccgagcucgggagccuggccuccaucgaccgggagaucgcgaugcacaaccagcagcugagcgagauggccgccggcaaggggcgcggccggcuggacuccgggacccucccgcccgccguggccgcggccggcggcaccgggggcgggggcagcggcggguccggcgccgggaagcccaagaccggccaccugugccuguacugcgggaagcucuacagccgcaaguacggccugaagauccacaugcggacgcacaccggcuacaagccccugaagugcaaggugugccuccgccccuucggggaccccagcaaccugaacaagcacauccggcugcacgccgagggcaacaccccguaccgcugcgaguucugcgggaagguccucgugcggcgccgggaccuggagcgccacgugaagucccggcaccccggccagagccugcucgccaaggcgggggacggccccggcgccgagcccggguacccgcccgagcccggcgaccccaaguccgacgacagcgacgucgacgugugcuucaccgacgaccaguccgacccggaggucgggggcgggggcgagcgcgaccuguga

SEQ ID NO: 35008 - RNA, 1716 nt, Artificial Sequence
  derived and/or modified sequence opt1 from PRDM14__Homo_sapiens__NP_078780
auggcccugccccgcccgagcgaggccgugccccaggacaaggucugcuacccgcccgaguccagcccccagaaccucgcggccuacuacacccccuuccccuccuacggccacuaccggaacagccuggccaccguggaggaggacuuccagcccuuccgccagcuggaggccgccgcguccgccgccccggccaugccgcccuuccccuuccggauggcgccgccccuccugagccccgggcugggccuccagcgcgagccccuguacgaccugcccugguacuccaagcucccgcccugguaccccaucccccacgugccccgggaggucccgcccuuccugagcuccagccacgaguacgccggggccuccagcgaggaccugggccaccagaucaucgggggcgacaacgaguccggccccugcugcgggcccgacacgcucaucccgccgccgcccgccgacgccagccugcugcccgagggccuccgcaccucccagcugcugcccugcagccccuccaagcagagcgaggacgggcccaagcccuccaaccaggagggcaagagccccgcgcgguuccaguucaccgaggaggaccuccacuucgugcuguacggggugacccccagccuggagcaccccgccucccuccaccacgccaucagcggccugcuggugcccccggacuccagcggcuccgacagccucccccagacgcuggacaaggacucccugcagcuccccgaggggcugugccugaugcagaccgucuucggcgaggugccccacuucggggucuucugcagcuccuucaucgccaagggcgugcgcuucggcccguuccaggggaagguggucaacgccagcgaggugaagaccuacggcgacaacuccgugaugugggagaucuucgaggacgggcaccucagccacuucaucgacggcaagggcgggaccggcaacuggauguccuacgucaacugcgcgcgguuccccaaggagcagaaccugguggccgugcagugccaggggcacaucuucuacgagagcugcaaggagauccaccagaaccaggagcugcucgucugguacggcgacugcuacgagaaguuccuggacauccccgugucccuccaggugacggagcccgggaagcagccgagcggccccuccgaggagagcgccgagggguaccgcugcgagcggugcggcaaggucuucaccuacaaguacuaccgcgacaagcaccugaaguacacccccugcguggacaagggcgaccggaaguuccccugcucccugugcaagcgcagcuucgagaagcgggaccgccugcggauccacauccuccacgugcacgagaagcaccgcccgcacaagugcagcacgugcgggaagugcuucucccagagcuccagccugaacaagcacaugcggguccacuccggcgaccgccccuaccagugcguguacugcaccaagcgguucaccgccagcuccauccugcgcacccacauccgccagcacagcggggagaagcccuucaagugcaaguacugcggcaaguccuucgccagccacgcggcccacgacucccacguccggcgcagccacaaggaggacgacgggugcuccugcagcaucugcggcaagaucuucuccgaccaggagaccuucuacagccacaugaaguuccacgaggacuacuga

SEQ ID NO: 35009 - RNA, 2478 nt, Artificial Sequence
  derived and/or modified sequence opt1 from PRDM1__Homo_sapiens__NP_001189
augcuggacaucugccucgagaagcgcgugggcaccacccuggccgcccccaagugcaacagcuccacgguccgguuccaggggcuggcggagggcaccaaggggaccaugaagauggacauggaggacgccgacaugacccucuggacggaggccgaguucgaggagaagugcaccuacaucgugaacgaccacccgugggacagcggcgccgacgggggcaccuccgugcaggccgaggcgagccugccccgcaaccugcuguucaaguacgccaccaacuccgaggaggucaucggcgugaugagcaaggaguacauccccaaggggacgcgguucggcccccugaucggggagaucuacaccaacgacaccgugccgaagaacgccaaccgcaaguacuucuggcggaucuacucccgcggcgagcugcaccacuucaucgacggguucaacgaggagaaguccaacuggaugcgguacgucaaccccgcccacagcccccgcgagcagaaccucgcggccugccagaacggcaugaacaucuacuucuacaccaucaagcccaucccggccaaccaggagcugcuggugugguacugccgggacuucgccgagcgccuccacuaccccuaccccggcgagcugacgaugaugaaccugacccagacccagagcucccucaagcagcccagcaccgagaagaacgagcugugcccgaagaacgugcccaagcgggaguacuccgucaaggagauccugaagcucgacagcaaccccuccaaggggaaggaccuguaccgcagcaacaucagcccccugacgagcgagaaggaccucgacgacuuccggcgccggggcuccccggagaugcccuucuacccccgcgugguguaccccauccgggccccgcugcccgaggacuuccugaaggcgagccucgccuacgggaucgagcgccccaccuacaucacccggagccccaucccguccagcaccacgcccucccccagcgcccgcuccagccccgaccagucccugaaguccuccagcccgcacuccagccccggcaacaccgucucccccgugggcccggggagccaggagcaccgggacuccuacgccuaccugaacgccagcuacggcaccgaggggcucggcuccuaccccggguacgcgccccugccccaccucccgcccgccuucauccccagcuacaacgcccacuaccccaaguuccuccugccgcccuacggcaugaacugcaacggccuguccgccgugagcagcaugaacgggaucaacaacuucggccucuucccccgccugugccccgucuacuccaaccugcucgggggcgggagccugccgcaccccaugcugaaccccaccucccuccccagcucccugccgagcgacggcgcccgccggcugcuccagcccgagcacccccgcgaggugcuggugcccgcgccgcacuccgccuucagcuucacgggcgccgccgccuccaugaaggacaaggcgugcagccccaccuccgggagccccaccgccggcaccgccgccacggcggagcacgucgugcagcccaaggccaccuccgccgccauggccgcgccgagcuccgacgaggccaugaaccugaucaagaacaagcggaacaugaccggguacaagacccuccccuacccccugaagaagcagaacggcaagaucaaguacgagugcaacgugugcgccaagacguucgggcagcugagcaaccucaagguccaccuccgcgugcacuccggcgagcggccguucaagugccagaccugcaacaagggcuucacccagcuggcccaccuccagaagcacuaccuggugcacaccggggagaagccccacgagugccaggucugccacaagcgcuucagcagcacguccaaccugaagacccaccuccggcugcacagcggcgagaagcccuaccagugcaaggugugccccgccaaguucacccaguucguccaccugaagcugcacaagcgccugcacacccgggagcgcccgcacaagugcucccagugccacaagaacuacauccaccugugcagccugaaggugcaccucaaggggaacugcgcggccgcccccgcccccggccugccccuggaggaccucacccggaucaacgaggagaucgagaaguucgacaucuccgacaacgccgaccgccuggaggacguggaggacgacaucagcgucaucuccgugguggagaaggagauccuggcggucgugcggaaggagaaggaggagacgggccucaaggugagccugcagcgcaacauggggaacggccugcucuccagcgggugcucccuguacgagagcuccgaccugccgcucaugaagcugccgcccagcaacccccugccccucguccccgugaaggugaagcaggagaccgucgagcccauggaccccuga

SEQ ID NO: 35010 - RNA, 2406 nt, Artificial Sequence
  derived and/or modified sequence opt1 from PRDM4__Homo_sapiens__NP_036538
augcaccaccgcaugaacgagaugaaccugagccccgugggcauggagcagcucaccuccagcuccgucagcaacgcccugccgguguccgggagccaccugggccucgccgcgucccccacccacagcgccauccccgcccccgggcugccgguggccauccccaaccugggccccucccucagcucccugcccagcgcccugucccucaugcugccgauggggaucggcgaccggggcgucaugugcgggcugcccgagcgcaacuacacgcugcccccgccgcccuacccccaccuggagagcuccuacuuccggaccauccugcccggcauccucagcuaccuggcggaccgcccgccgccccaguacauccaccccaacuccaucaacguggacgggaacaccgcccugagcaucaccaacaaccccuccgcccucgaccccuaccagagcaacggcaacguggggcuggagcccggcaucgucagcaucgacucccggagcgugaacacgcacggcgcccagucccugcaccccagcgacgggcacgagguggcgcucgacaccgccaucaccauggagaacgucucccgcgugaccagcccgaucuccacggacggcauggccgaggagcugaccauggacgggguggccggcgagcacagccagauccccaacggcucccggagccacgagccccuguccgucgacagcguguccaacaaccucgccgcggacgccguggggcacggcggggucauccccaugcacggcaacgggcuggagcugccgguggugauggagaccgaccacaucgccagccgcgucaacggcauguccgacagcgcccucuccgacagcauccacaccguggccauguccacgaacagcgugagcgucgcgcuguccaccagccacaaccuggccucccucgagagcgugucccugcacgaggugggccugagccucgagcccgucgccguguccagcaucacccaggaggucgccauggggaccggccacguggacguguccagcgacucccugagcuucgucucccccagccugcagauggaggacuccaacagcaacaaggagaacauggccacccucuucacgaucuggugcacccugugcgaccgggcguaccccuccgacugccccgagcacgggcccgugaccuucgugcccgacacgccgaucgagagccgcgcccggcugagccuccccaagcagcugguccugcgccaguccaucgugggcgccgaggugggggucuggaccggcgagaccauccccgugcggaccugcuucggcccccucaucgggcagcagagccacuccauggagguggccgaguggacggacaaggccgucaaccacaucuggaagaucuaccacaacggcgugcuggaguucugcaucaucaccaccgacgagaacgagugcaacuggaugauguucgugcgcaaggcgcggaaccgcgaggagcagaaccuggucgccuacccgcacgacgggaagaucuucuucugcaccagccaggacaucccgcccgagaacgagcuccuguucuacuacucccgggacuacgcccagcagaucggcgugcccgagcaccccgacgugcaccugugcaacugcgggaaggagugcaacagcuacacggaguucaaggcccaccucaccucccacauccacaaccaccuccccacccagggccacagcggcucccacgggcccagccacuccaaggagcgcaaguggaagugcagcaugugcccccaggcguucaucuccccgagcaagcugcacguccacuucaugggccacauggggaugaagccccacaagugcgacuucugcuccaaggccuucagcgaccccuccaaccugcggacccaccucaagauccacacgggccagaagaacuaccgcugcacccugugcgacaagagcuucacccagaaggcccaccuggagucccacauggugauccacaccggcgagaagaaccucaagugcgacuacugcgacaagcuguucaugcggcgccaggaccugaagcagcacgugcucauccacacgcaggagcgccagaucaagugccccaagugcgacaagcuguuccugcggaccaaccaccucaagaagcaccugaacagccacgaggggaagcgcgacuacgucugcgagaagugcaccaaggccuaccugaccaaguaccaccucacccggcaccugaagacgugcaagggcccgaccagcuccagcuccgcccccgaggaggaggaggaggacgacagcgaggaggaggaccuggcggacuccguggggaccgaggacugccgcaucaacagcgccguguacuccgccgacgagagccucuccgcccacaaguga

SEQ ID NO: 35011 - RNA, 1800 nt, Artificial Sequence
  derived and/or modified sequence opt1 from PRDM5__Homo_sapiens__NP_001287752
augcugggcauguacgugcccgaccgcuucagccucaaguccagccggguccaggacgggaugggccuguacaccgcccgccgggugcgcaagggggagaaguucggcccguucgccggggagaagcggaugcccgaggaccuggacgagaacauggacuaccgccucaugugggaggugcggggcuccaagggcgagguccuguacauccuggacgcgaccaacccccgccacagcaacuggcuccgguucgugcacgaggcccccucccaggagcagaagaaccuggccgccauccaggagggggagaacaucuucuaccuggccguggaggacaucgagacggacaccgagcuccugaucggcuaccuggacagcgacauggaggcggaggaggaggagcagcagaucaugaccgucaucaaggagggggagguggagaacucccgccggcagagcaccgccggccgcaaggaccggcucgggugcaaggaggacuacgccugcccgcagugcgaguccagcuucacguccgaggacauccuggccgagcaccuccagacccugcaccagaagcccaccgaggagaaggaguucaagugcaagaacugcggcaagaaguuccccgugaagcaggcgcugcagcgccacuucgagcagcaccaggagaccugccggggcgacgcccgcuucgucugcaaggccgacagcugcgggaagcggcugaaguccaaggacgcccucaagcgccaccaggagaacgugcacacgggcgaccccaagaagaagcugaucugcagcgugugcaacaagaagugcuccagcgccuccagccugcaggagcaccggaagauccacgagaucuucgacugccaggagugcaugaagaaguucaucuccgcgaaccagcucaagcgccacaugaucacccacagcgagaagcggccguacaacugcgagaucugcaacaagagcuucaagcgccuggaccaggucggggcccacaaggugauccacuccgaggacaagcccuacaagugcaagcugugcggcaagggcuucgcccaccgcaacguguacaagaaccacaagaagacccacagcgaggagcggcccuuccagugcgaggagugcaaggcccucuuccgcacccccuucucccugcagcggcaccuccugauccacaacagcgagcgcacguucaagugccaccacugcgacgccaccuucaagcggaaggacacccugaacguccacguccagguggugcacgagcgccacaagaaguaccggugcgagcugugcaacaaggcguucgugaccccguccgugcuccgcagccacaagaagacgcacaccggggagaaggagaagaucugccccuacugcggccagaaguucgccuccagcgggacccugcggguccacauccgcucccacaccggcgagcggcccuaccagugccccuacugcgagaagggguucagcaagaacgacggccugaagaugcacauccgcacgcacacccgggagaagccguacaagugcuccgagugcagcaaggccuucucccagaagcgcggccucgacgagcacaagcggacccacaccggggagaagcccuuccagugcgacgugugcgaccuggccuucagccugaagaagaugcucauccgccacaagaugacgcacaaccccaaccggccccuggccgagugccaguucugccacaagaaguucacccgcaacgacuaccugaaggugcacauggacaacauccacggcgucgcggacuccuga

SEQ ID NO: 35012 - RNA, 1788 nt, Artificial Sequence
  derived and/or modified sequence opt1 from PRDM6__Homo_sapiens__NP_001129711
augcugaagcccggcgaccccgggggcagcgccuuccucaagguggaccccgccuaccugcagcacuggcagcagcuguucccccacgggggcgcggggccccucaagggcuccggcgccgccgggcugcugagcgccccgcagccccuccagccgcccccgcccccgcccccgcccgagcgcgccgagcccccgcccgacucccugcggccccgccccgcgagccuguccagcgccuccagcacccccgccuccagcuccaccagcgccuccagcgcguccagcugcgccgccgccgccgcggccgccgcccucgccggccuguccgcgcugcccgucagccagcuccccguguucgcgccccuggccgccgccgccguggccgccgagccccugccgcccaaggagcucugccugggggccacguccggccccgggcccgucaagugcggcggcgggggcgggggcggcggggagggccgcggggccccgcgguuccggugcagcgcggaggagcuggacuacuaccucuacggccagcagcgcauggagaucaucccccugaaccagcacaccagcgaccccaacaaccggugcgacaugugcgccgacaaccgcaacggggagugcccgaugcacggcccccugcacucccuccggcgccuggugggcaccagcuccgccgccgcggccgccccgccgcccgagcugcccgaguggcuccgggaccugccccgcgaggugugccugugcaccagcacgguccccgggcucgccuacggcaucugcgccgcgcagcggauccagcaggggaccuggaucggccccuuccagggggugcugcugccgcccgagaaggugcaggccggcgccguccgcaacacccagcaccucugggagaucuacgaccaggacggcacccugcagcacuucaucgacgggggcgagcccuccaagagcuccuggaugcgguacauccgcugcgcccggcacugcggggagcagaaccugacgguggugcaguaccgcagcaacaucuucuaccgggccugcaucgacaucccccgcggcaccgagcuccuggucugguacaacgacuccuacaccagcuucuucgggaucccccugcagugcaucgcgcaggacgagaaccucaacgugcccuccaccgugauggaggccaugugccggcaggacgcccugcagcccuucaacaagagcuccaagcuggccccgacgacccagcagcgcagcgucguguucccccagacccccugcucccgcaacuucagccuccuggacaaguccggccccaucgagagcggcuucaaccagaucaacgugaagaaccagcggguccuggccuccccgaccagcacgagccagcuccacuccgaguucagcgacuggcaccuguggaagugcgggcagugcuucaagaccuucacccagcgcauccugcuccagaugcacgugugcacccagaaccccgaccggcccuaccagugcggccacugcucccagagcuucucccagcccagcgagcugcgcaaccacguggucacgcacuccagcgaccggccguucaagugcggguacugcggccgcgcguucgccggcgccaccacccugaacaaccacauccggacccacacgggggagaagcccuucaagugcgagcgcugcgagcgguccuucacccaggccacccagcucagccgccaccagcggaugcccaacgagugcaagccgaucaccgagucccccgagagcaucgagguggacuga

SEQ ID NO: 35013 - RNA, 1479 nt, Artificial Sequence
  derived and/or modified sequence opt1 from PRDM7__Homo_sapiens__NP_001091643
augagccccgagcgcucccaggaggagagcccggagggcgacaccgagcggaccgagcgcaagcccauggugaaggacgccuucaaggacaucuccaucuacuucacgaaggaggagugggccgagaugggggacugggagaagacccgguaccgcaacgucaagaugaacuacaacgcgcugaucaccgugggccugcgggccacccgccccgccuucaugugccaccggcgccaggccaucaagcuccagguggacgacacggaggacagcgacgaggaguggacgccccggcagcaggucaagccgcccuggauggccuuccgcggggagcaguccaagcaccagaagggcaugcccaaggcgagcuucaacaacgaguccagccugcgggagcucuccgggacccccaaccugcugaacaccagcgacuccgagcaggcccagaagccggugagcccgcccggcgaggccuccaccagcggccagcacucccgccucaagcuggagcugcggcgcaaggagaccgaggggaagauguacagccuccgggagcgcaagggccacgccuacaaggagaucuccgagccccaggacgacgacuaccuguacugcgagaugugccagaacuucuucaucgacagcugcgcggcccacgggccgcccaccuucgugaaggacuccgccgucgacaagggccaccccaaccggagcgcccugagccugccgcccgggcugcgcaucggccccuccggcaucccccaggccgggcugggcguguggaacgaggcgagcgaccucccccuggggcugcacuucggccccuacgagggccggaucaccgaggacgaggaggccgccaacuccggguacagcuggcucaucacgaagggccgcaacugcuacgaguacguggacgggaaggacaaguccagcgccaacuggaugcgguacgucaacugcgcccgcgacgacgaggagcagaaccugguggcguuccaguaccaccgccagaucuucuaccggaccugccgcgugauccggcccggcugcgagcugcucgucugguccggggacgaguacggccaggagcugggcauccgcagcuccaucgagcccgccgagagccuggggcaggccgugaacugcugguccggcauggggaugagcauggcccggaacugggccuccagcggcgcggccuccgggcgcaagagcuccuggcagggcgagaaccagagccagcgguccauccacgugccccacgccgucuggccguuccaggugaagaacuucagcgugaacauguggaacgccaucacgccccuccgcaccagccaggaccaccuccaggagaacuucuccaaccagcggauccccgcccagggcauccgcauccggagcgggaacauccugauccacgcggccgucaugaccaagcccaaggugaagcgcuccaagaagggcccgaacagcuga

SEQ ID NO: 35014 - RNA, 2070 nt, Artificial Sequence
  derived and/or modified sequence opt1 from PRDM8__Homo_sapiens__NP_064611
auggaggacaccggcauccagcgcgggaucugggacggcgacgccaaggccgugcagcagugccugaccgacaucuucacgagcgucuacacgaccugcgacauccccgagaacgcgaucuucgggccgugcgugcucucccacaccagccuguacgacuccaucgccuucaucgcccugaaguccaccgacaagcggaccgugcccuacaucuuccgcgucgacaccuccgccgccaacggcagcuccgaggggcucauguggcugcggcuggugcagagcgcgcgcgacaaggaggagcagaaccucgaggccuacaucaagaacggccagcuguucuaccggucccugcgccggaucgccaaggacgaggagcuccuggugugguacggcaaggagcugaccgagcuccugcugcucugccccagccgcucccacaacaagaugaacgggagcucccccuacacgugccuggagugcagccagcgguuccaguucgaguucccguacgucgcccaccuccgcuuccggugccccaagcgccugcacuccgcggacaucagcccccaggacgagcagggcgggggcguggggaccaaggaccacggcggcgggggcgggggcggcaaggaccagcagcagcagcagcaggaggccccgcuggggccgggccccaaguucugcaaggccgggccccugcaccacuaccccuccccgagccccgaguccagcaaccccagcgccgccgcgggcggguccagcgccaagcccuccaccgacuuccacaaccucgcccgggagcuggagaacagccgcggcggcuccagcugcuccccggcccagagccuguccagcggguccggcagcgggggcgggggcggccaccaggaggccgagcucucccccgacgggaucgcgaccggcgggggcaaggggaagcggaaguuccccgaggaggccgccgagggcggcgggggcgccgggcuggugggcggccgcgggcgguucgucgagcgcccccugccggccagcaaggaggaccucgugugcacgccccagcaguaccgggcguccggcagcuacuucgggcuggaggagaacggccgccuguucgccccgcccuccccggagaccggggaggccaagcggagcgccuucguggaggucaagaaggccgcgcgcgccgccucccuccaggaggagggcaccgccgacggcgcggggguggccagcgaggaccaggacgccggcgggggcgggggcagcuccacccccgccgccgcgagccccgugggcgccgagaagcugcuggcgccccgccccgggggcccccuccccucccggcuggagggcgggagcccggcccgcggguccgccuucacgagcgucccccagcugggcuccgccggcagcaccuccgggggcgggggcaccggggccggcgccgccggcggggccggcgggggccagggcgcggccagcgacgagcggaaguccgccuucagccagcccgcccgcuccuucagccagcucagcccccuggugcuggggcagaagcucggcgcgcuggagccgugccaccccgccgacggggugggccccacccggcuguaccccgccgccgccgacccgcucgcggucaagcugcagggggccgccgaccugaacggcggcugcgggagccuccccuccggcgggggcgggcugcccaagcagagccccuuccuguacgccacggccuucuggcccaagagcuccgcggccgccgccgccgcggccgccgccgcggccgccggcccccuccagcugcagcugcccagcgcccugacccuccugcccccguccuucaccagccugugccuccccgcccagaacuggugcgcgaagugcaacgccuccuuccgcaugaccagcgaccugguguaccacaugcggucccaccacaagaaggaguacgccauggagccccuggugaagcgccggcgcgaggagaagcucaagugccccaucugcaacgagagcuuccgggagcgccaccaccugucccggcacaugacgagccacaacuga

SEQ ID NO: 35015 - RNA, 2685 nt, Artificial Sequence
  derived and/or modified sequence opt1 from PRDM9__Homo_sapiens__NP_064612
augagccccgagaagucccaggaggagagcccggaggaggacaccgagcgcaccgagcggaagcccauggugaaggacgccuucaaggacaucuccaucuacuucacgaaggaggagugggccgagaugggcgacugggagaagacccgcuaccggaacgucaagcgcaacuacaacgcgcugaucaccaucgggcuccgggccacccgccccgccuucaugugccaccggcgccaggccaucaagcuccagguggacgacacggaggacagcgacgaggaguggacgccccggcagcaggucaagccgcccuggauggcccugcgcguggagcagcggaagcaccagaagggcaugcccaaggcguccuucagcaacgaguccagccugaaggagcugucccgcaccgccaaccugcucaacgccagcggguccgagcaggcccagaagcccgugagcccguccggcgaggcgagcaccuccgggcagcacagccggcugaagcuggagcuccgcaagaaggagaccgagcggaagauguacucccugcgcgagcggaagggccacgccuacaaggaggugagcgagccccaggacgacgacuaccuguacugcgagaugugccagaacuucuucaucgacuccugcgccgcccacggcccgcccaccuucgucaaggacagcgccguggacaaggggcaccccaaccgcagcgcgcucucccugccgcccggccugcggaucgggcccagcggcaucccccaggccgggcucggcguguggaacgaggccuccgaccugccccugggccuccacuucgggcccuacgagggccgcaucaccgaggacgaggaggccgccaacaacggguacagcuggcugaucaccaagggccggaacugcuacgaguacgucgacggcaaggacaaguccugggcgaacuggaugcgcuacgugaacugcgcccgcgacgacgaggagcagaaccugguggccuuccaguaccaccggcagaucuucuaccgcacgugccgggucauccgccccgggugcgagcuccuggugugguacggcgacgaguacgggcaggagcugggcaucaagugggggagcaaguggaagaaggagcucauggccggccgggagccgaagcccgagauccaccccugccccuccugcugccuggccuucagcucccagaaguuccugagccagcacguggagcgcaaccacuccagccagaacuucccgggccccuccgcgcggaagcuccugcagcccgagaaccccugcccgggggaccagaaccaggagcagcaguaccccgacccccacagccgcaacgacaagaccaagggccaggagaucaaggagcgguccaagcugcucaacaagcgcaccuggcagcgggagaucagccgcgccuucuccagcccgcccaaggggcagaugggcuccugccgggucgggaagcgcaucauggaggaggagagccggaccggccagaaggugaaccccggcaacacggggaagcuguucgugggcgucgggaucagccgcaucgccaaggugaaguacggcgagugcgggcagggcuucuccgucaagagcgacgugaucacccaccagcggacccacaccggcgagaagcuguacgugugccgcgagugcgggcggggcuucuccuggaagucccaccuccugauccaccagcgcauccacacgggggagaagcccuacgugugccgcgagugcggccggggcuucagcuggcagagcguccugcucacccaccagcgcacccacaccggggagaagccguacgugugccgggagugcggccgcggguucucccggcagagcguccugcugacgcaccagcgccggcacaccggcgagaagcccuacgugugccgcgagugcgggcggggcuucucccgccagagcgugcuccugacccaccagcggcgccacaccggcgagaagcccuacgucugccgggagugcgggcgcggcuucuccuggcagagcgugcugcucacgcaccagcggacccacaccggggagaagcccuacgugugccgcgagugcggccggggguucuccuggcagagcguccugcugacccaccagcgcacgcacaccggcgagaagccguacgugugccgggagugcggccgcggguucuccaacaagagccaccuccugcggcaccagcgcacccacaccggcgagaagcccuacgugugccgcgagugcgggcggggcuuccgcgacaagucccaccuccugcggcaccagcgcacgcacaccggggagaagcccuacgucugccgggagugcggccgcggcuuccgggacaagagcaaccugcugagccaccagcgcacccacaccggggagaagcccuacgugugccgggagugcggccgcggguucuccaacaagagccaccuccugcggcaccagcgcacccacacgggcgagaagccguacgugugccgggagugcgggcgcggcuuccggaacaagucccaccuccugcgccaccagcggacccacaccggcgagaagcccuacgucugccgcgagugcgggcggggcuucagcgaccgcuccagccugugcuaccaccagcgcacccacacgggggagaagcccuacgugugccgggaggacgaguga

SEQ ID NO: 35016 - RNA, 597 nt, Artificial Sequence
  derived and/or modified sequence opt1 from PRDX2__Homo_sapiens__NP_005800
auggccagcggcaacgcccgcaucgggaagcccgcgccggacuucaaggccaccgccguggucgacggcgccuucaaggaggugaagcuguccgacuacaaggggaaguacgugguccucuucuucuacccccuggacuucaccuucgugugccccacggagaucaucgccuucagcaaccgggcggaggacuuccgcaagcugggcugcgaggugcucggggucuccguggacagccaguucacccaccuggccuggaucaacacgccccggaaggagggcggccuggggccgcucaacaucccccugcuggccgacgugacccgccggcucuccgaggacuacggcguccugaagaccgacgaggggaucgccuaccgcggccuguucaucaucgacgggaagggcgugcuccggcagaucaccgugaacgaccugcccgucggccgcagcguggacgaggcgcugcggcucgugcaggccuuccaguacaccgacgagcacggggaggucugccccgccggcuggaagccgggguccgacaccaucaagcccaacguggacgacagcaaggaguacuucuccaagcacaacuga

SEQ ID NO: 35017 - RNA, 771 nt, Artificial Sequence
  derived and/or modified sequence opt1 from PRDX3__Homo_sapiens__NP_006784
auggccgccgcggugggccgccugcuccgggccagcgucgcccgccacguguccgccauccccugggggaucagcgccaccgcggcccugcggccggccgccugcggccgcaccucccugacgaaccuccugugcagcggguccagccaggcgaagcuguucuccaccagcuccagcugccacgcccccgccgugacccagcacgcccccuacuucaagggcaccgccgucgugaacggggaguucaaggaccucucccuggacgacuucaagggcaaguaccugguccucuucuucuacccccuggacuucacguucgugugcccgaccgagaucguggcguucagcgacaaggccaacgaguuccacgacgugaacugcgaggucguggccguguccgucgacagccacuucucccaccuggccuggaucaacacgccccggaagaacggcgggcucggccacaugaacaucgcccugcugagcgaccucaccaagcagaucucccgcgacuacggggugcugcuggagggcagcgggcucgcgcugcggggccuguucaucaucgaccccaacggcgugaucaagcaccucuccgucaacgaccugcccguggggcgcagcguggaggagacccugcggcucgucaaggccuuccaguacguggagacccacggcgaggugugcccggccaacuggacccccgacagccccaccaucaagcccuccccggccgccagcaaggaguacuuccagaaggucaaccaguga

SEQ ID NO: 35018 - RNA, 816 nt, Artificial Sequence
  derived and/or modified sequence opt1 from PRDX4__Homo_sapiens__NP_006397
auggaggcccugccccuccuggccgcgaccaccccggaccacggccgccaccggcgccugcuccugcugccccuccugcuguuccuccugcccgccggggccgugcagggcugggagacggaggagcggccccgcacccgggaggaggagugccacuucuacgccgggggccaggucuacccgggggaggccagccgcguguccguggcggaccacagccugcaccucuccaaggccaagaucagcaagcccgcccccuacugggagggcaccgccgucaucgacggcgaguucaaggagcugaagcugaccgacuaccgggggaaguaccucguguucuucuucuacccccuggacuucacguucgugugcccgaccgagaucaucgcguucggcgaccgccuggaggaguuccgguccaucaacaccgaggucguggccugcagcguggacucccaguucacccaccucgccuggaucaacacgccccgccggcagggcgggcuggggcccauccgcaucccccugcucagcgaccugacccaccagaucuccaaggacuacggcgucuaccuggaggacagcggccacacccuccgggggcuguucaucaucgacgacaagggcauccugcgccagaucacccucaacgaccugccgguggggcgguccguggacgagacgcugcgccucguccaggccuuccaguacaccgacaagcacggcgaggugugccccgccggcuggaagcccgggagcgagaccaucauccccgacccggcgggcaagcugaaguacuucgacaagcugaacuga

SEQ ID NO: 35019 - RNA, 645 nt, Artificial Sequence
  derived and/or modified sequence opt1 from PRDX5__Homo_sapiens__NP_036226
augggccuggccggggugugcgcccuccgccggagcgcgggcuacauccuggucgggggcgccgggggccaguccgccgccgccgcggcccgccggugcagcgagggcgagugggccuccgggggcgugcgcagcuucucccgggccgcggccgccauggcccccaucaaggugggggacgccaucccggcggucgagguguucgagggcgagcccgggaacaaggugaaccuggccgagcuguucaagggcaagaagggcguccuguucggggugcccggcgccuucacccccgggugcagcaagacccaccucccgggcuucguggagcaggccgaggcccucaaggcgaagggcguccaggugguggccugccuguccgucaacgacgccuucgugacgggggaguggggccgcgcccacaaggccgaggggaaggugcggcugcucgcggaccccaccggcgccuucgggaaggagaccgaccugcugcucgacgacagccuggucuccaucuucggcaaccgccggcugaagcgcuucagcaugguggugcaggacggcaucgucaaggcccucaacguggagcccgacgggaccggccugacgugcucccuggcccccaacaucaucagccagcucuga

SEQ ID NO: 35020 - RNA, 675 nt, Artificial Sequence
  derived and/or modified sequence opt1 from PRDX6__Homo_sapiens__NP_004896
augcccggcgggcugcuccugggcgacguggccccgaacuucgaggccaacaccaccgucgggcgcauccgguuccacgacuuccugggcgacagcugggggauccucuucucccacccccgcgacuucacgcccgugugcaccaccgagcugggccgggcggccaagcuggcccccgaguucgccaagcgcaacgugaagcucaucgcccugagcaucgacuccgucgaggaccaccuggcguggagcaaggacaucaacgccuacaacugcgaggagccgaccgagaagcuccccuuccccaucaucgacgaccggaaccgcgagcuggccauccugcucggcaugcuggaccccgccgagaaggacgagaaggggaugccggugacggcgcggguggucuucguguucggccccgacaagaagcugaagcucuccauccuguaccccgccaccaccgggcgcaacuucgacgagauccugcggguggucaucagccuccagcugaccgccgagaagcgcguggccacgcccguggacuggaaggacggcgacuccgucauggugcugccgaccauccccgaggaggaggccaagaagcuguuccccaaggggguguucaccaaggagcuccccagcggcaagaaguaccugcgguacaccccgcagcccuga

SEQ ID NO: 35021 - RNA, 1254 nt, Artificial Sequence
  derived and/or modified sequence opt1 from PREB__Homo_sapiens__NP_037520
augggccgccggcgcgcccccgagcuguaccgggccccguucccccucuacgcgcuccagguggaccccagcaccgggcugcugaucgccgccggcgggggcggggccgccaagaccggcaucaagaacggcguccacuuccugcagcuggagcucaucaacgggcgccuguccgcgagccugcuccacucccacgacacggagacccgggccaccaugaaccuggcccuggccggcgacauccucgcggccgggcaggacgcccacugccagcugcugcgcuuccaggcccaccagcagcagggcaacaaggccgagaaggcggggagcaaggagcagggcccccggcagcgcaagggcgccgccccggccgagaagaagugcggggccgagacccagcacgagggccucgagcugcggguggagaaccugcaggcggugcagacggacuucuccagcgacccccuccagaaggucgugugcuucaaccacgacaacacccugcuggccaccgggggcaccgacggcuacgugcgcgucuggaaggugcccucccucgagaaggugcuggaguucaaggcccacgagggggagaucgaggaccuggcccucggccccgacgggaagcuggucacggugggccgggaccugaaggccagcguguggcagaaggaccagcucgucacccagcugcacuggcaggagaacgggccgaccuucuccagcacccccuaccgcuaccaggcgugccgguucggccaggugcccgaccagcccgccggccugcgccucuucacggugcagaucccgcacaagcggcugcgccagcccccgcccugcuaccugaccgccugggacggguccaacuuccucccccugcggaccaagagcugcggccacgaggucguguccugccuggacgugagcgaguccgggaccuuccucggccuggggacggucaccggcagcguggccaucuacaucgccuucucccugcagugccucuacuacgugcgcgaggcgcacggcaucgucgugaccgacguggccuuccugcccgagaaggggcggggccccgagcugcucgggagccacgagaccgcccuguucuccgucgccguggacagccgcugccagcugcaccuccugcccagccggcgcuccgucccgguguggcugcuccugcugcugugcgugggccucaucaucgucacgauccugcugcuccagagcgcguuccccggguuccuguga

SEQ ID NO: 35022 - RNA, 1149 nt, Artificial Sequence
  derived and/or modified sequence opt1 from PRELP__Homo_sapiens__NP_958505
augcgcagcccccugugcuggcuccugccgcugcucauccuggccuccguggcccagggccagcccacccggcgcccccggcccgggaccggcccggggcgccggccccgcccccggccccgcccgacgcccagcuucccccagcccgacgagccggcggagcccaccgaccugcccccgccccucccgcccggcccgcccuccaucuuccccgacugcccccgggagugcuacugcccgcccgacuuccccagcgcccuguacugcgacucccgcaaccugcggaagguccccgugaucccgccccgcauccacuaccucuaccugcagaacaacuucaucaccgagcugcccguggagagcuuccagaacgccaccgggcuccgguggaucaaccuggacaacaaccgcauccggaagaucgaccagcgcguccuggagaagcuccccggccugguguuccuguacauggagaagaaccagcucgaggaggugcccuccgcccugccccggaaccuggagcagcuccgccugagccagaaccacaucucccggaucccgcccggcgucuucagcaagcuggagaaccuccugcugcucgaccugcagcacaaccgccuguccgacgggguguucaagcccgacacguuccacggccucaagaaccugaugcagcugaaccucgcccacaacauccugcggaagaugccgccccgcgugcccaccgcgauccaccagcuguaccucgacagcaacaagaucgagaccauccccaacggguacuucaaguccuuccccaaccuggccuucauccgccugaacuacaacaagcucaccgaccggggccugcccaagaacagcuucaacaucuccaaccugcucguccugcaccugagccacaaccgcaucuccagcgugcccgccaucaacaaccggcucgagcaccuguaccugaacaacaacuccaucgagaagaucaacgggacgcagaucugcccgaacgaccucguggccuuccacgacuucagcagcgaccuggagaacgucccccaccuccgcuaccugcggcuggacggcaacuaccugaagccgcccaucccccuggaccucaugaugugcuuccgccugcugcaguccguggugaucuga

SEQ ID NO: 35023 - RNA, 2133 nt, Artificial Sequence
  derived and/or modified sequence opt1 from PREP__Homo_sapiens__NP_002717
augcugagccuccaguaccccgacguguaccgcgacgagaccgccguccaggacuaccacggccacaagaucugcgacccguacgccuggcuggaggaccccgacuccgagcagaccaaggcguucguggaggcccagaacaagaucacggugcccuuccuggagcagugccccauccgggggcucuacaaggagcgcaugaccgagcuguacgacuacccgaaguacagcugccacuucaagaagggcaagcgguacuucuacuucuacaacaccgggcugcagaaccagcgcguccucuacgugcaggacucccuggagggcgaggcccggguguuccuggaccccaacauccucagcgacgacgggaccgucgcccugcgcggcuacgccuucuccgaggacggcgaguacuucgcguacgggcugagcgccuccggcagcgacugggugacgaucaaguucaugaagguggacggggccaaggagcuccccgacguccuggagcgggugaaguucuccugcauggccuggacccacgacggcaaggggauguucuacaacagcuacccccagcaggacggcaaguccgacggcaccgagaccagcacgaaccugcaccagaagcucuacuaccacgugcuggggaccgaccaguccgaggacauccugugcgcggaguucccggacgagcccaaguggaugggcggggccgagcucagcgacgacggccgcuacguccugcuguccauccgggagggcugcgaccccgugaaccgccucugguacugcgaccugcagcaggagagcuccgggaucgccggcauccugaagugggugaagcucaucgacaacuucgagggggaguacgacuacgucaccaacgagggcaccguguucacguucaagaccaaccggcagagccccaacuaccgcgugaucaacaucgacuuccgggacccggaggaguccaaguggaagguccuggugcccgagcacgagaaggacgugcuggaguggaucgccugcguccgcagcaacuuccucgugcugugcuaccugcacgacgugaagaacauccuccagcugcacgaccugaccaccggggcccuccugaagacguucccccuggacgucggcagcaucgugggcuacuccgggcagaagaaggacaccgagaucuucuaccaguucaccagcuuccucucccccggcaucaucuaccacugcgaccugaccaaggaggagcuggagccgcgggucuuccgcgaggugacggugaaggggaucgacgcgagcgacuaccagaccguccagaucuucuaccccuccaaggacggcaccaagauccccauguucaucgugcacaagaaggggaucaagcucgacggcagccaccccgccuuccuguacggcuacgggggcuucaacaucuccaucaccccgaacuacagcgugucccggcugaucuucguccgccacaugggcgggauccucgccguggccaacauccgcgggggcggcgaguacggggagacguggcacaagggcgggauccuggccaacaagcagaacugcuucgacgacuuccagugcgcggccgaguaccugaucaaggagggcuacaccagccccaagcggcucaccaucaacggcggguccaacggcgggcugcugguggccgccugcgccaaccagcggcccgaccucuucggcugcgucaucgcccaggugggggugauggacaugcugaaguuccacaaguacaccaucggccacgcguggacgaccgacuacggcugcagcgacuccaagcagcacuucgaguggcuggucaaguacagcccccugcacaacgugaagcucccggaggccgacgacauccaguaccccuccaugcugcugcucaccgccgaccacgacgaccgcguggucccccugcacagccugaaguucaucgccacccuccaguacaucguggggcgcucccggaagcagagcaacccccugcugauccacguggacacgaaggcgggccacggggccggcaagccgaccgccaaggucaucgaggagguguccgacauguucgccuucaucgcgcgcugccucaacguggacuggauccccuga

SEQ ID NO: 35024 - RNA, 1998 nt, Artificial Sequence
  derived and/or modified sequence opt1 from PREPL__Homo_sapiens__NP_001035844
augcagcagaagaccaagcuguuccuccaggcccugaaguacagcaucccccaccugggcaagugcaugcagaagcagcaccucaaccacuacaacuucgccgaccacugcuacaaccgcaucaagcugaagaaguaccaccugaccaagugccuccagaacaagccgaagaucuccgagcuggcgcggaacauccccagccgcuccuucagcugcaaggaccugcagcccgugaagcaggagaacgagaagccccucccggagaacauggacgccuucgagaagguccggacgaagcuggagacccagccccaggaggaguacgagaucaucaacguggaggugaagcacgggggcuucgucuacuaccaggaggggugcugccuggugcgcuccaaggacgaggaggccgacaacgacaacuacgagguccucuucaaccuggaggagcugaagcucgaccagcccuucaucgacugcauccggguggcccccgacgagaaguacguggccgcgaagauccgcaccgaggacagcgaggccuccacgugcgugaucaucaagcugagcgaccagccggucauggaggccuccuuccccaacgugagcuccuucgagugggugaaggacgaggaggacgaggacguccuguucuacaccuuccagcggaaccuccgcugccacgacguguaccgggccaccuucggcgacaacaagcgcaacgagcgguucuacaccgagaaggaccccagcuacuucguguuccuguaccugaccaaggacucccgcuuccucacgaucaacaucaugaacaagaccaccagcgaggucuggcugaucgacgggcugucccccugggacccgcccgugcucauccagaagcggauccacggcgugcuguacuacgucgagcaccgcgacgacgagcuguacauccucaccaacgugggcgagcccacggaguucaagcugcccccgugggcgugcggguucaucauggacaccaacagcgaccccaagaacugccccuuccagcugugcucccccauccggccgcccaaguacuacaccuacaaguucgccgagggcaagcuguucgaggagaccgggcacgaggaccccaucacgaagaccagccgcgugcuccggcuggaggccaaguccaaggacggcaagcucguccccaugaccguguuccacaagaccgacagcgaggaccugcagaagaagccgcugcucgugcacgucuacggggccuacggcauggaccugaagaugaacuuccgccccgagcggcgcgugcuggucgacgacggcuggauccucgccuacugccacgugcgcgggggcggggagcugggccugcaguggcacgcggacggccggcucacgaagaagcugaacgggcuggccgaccucgaggccugcaucaagacccugcacggccagggguucagccagcccucccugaccacccucacggccuucagcgccggcggggugcuggcgggcgcccugugcaacuccaaccccgagcugguccgcgccgugacccucgaggccccguuccuggacgugcugaacaccaugauggacaccacgcucccccugacccuggaggagcucgaggaguggggcaaccccagcuccgacgagaagcacaagaacuacaucaagcgguacugcccguaccagaacaucaagccccagcacuaccccagcauccacaucaccgccuacgagaacgacgagcgcgucccccugaaggggaucguguccuacaccgagaagcugaaggaggcgaucgccgagcacgccaaggacacgggcgagggguaccagaccccgaacaucauccucgacauccagcccggcgggaaccacgugaucgaggacagccacaagaagaucaccgcccagaucaaguuccuguacgaggagcugggccucgacuccaccagcgucuucgaggaccugaagaaguaccugaaguucuga

SEQ ID NO: 35025 - RNA, 4980 nt, Artificial Sequence
  derived and/or modified sequence opt1 from PREX1__Homo_sapiens__NP_065871
auggaggcccccagcggcuccgagcccgggggcgacggggccggcgacugcgcccaccccgacccccgcgcccccggggccgccgccccgagcuccggccccggccccugcgcggccgcccgggagagcgagcgccagcugcggcuccgccugugcgugcugaacgagauccucgggaccgagcgggacuacgucggcacccugcgcuuccugcaguccgccuuccuccaccggauccgccagaacguggcggacagcguggagaaggggcugacggaggagaacgucaaggugcuguucuccaacaucgaggacauccucgaggugcacaaggacuuccuggccgcccuggaguacugccuccaccccgagccgcagagccagcacgagcugggcaacgucuuccugaaguucaaggacaaguucugcguguacgaggaguacugcuccaaccacgagaaggcccuccggcugcugguggagcucaacaagauccccaccguccgcgccuuccugcugagcugcaugcuccucgggggccggaagaccaccgacaucccccuggagggcuaccugcugucccccauccagcgcaucugcaaguacccgcugcuccugaaggagcuggcgaagcggacgcccgggaagcaccccgaccaccccgccgugcagagcgcccuccaggccaugaagaccgugugcuccaacaucaacgagaccaagcgccagauggagaagcuggaggcccuggagcagcuccagagccacaucgagggcugggagggguccaaccugaccgacaucugcacgcagcugcuccugcagggcacccugcucaagaucagcgcgggcaacauccaggagcgggccuucuuccuguucgacaaccugcucgucuacugcaagcgcaagucccgggugaccgggagcaagaaguccaccaagcgcaccaagagcaucaacggcagccuguacaucuuccgggggcgcaucaacacggaggugauggaggucgagaacguggaggacggcaccgccgacuaccacuccaacggguacaccgugacgaacggcuggaagauccacaacaccgccaagaacaagugguucgucugcauggccaagaccgcggaggagaagcagaaguggcuggacgccaucauccgggagcgcgagcagcgcgagagccucaagcugggcauggagcgggacgccuacgugaugaucgccgagaagggggagaagcuguaccacaugaugaugaacaagaaggugaaccucaucaaggaccgccggcgcaagcuguccaccgucccgaagugcuuccugggcaacgaguucguggccuggcugcucgagaucggggagaucagcaagacggaggagggcgugaaccuggggcaggcgcugcucgagaacggcaucauccaccacgucuccgacaagcaccaguucaagaacgagcaggucauguaccgguuccgcuacgacgacggcaccuacaaggcccggagcgagcuggaggacaucauguccaagggggugcgccuguacugccggcuccacagccuguacacccccgugaucaaggaccgcgacuaccaccugaagaccuacaaguccgugcuccccggcagcaagcuggucgacuggcugcucgcccagggggacugccagacgcgggaggaggccguggcgcugggcguggggcugugcaacaacggcuucaugcaccacguccucgagaaguccgaguuccgcgacgagagccaguacuuccgguuccacgccgacgaggagauggagggcaccuccagcaagaacaagcagcugcgcaacgacuucaagcugguggagaacauccucgccaagcggcugcugauccucccccaggaggaggacuacggguucgacaucgaggagaagaacaaggccguggucgugaaguccgugcagcgcggcagccuggccgaggucgcggggcuccaggugggccggaagaucuacuccaucaacgaggaccugguguuccugcgcccguucagcgaggucgaguccauccugaaccagagcuucugcagccggcgcccccuccgccugcugguggccaccaaggccaaggagaucaucaagauccccgaccagcccgacacccucugcuuccagauccggggcgccgccccgcccuacguguacgcggucgggcgcggcuccgaggccauggccgccgggcugugcgccggccagugcauccugaaggugaacgggagcaacgugaugaacgacggcgcgcccgagguccucgagcacuuccaggccuuccggucccgccgggaggaggcccugggccuguaccaguggaucuaccacacgcacgaggacgcccaggaggcgcgcgccagccaggaggccuccaccgaggaccccagcggggagcaggcccaggaggaggaccaggccgacuccgcguucccgcuccugagccugggcccccggcucucccugugcgaggacagccccauggugacccugaccguggacaacguccaccucgagcacggggugguguacgaguacgucuccacggccggcgugcgcugccacgugcuggagaagaucgucgagccgcgggggugcuucggccugaccgccaagauccucgaggccuucgccgcgaacgacagcguguucguggagaacugccgccggcugauggcccuguccagcgccaucgucaccaugccccacuucgaguuccgcaacaucugcgacaccaagcucgaguccaucggccagcggaucgccugcuaccaggaguucgccgcgcagcucaagagccgcguguccccgcccuucaagcaggccccgcuggagccccacccccugugcgggcuggacuucugccccacgaacugccacaucaaccugauggaggugagcuacccgaagaccacccccagcgucggccgguccuucagcauccgcuucgggcggaagcccucccucaucggccuggaccccgagcaggggcaccugaacccgaugagcuacacccagcacugcaucaccacgauggccgcccccuccuggaagugccuccccgcggccgagggcgacccccagggccaggggcugcacgacggcagcuucgggccggccuccggcacccuggggcaggaggaccgcggccucagcuuccugcugaagcaggaggaccgggagauccaggacgccuaccuccagcuguucaccaagcuggacguggcccucaaggagaugaagcaguacgugacccagaucaaccgccugcuguccacgaucaccgagcccaccagcggcggguccugcgacgcgagccucgccgaggaggccuccagccugccccuggucuccgaggagagcgagauggaccgguccgaccacggcgggaucaagaaggugugcuucaagguggccgaggaggaccaggaggacagcggccacgacaccauguccuaccgcgacagcuacagcgagugcaacuccaaccgcgacagcguccucuccuacacgagcgugcgguccaacagcuccuaccugggcagcgacgagaugggguccggcgacgagcugcccugcgacaugcgcaucccgagcgacaagcaggacaagcuccacgggugccuggagcaccuguucaaccagguggacuccaucaacgcccuccugaagggccccgucaugagccgggcguucgaggagaccaagcacuuccccaugaaccacucccugcaggaguucaagcagaaggaggagugcaccauccgcgggcggagccucauccagaucuccauccaggaggaccccuggaaccugccgaacagcaucaagacccugguggacaacauccagcgcuacguggaggacggcaagaaccagcuccugcuggcccuccugaagugcacggacaccgagcugcagcuccggcgcgacgccaucuucugccaggcccuggucgccgcggugugcaccuucuccgagcagcugcucgccgcccugggcuaccgguacaacaacaacggggaguacgaggagagcucccgcgacgccagccggaaguggcuggagcaggucgccgcgaccggcgugcugcuccacugccagagccugcugucccccgccacggugaaggaggagcgcaccaugcucgaggacaucugggucacccugagcgagcuggacaacgugaccuucuccuucaagcagcucgacgagaacuacguggccaacacgaacgucuucuaccacaucgaggggagccggcaggcccugaaggugaucuucuaccuggacuccuaccacuucagcaagcuccccucccgccuggagggcggggcgagccugcggcuccacaccgcccuguucaccaaggugcuggagaacgucgagggccucccgucccccggcagccaggccgccgaggaccugcagcaggacaucaacgcccagucccuggagaaggugcagcaguacuaccgcaagcuccgggcguucuaccuggagcgcagcaaccugcccaccgacgccuccacgaccgccgugaagaucgaccagcucauccggcccaucaacgcccuggacgagcugugccgccucaugaaguccuucguccacccgaagcccggggccgcgggcagcgugggggccggccugauccccaucagcuccgagcugugcuaccgccucggggccugccagauggugaugugcggcaccggcaugcagcggagcacccuguccgucagccuggagcaggccgccauccucgcgcgcagccacgggcugcugcccaagugcaucaugcaggccacggacaucaugcggaagcagggcccgcgcguggagauccucgccaagaaccugcgggugaaggaccagaugccccagggggcgccccgccuguaccggcucugccagcccccggucgacggcgaccuguga

SEQ ID NO: 35026 - RNA, 4821 nt, Artificial Sequence
  derived and/or modified sequence opt1 from PREX2__Homo_sapiens__NP_079146
augagcgaggacucccgcggcgacagccgggccgaguccgccaaggaccuggagaagcagcuccgccugcgggugugcguccugagcgagcuccagaagaccgagcgcgacuacguggggacccuggaguuccugguguccgccuuccuccaccggaugaaccagugcgccgccagcaaggucgacaagaacgugaccgaggagaccgugaagaugcuguucuccaacaucgaggacauccuggccguccacaaggaguuccucaaggugguggaggagugccugcaccccgagcccaacgcccagcaggaggucgggaccugcuuccugcacuucaaggacaaguuccgcaucuacgacgaguacugcagcaaccacgagaaggcgcagaagcuccugcuggagcucaacaagauccggaccauccgcacguuccugcugaacugcaugcuccucgggggccggaagaacaccgacgugccccuggagggguaccuggugacccccauccagcgcaucugcaaguacccccugauccugaaggagcuccugaagcggaccccgcgcaagcacuccgacuacgccgccgucauggaggcccugcaggcgaugaaggccgugugcagcaacaucaacgaggccaagcggcagauggagaagcucgaggugcuggaggaguggcagucccacaucgagggcugggagggcagcaacaucacggacacgugcaccgagaugcugaugugcgggguccuccugaagaucuccagcggcaacauccaggagcgcguguucuuccuguucgacaaccuccugguguacugcaagcggaagcaccgccggcugaagaacuccaaggccagcaccgacgggcaccgcuaccucuuccggggccgcaucaacacggaggucauggagguggagaacguggacgacgggaccgccgacuuccacuccagcggccacaucgucgugaacggcuggaagauccacaacaccgcgaagaacaagugguucgugugcauggccaagacccccgaggagaagcacgagugguucgaggccauccugaaggagcgggagcgccgcaaggggcugaagcucggcauggagcaggacacgugggucaugaucuccgagcagggggagaagcuguacaagaugaugugccggcagggcaaccugaucaaggaccgcaagcggaagcucaccaccuuccccaagugcuuccugggcagcgaguucgugagcuggcugcucgagaucggggagauccaccgccccgaggagggcguccaccuggggcaggcccugcucgagaacggcaucauccaccacgugaccgacaagcaccaguucaagccggagcagaugcuguaccgguuccgcuacgacgacgggacguucuacccccggaacgagaugcaggacgugaucuccaagggcguccgccuguacugccggcugcacagccucuucacccccgugauccgcgacaaggacuaccaccuccggaccuacaaguccguggucauggccaacaagcugaucgacuggcucaucgcgcagggcgacugccgcacccgggaggaggccaugaucuucggggugggccugugcgacaacggcuucaugcaccacgugcuggagaaguccgaguucaaggacgagccccugcuguuccgcuucuucagcgacgaggagauggagggcagcaacaugaagcaccggcugaugaagcacgaccucaaggucguggagaacgugaucgccaagucccugcugaucaagagcaacgagggguccuacggcuucggccucgaggacaagaacaagguccccaucaucaagcugguggagaaggggagcaacgccgagauggccggcauggagguggggaagaagaucuucgcgaucaacggcgaccuggucuucaugcgccccuucaacgagguggacugcuuccucaaguccugccugaacagccggaagccccugcgcgugcucgucuccaccaagccccgggagaccgugaagaucccggacagcgccgacgggcugggcuuccagauccgcggcuucgggcccuccgugguccacgccgugggccgcgggaccguggccgccgcggccggccugcaccccggccagugcaucaucaaggucaacgggaucaacgugagcaaggagacccacgccuccgugaucgcccacgucacggcgugccggaaguaccgccggcccaccaagcaggacagcauccaguggguguacaacuccaucgagagcgcccaggaggaccuccagaagucccacagcaagccgcccggcgacgaggccggggacgccuucgacugcaagguggaggaggucaucgacaaguucaacaccauggccaucaucgacggcaagaaggagcacgugagccugaccguggacaacguccaccuggaguacggggugguguacgaguacgacuccacggcgggcaucaagugcaacgucguggagaagaugaucgagcccaagggcuucuucagccucaccgccaagauccuggaggcccuggccaaguccgacgagcacuucgugcagaacugcaccagccucaacucccugaacgaggucauccccaccgaccugcagagcaaguucuccgcccucugcagcgagcgcaucgagcaccugugccagcggaucuccagcuacaagaaguucucccgcgugcugaagaaccgggcguggccgacguucaagcaggccaagagcaagaucagcccccuccacuccuccgacuucugccccaccaacugccacgugaacgucauggaggugagcuaccccaagaccagcaccucccuggggagcgccuucggcgugcagcuggacucccgcaagcacaacagccacgacaaggagaacaaguccagcgagcaggggaagcucuccccgauggucuacauccagcacaccaucacgaccauggccgcccccagcggccugucccuggggcagcaggacggccacggccuccgguaccugcugaaggaggaggaccucgagacccaggacaucuaccagaagcugcuggggaagcuccagaccgcgcugaaggagguggagaugugcgugugccagaucgacgaccugcucagcuccaucacguacagccccaagcuggagcgcaagaccuccgagggcaucaucccgaccgacagcgacaacgagaagggggagcggaacuccaagcgcgucugcuucaacguggccggcgacgagcaggaggacagcgggcacgacaccaucuccaaccgggacagcuacuccgacugcaacagcaaccgcaacagcaucgccuccuucacgagcaucugcuccagccagugcuccagcuacuuccacuccgacgagauggacagcggcgacgagcugccccucuccgugcggaucagccacgacaagcaggacaagauccacuccugccuggagcaccuguucagccaggucgacuccaucaccaaccuccugaagggccaggccgugguccgcgcguucgaccagaccaaguaccugacccccgggcggggccuccaggaguuccagcaggagauggagcccaagcugagcugcccgaagcgccugcggcuccacaucaagcaggaccccuggaaccugcccuccagcgugcgcacgcuggcccagaacauccggaaguucguggaggaggucaagugccgccuccugcuggcccuccuggaguacuccgacagcgagacccagcugcgccgggacaugguguucugccagacccucguggccaccgucugcgccuucuccgagcagcugauggcggcccugaaccagauguucgacaacagcaaggagaacgagauggagacgugggaggccagccgccgguggcucgaccagaucgccaacgccggggugcuguuccacuuccagucccugcucagccccaaccugaccgacgagcaggcgaugcuggaggacacccucguggcccuguucgaccuggagaaggucuccuucuacuucaagccgagcgaggaggagccccucguggccaacgugccccugaccuaccaggccgagggcucccgccaggcccugaaggucuacuucuacaucgacagcuaccacuucgagcagcucccccagcggcugaagaacgggggcggcuucaagauccacccggugcuguucgcgcaggcccucgaguccauggagggguacuacuaccgcgacaacgugagcgucgaggaguuccaggcccagaucaacgccgcgucccuggagaaggugaagcaguacaaccagaagcugcgggccuucuaccucgacaagagcaacuccccgcccaacagcacguccaaggccgccuacguggacaagcugaugcgcccccugaacgcccucgacgagcuguaccggcuggucgcgagcuucauccgcuccaagcggaccgccgccugcgccaacaccgccugcagcgcguccggcguggggcugcucagcguguccagcgagcugugcaaccgccugggcgccugccacaucaucaugugcagcuccggcguccaccggugcacccucagcgugacgcuggagcaggccaucauccuggcccgcucccacgggcucccgccccgguacaucaugcaggccaccgacgugaugcgcaagcagggcgcgcggguccagaacaccgccaagaaccugggggugcgcgaccggacgccccagagcgcgccccgccuguacaagcucugcgagcccccgccgcccgccggcgaggaguga

SEQ ID NO: 35027 - RNA, 1668 nt, Artificial Sequence
  derived and/or modified sequence opt1 from PRF1__Homo_sapiens__NP_001076585
auggccgcccgccugcuccugcugggcauccuccugcugcuccugccccugccggugcccgcgcccugccacaccgccgcccggagcgagugcaagcgcucccacaaguucguccccggggccuggcucgccggcgaggggguggacgugaccagccugcggcgcuccggcagcuucccggucgacacgcagcgguuccugcgccccgacgggaccugcacccucugcgagaacgcgcugcaggagggcacccugcagcggcucccccuggcccugacgaacuggcgcgcccagggcuccgggugccagcggcacgugacccgcgccaaggugagcuccaccgaggcggucgcccgggacgccgcccgcagcauccggaacgacuggaaggugggccucgacgugacccccaagccgacguccaacguccacgugagcguggccgggucccacagccaggcggccaacuucgccgcccagaagacccaccaggaccaguacuccuucagcaccgacaccgucgagugccgcuucuacuccuuccacguggugcacacgccgccccugcaccccgacuucaagcgggcccugggcgaccucccccaccacuucaacgcgagcacccagcccgccuaccugcgccugaucuccaacuacgggacccacuucauccgggccgucgagcucggcggccgcaucagcgcccugaccgcccugcggacgugcgagcucgcgcuggaggggcugaccgacaacgagguggaggacugccucaccguggaggcccaggucaacaucggcauccacggguccaucagcgccgaggccaaggccugcgaggagaagaagaagaagcacaagaugaccgcgagcuuccaccagacguaccgcgagcggcacuccgagguggugggcggccaccacaccagcaucaacgaccugcuguucgggauccaggccggccccgagcaguacuccgccugggucaacagccuccccggguccccgggccugguggacuacacccuggagccccuccacgugcugcuggacagccaggacccccgccgcgaggcccuccggcgcgcgcugucccaguaccugaccgaccgggcccgcuggcgggacugcagccgccccugcccgcccgggcggcagaaguccccgcgcgaccccugccagugcgucugccacggcagcgccgugacgacccaggacugcugcccccggcagcgcggccucgcccagcuggaggucaccuucauccaggccugggggcuguggggcgacugguucaccgcgacggacgccuacgugaagcuguucuucgggggccaggagcugcggaccuccaccgugugggacaacaacaaccccaucuggagcguccgccuggacuucggggacgugcuccuggccaccggcggcccccugcggcuccaggugugggaccaggacuccgggcgcgacgacgaccuccugggcacgugcgaccaggcccccaagagcgggucccacgagguccggugcaaccugaaccacggccaccucaaguuccgcuaccacgcccggugccugccgcaccugggcggcgggaccugccucgacuacgugccccagaugcugcugggggagcccccgggcaaccgcagcggggcggugugguga

SEQ ID NO: 35028 - RNA, 636 nt, Artificial Sequence
  derived and/or modified sequence opt1 from PRG2__Homo_sapiens__NP_001230174
augaagcugccccuccugcuggcccuccuguucggcgccgugagcgcgcugcaccuccgcuccgagaccagcaccuucgagacgccgcugggggccaagacccugcccgaggacgaggagacccccgagcaggagauggaggagacccccugccgggagcucgaggaggaggaggaguggggcuccgggagcgaggacgccuccaagaaggacggcgccgucgagagcaucuccgugccggacaugguggacaagaaccugacgugccccgaggaggaggacaccgucaaggugguggggauccccggcugccagaccugccgcuaccuccuguucacgugccggcgcugcuaccggggcaaccuggucagcauccacaacuucaacaucaacuaccgcauccagugcuccgugagcgcccugaaccaggggcaggucuggaucggcgggcggaucaccggcuccgggcgcugccggcgcuuccaguggguggacggcagccgguggaacuucgcguacugggccgcccaccagcccuggucccgcggcgggcacugcguggcccucugcacccggggcgggcacuggcgccgggcgcacugccugcgccggcugccguucaucugcagcuacuga

SEQ ID NO: 35029 - RNA, 4092 nt, Artificial Sequence
  derived and/or modified sequence opt1 from PRG4__Homo_sapiens__NP_001121180
auggccuggaagacccugcccaucuaccuccugcugcuccugagcguguucgucauccagcaggucuccagccaggagcuguccugcaagggccgcugcuucgagagcuucgagcgggggcgcgagugcgacugcgacgcccagugcaagaaguacgacaagugcugcccggacuacgaguccuucugcgcggaggugcacaaccccaccagcccgcccuccagcaagaaggcgcccccgcccuccggcgccagccagacgaucaaguccaccaccaagcggagccccaagccgcccaacaagaagaagaccaagaaggugaucgaguccgaggagaucacggaggagcacagcguguccgagaaccaggagagcuccagcuccagcagcuccagcuccagcuccagcaccauccgcaagaucaaguccagcaagaacuccgccgccaaccgggagcuccagaagaagcugaaggugaaggacaacaagaagaaccgcaccaagaagaagcccacccccaagccgcccgucguggacgaggcggggagcggccuggacaacggggacuucaaggugacgacccccgacaccuccaccacgcagcacaacaaggucagcaccucccccaagaucaccaccgccaagccgaucaacccccggcccagccugcccccgaacuccgacacgagcaaggagaccucccucaccgugaacaaggagaccacgguggagaccaaggagaccaccacgaccaacaagcagaccagcaccgacggcaaggagaagacgaccuccgccaaggagacccagagcaucgagaagaccagcgccaaggaccuggcgcccacguccaagguccucgccaagcccacccccaaggccgagaccaccacgaagggcccggcccugaccacccccaaggagcccacccccaccacgccgaaggagcccgccagcaccacccccaaggagccgacccccacgaccaucaaguccgcgcccaccacccccaaggagccggcccccacgaccaccaagagcgcccccaccacgcccaaggagccggcccccaccaccaccaaggagcccgcccccacgaccccgaaggagcccgcgcccaccaccacgaaggagcccgccccgaccaccaccaaguccgcccccacgacccccaaggagcccgccccgaccacccccaagaagcccgcccccacgaccccgaaggagcccgcgcccaccaccccgaaggagcccacgcccaccacccccaaggagccggcccccaccacgaaggagcccgcccccaccaccccgaaggagcccgcccccaccgcccccaagaagccggcgcccaccacgcccaaggagcccgcccccaccacccccaaggagcccgcccccaccacgaccaaggagccgagccccaccacccccaaggagcccgccccgacgaccaccaaguccgcccccaccacgaccaaggagcccgcccccaccaccaccaagagcgccccgacgacccccaaggagcccuccccgaccacgaccaaggagcccgcccccaccacccccaaggagccggcccccacgacccccaagaagcccgcgccgaccacccccaaggagcccgcccccacgaccccgaaggagcccgcccccaccaccacgaagaagcccgccccgaccacccccaaggagcccgcccccaccacgccgaaggagaccgcgcccaccacccccaagaagcugacccccacgaccccggagaagcucgcccccaccacccccgagaagcccgccccgacgacccccgaggagcuggcccccaccaccccggaggagcccacgcccaccacccccgaggagccggcccccaccacgcccaaggcggccgcccccaacaccccgaaggagcccgcccccaccacccccaaggagccggcgcccacgacccccaaggagcccgccccgaccacccccaaggagacggcccccaccacccccaaggggaccgccccgacgacccugaaggagcccgcccccaccacccccaagaagccggcgcccaaggagcucgcccccacgaccaccaaggagccgaccagcacgaccuccgacaagcccgcccccaccacccccaagggcacggccccgaccacccccaaggagcccgcccccaccacgccgaaggagcccgcgcccaccacccccaaggggaccgccccgaccacgcugaaggagcccgcccccaccacccccaagaagccggcccccaaggagcuggcccccaccacgaccaagggccccaccagcaccacguccgacaagccggcgcccaccacccccaaggagaccgcccccacgaccccgaaggagcccgcccccaccacccccaagaagccggcccccacgacccccgagaccccgccgcccaccacgagcgagguguccacccccaccaccacgaaggagcccaccaccauccacaagagccccgacgaguccacccccgagcucagcgcggagcccacgccgaaggcccuggagaacagccccaaggagcccggggugcccaccaccaagaccccggccgccacgaagcccgagaugaccaccaccgccaaggacaagacgaccgagcgcgaccugcggaccacccccgagaccacgaccgcggcccccaagaugaccaaggagaccgccacgaccaccgagaagaccacggaguccaagaucaccgccaccaccacgcaggucaccagcaccaccacgcaggacaccaccccguucaagaucaccacgcucaagaccaccacccuggcccccaaggugacgaccaccaagaagaccaucacgaccaccgagaucaugaacaagcccgaggagaccgcgaagcccaaggaccgcgccacgaacuccaaggccaccaccccgaagccccagaagcccaccaaggcccccaagaagccgacgagcaccaagaagcccaagaccaugccccgggugcgcaagcccaagaccaccccgacgccccggaagaugaccuccaccaugcccgagcugaacccgaccagccgcaucgccgaggcgaugcuccagacgaccacccggcccaaccagacccccaacuccaagcuggucgaggugaaccccaagagcgaggacgccggcggcgccgagggggagacgccgcacaugcugcuccgcccccacguguucaugcccgaggucacccccgacauggacuaccugccgcgggugcccaaccagggcaucaucaucaaccccaugcuguccgacgagaccaacaucugcaacgggaagcccguggacggccucaccacgcugcgcaacggcacccuggucgccuuccgggggcacuacuucuggaugcucagcccguucuccccgcccagccccgcccgccggaucaccgagguguggggcauccccucccccaucgacaccgucuucacgcgcugcaacugcgaggggaagaccuucuucuucaaggacagccaguacuggcgcuucaccaacgacaucaaggacgcgggcuaccccaagcccaucuucaagggguucggcggccugaccgggcagaucguggccgcccuguccacggccaaguacaagaacuggccggagagcguguacuucuucaagcggggcggguccauccagcaguacaucuacaagcaggagcccguccagaagugccccggccgccggcccgcgcucaacuacccgguguacggggagaccacccaggugcgccggcgccgguucgagcgcgccaucggccccagccagacccacacgauccggauccaguacucccccgcccgccuggccuaccaggacaagggcguccugcacaacgaggugaaggugagcauccucuggcgggggcugcccaacgucgugaccagcgccaucucccugccgaacauccgcaagcccgacggcuacgacuacuacgcguucagcaaggaccaguacuacaacaucgacgugcccucccggaccgcccgcgccaucaccacgcggagcgggcagacccucuccaaggucugguacaacugcccguga

SEQ ID NO: 35030 - RNA, 564 nt, Artificial Sequence
  derived and/or modified sequence opt1 from PRH1__Homo_sapiens__NP_001278243
augcugcucauccugcugagcguggcccuccuggccuucuccagcgcgcaggaccugaacgaggacgucucccaggaggacgugccccucgugaucagcgacggcggggacuccgagcaguuccuggacgaggagcgccagggcccgccccuggggggccagcagagccagcccuccgccggggacggcaaccaggacgacggcccccagcaggggccgccccagcagggcgggcagcagcagcagggcccccccccgccccaggggaagccccagggccccccgcagcagggcgggcagcagcagcagggccccccccccccgcaggggaagccccagggccccccccagcagggcgggcacccgccccccccccagggccggccgcaggggcccccccagcagggcgggcacccccgcccgccccggggccgcccccagggcccgccccagcaggggggccaccagcaggggccccccccgcccccccccggcaagccgcaggggccccccccccagggcggccggccgcaggggcccccccagggccagagcccccaguga

SEQ ID NO: 35031 - RNA, 501 nt, Artificial Sequence
  derived and/or modified sequence opt1 from PRH2__Homo_sapiens__NP_001103683
augcugcucauccugcugagcguggcccuccuggccuucuccagcgcgcaggaccuggacgaggacgucucccaggaggacgugccccucgugaucagcgacggcggggacuccgagcaguucaucgacgaggagcgccagggcccgccccuggggggccagcagagccagcccuccgccggggacggcaaccagaacgacggcccccagcaggggccgccccagcagggcgggcagcagcagcagggcccccccccgccccaggggaagccccagggccccccgcagcagggcgggcaccccccccccccgcagggccggccccaggggcccccccagcagggcggccacccgcgccccccccgggggcgcccccagggcccgccccagcaggggggccaccagcaggggccccccccgccccccccgggcaagccccagggcccccccccgcaggggggccggccccaggggcccccccagggccagagcccgcaguga

SEQ ID NO: 35032 - RNA, 2496 nt, Artificial Sequence
  derived and/or modified sequence opt1 from PRICKLE1__Homo_sapiens__NP_001138354
augccccuggagauggagcccaagaugagcaagcucgccuucggcugccagcgcuccagcaccuccgacgacgacagcgggugcgcccuggaggaguacgcgugggugccgcccggccugcggcccgagcagauccagcucuacuucgccugccugcccgaggagaagguccccuacgugaacucccccggggagaagcaccgcaucaagcagcugcucuaccagcugcccccgcacgacaacgaggugcgguacugccagagccuguccgaggaggagaagaaggagcuccaggucuucagcgcccagcgcaagaaggaggcccugggccgggggaccaucaagcugcucucccgcgccgugaugcacgcggugugcgagcagugcggccugaagaucaacggcggggaggucgccguguucgccagccgggccggccccggggugugcuggcaccccuccugcuucgucugcuucacgugcaacgagcugcucguggaccugaucuacuucuaccaggacggcaagauccacugcgggcgccaccacgcggagcugcucaagccccggugcagcgccugcgacgagaucaucuucgccgacgagugcaccgaggccgagggccgccacuggcacaugaagcacuucugcugccuggagugcgagaccgugcugggcgggcagcgguacaucaugaaggacggccgcccguucugcugcgggugcuucgagucccucuacgccgaguacugcgagaccugcggcgagcacaucggcgucgaccacgcgcagaugacguacgacgggcagcacuggcacgccaccgaggccugcuucagcugcgcccagugcaaggccucccugcugggcugccccuuccuccccaagcaggggcagaucuacugcagcaagaccugcucccugggcgaggacgugcacgcgagcgacuccagcgacagcgccuuccaguccgcccggagccgcgacucccggcgcagcgugcggauggggaaguccagccgcuccgccgaccagugccggcagagccugcuccugucccccgcccugaacuacaaguucccgggccucagcggcaacgcggacgacacccugucccgcaagcuggacgaccucagccugucccggcaggggacgagcuucgccuccgaggaguucuggaagggccgcgucgagcaggagacccccgaggaccccgaggagugggccgaccacgaggacuacaugacccagcugcuccugaaguucggggacaagagccuguuccagccccagccgaacgagauggacauccgcgccuccgagcacuggaucagcgacaacauggugaaguccaagaccgagcucaagcagaacaaccagagccuggccagcaagaaguaccaguccgacauguacugggcgcagagccaggacggccugggggacuccgccuacggcagccaccccggccccgccuccagccggcgccuccaggagcuggagcuggaccacggggccuccggcuacaaccacgacgagacgcagugguacgaggacagccucgagugccuguccgaccugaagcccgagcagagcgugcgggacuccauggacagccucgcgcuguccaacaucaccggggccagcgucgacggcgagaacaagccgcgccccucccuguacagccugcagaacuucgaggagauggagaccgaggacugcgagaagauguccaacauggggacccucaacagcagcaugcugcaccgguccgccgagagccugaagucccucagcuccgagcugugccccgagaagauccugcccgaggagaagccggugcaccuccccgugcugcgccggagcaagucccagagccgcccccagcaggucaaguucuccgacgacgugaucgacaacggcaacuacgacaucgagauccggcagccgcccaugagcgagcgcacgcggcgccggguguacaacuucgaggagcgcggcucccggagccaccaccaccgccggcgccggucccgcaagagccgcuccgacaacgcccugaaccucgucaccgagcggaaguacagccccaaggaccgccugcggcuguacacccccgacaacuacgagaaguucauccagaacaaguccgcccgcgagauccaggcguacauccagaacgccgaccucuacgggcaguacgcccacgccaccagcgacuacggccugcagaacccggggaugaaccgguuccugggccucuacggcgaggacgacgacuccuggugcagcagcuccagcuccagcuccgacagcgaggaggagggguacuuccugggccagcccaucccccagccccgcccgcagcgguucgccuacuacacggacgaccuguccagcccgcccuccgcgcuccccaccccgcaguucgggcagcgcaccaccaagagcaagaagaagaagggccacaaggggaagaacugcaucaucuccuga

SEQ ID NO: 35033 - RNA, 2535 nt, Artificial Sequence
  derived and/or modified sequence opt1 from PRICKLE2__Homo_sapiens__NP_942559
auggugaccgucaugccccuggagauggagaagaccaucagcaagcucauguucgacuuccagcgcaacuccacgagcgacgacgacuccggcugcgcccuggaggaguacgccugggugccgcccgggcugaagcccgagcagguccaccaguacuacagcugccuccccgaggagaaggugccguacgugaacucccccggcgagaagcugcggaucaagcagcugcuccaccagcugccgccccacgacaacgaggugcgcuacugcaacagccuggacgaggaggagaagcgggagcucaagcuguucuccagccagcgcaagcgggagaaccuggggcgcggcaacguccggcccuuccccgugaccaugaccggggcgaucugcgagcagugcggcggccagaucaacgggggcgacaucgccguguucgccucccgcgccgggcacggcgucugcuggcacccgcccugcuucgugugcaccgugugcaacgagcuccuggucgaccugaucuacuucuaccaggacgggaagaucuacugcggccggcaccacgccgagugccucaagccccgcugcgcggccugcgacgagaucaucuucgccgacgagugcacggaggccgagggccggcacuggcacaugaagcacuucugcugcuucgagugcgagaccgugcucgggggccagcgcuacaucaugaaggaggggcggcccuacugcugccacugcuucgagagccuguacgcggaguacugcgacacgugcgcccagcacaucggcaucgaccagggccagaugaccuacgacgggcagcacuggcacgccaccgagaccugcuucugcugcgcccacugcaagaagucccugcugggccgccccuuccugcccaagcaggggcagaucuucugcagccgggccugcuccgcgggcgaggacccgaacgggagcgacuccagcgacuccgccuuccagaacgcccgcgccaaggagagccggcgcuccgccaagaucggcaagaacaagggcaagaccgaggagcccaugcucaaccagcacagccagcuccaggugagcuccaaccggcugagcgcggacgucgacccccugucccugcagauggacaugcugagccucuccagccagacccccucccugaaccgcgacccgaucuggcggagccgcgaggagcccuaccacuacgggaacaagauggagcagaaccagacgcagagcccccugcagcuccugagccagugcaacauccgcaccuccuacagccccggcgggcagggcgccggggcccagccggagauguggggcaagcacuucuccaaccccaagcggagcuccagccuggccaugaccggccacgccggguccuucaucaaggagugccgcgaggacuacuaccccggccggcuccgcagccaggaguccuacagcgacaugagcucccagagcuucuccgagacccgggggagcauccaggugcccaaguacgaggaggaggaggaggaggagggcgggcuguccacgcagcagugccgcacccggcacccgaucagcucccugaaguacaccgaggacaugacccccacggagcagacgccccgcggcagcauggagucccucgcgcugagcaacgccaccggccuguccgccgacgggggcgccaagcggcaggagcaccucagccgcuucuccaugccggaccugagcaaggacuccgggaugaacgugagcgagaagcuguccaacaugggcacccucaacagcagcaugcaguuccgguccgccgagagcguccgcucccugcugagcgcgcagcaguaccaggagauggagggcaaccuccaccagcuguccaaccccaucggguaccgggaccugcagagccacggccgcaugcaccaguccuucgacuucgacgggggcauggccgggagcaagcuccccggccaggagggcgugcggauccagcccauguccgagcgcacccggcgccgggccaccagccgcgacgacaaccgccgguuccgcccgcaccggucccgccggagccgccggucccgcagcgacaacgcccugcaccuggcguccgagcgggaggccaucagccgccugaaggaccggccgccccuccgcgcccgggaggacuacgaccaguucaugcgccagcgguccuuccaggagagcauggggcacggcucccgccgggaccuguacgggcagugcccccgcaccgugagcgaccuggcccuccagaacgccuucggcgaccggugggggcccuacuucgcggaguacgacuggugcagcacgugcuccagcuccagcgaguccgacaacgagggcuacuuccugggcgagcccaucccccagcccgcccgccugcgguacgucaccagcgacgagcuccugcacaaguacuccagcuacgggcugccgaaguccagcacccucggcgggcgcggccagcugcacucccgcaagcggcagaaguccaagaacugcaucaucuccuga

SEQ ID NO: 35034 - RNA, 1155 nt, Artificial Sequence
  derived and/or modified sequence opt1 from PRICKLE4__Homo_sapiens__NP_037529
augagcgugcagaacuccggcuggccccaccaggaggacagcccgaagccccaggaccccgggcccccggccaacuccgacagcgacuccggccaccuccccggggaggaccccgaggacacccacgcccagggccccgcgguccugagccuggggucccugugccucgacaccaaccaggccccgaacuggacgggccugcagacccugcuccagcagcugccgccccaggacaucgacgagcgcuacugccuggcccucggcgaggaggagcgggccgagcugcagcuguucugcgcccgccggaagcaggaggcgcucgggcagggcguggcccgccuggugcugcccaagcucgaggggcacacgugcgagaagugccgggagcugcugaagcccggcgaguacggggucuucgccgcccgcgcgggcgagcagcggugcuggcaccagcccugcuucgccugccaggccugcggccaggcccucaucaaccugaucuacuucuaccacgacgggcagcuguacugcggccgccaccacgccgagcuccugcggccccgcugccccgcgugcgaccagcugaucuucagcuggcggugcaccgaggccgaggggcagcgcuggcacgagaaccacuucugcugccaggacugcgccggcccgcucggcgggggccgguacgcccugcccgggggcucccccugcugccccagcugcuucgagaaccgcuacuccgacgccgggagcuccugggcgggcgcccuggagggccaggccuuccucggggagaccggccuggaccggaccgaggggcgcgaccagaccagcgugaacuccgccacccugagccggacgcuccuggccgcggccggcggguccagccugcagacccagcgcggccucccgggcuccagcccccagcaggagaaccggcccggggacaaggccgaggcccccaagggccaggagcagugccgccuggagaccauccgggacccgaaggacacccccuucagcacgugcuccagcuccagcgacuccgagcccgagggguucuuccugggcgagcgccucccccagagcuggaagaccccggggucccugcaggccgaggacagcaacgcguccaagacccacugcaccaugugcuga

SEQ ID NO: 35035 - RNA, 1263 nt, Artificial Sequence
  derived and/or modified sequence opt1 from PRIM1__Homo_sapiens__NP_000937
auggagaccuucgaccccaccgagcugccggagcuccugaagcuguacuaccgccggcuguuccccuacagccaguacuaccgcuggcugaacuacggcggggugaucaagaacuacuuccagcaccgggaguucagcuucacgcugaaggacgacaucuacauccgcuaccagagcuucaacaaccaguccgaccucgagaaggagaugcagaagaugaaccccuacaagaucgacaucggcgccgucuacagccaccggcccaaccagcacaacaccgugaagcugggggccuuccaggcgcaggagaaggagcugguguucgacaucgacaugaccgacuacgacgacguccgccggugcugcuccagcgccgacaucugcccgaagugcuggacccucaugacgauggccauccgcaucaucgaccgggcccugaaggaggacuucggcuucaagcaccgccuguggguguacuccgggcggcgcggcgugcacugcugggucugcgacgagagcgugcggaagcucuccagcgccgugcgcuccggcaucgucgaguaccugagccuggugaagggcgggcaggacgugaagaagaagguccaccucuccgagaagauccaccccuucauccgcaagagcaucaacaucaucaagaaguacuucgaggaguacgcgcuggugaaccaggacauccuggagaacaaggaguccugggacaagauccucgcccuggugcccgagaccauccacgacgagcugcagcagagcuuccagaagucccacaacagccuccagcggugggagcaccugaagaaggucgccucccgguaccagaacaacaucaagaacgacaaguacgggcccuggcuggagugggagaucaugcuccaguacugcuucccgcgccuggacaucaacgugagcaagggcaucaaccaccuccucaagagccccuucuccgugcaccccaagaccgggcggaucagcguccccaucgaccugcagaagguggaccaguucgacccguucaccgugcccacgaucuccuucaucugccgcgagcuggacgccaucagcaccaacgaggaggagaaggaggagaacgaggcggaguccgacgucaagcaccggacccgcgacuacaagaagaccagccucgcccccuacgugaagguguucgagcacuuccuggagaaccuggacaagucccgcaagggcgagcuccugaagaaguccgaccugcagaaggacuucuga

SEQ ID NO: 35036 - RNA, 462 nt, Artificial Sequence
  derived and/or modified sequence opt1 from PRIMA1__Homo_sapiens__XP_011544946
augcugcuccgcgaccuggugcugcggcgcggcugcugcuggagcucccuccugcugcacugcgcccuccacccccuguggggguucguccaggugacccacggcgagccgcagaagagcugcuccaaggugaccgacagcugccggcacgucugccagugccgccccccccccccgcugcccccccccccgcccccccccccgcccccccggcuccuguccgcccccgcgccgaacagcacguccugccccaccgaggagagcuggugguccgggcuggugaucaucaucgccgugugcugcgccagccucgucuuccugaccgugcuggugaucaucugcuacaaggccaucaagcgcaagccccuccggaaggacgagaacggcaccuccgucgccgaguaccccaugagcgcgucccagagcaacaaggggguggacgugaacaacgccgucguguga

SEQ ID NO: 35037 - RNA, 1683 nt, Artificial Sequence
  derived and/or modified sequence opt1 from PRIMPOL__Homo_sapiens__NP_689896
augaaccgcaagugggaggccaagcugaagcagaucgaggagcgggccagccacuacgagcgcaagccccucuccagcguguaccggccgcgccuguccaagcccgaggagccgcccagcaucuggcggcuguuccaccgccaggcgcaggccuucaacuucgucaaguccugcaaggaggacgugcacguguucgcccucgagugcaaggucggcgacgggcagcggaucuaccuggugaccaccuacgccgaguucugguucuacuacaagagccgcaagaaccugcuccacugcuacgaggugauccccgagaacgccgucugcaagcuguacuucgaccuggaguucaacaagcccgcgaaccccggcgccgacgggaagaagaugguggcccuccugaucgaguacgugugcaaggcccugcaggagcucuacggcgucaacugcuccgcggaggacgugcugaaccuggacagcuccacggacgagaaguucagccggcaccucaucuuccagcugcacgacguggccuucaaggacaacauccacgucgggaacuuccugcgcaagauccuccagcccgcccuggaccugcucggcuccgaggacgacgacagcgccccggagaccaccggccacggguucccccacuucuccgaggcccccgcgcggcagggcuucagcuucaacaagauguucaccgagaaggccacggaggaguccuggaccagcaacuccaagaagcuggagcgccuggggagcgccgagcaguccagccccgaccucagcuuccugguggugaagaacaacaugggcgagaagcaccuguucgucgaccucgggguguacacccggaaccgcaacuuccggcuguacaaguccagcaagaucggcaagcgcguggcccuggaggucaccgaggacaacaaguucuucccgauccaguccaaggacgugagcgacgaguaccaguacuuccucuccagccugguguccaacguccgguucagcgacacgcugcgcauccugaccugcgagcccucccagaacaagcagaagggcgugggguacuucaacagcaucggcaccuccguggagaccaucgagggguuccagugcagccccuaccccgaggucgaccacuucgugcugucccuggucaacaaggacggcaucaagggcgggauccggcgcuggaacuacuucuucccggaggagcuccugguguacgacaucugcaaguaccgguggugcgagaacaucggccgcgcccacaagagcaacaacaucaugauccugguggaccucaagaacgaggucugguaccagaagugccacgaccccgugugcaaggcggagaacuucaaguccgacugcuucccccugcccgccgaggugugccuccucuuccuguucaaggaggaggaggaguucacgaccgacgaggccgacgagacccgcagcaacgagacccagaacccgcacaagcccucccccagccggcuguccacgggggccagcgccgacgcggucugggacaacggcaucgacgacgccuacuuccucgaggccaccgaggacgccgagcuggccgaggcggccgagaacagccugcucuccuacaacagcgagguggacgagauccccgacgagcugaucaucgaggugcugcaggaguga

SEQ ID NO: 35038 - RNA, 1680 nt, Artificial Sequence
  derived and/or modified sequence opt1 from PRKAA1__Homo_sapiens__NP_006242
augcgccggcugagcuccuggcgcaagauggccaccgccgagaagcagaagcacgacggccgggugaagaucgggcacuacauccucggcgacacccugggggucggcaccuucgggaaggugaaggugggcaagcacgagcugaccggccacaaggucgcggugaagauccucaaccgccagaagauccggagccuggacguggucgggaagauccgccgggagauccagaaccugaagcuguuccgccacccccacaucaucaagcuguaccaggugaucuccaccccgagcgacaucuucauggugauggaguacgucuccggcggggagcuguucgacuacaucugcaagaacggccggcucgacgagaaggagagccgccggcuguuccagcagauccuguccgggguggacuacugccaccgccacauggugguccaccgggaccucaagcccgagaacgugcugcuggacgcccacaugaacgccaagaucgccgacuucggccucagcaacaugauguccgacggcgaguuccugcgcaccagcugcgggucccccaacuacgccgcgcccgaggugaucagcggccggcuguacgccgggccggaggucgacaucugguccagcggcgugauccucuacgcccugcugugcggcacgcuccccuucgacgacgaccacgugcccacccuguucaagaagaucugcgacgggaucuucuacacgccccaguaccugaacccguccgucaucagccuccugaagcacaugcuccagguggaccccaugaagcgcgccaccaucaaggacauccgggagcacgagugguucaagcaggaccuccccaaguaccuguuccccgaggacccguccuacagcuccaccaugaucgacgacgaggcgcugaaggaggugugcgagaaguucgagugcagcgaggaggagguccucagcugccuguacaaccgcaaccaccaggacccccuggccguggccuaccaccucaucaucgacaaccggcgcaucaugaacgaggccaaggacuucuaccuggccaccuccccgcccgacagcuuccuggacgaccaccaccucacccggccccaccccgagcgcgugcccuuccuggucgcggagacgccccgcgcccggcacacccuggacgagcucaacccgcagaaguccaagcaccagggcgugcgcaaggccaaguggcaccuggggauccggagccagucccgccccaacgacaucauggccgaggucugccgggccaucaagcagcuggacuacgaguggaagguggugaaccccuacuaccuccgcguccggcgcaagaaccccgugaccagcaccuacuccaagaugagccugcagcuguaccagguggacucccggaccuaccuccuggacuuccgcagcaucgacgacgagaucacggaggcgaaguccggcaccgccaccccgcagcggagcggguccgucagcaacuaccgcuccugccagcggagcgacuccgacgccgaggcccagggcaagagcuccgaggugagccugaccagcuccgugacgagccucgacuccagccccgucgaccugacgccccgccccggcucccacaccaucgaguucuucgagaugugcgccaaccugaucaagauccuggcgcaguga

SEQ ID NO: 35039 - RNA, 813 nt, Artificial Sequence
  derived and/or modified sequence opt1 from PRKAB1__Homo_sapiens__XP_005253966
augggcaacaccagcuccgagcgcgccgcccuggagcggcacgggggccacaagacgccccgccgggacagcuccgggggcaccaaggacggggaccgcccgaagauccucauggacagccccgaggacgcggaccuguuccacuccgaggagaucaaggcccccgagaaggaggaguuccuggccuggcagcacgaccucgaggugaacgacaaggcccccgcccaggcgcggccgaccgucuuccgcuggaccggcggcgggaaggagguguaccugagcggcuccuucaacaacuggagcaagcugccccucacccggucccacaacaacuucguggccauccuggaccugcccgagggggagcaccaguacaaguucuucgucgacggccaguggacgcacgaccccagcgagccgaucgugaccucccagcucgggaccgugaacaacaucauccaggucaagaagaccgacuucgagguguucgacgcccugaugguggacagccagaagugcuccgacgucagcgagcuguccagcuccccgcccggccccuaccaccaggagcccuacgugugcaagcccgaggagcgcuuccgggccccgcccauccucccgccccaccuccuccaggugauccugaacaaggacacgggcaucagcugcgaccccgcgcugcugcccgagcccaaccacgucaugcugaaccaccuguacgcccuguccaucaaggacggggugauggugcucagcgccacccaccgcuacaagaagaaguacgucaccacccugcuguacaagcccaucuga

SEQ ID NO: 35040 - RNA, 1056 nt, Artificial Sequence
  derived and/or modified sequence opt1 from PRKACA__Homo_sapiens__NP_002721
augggcaacgccgccgcggccaagaaggggagcgagcaggaguccgugaaggaguuccuggccaaggccaaggaggacuuccucaagaagugggagagccccgcccagaacaccgcgcaccuggaccaguucgagcgcaucaagacccugggcacgggguccuucggccgggucaugcucgugaagcacaaggagaccgggaaccacuacgccaugaagauccuggacaagcagaagguggucaagcugaagcagaucgagcacacccucaacgagaagcgcauccugcaggccgugaacuucccguuccuggugaagcucgaguucagcuucaaggacaacuccaaccuguacauggucauggaguacgugcccggcggcgagauguucagccaccuccggcgcaucgggcgguucuccgagccccacgcccgcuucuacgcggcccagaucgugcugaccuucgaguaccugcacagccuggaccucaucuaccgggaccugaagcccgagaaccugcucaucgaccagcagggcuacauccaggucacggacuucggguucgccaagcgcgugaagggccggaccuggacccugugcgggaccccggaguaccuggcccccgagaucauccucuccaagggcuacaacaaggccguggacuggugggcgcugggcguccugaucuacgagauggccgccggguacccgcccuucuucgccgaccagcccauccagaucuacgagaagaucgugagcggcaaggugcgcuuccccucccacuucagcuccgaccucaaggaccugcugcggaaccuccugcaggucgaccugacgaagcgcuucgggaaccucaagaacggcgugaacgacaucaagaaccacaagugguucgccaccaccgacuggaucgcgaucuaccagcggaagguggaggcccccuucauccccaaguucaagggcccgggggacaccagcaacuucgacgacuacgaggaggaggagauccgcgucuccaucaacgagaagugcggcaaggaguucagcgaguucuga

SEQ ID NO: 35041 - RNA, 795 nt, Artificial Sequence
  derived and/or modified sequence opt1 from PRKACB__Homo_sapiens__NP_001287844
augagcgcccgcaaguccagcgacgccuccgcgugcagcuccagcgagaucuccgacagcuucgugaaggaguuccuggccaaggccaaggaggacuuccucaagaagugggagaaccccacccagaacaacgccggccuggaggacuucgagcggaagaagacccuggggacgggcuccuucgggcgcgucaugcucgugaagcacaaggccaccgagcaguacuacgcgaugaagauccuggacaagcagaagguggucaagcugaagcagaucgagcacacccucaacgagaagcggauccugcaggccgugaacuucccguuccuggugcgccucgaguacgccuucaaggacaacagcaaccuguacauggucauggaguacgugcccggcggggagauguucucccaccuccggcgcaucggccgguucagcgagccccacgcccgcuucuacgcggcccagaucgugcugaccuucgaguaccugcacucccuggaccucaucuaccgggaccugaagcccgagaaccugcucaucgaccaccagggcuacauccaggucacggacuucggguucgccaagcgcgugaagggccggaccuggacccugugcgggaccccggaguaccuggcccccgagaucauccucagcaagggcuacaacaaggccguggacuggugggcgcuggggguccugaucuacgagauggccgccggcuacccgcccuucuucgccgaccagcccauccagaucuacgagaagaucguguccggcaagcagaacuucuga

SEQ ID NO: 35042 - RNA, 1056 nt, Artificial Sequence
  derived and/or modified sequence opt1 from PRKACG__Homo_sapiens__NP_002723
augggcaacgcccccgccaagaaggacaccgagcaggaggagagcgugaacgaguuccuggcgaaggcccgcggggacuuccucuaccgguggggcaacccggcccagaacaccgccuccagcgaccaguucgagcgccugcggacgcuggggaugggcuccuucgggcgcgucaugcucgugcggcaccaggagaccggcggccacuacgccaugaagauccugaacaagcagaagguggucaagaugaagcaggucgagcacauccugaacgagaagcgcauccuccaggcgaucgacuuccccuuccuggugaagcugcaguucagcuucaaggacaacuccuaccucuaccuggugauggaguacgugcccgggggcgagauguucagccggcugcagcgcguggggcgguucuccgagccccacgccugcuucuacgccgcccaggucgugcucgcggugcaguaccugcacagccuggaccucauccaccgcgaccugaagccggagaaccugcucaucgaccagcagggcuaccugcaggucaccgacuucggguucgccaagcgggugaagggccgcaccuggacgcugugcggcacccccgaguaccucgcccccgagaucauccuguccaagggguacaacaaggccguggacuggugggcccugggcguccucaucuacgagauggcggugggguucccgcccuucuacgccgaccagcccauccagaucuacgagaagaucgugagcggccggguccgcuuccccuccaagcugagcuccgaccugaagcaccuccugcggagccugcuccagguggaccugaccaagcgcuucggcaaccugcggaacggggugggcgacaucaagaaccacaagugguucgccaccacguccuggaucgccaucuacgagaagaaggucgaggcccccuucaucccgaaguacaccgggcccggcgacgcgagcaacuucgacgacuacgaggaggaggagcuccgcaucuccaucaacgagaagugcgccaaggaguucagcgaguucuga

SEQ ID NO: 35043 - RNA, 1023 nt, Artificial Sequence
  derived and/or modified sequence opt1 from PRKAG1__Homo_sapiens__NP_001193638
auggagaccgugaucagcuccgacagcucccccgccgucgagaacgagcacccgcaggagacccccgagagcaacaacuccguguacacgagcuucaugaagucccaccgcugcuacgaccugauccccaccagcuccaagcucguggucuucgacaccagccuccaggugaagaaggccuucuucgcgcuggugaccaacggcguccgggccgcgccccugugggacuccaagaagcagagcuucguggugcugcgcgcccuguccugcccgcucgggaugcugacgaucaccgacuucaucaacauccugcaccgguacuacaagagcgcccucguccagaucuacgagcuggaggagcacaagaucgagaccuggcgcgagguguaccugcaggacuccuucaagccccucgugugcaucagccccaacgccucccuguucgacgccgucagcucccugauccggaacaagauccaccgccuccccgugaucgacccggagagcggcaacacccuguacauccugacgcacaagcggauccucaaguuccugaagcuguucaucaccgaguuccccaagcccgaguucaugagcaagucccucgaggagcugcagaucgggaccuacgccaacaucgccauggugcgcaccacgacccccgucuacguggcgcugggcaucuucgugcagcaccgggucagcgcccucccggugguggacgagaaggggcgcgucguggacaucuacuccaaguucgacgugaucaaccuggccgccgagaagaccuacaacaaccuggacgucagcgugaccaaggcccuccagcaccggucccacuacuucgagggcguccugaagugcuaccugcacgagacgcucgagaccaucaucaaccgccugguggaggcggaggugcaccggcuggucgugguggacgagaacgacgucgugaagggcaucgugagccucuccgacauccugcaggcccugguccucaccgggggcgagaagaagcccuga

SEQ ID NO: 35044 - RNA, 1578 nt, Artificial Sequence
  derived and/or modified sequence opt1 from PRKAG2__Homo_sapiens__NP_001035723
augccccugcucgacggcgaccuggaggggagcggcaagcacuccagccgcaagguggacuccccguucgggcccggcagccccuccaagggguucuucagccggggcccccagccgcgccccuccagccccauguccgcccccguccggccgaagaccagccccggcucccccaagaccguguuccccuucagcuaccaggaguccccgccccgcagcccccggcgcauguccuucagcgggaucuuccgguccagcuccaaggagagcagccccaacuccaacccggccacgagccccggcgggauccgcuucuucucccggagccgcaagaccuccggccugagcuccagccccuccacccccacccaggugacgaagcagcacaccuucccgcucgagagcuacaagcacgagcccgagcggcuggagaaccgcaucuacgcguccagcuccccgcccgacaccgggcagcgguucugccccagcuccuuccagagccccacccgcccgccccuggccucccccacgcacuacgcccccagcaaggccgccgcgcucgccgccgcccugggccccgcggaggccggcaugcuggagaagcucgaguucgaggacgaggccgucgaggacuccgagagcgggguguacaugcgguucaugcgcagccacaagugcuacgacaucgugccgaccuccagcaagcuggucguguucgacaccacccuccaggugaagaaggccuucuucgcccucgucgcgaacggcgugcgggccgcgccccugugggaguccaagaagcagagcuucguggggaugcugacgaucaccgacuucaucaacauccuccaccgcuacuacaagucccccaugguccagaucuacgagcuggaggagcacaagaucgagaccuggcgggagcuguaccuccaggagaccuucaagccccuggugaacaucagcccggacgccucccuguucgacgccguguacagccucaucaagaacaagauccaccgccugcccgucaucgaccccaucuccggcaacgcccuguacauccucacgcacaagcggauccugaaguuccugcagcuguucaugagcgacaugcccaagccggccuucaugaagcagaaccuggacgagcugggcaucgggaccuaccacaacaucgccuucauccaccccgacacccccaucaucaaggcccucaacaucuucguggagcgccgcaucuccgcccugcccguggucgacgagagcggcaaggugguggacaucuacuccaaguucgacgucaucaaccuggcggccgagaagaccuacaacaaccucgacaucacggugacccaggcccugcagcaccggagccaguacuucgaggggguggucaagugcaacaagcuggagauccucgagaccaucguggaccgcaucguccgggccgaggugcaccgccugguggucgugaacgaggccgacuccaucgugggcaucaucagccuguccgacauccuccaggcgcugauccugaccccggccggggccaagcagaaggagacggagaccgaguga

SEQ ID NO: 35045 - RNA, 1470 nt, Artificial Sequence
  derived and/or modified sequence opt1 from PRKAG3__Homo_sapiens__NP_059127
auggagcccggccuggagcacgcccuccgccggaccccgagcugguccagccucgggggcuccgagcaccaggagaugagcuuccuggagcaggagaacuccagcuccuggcccagccccgccgugaccuccagcuccgagcgcauccgggggaagcgccgggcgaaggcccugcgcuggacgcggcagaaguccgucgaggagggcgagcccccggggcagggcgagggcccccgcucccggcccgccgccgagagcaccgggcuggaggccaccuuccccaagaccacgccgcuggcgcaggccgaccccgccggcguggggaccccgcccaccggcugggacugccuccccuccgacugcaccgccagcgcggccggguccagcacggacgacguggagcuggccaccgaguuccccgccaccgaggccugggagugcgagcuggagggccuccuggaggagcgccccgcgcugugccucagcccccaggccccguuccccaagcugggcugggacgacgagcugcggaagcccggggcccagaucuacaugcgcuucaugcaggagcacacgugcuacgacgccauggccaccagcagcaagcucgucaucuucgacaccaugcuggagaucaagaaggcguucuucgcccugguggccaacggcgugcgggccgcgccccucugggacuccaagaagcagagcuucgucgggaugcugaccaucaccgacuucauccuggugcuccaccgcuacuaccgguccccgcuggugcagaucuacgagaucgagcagcacaagaucgagacguggcgcgagaucuaccugcagggcugcuucaagccccucgucagcaucucccccaacgacagccuguucgaggccguguacacccugaucaagaaccggauccaccgccuccccgugcuggacccggucuccggcaacgugcugcacauccucacccacaagcggcugcugaaguuccuccacaucuucgggagccugcugccccgccccuccuuccucuaccggaccauccaggaccugggcaucgggacguuccgcgaccuggccgugguccucgagaccgcccccauccugaccgcccuggacaucuucguggaccgccgggugagcgcccucccggucgugaacgagugcggccagguggucgggcuguacucccgcuucgacgugauccaccuggcggcccagcagaccuacaaccaccucgacaugagcgugggcgaggcccugcggcagcgcacgcugugccucgagggcguccuguccugccagccccacgagagccugggggaggugaucgaccggaucgcccgcgagcagguccaccggcuggugcucguggacgagacccagcaccuccugggcgucgugucccugagcgacauccugcaggcgcuggugcucucccccgccgggaucgacgcccugggcgccuga

SEQ ID NO: 35046 - RNA, 1146 nt, Artificial Sequence
  derived and/or modified sequence opt1 from PRKAR1A__Homo_sapiens__NP_001263218
auggagagcggcuccaccgccgccagcgaggaggcgcgcucccugcgggagugcgagcucuacgugcagaagcacaacauccaggcccugcugaaggacagcaucguccagcucugcaccgcccgccccgagcggccgauggccuuccugcgcgaguacuucgagcggcuggagaaggaggaggccaagcagauccagaaccuccagaaggcggggacgcgcaccgacucccgggaggacgagaucagcccgcccccgcccaaccccguggugaagggccgccggcgccgcggggccaucuccgccgaggucuacaccgaggaggacgccgcgagcuacgugcggaaggugauccccaaggacuacaagaccauggccgcccuggccaaggccaucgagaagaacguccuguucucccaccucgacgacaacgagcggagcgacaucuucgacgcgauguucuccgugagcuucaucgccggcgagacggugauccagcagggggacgagggcgacaacuucuacgucaucgaccagggcgagaccgacguguacgugaacaacgagugggccaccuccgucggggagggcgggagcuucggcgagcuggcccugaucuacgggacgccccgcgccgcgaccgugaaggccaagaccaacgugaagcucuggggcaucgaccgggacuccuaccgccggauccugaugggcagcacccugcgcaagcggaagauguacgaggaguuccucuccaaggucagcauccuggagucccuggacaagugggagcgccucaccguggccgacgcccuggagcccgugcaguucgaggacgggcagaagaucgucgugcagggcgagcccggggacgaguucuucaucauccuggagggcagcgccgcggugcuccagcggcgcagcgagaacgaggaguucgucgaggugggccgccuggggcccuccgacuacuucggcgagaucgcccugcucaugaaccggccccgcgccgccacgguggucgcccgggggccgcugaagugcgugaagcuggaccgcccccgguucgagcgcguccucggccccugcagcgacauccugaagcggaacauccagcaguacaacuccuucgugagccuguccguguga

SEQ ID NO: 35047 - RNA, 1146 nt, Artificial Sequence
  derived and/or modified sequence opt1 from PRKAR1B__Homo_sapiens__NP_002726
auggccagcccgcccgccugccccuccgaggaggacgagagccugaagggcugcgagcucuacgugcagcugcacgggauccagcagguccugaaggacugcaucgugcaccucugcaucuccaagcccgagcgccccaugaaguuccugcgggagcacuucgagaagcuggagaaggaggagaaccgccagauccucgcgcggcagaaguccaacagccagagcgacucccacgacgaggaggugagcccgaccccgcccaaccccgucgugaaggcccgccggcgccggggcgggguguccgccgaggucuacaccgaggaggacgccgugagcuacgugcgcaaggucauccccaaggacuacaagacgaugaccgcccuggcgaaggccaucuccaagaacgugcuguucgcccaccucgacgacaacgagcggagcgacaucuucgacgccauguuccccgugacccacaucgcgggcgagaccgucauccagcaggggaacgagggcgacaacuucuacgugguggaccagggcgaggucgacguguacgugaacggggagugggucacgaacaucuccgagggcgggagcuucggcgagcuggcccugaucuacgggacgccccgcgccgccaccgugaaggccaagaccgaccucaagcuguggggcaucgaccgggacuccuaccgccggauccugaugggcagcacccuccgcaagcggaagauguacgaggaguuccuguccaaggugagcauccuggagucccucgagaagugggagcgccugaccgucgcggacgcccuggagcccgugcaguucgaggacggggagaagaucgugguccagggcgagccgggggacgacuucuacaucaucaccgagggcaccgccagcgugcuccagcggcgcagccccaacgaggaguacgucgaggugggccggcuggggcccuccgacuacuucggcgagaucgcccugcuccugaaccgcccccgggccgcgacgguggucgcccgcgggccgcugaagugcgugaagcucgaccgcccccgguucgagcgcgugcugggccccugcagcgagauccugaagcggaacauccagcgcuacaacuccuucaucagccucaccgucuga

SEQ ID NO: 35048 - RNA, 1215 nt, Artificial Sequence
  derived and/or modified sequence opt1 from PRKAR2A__Homo_sapiens__NP_004148
augagccacauccagaucccgcccggccugaccgagcuccugcagggguacaccguggagguccugcgccagcagccgcccgaccucguggaguucgccguggaguacuucacgcggcugcgcgaggcccgggcgcccgccuccguccugcccgccgccacgccccgccagagccucggccacccgccgcccgagcccgggcccgaccggguggccgacgcgaagggcgacuccgagagcgaggaggacgaggaccuggaggugcccguccccucccgcuucaaccggcgcgugagcgugugcgccgagaccuacaaccccgacgaggaggaggaggacaccgacccccgggucauccaccccaagaccgacgagcagcgcugccggcugcaggaggccugcaaggacauccuccuguucaagaaccuggaccaggagcagcucucccaggugcuggacgccauguucgagcgcaucgugaaggcggacgagcacgucaucgaccagggggacgacggcgacaacuucuacgugaucgagcggggcaccuacgacauccuggugaccaaggacaaccagacccgcagcgucgggcaguacgacaaccggggcuccuucggggagcucgcccugauguacaacacgccgcgcgccgccaccaucguggccaccagcgagggcucccugugggggcucgaccgggugaccuuccgccggaucaucgucaagaacaacgcgaagaagcgcaagauguucgagagcuucaucgaguccgugccccugcucaagagccuggagguguccgagcggaugaagaucgucgacgugaucggcgagaagaucuacaaggacggcgagcgcaucaucacgcagggggagaaggccgacagcuucuacaucaucgaguccggcgaggugagcauccugauccgcucccggaccaagagcaacaaggacgggggcaaccaggaggucgagaucgcccgcugccacaagggccaguacuucggggagcuggcccucgugaccaacaagccccgggccgcgagcgccuacgccgucggcgacgugaagugccuggugauggacguccaggccuucgagcgccugcucgggcccugcauggacaucaugaagcggaacaucucccacuacgaggagcagcuggugaagauguucggcagcuccguggaccuggggaaccucggccaguga

SEQ ID NO: 35049 - RNA, 1257 nt, Artificial Sequence
  derived and/or modified sequence opt1 from PRKAR2B__Homo_sapiens__NP_002727
augagcaucgagauccccgccggccugaccgagcuccugcagggguucaccguggagguccugcgccaccagccggccgaccuccuggaguucgcgcugcagcacuucacgcggcuccagcaggagaacgagcgcaagggcaccgcccgguucgggcacgagggccgcaccuggggcgaccugggggccgccgccggcgggggcacccccuccaagggggugaacuucgcggaggagcccaugcagagcgacuccgaggacggcgaggaggaggaggccgcccccgccgacgcgggggccuucaacgccccggugaucaaccgguucacgcgccgggccagcgucugcgccgaggcguacaaccccgacgaggaggaggacgacgccgagucccgcaucauccaccccaagaccgacgaccagcggaaccgccugcaggaggccugcaaggacauccuccuguucaagaaccuggaccccgagcagaugagccaggugcucgacgccauguucgagaagcuggugaaggacggcgagcacgucaucgaccagggcgacgacggggacaacuucuacgugaucgaccggggcaccuucgacaucuacgugaagugcgacggggucggccgcugcgugggcaacuacgacaaccggggguccuucggcgagcuggcccucauguacaacaccccgcgcgcggccacgaucaccgccaccagccccggggcccuguggggccuggaccgggugaccuuccgccggaucaucgucaagaacaacgccaagaagcgcaagauguacgaguccuucaucgagagccuccccuuccugaagucccuggaguucagcgagcggcucaaggugguggacgucaucgggacgaagguguacaacgacggcgagcagaucaucgcgcagggcgacuccgccgacagcuucuucaucguggaguccggggaggucaagaucaccaugaagcgcaagggcaagagcgagguggaggagaacggggccguggagaucgcccggugcucccgcggccaguacuucggggagcuggcccuggucaccaacaagccccgcgcggccagcgcccacgccaucggcaccgugaagugccucgcgauggacgugcaggccuucgagcggcugcugggcccgugcauggagaucaugaagcgcaacaucgccacguacgaggagcagcucgucgcccuguucgggaccaacauggacaucguggagcccaccgccuga

SEQ ID NO: 35050 - RNA, 2019 nt, Artificial Sequence
  derived and/or modified sequence opt1 from PRKCA__Homo_sapiens__NP_002728
auggccgacguguuccccggcaacgacagcaccgccucccaggacgucgcgaaccgcuucgcccggaagggggcccugcgccagaagaacgugcacgaggugaaggaccacaaguucaucgcccgguucuucaagcagccgaccuucugcagccacugcaccgacuucaucuggggcuucgggaagcagggcuuccagugccaggucugcugcuucguggugcacaagcgcugccacgaguucgucaccuucuccugccccggggccgacaagggccccgacaccgacgacccccggagcaagcacaaguucaagauccacaccuacggcuccccgacguucugcgaccacugcgggagccuccuguacggccugauccaccaggggaugaagugcgacacgugcgacaugaacgugcacaagcagugcgugaucaacguccccucccucugcggcauggaccacaccgagaagcgcgggcggaucuaccugaaggcggagguggccgacgagaagcugcacgugaccguccgcgacgccaagaaccucauccccauggaccccaacggccugagcgacccguacgugaagcugaagcucauccccgaccccaagaacgaguccaagcagaagaccaagaccauccggagcacccugaacccccaguggaacgaguccuucaccuucaagcugaagccgagcgacaaggaccgccggcucuccguggagaucugggacugggaccgcacgacccggaacgacuucaugggcagccuguccuucggggucagcgagcugaugaagaugcccgccuccggcugguacaagcuccugaaccaggaggagggggaguacuacaacgugcccauccccgagggcgacgaggagggcaacauggagcugcgccagaaguucgagaaggcgaagcucgggccggccggcaacaaggugaucagccccuccgaggaccggaagcagcccagcaacaaccuggaccgcgucaagcugaccgacuucaacuuccucauggugcuggggaagggcagcuucgggaaggugaugcuggccgaccggaagggcaccgaggagcucuacgccaucaagauccugaagaaggacgucgugauccaggacgacgacguggagugcacgauggucgagaagcgcgugcuggcccuccuggacaagcccccguuccugacccagcuccacuccugcuuccagaccgucgaccggcuguacuucgugauggaguacgugaacggcggggaccugauguaccacauccagcaggucggcaaguucaaggagccccaggcgguguucuacgccgccgagaucagcaucggccucuucuuccugcacaagcgcgggaucaucuaccgggaccugaagcucgacaacgugaugcuggacuccgaggggcacaucaagaucgccgacuucggcaugugcaaggagcacaugauggacggcgucaccacgcgcaccuucugcgggacccccgacuacaucgcccccgagaucaucgcguaccagccguacggcaagagcguggacuggugggccuacggggugcugcucuacgagaugcuggccggccagccgcccuucgacggggaggacgaggacgagcuguuccaguccaucauggagcacaacgucagcuaccccaagucccucagcaaggaggccguguccaucugcaagggccugaugaccaagcaccccgccaagcgccugggcugcgggcccgagggcgagcgggacgugcgcgagcacgcguucuuccggcgcaucgacugggagaagcucgagaaccgggagauccagcccccguucaagcccaaggucugcgggaagggcgccgagaacuucgacaaguucuucacgcgcggccagcccgugcugacgcccccggaccagcuggugaucgccaacaucgaccagagcgacuucgagggguucuccuacgucaacccccaguucgugcaccccauccuccagagcgccguguga

SEQ ID NO: 35051 - RNA, 2022 nt, Artificial Sequence
  derived and/or modified sequence opt1 from PRKCB__Homo_sapiens__NP_002729
auggccgaccccgccgcggggcccccgcccagcgagggcgaggaguccaccgugcgcuucgcccggaagggcgcccugcgccagaagaacguccacgaggugaagaaccacaaguucaccgcccgguucuucaagcagcccacguucugcagccacugcaccgacuucaucuggggguucggcaagcagggguuccagugccaggugugcugcuucgucgugcacaagcgcugccacgaguucgugaccuucuccugccccggcgccgacaagggccccgcgagcgacgacccccgguccaagcacaaguucaagauccacaccuacagcucccccacguucugcgaccacugcgggagccuccuguacggccugauccaccaggggaugaagugcgacacgugcaugaugaacguccacaagcgcugcgugaugaacgugccgucccucugcggcaccgaccacaccgagcggcgcgggcggaucuacauccaggcccacaucgaccgcgacguccugaucgugcuggugcgggacgccaagaaccucguccccauggaccccaacggccugagcgaccccuacgugaagcugaagcucaucccggaccccaaguccgagagcaagcagaagaccaagaccaucaagugcucccugaaccccgaguggaacgagaccuuccgcuuccagcugaaggagagcgacaaggaccggcgccucuccguggagaucugggacugggaccugaccagccggaacgacuucaugggcucccugagcuucgggaucuccgagcuccagaaggccagcgucgacggcugguucaagcugcugagccaggaggagggggaguacuucaacgugcccgugccgcccgagggcuccgaggcgaacgaggagcuccgccagaaguucgagcgggccaagaucagccagggcacgaagguccccgaggagaagaccaccaacaccguguccaaguucgacaacaacgggaaccgcgaccggaugaagcugacggacuucaacuuccugauggugcucggcaaggggagcuucggcaaggucaugcuguccgagcgcaaggggaccgacgagcuguacgccgugaagauccucaagaaggacguggucauccaggacgacgacguggagugcaccauggucgagaagcgggugcuggcccugcccggcaagccgcccuuccucacccagcugcacagcugcuuccagacgauggaccgccuguacuucgugauggaguacgucaacggcggggaccucauguaccacauccagcaggucggccgcuucaaggagccccacgccguguucuacgcggccgagaucgccaucgggcuguucuuccugcaguccaagggcaucaucuaccgggaccucaagcuggacaacgugaugcuggacagcgaggggcacaucaagaucgccgacuucggcaugugcaaggagaacaucugggacggcgugaccaccaagaccuucugcgggacgcccgacuacaucgccccggagaucaucgcguaccagcccuacggcaaguccguggacuggugggccuucgggguccuccuguacgagaugcuggccggccaggcccccuucgagggggaggacgaggacgagcuguuccagagcaucauggagcacaacguggccuaccccaaguccaugagcaaggaggcgguggccaucugcaagggccucaugaccaagcacccgggcaagcgccuggggugcggccccgagggggagcgggacaucaaggagcacgccuucuuccgcuacaucgacugggagaagcucgagcggaaggagauccagcccccguacaagcccaaggccugcggccgcaacgccgagaacuucgaccgguucuucacccgccacccgcccguccugaccccgcccgaccaggaggugauccggaacaucgaccaguccgaguucgagggcuucagcuucgugaacuccgaguuccugaagcccgaggucaagagcuga

SEQ ID NO: 35052 - RNA, 786 nt, Artificial Sequence
  derived and/or modified sequence opt1 from PRKCDBP__Homo_sapiens__NP_659477
augcgcgagagcgcccuggagcggggccccgugccggaggcccccgccgggggccccguccacgccgugaccguggucacccuccuggagaagcuggccuccaugcucgagacgcugcgcgagcggcagggcgggcuggcccgccggcagggcgggcucgccggcagcgugcgccggauccaguccgggcugggcgcgcugagccgcucccacgacaccaccagcaacacccucgcccagcugcuggccaaggccgagcggguguccagccacgcgaacgccgcccaggagcgcgccguccggcgcgccgcccaggugcagcggcucgaggcgaaccacgggcugcugguggcccgcggcaagcuccacguccugcuguucaaggaggagggggaggugcccgccuccgccuuccagaaggcgccggagccccucggccccgccgaccagagcgagcugggccccgagcagcuggaggccgaggugggggaguccagcgacgaggagccggucgagucccgggcccagcgccuccggcgcacgggccugcagaaggugcagagccugcggcgcgcccucuccgggcggaagggccccgcggcgcccccgcccacccccgugaagccgccccgccugggccccgggcgcagcgccgaggcccagcccgaggcccagcccgcgcuggagcccacccucgagccggagccgccccaggacaccgaggaggaccccggccggcccggggccgccgaggaggcccugcugcagauggaguccgucgcguga

SEQ ID NO: 35053 - RNA, 2031 nt, Artificial Sequence
  derived and/or modified sequence opt1 from PRKCD__Homo_sapiens__NP_997704
auggcccccuuccugcgcaucgccuucaacagcuacgagcucggcucccugcaggcggaggacgaggccaaccagcccuucugcgccgugaagaugaaggaggcccugagcaccgagcgggggaagacccucguccagaagaagcccacgauguaccccgaguggaaguccaccuucgacgcccacaucuacgagggccgcgugauccagaucgugcugaugcgggcggccgaggagcccgucagcgaggugaccgugggggucuccgugcuggccgagcgcugcaagaagaacaacggcaaggccgaguucuggcucgaccugcagccgcaggcgaaggugcugaugagcguccaguacuuccucgaggacguggacugcaagcaguccaugcggagcgaggacgaggccaaguuccccaccaugaaccgccgcggggccaucaagcaggccaagauccacuacaucaagaaccacgaguucaucgccacguucuucggccagcccaccuucugcuccgugugcaaggacuucgucuggggccugaacaagcagggguacaagugccggcagugcaacgcggccauccacaagaagugcaucgacaagaucaucggccggugcaccgggaccgccgccaacagccgcgacacgaucuuccagaaggagcgguucaacaucgacaugccccaccgcuucaaggugcacaacuacauguccccgaccuucugcgaccacugcggcagccugcucugggggcuggugaagcagggccugaagugcgaggacugcggcaugaacguccaccacaagugccgggagaagguggccaaccucugcgggaucaaccagaagcugcuggcggaggcccucaaccaggugacccagcgcgccucccggcgcagcgacuccgccagcuccgagcccgucggcaucuaccagggguucgagaagaagaccggcguggccggcgaggacaugcaggacaacagcgggacguacggcaagaucugggagggguccagcaagugcaacaucaacaacuucaucuuccacaaggugcugggcaaggggagcuucggcaagguccugcucggcgagcugaaggggcggggcgaguacuucgcgaucaaggcccugaagaaggacguggugcucaucgacgacgacgucgagugcaccaugguggagaagcgcguccugacccuggccgccgagaaccccuuccucacccaccugaucugcacguuccagaccaaggaccaccuguucuucgugauggaguuccucaacgggggcgaccugauguaccacauccaggacaaggggcgguucgagcuguaccgcgccaccuucuacgcggccgagaucaugugcggccuccaguuccugcacuccaagggcaucaucuaccgggaccugaagcucgacaacgugcugcuggaccgcgacgggcacaucaagaucgccgacuucggcaugugcaaggagaacaucuucggggagagccgcgccuccaccuucugcggcacgcccgacuacaucgcgccggagauccuccaggggcugaaguacaccuucagcgucgacuggugguccuucggcgugcugcucuacgagaugcugaucggccagagccccuuccacggggacgacgaggacgagcuguucgaguccauccggguggacacgccccacuacccccgcuggaucaccaaggagagcaaggacauccucgagaagcuguucgagcgggagccgaccaagcgccugggcgucaccgggaacaucaagauccaccccuucuucaagaccaucaacuggacccuccuggagaagcggcgccuggagccgcccuuccggcccaaggugaaguccccgcgcgacuacagcaacuucgaccaggaguuccugaacgagaaggcccggcucuccuacagcgacaagaaccugaucgacuccauggaccagagcgccuucgccggcuucuccuucgugaaccccaaguucgagcaccuccuggaggacuga

SEQ ID NO: 35054 - RNA, 2214 nt, Artificial Sequence
  derived and/or modified sequence opt1 from PRKCE__Homo_sapiens__XP_005264485
augguggucuucaacggccugcucaagaucaagaucugcgaggccgugagccugaagcccaccgccuggucccugcgccacgcgguggggccgcggccccagaccuuccuccuggaccccuacaucgcccugaacgucgacgacagccgcaucggccagacggccaccaagcagaagaccaacucccccgccuggcacgacgaguucgugaccgacgugugcaacgggcggaagaucgagcucgccgucuuccacgacgcgccgaucggcuacgacgacuucguggccaacugcacgauccaguucgaggagcugcugcagaacgggagccgccacuucgaggacuggaucgaccucgagcccgagggccggguguacgucaucaucgaccuguccggcagcuccggggaggcccccaaggacaacgaggagcgcguguuccgggagcgcaugcggccccgcaagcggcagggcgccgugcgccggcgcguccaccaggugaacgggcacaaguucauggcgaccuaccugcggcagccgaccuacugcagccacugccgcgacuucaucuggggcgugaucgggaagcagggcuaccagugccaggucugcacgugcguggugcacaagcggugccacgagcucaucaucaccaagugcgccggccugaagaagcaggagacccccgaccaggucgggucccagcgcuucagcgugaacaugccccacaaguucggcauccacaacuacaaggugcccaccuucugcgaccacugcgggucccugcucuggggccugcugcggcagggccuccagugcaaggucugcaagaugaacgugcaccgccggugcgagaccaacguggccccgaacugcggggucgacgcccgcggcaucgccaaggugcuggcggaccugggggucacgcccgacaagaucaccaacagcggccagcgccggaagaagcucaucgccggggccgagagcccccagcccgccuccggcuccagcccguccgaggaggaccgcagcaaguccgcccccaccagccccugcgaccaggagaucaaggagcuggagaacaacauccggaaggcgcugagcuucgacaaccgcggcgaggagcaccgggccgccuccagccccgacgggcagcucauguccccgggcgagaacggggaggugcgccagggccaggccaagcggcuggggcuggacgaguucaacuucaucaaggugcucggcaagggcagcuucgggaaggucaugcuggccgagcugaagggcaaggacgagguguacgcggugaagguccucaagaaggacgugauccugcaggacgacgacguggacugcaccaugacggagaagcgcauccuggcccucgcccggaagcaccccuaccugacccagcuguacugcugcuuccagaccaaggaccgccucuucuucgucauggaguacgugaacgggggcgaccugauguuccagauccagcggucccgcaaguucgacgagccccggagccgcuucuacgccgccgaggugaccuccgcgcugauguuccuccaccagcacggggucaucuaccgggaccugaagcuggacaacauccuccuggacgccgagggccacugcaagcuggccgacuucggcaugugcaaggaggggauccucaacggcgugacgaccaccaccuucugcgggacgcccgacuacaucgccccggagauccugcaggagcuggaguacggccccagcguggacuggugggcgcucggcguccugauguacgagaugauggccgggcagccgcccuucgaggccgacaacgaggacgaccuguucgaguccauccugcacgacgacgugcucuaccccguguggcugagcaaggaggccgucuccauccugaaggccuucaugaccaagaacccccacaagcgccucggcugcguggcgagccagaacggggaggacgccaucaagcagcaccccuucuucaaggagaucgacugggugcugcuggagcagaagaagaucaagccgcccuucaagccccggaucaagaccaagcgcgacgucaacaacuucgaccaggacuucacccgggaggagcccgugcucacgcugguggacgaggccaucgucaagcagaucaaccaggaggaguucaagggcuucuccuacuucggggaggaccugaugccguga

SEQ ID NO: 35055 - RNA, 2094 nt, Artificial Sequence
  derived and/or modified sequence opt1 from PRKCG__Homo_sapiens__NP_002730
auggccggccuggggcccggcgugggggacagcgagggcgggccgcgcccccucuucugccggaagggcgcccugcgccagaaggucgugcacgaggugaagucccacaaguucaccgcgcgguucuucaagcagcccaccuucugcagccacugcacggacuucaucuggggcaucgggaagcagggccugcagugccaggucugcuccuucguggugcaccgccggugccacgaguucgucaccuucgagugccccggggccggcaaggggccgcagaccgacgacccccgcaacaagcacaaguuccggcuccacagcuacuccagccccaccuucugcgaccacugcggcucccugcuguacggccucgugcaccaggggaugaagugcagcugcugcgagaugaacgugcaccgccggugcguccgcuccgugcccagccugugcggcguggaccacacggagcggcgcgggcggcugcagcucgagauccgcgccccgaccgccgacgagauccacgucaccgugggcgaggcccggaaccugauccccauggaccccaacggccuguccgaccccuacgugaagcucaagcugaucccggacccccgcaaccugaccaagcagaagacgcggaccgucaaggcgacccucaaccccguguggaacgagaccuucguguucaaccugaagcccggggacgucgagcgccggcugagcguggaggugugggacugggaccgcacgucccggaacgacuucaugggcgccaugagcuucggggucuccgagcuccugaaggccccgguggacggcugguacaagcugcucaaccaggaggagggggaguacuacaacgugcccgucgccgacgcggacaacugcagccugcugcagaaguucgaggccugcaacuacccccucgagcuguacgagcgcgugcgcaugggccccuccagcuccccgauccccagccccagccccuccccgaccgaccccaagcggugcuucuucggcgccagccccgggcgccugcacaucuccgacuucagcuuccucaugguccugggcaagggguccuucggcaaggugaugcuggccgagcggcgcgggagcgacgagcucuacgccaucaagauccugaagaaggacgugaucguccaggacgacgacguggacugcacccugguggagaagcggguccucgcgcugggcggccgcgggcccggcgggcggccgcacuuccugacccagcuccacuccacguuccagacccccgaccgccuguacuucgugauggaguacgugaccggcggggaccugauguaccacauccagcagcucggcaaguucaaggagccccacgccgccuucuacgccgccgagaucgcgaucggccuguucuuccugcacaaccaggggaucaucuaccgggaccucaagcuggacaacgucaugcuggacgccgagggccacaucaagaucaccgacuucgggaugugcaaggagaacguguucccgggcacgaccacccgcaccuucugcggcacgcccgacuacaucgcccccgagaucaucgccuaccagcccuacggcaagagcguggacuggugguccuucgggguccuccuguacgagaugcuggccgggcagccgcccuucgacggcgaggacgaggaggagcuguuccaggcgaucauggagcagaccgugaccuaccccaagagccucucccgggaggccguggccaucugcaagggguuccugaccaagcaccccggcaagcgccugggcagcgggccggacggcgagcccacgauccgggcccacggguucuuccgcuggaucgacugggagcggcucgagcgccuggagaucccgccgcccuuccggccccgccccugcggccgguccggggagaacuucgacaaguucuucacccgcgccgcgcccgcccugaccccgcccgaccgccucguccuggccagcaucgaccaggccgacuuccagggcuucaccuacgugaaccccgacuucgugcaccccgacgcgcggucccccacgagccccguccccgugcccgugauguga

SEQ ID NO: 35056 - RNA, 2052 nt, Artificial Sequence
  derived and/or modified sequence opt1 from PRKCH__Homo_sapiens__NP_006246
augagcuccggcaccaugaaguucaacggguaccugcgcgugcggaucggcgaggccgucgggcuccagcccacccgcuggagccugcggcacucccuguucaagaagggccaccagcuccuggacccguaccugacggugagcguggaccagguccgcguggggcagaccuccaccaagcagaagaccaacaagcccacguacaacgaggaguucugcgccaacgugaccgacggcggccaccucgagcuggcggucuuccacgagacgccccugggguacgaccacuucguggccaacugcacccuccaguuccaggagcugcugcggaccaccggcgccagcgacaccuucgagggguggguggaccucgagcccgagggcaaggucuucguggugaucacccugacgggguccuucaccgaggccacccugcagcgcgaccggaucuucaagcacuucacccgcaagcggcagcgcgccaugcggcgccggguccaccagaucaacggccacaaguucauggcgacguaccuccgccagccgaccuacugcagccacugccgggaguucaucuggggcguguucgggaagcagggcuaccagugccaggugugcacgugcgucgugcacaagcgcugccaccaccugaucgugaccgccugcacgugccagaacaacaucaacaaggucgacuccaagaucgccgagcagcgguucgggaucaacaucccccacaaguucagcauccacaacuacaaggugcccaccuucugcgaccacugcggcucccugcucuggggcaucaugcgccaggggcugcagugcaagaucugcaagaugaacgugcacauccggugccaggccaacgucgcgcccaacugcggcgugaacgccguggagcuggccaagacccucgccgggaugggccugcagccggggaacaucagccccaccuccaagcuggucagccgcuccacccuccggcgccagggcaaggagagcuccaaggagggcaacgggaucggcgugaacagcuccaaccgccuggggaucgacaacuucgaguucauccggguccugggcaaggggagcuucggcaaggugaugcucgcccgcgugaaggagaccggcgaccuguacgcggucaaggugcugaagaaggacgugauccuccaggacgacgacgucgagugcaccaugaccgagaagcggauccugagccuggcccgcaaccaccccuuccucacgcagcuguucugcugcuuccagacccccgaccggcuguucuucgugauggaguucgugaacgggggcgaccucauguuccacauccagaagucccgccgguucgacgaggcccgcgcccgguucuacgccgcggagaucaucagcgcccugauguuccugcacgacaaggggaucaucuaccgcgaccucaagcuggacaacguccugcucgaccacgagggccacugcaagcuggccgacuucgggaugugcaaggagggcaucugcaacggcgugaccaccgccacguucugcgggaccccggacuacaucgcccccgagauccugcaggagaugcucuacggccccgcgguggacuggugggccauggggguccugcuguacgagaugcucugcggccacgcccccuucgaggccgagaacgaggacgaccuguucgaggccauccugaacgacgaggugguguacccgaccuggcugcacgaggacgcgaccggcauccucaaguccuucaugacgaagaaccccaccaugcggcuggggagccugacccagggcggggagcacgccauccuccgccaccccuucuucaaggagaucgacugggcccagcugaaccaccggcagaucgagcccccguuccgcccccggaucaagucccgcgaggacgucagcaacuucgaccccgacuucaucaaggaggagcccgugcugaccccgaucgacgagggccaccuccccaugaucaaccaggacgaguuccggaacuucuccuacgugagccccgagcugcagcccuga

SEQ ID NO: 35057 - RNA, 1791 nt, Artificial Sequence
  derived and/or modified sequence opt1 from PRKCI__Homo_sapiens__NP_002731
augcccacccagcgcgacagcuccaccaugagccacacgguggccggcgggggcuccggggaccacagccaccagguccgggugaaggccuacuaccgcggcgacaucaugaucacccacuucgagccguccaucagcuucgaggggcugugcaacgaggugcgggacaugugcuccuucgacaacgagcagcuguucaccaugaaguggaucgacgaggagggcgaccccugcaccgucagcucccagcucgagcuggaggaggcguuccgccucuacgagcugaacaaggacagcgagcugcucauccacguguuccccugcgugcccgagcggccgggcaugcccugccccggggaggacaaguccaucuaccgccggggcgcccgccgguggcgcaagcuguacugcgccaacgggcacacguuccaggccaagcgguucaaccgccgggcccacugcgcgaucugcaccgaccgcaucuggggccuggggcggcagggcuacaagugcaucaacugcaagcuccugguccacaagaagugccacaagcuggugaccaucgagugcggccgccacagccucccccaggagccggugaugcccauggaccaguccagcaugcacuccgaccacgcccagaccgucauccccuacaaccccagcucccacgagagccuggaccaggugggggaggagaaggaggccaugaacacgcgggaguccggcaaggccagcagcucccuggggcuccaggacuucgaccugcugcgcgugaucggccggggcagcuacgcgaagguccuccuggugcgccugaagaagaccgaccggaucuacgccaugaagguggucaagaaggagcucgugaacgacgacgaggacaucgacugggugcagaccgagaagcacgucuucgagcaggccuccaaccacccguuccugguggggcugcacagcugcuuccagaccgagucccgccucuucuucgugaucgaguacgucaacggcggggaccugauguuccacaugcagcgccagcggaagcugcccgaggagcacgcccgcuucuacagcgccgagaucucccucgcgcugaacuaccugcacgagcggggcaucaucuaccgcgaccucaagcuggacaacgugcugcucgacagcgaggggcacaucaagcugacggacuacggcaugugcaaggagggccugcggcccggggacaccaccuccaccuucugcggcacgcccaacuacaucgccccggagauccuccgcggggaggacuacggcuucagcguggacuggugggcccuggggguccugauguucgagaugauggccggccggucccccuucgacaucgugggcagcuccgacaaccccgaccagaacaccgaggacuaccucuuccaggucauccuggagaagcagauccgcaucccccggagccuguccgugaaggccgcgagcgugcucaaguccuuccugaacaaggacccgaaggagcgccuggggugccacccccagaccggcuucgccgacauccaggggcaccccuucuuccggaacgucgacugggacaugauggagcagaagcaggucgugcccccguucaagcccaacaucagcggcgaguucgggcucgacaacuucgacucccaguucaccaacgagcccgugcagcugacgcccgacgacgacgacaucgugcgcaagaucgaccagagcgaguucgagggcuucgaguacaucaacccgcugcucaugagcgccgaggagugcguguga

SEQ ID NO: 35058 - RNA, 1932 nt, Artificial Sequence
  derived and/or modified sequence opt1 from PRKCQ__Homo_sapiens__NP_001229342
augagccccuuccugcgcaucggccucuccaacuucgacugcgggagcugccaguccugccagggcgaggccgugaacccguacugcgccgugcuggugaaggaguacguggagagcgagaacgggcagauguacauccagaagaagcccaccauguacccgcccugggacuccaccuucgacgcgcacaucaacaagggccgggucaugcagaucaucgugaaggggaagaacguggaccugaucagcgagacgaccgucgagcucuacucccuggccgagcgcugccggaagaacaacggcaagaccgagaucuggcuggagcucaagccgcagggccgcaugcugaugaacgcccgguacuuccuggagaugagcgacaccaaggacaugaacgaguucgagacggagggguucuucgcccuccaccagcgccggggcgccaucaagcaggcgaaggugcaccacgugaagugccacgaguucaccgccaccuucuucccccagcccaccuucugcuccgucugccacgaguucgugugggggcugaacaagcagggcuaccagugccgccagugcaacgccgccauccacaagaagugcaucgacaaggugaucgcgaagugcacggggagcgccaucaacucccgggagaccauguuccacaaggagcgcuucaagaucgacaugccccaccgguucaaggucuacaacuacaagagcccgaccuucugcgagcacugcggcacccugcucuggggccuggcccgccaggggcugaagugcgacgccugcggcaugaacgugcaccaccggugccagacgaagguggccaaccucugcgggaucaaccagaagcugauggcggaggcccuggccaugaucgaguccacccagcaggcccgcugccuccgggacaccgagcagaucuuccgcgagggccccgucgagaucggccugcccugcagcaucaagaacgaggcccggcccccgugccugcccacccccgggaagcgcgagccccagggcaucuccugggagagcccgcucgacgagguggacaagaugugccaccuccccgagcccgagcugaacaaggagcggcccucccugcagaucaagcugaagaucgaggacuucauccugcacaagaugcucgggaagggcagcuucgggaagguguuccuggcggaguucaagaagacgaaccaguucuucgccaucaaggcccugaagaaggacgucgugcucauggacgacgacguggagugcaccauggucgagaagcgcgugcugucccuggccugggagcacccguuccucacccacauguucugcaccuuccagacgaaggagaaccuguucuucgugauggaguaccugaacggcggcgaccucauguaccacauccagagcugccacaaguucgaccugagccgggccaccuucuacgcggccgagaucauccuggggcuccaguuccugcacuccaagggcaucgucuaccgcgaccugaagcucgacaacauccugcuggacaaggacgggcacaucaagaucgccgacuucggcaugugcaaggagaacaugcucggggacgccaagaccaacaccuucugcggcacgcccgacuacaucgcccccgagcuguucgugcgcgagcccgagaagcggcugggcguccgcggggacauccggcagcacccccucuuccgcgagaucaacugggaggagcuggagcggaaggagaucgacccgcccuuccgccccaaggucaagagccccuucgacugcuccaacuucgacaaggaguuccugaacgagaagccccggcugagcuucgcggaccgcgcccucaucaacuccauggaccagaacauguuccggaacuucagcuucaugaaccccggcauggagcgccugaucuccuga

SEQ ID NO: 35059 - RNA, 1587 nt, Artificial Sequence
  derived and/or modified sequence opt1 from PRKCSH__Homo_sapiens__XP_011526433
augcugcucccccugcugcuccugcugccgaugugcugggccguggaggucaagcgcccccggggcgugagccucaccaaccaccacuucuacgacgaguccaagcccuucacgugccuggacgggagcgccaccauccccuucgaccaggugaacgacgacuacugcgacugcaaggacggcuccgacgagccggggaccgcggccugccccaacggcagcuuccacugcaccaacaccggguacaagccccuguacauccccuccaaccgcgucaacgacggcgugugcgacugcugcgacggcacggacgaguacaacagcggggugaucugcgagaacacgugcaaggagaagggccggaaggagcgcgagucccuccagcagauggccgaggucacccgggagggguuccgccugaagaagauccugaucgaggacuggaagaaggcccgggaggagaagcagaagaagcucaucgagcugcaggccggcaagaagucccuggaggaccagguggagaugcuccgcaccgugaaggaggaggcggagaagccggagcgggaggccaaggagcagcaccagaagcugugggaggagcagcuggccgccgcgaaggcccagcaggagcaggagcucgccgccgacgccuucaaggagcuggacgacgacauggacgggaccgucagcgugaccgagcugcagacccaccccgagcucgacaccgacggcgacggcgcgcugagcgaggccgaggcccaggcccugcucuccggggacacgcagaccgacgccaccagcuucuacgaccgcgugugggcggccauccgggacaaguaccgcuccgaggcccugcccaccgaccugcccgccccgagcgcccccgaccucacggagcccaaggaggagcagcccccgguccccuccagccccaccgaggaggaggaggaggaggaggaggaggaggaggaggaggcggaggaggaggaggaggaggaggacuccgaggaggcgcccccgccccugagcccgccccagcccgccucccccgccgaggaggacaagaugccgcccuacgacgagcagacccaggccuucaucgacgccgcccaggaggcccggaacaaguucgaggaggccgagcgcagccugaaggacauggaggagagcauccggaaccucgagcaggagaucuccuucgacuucggccccaacggggaguucgcguaccuguacagccagugcuacgagcugaccacgaacgaguacguguaccgccucugccccuucaagcuggugucccagaagcccaagcugggcggcagcccgaccucccucgggaccuggggcagcuggaucgggcccgaccacgacaaguucuccgccaugaaguacgagcagggcaccgggugcuggcagggccccaaccggagcacgaccguccgccugcugugcggcaaggagaccauggugaccuccacgaccgagcccagccggugcgaguaccucauggagcugaugaccccggccgccugccccgagcccccgcccgaggcccccaccgaggacgaccacgacgagcuguga

SEQ ID NO: 35060 - RNA, 1788 nt, Artificial Sequence
  derived and/or modified sequence opt1 from PRKCZ__Homo_sapiens__XP_011540075
augcccagccgcaccggcccgaagauggagggguccggcgggcgggugcgccugaaggcccacuacggcggggacaucuucaucaccagcgucgacgccgcgacgaccuucgaggagcucugcgaggaggugcgggacaugugccgccugcaccagcagcacccccugacccucaaguggguggacuccgagggcgaccccugcaccgucagcucccagauggagcuggaggaggccuuccggcuggcccgccagugccgggacgagggccucaucauccacguguuccccagcacgccggagcagcccgggcugcccugccccggcgaggacaaguccaucuaccgccgcggggcccggcgguggcgcaagcuguaccgggccaacggccaccucuuccaggcgaagcgcuucaaccggcgcgccuacugcgggcagugcagcgagcggaucuggggccuggcccgccagggcuaccggugcaucaacugcaagcugcucgugcacaagcgcugccacgggcuggucccgcugaccugccggaagcacauggacuccgugaugcccagccaggagccgcccguggacgacaagaacgaggacgccgaccuccccuccgaggagaccgacggcaucgcguacaucagcuccagccgcaagcacgacuccaucaaggacgacagcgaggaccugaagcccgucaucgacgggauggacggcaucaagaucucccagggccuggggcuccaggacuucgaccugauccgcgugaucggccgggggagcuacgccaaggugcugcucguccgccugaagaagaacgaccagaucuacgccaugaagguggugaagaaggagcugguccacgacgacgaggacaucgacugggugcagaccgagaagcacguguucgagcaggccuccagcaaccccuuccucgucggccugcacagcugcuuccagacgaccucccggcuguuccucgugaucgaguacgugaacgggggcgaccugauguuccacaugcagcgccagcggaagcugcccgaggagcacgcccgcuucuacgcggccgagaucugcaucgcccucaacuuccugcacgagcggggcaucaucuaccgcgaccugaagcucgacaacguccugcuggacgccgacgggcacaucaagcucaccgacuacggcaugugcaaggaggggcugggcccgggggacaccacgagcaccuucugcggcacccccaacuacaucgcccccgagauccugcggggcgaggaguacggguucuccguggacuggugggcgcucggcgugcugauguucgagaugauggccgggcgcagccccuucgacaucaucaccgacaacccggacaugaacacggaggacuaccuguuccaggucauccucgagaagcccauccggaucccccgcuuccuguccgugaaggccagccacguccugaagggcuuccucaacaaggaccccaaggagcggcuggggugccgcccgcagaccggcuucuccgacaucaagagccacgccuucuuccgguccaucgacugggaccugaugcaccgccagcuccggugcaccgacgcccgcaccacguggacgccccggcgcugcggccgcaccgacgacauggacgcgcagaccauguggaugcacgggcggcgccggcacaccgacgacagcuccaccgacgacagcgacgcccgcacgccccggcgccggggccgcaccgacgacgccgacgcccagaugaccuggacccaccgguga

SEQ ID NO: 35061 - RNA, 2739 nt, Artificial Sequence
  derived and/or modified sequence opt1 from PRKD1__Homo_sapiens__NP_002733
augagcgcgcccccggugcugcgcccgcccagcccccuccugcccgucgccgccgccgccgccgccgcggccgccgcccuggugcccggcagcgggcccggccccgcgccguuccucgcccccguggccgcccccgucgggggcaucuccuuccaccuccagaucgggcugagccgggagcccgugcugcugcugcaggacuccagcggcgacuacucccucgcccacgugcgcgagauggcgugcagcaucgucgaccagaaguucccggagugcggcuucuacgggauguacgacaagauccugcuguuccggcacgaccccaccuccgagaacauccuccagcuggugaaggccgccagcgacauccaggagggcgaccugaucgaggugguccucuccgccagcgccaccuucgaggacuuccagauccgcccccacgcgcuguucgugcacuccuaccgggcccccgccuucugcgaccacugcggggagaugcuguggggccucgugcgccaggggcugaagugcgagggcugcggccugaacuaccacaagcggugcgccuucaagaucccgaacaacugcagcgggguccgccggcgccggcucuccaacgugagccugacgggcguguccaccauccgcaccagcuccgccgagcugagcaccagcgcgcccgacgagccccuccugcagaagucccccagcgaguccuucaucgggcgggagaagcgcagcaacucccagagcuacaucggccggccgauccaccuggacaagauccucauguccaaggucaaggugccccacacguucgugauccacagcuacacccgccccaccgucugccaguacugcaagaagcugcugaagggccucuuccggcaggggcugcagugcaaggacugccgcuucaacugccacaagcggugcgcccccaaggugccgaacaacugccugggcgaggugaccaucaacggggaccuccugucccccggcgccgagagcgacgucgugauggaggagggguccgacgacaacgacagcgagcgcaacuccggccugauggacgacauggaggaggccauggugcaggacgccgagauggcgauggccgagugccagaacgacagcggcgagaugcaggaccccgaccccgaccacgaggacgccaaccggacgaucuccccgagcaccuccaacaacaucccccucaugcgcgucgugcagagcgucaagcacaccaagcgcaaguccagcaccgugaugaaggagggguggauggugcacuacacgagcaaggacacccugcggaagcgccacuacuggcggcuggacuccaagugcaucacccucuuccagaacgacaccggcagccgcuacuacaaggagaucccccuguccgagauccugagccucgagccggucaagacguccgcccugauccccaacggggcgaacccccacugcuucgagaucaccaccgccaacgugguguacuacgucggcgagaacguggugaaccccagcuccccgagccccaacaacuccguccugaccagcggggugggcgccgacguggcccggaugugggagaucgccauccagcacgcgcucaugcccgucauccccaagggcuccagcguggggacgggcaccaaccugcaccgcgacaucuccgugagcaucuccgucagcaacugccagauccaggagaacguggacaucuccaccguguaccagaucuucccggacgagguccuggggagcggccaguucgggaucguguacggcggcaagcaccggaagaccgggcgcgacguggccaucaagaucaucgacaagcuccgguuccccacgaagcaggagagccagcugcgcaacgaggucgccauccugcagaaccugcaccaccccggcguggugaaccucgagugcauguucgagacccccgagcgggucuucguggugauggagaagcugcacggggacaugcuggagaugauccucuccagcgagaagggccgccugccggagcacaucaccaaguuccugaucacccagauccucgucgcccugcggcaccuccacuucaagaacaucgugcacugcgaccugaagcccgagaacgugcugcuggccuccgcggaccccuucccccaggucaagcucugcgacuucggcuucgcccgcaucaucggggagaaguccuuccggcgcuccguggugggcacgccggccuaccuggcccccgagguccugcggaacaagggguacaaccgcagccucgacaugugguccgugggcgugaucaucuacgucagccuguccgggaccuuccccuucaacgaggacgaggacauccacgaccagauccagaacgccgcguucauguacccgcccaaccccuggaaggagaucagccacgaggccaucgaccugaucaacaaccuccuccaggugaagaugcggaagcgcuacuccguggacaagacccugagccaccccuggcugcaggacuaccagaccuggcuggaccugcgcgagcucgagugcaagaucggcgagcgguacaucacgcacgaguccgacgaccugcgcugggagaaguacgccggcgagcaggggcugcaguaccccacccaccucaucaacccgagcgccucccacagcgacacccccgagaccgaggagacggagaugaaggcgcugggcgagcgggucuccauccuguga

SEQ ID NO: 35062 - RNA, 2673 nt, Artificial Sequence
  derived and/or modified sequence opt1 from PRKD3__Homo_sapiens__XP_005264294
augagcgccaacaacuccccgcccagcgcccagaaguccgugcugcccaccgcgauccccgccguccuccccgccgccagcccgugcuccagccccaagaccggccuguccgcccgccugagcaacggguccuucagcgcgcccucccucacgaacagccggggcuccgugcacaccgugagcuuccugcugcagaucgggcucacccgcgaguccgucaccaucgaggcccaggagcugagccuguccgccgugaaggaccucgugugcagcaucgucuaccagaaguuccccgagugcggcuucuucgggauguacgacaagauccugcuguuccggcacgacaugaacuccgagaacauccuccagcugaucacgagcgccgacgagauccacgagggcgaccugguggaggugguccucagcgcgcuggccaccguggaggacuuccagauccgcccgcacacccuguacgugcacuccuacaaggcccccaccuucugcgacuacugcggcgagaugcucugggggcugguccggcagggccugaagugcgaggggugcggccucaacuaccacaagcgcugcgccuucaagauccccaacaacugcagcggggugcggaagcgccggcuguccaacgugagccugcccggcccgggccucuccgucccccgcccccugcagcccgaguacguggcccugccgagcgaggagucccacgugcaccaggagcccagcaagcggauccccuccuggagcgggcgccccaucuggauggagaagauggucaugugccgggugaaggugccgcacacguucgcgguccacuccuacacccgccccaccaucugccaguacugcaagcggcuccugaagggccuguuccgccaggggaugcagugcaaggacugcaaguucaacugccacaagcggugcgccagcaaggugccccgcgacugccucggcgaggugaccuucaacggcgagcccuccagccuggggacggacaccgacaucccgauggacaucgacaacaacgacaucaacuccgacagcucccggggccuggacgacaccgaggagcccagcccgcccgaggacaagauguucuuccucgaccccuccgaccuggacgucgagcgcgacgaggaggccgugaagaccaucagccccagcacguccaacaacaucccccugaugcgggucgugcagagcaucaagcacaccaagcgcaaguccagcaccauggugaaggagggguggaugguccacuacaccucccgcgacaaccuccggaagcgccacuacuggcggcuggacagcaagugccugacccucuuccagaacgaguccggcagcaaguacuacaaggagaucccgcuguccgagauccugcgcaucagcagcccccgggacuucaccaacaucucccagggguccaacccccacugcuucgagaucaucaccgacaccaugguguacuucgugggcgagaacaacggcgacagcucccacaaccccguccucgccgccacgggggugggccuggacguggcgcagagcugggagaaggccauccgccaggcccugaugccggucacgccccaggccuccgugugcaccagccccgggcagggcaaggaccacaaggaccucagcaccuccaucagcguguccaacugccagauccaggagaacgucgacaucagcacgguguaccagaucuucgccgacgaggugcugggguccggccaguucggcaucgucuacgggggcaagcaccggaagaccgggcgcgacguggcgaucaaggugaucgacaagaugcgguuccccaccaagcaggagagccagcugcgcaacgaggucgccauccuccagaaccugcaccacccgggcaucgugaaccuggagugcauguucgagacccccgagcggguguucgucgugauggagaagcugcacggggacaugcucgagaugauccuguccagcgagaagucccgccugcccgagcggaucacgaaguucauggugacccagauccucgucgcccugcgcaaccugcacuucaagaacaucgugcacugcgaccucaagcccgagaacgugcugcuggccagcgccgagccguucccccaggucaagcucugcgacuucggcuucgcgcggaucaucggcgagaaguccuuccgccggagcgugguggggacccccgccuaccuggcccccgagguccugcgcuccaagggcuacaaccggagccucgacaugugguccgugggggugaucaucuacgucagccuguccggcaccuucccguucaacgaggacgaggacaucaacgaccagauccagaacgccgcguucauguacccgcccaaccccuggcgcgagaucagcggcgaggccaucgaccugaucaacaaccuccuccaggugaagaugcgcaagcgguacuccguggacaagagccugagccaccccuggcugcaggacuaccagacguggcuggaccugcgcgaguucgagacccggaucggggagcgcuacaucacccacgaguccgacgacgcccggugggagauccacgccuacacccacaaccucgucuaccccaagcacuucaucauggcccccaaccccgacgacauggaggaggacccguga

SEQ ID NO: 35063 - RNA, 12294 nt, Artificial Sequence
  derived and/or modified sequence opt1 from PRKDC__Homo_sapiens__NP_001075109
auggccggcagcggggccggcgugcggugcagccugcugcggcugcaggagacccugagcgccgccgaccgcugcggggccgcccuggccggccaccagcugauccgggggcugggccaggagugcgugcugagcagcagccccgccgugcuggcccugcagaccagccucguguucucccgcgacuucggccugcugguguucgugcgcaagagccucaacuccaucgaguuccgcgagugccgggaggagauccugaaguuccugugcaucuuccucgagaagauggggcagaagaucgcccccuacagcguggagaucaagaacacgugcaccuccguguacaccaaggaccgcgccgccaagugcaagauccccgcccuggaccugcucaucaagcugcugcagaccuuccggagcucccgccucauggacgaguucaagaucggcgagcuguucagcaaguucuacggggagcuggcccucaagaagaagauccccgacaccgugcuggagaagguguacgagcugcucggccugcugggggagguccaccccuccgagaugaucaacaacgccgagaaccucuuccgggccuuccugggcgagcugaagacccagaugaccagcgcggugcgcgagccgaagcuccccgugcuggccggcugccugaaggggcucuccagccugcugugcaacuucaccaaguccauggaggaggacccccagaccagccgggagaucuucaacuucguccucaaggccauccgcccccagaucgaccugaagcgguacgccgugcccagcgccggccugcgccucuucgcccugcacgccucccaguucuccacgugccugcucgacaacuacgugucccuguucgagguccugcucaaguggugcgcccacaccaacguggagcugaagaaggccgcccugagcgcgcuggaguccuuccucaagcaggucagcaacauggucgccaagaacgccgagaugcacaagaacaagcugcaguacuucauggagcaguucuacgggaucauccggaacguggacuccaacaacaaggagcugagcaucgccauccgcggcuacggccucuucgccgggcccugcaaggugaucaacgcgaaggacgucgacuucauguacguggagcugauccagcggugcaagcagauguuccugacccagaccgacaccggcgacgaccgcguguaccagaugcccuccuuccuccagagcgucgccuccgugcugcuguaccucgacaccguccccgagguguacacccccgugcuggagcaccuggucgugaugcagaucgacagcuucccccaguacucccccaagaugcagcucgugugcugccgggccaucgucaagguguuccuggcccuggcggccaaggggcccgugcuccgcaacugcaucagcaccgucgugcaccagggccugauccgcaucugcuccaagcccgugguccugcccaaggggcccgagagcgaguccgaggaccaccgggccagcggcgaggugcgcaccggcaaguggaaggugcccaccuacaaggacuacgucgaccucuuccggcaccuccucuccagcgaccagaugauggacagcauccucgccgacgaggccuucuucuccgugaacagcuccagcgagucccugaaccaccuccuguacgacgaguucgucaagagcguccugaagaucguggagaagcuggaccucacccuggagauccagacggugggggagcaggagaacggcgacgaggcgccgggggucuggaugauccccaccuccgaccccgccgccaaccugcaccccgccaagccgaaggacuucagcgccuucaucaaccucguggaguucugccgcgagauccugcccgagaagcaggcggaguucuucgagcccuggguguacuccuucagcuacgagcugauccuccaguccacccggcugccccugaucagcggcuucuacaagcuccuguccaucaccguccgcaacgccaagaagaucaaguacuucgagggggugagcccgaagucccugaagcacagccccgaggaccccgagaaguacuccugcuucgcccucuucgugaaguucggcaaggaggucgccgugaagaugaagcaguacaaggacgagcugcuggccagcugccucacguuccugcugagccucccgcacaacaucaucgagcuggacgugcgggcguacguccccgcccugcagauggccuucaagcucggccuguccuacacgccccucgccgagguggggcucaacgcgcuggaggaguggagcaucuacaucgaccgccacgugaugcagcccuacuacaaggacauccugccgugccucgacggcuaccugaagaccuccgcccugagcgacgagaccaagaacaacugggaggucuccgcccucagccgggccgcccagaagggguucaacaagguggugcugaagcaccugaagaagacgaagaaccucuccagcaacgaggcgaucucccuggaggagauccgcauccgggucgugcagaugcugggcagccucgggggccagaucaacaagaaccugcugaccgugaccuccagcgacgagaugaugaaguccuacgucgccugggaccgcgagaagcggcucagcuucgccgugcccuuccgcgagaugaagcccgugaucuuccuggacgucuuccugccccgggugaccgagcucgcccugacggccuccgaccgccagaccaagguggcggccugcgagcugcuccacagcauggucauguucaugcugggcaaggccacccagaugccggagggcgggcagggggcgccgcccauguaccagcuguacaagcggaccuuccccgugcuccugcgccuggccugcgacguggaccaggucacgcggcagcucuacgagccccuggugaugcagcugauccacugguucaccaacaacaagaaguucgagucccaggacaccguggcgcuccuggaggccauccuggacggcaucgucgaccccguggacagcacccuccgcgacuucugcggccgcugcauccgggaguuccugaagugguccaucaagcagaucacgccccagcagcaggagaagucccccgucaacaccaagagccuguucaagcgccucuacucccuggcccugcacccgaacgccuucaagcggcucggggcgagccuggccuucaacaacaucuaccgcgaguuccgggaggaggagucccugguggagcaguucguguucgaggcccucgucaucuacauggagagccuggcccuggcccacgcggacgagaagucccugggcaccauccagcagugcugcgacgccaucgaccaccucugccgcaucaucgagaagaagcacgugagccugaacaaggccaagaagcggcgccugccccggggguucccgcccuccgccagccucugccugcuggaccucgugaaguggcugcuggcccacugcggccgcccgcagaccgagugccggcacaaguccaucgagcuguucuacaaguucgucccccugcugcccgggaaccgcagccccaaccucuggcugaaggacgugcugaaggaggagggcguguccuuccucaucaacaccuucgagggcgggggcugcgggcagccgagcggcauccuggcgcagcccacgcugcucuaccugcgggggcccuucucccugcaggccacccucugcuggcuggaccugcuccuggccgcccuggagugcuacaacaccuucaucggcgagcgcaccgucggcgcccuccaggugcuggggacggaggcgcagagcucccugcucaaggccguggccuucuuccuggagagcaucgccaugcacgacaucaucgccgcggagaagugcuucggcaccggggccgccggcaaccggaccuccccgcaggagggggagcgcuacaacuacagcaagugcaccgucguggugcggaucauggaguucacgaccacccugcucaacaccucccccgagggcuggaagcugcugaagaaggaccucugcaacacgcaccugaugcgcguccuggugcagacccucugcgagcccgccagcaucggcuucaacaucggggacgugcaggucauggcgcaccuccccgacgugugcgugaaccugaugaaggcccucaagaugagcccguacaaggacauccuggagacccaccuccgggagaagaucaccgcccaguccaucgaggagcucugcgccgucaaccuguacggccccgacgcccagguggaccgcagccggcuggcggccguggucuccgccugcaagcagcuccaccgcgccgggcugcugcacaacauccuccccagccaguccacggaccugcaccacagcgugggcaccgagcugcucucccugguguacaaggggaucgcccccggcgacgagcgccagugccugccgagccucgaccuguccugcaagcagcuggcgagcggccuccuggagcuggccuucgccuucgggggccucugcgagcggcuggucucccugcuccugaaccccgccgugcugagcaccgccucccucgggagcucccagggcagcgugauccacuucucccacggcgaguacuucuacagccuguucuccgagaccaucaacacggagcugcucaagaaccuggaccuggcgguccucgagcugaugcagagcagcguggacaacaccaagaugguguccgccguccugaacgggaugcucgaccagagcuuccgcgagcgggccaaccagaagcaccagggccugaagcuggccaccaccauccuccagcacuggaagaagugcgacuccuggugggcgaaggacagcccccuggagacgaagauggccgugcuggcccuccuggccaagauccugcagaucgacuccagcguguccuucaacaccagccacggguccuuccccgaggucuucaccaccuacaucagccuccuggccgacacgaagcuggaccuccaccugaagggccaggcggugacccugcucccguucuucaccucccugaccgggggcagccuggaggagcuccgccgggugcuggagcagcugaucgucgcccacuuccccaugcagucccgcgaguucccgcccggcacgccgcgguucaacaacuacguggacugcaugaagaaguuccucgacgcccuggagcugagccagucccccaugcugcucgagcugaugaccgaggugcugugccgcgagcagcagcacgucauggaggagcuguuccagagcuccuuccggcgcaucgcccggcgcgggagcugcgugacccaggugggccugcuggaguccgucuacgagauguuccggaaggacgacccccgccucagcuucacccggcagagcuucguggaccgcucccugcugacccuccuguggcacugcagccuggacgcccuccgggaguucuucuccacgaucguggucgacgcgaucgacgugcucaagagccgcuucaccaagcugaacgaguccaccuucgacacccagaucacgaagaagaugggguacuacaagauccucgacgugauguacagccggcugcccaaggacgacguccacgccaaggaguccaagaucaaccagguguuccacggcagcugcaucaccgaggggaacgagcugaccaagacccucaucaagcugugcuacgacgccuucacggagaacauggccggcgagaaccagcugcucgagcgccgccggcuguaccacugcgccgcguacaacugcgccaucuccgucaucugcugcguguucaacgagcugaaguucuaccagggcuuccucuucagcgagaagccggagaagaaccugcugaucuucgagaaccucaucgaccugaagcgccgguacaacuuccccguggaggucgaggugcccauggagcgcaagaagaaguacaucgagauccggaaggaggcccgcgaggccgcgaacggggacuccgacggccccagcuacauguccagccuguccuaccucgccgacagcacccuguccgaggagaugagccaguucgacuucuccaccggggugcagagcuacagcuacuccagccaggacccgcggcccgccaccggccgcuuccggcgccgggagcagcgcgaccccacgguccacgacgacgugcuggagcucgagauggacgagcugaaccggcacgagugcauggcgccccugaccgcccucgugaagcacaugcaccgcucccuggggccgccccagggcgaggaggacagcgucccccgggaccugccguccuggaugaaguuccuccacggcaagcuggggaaccccaucgugccccugaacauccgccucuuccuggcgaagcuggugaucaacaccgaggaggucuuccggcccuacgccaagcacuggcucagcccgcugcugcagcucgccgccuccgagaacaacggcggggagggcauccacuacauggugguggagaucgucgccaccauccugagcuggacgggccuggcgacccccaccggggugcccaaggacgaggugcucgccaaccgccugcugaacuuccucaugaagcacgucuuccaccccaagcgggccguguuccgccacaaccuggagaucaucaagacccugguggagugcuggaaggacugccucuccaucccguaccggcugaucuucgagaaguucagcggcaaggaccccaacuccaaggacaacagcgucgggauccagcugcucggcaucgugauggccaacgaccugccgcccuacgacccccagugcgggauccaguccagcgaguacuuccaggcccuggugaacaacauguccuucguccgcuacaaggagguguacgcggccgccgccgaggugcucggccugauccugcgcuacgucauggagcggaagaacauccucgaggagagccugugcgagcugguggccaagcagcucaagcagcaccagaacacgauggaggacaaguucaucgugugccugaacaaggucaccaaguccuucccgccccuggcggaccgcuucaugaacgccguguucuuccuccugcccaaguuccacggcgugcugaagacccucugccuggaggucgugcugugccggguggaggggaugaccgagcucuacuuccagcucaagagcaaggacuucguccaggugaugcgccaccgggacgacgagcgccagaaggugugccuggacaucaucuacaagaugaugccgaagcucaagcccgucgagcugcgggagcugcucaaccccgugguggaguucgucagccaccccuccacgaccugccgcgagcagauguacaacauccugauguggauccacgacaacuaccgggacccggagagcgagaccgacaacgacucccaggagaucuucaagcuggccaaggacgugcucauccagggccugaucgacgagaaccccgggcugcagcucaucauccgcaacuucuggagccacgagacccggcugcccuccaacacgcuggaccgccuccuggcccugaacagccucuacucccccaagaucgaggugcacuuccugagccuggcgaccaacuuccugcucgagaugaccuccaugagcccggacuaccccaaccccauguucgagcacccccuguccgagugcgaguuccaggaguacaccaucgacagcgacuggcgguuccgcuccacgguccugaccccgauguucguggagacccaggccagccagggcacccuccagacgcggacccaggaggggucccugagcgcccgcuggcccguggccggccagauccgggccacccagcagcagcacgacuucacccugacccagacggcggacggccgcuccagcuucgacuggcucaccggguccagcaccgacccccuggucgaccacaccagcccguccagcgacucccuccuguucgcccacaagcggagcgagcgccugcagcgcgcgccccugaaguccgugggccccgacuucgggaagaagcggcucggccugcccggggacgagguggacaacaaggucaagggcgccgccggccgcacggaccugcuccggcugcgccggcgcuucaugcgggaccaggagaagcugagccucauguacgcgcgcaaggggguggccgagcagaagcgggagaaggagaucaaguccgagcugaagaugaagcaggacgcccaggucgugcuguaccgcagcuaccggcacggcgaccucccggacauccagaucaagcacuccagccugaucacgccccugcaggccguggcccagcgcgaccccaucaucgcgaagcagcuguucuccagccuguucuccgggauccugaaggagauggacaaguucaagacccucagcgagaagaacaacaucacccagaagcugcugcaggacuucaaccgguuccucaacacgaccuucuccuucuucccgcccuucgucagcugcauccaggacaucuccugccagcacgccgcccugcugagccucgaccccgccgcgguguccgccggcugccuggccagccugcagcagcccguggggauccgccuccuggaggaggcccugcuccggcugcugcccgccgagcucccggcgaagcgcguccggggcaaggcccgccugccgcccgacgugcugcgguggguggagcucgccaagcuguaccgcagcaucggcgaguacgacguccugcgggggaucuucaccuccgagaucggcaccaagcagaucacgcagagcgcccuccuggccgaggcgcgcuccgacuacagcgaggccgccaagcaguacgacgaggcccugaacaagcaggacuggguggacggggagcccaccgaggccgagaaggacuucugggagcucgcgucccuggacugcuacaaccaccuggccgaguggaagucccucgaguacugcuccaccgccagcaucgacuccgagaacccgcccgaccugaacaagaucuggagcgagcccuucuaccaggagaccuaccugcccuacaugauccgcuccaagcucaagcugcugcuccagggcgaggccgaccagagccugcugacguucaucgacaaggcgaugcacggcgagcuccagaaggccauccuggagcugcacuacucccaggagcucagccugcuguaccuccugcaggacgacguggaccgggccaaguacuacauccagaacgggauccaguccuucaugcagaacuacagcuccaucgacguccugcuccaccagagccgccugaccaagcugcaguccgugcaggcccucaccgagauccaggaguucaucagcuucaucagcaagcagggcaaccuguccagccaggugccgcugaagcggcuccugaacaccuggacgaaccgcuaccccgacgccaagauggaccccaugaacaucugggacgacaucaucaccaaccggugcuucuuccuguccaagaucgaggagaagcucacgccccugccggaggacaacagcaugaacgucgaccaggacggggaccccuccgaccgcauggaggugcaggagcaggaggaggacaucagcucccugauccggagcugcaaguucuccaugaagaugaagaugaucgacagcgcgcgcaagcagaacaacuucucccucgccaugaagcugcugaaggagcuccacaaggagagcaagacccgggacgacuggcugguguccuggguccagagcuacugccgccugucccacugccggagccgcucccagggcugcagcgagcagguccucacggugcugaagaccgucucccugcucgacgagaacaacgugagcagcuaccuguccaagaacauccuggccuuccgggaccagaacauccugcucgggaccaccuaccgcaucaucgccaacgcccugagcuccgagcccgcgugccuggccgagaucgaggaggacaaggcccggcgcauccucgagcugagcggcuccagcuccgaggacagcgagaaggugaucgccggccuguaccagcgggccuuccagcaccucuccgaggcgguccaggccgccgaggaggaggcccagccgcccagcugguccugcgggcccgccgcgggcgugaucgacgccuacaugacgcuggccgacuucugcgaccagcagcugcgcaaggaggaggagaacgccagcgugaucgacuccgcggagcuccaggccuaccccgcccuggucguggagaagaugcugaaggcccucaagcugaacagcaacgaggcccggcugaaguucccgcgccuccugcagaucaucgagcgcuaccccgaggagacccugucccucaugaccaaggagaucagcuccgugcccugcuggcaguucaucagcuggaucucccacauggucgcgcugcuggacaaggaccaggccguggccgugcagcacagcgucgaggagaucaccgacaacuacccccaggccaucguguacccguucaucaucagcuccgagagcuacuccuucaaggacacgagcaccgggcacaagaacaaggaguucguggcccggaucaaguccaagcucgaccagggcggggucauccaggacuucaucaacgcgcuggaccagcugagcaaccccgagcuccuguucaaggacugguccaacgacgugcgcgccgagcuggccaagacccccgugaacaagaagaacaucgagaagauguacgagcggauguacgccgcccucggcgaccccaaggcgccgggccugggggccuuccgccggaaguucauccagaccuucggcaaggaguucgacaagcacuucgggaagggcgggagcaagcugcuccgcaugaagcuguccgacuucaacgacaucacgaacaugcugcuccugaagaugaacaaggacagcaagccgcccggcaaccugaaggagugcucccccuggaugagcgacuucaaggucgaguuccuccggaacgagcuggagaucccgggccaguacgacgggcgcggcaagccccugcccgaguaccacgugcggaucgccggguucgacgagcgcgugaccgucauggccucccuccggcgccccaagcggaucaucauccgcggccacgacgagcgggagcacccguuccuggugaagggcggggaggaccugcgccaggaccagcggguggagcagcuguuccaggucaugaacggcauccuggcgcaggacagcgccugcucccagcgcgcccugcagcuccggaccuacagcguggugcccaugaccuccagcgacccccgcgcgccgcccugcgaguacaaggacuggcugacgaagaugagcgggaagcacgacgucggcgccuacaugcugauguacaagggggcgaaccggaccgagaccgugaccuccuuccgcaagcgcgagagcaaggugcccgccgaccuccugaagcgggccuucguccgcauguccaccagccccgaggccuuccuggcccuccggucccacuucgcgagcucccacgcccugaucugcaucagccacuggauccugggcaucggcgaccgccaccucaacaacuucaugguggccauggagaccggcggggucaucgggaucgacuucgggcacgccuucggguccgccacccaguuccugcccgugcccgagcugaugcccuuccggcucacccgccaguucaucaaccugaugcugcccaugaaggagaccggccucauguacagcaucauggugcacgcgcugcgggccuuccgcuccgacccgggccugcucacgaacaccauggacgucuucgugaaggagcccagcuucgacuggaagaacuucgagcagaagaugcugaagaagggcggcuccuggauccaggagaucaacguggccgagaagaacugguacccccggcagaagaucugcuacgccaagcgcaagcuggccggggcgaaccccgccgucaucacgugcgacgagcuccugcugggccacgagaaggccccggccuuccgggacuacguggcgguggcccgcgggagcaaggaccacaacauccgggcccaggagcccgaguccggccucagcgaggagacccaggucaagugccugauggaccaggccacggaccccaacauccugggccgcaccugggaggggugggagcccuggauguga

SEQ ID NO: 35064 - RNA, 2016 nt, Artificial Sequence
  derived and/or modified sequence opt1 from PRKG1__Homo_sapiens__NP_001091982
augagcgagcuggaggaggacuucgccaagauccucaugcugaaggaggagcgcaucaaggagcuggagaagcggcucuccgagaaggaggaggagauccaggagcugaagcgcaagcugcacaagugccagagcgugcuccccgucccguccacccacaucggcccccggaccacgcgcgcccaggggaucagcgcggagccccagaccuaccgguccuuccacgaccugcgccaggccuuccggaaguucaccaagagcgagcgcuccaaggaccugaucaaggaggccauccucgacaacgacuucaugaagaaccuggagcugagccagauccaggagaucguggacugcauguaccccguggaguacggcaaggacuccugcaucaucaaggagggggacgucggcagccucguguacgugauggaggacgggaaggucgaggugaccaaggagggcgugaagcugugcacgaugggcccggggaaggucuucggcgagcuggccauccucuacaacugcacccggaccgccaccgugaagacgcuggugaacgucaagcugugggcgaucgaccgccagugcuuccagaccaucaugaugcggaccgggcucaucaagcacaccgaguacauggaguuccugaaguccgugcccacguuccagagccugcccgaggagauccucuccaagcuggccgacgugcuggaggagacccacuacgagaacggcgaguacaucauccgccagggggcccggggcgacaccuucuucaucaucagcaagggcaccgucaacgugacgcgcgaggacucccccagcgaggacccgguguuccuccggacccuggggaagggcgacugguucggggagaaggcccugcagggcgaggacguccgcaccgcgaacgugaucgccgccgaggccgugaccugccucgucaucgaccgggacuccuucaagcaccugaucggcgggcuggacgacgugagcaacaaggccuacgaggacgcggaggccaaggccaaguacgaggccgaggccgcguucuucgccaaccucaagcuguccgacuucaacaucaucgacacgcugggcgucgggggcuucgggcgcguggagcucgugcagcucaagagcgaggagagcaagaccuucgccaugaagauccugaagaagcggcacaucgucgacacccgccagcaggagcacauccgguccgagaagcagaucaugcagggcgcccacagcgacuucaucgugcgccuguaccgcaccuucaaggacuccaaguaccuguacaugcugauggaggccugccucggcggggagcuguggacgauccugcgggaccgcggcagcuucgaggacuccaccacccgguucuacaccgcgugcguggucgaggccuucgccuaccuccacagcaaggggaucaucuaccgcgaccugaagcccgagaaccugauccucgaccaccggggcuacgccaagcugguggacuucggguucgccaagaagaucggcuucggcaagaagacguggaccuucugcgggacccccgaguacguggcgcccgagaucauccugaacaagggccacgacaucuccgccgacuacuggagccucgggauccugauguacgagcugcugaccggcuccccgcccuucagcgggcccgaccccaugaagacguacaacaucauccuccgcggcaucgacaugaucgaguucccgaagaagaucgccaagaacgccgcgaaccugaucaagaagcugugccgggacaaccccuccgagcgccucggcaaccugaagaacggggucaaggacauccagaagcacaagugguucgagggcuucaacugggaggggcugcggaagggcacccucaccccgcccaucauccccagcguggccucccccaccgacacgagcaacuucgacuccuuccccgaggacaacgacgagcccccgcccgacgacaacagcggcugggacaucgacuucuga

SEQ ID NO: 35065 - RNA, 1029 nt, Artificial Sequence
  derived and/or modified sequence opt1 from PRKG2__Homo_sapiens__NP_001269410
augagcaacuggaagcuguccaaggcccucagccuggagaugauccagcugaaggagaagguggcccgcuucuccagcuccagccccuuccagaaccucgagaucaucgcgacccugggcgucgggggcuucgggcggguggagcuggugaaggucaagaacgagaacguggccuucgccaugaagugcauccgcaagaagcacaucguggacaccaagcagcaggagcacgucuacuccgagaagcggauccucgaggagcugugcagccccuucaucgugaagcuguaccgcacguucaaggacaacaaguacguguacaugcuccuggaggccugccugggcggggagcucugguccauccugcgggaccgcggcagcuucgacgagcccaccuccaaguucugcgucgccugcgugaccgaggcguucgacuaccugcaccggcucggcaucaucuaccgcgaccugaagcccgagaaccugauccucgacgccgagggguaccugaagcugguggacuucggcuucgccaagaagaucgggagcggccagaagaccuggacguucugcgggacccccgaguacgucgccccggaggugauccucaacaagggccacgacuucuccguggacuucuggagccugggcauccuggucuacgagcuccugaccgggaacccgcccuucuccggcguggaccagaugaugaccuacaaccugauccucaaggggaucgagaagauggacuucccccggaagaucacgcgccggcccgaggaccugauccgccggcugugccgccagaaccccaccgagcggcucggcaaccugaagaacggcaucaacgacaucaagaagcaccgcuggcugaacggguucaacugggagggccucaaggcgcggagccugcccagcccccugcagcgcgagcucaaggggccgaucgaccacuccuacuucgacaaguacccgcccgagaagggcaugccgcccgacgagcuguccgggugggacaaggacuucuga

SEQ ID NO: 35066 - RNA, 909 nt, Artificial Sequence
  derived and/or modified sequence opt1 from PRKRA__Homo_sapiens__NP_001132989
augcagagcacccccuucugcggcuucugcucccuggggaagaugaucaccgccaagccgggcaagacgcccauccaggugcuccacgaguacgggaugaagaccaagaacauccccgucuacgagugcgagcgcagcgacgugcagauccacgugcccaccuucaccuuccgggucacggugggcgacaucacgugcaccggggagggcaccuccaagaagcuggccaagcaccgcgcggccgaggccgccaucaacauccugaaggccaacgcgagcaucugcuucgccgugccggacccccucaugcccgaccccuccaagcagccgaagaaccagcugaaccccaucggcagccugcaggagcucgccauccaccacggguggcggcugcccgaguacacccugucccaggagggcgggcccgcccacaagcgcgaguacaccaccaucugccggcucgagagcuucauggagaccggcaagggggcguccaagaagcaggccaagcgcaacgccgccgagaaguuccuggccaaguucagcaacaucuccccggagaaccacaucagccugacgaacgucgugggccacucccucggcugcaccuggcacagccugcggaacucccccggggagaagaucaaccugcucaagcgcagccugcuguccauccccaacaccgacuacauccagcuccugagcgagaucgcgaaggagcagggcuucaacaucaccuaccuggacaucgacgagcucuccgccaacgggcaguaccagugccuggccgagcugagcacgagccccaucaccgugugccacggcuccggcaucagcugcgggaacgcccaguccgacgccgcgcacaacgcccuccaguaccugaagaucaucgccgagcggaaguga

SEQ ID NO: 35067 - RNA, 2286 nt, Artificial Sequence
  derived and/or modified sequence opt1 from PRKRIR__Homo_sapiens__NP_004696
augcccaacuucugcgccgccccgaacugcacccgcaagagcacccaguccgaccuggcguucuuccgguucccccgcgaccccgcccggugccagaaguggguggagaacugccgccgggccgaccucgaggacaagacgcccgaccagcugaacaagcacuaccgccugugcgccaagcacuucgagaccagcaugaucugccggaccuccccguaccgcaccguccuccgggacaacgccauccccacgaucuucgaccugaccagccaccugaacaacccccacucccgccaccggaagcgcaucaaggagcucagcgaggacgagauccggacccugaagcagaagaagaucgacgagaccuccgagcaggagcagaagcacaaggagacgaacaacagcaacgcgcagaaccccuccgaggaggagggcgaggggcaggacgaggacauccugccgcucacccuggaggagaaggagaacaaggaguaccucaagagccucuucgagauccugauccugaugggcaagcagaacaucccccucgacgggcacgaggccgacgagauccccgagggccuguucacccccgacaacuuccaggcccugcucgagugccgcaucaacuccggggaggaggugcugcggaagcgcuucgagaccacggccgugaacacccuguucugcagcaagacccagcagcggcagaugcucgagaucugcgaguccugcauccgcgaggagacccugcgggagguccgcgacagccacuucuucuccaucaucacggacgacgugguggacaucgcgggcgaggagcaccucccgguccuggugcgguucguggacgagagccacaaccugcgcgaggaguucaucggcuuccugcccuacgaggccgacgccgagauccucgccgucaaguuccacaccaugaucaccgagaagugggggcugaacauggaguacugccgcggccaggccuacaucguguccagcggguucuccagcaagaugaagguggucgcgagccggcugcucgagaaguacccccaggccaucuacacccugugcuccagcugcgcccugaacauguggcucgccaaguccgugcccgugaugggcgucagcguggcccuggggacgaucgaggaggugugcuccuucuuccaccgcagcccgcagcugcuccuggagcuggacaacgucaucuccgugcuguuccagaacagcaaggagcggggcaaggagcugaaggagaucugccacucccaguggaccggccgccacgacgcguucgagauccugguggagcuccugcaggcccugguccucugccuggacgggaucaacagcgacaccaacauccgguggaacaacuacaucgccggccgcgccuucgugcugugcuccgccgugagcgacuucgacuucaucgucaccaucgugguccucaagaacgugcuguccuucacgcgggcguucgggaagaaccugcagggccagaccagcgacguguucuucgccgccggcucccugaccgccguccuccacagccugaacgaggugauggagaacaucgagguguaccacgaguucugguucgaggaggccaccaaccuggcgacgaagcucgacauccagaugaagcugcccgggaaguuccgccgggcccaccagggcaaccuggagucccagcucaccagcgaguccuacuacaaggagacccugagcguccccaccguggagcacaucauccaggagcugaaggacaucuucagcgagcagcaccucaaggcccugaagugccugucccucgugcccagcgucauggggcagcugaaguucaacacguccgaggagcaccacgccgacauguaccgcagcgaccugccgaaccccgacacccucuccgcggagcugcacugcuggcggaucaaguggaagcaccgcggcaaggacaucgagcugcccagcaccaucuacgaggcccuccaccuccccgacaucaaguucuucccgaacguguacgcccugcugaaggugcugugcauccugcccgucaugaagguggagaacgagcgguacgagaacgggcgcaagcggcucaaggccuaccugcgcaacacccugacggaccagcgguccagcaaccucgcccugcugaacaucaacuucgacaucaagcacgaccucgaccugaugguggacaccuacaucaagcuguacaccuccaagagcgagcuccccaccgacaacuccgagaccgucgagaacacguga

SEQ ID NO: 35068 - RNA, 1077 nt, Artificial Sequence
  derived and/or modified sequence opt1 from PRKX__Homo_sapiens__NP_005035
auggaggcccccggccuggcccaggcggccgccgccgagagcgacucccgcaagguggccgaggagaccccggacggggcgcccgcccucugccccagccccgaggcccuguccccggagccgcccgucuacagccugcaggacuucgacacccucgccacggugggcaccgggaccuucggccgggugcaccuggucaaggagaagaccgcgaagcacuucuucgcccugaaggugauguccauccccgacgugauccgccucaagcaggagcagcacguccacaacgagaaguccgugcugaaggaggugagccaccccuuccugauccgccucuucuggacguggcacgacgagcgguuccuguacaugcugauggaguacguccccgggggcgagcuguucagcuaccuccggaaccgcggccgguucuccagcaccaccgggcuguucuacuccgccgagaucaucugcgccaucgaguaccuccacagcaaggagaucguguaccgcgaccugaagcccgagaacauccugcucgaccgggacggccacaucaagcugaccgacuucggguucgccaagaagcugguggaccgcacguggacccucugcggcacccccgaguaccuggcgccggaggucauccaguccaaggggcacggccgggccguggacuggugggcccugggcauccucaucuucgagaugcugagcggguucccgcccuucuucgacgacaaccccuucggcaucuaccagaagauccuggccgggaagaucgacuucccccgccaccucgacuuccacgugaaggaccugaucaagaagcugcucgucguggaccggacccgccggcugggcaacaugaagaacggcgccaacgacgugaagcaccaccgcugguuccgguccgucgacugggaggcggugccccagcgcaagcugaagccgcccaucgugcccaagaucgccggggacggcgacacgagcaacuucgagaccuaccccgagaacgacugggacaccgccgcccccgucccccagaaggaccucgagaucuucaagaacuucuga

SEQ ID NO: 35069 - RNA, 264 nt, Artificial Sequence
  derived and/or modified sequence opt1 from PRLH__Homo_sapiens__NP_056977
augaaggugcugcgcgccuggcuccugugccugcucaugcugggccuggcccuccgcggggcggccagccggacccaccggcacuccauggagauccgcacccccgacaucaacccggccugguacgccagccggggcauccgccccgucgggcgguucggccgccggcgcgccacgcugggggacgugcccaagcccggccugcggccgcgccugaccugcuucccccucgagggcggggcgauguccagccaggacggcuga

SEQ ID NO: 35070 - RNA, 684 nt, Artificial Sequence
  derived and/or modified sequence opt1 from PRL__Homo_sapiens__NP_000939
augaacaucaagggcagccccuggaaggggucccugcuccugcugcucgugagcaaccugcugcucugccaguccgucgccccgcugcccaucugccccggcggggccgcgcgcugccaggugacccugcgggaccucuucgaccgcgccgugguccugagccacuacauccacaaccuguccagcgagauguucuccgaguucgacaagcgguacacccacggccgcggguucaucacgaaggccaucaacagcugccacaccuccagccucgccacccccgaggacaaggagcaggcccagcagaugaaccagaaggacuuccugucccugaucgugagcauccuccgguccuggaacgagccgcuguaccaccuggugaccgagguccgcggcaugcaggaggcgcccgaggccauccucagcaaggccguggagaucgaggagcagacgaagcggcugcuggagggcauggagcucaucgugucccagguccaccccgagaccaaggagaacgagaucuaccccguguggagcgggcugccgucccugcagauggccgacgaggagagccgccucuccgcguacuacaaccugcugcacugccuccggcgcgacagccacaagaucgacaacuaccugaagcugcucaagugccggaucauccacaacaacaacugcuga

SEQ ID NO: 35071 - RNA, 1113 nt, Artificial Sequence
  derived and/or modified sequence opt1 from PRLHR__Homo_sapiens__NP_004239
auggccagcuccaccacccgcggcccccgggugagcgaccuguucuccgggcucccgcccgccgucacgacccccgccaaccagagcgccgaggccuccgccggcaacgggagcguggccggcgcggacgcccccgccgugaccccguuccagucccugcagcugguccaccagcucaaggggcugaucgugcugcucuacagcguggucgugguggucggccuggugggcaacugccugcucgugcuggucaucgcccgcgugcggcgccugcacaacgugaccaacuuccucaucgggaaccuggcgcuguccgacguccucaugugcacggccugcgugccccugacccuggccuacgccuucgagccccggggcuggguguucgggggcgggcucugccaccuggucuucuuccugcagcccgugaccguguacgucagcguguucacccucacgaccaucgccguggaccgcuacgucgugcugguccacccgcugcggcgccggaucucccuccgccugagcgcguacgccgugcuggccaucugggcccucuccgccgugcuggcgcugcccgccgccguccacaccuaccacguggagcucaagccccacgacgugcggcugugcgaggaguucuggggcagccaggagcgccagcggcagcuguacgccuggggccuccugcuggucaccuaccuccugccccugcucgugauccugcuguccuacgugcgcgucagcgugaagcuccggaaccgcguggucccggggugcgugacgcagucccaggccgacugggaccgggcgcgccggcgccggaccuucugccugcugguggucgugguggucguguucgccgugugcuggcucccccugcacgucuucaaccugcuccgcgaccuggacccccacgccaucgaccccuacgccuucggccuggugcagcugcucugccacuggcuggccaugagcuccgcgugcuacaacccguucaucuacgccuggcugcacgacagcuuccgcgaggagcuccggaagcugcugguggccuggccccgcaagaucgcgccccacgggcagaacaugaccgucagcguggugaucuga

SEQ ID NO: 35072 - RNA, 1566 nt, Artificial Sequence
  derived and/or modified sequence opt1 from PRLR__Homo_sapiens__NP_001191243
augaaggagaacguggccagcgccaccgucuucacccugcuccuguuccugaacacgugccuccugaacgugcagcccgacccgccccuggagcucgcgguggaggucaagcagcccgaggaccgcaagcccuaccuguggaucaagugguccccgcccacccugaucgaccucaagaccggcugguucacccugcuguacgagauccggcucaagcccgagaaggccgccgagugggagauccacuucgccgggcagcagacggaguucaagauccugagccugcaccccggccagaaguaccucguccaggugcgcugcaagcccgaccacggguacugguccgccuggagccccgcgaccuucauccagauccccuccgacuucaccaugaacgacaccacggucuggaucagcguggccgugcuguccgccgucaucugccugaucaucgugugggccguggcgcucaagggcuacagcauggugaccugcaucuucccgcccgugcccgggcccaagaucaagggcuucgacgcccaccuccuggagaagggcaaguccgaggagcugcugagcgcccuggggugccaggacuucccgcccaccuccgacuacgaggaccuccugguggaguaccuggaggucgacgacagcgaggaccagcaccucauguccgugcacagcaaggagcaccccucccagggcaugaagcccaccuaccuggaccccgacacggacagcgggcggggcuccugcgacagcccgucccugcucagcgagaagugcgaggagccccaggccaaccccagcaccuucuacgaccccgaggugaucgagaagccggagaaccccgagaccacccacacgugggacccccagugcaucuccauggaggggaagauccccuacuuccacgccggcggcagcaagugcuccaccuggccgcugccccagcccagccagcacaacccgcgcuccagcuaccacaacaucaccgacgucugcgagcuggcgguggggcccgccggcgcccccgccacccuccugaacgaggccgggaaggacgcgcugaaguccagccagacgaucaagucccgggaggagggcaaggccacccagcagcgcgagguggagagcuuccacuccgagaccgaccaggacacccccuggcuccugccgcaggagaagacgcccuucggcagcgccaagccccuggacuacgucgagauccacaaggugaacaaggacggggcccucucccugcugcccaagcagcgggagaacagcggcaagccgaagaagcccgggacccccgagaacaacaaggaguacgccaagguguccggcgucauggacaacaacauccucgugcugguccccgacccgcacgcgaagaacguggccugcuucgaggagagcgccaaggaggccccgcccucccuggagcagaaccaggccgagaaggcgcucgccaacuucaccgccaccagcuccaagugccgccugcagcucgggggccuggacuaccuggaccccgccugcuucacgcacagcuuccacuga

SEQ ID NO: 35073 - RNA, 156 nt, Artificial Sequence
  derived and/or modified sequence opt1 from PRM1__Homo_sapiens__NP_002752
auggcccgcuaccggugcugccgcagccagucccggagccgcuacuaccggcagcgccagcggucccgccggcgccggcgccggagcugccagacccgccggcgcgccaugcggugcugccgcccccgguaccgcccgcggugccgccgccacuga

SEQ ID NO: 35074 - RNA, 423 nt, Artificial Sequence
  derived and/or modified sequence opt1 from PRM2__Homo_sapiens__NP_001273285
auggugcgcuaccggguccgcagccuguccgagcggagccacgagguguaccgccagcagcuccacggccaggagcaggggcaccacggccaggaggagcaggggcugucccccgagcacguggaggucuacgagcggacccacggccagagccacuaccgccggcgccacugcucccggcgccggcugcaccgcauccaccggcgccagcaccggagcugccgccggcgcaagcggcgcuccugccggcaccgccgccggcaccgccgggagagccucggggacccgcugaaccagaacuuccugucccagaaggccgccgagcccggccgcgagcacgcggagggcaccaagcuccccgggccccugacgccgagcuggaagcugcggaagucccgccccaagcaccaggugcggcccuga

SEQ ID NO: 35075 - RNA, 312 nt, Artificial Sequence
  derived and/or modified sequence opt1 from PRM3__Homo_sapiens__NP_067070
augggcagccgcugcgccaagcugaacaccgggcagucccccggccacagcccggggcacuccaccggccacgggcggggccacgagagcuccaugaagaagcucauggccugcgugagccaggacaacuucucccugagcuccgcgggcgaggaggaggaggaggaggaggaggagggggaggaggaggagaaggaggagcugcccguccagggcaagcuccugcugcucgagcccgagcgccaggaggaggggcacaaggacaacgccgaggcccagcagagccccgagccgaagcggacgcccuccuga

SEQ ID NO: 35076 - RNA, 1116 nt, Artificial Sequence
  derived and/or modified sequence opt1 from PRMT1__Homo_sapiens__NP_001527
auggccgccgcggaggccgccaacugcaucauggagaacuucguggccacccuggccaacggcaugagccuccagcccccgcuggaggaggucuccugcgggcaggcggagagcuccgagaagcccaacgccgaggacaugaccagcaaggacuacuacuucgacuccuacgcccacuucggcauccacgaggagaugcugaaggacgaggugcgcacgcucaccuaccggaacagcauguuccacaaccgccaccuguucaaggacaaggugguccuggacgugggguccggcaccgggauccucugcauguucgccgcgaaggccggcgcccggaaggugaucggcaucgagugcagcuccaucagcgacuacgccgucaagaucgugaaggccaacaagcuggaccacguggucaccaucaucaaggggaagguggaggagguggagcugcccgucgagaagguggacaucaucaucuccgaguggaugggcuacugccucuucuacgagagcaugcugaacacggugcuguacgcgcgcgacaaguggcucgcccccgacgggcugaucuucccggaccgggccacccuguacgucaccgccaucgaggaccgccaguacaaggacuacaagauccacuggugggagaacguguacggcuucgacauguccugcaucaaggacguggccaucaaggagccccucgucgacgugguggaccccaagcagcuggucaccaacgcgugccugaucaaggagguggacaucuacacggugaaggucgaggaccucaccuucaccagccccuucugccuccaggugaagcggaacgacuacguccacgcccugguggccuacuucaacaucgaguucacccgcugccacaagcggacgggguucuccaccagcccggagucccccuacacccacuggaagcagaccguguucuacauggaggacuaccugacggucaagaccggcgaggagaucuucggcaccaucgggaugcgccccaacgccaagaacaaccgggaccuggacuucaccaucgaccuggacuucaagggccagcucugcgagcugagcugcuccacggacuaccgcaugcgguga

SEQ ID NO: 35077 - RNA, 996 nt, Artificial Sequence
  derived and/or modified sequence opt1 from PRMT2__Homo_sapiens__NP_001229793
auggccaccagcggcgacugcccccgcuccgagagccagggggaggagccggccgagugcuccgaggcgggccugcuccaggagggggugcagcccgaggaguucgucgccaucgccgacuacgccgccaccgacgagacgcagcugagcuuccugcggggcgagaagauccucauccugcgccagaccaccgcggacuggugguggggcgagcgggccggcugcugcggcuacauccccgccaaccacguggggaagcacguggacgaguacgaccccgaggacaccuggcaggacgaggaguacuucggcuccuacgggacgcugaagcuccaccuggagaugcuggccgaccagccgcgcaccaccaaguaccacagcgucauccuccagaacaaggagucccugaccgacaaggugauccuggacgugggcugcgggacgggcaucaucagccucuucugcgcgcacuacgcccggccccgcgccgucuacgccguggaggccuccgagauggcgcagcacaccggccagcuggugcugcagaacggguucgccgacaucaucaccgucuaccagcagaagguggaggacgugguccuccccgagaagguggacgugcuggucagcgaguggauggggaccugccugcucacgcugcgcggggagcugcgguucgacauccggaaggccggcacccuccacggcuucaccgccugguucuccgugcacuuccagagccugcaggaggggcagcccccgcagguccuguccaccggccccuuccaccccacgacccacuggaagcagacccucuucaugauggacgaccccgugccggugcacaccggggacguggucacgggcagcguggugcugcagcgcaaccccgucuggcggcgccacauguccguggcccugagcugggcggucaccucccggcaggaccccaccagccagaaggugggggagaagguguuccccaucuggcgcuga

SEQ ID NO: 35078 - RNA, 1410 nt, Artificial Sequence
  derived and/or modified sequence opt1 from PRMT3__Homo_sapiens__NP_001138638
augugcagccuggccuccggcgccaccggguacagccaccuccugaagaagcacuuccacaccgugucccugagcaucucccucauccugacggcgugguucaucaacaugaaccccaccgucgaguacaugaacagcaucuacaacccggugcccugggagaaggaggaguaccugaagcccgugcucgaggacgaccugcugcuccaguucgacgucgaggaccuguacgagcccguguccgugccguucagcuaccccaacggccuguccgagaacaccagcgucguggagaagcucaagcacauggaggcccgcgcccuguccgccgaggccgcgcuggcccgggcccgcgaggaccuccagaagaugaagcaguucgcccaggacuucgugaugcacaccgacguccggacgugcagcuccagcaccuccgugaucgcggaccugcaggaggacgaggacgggguguacuucagcuccuacggccacuacgggauccacgaggagaugcugaaggacaagauccgcaccgagagcuaccgggacuucaucuaccagaacccccacaucuucaaggacaaggucgugcucgacgugggcugcggcaccgggauccuguccauguucgccgccaaggccggcgccaagaagguccuggggguggaccagagcgagauccucuaccaggcgauggacaucauccgccugaacaagcuggaggacacgaucacccucaucaagggcaagaucgaggaggugcaccuccccgucgagaagguggacgugaucaucagcgaguggaugggguacuuccugcuguucgaguccaugcuggacagcguccuguacgccaagaacaaguaccucgccaagggcggcuccguguacccggacaucugcaccaucagccugguggccgucuccgacgugaacaagcacgccgaccggaucgcguucugggacgacgucuacggguucaagaugagcugcaugaagaaggccgugauccccgaggccguggucgaggugcuggaccccaagacccucaucuccgagcccugcggcaucaagcacaucgacugccacacgaccagcaucuccgaccuggaguucagcuccgacuucacccugaagaucacccgcacgagcaugugcaccgccaucgccggguacuucgacaucuacuucgagaagaacugccacaaccggguggucuucuccaccggcccgcagagcaccaagacgcacuggaagcagaccguguuccuccuggagaagcccuucuccgugaaggcgggcgaggcccugaaggggaaggucaccgugcacaagaacaagaaggacccccgcagccucaccgugacgcugacccugaacaacuccacccagaccuacggccuccaguga

SEQ ID NO: 35079 - RNA, 1863 nt, Artificial Sequence
  derived and/or modified sequence opt1 from PRMT5__Homo_sapiens__NP_001034708
augcgcggccccaacagcgggaccgagaagggccggcuggugaucccggagaagcagggguucgacuuccucugcaugcccgucuuccacccccgcuucaagcgggaguucauccaggagcccgccaagaaccgcccgggcccccagacccgguccgaccugcugcucagcgggcgcgacuggaacacgcugaucgugggcaagcugucccccuggauccggcccgacagcaagguggagaagauccgccggaacuccgaggccgcgaugcuccaggagcugaacuucggcgccuaccuggggcucccggccuuccugcugccccucaaccaggaggacaacaccaaccuggcccgcguccugaccaaccacauccacaccggccaccacagcuccauguucuggaugcgggugccccucguggcccccgaggaccugcgcgacgacaucaucgagaacgcgccgacgacccacaccgaggaguacagcggggaggagaagaccuggaugugguggcacaacuuccggacgcugugcgacuacuccaagcgcaucgccgucgcccucgagaucggcgccgaccugcccagcaaccacgugaucgaccgguggcugggggagcccaucaaggcggccauccuccccaccuccaucuuccugaccaacaagaagggcuucccggugcugagcaagaugcaccagcgccucaucuuccggcugcugaagcucgagguccaguucaucaucaccggcacgaaccaccacuccgagaaggaguucugcagcuaccugcaguaccuggaguaccucucccagaaccgcccgccgcccaacgccuacgagcuguucgccaagggguacgaggacuaccugcagagcccccuccagccccugauggacaaccuggagucccagaccuacgagguguucgagaaggaccccaucaaguacagccaguaccagcaggccaucuacaagugccuccuggaccgggugcccgaggaggagaaggacaccaacguccaggugcugauggugcucggcgcggggcgcggcccccuggucaacgccucccugcgggccgccaagcaggccgaccgccgcaucaagcucuacgcgguggagaagaaccccaacgccguggucacccuggagaacuggcaguucgaggaguggggcagccaggugacgguggucagcuccgacaugcgggaguggguggcccccgagaaggccgacaucaucgugagcgagcugcucggguccuucgccgacaacgagcugagccccgagugccuggacggcgcgcagcacuuccucaaggacgacggggucuccaucccgggcgaguacaccagcuuccuggcccccaucuccagcuccaagcuguacaacgaggugcgcgccugccgggagaaggaccgcgaccccgaggcccaguucgagaugccguacgucgugcggcugcacaacuuccaccagcucagcgcgccccagcccugcuucaccuucucccaccccaaccgcgacccgaugaucgacaacaaccgguacugcacccuggaguuccccguggaggucaacacggugcugcacggguucgccggcuacuucgagaccgugcucuaccaggacaucacccugagcauccgccccgagacccacucccccggcauguucagcugguucccgauccuguuccccaucaagcagcccaucacgguccgggaggggcagaccaucugcgugcgcuucuggcggugcuccaacagcaagaaggugugguacgagugggccgucaccgcccccgugugcuccgccauccacaacccgaccggccgcagcuacacgaucgggcucuga

SEQ ID NO: 35080 - RNA, 1158 nt, Artificial Sequence
  derived and/or modified sequence opt1 from PRMT8__Homo_sapiens__NP_001243465
auggagagccuggccuccgacggcuucaagcucaaggaggugagcuccgucaacagcccgcccucccagccgccccagcccguggugcccgccaagcccguccagugcgugcaccacgugagcacccagcccuccugccccgggcgcggcaagaugagcaagcugcugaacccggaggagaugaccucccgggacuacuacuucgacagcuacgcgcacuucgggauccacgaggagaugcucaaggacgagguccgcacgcugaccuaccggaacuccauguaccacaacaagcacguguucaaggacaaggugguccuggacgugggcagcgggaccggcauccucuccauguucgccgccaaggccggcgccaagaagguguucgggaucgagugcagcuccaucagcgacuacuccgagaagaucaucaaggcgaaccaccuggacaacaucaucaccaucuucaagggcaaggucgaggagguggagcugcccguggagaaggucgacaucaucaucagcgaguggaugggguacugccucuucuacgaguccaugcugaacacggugaucuucgcccgcgacaaguggcugaagcccggcgggcucauguuccccgaccgggccgcccuguacguggucgcgaucgaggaccgccaguacaaggacuucaagauccacuggugggagaacguguacggcuucgacaugaccugcauccgggacguggccaugaaggagccgcuggucgacaucguggaccccaagcaggucgugaccaacgccugccucaucaaggagguggacaucuacaccgucaagacggaggagcugagcuucaccagcgccuucugccugcagauccagcgcaacgacuacgugcacgcccucgugaccuacuucaacaucgaguucaccaagugccacaagaagaugggcuucuccacggcgcccgacgcccccuacacccacuggaagcagaccgucuucuaccuggaggacuaccugaccgugcggcgcggggaggagaucuacggcacgaucagcaugaagccgaacgccaagaacgugcgggaccucgacuucaccgucgaccuggacuucaaggggcagcugugcgagaccuccgugagcaacgacuacaagaugcgcuga

SEQ ID NO: 35081 - RNA, 531 nt, Artificial Sequence
  derived and/or modified sequence opt1 from PRND__Homo_sapiens__NP_036541
augcgcaagcaccugagcuggugguggcucgccaccgugugcaugcugcuguucucccaccucagcgccguccagacccggggcaucaagcaccgcaucaaguggaaccggaaggcgcugcccuccacggcccagaucaccgaggcccagguggccgagaaccgcccgggggccuucaucaagcagggccggaagcuggacaucgacuucggggcggagggcaaccgcuacuacgaggccaacuacuggcaguuccccgacgggauccacuacaacggcugcagcgaggccaacgugaccaaggaggccuucgucaccggcugcaucaacgcgacgcaggccgccaaccagggggaguuccagaagcccgacaacaagcuccaccagcagguccuguggcggcuggugcaggagcucugcucccugaagcacugcgaguucuggcuggagcgcggcgccgggcuccgggugaccaugcaccagcccgugcugcugugccuccuggcccugaucuggcucaccgugaaguga

SEQ ID NO: 35082 - RNA, 762 nt, Artificial Sequence
  derived and/or modified sequence opt1 from PRNP__Homo_sapiens__NP_001073592
auggccaaccugggcugcuggaugcucgugcuguucgucgccaccuggagcgaccuggggcucugcaagaagcgccccaagcccggcggguggaacaccggcgggucccgguaccccggccagggcagccccgggggcaaccgcuacccgccccagggcggcgggggcuggggccagccccacgggggcggguggggccagccccacggcgggggcugggggcagccccacggcgggggcuggggccagccgcacgggggcggguggggccagggcgggggcacgcacucccaguggaacaagcccagcaagcccaagaccaacaugaagcacauggcgggggccgccgccgccggcgcgguggugggcgggcucggcggguacaugcugggguccgccaugagccggcccaucauccacuucggguccgacuacgaggaccgcuacuaccgggagaacaugcaccgcuacccgaaccaggucuacuaccggcccauggacgaguacagcaaccagaacaacuucgugcacgacugcgugaacaucaccaucaagcagcacaccgucacgaccaccaccaagggcgagaacuucacggagaccgacgugaagaugauggagcgcguggucgagcagaugugcaucacccaguacgagcgggagucccaggccuacuaccagcgcgggagcuccaugguccuguucagcuccccgcccgugauccugcugaucagcuuccucaucuuccugaucgugggcuga

SEQ ID NO: 35083 - RNA, 1386 nt, Artificial Sequence
  derived and/or modified sequence opt1 from PROC__Homo_sapiens__NP_000303
auguggcagcugaccagccuccugcuguucguggccaccuggggcaucagcgggacgcccgccccgcucgacagcgucuucuccagcuccgagcgcgcccaccaggugcugcggauccgcaagcgggccaacagcuuccuggaggagcuccgccacuccagccuggagcgggagugcaucgaggagaucugcgacuucgaggaggccaaggagaucuuccagaacguggacgacacccuggccuucugguccaagcacgucgacggcgaccagugccucgugcugccccuggagcaccccugcgccagccucugcugcgggcacgggaccugcaucgacggcaucggcuccuucagcugcgacugccgcuccggcugggaggggcgguucugccagcgcgaggugagcuuccugaacugcucccuggacaacggcgggugcacccacuacugccucgaggaggucggcuggcggcgcugcagcugcgcgcccggguacaagcugggcgacgaccugcuccagugccacccggccgugaaguuccccugcggccggcccuggaagcgcauggagaagaagcggucccaccugaagcgcgacacggaggaccaggaggaccagguggacccccggcugaucgacgggaagaugacccgccggggcgacagcccguggcaggucgugcuccuggacuccaagaagaagcuggccugcggggccgugcucauccaccccagcuggguccugaccgcggcccacugcauggacgagagcaagaagcugcucgugcgccugggcgaguacgaccugcggcgcugggagaagugggagcucgaccuggacaucaaggagguguucguccaccccaacuacuccaagagcaccacggacaacgacaucgcccugcuccaccuggcccagcccgccacccugucccagaccaucgugccgaucugccuccccgacagcggccuggcggagcgggagcugaaccaggccgggcaggagacccucgugacgggcuggggguaccacuccagccgcgagaaggaggccaagcgcaaccggaccuucguccugaacuucaucaagauccccguggugccccacaacgagugcuccgaggucaugagcaacaugguguccgagaacaugcugugcgccggcauccucggggaccgccaggacgccugcgagggcgacagcggcgggccgaugguggcguccuuccacggcaccugguuccuggucgggcuggugagcuggggcgaggggugcggccuccugcacaacuacggcgucuacaccaaggugucccgguaccuggacuggauccacgggcacauccgcgacaaggaggcgccccagaaguccugggcccccuga

SEQ ID NO: 35084 - RNA, 717 nt, Artificial Sequence
  derived and/or modified sequence opt1 from PROCR__Homo_sapiens__NP_006395
augcugacgacccuccugcccauccugcuccugagcggcugggccuucugcucccaggacgccagcgacgggcugcagcgccuccacaugcugcagaucuccuacuuccgggaccccuaccacgugugguaccagggcaacgcgagccucgggggccaccugacgcacguccuggaggggcccgacaccaacaccaccaucauccagcugcagccccuccaggagcccgaguccugggcccgcacgcagagcggccugcaguccuaccugcuccaguuccacggccuggugcggcuggugcaccaggagcgcacccucgccuucccgcugaccauccggugcuuccuggggugcgagcucccgcccgagggcagccgcgcccacgucuucuucgagguggccgugaacggguccagcuucgucuccuuccggcccgagcgcgcgcuguggcaggccgacacccaggugacgagcggcguggucaccuucacccugcagcagcucaacgccuacaaccggacccgcuacgagcugcgggaguuccuggaggacacgugcgugcaguacgugcagaagcacaucuccgccgagaacaccaaggggagccagaccucccgcagcuacaccucccucguccugggcgugcuggugggcagcuucaucaucgcgggggucgccgugggcaucuuccucugcaccgggggccggcgcugcuga

SEQ ID NO: 35085 - RNA, 1230 nt, Artificial Sequence
  derived and/or modified sequence opt1 from PRODH__Homo_sapiens__XP_011528580
auggccguggcccgcaucagcggcaccuccaacacccggcccacggggccgagcggcaccgcggggauggucuccagcgugcccgcccccaccuccacccccaugcgcccgagcgccacggccaccuggcggcacuccugcgccgcgagcaagccccagcugcaguucuccgaggugcucgccaaguggcgcugcuucuuccaccagauggccgucgagcagggccaggccgggcuggcggccauggacaccaagcuggagguggccgugcuccaggagagcgucgccaagcugggcaucgccucccgggcggagaucgaggacugguucaccgccgagacgcugggcgugagcgggaccauggaccuccuggacugguccagccugaucgacucccgcaccaagcucagcaagcaccuggugguccccaacgcccagaccggccagcuggagccccuccugucccgguucacggaggaggaggagcugcagaugacccgcaugcuccagcggauggacgugcuggccaagaaggccaccgagaugggggugcgccugauggucgacgcggagcagaccuacuuccagccggccaucagccggcucacgcuggagaugcagcgcaaguucaacguggagaagccccugaucuucaacaccuaccagugcuaccucaaggacgccuacgacaacgugacccuggacgucgagcuggcccggcgcgagggcuggugcuucggggccaagcucgugcggggcgcguaccuggcccaggagcgcgcccgggccgccgagaucggcuacgaggaccccaucaaccccaccuacgaggcgacgaacgccauguaccaccgcugccuggacuacgugcucgaggagcugaagcacaacgccaaggccaaggucaugguggcgucccacaacgaggacaccgugcgguucgcccugcgccggauggaggagcucgggcugcacccggccgaccaccgcgucuacuucggccagcugcucgggaugugcgaccagaucagcuucccccugggccaggccggcuaccccguguacaaguacgugcccuacgggccggucauggaggugcugcccuaccucagccgccgggcccuggagaacuccagccugaugaagggcacccaccgcgagcggcagcuccuguggcuggagcuccugcgccggcugcgcaccgggaaccucuuccaccggcccgcguga

SEQ ID NO: 35086 - RNA, 390 nt, Artificial Sequence
  derived and/or modified sequence opt1 from PROK2__Homo_sapiens__NP_001119600
augcgcagccugugcugcgcgccccuccugcugcuccugcugcucccgccccugcugcucaccccgcgggccggcgacgccgccgugaucaccggggccugcgacaaggacucccagugcggcgggggcaugugcugcgccgucagcaucugggugaaguccauccgcaucugcacccccauggggaagcugggcgacagcugccacccccugacccggaagaacaacuucggcaacgggcgccaggagcggcgcaagcggaagcgcuccaagcggaagaaggaggugcccuucuucggccgccggaugcaccacacgugccccugccuccccgggcuggccugccugcgcaccagcuucaaccgguucaucugccucgcgcagaaguga

SEQ ID NO: 35087 - RNA, 1182 nt, Artificial Sequence
  derived and/or modified sequence opt1 from PROKR1__Homo_sapiens__NP_620414
auggagaccaccaugggcuucauggacgacaacgccacgaacaccagcaccuccuuccugagcgugcucaacccccacggggcccacgcgaccuccuucccguucaacuucagcuacuccgacuacgacaugccccuggacgaggacgaggacgucacgaacagccgcaccuucuucgccgccaagaucgugaucggcauggcccugguggggaucaugcucgucugcggcaucgggaacuucaucuucaucgccgcgcuggugcgguacaagaagcugcgcaaccucaccaaccugcugaucgccaaccucgccaucuccgacuuccugguggccaucgucugcugccccuucgagauggacuacuacguggugcggcagcugagcugggagcacggccacguccucugcaccuccgugaacuaccugcgcacggugagccuguacgucuccaccaacgcgcuccuggccaucgccaucgaccgguaccuggccaucgugcacccccuccgcccgcggaugaagugccagaccgccaccggccugaucgcgcugguguggacggucagcauccucaucgccauccccuccgccuacuucaccaccgagaccgugcuggugaucgucaagagccaggagaagaucuucugcgggcagaucuggcccguggaccagcagcuguacuacaaguccuacuuccucuucaucuucggcaucgaguucguggggcccgucgugacgaugacccugugcuacgcccgcaucagccgggagcugugguucaaggccgugccgggcuuccagaccgagcagauccgcaagcggcuccgcugccggcgcaagaccguccuggugcugaugugcauccucacggcguacguccugugcugggcccccuucuacggguucaccaucgugcgggacuucuuccccaccguguucgucaaggagaagcacuaccugaccgccuucuacaucguggagugcaucgccauguccaacagcaugaucaacacgcucugcuucgugaccgucaagaacgacaccgugaaguacuucaagaagaucaugcugcugcacuggaaggccuccuacaacggcggcaagagcagcgcggaccucgaccugaagaccaucgggaugcccgccacggaggagguggacugcauccgccugaaguga

SEQ ID NO: 35088 - RNA, 1155 nt, Artificial Sequence
  derived and/or modified sequence opt1 from PROKR2__Homo_sapiens__NP_658986
auggccgcccagaacggcaacaccagcuucacccccaacuucaacccgccccaggaccacgcguccagccuguccuucaacuucagcuacggggacuacgaccuccccauggacgaggacgaggacaugacgaagacccgcaccuucuucgccgccaagaucgugaucggcaucgcccuggccgggaucaugcuggucugcggcaucgggaacuucguguucaucgcggcccucacccgguacaagaagcugcgcaaccugacgaaccuccugaucgccaaccuggccaucuccgacuuccucguggcgaucaucugcugccccuucgagauggacuacuacgucgugcggcagcugagcugggagcacggccacgugcugugcgccuccgucaacuaccuccgcaccgugagccuguacguguccaccaacgcccugcucgccaucgccaucgaccgguaccuggcgaucguccacccgcugaagccccgcaugaacuaccagaccgccagcuuccucaucgcccugguguggaugguguccauccugaucgccauccccagcgccuacuucgcgacggagaccguccucuucaucgugaagucccaggagaagaucuucugcggccagaucuggcccguggaccagcagcuguacuacaagagcuacuuccuguucaucuucggggucgaguucgugggcccgguggucaccaugacccucugcuacgcccggaucucccgcgagcugugguucaaggccgugcccggguuccagacggagcagauccggaagcgccugcggugccgccggaagaccgugcucguccugaugugcauccugaccgccuacgugcucugcugggcccccuucuacggcuucaccaucgugcgcgacuucuuccccacggucuucgugaaggagaagcacuaccugaccgcguucuacgucguggagugcaucgccaugagcaacuccaugaucaacaccgugugcuucgucaccgugaagaacaacacgaugaaguacuucaagaagaugaugcugcuccacuggcggccgagccagcgcggguccaagagcagcgccgaccuggaccugcggaccaacggcgugcccaccaccgaggaggucgacugcauccgccucaaguga

SEQ ID NO: 35089 - RNA, 747 nt, Artificial Sequence
  derived and/or modified sequence opt1 from PROL1__Homo_sapiens__NP_067048
augaagcugaccuucuuccucggccugcuggcccucaucagcugcuucacccccuccgagagccagcgcuucucccggcgcccguaccugcccgggcagcugccgcccccgccccucuaccggccccgcugggugcccccgagcccgccgccgcccuacgacucccggcugaacagcccccugucccuccccuucguccccggccgcgugccgcccagcuccuucagccgguucucccaggccgugauccugagccagcuguucccccucgaguccauccgccagccccggcuguuccccggguaccccaaccugcacuucccccuccgccccuacuacgucggccccauccggauccugaagccgcccuucccgcccauccccuucuuccuggcgaucuaccuccccaucagcaaccccgagccccagaucaacaucacgaccgccgacaccaccaucacgaccaacccgcccaccaccgccacggccaccaccuccaccagcacgaagcccaccaugaccaucuccagcuccaccgugcccaucagcagcacgcccgagcccgccaccuccaucagcgcggccacccccgccgccuccaccgagaacacgacccagauccuggcgaaccgcccccacaccgugcugcucaacgccaccguccaggugacgaccagcaaccagaccauccuguccagccccgccuucaaguccuucuggcagaagcuguucgccaucuucggguga

SEQ ID NO: 35090 - RNA, 2571 nt, Artificial Sequence
  derived and/or modified sequence opt1 from PROM1__Homo_sapiens__NP_001139319
auggcccuggugcucggcagccugcugcuccuggggcugugcggcaacuccuucagcgggggccagcccuccagcaccgacgccccgaaggcguggaacuacgagcuccccgccaccaacuacgagacgcaggacucccacaaggccgggcccaucggcauccuguucgagcugguccacaucuuccucuacguggugcagccccgcgacuucccggaggacacccugcggaaguuccugcagaaggccuacgagagcaagaucgacuacgacaagaucgucuacuacgaggccggcaucauccucugcugcgugcuggggcugcuguucaucauccugaugccccuggugggcuacuucuucugcaugugccgcugcugcaacaagugcgggggcgagaugcaccagcggcagaaggagaacgggcccuuccuccgcaagugcuucgcgaucucccugcuggucaucugcaucaucaucagcaucggcaucuucuacggcuucguggccaaccaccaggugcggacccgcaucaagcggucccgcaagcucgccgacagcaacuucaaggaccugcggacccugcucaacgagacgcccgagcagaucaaguacauccuggcccaguacaacaccaccaaggacaaggcguucaccgaccugaacuccaucaacagcguccucgggggcgggauccuggaccgccugcggccgaacaucauccccgugcucgacgagaucaaguccauggccacggccaucaaggagaccaaggaggcccuggagaacaugaacagcacccugaagucccuccaccagcagagcacccagcuguccagcucccugacgagcgugaagaccagccuccgcuccagccugaacgacccccugugccucguccaccccuccagcgagaccugcaacuccauccggcugagccugucccagcucaacagcaacccggagcugcgccagcugccgcccguggacgccgagcucgacaacgugaacaacguccugcggaccgaccuggacggccucgugcagcagggcuaccagucccugaacgacauccccgaccgcgugcagcggcagacgaccaccgucguggcggggaucaagcgcgugcugaacagcaucggcuccgacaucgacaacgucacccagcggcugcccauccaggacauccucagcgccuucuccguguacgugaacaacacggagagcuacauccaccgcaaccugcccacccuggaggaguacgacuccuacugguggcucgggggccuggucaucugcagccugcucacccugaucgugaucuucuacuaccuggggcuccugugcggcgucugcggcuacgaccggcacgccacccccacgacccgcgggugcguguccaacaccggcgggguguuccugauggucggcguggggcucagcuuccuguucugcuggauccugaugaucaucgugguccucaccuucguguucggcgccaacguggagaagcugaucugcgagcccuacacguccaaggagcuguuccgcguccucgacaccccguaccugcugaacgaggacugggaguacuaccucagcggcaagcuguucaacaagagcaagaugaagcugaccuucgagcaggucuacuccgacugcaagaagaaccgggggaccuacggcacgcuccaccuccagaacagcuucaacaucuccgagcaccugaacaucaacgagcacaccgggagcaucuccagcgagcucgagucccugaaggugaaccugaacaucuuccuccugggcgccgcggggcgcaagaaccugcaggacuucgccgccugcggcaucgaccggaugaacuacgacagcuaccucgcccagaccggcaagucccccgccggggugaaccugcugagcuucgcguacgaccucgaggccaaggccaacucccugccgcccggcaaccugcgcaacagccucaagcgggacgcccagaccaucaagacgauccaccagcagcgcgugcugcccaucgagcagucccugagcacccucuaccaguccgugaagauccugcagcggaccgggaacggccugcucgagcgcgucacccggauccuggccagccuggacuucgcgcagaacuucaucaccaacaacacguccagcgugaucaucgaggagaccaagaaguacggccgcaccaucaucggguacuucgagcacuaccuccaguggaucgaguucagcaucuccgagaagguggccagcugcaagcccgucgccaccgcccuggacacggcgguggacguguuccugugcuccuacaucaucgacccccucaaccuguucugguucggcaucgggaaggccaccgucuuccugcuccccgcccugaucuucgccgugaagcuggccaaguacuaccggcgcauggacagcgaggacguguacgacgacgucgagaccaucccgaugaagaacauggagaacggcaacaacggguaccacaaggaccacguguacggcauccacaaccccgugaugaccucccccagccagcacuga

SEQ ID NO: 35091 - RNA, 2505 nt, Artificial Sequence
  derived and/or modified sequence opt1 from PROM2__Homo_sapiens__NP_001159449
augaagcacacccuggcccuccuggcgccccugcucggccuggggcugggccucgcccugagccagcuggccgccggggccaccgacugcaaguuccucggcccggccgagcaccugacguucacccccgcggcccgcgcccgguggcuggcgccccgcgugcgggcccccgggcuccuggacucccuguacggcaccguccgccgguuccucagcguggugcagcugaacccguuccccuccgagcuggucaaggcccuccugaacgagcuggccagcgugaaggugaacgaggucgugcgcuacgaggccggcuacguggucugcgccgugaucgcggggcucuaccugcugcucgugcccaccgccggccugugcuucugcugcugccggugccaccgccggugcgggggccgcgucaagacggagcacaaggcccuggccugcgagcgggccgcgcucaugguguuccugcugcucaccacccugcugcuccugaucgggguggucugcgccuucgugaccaaccagcgcacgcacgagcagaugggccccuccaucgaggccaugccggagacccugcucagccuguggggccugguguccgacgucccccaggagcuccaggccguggcccagcaguucagccugccccaggagcaggucuccgaggagcuggacggggugggcgugagcaucggguccgcgauccacacccagcuccggagcuccguguacccccugcuggccgccgucggcagccucggccaggugcugcaggucuccgugcaccaccuccagacccugaacgccacgguggucgagcugcaggccgggcagcaggaccuggagccggcgauccgcgagcaccgggaccgccugcucgagcugcugcaggaggcccggugccagggcgacugcgccggggcccucagcugggcgcgcacccuggagcugggcgccgacuucucccaggugcccagcguggaccacguccuccaccagcugaagggggugcccgaggccaacuucuccagcauggugcaggaggagaacagcaccuucaacgcccugcccgcccucgcggccaugcagaccuccagcgucgugcaggagcugaagaaggccguggcccagcagccggagggcguccggacgcuggccgagggcuuccccgggcucgaggcggccucccgcugggcccaggcccugcaggagguggaggagagcucccggcccuaccugcaggaggugcagcgcuacgagaccuaccgcuggaucgucggcugcgugcucugcagcgugguccuguucguggugcugugcaaccuccuggggcugaaccucggcaucugggggcuguccgcccgggacgaccccagccacccggaggcgaagggcgaggccggcgcccgcuuccugauggccggggucggccucuccuuccuguucgcggcgccccugauccuccugguguucgccaccuuccuggucgggggcaacgugcagacccucgugugccagagcugggagaacggggagcuguucgaguucgccgacacgcccggcaaccugcccccguccaugaaccucagccagcugcugggccuccggaagaacaucuccauccaccaggccuaccagcagugcaaggagggggccgcccuguggaccgugcugcagcucaacgacagcuacgaccuggaggagcaccuggacaucaaccaguacaccaacaagcuccgccaggagcugcagucccugaaggucgacacccagagccucgaccugcuguccagcgccgcccggcgcgaccucgaggcccugcaguccagcggccugcagcggauccacuaccccgacuuccucgugcagauccagcgccccguggucaagacgagcauggagcagcuggcgcaggagcugcaggggcucgcccaggcccaggacaacuccgugcugggccagcggcugcaggaggaggcccagggccuccgcaaccugcaccaggagaagguggucccccagcagagccugguggccaagcucaaccuguccgugcgggcgcuggagagcuccgccccgaaccuccagcuggagaccagcgacguccuggccaacgugaccuaccucaagggggagcugcccgccugggcggcccgcauccugcggaacguguccgagugcuuccucgcccgcgagaugggcuacuucagccaguacgucgccugggugcgggaggaggugacccagcgcaucgccacgugccagccccuguccggggcgcuggacaacagccgggucauccucugcgacaugauggccgacccguggaacgccuucugguucugccuggccuggugcaccuucuuccugauccccuccaucaucuucgccgugaagaccagcaaguacuuccgccccauccggaagcgccucuccagcaccuccagcgaggagacgcagcuguuccacaucccccgcgugaccucccugaagcucuga

SEQ ID NO: 35092 - RNA, 681 nt, Artificial Sequence
  derived and/or modified sequence opt1 from PROP1__Homo_sapiens__NP_006252
auggaggccgagcgccggcgccaggccgagaagcccaagaagggccggguggggagcucccugcuccccgagcgccaccccgcgaccggcacccccacgaccaccgucgacagcuccgccccgcccugccggcgccugcccggggccggcgggggccggagccgcuucagcccccagggcgggcagcggggccgcccccacucccggcgccggcaccgcaccacguucucccccguccagcuggagcagcucgagagcgccuucgggcggaaccaguaccccgacaucugggcccgcgagucccuggcgcgggacaccggccugagcgaggcccgcauccaggugugguuccagaaccggcgcgccaagcagcggaagcaggagcgcucccuccugcagccccuggcccaccucagccccgcggccuucuccagcuuccugccggaguccaccgccugccccuacagcuacgccgccccgcccccgcccgugaccugcuucccccaccccuacucccacgcgcugccgagccagcccuccaccgggggcgccuucgcccucagccaccagagcgaggacugguaccccacgcugcaccccgccccggccggccaccuccccugcccgccgcccccgcccaugcugccccugucccuggagcccagcaaguccuggaacuga

SEQ ID NO: 35093 - RNA, 2031 nt, Artificial Sequence
  derived and/or modified sequence opt1 from PROS1__Homo_sapiens__NP_000304
augcgcgugcugggcgggcggugcggcgcccuccuggccugccugcuccugguccugcccgugagcgaggcgaacuuccucuccaagcagcaggccagccaggugcugguccgcaagcggcgcgccaacucccugcucgaggagaccaagcaggggaaccuggagcgggagugcaucgaggagcugugcaacaaggaggaggcccgcgagguguucgagaacgacccggagaccgacuacuucuaccccaaguaccucgugugccugcggagcuuccagacgggccuguucaccgccgcgcgccaguccaccaacgccuaccccgaccuccggagcugcgucaacgccauccccgaccagugcuccccgcugcccugcaacgaggacggguacaugagcugcaaggacggcaaggccuccuucacgugcacgugcaagcccggcuggcagggggagaagugcgaguucgacaucaacgagugcaaggaccccagcaacaucaacggcgggugcucccagaucugcgacaacaccccgggcagcuaccacugcuccugcaagaacggguucgugaugcugagcaacaagaaggacugcaaggacguggacgagugcucccucaagcccagcaucugcggcaccgcggucugcaagaacauccccggcgacuucgagugcgagugccccgagggguaccgcuacaaccugaaguccaagagcugcgaggacaucgacgagugcuccgagaacaugugcgcccagcugugcgugaacuacccgggcggguacacgugcuacugcgacggcaagaagggcuucaagcucgcccaggaccagaaguccugcgagguggucagcgugugccugccccugaaccucgacaccaaguacgagcugcuguaccucgccgagcaguucgccggggugguccuguaccugaaguuccggcuccccgagaucagccgcuucagcgcggaguucgacuuccggaccuacgacuccgagggcgugauccuguacgccgagagcaucgaccacuccgccuggcugcucaucgcccugcgcgggggcaagaucgaggugcagcugaagaacgagcacaccagcaagaucaccaccgggggcgacgucaucaacaacggccucuggaacaugguguccguggaggagcuggagcacagcaucuccaucaagaucgccaaggaggcggucauggacaucaacaagcccgggccgcuguucaagcccgagaacggccuccuggagaccaagguguacuucgccggguucccccggaagguggagagcgagcugaucaagcccaucaacccgcgccucgacggcugcauccgguccuggaaccugaugaagcagggggccagcggcaucaaggagaucauccaggagaagcagaacaagcacugccuggucaccguggagaagggcuccuacuaccccgggagcggcaucgcccaguuccacaucgacuacaacaacgucuccagcgccgagggguggcacgugaacgugacccucaacauccgccccuccacgggcaccggggucaugcuggcgcuggugagcggcaacaacaccgugcccuucgccgucucccucguggacagcaccagcgagaagucccaggacauccugcugagcguggagaacacggucaucuaccggauccaggcccugucccucugcagcgaccagcagucccaccuggaguuccgcgugaaccggaacaaccuggagcucagcaccccgcugaagaucgagaccaucucccacgaggaccugcagcgccagcucgccgugcuggacaaggccaugaaggcgaaggucgccaccuaccugggcgggcuccccgacgugcccuucagcgccacgcccgugaacgccuucuacaacggcugcauggaggucaacaucaacggggugcagcuggaccuggacgaggcgaucuccaagcacaacgacauccgcgcccacagcugcccguccguguggaagaagaccaagaacagcuga

SEQ ID NO: 35094 - RNA, 2835 nt, Artificial Sequence
  derived and/or modified sequence opt1 from PROSER1__Homo_sapiens__NP_079414
auggacaagaagagcuucgagauggugcuggacgagauccgcaaggccguccucaccgaguacaagcugaaggccaucgaguacgugcacggcuacuucuccagcgagcagguggucgaccugcuccgguacuucuccugggcggagccccagcugaaggccaugaaggcccugcagcacaagaugguggccgugcagccgaccgaggucgugaacauccucaacugcuucacguucagcaaggacaagcugguggcccuggagcuccuggcguccaacaucaucgacgcccagaacagccgccccaucgaggaccuguuccgggucaacauguccgagaagaagcgcugcaagcggauccucgagcaggccuucaaggggggcugcaaggccccccacgcgaugaucagcuccugcgggaccauccccggcaacccguaccccaaggggcgccccagccggaucaacggcaucuuccccggcaccccgcugaagaaggacggggaggagugcaccaacgagggcaaggggaucgccgcccgcauccugggccccuccaagccccccccgagcacguacaacccccacaagcccgugcccuacccgaucccccccugccggccccacgccaccaucgccccguccgcguacaacaacgccgggcucgugccccuggccaacgucaucgccccccccccgccccccuacacccccaacccggugggcaccgagaacgaggaccugagcaaccccuccaagcccauccagaaccagacguucagcaccccggccucccagcucuucagcccccacggcuccaaccccagcacccccgcggccaccccggugcccacggccagccccgucaaggccaucaaccaccccuccgccagcgcggccgccaccguguccgggaugaaccugcugaacaccgugcucccggucuuccccggccaggugagcuccgccgugcacaccccccagcccagcaucccgaaccccacggucauccgcacccccucccugcccaccgccccggugaccagcauccacuccacgaccaccacccccgugcccagcaucuucuccgggcuggucagccuccccggcccguccgcgacgcccaccgccgccacccccacccccggcccgacgccccggagcacccugggguccagcgaggccuucgcguccaccagcgcccccuucaccucccugccguucagcacgagcuccagcgccgccuccaccagcaaccccaacuccgccagccucuccagcguguucgcgggccugccccugccccucccgcccaccucccaggggcugagcaaccccacccccgucaucgccggcggguccacgccgagcguggccggcccccugggcgugaacuccccccuccugagcgcccugaagggguuccucaccuccaacgacaccaaccugaucaacagcuccgcccugagcagcgcggucaccuccggccucgccagccuguccagccugacccuccagaacuccgacagcuccgccagcgcccccaacaagugcuacgccccguccgcgauccccacgccccagcgcaccagcacccccgggcuggcccuguucccgggccuccccucccccguggccaacagcaccuccacgccccugacccugccggugcagagcccccucgccaccgcggccuccgccagcaccuccguccccgugagcugcggguccagcgccagccugcugcggggcccccacccgggcacguccgaccugcacaucagcuccacccccgccgcgaccacccuccccgugaugaucaagacggagcccaccagcccgacccccuccgccuucaaggggcccagccacuccggcaacccgagccacgggacccugggccuguccgggacgcucggccgcgccuacaccagcaccuccguccccaucagccuguccgccugccugaaccccgcccucagcggccuguccagccuguccaccccccucaacgggagcaacccgcuguccagcaucagccugcccccccacggcuccagcacgcccaucgcgccgguguucaccgcccuccccuccuucaccagccugaccaacaacuucccccugacggggaaccccucccucaacccgagcgugucccugcccggcagccugaucgccaccuccagcaccgccgccaccuccacgagccucccccaccccuccagcaccgcggccguccuguccggccugagcgccuccgccccggugagcgcggcccccuucccccucaaccuguccaccgccgugcccagccuguucagcgucacccaggggccgcucuccagcuccaaccccagcuaccccggcuucuccgugagcaacacgcccuccgugaccccggcccugcccagcuuccccgggcugcaggcccccuccaccgucgcggccgugaccccgcuccccguggccgccacggcccccagcccggcgcccguccugcccggcuucgccuccgccuucagcuccaacuucaacagcgcccugguggcccaggcggggcucuccagcggccugcaggccgccggcuccagcguguuccccgggcugcucucccugccgggcauccccggguucccccagaaccccagccagagcucccugcaggagcuccagcacaacgccgccgcgcagagcgcccugcugcagcagguccacuccgccagcgcccucgaguccuacccggcgcagcccgacggcuuccccagcuaccccuccgccccggggacccccuucagccugcagcccucccugagccaguccggcuggcaguga

SEQ ID NO: 35095 - RNA, 2217 nt, Artificial Sequence
  derived and/or modified sequence opt1 from PROX1__Homo_sapiens__XP_011508075
augcccgaccacgacagcaccgcccugcucucccgccagaccaagcggcgccggguggacaucggcgucaagcgcacgguggggaccgccagcgcguucuucgccaaggcccgggccaccuucuucuccgccaugaacccgcagggcagcgagcaggacguggaguacuccgucgugcagcacgcggacggggagaaguccaacgugcugcgcaagcugcucaagcgggccaacuccuacgaggacgccaugaugcccuuccccggcgccaccaucaucagccagcugcugaagaacaacaugaacaagaacgggggcacggagcccuccuuccaggcgagcggccucuccagcaccggguccgagguccaccaggaggacaucugcagcaacuccagccgcgacuccccgcccgagugccugagccccuucggccggcccaccaugucccaguucgacauggaccgccugugcgacgagcaccuccgggccaagcgcgcccggguggagaacaucauccgcgggaugagccacagcccguccguggcccugcggggcaacgagaacgagcgcgagauggcgccccagagcgucagcccccgggagagcuaccgcgagaacaagcggaagcagaagcugccccagcagcagcagcaguccuuccagcagcucgugagcgcccgcaaggagcagaagcgggaggagcgccgccagcugaagcagcagcuggaggacaugcagaagcagcuccggcagcugcaggagaaguucuaccagaucuacgacuccaccgacagcgagaacgacgaggacgggaaccuguccgaggacagcaugcgcuccgagauccucgacgcccgggcccaggacagcgugggccgcuccgacaacgagaugugcgagcuggacccgggccaguucaucgaccgggcccgcgcccugauccgggagcaggagauggcggagaacaagcccaagcgcgaggggaacaacaaggagcgggaccacggccccaacagccuccagcccgaggggaagcaccuggccgagacgcugaagcaggagcucaacaccgccaugucccaggucguggacaccguggucaagguguucagcgccaagccgucccgccaggugccccaggucuucccgccccugcagaucccccaggcccgguucgcggugaacggcgagaaccacaacuuccacaccgccaaccagcgccugcagugcuucggcgacgugaucauccccaacccccucgacacguucgggaacguccagauggccagcuccaccgaccagaccgaggcccugccccugguggugcggaagaacagcagcgaccaguccgccagcggcccggcggccgggggccaccaccagccccuccaccagagcccccuguccgccaccacgggguucaccaccuccaccuuccgccaccccuucccgcugccccucauggccuaccccuuccagagcccgcugggcgcgcccuccggcagcuucuccgggaaggaccgggccagccccgagucccuggaccucacgcgcgacaccaccagccugcggaccaagauguccagccaccaccugucccaccaccccugcagcccggcccacccgcccuccacggccgagggccucagccugagccugaucaaguccgagugcggggaccuccaggacaugagcgagaucucccccuacagcggcuccgccaugcaggaggggcugagccccaaccaccugaagaaggcgaagcucauguucuucuacacccgcuaccccuccagcaacaugcugaagaccuacuucuccgacgucaaguucaaccggugcaucaccagccagcugaucaagugguucuccaacuuccgcgaguucuacuacauccagauggagaaguacgcccgccaggccaucaacgacggcgugacgagcaccgaggagcucuccaucacccgggacugcgagcuguaccgcgcccugaacaugcacuacaacaaggccaacgacuucgagcagguccccgagcgguuccuggagguggcgcagaucacccuccgcgaguucuucaacgccaucaucgccggcaaggacguggaccccagcuggaagaaggccaucuacaaggucaucugcaagcuggacuccgaggugccggagaucuucaagagccccaacugccugcaggagcuccugcacgaguga

SEQ ID NO: 35096 - RNA, 1269 nt, Artificial Sequence
  derived and/or modified sequence opt1 from PROZ__Homo_sapiens__NP_001243063
auggccggcugcgugccccugcuccaggggcugguccuggugcucgcccugcaccgcguggagccgagcgcgaccucccugaaggagcggcacggccuccacagcgacuccgccugcaccgggguccaggagagccuguuccugcccgccuccaaggccaacgacgugcucgugcgcuggaagcgggccggcagcuaccugcuggaggagcuguucgaggggaaccuggagaaggagugcuacgaggagaucugcgucuacgaggaggcgcgcgagguguucgagaacgagguggucacggacgaguucuggcggcgcuacaagggcggcucccccugcaucagccagcccugccugcacaacggguccugccaggacagcaucuggggcuacacgugcacgugcuccccgggguacgagggcagcaacugcgagcucgccaagaacgagugccaccccgagcggaccgacgggugccagcacuucugccugcccggccaggaguccuacacgugcagcugcgcccagggcuaccgccugggggaggaccacaagcagugcgugccccacgaccagugcgccugcggcgugcucaccuccgagaagcgggcgccggaccugcaggaccugcccuggcaggucaagcucaccaacagcgaggggaaggacuucugcggcggcgugaucauccgcgagaacuucgugcugaccaccgccaagugcucccugcuccaccggaacaucaccgucaagaccuacuucaaccgcaccagccaggacccccugaugaucaagaucacccacgugcacgugcacaugcgguacgacgccgacgccggggagaacgaccugucccuccuggagcuggaguggcccauccagugcccgggcgccgggcuccccgucugcacccccgagaaggacuucgcggagcaccuccugaucccccgcacccggggccuccugagcgggugggcccgcaacggcaccgaccugggcaacagccucacgacccggccggugacccugguggagggggaggagugcggccagguccugaacgugaccgugacgacccgcaccuacugcgagcgguccagcgucgccgccaugcacuggauggacggguccguggucacccgcgagcaccggggcagcugguuccucacgggggugcugggcucccagcccgugggcgggcaggcccacaugguccuggugaccaaggugagccgcuacucccucugguucaagcagaucaugaacuga

SEQ ID NO: 35097 - RNA, 1515 nt, Artificial Sequence
  derived and/or modified sequence opt1 from PRPF19__Homo_sapiens__NP_055317
augagccugaucugcuccaucagcaacgaggugcccgagcacccgugcgucucccccgugagcaaccacguguacgagcgccggcucaucgagaaguacaucgccgagaacggcaccgaccccaucaacaaccagccccuguccgaggagcagcugaucgacaucaaggucgcccacccgauccgccccaagccgcccagcgcgaccuccauccccgccauccucaaggcccugcaggacgagugggacgccgugaugcugcacagcuucacgcuccggcagcagcugcagaccacccgccaggagcugucccacgcccucuaccagcacgacgcggccugccgggugaucgcccgccugaccaaggaggucacggccgcgcgggaggcccuggccacccucaagccccaggccgggcugaucgugccccaggccgugcccagcucccagccgagcgucgugggcgcgggggagcccauggaccugggcgagcucguggggaugacccccgagaucauccagaagcugcaggacaaggccaccguccugacgaccgagcgcaagaagcggggcaagaccgugcccgaggagcucgugaagccggaggagcuguccaaguaccgccaggucgccagccacgugggccugcacuccgccagcauccccgggauccucgcccuggaccugugccccuccgacaccaacaagauccucacgggcggggcggacaagaacguggucguguucgacaagagcuccgagcagauccuggccacccugaagggccacaccaagaaggugaccagcgucguguuccaccccagccaggaccucguguucuccgccagcccggacgccacgauccggaucugguccguccccaacgccagcugcgugcaggucgugcgcgcgcacgaguccgccgugaccgggcugagccugcacgccaccggcgacuaccuccuguccagcuccgacgaccaguacugggccuucagcgacauccagaccggccggguccugacgaaggugaccgacgagaccuccgggugcagccugaccugcgcccaguuccaccccgacggccucaucuucgggacgggcaccauggacucccagaucaagaucugggaccugaaggagcgcaccaacguggcgaacuuccccggccacagcgggccgaucaccuccaucgccuucagcgagaacggcuacuaccucgccacggccgcggacgacuccagcgucaagcugugggaccugcggaagcucaagaacuucaagacccugcagcuggacaacaacuucgaggugaagucccucaucuucgaccagagcgggaccuaccuggcccugggcgggaccgacgugcagaucuacaucugcaagcaguggacggagauccuccacuucaccgagcacagcggccugaccaccggcgucgccuucgggcaccacgccaaguucaucgccuccacgggcauggaccgcagccugaaguucuacucccucuga

SEQ ID NO: 35098 - RNA, 1500 nt, Artificial Sequence
  derived and/or modified sequence opt1 from PRPF31__Homo_sapiens__XP_006726118
augagccuggccgacgagcuccuggccgaccuggaggaggcggccgaggaggaggagggcggguccuacggcgaggaggaggaggagcccgccaucgaggacgugcaggaggagacccagcucgaccugagcggggacuccgucaagaccaucgccaagcugugggacagcaagauguucgccgagaucaugaugaagaucgaggaguacaucuccaagcaggcgaaggccagcgaggugaugggcccgguggaggccgcccccgaguaccgcgucaucguggacgcgaacaaccucaccguggagaucgagaacgagcugaacaucauccacaaguucauccgggacaaguacuccaagcgcuuccccgagcuggagagccucguccccaacgcccuggacuacauccggaccgugaaggagcuggggaacucccucgacaagugcaagaacaacgagaaccugcagcagauccugaccaacgccaccaucaugguggucagcgugacggccuccaccacccagggccagcagcucagcgaggaggagcuggagcgccuggaggaggccugcgacauggcgcucgagcugaacgccuccaagcaccggaucuacgaguacguggagagccgcauguccuucaucgccccgaaccugagcaucaucaucggcgccuccaccgccgcgaagaucaugggggucgccggcgggcucacgaaccugagcaagaugcccgccugcaacaucaugcugcucggcgcccagcggaagacccuguccggguucagcagcaccuccgugcugccccacaccggcuacaucuaccacagcgacaucgugcagucccugcccccggaccuccgccggaaggccgcgcgccuggucgccgccaagugcacgcucgccgcccggguggacagcuuccacgaguccaccgagggcaaggugggguacgagcugaaggacgagaucgagcgcaaguucgacaaguggcaggagcccccgcccgucaagcaggucaagccccugcccgcgccccucgacggccagcggaagaagcgcgggggccggcgcuaccggaagaugaaggagcgccugggccugaccgagauccggaagcaggccaaccgcaugagcuucggggagaucgaggaggacgccuaccaggaggaccucggcuucucccuggggcaccugggcaagagcggguccggccgggugcgccagacccaggugaacgaggccacgaaggcgcgcaucagcaagacccuccagcggacccugcagaagcaguccgugguguacggcggcaagagcaccauccgcgaccgguccagcgggacggccuccagcgucgccuucacgccccugcaggggcucgagaucgugaacccgcaggccgccgagaagaaggucgcggaggccaaccagaaguacuucuccagcauggccgaguuccugaaggugaagggcgagaaguccgggcugaugagcaccuga

SEQ ID NO: 35099 - RNA, 1050 nt, Artificial Sequence
  derived and/or modified sequence opt1 from PRPF38B__Homo_sapiens__XP_011539987
augaccaucggcgagaugcugcgcagcuuccucaccaagcuggagugguucuccacgcuguucccccggaucccggugcccguccagaagaacaucgaccagcagaucaagacccgcccccggaagaucaagaaggacgggaaggagggcgccgaggagaucgaccgccacguggagcggcgccggagccgcagcccccggcgcagccucuccccgcggcgcagcccccggcgcucccggagccgcucccaccaccgggaggggcacggcagcuccagcuucgaccgcgagcuggagcgggagaaggagcgccagcggcuggagcgcgaggccaaggagcgcgagaaggagcggcgccggucccgcagcaucgaccgggggcucgagcgccggcgcucccggagccgcgagcggcaccgcucccggagccgcucccgggaccgcaagggcgaccggcgcgaccgggaccgcgagcgcgagaaggagaacgagcggggccgccggcgcgaccgggacuacgacaaggagcgcgggaacgagcgggagaaggagcgcgagcggagccgcgagcggagcaaggagcagcgcucccggggcgagguggaggagaagaagcacaaggaggacaaggacgaccgccggcaccgcgacgacaagcgggacagcaagaaggagaagaagcacucccgcagccggucccgcgagcggaagcaccgcagccgcucccggagccgcaacgcggggaagcggucccgcagccgguccaaggagaaguccuccaagcacaagaacgagagcaaggagaaguccaacaagcgcagccgguccggcagccaggggcgcaccgacuccgucgagaaguccaagaagcgggagcacagccccagcaaggagaagucccgcaagcggagccgcagcaaggagcggucccacaagcgcgaccacagcgacuccaaggaccagagcgacaagcacgaccggcgccggucccagagcaucgagcaggagucccaggagaagcagcacaagaacaaggacgagaccguguga

SEQ ID NO: 35100 - RNA, 1251 nt, Artificial Sequence
  derived and/or modified sequence opt1 from PRPF3__Homo_sapiens__XP_011508434
auggcccugagcaagcgcgagcucgacgagcugaagcccuggaucgagaagaccgugaagcggguccugggcuucuccgagccgaccguggugacggccgcgcucaacugcgucgggaagggcauggacaagaagaaggccgccgaccaccugaagcccuuccuggacgacagcacccuccgcuucguggacaagcuguucgaggccguggaggaggggcgguccagccgccacuccaagagcuccagcgaccggucccgcaagcgggagcugaaggaggucuucggcgacgacagcgagaucuccaaggagagcuccggggugaagaagcgccggaucccccgcuucgaggagguggaggaggagcccgaggucaucccgggcccgcccagcgagucccccggcaugcucaccaagcugcagaucaagcagaugauggaggccgcgacccggcagaucgaggagcgcaagaagcagcugagcuucaucuccccgcccacgccccagcccaagacccccagcuccagccagcccgagcggcuccccaucgggaacaccauccagcccagccaggccgccaccuucaugaacgacgccaucgagaaggcgcgcaaggccgccgagcugcaggcccggauccaggcccagcuggcgcucaagccgggccugaucgggaacgccaacauggugggccuggccaaccuccacgccauggggaucgccccgcccaagguggagcugaaggaccagacgaagcccacgccccugauccucgacgagcagggccgcaccgucgacgcgaccggcaaggagaucgagcugacccaccggaugcccacccugaaggccaacauccgcgccgugaagcgggagcaguucaagcagcagcucaaggagaagcccuccgaggacauggagagcaacaccuucuucgacccccgcguguccaucgccccgagccagcggcagcgccgcaccuucaaguuccacgacaaggggaaguucgagaagaucgcccagcggcugcgcacgaaggcgcagcuggagaagcuccaggccgagaucucccaggccgcccggaagaccggcauccacaccagcacccgccuggcccugaucgcgcccaagaaggagcucaaggagggggacauccccgagaucgaguggugggacuccuacaucauccccaacggcuucgaccugggcaagagccaggagcggcgccuguucuggaaccacaaguccugcuga

SEQ ID NO: 35101 - RNA, 2793 nt, Artificial Sequence
  derived and/or modified sequence opt1 from PRPF40A__Homo_sapiens__NP_060362
augugcagcggcuccgggcgccggcgcagcucccugagccccaccaugcggccgggcaccggggccgagcgcggcgggcucaugaugggccaccccggcaugcacuacgcccccauggggaugcaccccaugggccagcgggcgaacaugccgcccgugccccacgggaugaugccccagaugaugccgcccaugggcgggccgcccaugggccagaugcccggcaugauguccagcgucaugcccgggaugaugaugucccacaugagccaggccuccaugcagcccgcccugcccccgggcgugaacagcauggacguggccgccgggacggcguccggcgccaagagcauguggaccgagcacaagucccccgacggccgcaccuacuacuacaacaccgagacgaagcagagcaccugggagaagcccgacgaccugaagacccccgccgagcagcuccuguccaagugcccguggaaggaguacaagagcgacuccgggaagcccuacuacuacaacagccagaccaaggagucccggugggccaagcccaaggagcuggaggaccucgagggcuaccagaacacgaucgucgcggggagccugaucaccaagagcaaccugcacgccaugaucaaggccgaggaguccagcaagcaggaggagugcaccaccacguccaccgcccccgugccgaccaccgagauccccacgaccaugagcaccauggccgcggccgaggccgccgccgcgguggucgccgccgccgccgcggccgccgccgccgcggccgccgccaacgcgaacgccuccaccagcgccuccaacacggugagcggcaccgugcccgucgugcccgagccggaggugaccuccaucgucgccaccgugguggacaacgagaacacggucaccaucagcaccgaggagcaggcccagcucaccuccacgcccgcgauccaggaccagagcguggagguguccagcaacaccggggaggagaccuccaagcaggagaccgucgccgacuucacgcccaagaaggaggaggaggagagccagccggccaagaagaccuacaccuggaacaccaaggaggaggccaagcaggccuucaaggagcugcugaaggagaagcgcgugcccuccaacgcgagcugggagcaggccaugaagaugaucaucaacgacccccgguacuccgcccucgccaagcugagcgagaagaagcaggccuucaacgcguacaaggugcagacggagaaggaggagaaggaggaggcccgcagcaaguacaaggaggccaaggaguccuuccagcgguuccuggagaaccacgagaagaugaccagcaccacccgcuacaagaaggccgagcagauguucggcgagauggaggucuggaacgcgaucuccgagcgggaccgccucgagaucuacgaggacgugcuguucuuccugagcaagaaggagaaggagcaggccaagcagcuccggaagcgcaacugggaggcccugaagaacauccuggacaacauggccaacgugaccuacuccacgaccuggagcgaggcccagcaguaccucauggacaaccccaccuucgcggaggacgaggagcugcagaacauggacaaggaggacgcccugaucugcuucgaggagcacauccgggcccucgagaaggaggaggaggaggagaagcagaagucccugcugcgcgagcggcgccggcagcgcaagaaccgcgagagcuuccagaucuuccucgacgagcugcacgagcacggccagcugcacuccaugagcuccuggauggagcucuacccgaccaucagcuccgacauccgguucacgaacaugcuggggcagcccggcagcaccgcccuggaccucuucaaguucuacgucgaggaccugaaggcccgcuaccacgacgagaagaagaucaucaaggacauccugaaggacaagggguucguggucgaggugaacaccaccuucgaggacuucguggcgaucaucuccagcacgaagcgguccaccacccucgacgccggcaacaucaagcuggccuucaacagccugcucgagaaggccgaggcccgcgagcgggagcgcgagaaggaggaggcgcggaagaugaagcgcaaggagagcgccuucaaguccaugcugaagcaggccgccccgcccaucgagcuggacgcggucugggaggacauccgggagcgcuucgugaaggagcccgccuucgaggacaucacccucgagagcgagcggaagcgcaucuucaaggacuucaugcacgugcuggagcacgagugccagcaccaccacuccaagaacaagaagcacagcaagaaguccaagaagcaccaccggaagcgcagccggucccgcagcggguccgacagcgacgacgacgacucccacagcaagaagaagcggcagcgcuccgagagccgguccgccagcgagcacuccagcuccgccgagagcgagcgcagcuacaagaaguccaagaagcacaagaagaaguccaagaagcgccggcacaagagcgacagccccgaguccgacgccgagcgcgagaaggacaagaaggagaaggaccgggagagcgagaaggaccgcacgcggcagcgcuccgagagcaagcacaagucccccaagaagaagaccggcaaggacagcggcaacugggacaccuccgggagcgagcuguccgagggcgagcucgagaagcggcgccggacccugcuggagcagcucgacgacgaccaguga

SEQ ID NO: 35102 - RNA, 3024 nt, Artificial Sequence
  derived and/or modified sequence opt1 from PRPF4B__Homo_sapiens__NP_003904
auggccgccgcggagacccagagccugcgcgagcagcccgagauggaggacgccaacuccgagaaguccaucaacgaggagaacggcgagguguccgaggaccagagccagaacaagcacucccggcacaagaagaagaagcacaagcaccgcagcaagcacaagaagcacaagcacuccagcgaggaggacaaggacaagaagcacaagcacaagcacaagcacaagaagcacaagcggaaggagaucaucgacgccuccgacaaggaggggaugagcccggccaagcgcaccaagcucgacgaccuggcccugcucgaggaccuggagaagcagcgggcgcugaucaaggccgagcucgacaacgagcugauggagggcaagguccaguccgggaugggccugauccuccagggguacgagagcggcuccgaggaggagggcgagauccacgagaaggcccgcaacgggaaccggagcuccacgcgcagcuccagcaccaagggcaagcuggagcugguggacaacaagaucaccaccaagaagcgguccaagagccgcagcaaggagcggacgcgccaccgguccgacaagaagaaguccaagggcgggaucgagaucgugaaggagaagaccacccgcagcaagagcaaggagcggaagaaguccaagagccccuccaagcgcagcaagucccaggaccaggcccgcaagagcaagucccccacccuccggcggcgcagccaggagaagaucgggaaggcgcggucccccacggacgacaaggucaagaucgaggacaagagcaaguccaaggaccgcaagaaguccccgaucaucaacgagagccgcagccgggaccgcggcaagaagucccggagccccguggaccugcgcggcaagagcaaggaccggcgcucccggagcaaggagcgcaaguccaagcggagcgagaccgacaaggagaagaagcccaucaagucccccagcaaggacgccuccagcgggaaggagaaccgcuccccgagccggcgccccggccggucccccaagcgccggagccugucccccaagccgcgcgacaagagccggcgcucccggagcccccuccugaacgaccgccgcuccaagcagagcaagagccccucccggacccugagccccgggcgccgggccaagucccgcagccucgagcggaagcgccgggagccggagcgccggcgccuguccagcccccggacccgcccccgggacgacauccugucccgccgggagcgcagcaaggacgccucccccaucaaccgguggagcccgacgcgccggcgcucccggagccccauccgccgccggucccgcagcccccuccggcgcucccggagcccccgccggcgcucccggagcccgcgccggcgcgaccggggccgccggucccgcagccggcugcgccggcgcagccgcucccggggcgggcgccggcgccggagccgcuccaaggugaaggaggacaaguucaagggcagccuguccgaggggaugaaggucgagcaggagagcuccagcgacgacaaccucgaggacuucgacguggaggaggaggacgaggaggcccugaucgagcagcggcgcauccagcggcaggcgaucgugcagaaguacaaguaccuggccgaggacuccaacaugagcguccccuccgagcccagcagcccccagagcuccacccgcacccggagcccgucccccgacgacauccucgagcgcguggccgccgacgugaaggaguacgagcgggagaacgucgacaccuucgaggccagcgugaaggcgaagcacaaccugaugacgguggagcagaacaacggcuccagccagaagaagcugcucgcccccgacauguucaccgagagcgacgacauguucgccgccuacuucgacuccgcccgccugcgggcggccgggaucggcaaggacuucaaggagaacccgaaccugcgcgacaacuggaccgacgccgagggcuacuaccgggucaacaucggggaggugcucgacaagcgcuacaacguguacggcuacaccgggcagggcgucuucagcaacguggugcgggcccgcgacaacgcccgggcgaaccaggaggucgccgugaagaucauccgcaacaacgagcugaugcagaagacggggcugaaggagcucgaguuccugaagaagcugaacgacgccgaccccgacgacaaguuccacugccuccgccuguuccggcacuucuaccacaagcagcaccugugccucguguucgagccccuguccaugaaccugcgcgagguccucaagaaguacggcaaggacgugggccugcacaucaaggccguccggagcuacucccagcagcuguuccucgcgcugaagcugcugaagcgcugcaacauccuccacgccgacaucaagcccgacaacauccuggugaacgagagcaagaccauccugaagcucugcgacuucggguccgccagccacguggccgacaacgacaucaccccguaccuggucucccgguucuaccgcgcccccgagaucaucaucggcaagagcuacgacuacgggaucgacaugugguccgugggcugcacccuguacgagcucuacacggggaagauccuguuccccggcaagaccaacaaccacaugcugaagcucgcgauggaccugaagggcaagaugcccaacaagaugauccggaaggggguguucaaggaccagcacuucgaccagaaccugaacuucauguacaucgaggucgacaaggugaccgagcgcgagaaggugaccgucaugagcacgaucaacccgaccaaggaccuccuggccgaccugaucggcugccagcggcuccccgaggaccagcgcaagaaggugcaccagcugaaggaccugcucgaccagauccugaugcuggaccccgccaagcggaucuccaucaaccaggcccuccagcacgccuucauccaggagaagaucuga

SEQ ID NO: 35103 - RNA, 1566 nt, Artificial Sequence
  derived and/or modified sequence opt1 from PRPF4__Homo_sapiens__NP_001231855
auggccagcucccgcgccagcuccaccgccaccaagacgaaggcccccgacgaccugguggccccggucgugaagaagccccacaucuacuacggcagccucgaggagaaggagcgggagcgccuggccaagggggaguccggcauccuggggaaggacggccucaaggccgggaucgaggcgggcaacaucaacaucaccagcggcgagguguucgagaucgaggagcacaucuccgagcggcaggccgagguccuggccgaguucgagcgccggaagcgcgcccggcagaucaacgugagcaccgacgacuccgaggugaaggcgugccugcgcgcccucggggagcccaucacccuguucggcgaggggcccgccgagcggcgcgagcggcugcgcaacauccucagcgucgugggcacggacgcccugaagaagaccaagaaggacgacgagaaguccaagaaguccaaggaggaguaccagcagaccugguaccacgaggggccgaacucccugaagguggcccggcucuggaucgcgaacuacagccugccccgcgccaugaagcggcuggaggaggcccgccuccacaaggagauccccgagaccacgcggaccucccagaugcaggagcugcacaagagccugcgcucccucaacaacuucugcagccagaucggcgacgaccggcccaucuccuacugccacuucagcccgaacagcaagaugcuggccaccgccugcugguccggccugugcaagcucuggagcguccccgacugcaaccugcugcacacccuccgcgggcacaacacgaacgugggcgcgaucguguuccaccccaaguccaccgucagccuggaccccaaggacgugaaccuggccuccugcgccgccgacgggagcgugaagcucuggucccuggacagcgacgagccggucgccgacaucgagggccacaccgugcggguggcgcgcgucauguggcaccccuccggccgcuuccuggggaccacgugcuacgaccggagcuggcgccucugggaccuggaggcccaggaggagauccugcaccaggagggccacuccauggggguguacgacaucgccuuccaccaggacggcagccucgccgggaccggcggccuggacgccuucgggcgggugugggaccugcgcaccggccggugcaucauguuccucgaggggcaccugaaggagaucuacggcaucaacuucucccccaacggguaccacaucgcgaccggcagcggcgacaacacgugcaaggucugggaccugcgccagcggcgcugcguguacaccauccccgcccaccagaaccucgugaccggggucaaguucgagccgauccacggcaacuuccugcugaccggggccuacgacaacacggccaagaucuggacccaccccggcuggagcccccucaagacccuggcggggcacgagggcaaggugaugggccuggacaucagcuccgacgggcagcucaucgcgaccugcagcuacgaccggacguucaagcuguggauggccgaguga

SEQ ID NO: 35104 - RNA, 2826 nt, Artificial Sequence
  derived and/or modified sequence opt1 from PRPF6__Homo_sapiens__NP_036601
augaacaagaagaagaagcccuuccugggcaugccggcgccccucggguacgugcccggccuggggcgcggcgccaccggguucaccacgcggagcgacaucggccccgcccgcgacgccaacgacccggucgacgaccggcacgccccgcccggcaagcgcaccgugggggaccagaugaagaagaaccaggccgccgacgacgacgacgaggaccugaacgacaccaacuacgacgaguucaacggcuacgcggggucccucuucagcuccggccccuacgagaaggacgacgaggaggccgacgccaucuacgccgcgcuggacaagcggauggacgagcgccggaaggagcgccgggagcagcgcgagaaggaggagaucgagaaguaccggauggagcgccccaagauccagcagcaguucagcgaccugaagcggaagcucgccgaggugaccgaggaggaguggcuguccauccccgaggucggggacgcccgcaacaagcggcagcgcaacccccgguacgagaagcugacgcccgugccggacagcuucuucgccaagcaccuccagaccggcgagaaccacaccuccguggacccccgccagacccaguucggcgggcugaacacgcccuaccccggcgggcugaacaccccguaccccggcggcaugacccccgggcucaugacccccggcacgggggagcuggacaugcggaagaucggccaggcccgcaacacccugauggacaugcggcucagccaggucuccgacagcguguccgggcagaccguggucgacccgaagggcuaccugaccgaccugaacagcaugauccccacgcacggcggggacaucaacgacaucaagaaggcgcgccuccugcugaaguccgugcgcgagaccaacccccaccacccgcccgccuggaucgccagcgcccggcucgaggaggugaccggcaagcugcaggucgcccgcaaccugaucaugaaggggaccgagaugugccccaaguccgaggacguguggcucgaggcggcccggcugcagcccggcgacacggccaaggccguggucgcccaggcggugcgccaccucccccagagcgugcggaucuacauccgcgccgccgagcucgagaccgacauccgggccaagaagcgcguccugcggaaggcccuggagcacgugccgaacuccgugcgccucuggaaggcggccgucgagcuggaggagcccgaggacgcccggaucaugcugagccgcgccguggagugcugccccaccuccguggagcucuggcuggcgcuggcccggcucgagaccuacgagaacgcccgcaagguccugaacaaggcccgggagaacaucccgacggaccgccacaucuggaucaccgccgcgaagcuggaggaggccaacgggaacacccagaugguggagaagaucaucgaccgggccaucaccagccuccgcgccaacggcgucgagaucaaccgggagcaguggauccaggacgccgaggagugcgaccgcgcgggcagcguggccacgugccaggccgugaugcgcgccgucaucgggaucggcaucgaggaggaggaccggaagcacaccuggauggaggacgccgacuccugcguggcgcacaacgcccuggagugcgcccgcgccaucuacgcguacgcccuccagguguuccccagcaagaaguccgucuggcugcgggccgccuacuucgagaagaaccacgggacccgcgagagccuggaggcccugcuccagcgggcgguggcccacugccccaaggccgaggugcuguggcugaugggcgccaaguccaaguggcucgccggggacguccccgcggcccgcagcauccuggcccuggccuuccaggccaacccgaacuccgaggagaucuggcuggcggccgugaagcucgagagcgagaacgacgaguacgagcgggcccgccggcugcuggccaaggcgcgcuccagcgcccccaccgcccggguguucaugaaguccgucaagcucgagugggugcaggacaacauccgcgccgcccaggaccugugcgaggaggcgcugcggcacuacgaggacuuccccaagcucuggaugaugaagggccagaucgaggagcagaaggagaugauggagaaggcccgcgaggccuacaaccagggccugaagaagugcccccacagcacgccgcuguggcuccugcugucccggcucgaggagaagaucgggcagcugacccgcgcccgggccauccuggagaagucccgccucaagaaccccaagaaccccggccuguggcuggagagcgugcggcucgaguaccgcgcggggcugaagaacaucgccaacacccugauggccaaggcccuccaggagugccccaacagcggcauccugugguccgaggccaucuuccuggaggcgcggccgcagcgccgcaccaagagcgucgacgcccucaagaagugcgagcacgacccccacgugcugcuggccguggccaagcuguucuggucccagcggaagaucacgaaggcccgcgagugguuccaccggaccgucaagaucgacagcgaccugggcgacgcgugggccuucuucuacaaguucgagcugcagcacgggaccgaggagcagcaggaggaggugcgcaagcggugcgagagcgccgagccccgccacggcgagcucuggugcgccguguccaaggacaucgcgaacuggcagaagaagaucggggacauccugcggcuggucgccggccgcaucaagaacaccuucuga

SEQ ID NO: 35105 - RNA, 7008 nt, Artificial Sequence
  derived and/or modified sequence opt1 from PRPF8__Homo_sapiens__NP_006436
auggccggcguguuccccuaccgggggcccggcaaccccguccccgggccccuggcgccccuccccgacuacauguccgaggagaagcugcaggagaaggcccggaaguggcagcagcugcaggccaagcgguacgccgagaagcggaaguucggcuucguggacgcccagaaggaggacaugccgcccgagcacgugcgcaagaucauccgggaccacggggacaugaccaaccgcaaguuccggcacgacaagcgcgucuaccucggcgcccugaaguacaugccccacgcggugcugaagcuccuggagaacaugcccaugcccugggagcagauccgggacgugcccguccuguaccacaucaccggcgccaucuccuucgugaacgagauccccugggugaucgagcccgucuacaucucccaguggggguccauguggaucaugaugcgccgggagaagcgcgaccggcgccacuucaagcggaugcgcuucccgcccuucgacgacgaggagccgccccucgacuacgccgacaacauccuggacguggagccccuggaggccauccagcucgagcuggaccccgaggaggacgcgcccgugcuggacugguucuacgaccaccagccccuccgggacagccgcaaguacgucaacggcuccaccuaccagcgguggcaguucacccugcccaugaugagcacccuguaccgccucgccaaccagcugcugaccgaccucguggacgacaacuacuucuaccuguucgaccugaaggccuucuucaccuccaaggcccucaacauggccauccccgggggccccaaguucgagccccuggugcgggacaucaaccugcaggacgaggacuggaacgaguucaacgacaucaacaagaucaucauccgccagcccauccgcaccgaguacaagaucgcguuccccuaccucuacaacaaccugccgcaccacguccaccugaccugguaccacacccccaacgugguguucaucaagacggaggaccccgaccucccggccuucuacuucgacccccugaucaaccccaucagccaccggcacuccgucaagagccaggagccccugccggacgacgacgaggaguucgagcuccccgaguucguggagcccuuccugaaggacacgccccucuacaccgacaacaccgccaacgggaucgcccuccugugggccccgcgccccuucaaccugcgguccggccgcacgcggcgcgcgcucgacaucccccuggugaagaacugguaccgggagcacugccccgccggccagccggucaaggugcgcgugagcuaccagaagcugcucaaguacuacguccugaacgcccugaagcaccggccgcccaaggcccagaagaagcgcuaccucuuccgguccuucaaggccaccaaguucuuccagagcaccaagcuggacuggguggaggucgggcuccaggugugccgccagggcuacaacaugcucaaccugcugauccaccggaagaaccugaacuaccuccaccuggacuacaacuucaaccugaagcccgugaagacccucacgaccaaggagcgcaagaagucccgguucgggaacgcguuccaccugugccgcgagguccugcggcucaccaagcuggugguggacagccacguccaguaccgccugggcaacguggacgccuuccagcucgccgacggccugcaguacaucuucgcccacguggggcagcugaccggcauguaccgguacaaguacaagcucaugcgccagauccgcaugugcaaggaccugaagcaccugaucuacuaccgguucaacacggggccggucggcaaggggcccggcugcggcuucugggccgcgggguggcgcguguggcuguucuucaugcggggcaucacgccccugcuggagcgcuggcucgggaaccugcuggcccggcaguucgagggccgccacuccaaggggguggccaagaccgucaccaagcagcggguggagagccacuucgaccucgagcugcgcgccgcggugaugcacgacauccuggacaugaugcccgagggcaucaagcagaacaaggcccggacgauccuccagcaccuguccgaggccuggcgcugcuggaaggccaacaucccguggaagguccccggccugcccacccccaucgagaacaugauccuccgguacgugaaggccaaggcggacugguggaccaacaccgcccacuacaaccgcgagcggauccgccgcggggccacgguggacaagaccgucugcaagaagaaccugggccgccugacccggcucuaccugaaggccgagcaggagcgccagcacaacuaccugaaggacgggccguacaucaccgccgaggaggcgguggccguguacacgaccaccguccacuggcucgagagccggcgcuucagccccauccccuucccgccccuguccuacaagcacgacaccaagcugcucauccuggcccuggagcggcucaaggaggccuacagcgugaagucccgccugaaccagagccagcgcgaggagcugggccucaucgagcaggccuacgacaacccccacgaggcgcugucccggaucaagcgccaccuccugacgcagcgggccuucaaggagguggggaucgaguucauggaccuguacagccaccugguccccguguacgacguggagccgcucgagaagaucaccgacgccuaccuggaccaguaccugugguacgaggccgacaagcgccgccuguucccgcccuggaucaagcccgcggacaccgagccgccgccccugcuggucuacaaguggugccagggcaucaacaaccuccaggacgugugggagaccuccgagggcgagugcaacgugaugcuggagagccgcuucgagaagauguacgagaagaucgaccugacccuccugaaccggcugcuccgccugaucgucgaccacaacaucgccgacuacaugacggccaagaacaacguggugaucaacuacaaggacaugaaccacaccaacuccuacgggaucauccggggccugcaguucgccagcuucaucguccaguacuacgggcucgugauggaccugcuggugcucggccugcaccgcgccuccgagauggcgggcccgccccagaugcccaacgacuuccugagcuuccaggacaucgccaccgaggccgcccaccccauccgccucuucugccgcuacaucgaccggauccacaucuucuuccgcuucaccgccgacgaggcgcgggaccugauccagcgcuaccugacggagcaccccgaccccaacaacgagaacaucgucggguacaacaacaagaagugcuggccccgggacgcccgcaugcggcucaugaagcacgacgugaaccugggccgcgccguguucugggacaucaagaaccgccugccccgguccgucaccaccgugcagugggagaacagcuucguguccgucuacagcaaggacaaccccaaccuccuguucaacaugugcggguucgagugccgcauccugccgaagugccggaccuccuacgaggaguucacgcacaaggacggcguguggaaccuccagaacgaggugaccaaggagcgcaccgcccagugcuuccugcgggucgacgacgagagcaugcagcgcuuccacaaccgggugcgccagauccugauggccuccgggagcaccacguucaccaagaucgugaacaaguggaacaccgcgcucaucggccugaugaccuacuuccgggaggccgucgugaacacgcaggagcugcucgaccugcuggugaagugcgagaacaagauccagacccgcaucaagaucggccucaacagcaagaugcccucccgguucccgcccgucguguucuacaccccgaaggagcucgggggccuggggaugcucagcaugggccacguccugaucccccaguccgaccugcgcuggagcaagcagaccgacguggggaucacgcacuuccgguccggcaugagccacgaggaggaccagcucauccccaaccuguaccgcuacauccagcccugggaguccgaguucaucgacagccagcgggugugggccgaguacgcccugaagcgccaggaggcgaucgcccagaaccggcgccugacccucgaggaccuggaggacuccugggaccggggcaucccgcgcaucaacacccuguuccagaaggaccggcacacccucgccuacgacaagggguggcgcguccgcacggacuucaagcaguaccaggugcugaagcagaaccccuucugguggacccaccagcggcacgacggcaagcuguggaaccucaacaacuaccgcaccgacaugauccaggcccucgggggcguggaggggauccuggagcacacccuguucaagggcacguacuuccccaccugggagggccuguucugggagaaggccagcggguucgaggaguccaugaaguggaagaagcugaccaacgcgcagcggagcggccucaaccagaucccgaaccgccgguucacccugugguggucccccacgaucaaccgcgccaacgucuacgugggguuccaggugcagcuggaccucaccggcaucuucaugcacgggaagauccccacccugaagaucagccugauccagaucuuccgggcccaccucuggcagaagauccacgaguccaucgucauggaccugugccagguguucgaccaggagcuggacgcccucgagaucgagaccgugcagaaggagacgauccacccccgcaagagcuacaagaugaacuccagcugcgccgacauccugcuguucgcgagcuacaaguggaacgucucccggccgagccuccuggccgacuccaaggacgugauggacagcaccaccacccagaaguacuggaucgacauccagcugcgcuggggcgacuacgacucccacgacaucgagcgguacgcccgcgccaaguuccucgacuacaccacggacaacaugagcaucuaccccucccccaccggcgugcugaucgccaucgaccuggcguacaaccuccacagcgccuacgggaacugguuccccggcuccaagccgcugauccagcaggccauggccaagaucaugaaggccaaccccgcgcuguacguccuccgggagcgcauccggaaggggcugcagcuguacagcuccgagcccaccgagcccuaccucagcucccagaacuacggcgagcuguucagcaaccagaucaucugguucguggacgacaccaacguguaccgcgucacgauccacaagaccuucgagggcaaccugaccaccaagccgaucaacggggccaucuucaucuucaacccccggacgggccagcuguuccugaagaucauccacaccuccgugugggccgggcagaagcgccugggccagcucgccaaguggaagaccgcggaggagguggccgcccugauccggagccugcccgucgaggagcagcccaagcagaucaucgugacccgcaaggggaugcucgacccgcuggaggugcaccuccucgacuuccccaacaucgucaucaagggcuccgagcugcagcugcccuuccaggccugccucaagguggagaaguucggcgaccugauccugaaggccacggagccccagauggugcuguucaaccuguacgacgacuggcugaagaccaucagcuccuacaccgcguucagccgccucauccugauccugcgggcccuccacgucaacaacgaccgcgccaaggugauccugaagccggacaagaccacgaucaccgagccccaccacaucuggcccacccugaccgacgaggaguggaucaagguggagguccagcucaaggaccugauccuggccgacuacgggaagaagaacaacgugaacguggccagccucacgcaguccgagauccgggacaucauccugggcauggagaucagcgcgcccucccagcagcgccagcagaucgccgagaucgagaagcagaccaaggagcagagccagcugaccgccacccagacgcggaccgucaacaagcacggggacgagaucaucaccuccaccacgagcaacuacgagacccagaccuucuccagcaagaccgaguggcgcgugcgggccaucuccgccgcgaaccuccaccuccggacgaaccacaucuacgugagcuccgacgacaucaaggagaccggcuacaccuacauccugccgaagaacguccugaagaaguucaucugcaucagcgaccugcgggcccagaucgccggguaccuguacggcgugagcccgcccgacaacccccaggugaaggagauccgcugcaucgucauggugccgcaguggggcacccaccagacggugcaccuccccgggcagcugccccagcacgaguaccugaaggagauggagccgcucggcuggauccacacccagcccaacgagagcccccagcugagcccccaggacgucaccacccacgccaagaucauggcggacaacccgagcugggacggggagaagaccaucaucaucacgugcuccuucacccccggcagcugcacccugaccgccuacaagcucacgcccuccggguacgaguggggccggcagaacaccgacaagggcaacaaccccaagggguaccugccgagccacuacgagcgcgugcagaugcugcucagcgaccgguuccugggcuucuucauggugcccgcccaguccagcuggaacuacaacuucauggggguccgccacgaccccaacaugaaguacgagcugcagcucgccaaccccaaggaguucuaccacgaggugcaccggccgucccacuuccugaacuucgcccugcuccaggagggcgagguguacagcgcggaccgcgaggaccuguacgccuga

SEQ ID NO: 35106 - RNA, 1041 nt, Artificial Sequence
  derived and/or modified sequence opt1 from PRPH2__Homo_sapiens__NP_000313
auggcccugcucaaggugaaguucgaccagaagaagcgcgucaagcuggcccagggccuguggcucaugaacugguucagcgugcuggcggggaucaucaucuucucccugggccucuuccugaagaucgagcugcggaagcgcagcgacgugaugaacaacuccgagagccacuucguccccaacucccucaucgggaugggcgugcugagcugcguguucaacucccuggccgggaagaucugcuacgacgcccucgacccggccaaguacgcccgguggaagcccuggcugaagcccuaccuggcgaucugcguccucuucaacaucauccuguuccugguggcccucugcugcuuccugcugcgcggcagccucgagaacacccugggccaggggcugaagaacggcaugaaguacuaccgggacaccgacacgcccgggcgcugcuucaugaagaagaccaucgacaugcuccagaucgaguucaagugcugcggcaacaacggguuccgggacugguucgagauccaguggaucuccaaccgcuaccuggacuucagcuccaaggaggugaaggaccggaucaagagcaacgucgacggccgcuaccugguggacggcgugccguucuccugcugcaaccccagcagcccccggcccugcauccaguaccagaucaccaacaacuccgcccacuacuccuacgaccaccagaccgaggagcucaaccuguggguccgcgggugccgggccgcgcugcucagcuacuacuccagccugaugaacagcaugggcguggugacgcugcucaucuggcuguucgaggucaccaucaccaucgggcugcgcuaccuccagaccucccuggacggcgugagcaacccggaggaguccgagagcgagucccagggcuggcugcucgagcggagcgugcccgagacguggaaggccuuccuggaguccgucaagaagcuggggaagggcaaccagguggaggccgagggggccgacgccggccaggcgcccgaggccggguga

SEQ ID NO: 35107 - RNA, 1413 nt, Artificial Sequence
  derived and/or modified sequence opt1 from PRPH__Homo_sapiens__NP_006253
augagccaccaccccuccggccugcgcgccggguucagcuccaccagcuaccggcgcaccuucggcccgccgcccucccucagccccggggccuucuccuacagcuccagcucccgguucagcuccagccgccugcugggcuccgcgagccccuccagcuccgugcggcucgggagcuuccgcagcccccgggccggcgccggcgcccugcugcgccuccccuccgagcggcuggacuucagcauggccgaggcgcugaaccaggaguuccucgccacgcgcuccaacgagaagcaggagcugcaggagcugaacgaccgguucgccaacuucaucgagaagguccgcuuccucgagcagcagaacgccgcgcugcgcggggagcugagccaggcccggggccaggagcccgcccgggccgaccagcucugccagcaggagcugcgcgagcugcggcgcgagcucgagcugcuggggcgggagcgcgaccggguccagguggagcgcgacggccucgccgaggaccuggcggcccugaagcagcgccucgaggaggagacccggaagcgcgaggacgccgagcacaaccuggugcuguuccggaaggacguggacgacgccacccucucccgccuggagcuggagcggaagaucgagagccucauggacgagaucgaguuccugaagaagcugcacgaggaggagcuccgcgaccuccagguguccgucgagagccagcagguccagcaggucgagguggaggccaccgugaagccggagcugacggcggcccugcgggacauccgcgcccaguacgaguccaucgccgccaagaaccugcaggaggcggaggagugguacaagagcaaguacgccgaccuguccgacgccgccaaccggaaccacgaggcccuccgccaggcgaagcaggagaugaacgagagccggcgccagauccagucccugaccugcgagguggacgggcugcggggcaccaacgaggcccuccugcgccagcugcgggagcucgaggagcaguucgcccuggaggccggcggguaccaggcgggcgccgcccgccuggaggaggagcuccggcagcugaaggaggagauggcccgccaccuccgggaguaccaggagcugcugaacgugaagauggcccuggacaucgagaucgcgaccuaccgcaagcugcucgagggggaggagagccgcaucuccgugcccgugcacagcuucgccucccugaacaucaagacgaccguccccgagguggagcccccgcaggacagccacucccggaagaccgugcugaucaagaccaucgagacgcgcaacggcgaggucgugaccgagagccagaaggagcagcggagcgagcucgacaaguccagcgcccacuccuacuga

SEQ ID NO: 35108 - RNA, 957 nt, Artificial Sequence
  derived and/or modified sequence opt1 from PRPS1__Homo_sapiens__NP_002755
augcccaacaucaagaucuucagcggcuccagccaccaggaccugucccagaagaucgccgaccgccucgggcuggagcugggcaagguggucaccaagaaguucagcaaccaggagaccugcguggagaucggggaguccgugcggggcgaggacgucuacaucgugcagagcgggugcggcgagaucaacgacaaccucauggagcugcugaucaugaucaacgccugcaagaucgcguccgccagccgcgugacggccgucaucccgugcuuccccuacgcccggcaggacaagaaggacaagucccgcgcccccaucagcgcgaagcucguggccaacaugcuguccguggccggcgccgaccacaucaucaccauggaccugcacgcgagccagauccagggguucuucgacauccccgucgacaaccucuacgccgagccggccgugcugaaguggauccgggagaacaucuccgaguggcgcaacugcaccaucgugagccccgacgccggcggggccaagcgggucaccuccaucgcggaccgccugaacguggacuucgcccucauccacaaggagcggaagaaggccaacgagguggaccgcaugguccuggugggcgacgugaaggaccgggucgccauccugguggacgacauggccgacacgugcgggaccaucugccacgcggccgacaagcuccugagcgccggcgccacccgcguguacgccauccugacccacggcaucuucuccgggcccgcgaucagccggaucaacaacgccugcuucgaggccgucguggugacgaacaccaucccccaggaggacaagaugaagcacugcuccaagauccaggucaucgacaucagcaugauccucgccgaggccauccgccggacccacaacggcgagagcguguccuaccuguucagccacgucccgcuguga

SEQ ID NO: 35109 - RNA, 957 nt, Artificial Sequence
  derived and/or modified sequence opt1 from PRPS1L1__Homo_sapiens__NP_787082
augcccaacaucaagaucuucagcggcuccagccaccaggaccugucccagaagaucgccgaccgccucgggcuggagcugggcaagguggucaccaagaaguucagcaaccaggagaccugcguggagaucgacgaguccgugcgcggggaggacgucuacaucgugcagagcggcugcggggagaucaacgacucccucauggagcugcugaucaugaucaacgccugcaagaucgcgagcgccucccgggugacggccgucaucccgugcuuccccuacgcccggcaggacaagaaggacaagagccgcucccccaucagcgccaagcucguggcgaacaugcuguccaucgccggcgccgaccacaucaucaccauggaccugcacgccagccagauccagggcuucuucgacauccccguggacaaccucuacgcggagccgaccguccugaaguggauccgggagaacauccccgaguggaagaacugcaucaucgugucccccgacgccgggggcgccaagcgcgugaccagcaucgccgaccagcugaacgucgacuucgcccucauccacaaggagcggaagaaggcgaacgagguggacugcaucgugcuggucggggacgugaacgaccgcguggccauccuggucgacgacauggccgacacgugcgugaccaucugccucgccgccgacaagcugcuguccgcgggcgccacccggguguacgccauccucacccacgggaucuucagcggccccgccaucucccgcaucaacacggccugcuucgaggcggucguggugaccaacaccaucccgcaggacgagaagaugaagcacugcagcaagauccgggucaucgacaucagcaugauccuggccgaggccauccgccggacccacaacggcgaguccgugagcuaccuguucucccacgucccccucuga

SEQ ID NO: 35110 - RNA, 966 nt, Artificial Sequence
  derived and/or modified sequence opt1 from PRPS2__Homo_sapiens__NP_001034180
augcccaacaucgugcuguucagcggcuccagccaccaggaccucucccagcgcgucgccgaccggcuggggcuggagcucggcaagguggugaccaagaaguucagcaaccaggagaccuccgucgagaucggggagagcgugcgcggcgaggacguguacaucauccaguccgggugcggcgagaucaacgacaaccugauggagcugcucaucaugaucaacgccugcaagaucgcgagcuccagccgggucacggccgugaucccgugcuuccccuacgcccgccaggacaagaaggacaaggugggcgagucccgggcccccaucagcgccaagcuggucgcgaacaugcuguccguggccggggccgaccacaucaucaccauggaccuccacgccagccagauccagggcuucuucgacauccccguggacaaccuguacgcggagccggccguccugcaguggauccgcgagaacaucgccgaguggaagaacugcaucaucgugucccccgacgccgggggcgccaagcgggugaccagcaucgcggaccgccucaacgucgaguucgcccugauccacaaggagcggaagaaggccaacgagguggaccgcauggugcuggucggggacgugaaggaccggguggccauccucgucgacgacauggccgacacgugcggcaccaucugccacgcggccgacaagcugcuguccgccggcgccaccaagguguacgccauccucacccacgggaucuucagcggccccgcgaucucccgcaucaacaacgccgccuucgaggccguggucgugaccaacacgaucccccaggaggacaagaugaagcacugcaccaagauccaggucaucgacaucagcaugauccuggccgaggcgauccggcgcacccacaacggggagagcguguccuaccuguucagccacgugccgcucuga

SEQ ID NO: 35111 - RNA, 1158 nt, Artificial Sequence
  derived and/or modified sequence opt1 from PRPSAP1__Homo_sapiens__NP_002757
augcccaagaagcugcuccugcugccgccgcccagcgccuccagcgccuuccgcgugccccgggcccgccccgucccgccgcccgccaugaacgccgcccggaccggcuaccgcguguucuccgccaacagcaccgcggccugcacggagcucgccaagcggaucaccgagcgccugggggccgagcugggcaaguccguggucuaccaggagaccaacggggagacccggguggagaucaaggagagcgugcgcggccaggacaucuucaucauccagacgaucccccgggacgucaacaccgcggugauggagcuccugaucauggccuacgcccugaagaccgccugcgcccgcaacaucaucggggugauccccuacuuccccuacuccaagcagagcaagaugcggaagcgcggcuccaucgucugcaagcuccuggcgagcaugcuggccaaggccggccucacccacaucaucacgauggaccugcaccagaaggagauccagggguucuucuccuuccccguggacaaccugcgggccagccccuuccuccugcaguacauccaggaggagauccccaacuaccgcaacgccgugaucgucgcgaagucccccgacgccgccaagcgggcccagagcuacgccgagcgccugcggcucggccuggcggugauccacggggaggcccagugcaccgagcuggacauggacgacggccgccacuccccgcccauggugaagaacgccaccguccaccccgggcucgagcugccccugaugauggccaaggagaagcccccgaucaccguggugggcgacgucggcgggcggaucgccaucaucguggacgacaucaucgacgacguggagagcuucgucgcggccgccgagauccucaaggagcgcggcgccuacaagaucuacgugauggcgacgcacgggauccuguccgccgaggcgccccggcugaucgaggagagcuccguggacgaggucguggucaccaacaccgugccccacgaggugcagaagcuccagugccccaagaucaagaccgucgacaucagccugauccugagcgaggccauccgccgcauccacaacggcgaguccauggccuaccucuuccggaacaucacgguggacgacuga

SEQ ID NO: 35112 - RNA, 990 nt, Artificial Sequence
  derived and/or modified sequence opt1 from PRPSAP2__Homo_sapiens__NP_001230865
auguucugcgugacgcccccggagcuggagaccaagaugaacaucaccaagggcgggcucguccuguucagcgccaacuccaacagcuccugcauggagcugagcaagaagaucgccgaggacgugaacaccaccaucauggagcuccugaucaugguguacgcgugcaagaccuccugcgccaagagcaucaucggcgucauccccuacuuccccuacuccaagcagugcaagaugcgcaagcgggggagcaucguguccaagcugcucgccagcaugaugugcaaggccggccugacgcaccugaucaccauggaccuccaccagaaggagauccagggguucuucaacauccccguggacaaccugcgcgccuccccguuccugcuccaguacauccaggaggagauccccgacuaccggaacgcggucaucguggccaagagccccgccuccgccaagcgcgcgcagagcuucgccgagcggcugcgccugggcaucgccgugauccacggcgaggcccaggacgccgaguccgaccucgucgacgggcggcacagcccgcccauggugcgcuccguggcggccauccaccccagccuggagauccccaugcugauccccaaggagaagccgcccaucaccgucgugggcgacgucgggggccggaucgccaucaucguggacgacaucaucgacgacguggacuccuuccucgccgccgcggagacccugaaggagcgcggggccuacaagaucuucgugauggccacgcacggccugcucagcagcgacgcgccccggcgcaucgaggaguccgccaucgacgaggucguggugaccaacaccaucccccacgagguccagaagcugcagugcccgaagaucaagaccguggacaucagcaugauccuguccgaggccauccggcgcauccacaacggcgagagcauguccuaccucuuccggaacaucgggcuggacgacuga

SEQ ID NO: 35113 - RNA, 1083 nt, Artificial Sequence
  derived and/or modified sequence opt1 from PRR11__Homo_sapiens__NP_060774
augcccaaguucaagcagcgccggcgcaagcugaaggccaaggccgagcggcucuucaagaagaaggaggcgagccacuuccaguccaagcugaucaccccgcccccccccccgcccagccccgagcgcgugggcaucuccagcaucgacaucucccagagccgguccuggcugaccagcuccuggaacuucaacuuccccaacauccgcgacgccaucaagcucuggacgaaccgggucuggagcaucuacuccuggugccagaacugcaucacccagagccuggaggugcugaaggacaccaucuucccgucccgcaucugccaccgggagcucuacagcgugaagcagcaguucugcauccuggaguccaagcugugcaagcuccaggaggcccugaagaccaucagcgaguccagcuccugccccagcugcgggcagacgugccacaugagcggcaagcugaccaacguccccgccugcgugcucaucacccccggggacuccaaggccgugcugccgcccacccugccccagcccgcgagccacuucccgcccccccccccgccccccccccucccgcccccccccccgccccuggcccccguccugcuccgcaagccgucccuggccaaggcccugcaggcgggcccccucaagaaggacgggcccaugcagaucacggugaaggaccugcugaccgugaagcucaagaagacccagagccuggacgagaagcggaagcugauccccuccccgaaggcccgcaacccccucgucaccgugagcgaccugcagcacgugacgcugaagcccaacuccaagguccucagcacccgggugaccaacgugcugaucacccccggcaagucccagauggaccugcgcaagcuccugcggaaggucgacguggagcgcagcccgggcgggacgccccugaccaacaaggagaacauggagaccggcaccgggcucacgcccgugaugacccaggcccugcggcgcaaguuccagcuggcccacccccgguccccgacccccacccucccccugagcacguccagcuucgacgagcagaacuga

SEQ ID NO: 35114 - RNA, 297 nt, Artificial Sequence
  derived and/or modified sequence opt1 from PRR13__Homo_sapiens__NP_001005354
auguggaaccccaacgccggcgggccgccccaccccgugccccagccgggcuaccccgggugccagccccugggccccuacccgccccccuaccccccgcccgcccccgggauccccccggucaacccccucgcgcccggcauggugggccccgccgugaucgucgacaagaagaugcagaagaagaugaagaaggcccacaagaagaugcacaagcaccagaagcaccacaaguaccacaagcacgggaagcacagcuccagcuccagcuccagcuccagcuccgacagcgacuga

SEQ ID NO: 35115 - RNA, 390 nt, Artificial Sequence
  derived and/or modified sequence opt1 from PRR15__Homo_sapiens__XP_011513501
auggccgacagcggcgacgccggguccagcggccccugguggaagucccugaccaacagccgcaagaaguccaaggaggcggccgugggggucccgccgcccgcccagcccgcccccggcgagcccaccccgcccgccccgcccagccccgacuggacguccagcucccgggagaaccagcaccccaaccuccucgggggcgcgggcgagccgcccaagcccgacaagcuguacggggacaagagcggcuccagccgccggaaccugaagaucucccgcagcgggcgguucaaggagaagcgcaaggugcgggccacccugcugcccgaggccggccgcucccccgaggaggccggguuccccggcgacccccacgaggacaagcaguga

SEQ ID NO: 35116 - RNA, 915 nt, Artificial Sequence
  derived and/or modified sequence opt1 from PRR16__Homo_sapiens__NP_001287712
augagcgccaaguccaagggcaaccccagcuccagcugccccgccgaggggccgcccgcggccuccaagaccaaggugaaggagcagaucaagaucaucgucgaggaccuggagcuggugcugggcgaccugaaggacguggccaaggagcucaaggaggucguggaccagaucgacacccugacgagcgaccugcagcucgaggacgagaugaccgacuccagcaagaccgacacccugaacuccagcuccagcgggacgaccgccuccagccuggagaagaucaaggugcaggccaacgcgccccucaucaagccgcccgcccaccccuccgccauccugaccguccugcgcaagcccaacccgcccccgccgccgccccggcucacccccgugaagugcgaggaccccaagcgcgugguccccacggccaaccccgugaagaccaacggcacccugcugcggaacgggggccuccccggcgggcccaacaagauccccaacggcgacaucugcugcauccccaacagcaaccuggacaaggcgcccgugcagcugcucaugcaccgccccgagaaggaccggugcccccaggccgggccccgcgagcggguccgcuucaacgagaaggugcaguaccacggcuacugccccgacugcgacacccgguacaacaucaagaaccgcgaggugcaccuccacuccgagcccguccacccgcccgggaagaucccccaccagggcccgccccugccgcccacgccccaccucccgcccuucccccuggagaacggcgggaugggcaucagccacuccaacagcuucccgcccauccggcccgccaccgugcccccgcccaccgcccccaagccccagaagaccauccugcgcaagagcacgaccaccaccguguga

SEQ ID NO: 35117 - RNA, 417 nt, Artificial Sequence
  derived and/or modified sequence opt1 from PRR34__Homo_sapiens__NP_060750
augcccgccagcgccaccgcggccuggcacugcccgccccugugccugccgccccugcccgccuccgcccccaccagcccgcccaaccccgccacgcgccccgcgcccggccccgggcggcgcgcccggugcccgcaguccgcccaccccgcccccacccgcggcgcgcugaccuucugggcccccgggagcuggccccgggugcuccuggucccccgcucccccggccccgugcugcgggccccgcgccucccccaccccgccgcccgggcgcgccggcgcgccuggcacggggcccggcugcccggcagcccggcccgcgccggccggaccuuccagcgcgggcugguguccaacagcugggcgcacgccaucuuccucccccggccgcccaacguccuggagcuccagguguga

SEQ ID NO: 35118 - RNA, 504 nt, Artificial Sequence
  derived and/or modified sequence opt1 from PRR3__Homo_sapiens__NP_001070965
augcccaagcgcaagaagcagaaccaccaccagccgcccacccagcagcagcccccccugccggagcgggaggagaccggcgacgaggaggacgggagccccaucgcccuccaccgcggcccccccgggucccggggcccgcugauccccccccugcucagccugcccccgccccccugggggcgcggccccauccggcgcggccuggggccgcgguccagccccuacggccgcgggugguggggcgugaacgccgagccccccuucccggggcccggccacggcgggcccacgcggggcuccuuccacaaggagcagcgcaacccccggcgccucaagagcuggucccugaucaagaacaccugcccgcccaaggacgacccccaggucauggaggacaagagcgaccggcccgugugccgccacuucgcgaagaaggggcacugccgguacgaggaccugugcgccuucuaccacccgggcgugaacggccccccccucuga

SEQ ID NO: 35119 - RNA, 1140 nt, Artificial Sequence
  derived and/or modified sequence opt1 from PRR5__Homo_sapiens__NP_001017528
augagcucccccagccuguccgaccucggcaagcgcgagccggccgccgccgccgacgagcgggggacccagcagcgccgggccugcgccaacgccaccuggaacagcauccacaacggcgugaucgcggucuuccagcgcaaggggcugcccgaccaggagcuguucucccucaacgagggcgugcggcagcugcugaagacggagcucgggagcuucuucaccgaguaccugcagaaccagcugcucaccaagggcauggugauccugcgcgacaagauccgguucuacgagggccagaagcugcucgacucccuggccgagaccugggacuucuucuucagcgacguccugcccaugcuccaggccaucuucuaccccgugcaggggaaggagccguccgugcgccagcuggcccugcuccacuuccggaacgcgaucacgcugagcgucaagcuggaggacgcccucgcccgcgcccacgcccgggugccgcccgcgaucgugcagaugcugcugguccuccagggcgugcacgagucccgcggggugaccgaggacuaccugcggcuggagacccucguccagaagguggugagccccuaccugggcaccuacgggcugcacuccagcgagggccccuucacgcacuccugcauccucgagaagcgccugcugcggcgcagccgguccggcgacguccucgccaagaaccccguggugcgcagcaaguccuacaacacgccccugcugaaccccguccaggagcacgaggccgagggggccgccgcgggcgggaccagcauccggcgccacagcguguccgagaugaccagcugcccggagccccagggcuucuccgacccgcccggccaggggcccaccggcaccuuccggagcucccccgcgccccacagcgggcccugcccgucccgccucuaccccaccacccagccgcccgagcagggccuggaccccacgcgcagcucccugccccggagcucccccgagaaccucguggaccagauccuggagagcgucgacuccgacagcgaggggaucuucaucgacuucggccgcggccggggguccggcaugagcgaccuggagggguccggcgggcgccagagcgugguguga

SEQ ID NO: 35120 - RNA, 387 nt, Artificial Sequence
  derived and/or modified sequence opt1 from PRR9__Homo_sapiens__XP_011508108
augaccgccugcacgugcagcgccaaccacccccgcauguccuucagcgagcagcagugcaagcagcccugcgugcccccgcccugccugcccaagacccaggagcagugccaggcgaaggccgaggaggucugccucccgaccugccagcaccccugccaggacaagugccuggugcaggcccaggaggugugccugucccagugccaggagagcucccaggagaagugcccccagcagggccaggagcccuaccucccgcccugccaggaccagugcccgccccagugcgccgagcccugccaggagcuguuccagaccaagugcgucgaggugugcccccagaaggugcaggagaagugcagcucccccgggaagggcaaguga

SEQ ID NO: 35121 - RNA, 1389 nt, Artificial Sequence
  derived and/or modified sequence opt1 from PRRC1__Homo_sapiens__NP_001273737
augauggaggagagcggcaucgagaccaccccgcccgggacgcccccgcccaaccccgccggccuggccgcgaccgccauguccagcacccccgugccccucgccgccaccuccagcuucuccagccccaacgucuccagcauggaguccuucccgccccuggccuacagcacgccccagcccccgcugccgcccgugcgccccuccgcgccccuccccuucgugcccccgcccgccguccccagcgugccgccccuggugaccuccaugcccccgcccgucagccccuccaccgccgccgcguucgggaacccgcccgugagccacuucccgcccuccaccagcgcccccaacacgcugcuccccgcgcccccguccggcccgcccaucagcggguucagcgugggcuccaccuacgacaucacccggggccacgccgggcgcgcgccccagacgccccugaugcccagcuucuccgcccccagcggcaccgggcugcuccccacccccaucacccagcaggccucccugaccagccuggcccagggcacggggaccaccuccgccaucaccuuccccgaggagcaggaggacccccggaucacgcgcggccaggacgaggccagcgccggcgggaucuggggcuucaucaagggggucgccggcaaccccauggugaaguccgugcucgacaagaccaagcacagcgucgaguccaugaucaccacccuggacccgggcauggcccccuacaucaagagcgggggcgagcuggacaucguggugacguccaacaaggaggucaagguggccgccgugcgggacgcguuccaggaggucuucgggcucgccgugguggucggcgaggccgggcagagcaacaucgcgccccagcccgugggcuacgccgccggccugaagggggcccaggagcgcaucgacucccugcggcgcaccggcgugauccacgagaagcagaccgccgucagcguggagaacuucaucgccgagcuccugccggacaagugguucgacaucgggugccuggucguggaggaccccgugcacggcauccaccucgagaccuucacgcaggcgacccccgucccccuggaguucgugcagcaggcccagucccugaccccgcaggacuacaaccuccgguggagcgggcugcuggugaccgucggcgaggugcucgagaagucccugcugaacgugagccgcacggacuggcacauggccuucaccggcaugagccggcgccagaugaucuacuccgccgcccgggcgaucgccgacgacuacuucccccgcauccccaaggagcaguggcagagcauggccuggcucaagcuggagaucuuccugccgcucgucaccugguga

SEQ ID NO: 35122 - RNA, 6474 nt, Artificial Sequence
  derived and/or modified sequence opt1 from PRRC2A__Homo_sapiens__NP_542417
augagcgaccgcuccggccccaccgccaaggggaaggacggcaagaaguacagcucccugaaccucuucgacaccuacaaggggaagagccuggagauccagaagccggccguggcgccccggcacggccugcagucccucgggaaggucgccaucgcccgccggaugccccccccggccaaccugcccagccugaaggccgagaacaagggcaacgaccccaacgugucccucgugcccaaggacggcacggggugggcgagcaagcaggagcaguccgacccgaagagcuccgacgccagcaccgcccagccccccgagucccagccccugccggccagccagacccccgcguccaaccagcccaagcgccccccggccgcccccgagaacaccccccugguccccagcggcgugaaguccugggcccaggccagcgugacgcacggggcgcacggcgacgggggccgggccuccagccuccugagccgcuucucccgggaggaguucccgacccugcaggccgccggcgaccaggacaaggccgcgaaggagcgcgagagcgccgagcaguccagcgggcccggccccucccuccggccccagaacagcaccaccuggcgcgacgggggcggccgggggccggacgagcuggagggccccgacuccaagcugcaccacgggcacgacccccgcggcgggcuccagcccagcggcccgccccaguuccccccguaccggggcaugaugccccccuucauguaccccccguaccugcccuucccccccccguacgggccccagggccccuaccgcuaccccacgccggacgggcccucccgguucccccgcgucgccggcccccgggggagcggcccgcccaugcgccugguggagcccgugggccggcccuccauccucaaggaggacaaccugaaggaguucgaccagcuggaccaggagaacgacgacgggugggccggcgcccacgaggaggucgacuacaccgagaagcucaaguucagcgacgaggaggacgggcgcgacuccgacgaggagggcgcggaggggcaccgggacagccaguccgccagcggcgaggagcgcccgcccgaggccgacggcaagaaggggaacucccccaacagcgagcccccgacccccaagaccgccugggccgagacgucccgccccccggagaccgagcccggcccccccgcgccgaagcccccccugcccccgccccaccgggggcccgccggcaacuggggccccccgggggacuaccccgaccgcggcgggccccccugcaagccgcccgcccccgaggacgaggacgaggccuggcggcagcgccggaagcagagcagcuccgagaucagccuggcgguggagcgcgcccggcgccggcgcgaggaggaggagcggcgcaugcaggaggagcggcgcgccgccugcgccgagaagcucaagcggcuggacgagaaguucggcgcgcccgacaagcgccugaaggccgagccggccgccccccccgccgcgcccuccaccccggcccccccccccgccgugccgaaggagcuccccgcccccccggcccccccccccgcgagcgccccgacccccgagacggagcccgaggagcccgcccaggccccgcccgcgcaguccacccccacccccggggucgccgccgccccgacccuggugagcggcggcggguccacgagcuccaccagcuccggcagcuucgaggccucccccguggagccccagcugcccagcaaggaggggccggagccccccgaggagguccccccgcccaccaccccccccgugccgaagguggagcccaagggcgacgggaucggccccacgcggcagcccccgucccagggccucggguaccccaaguaccagaagagccugcccccgcgcuuccagcggcagcagcaggagcagcugcucaagcagcagcagcagcaccaguggcagcagcaccagcagggcuccgcgccccccacccccgucccgcccagccccccccagccggugacccugggggccgugcccgccccccaggcccccccgcccccccccaaggcccuguacccgggcgcgcucgggcgccccccccccaugccgcccaugaacuucgacccccgcuggaugaugauccccccguacgucgacccccggcugcugcagggccgccccccgcucgacuucuacccccccggcgugcaccccagcgggcuggugccgcgggagcgcuccgacagcggcggguccagcuccgagcccuucgaccggcacgcccccgccaugcugcgcgagcggggcacccccccggucgaccccaagcucgccugggugggggacgucuucacggccacccccgcggagccccgcccgcugaccagcccccugcggcaggccgccgacgaggacgacaagggcaugcgcuccgagaccccccccgugccgcccccccccccguaccucgccagcuaccccggcuuccccgagaacggggcgcccggcccgcccaucucccgguucccccuggaggagcccgggccgcgcccccugcccuggccgcccggcagcgacgagguggccaagauccagacgccccccccgaagaaggagccccccaaggaggagaccgcccagcucaccggccccgaggccgggcggaagccggcccgcggcgucggguccggcgggcagggccccccccccccgcggcgcgagagccggaccgagacgcgcuggggcccccggcccggguccagccgccggggcauccccccggaggagcccggggcgcccccccgccgcgccggcccgaucaagaagcccccccccccgaccaagguggaggagcugccccccaagccccuggagcagggggacgagaccccgaagccccccaagccggacccccugaagaucaccaagggcaagcucggcgggcccaaggagacccccccgaacggcaaccugucccccgccccccggcugcgccgggacuacagcuacgagcgcguggggcccacguccugccggggccgcgggcggggcgaguacuucgcccgcggccggggguuccgcggcaccuacgggggccggggccgcggggcccggagccgcgaguuccgguccuaccgcgaguuccggggcgacgacgggcgcggcgggggcaccggcgggccgaaccacccccccgcgccccggggccgcaccgccagcgagacgcgcagcgagggguccgaguacgaggagaucccgaagcggcgccggcagcgcggcagcgagaccggguccgagacccacgagagcgaccucgcccccuccgacaaggaggcccccacccccaaggagggcacgcugacccaggucccgcuggcccccccccccccgggcgcgccccccagccccgccccggcccgguucaccgcccgcgggggccggguguucaccccccgcggggugcccucccggcgcggccgggggggcggccgccccccgccccaggucugccccggguggagcccgcccgccaagucccucgcgcccaagaagcccccgacgggcccccugccccccagcaaggagccgcugaaggagaagcucauccccgggccccugucccccguggcccggggcgggagcaacggcggcuccaacguggggauggaggacggcgagcgcccgcggcgccggcgccacgggcgggcccagcagcaggacaagcccccccgcuuccggcgccugaagcaggagcgcgagaacgccgcgcggggcagcgagggcaagcccucccucacccugccggccagcgcccccgggcccgaggaggcccugaccaccgucacgguggcccccgcgccgcgccgggccgccgccaagucccccgaccucagcaaccagaacuccgaccaggccaacgaggagugggagaccgcgagcgagagcuccgacuucaccagcgagcgccggggcgacaaggaggccccccccccggugcugcugacccccaaggccgucgggacgcccggcgggggcggcgggggcgccgugccggggaucuccgccaugagccgcggcgaccucucccagcgggcgaaggaccugagcaagcgcuccuucagcucccagcggcccgggauggagcgccagaaccggcgccccggccccggcgggaaggccggcagcuccgggagcuccagcggcgggggcggcgggggcccggggggccggaccgggcccggccgcggcgacaagcgguccuggcccagccccaagaaccgcucccggccgcccgaggagcgcccccccgggcugccgcuccccccccccccgcccagcuccagcgccguguuccggcuggaccaggucauccacagcaaccccgccggcauccagcaggcgcuggcccagcucuccagccgccagggguccgugaccgcccccggcggccacccgcgccacaagcccgggcugccccaggccccccagggcccgagcccccggccccccacccgcuacgagccgcagcgggugaacuccgggcugagcuccgacccccacuucgaggagcccggcccgaugguccgcggggugggcggcacgccccgggacagcgccggggugucccccuuccccccgaagcgccgggagcgccccccccggaagcccgagcuccugcaggaggagagccugccgcccccccacuccagcggcuuccucggguccaagcccgagggcccggggccccaggcggagagccgcgacaccggcaccgaggcccugaccccccacaucuggaaccggcugcacacggccaccucccgcaagagcuaccggcccuccagcauggagccguggauggagccccucucccccuucgaggacgucgccggcaccgagaugagccagagcgacuccgggguggaccugagcggcgacucccaggugagcuccgggcccugcagccagcgcuccagcccggacggcgggcugaagggcgccgcggagggcccccccaagcggcccgggggcuccagcccgcucaacgccguccccugcgaggggccccccggcuccgagccgccccgccggcccccgcccgccccccacgacggcgaccgcaaggagcugccccgggagcagccgcugccccccgggcccaucggcaccgagcgcagccagcggacggaccgcgggaccgagccgggccccauccgccccucccaccggcccgggccgcccgugcaguucggcaccagcgacaaggacuccgaccuccgccugguggucggcgacagccugaaggccgagaaggagcucaccgccuccgugacggaggcgauccccgugagccgggacugggagcugcugcccuccgccgccgccagcgcggagccgcagagcaagaaccucgacuccgggcacugcguccccgagcccagcuccagcggccagcgccuguaccccgagguguucuacggguccgccggcccgagcuccagccagaucuccgggggcgccauggacagccagcugcaccccaacuccggcggguuccggcccggcacccccagccuccacccguaccgcucccagccccuguaccugcccccggggcccgccccccccagcgcccuccuguccggccuggcgcucaaggggcaguuccuggacuucagcaccaugcaggccaccgagcugggcaagcucccggccggcggggugcuguaccccccccccuccuuccuguacagcccggccuucugccccagcccccuccccgacaccucccugcugcagguccggcaggaccucccgagccccuccgacuucuacagcacgccccugcagcccggcgggcaguccggcuuccugccgagcggggcccccgcgcagcagaugcuccugcccaugguggacucccagcugcccguggucaacuucggcagccucccgcccgccccccccccggccccccccccccugucccugcucccggugggccccgcccugcagcccccgagccuggccgugcgccccccccccgcgccggccacccggguccuccccucccccgcccgccccuucccggccagccuggggcgggccgagcugcaccccguggagcucaagcccuuccaggacuaccagaagcuguccagcaaccugggcgggcccggcuccagccgcaccccgcccaccggccgguccuucagcgggcucaacucccgccugaaggcgacgcccagcaccuacagcggcguguuccggacccagcgcgucgaccuguaccagcaggccucccccccggacgcccuccgguggauccccaagcccugggagcgcaccgggcccccgccccgggagggccccagccgccgcgccgaggagcccgggucccggggcgacaaggagccgggccugccccccccccgcuga

SEQ ID NO: 35123 - RNA, 8454 nt, Artificial Sequence
  derived and/or modified sequence opt1 from PRRC2C__Homo_sapiens__NP_055987
augagcgagaaguccggccagagcaccaaggccaaggacgggaagaaguacgccacccugucccucuucaacaccuacaagggcaagagccuggagacccagaagaccaccgcccgccacgggcugcagucccucggcaagguggggaucagccggcgcaugcccccgcccgccaaccugcccucccugaaggccgagaacaagggcaacgaccccaacgucaacaucgugcccaaggacggcacggggugggccagcaagcaggagcagcacgaggaggagaagacccccgaggugccgcccgcccagcccaagcccggcgucgccgcgccgcccgagguggcccccgcccccaaguccugggccagcaacaagcagggcgggcagggggacggcauccaggugaacucccaguuccagcaggaguuccccagccuccaggccgccggcgaccaggagaagaaggagaaggagaccaacgacgacaacuacgggcccggccccucccugcggccgcccaacgucgccugcuggcgcgacgggggcaaggccgccggcagccccuccagcuccgaccaggacgagaagcugcccgggcaggacgagagcaccgccggcacguccgagcagaacgacauccucaaggugguggagaagcggaucgccugcgggccgccccaggccaagcugaacggccagcaggccgcccuggccagccaguaccgcgccaugaugccgcccuacauguuccagcaguacccccggaugaccuacccgccccuccacgggcccaugcgcuucccgcccagccuguccgagaccaacaagggccugcggggccgcgggcccccgcccagcugggccuccgagcccgagcggcccagcauccucuccgccagcgagcugaaggagcuggacaaguucgacaaccucgacgcggaggccgacgagggcugggccggggcccagauggaggucgacuacaccgagcagcugaacuucuccgacgacgacgagcagggcagcaacucccccaaggagaacaacagcgaggaccagggguccaaggccagcgagaacaacgagaacaagaaggagacggacgagguguccaacaccaagagcuccagccagauccccgcgcagcccuccguggccaagguccccuacggcaagggccccagcuucaaccaggagcgcgggaccuccagccaccucccgcccccgcccaagcuccuggcccagcagcacccgccgcccgaccggcaggccgugcccggccgccccgggcccuuccccagcaagcagcaggucgcggacgaggacgagaucuggaagcagcggcgccggcagcaguccgagaucagcgccgccgucgagcgcgcccggaagcgccgggaggaggaggagcgccgcauggaggagcagcggaaggccgcgugcgccgagaagcugaagcgccucgacgagaagcugggcauccuggagaagcagcccucccccgaggagauccgggagcgcgagcgggagaaggagcgcgagcgggagaaggagcucgagaaggagcaggagcaggagcgcgagaaggagcgggagaaggaccgcgagcggcagcaggagaaggagaaggagcuggagaaggagcaggagaagcagcgcgagauggagaaggagcggaagcaggagaaggagaaggagcuggagcgccagaaggagaaggagaaggagcuccagaagaugaaggagcaggagaaggagugcgagcuggagaaggagcgggagaagcuggaggagaagaucgagccccgcgagcccaaccucgagcccaugguggagaagcaggagagcgagaacuccugcaacaaggaggaggagcccguguucacccggcaggacagcaaccgcuccgagaaggaggccacgcccgucgugcacgagaccgagcccgagagcgggucccagccccggcccgccgugcugagcggcuacuucaagcaguuccagaagucccugccgccccgcuuccagcgccagcaggagcagaugaagcagcagcaguggcagcagcagcagcagcagggcguccucccccagaccgugcccagccagcccuccagcuccaccgugccgcccccgccccaccggccccuguaccagcccaugcagccccacccccagcaccuggccagcaugggguucgacccccgcuggcucaugaugcaguccuacauggacccccggaugaugagcggccgccccgcgauggacaucccgcccauccaccccgggaugaucccgcccaagccccugaugcggcgcgaccagauggagggcagccccaacuccagcgaguccuucgagcacaucgcccggagcgcccgcgaccacgccaucucccugagcgagccccggaugcucuggggcuccgaccccuacccccacgccgagccccagcaggcgacgaccccgaaggccaccgaggagcccgaggacguccgcagcgaggccgcccuggaccaggagcagaucaccgcggccuacuccguggagcacaaccagcuggaggcccaccccaaggccgacuucauccgggagagcuccgaggcccagguccagaaguuccucagccgcuccguggaggacgugcggccccaccacacggacgcgaacaaccagagcgccugcuucgaggccccggaccagaagacccuguccgcgccccaggaggagcgcaucagcgccgucgagucccagcccagccggaagcgcuccgugagccacgggagcaaccacacccagaagcccgacgagcagcgguccgagcccagcgcgggcauccccaaggugaccucccgcugcaucgacagcaaggagcccaucgagcggcccgaggagaagccgaagaaggagggguucauccgcuccagcgagggccccaagcccgagaaggucuacaaguccaagagcgagacgcggugggggccccgcccguccagcaaccgccgggaggaggugaacgaccgccccgugcggcgcuccggccccaucaagaagcccguccugcgggacaugaaggaggagcgcgagcagcggaaggagaaggagggcgagaaggccgagaaggugaccgagaagguggucgugaagccggagaagaccgagaagaaggaccugccgccgccgccgccgccgccccagccgcccgcccccauccagccccagagcgugcccccgcccauccagcccgaggccgagaaguuccccuccaccgagacggccacccuggcgcagaagcccagccaggacaccgagaagccccuggagccggucuccaccguccagguggagcccgccgucaagacggugaaccagcagaccauggccgcccccguggucaaggaggagaagcagcccgagaaggugaucagcaaggaccuggugaucgagcgcccgcggcccgacucccgccccgcggucaagaaggagagcacccucccgccccggaccuacuggaaggaggcccgcgagcgggacugguuccccgaccagggguaccgcggccgggggcgcggcgaguacuacucccgggggcgcagcuaccggggcagcuacggcgggcgcggccgcgggggccgggggcacacccgcgacuacccccaguaccgggacaacaagccccgcgccgagcacauccccuccggcccccugcggcagcgcgaggagagcgagacgcgguccgagagcuccgacuucgagguggugcccaagcgccggcgccagcggggcagcgagaccgacaccgacuccgagauccacgagagcgccuccgacaaggacagccuguccaaggggaagcuccccaagcgcgaggagcggccggagaacaagaagcccgucaagccccacagcuccuucaagccggacaaccacgugcgcaucgacaaccggcugcuggagaagcccuacgugcgcgacgacgacaaggccaagcccggcuuccuccccaagggggagccgacccggcgcggccgcggcgggacguuccgccggggcgggcgcgaccccggcgggcgccccagccggcccuccacccugcgccggccggcguaccgcgacaaccaguggaacccccggcagagcgagguccccaagcccgaggacggggagccgccccgccggcacgagcaguucauccccaucgccgccgacaagcgcccgcccaaguucgagcggaaguucgaccccgcccgcgagcggccccgccggcagcgccccacccggccgccccgccaggacaagccgccccgguuccgccggcugcgcgagcgcgaggccgcguccaagagcaacgaggugguggccguccccaccaacggcacggugaacaacguggcccaggagcccgucaacacccucggggacaucuccggcaacaagacccccgaccugagcaaccagaacagcuccgaccaggccaacgaggagugggagaccgccagcgaguccagcgacuucaacgagcggcgcgagcgggacgagaagaagaacgcggaccugaacgcccagacgguggugaaggucggggagaacgugcucccgcccaagcgcgagaucgccaagcgguccuucagcucccagcgccccguggaccggcagaaccgccggggcaacaacgggccgcccaagagcggccgcaacuucuccggcccccggaacgagcgccggagcgggccgcccuccaagagcggcaagcgcgggcccuucgacgaccagcccgccggcaccaccggggucgaccugaucaacggcuccagcgcccaccaccaggagggcgugcccaacgggaccggccagaagaacuccaaggacagcacggggaagaagcgggaggaccccaagcccggccccaagaagcccaaggagaagguggacgcgcugucccaguucgaccucaacaacuacgccagcgucgugaucaucgacgaccaccccgaggugaccgucaucgaggacccgcaguccaaccugaacgacgacggguucaccgagguggugagcaagaagcagcagaagcgccugcaggacgaggagcggcgcaagaaggaggagcaggucauccagguguggaacaagaagaacgccaacgagaagggccggagccagaccuccaagcugccgccccgguucgccaagaagcaggcgacgggcauccagcaggcccagagcuccgccagcgugccgccccuggccuccgcgccccucccgcccagcaccuccgccagcgugcccgccuccaccagcgcgccccuccccgccacccugacgcccgugccggccuccaccagcgcgcccguccccgccuccacccuggcccccgugcucgccagcaccuccgccccggugcccgcgagcccccuggccccggucuccgccagcgccuccgugagcgcgagcgugcccgccuccacgagcgccgccgccaucaccuccagcuccgcgcccgccagcgcccccgccccgacccccauccuggccuccgucagcacccccgcguccgugacgauccucgccagcgccuccauccccauccuggccagcgcccuggcguccaccagcgccccgacccccgcccccgccgcguccagccccgccgccccggugaucaccgcccccacgauccccgccuccgcgcccaccgccagcgucccgcucgcccccgccagcgccuccgcgcccgcccccgccccgacccccgugagcgcccccaaccccgccccgcccgcgcccgcccagacccaggcccagacccacaagcccgugcagaacccgcugcagacgaccucccagagcuccaagcagccgccgcccagcauccggcugcccuccgcccagacccccaacgggaccgacuacgucgccagcggcaaguccauccagacgccccagagccacgggacccucaccgcggagcugugggacaacaagguggccccgcccgccgugcugaacgacaucuccaagaagcucggccccaucagcccgccccagccgcccuccgucagcgccuggaacaagccccugaccuccuucggcagcgcgcccuccagcgagggggccaagaacggccaggaguccgggcuggagaucggcacggacaccauccaguucggggcccccgccagcaacggcaacgagaacgagguggugcccguccucagcgagaaguccgccgacaagauccccgagcccaaggagcagcgccagaagcagccccgcgcgggccccaucaaggcccagaagcugcccgaccugagcccgguggagaacaaggagcacaagcccgggcccaucggcaaggagcggucccucaagaaccgcaaggugaaggacgcccagcaggucgagcccgaggggcaggagaagccgagccccgccaccgugcgguccaccgaccccgugacgaccaaggagaccaaggccgucagcgagauguccaccgagaucggcacgaugaucagcguguccagcgcggaguacgggaccaacgccaaggaguccgugaccgacuacaccacgccgagcuccagccugcccaacaccgucgccaccaacaacaccaagauggaggacacgcuggugaacaacgugccccuccccaacacccugccgcugcccaagcgcgagaccauccagcaguccagcucccucaccagcgugccgcccacgaccuucucccugaccuucaagauggagagcgcccggaaggccugggagaacagcccgaacgugcgcgagaagggcucccccgugaccagcacggcgccgcccaucgccaccggcgucuccagcuccgccagcgggccguccaccgccaacuacaacagcuucuccagcgcguccaugccccagauccccguggccagcgugacccccacggccucccugagcggcgccgggaccuacaccaccuccagccucuccaccaagagcacgaccaccuccgacccgcccaacaucugcaaggucaagccccagcagcugcagaccagcagccugcccuccgccagccacuucucccagcucagcugcaugccgucccugaucgcgcagcagcagcagaacccccagguguacgugagccaguccgccgccgcccagauccccgccuucuacauggacacgagccaccuguucaacacccagcacgcgcggcucgcgccgcccucccuggcccagcagcagggcuuccagcccgggcugagccagcccaccuccguccagcagauccccauccccaucuacgcgccccuccagggccagcaccaggcccagcugagccugggcgcggggcccgccgugucccaggcccaggagcuguucagcuccagccugcagccguaccgcucccagcccgccuucaugcagagcucccugagccagcccagcgugguccucuccggcaccgcgauccacaacuuccccacggugcagcaccaggagcuggccaaggcccagagcgggcuggccuuccagcagaccuccaacacccagccgauccccauccucuacgagcaccagcugggccaggccagcgggcugggcggcucccagcucaucgacacccaccuccugcaggcgcgggccaaccucacgcaggccagcaaccuguacuccggccaggugcagcagcccggccagaccaacuucuacaacaccgcccagagccccuccgcccugcagcaggucaccgugccgcuccccgcgagccagcugucccugcccaacuucgggagcacgggccagccccucaucgcccugccgcagacccugcagccgccccuccagcacaccacgccccaggcccaggcccagucccugagccgcccggcccaggugucccagcccuuccggggccugauccccgcggggacgcagcacagcaugaucgccaccaccggcaagauguccgagauggagcucaaggccuucgggagcggcaucgacaucaagcccgggaccccgcccaucgccggccgcuccacgacccccaccagcagccccuuccgggccaccuccacgagcccgaacucccagagcuccaagaugaacagcaucgucuaccagaagcaguuccaguccgcgcccgccaccgugcgcaugacccagcccuuccccacccaguucgccccgcaggccaagcagcgggcggagguccugcagagcacgcagcgcuucuucuccgagcagcagcagagcaagcagaucggcgggggcaaggcccagaagguggacuccgacagcuccaagccgcccgagacccugaccgacccgcccggggugugccaggagaaggucgaggagaagccgccgcccgcccccagcaucgccaccaagcccgugcggacgggccccaucaagccccaggccaucaagaccgaggagaccaaguccuga

SEQ ID NO: 35124 - RNA, 681 nt, Artificial Sequence
  derived and/or modified sequence opt1 from PRRG4__Homo_sapiens__NP_076986
auguucacccugcucgugcugcugagccagcuccccaccgucacgcugggcuucccgcacugcgcccgcgggcccaaggccuccaagcacgcgggcgaggagguguucaccagcaaggaggaggccaacuucuucauccaccggcgccugcucuacaaccgguucgaccuggagcuguucacccccgggaaccucgagcgcgagugcaacgaggagcugugcaacuacgaggaggcccgggagaucuucguggacgaggacaagaccaucgccuucuggcaggaguacuccgccaagggccccacgaccaagagcgacgggaaccgcgagaagaucgacgucaugggccugcucaccggccugaucgcggccgggguguuccuggugaucuucggccuccugggguacuaccugugcaucaccaagugcaaccggcuccagcacccgugcuccagcgccgucuacgagcgcggccggcacacgcccuccaucaucuuccgccggcccgaggaggccgcgcugagcccccugccgcccuccguggaggacgccgggcuccccagcuacgagcaggccguggcccugacccgcaagcacuccgucagcccgcccccgcccuaccccggccacaccaagggcuuccggguguucaagaaguccaugagccugcccucccacuga

SEQ ID NO: 35125 - RNA, 921 nt, Artificial Sequence
  derived and/or modified sequence opt1 from PRRT1__Homo_sapiens__NP_085154
augagcuccgagaagagcggccugcccgacuccgugccgcacaccagccccccccccuacaacgccccgcagccccccgccgagcccccggcgccccccccccaggccgccccguccagccaccaccaccaccaccaccacuaccaccaguccgggaccgccacgcucccccgccugggcgccgggggccuggcgagcuccgccgccaccgcccagcgggggcccagcuccagcgcgacccucccccgcccgccccaccacgccccccccggcccggccgccggcgcccccccccccgggugcgcgacccugccgcggaugccccccgaccccuaccugcaggagacgcgcuucgagggcccgcucccccccccgccccccgccgccgccgcccccccgccccccgcgcccgcccagaccgcccaggccccgggguucgucgugcccacccacgccggcaccguggggacgcugccccugggcggcuacgucgcgcccggguacccgcuccagcugcagcccugcaccgccuacgugcccguguaccccgucggcaccccguacgccgggggcacccccggcgggacgggcgugaccuccacccugccccccccgccccaggggcccggccucgcccugcuggagccccggcgcccgccccacgacuacaugcccaucgccgugcucaccacgaucugcugcuucuggccgaccgggaucaucgcgaucuucaaggccguccaggugcggaccgcccuggcccgcggcgacauggugagcgcggagaucgccucccgggaggcccgcaacuucagcuucaucucccuggccgucggcaucgccgcgauggugcucugcaccauccugacgguggucaucaucaucgccgcccagcaccacgagaacuacugggaccccuga

SEQ ID NO: 35126 - RNA, 900 nt, Artificial Sequence
  derived and/or modified sequence opt1 from PRRT2__Homo_sapiens__NP_001243372
auggccgccagcuccagcgagaucuccgagaugaagggcguggaggagagccccaaggucccgggggagggccccgggcacuccgaggcggagaccggccccccccaggugcuggccggggugccggaccagcccgaggccccccagcccggcccgaacaccacggccgcccccgucgacagcggccccaaggcggggcucgcccccgagaccaccgagaccccggccggcgccuccgagacggcgcaggccaccgaccugagccugucccccgggggcgagagcaaggccaacugcucccccgaggaccccugccaggagaccgugagcaagccggagguguccaaggaggccaccgccgaccaggggagccgccucgaguccgcggccccccccgagcccgccccggagcccgccccccagcccgacccgcggcccgacagccagcccacgcccaagccggcccugcagcccgagcugcccacccaggaggacccgacccccgagauccucuccgagagcgucggcgagaagcaggagaacggcgcgguggugccccugcaggccggggacggcgaggaggggcccgccccggagccccacuccccccccagcaagaagagcccgcccgccaacggcgcccccccccgcguccugcagcagcucguggaggaggaccggaugcgccgggcgcacuccggccacccggggagcccccgcggcucccugagccggcaccccuccagccagcuggccgggcccggcguggaggggggcgagggcacccagaagccgcgcgacuacaucauccucgccauccuguccugcuucugccccauguggcccgucaacaucguggccuucgccuacgcggugauggucagccccauggggccguga

SEQ ID NO: 35127 - RNA, 654 nt, Artificial Sequence
  derived and/or modified sequence opt1 from PRRX1__Homo_sapiens__NP_008833
augaccagcuccuacggccacgugcuggagcgccagcccgcccucgggggccggcuggacagcccggggaaccuggacacccuccaggccaagaagaacuucuccgucagccaccuccuggaccuggaggaggcgggcgacaugguggccgcccaggccgacgagaacgugggggaggccggccgcucccugcuggagagccccggccucacguccgggagcgacacgccccagcaggacaacgaccagcugaacuccgaggagaagaagaagcggaagcagcgccggaaccgcaccaccuucaacagcucccagcugcaggcgcucgagcgggucuucgagcgcacccacuaccccgacgccuucgugcgggaggaccuggcccgccgggugaaccugaccgaggcccgcguccaggugugguuccagaaccggcgcgcgaaguuccggcgcaacgagcgggccaugcucgccaacaagaacgccagccugcugaaguccuacagcggcgacgugaccgccgucgagcagccgaucgugccccgccccgcgccccggccgaccgacuaccucuccugggggacggccagccccuaccgcuccagcucccugccccggugcugccugcacgagggccuccacaacggguucuga

SEQ ID NO: 35128 - RNA, 762 nt, Artificial Sequence
  derived and/or modified sequence opt1 from PRRX2__Homo_sapiens__NP_057391
auggacagcgccgccgcggccuucgcccuggacaagcccgcccucggcccggggcccccgccgcccccgcccgcccugggccccggggacugcgcgcaggcccgcaagaacuucuccgugagccaccuccuggaccuggaggaggucgccgccgcgggccggcuggccgcccgccccggggcccgggccgaggcgcgcgagggcgccgcccgggagcccuccggcgggagcuccggcagcgaggccgcgccccaggacggggagugccccucccccggccgcgggagcgccgccaagcggaagaagaagcagcgccggaaccgcaccaccuucaacuccagccagcuccaggcccuggagcggguguucgagcgcacgcacuaccccgacgccuucgugcgggaggagcuggcccgccgggucaaccucuccgaggcgcgcguccaggugugguuccagaaccggcgcgccaaguuccggcgcaacgagcgggccaugcuggccagccgcuccgccagccugcucaaguccuacagccaggaggcggccaucgagcagcccguggcgccccgcccgaccgcccugucccccgacuaccugagcuggaccgccuccagccccuacagcaccgugcccccguacucccccggcagcuccggccccgccacgcccggggugaacauggccaacagcaucgccucccuccggcugaaggccaaggaguucagccugcaccacucccaggucccgaccgugaacuga

SEQ ID NO: 35129 - RNA, 2628 nt, Artificial Sequence
  derived and/or modified sequence opt1 from PRSS12__Homo_sapiens__NP_003610
augacccuggcccgcuucgugcucgcccugaugcugggcgcgcuccccgaggucgugggguucgacagcgugcugaacgacucccugcaccacagccaccggcacuccccgcccgccggcccccacuaccccuacuaccucccgacccagcagcgcccgccccggacgcggcccccgccgccccugccccgguucccccgcccgccccgggcccugcccgcccagcgcccccacgcccuccaggcggggcacacgccccggccccaccccuggggcugcccggccggggagcccugggucagcgugaccgacuucggcgcccccugccugcgcugggccgaggugcccccguuccuggagcgguccccgcccgcgagcugggcccagcuccgcggccagcggcacaacuucugccgcucccccgacggggccggccggcccuggugcuucuacggggacgcccgcggcaaggucgacuggggguacugcgacugccggcacggcagcgugcgccugcggggcgggaagaacgaguucgagggcaccguggaggucuacgccuccgggguguggggcaccgugugcagcucccacugggacgacagcgacgcguccgucaucugccaccagcugcagcucggcgggaagggcaucgccaagcagacccccuucagcgggcugggccugauccccaucuacugguccaacgugcgcugccgcggggacgaggagaacauccuccugugcgagaaggacaucuggcagggcggcgugugcccgcagaagauggccgccgccgugaccugcagcuucucccacgggcccaccuuccccaucauccgccuggcgggcgggagcuccguccacgagggccgcguggagcucuaccacgccgggcaguggggcacggucugcgacgaccagugggacgacgccgacgccgaggugaucugccggcagcugggccugagcgggaucgccaaggcguggcaccaggccuacuucggcgaggggagcggccccgugaugcucgacgagguccgcugcaccgggaacgagcuguccaucgagcagugccccaagagcuccuggggcgagcacaacugcggccacaaggaggacgccggggugagcugcacgccccugaccgacggcgugauccggcucgccgggggcaagggcucccacgaggggcgccuggaggucuacuaccggggccagugggggaccgugugcgacgacggcuggaccgagcugaacaccuacgucgugugccgccagcucggguucaaguacggcaagcaggccagcgcgaaccacuucgaggaguccaccggccccaucuggcuggacgacgugagcugcuccgggaaggagacgcgguuccugcagugcagccgccggcaguggggccgccacgacugcucccaccgggaggacgucagcaucgccugcuaccccgggggcgaggggcaccgccucucccugggcuucccggugcggcugauggacggcgagaacaagaaggaggggcgcguggaggucuucaucaacggccagugggggaccaucugcgacgacggcuggaccgacaaggacgccgccgugaucugccggcagcucggguacaagggccccgcgcgcgcccggaccauggccuacuucggcgaggggaagggccccauccacguggacaacgucaagugcacggggaacgagcgcagccuggccgacugcaucaagcaggacaucggccggcacaacugccgccacuccgaggacgccggggugaucugcgacuacuucggcaagaaggcgagcggcaacuccaacaaggagagccuguccagcgugugcgggcuccgccugcugcaccggcgccagaagcggaucaucggcgggaagaacagccuccgcggcggcuggcccuggcaggucucccugcggcucaagagcucccacggggacggccgccugcugugcggggccacccugcucagcuccugcugggugcugaccgccgcccacugcuucaagcgguacggcaacagcacccgcuccuacgccgugcgggucggggacuaccacacgcuggugccggaggaguucgaggaggagaucggcgugcagcagaucgucauccaccgcgaguaccggcccgaccgcagcgacuacgacaucgcgcuggugcggcuccagggccccgaggagcagugcgcccgcuucuccagccacgugcugcccgccugccugccgcucuggcgggagcgcccccagaagaccgccuccaacugcuacaucaccggguggggcgacaccgggcgggccuacagccgcacgcugcagcaggcggccaucccccugcuccccaagcgguucugcgaggagcgcuacaagggccgguucaccgggcgcaugcugugcgccggcaaccugcacgagcacaagcgcgucgacuccugccagggcgacagcgggggcccgcucaugugcgagcggcccggggaguccugggugguguacggcgucaccagcuggggguacggcugcggcgugaaggacucccccgggguguacaccaaggucagcgccuucgugcccuggaucaagagcgugacgaagcuguga

SEQ ID NO: 35130 - RNA, 1545 nt, Artificial Sequence
  derived and/or modified sequence opt1 from PRSS16__Homo_sapiens__NP_005856
auggccguguggcuggcccaguggcucggcccccugcugcucgucagccugugggggcugcucgcgccggccucccugcugcgccggcucggcgagcacauccagcaguuccaggagagcuccgcccaggggcugggccugagccucgggcccggcgccgccgcgcugcccaaggugggcuggcuggagcagcuccuggaccccuucaacguguccgaccgccggagcuuccugcagcgcuacugggucaacgaccagcacuggguggggcaggacggcccgaucuuccuccaccucgggggcgaggggucccugggccccggcagcgugaugcgggggcaccccgccgcccuggcccccgcguggggcgcccuggucaucucccuggagcaccgcuucuacgggcucagcaucccggccggcggccuggagauggcccagcugcgguuccucuccagccgccuggcccuggcggacgugguguccgcccggcucgcccugagccgccuguucaacaucuccagcuccagccccuggaucugcuucgggggcuccuacgccgggagccucgccgcgugggcccggcugaaguucccccaccugaucuucgccagcgucgccuccagcgcccccgugcgcgcggugcucgacuucuccgaguacaacgacgucgugagccggucccugaugagcaccgccaucggcgggucccuggagugccgcgccgccgugagcgucgccuucgcggagguggagcggcgccuccgguccggcggcgccgcccaggccgcgcugcgcaccgagcugagcgccugcgggccgcucggccgggccgagaaccaggccgagcugcugggggcccuccaggcgcuggugggcggggucgugcaguacgacggccagacgggcgcgccccuguccgugcgccagcucugcgggcugcugcugggcgggggcgggaaccggagccacuccacccccuacugcggccuccgccgcgccguccagaucgugcugcacagccugggccagaagugccucuccuucagccgggccgagaccguggcccagcugcgcuccaccgagccccagcugagcggggucggcgaccggcaguggcucuaccagacgugcaccgaguucggguucuacgugaccugcgagaacccgcgcugccccuucucccagcugcccgcccugcccagccagcucgaccugugcgagcaggucuucggccugagcgcccucuccguggcccaggccguggcccagaccaacagcuacuacggcgggcagacgccgggcgcgaacaagguccuguucgugaacggggacaccgaccccuggcacgugcuguccgucacccaggcccucggcagcuccgagagcacccugcugauccggacggggucccacugccucgacauggcccccgagcgccccagcgacuccccgagccugcggcugggccgccagaacaucuuccagcagcuccagaccuggcugaagcuggccaaggagucccagaucaagggcgagguguga

SEQ ID NO: 35131 - RNA, 744 nt, Artificial Sequence
  derived and/or modified sequence opt1 from PRSS1__Homo_sapiens__NP_002760
augaacccccugcucauccugaccuucguggccgccgcgcuggccgccccguucgacgacgacgacaagaucgucggcggguacaacugcgaggagaacagcgugcccuaccaggugucccucaacagcggcuaccacuucugcgggggcucccugaucaacgagcagugggucgugagcgccgggcacugcuacaagucccgcauccaggugcggcugggcgagcacaacaucgagguccucgagggcaacgagcaguucaucaacgccgcgaagaucauccgccacccccaguacgaccggaagacccugaacaacgacaucaugcugaucaagcucagcucccgcgccgugaucaacgcccgggugagcacgaucucccugcccaccgccccgcccgcgaccgggaccaagugccugaucagcggcugggggaacacggccuccagcggcgccgacuaccccgacgagcuccagugccuggacgcccccguccugucccaggccaagugcgaggcgagcuacccggggaagaucaccuccaacauguucugcgugggcuuccucgagggcgggaaggacagcugccagggcgacuccgggggccccguggucugcaacggccagcugcaggggguggugagcuggggcgacgggugcgcccagaagaacaagcccggcgucuacaccaagguguacaacuacgugaaguggaucaagaacaccaucgccgccaacuccuga

SEQ ID NO: 35132 - RNA, 678 nt, Artificial Sequence
  derived and/or modified sequence opt1 from PRSS21__Homo_sapiens__NP_001257381
augggcgcccgcggggcccugcuccuggcgcugcuccuggcccgggccggccugcgcaagcccgagagccaggaggccgccccgcucuccgggcccugcggccggcgcgugaucaccagccggaucgucgggggcgaggacgcggagcugggccgcuggcccuggcaggggucccugcggcucugggacagccacgugugcggcgugucccugcugagccaccgcugggcccucaccgccgcccacugcuucgagacggaccuguccgaccccagcggguggaugguccaguucggccagcugaccuccaugccgagcuucuggucccuccaggcguacuacacccgguacuucgugagcaacaucuaccugagcccccgcuaccuggggaacucccccuacgacaucgcccucgugaagcuguccgcccccgucaccuacacgaagcacauccagccgaucugccugcaggccagcaccuucgaguucgagaaccggaccgacugcugggugaccggcuggggcuacaucaaggaggacgagggguccagcggccgccaccacaagcagcucuacgugcagccgccccugccccagguccaguucccccaggggcaccuguggcggcacggccucugcuggcagugcccccgccgggagggcugccugcugcgcuga

SEQ ID NO: 35133 - RNA, 954 nt, Artificial Sequence
  derived and/or modified sequence opt1 from PRSS22__Homo_sapiens__NP_071402
augguggucagcggcgcgcccccggcccucgggggcgggugccugggcaccuucaccucccugcugcuccuggccagcacggccauccugaacgccgcccgcauccccgugccgcccgccugcgggaagccccagcagcucaaccggguggucggcggcgaggacuccaccgacagcgaguggcccuggaucguguccauccagaagaacgggacccaccacugcgcgggcagccugcugaccucccgcugggugaucacggccgcccacugcuucaaggacaaccucaacaagcccuaccuguucagcguccugcucggggccuggcagcugggcaaccccgggucccggagccagaaggugggcguggcgugggucgagccgcaccccguguacuccuggaaggagggcgccugcgccgacaucgcccuggugcgccucgagcggagcauccaguucuccgagcgcguccugcccaucugccugcccgacgccagcauccaccucccgcccaacacccacugcuggaucuccggguggggcagcauccaggacggggugccccugccccacccgcagacccugcagaagcucaaggugcccaucaucgacuccgaggucugcagccaccuguacuggcggggcgcgggccaggggcccaucaccgaggacaugcugugcgccggcuaccucgagggggagcgcgacgccugccugggcgacuccgggggcccccugaugugccagguggacggcgccuggcuccuggccgggaucaucagcuggggcgaggggugcgcggagcggaaccgcccgggcguguacaucagccuguccgcccaccggagcugggucgagaagaucgugcagggggugcagcuccgcggccgggcccagggcgggggcgcccugcgcgcccccucccaggggagcggcgcggccgcccgguccuga

SEQ ID NO: 35134 - RNA, 1299 nt, Artificial Sequence
  derived and/or modified sequence opt1 from PRSS23__Homo_sapiens__NP_001280107
augugcuccggcgccgggggcgugcgcgccgcgagcccccggccggaggccgggcgcgccggccugggguggcggggcggccgcacccggcagcuccccgcccugcuggccucccuccuggcgcuggggugcgccgccggccaggccugggagccccgcgcgcucucccggcgcccccaccugagcgagcggcgcuccgagccgcggcccgggcgcgccgcccggcgcggcaccguccuggggauggccggcauccccggccuccuguuccuccuguucuuccugcugugcgccgugggccaggugagccccuacuccgcgccguggaagcccacguggcccgccuaccggcuccccgucgugcugccgcagagcacccugaaccucgccaagcaguaccuguccuacgagacccuguacgccaacgggagccgcaccgagacccagguggggaucuacauccucuccagcuccggcgacggcgcccagcaccgggacagcggguccagcggcaagucccgccggaagcgccagaucuacggguacgacagccgguucuccaucuucggcaaggacuuccugcugaacuaccccuucagcacgagcgucaagcucuccaccgggugcaccggcacgcugguggcggagaagcacgugcugaccgccgcccacugcauccacgacggcaagaccuacgucaaggggacccagaagcuccgcgugggcuuccugaagcccaaguucaaggacgggggccgcggggccaacgacagcacguccgccaugcccgagcagaugaaguuccaguggauccgggugaagcgcacccacgucccgaagggcuggaucaagggcaacgcgaacgacaucgggauggacuacgacuacgcccugcucgagcugaagaagccccacaagcggaaguucaugaagaucggcgugagcccgcccgccaagcagcugcccgggggccgcauccacuucuccggguacgacaacgaccggcccggcaaccucguguaccgcuucugcgacgucaaggacgagaccuacgaccugcuguaccagcagugcgacgcccagcccggcgccagcggguccggcguguacgugcggauguggaagcgccagcagcagaagugggagcggaagaucaucgggaucuucagcggccaccagugggucgacaugaacggcagcccccaggacuucaacguggcggugcgcaucaccccgcucaaguacgcccagaucugcuacuggaucaaggggaacuaccuggacugccgggagggcuga

SEQ ID NO: 35135 - RNA, 873 nt, Artificial Sequence
  derived and/or modified sequence opt1 from PRSS27__Homo_sapiens__NP_114154
augcgccggcccgccgccgugccgcugcuccugcugcucugcuucggcagccagcgcgcgaaggccgccaccgccugcgggcggccccgcaugcugaaccggauggucggcgggcaggacacccaggagggcgaguggcccuggcaggucuccauccagcgcaacgggagccacuucugcggcggcucccugaucgccgagcagugggugcucacggcggcccacugcuuccggaacaccagcgagaccucccuguaccaggugcugcucggggcccgccagcuggugcagcccggcccgcacgccauguacgcgcgggugcgccaggucgagagcaacccccuguaccaggggaccgccuccagcgccgacguggcccucguggagcuggaggcccccguccccuucacgaacuacauccugccggugugccuccccgaccccuccgugaucuucgagaccggcaugaacugcugggucaccggguggggcagccccuccgaggaggaccugcugccggagccccggauccuccagaagcuggcggugcccaucaucgacacccccaagugcaaccugcucuacagcaaggacacggaguucggcuaccagccgaagaccaucaagaacgacaugcugugcgccggguucgaggagggcaagaaggacgccugcaagggggacuccggcggcccccuggugugccucgucgggcagagcuggcugcaggccggcgugaucuccuggggcgaggggugcgcccgccagaaccggcccgggguguacauccgcgucaccgcgcaccacaacuggauccaccggaucauccccaagcugcaguuccagccggcccgccucggcggccagaaguga

SEQ ID NO: 35136 - RNA, 744 nt, Artificial Sequence
  derived and/or modified sequence opt1 from PRSS2__Homo_sapiens__NP_002761
augaaccugcuccugauccugaccuucguggccgccgcggucgccgcccccuucgacgacgacgacaagaucgugggcggguacaucugcgaggagaacagcgugccguaccaggucucccucaacagcggcuaccacuucugcgggggcucccugaucagcgagcagugggugguguccgccgggcacugcuacaagagccgcauccagguccggcugggcgagcacaacaucgaggugcucgagggcaacgagcaguucaucaacgccgcgaagaucauccgccaccccaaguacaacucccggacccuggacaacgacauccugcucaucaagcugagcucccccgccgugaucaacagccgcgucuccgccaucagccugcccacggccccgcccgcggccgggaccgagucccucaucagcggcugggggaacacccuguccagcggcgccgacuaccccgacgagcugcagugccucgacgcccccgugcugucccaggccgagugcgaggcgagcuacccggggaagaucaccaacaacauguucugcgugggcuuccuggagggcgggaaggacuccugccagggcgacagcgggggccccgucgugagcaacggcgagcuccaggggaucguguccuggggcuacgggugcgcccagaagaaccggcccggcgucuacacgaagguguacaacuacguggacuggaucaaggacaccaucgccgccaacagcuga

SEQ ID NO: 35137 - RNA, 843 nt, Artificial Sequence
  derived and/or modified sequence opt1 from PRSS33__Homo_sapiens__NP_690851
augcgcggcgugagcugccugcagguccuccugcugcucgugcugggggccgccggcacccaggggcggaaguccgcggccugcggccagccccgcaugagcucccggaucgucgggggccgcgacggccgggacggggaguggccguggcaggccagcauccagcaccgcggcgcccacgugugcgggggcucccugaucgcgccccagugggugcucaccgccgcccacugcuucccccggcgcgcccugcccgccgaguaccgggugcgccugggggcgcuccggcugggcagcacguccccgcgcacccugagcguccccgugcggcgcgugcuccugccgcccgacuacuccgaggacggcgcccgcggggaccuggcccuccugcagcugcggcggcccgucccccucagcgcccgcgugcagcccgugugccugcccgucccgggcgcccggcccccgcccgggacccccugccgcgugaccggcuggggcucccugcggcccggggugccccuccccgaguggcgcccgcugcagggcguccgcgugccccugcucgacagccggacgugcgacgggcuguaccacgugggcgcggacgucccccaggccgagcgcaucgugcugcccgggucccucugcgccggcuacccgcagggccacaaggacgccugccagggggacagcggcgggccccugaccugccugcaguccggcagcugggugcucgucggggugguguccuggggcaagggcugcgcccugcccaaccggcccggggucuacaccagcguggcgaccuacuccccguggauccaggcccgcgucagcuucuga

SEQ ID NO: 35138 - RNA, 1242 nt, Artificial Sequence
  derived and/or modified sequence opt1 from PRSS35__Homo_sapiens__NP_001163894
auggagaacaugcugcucuggcugaucuucuucacccccggcuggacccugaucgacgggagcgagauggagugggacuucauguggcaccuccgcaaggugccgcggaucgucuccgagcgcacguuccaccugaccagccccgccuucgaggccgacgcgaagaugauggugaacaccgugugcggcaucgagugccagaaggagcugcccacccccucccucagcgagcuggaggacuaccuguccuacgagacggucuucgagaacgggacccggacccucacccgcgugaaggugcaggaccugguccuggagccgacgcagaacaucaccaccaagggcgugagcgugcggcgcaagcggcaggucuacgggaccgacucccgcuucagcauccucgacaagcgguuccugacgaacuuccccuucuccaccgccgugaagcugagcaccggcugcuccggcauccucaucagcccccagcacgugcugaccgccgcccacugcguccacgacgggaaggacuacgugaagggcuccaagaagcugcgcguggggcuccugaagaugcggaacaagagcggcgggaagaagcgccggggcuccaagcgcagccggcgcgaggccuccggcggggaccagcgggagggcacgcgcgagcaccuccgggagcgcgcgaagggcgggcggcgccgcaagaaguccggccgggggcagcgcaucgccgagggccggcccagcuuccaguggacccgcgucaagaacacccacaucccgaaggggugggcccggggcgggaugggcgacgccacccuggacuacgacuacgcgcugcuggagcucaagcgcgcccacaagaagaaguacauggagcugggcaucagccccacgaucaagaagaugcccgggggcaugauccacuucagcggguucgacaacgaccgggccgaccagcugguguaccgcuucugcuccgugagcgacgaguccaacgaccuccuguaccaguacugcgacgccgagagcggcuccaccgggagcggcgucuaccugcggcucaaggaccccgacaagaagaacuggaagcgcaagaucaucgccguguacuccggccaccaguggguggacguccacggggugcagaaggacuacaacguggcgguccggaucaccccgcugaaguacgcccagaucugccuguggauccacggcaacgacgccaacugcgccuacggguga

SEQ ID NO: 35139 - RNA, 786 nt, Artificial Sequence
  derived and/or modified sequence opt1 from PRSS3__Homo_sapiens__NP_001184026
augcacaugcgcgagaccagcggcuucacccugaagaaggggcgguccgcgccccucguguuccacccgcccgacgcccugaucgccguccccuucgacgacgacgacaagaucgugggcggguacacgugcgaggagaacagccugcccuaccaggugucccucaacagcggcucccacuucugcgggggcagccugaucuccgagcagugggucgugagcgccgcccacugcuacaagacccgcauccaggugcggcugggcgagcacaacaucaagguccucgaggggaacgagcaguucaucaacgccgccaagaucauccgccacccgaaguacaaccgggacacccuggacaacgacaucaugcugaucaagcucuccagccccgcggugaucaacgcccgcguguccaccaucagccugcccacggcgcccccggccgccggcaccgagugccugaucuccggguggggcaacacccucagcuucggggccgacuaccccgacgagcugaagugccuggacgcccccguccucacccaggccgagugcaaggccuccuaccccggcaagaucacgaacagcauguucugcgugggcuuccuggagggcgggaaggacuccugccagcgggacagcgggggcccgguggucugcaacggccagcugcagggggugguguccuggggccacgggugcgcguggaagaaccgccccggcgucuacaccaagguguacaacuacguggacuggaucaaggacaccaucgccgccaacagcuga

SEQ ID NO: 35140 - RNA, 1158 nt, Artificial Sequence
  derived and/or modified sequence opt1 from PRSS50__Homo_sapiens__NP_037402
augggccgcuggugccagaccguggcccgggggcagcgcccccggaccagcgccccgucccgcgcgggcgcccugcuccugcugcuccugcugcuccggagcgccgggugcuggggcgccggggaggcccccggcgcgcuguccacggccgaccccgccgaccagagcguccagugcgugcccaaggcgaccugcccguccagccgcccccggcugcucuggcagacccccaccacgcagacccugcccuccaccaccauggagacgcaguucccggugagcgagggcaaggucgaccccuaccgcuccugcggguucagcuacgagcaggaccccacccugcgggaccccgaggccguggcccgccgguggccguggaugguguccguccgcgccaacggcacccacaucugcgccgggaccaucaucgccagccagugggugcucacgguggcgcacugccugaucuggcgggacgucaucuacuccgugcgcgugggcagccccuggaucgaccagaugacccagaccgccuccgacguccccgugcuccaggugaucaugcacagccgguaccgcgcccagcgguucugguccugggucgggcaggccaacgacaucggccugcugaagcugaagcaggagcucaaguacagcaacuacgugcgccccaucugccugccgggcaccgacuacgugcugaaggaccacucccggugcacggucaccggguggggccucagcaaggccgacgggauguggccccaguuccgcaccauccaggagaaggaggugaucauccugaacaacaaggagugcgacaacuucuaccacaacuucaccaagauccccacgcuggugcagaucaucaagagccagaugaugugcgcggaggacacccaccgggagaaguucugcuacgagcucaccggcgagccccuggucugcuccauggagggcaccugguaccugguggggcucgugagcuggggcgccgggugccagaaguccgaggccccgcccaucuaccugcaggucagcuccuaccagcacuggaucugggacugccugaacggccaggcccucgcccugcccgcgcccagccgcacgcugcuccuggcccugccgcucccccugucccugcucgccgcccuguga

SEQ ID NO: 35141 - RNA, 1662 nt, Artificial Sequence
  derived and/or modified sequence opt1 from PRSS53__Homo_sapiens__NP_001034592
augaaguggugcuggggccccgugcugcucaucgccggggccaccgugcugauggagggccugcaggcggcccagcgcgccugcgggcagcggggcccggggccgcccaagccccaggagggcaacaccgugcccggcgaguggcccuggcaggccagcgugcgccggcagggggcccacaucugcuccggcagccucgucgcggacacgugggugcugaccgccgcccacugcuucgagaaggccgcggccaccgagcugaacuccuggagcgugguccucgggucccugcagcgcgagggccugagccccggggccgaggaggugggcguggccgcccuccagcugccccgggcguacaaccacuacucccagggcagcgaccuggcccuccugcagcuggcccacccgaccacgcacacgccccucugccugccccagcccgcccaccgcuucccguucggggccuccugcugggcgaccggcugggaccaggacaccagcgacgcccccgggacccugcggaaccuccgccugcggcugaucucccgcccgaccugcaacugcaucuacaaccagcuccaccagcggcaccugagcaaccccgcccgccccggcaugcugugcggcgggccccagcccggcguccaggggcccugccagggcgacuccgggggcccggugcucugccuggagcccgacggccacugggugcaggccgggaucaucagcuucgccuccagcugcgcgcaggaggacgcccccguccugcucaccaacaccgccgcccacuccagcuggcugcaggcccgggugcagggcgcggccuuccuggcccagucccccgagacgccggagaugagcgacgaggacagcugcguggccugcgggucccuccgcaccgcgggcccccaggccggggcccccagccccuggccgugggaggcccggcugaugcaccagggccagcuggccugcggcggggcgcucgucuccgaggaggccgugcugaccgccgcccacugcuucaucggccgccaggcccccgaggaguggagcguggggcugggcacccggcccgaggagugggggcucaagcagcugauccugcacggcgcguacacgcacccggagggcggguacgacauggcccuccugcugcucgcccagcccgucacccugggcgccucccugcgcccccucugccugcccuacccggaccaccaccuccccgacggggagcggggcugggugcugggccgcgcccggcccggggcgggcaucagcucccugcagaccgugcccgucacccugcuggggccgcgcgccugcagccgccuccacgccgcccccggcggggacggcucccccauccugcccggcauggugugcacgagcgcggugggggagcugccguccugcgagggccucagcggggcgccccugguccacgaggugcggggcaccugguuccuggccgggcuccacuccuucggcgacgccugccagggccccgcccgccccgccgucuucaccgcccugccggccuacgaggacugggugagcucccuggacuggcaggucuacuucgccgaggagcccgagcccgaggccgagcccgggagcugccucgcgaacaucucccagccgaccagcugcuga

SEQ ID NO: 35142 - RNA, 831 nt, Artificial Sequence
  derived and/or modified sequence opt1 from PRSS55__Homo_sapiens__NP_001183949
augcuccuguucagcgugcugcugcuccugucccuggucaccggcacccagcucgggccccgcacgccgcugcccgaggccggcguggccauccuggggcgggcgcgcggcgcccaccggccccagcccccgcacccgcccagccccguguccgagugcggggaccgcagcaucuucgagggccggacccgcuacucccggaucaccggcgggauggaggccgaggucggcgaguuccccuggcaggucagcauccaggcccgcuccgagcccuucugcgggggcagcauccucaacaagugguggauccugaccgccgcgcacugccuguacuccgaggagcuguuccccgaggagcugagcguggugcuggggacgaacgaccucaccucccccagcauggagaucaaggagguggccuccaucauccugcacaaggacuucaagcgggccaacauggacaacgacaucgcccugcuccugcuggcgagcccgaucaagcucgacgaccugaaggugcccaucugccugcccacccagcccggcccggccaccuggcgcgagugcugggucgccggcugggggcagacgaacgccgccgacaagaacuccgugaagaccgaccucaugaaggcgcccauggugaucauggacugggaggagugcagcaagauguuccccaagcugaccaagaacaugcugugcgccggcuacaagaacgaguccuacgacgccugcaagcagagcuacuuccccacccuccagcggaugaacacgggguccagccagaccaagccgcccggcagccacaccuuccaccuccagaacuga

SEQ ID NO: 35143 - RNA, 852 nt, Artificial Sequence
  derived and/or modified sequence opt1 from PRSS57__Homo_sapiens__NP_999875
augggccuggggcuccgcggcugggggcggccccugcugaccguggccaccgcccucaugcugcccgucaagccgcccgcgggcagcuggggcgcccagaucaucgggggccacgaggugacgccccacucccgccccuacauggccagcgugcgguucgggggccagcaccacugcgggggcuuccugcuccgcgcccggugggucguguccgccgcgcacugcuucagccaccgcgaccugcggaccgggcuggugguccucggcgcccacgugcuguccaccgccgagcccacccagcaggucuucggcaucgacgcccugacgacccaccccgacuaccaccccaugacccacgcgaacgacaucugccuccugcgccugaacgggagcgccgugcucggcccggccguggggcugcugcggcuccccggccgccgggcccgcccgcccaccgccggcacgcggugccgcguggcgggguggggcuucgucuccgacuucgaggagcugccgcccgggcugauggaggccaaggugcgggugcucgaccccgacgucugcaacagcuccuggaagggccaccugacccugaccaugcucugcacccgcagcggggacucccaccggcgcggcuucugcagcgccgacuccggcgggccccuggugugccggaaccgcgcccacggccuggugagcuucuccgggcucuggugcggcgaccccaagacgcccgacgucuacacccaggugagcgccuucguggcguggaucugggacgucgugcggcgcuccagcccccagcccgggccgcugcccggcaccacccgcccgcccggcgaggccgccuga

SEQ ID NO: 35144 - RNA, 726 nt, Artificial Sequence
  derived and/or modified sequence opt1 from PRSS58__Homo_sapiens__NP_001001317
augaaguucauccugcucugggcccugcugaaccucaccguggcccuggcguucaaccccgacuacaccgucagcuccacgccgcccuaccugguguaccucaagagcgacuaccugcccugcgccggcgugcugauccacccccucugggucaucaccgccgcccacugcaaccugccgaagcugcgcgugauccucggggugaccauccccgccgacuccaacgagaagcaccuccaggucaucggcuacgagaagaugauccaccacccccacuucagcgugaccuccaucgaccacgacaucaugcugaucaagcugaagacggaggcggagcugaacgacuacgugaagcuggccaaccuccccuaccagaccaucagcgagaacaccaugugcuccgucagcaccugguccuacaacgugugcgacaucuacaaggagccggacagccugcagacggugaacaucuccgucaucagcaagccccagugccgggacgccuacaagaccuacaacaucaccgagaacaugcugugcguggggaucgugcccggccgccggcagcccugcaaggaggucuccgccgcgccggccaucugcaacgggaugcuccagggcauccugagcuucgccgacggcugcgugcugcgcgccgacguggggaucuacgccaagaucuucuacuacauccccuggaucgagaacgucauccagaacaacuga

SEQ ID NO: 35145 - RNA, 1032 nt, Artificial Sequence
  derived and/or modified sequence opt1 from PRSS8__Homo_sapiens__NP_002764
auggcccagaagggcgugcuggggcccggccagcucggggccgucgcgauccugcuguaccucggccugcugcgcagcgggaccggcgccgagggcgccgaggccccgugcgggguggcgccccaggcccggaucaccggcggguccagcgccguggccggccaguggcccuggcaggucuccaucacguacgagggggugcacgugugcggcggcagccucgucuccgagcagugggugcugagcgccgcgcacugcuuccccuccgagcaccacaaggaggccuacgaggugaagcugggggcccaccagcucgacagcuacuccgaggacgccaaggucagcacccugaaggacaucaucccgcaccccuccuaccugcaggagggcagccagggggacaucgcccuccugcagcugucccgccccaucaccuucagccgguacauccgccccaucugccucccggcggccaacgccuccuuccccaacggccugcacugcaccgugacgggcugggggcacguggcccccagcgucucccugcucacccccaagccgcugcagcagcuggaggugccccucaucagccgggagaccugcaacugccuguacaacaucgacgccaagcccgaggagccccacuucgugcaggaggacauggucugcgcgggcuacguggagggcgggaaggacgccugccagggggacuccggcggcccgcugagcugccccguggaggggcucugguaccugaccggcaucgucagcuggggcgacgccugcggggcccgcaaccggcccgggguguacacgcuggccuccagcuacgcguccuggauccagagcaaggugaccgagcuccagccccgcgucgugccgcagacccaggagucccagcccgacagcaaccugugcggcucccaccuggccuucagcuccgcccccgcccagggccuccugcggcccauccuguuccucccgcuggggcuggcccucggccugcugagccccuggcucuccgagcacuga

SEQ ID NO: 35146 - RNA, 573 nt, Artificial Sequence
  derived and/or modified sequence opt1 from PRTFDC1__Homo_sapiens__NP_001269715
auggccggcagcuccgaggaggcccccgacuacgggcgcggcguggucaucauggacgacuggccgggguacgaccugaaccucuucaccuacccccagcacuacuacggcgaccuggaguacgugcugaucccccacgggaucaucguggaccggaucgagcgccucgcgaaggacaucaugaaggacaucggcuacagcgacaucaugguccugugcgugcugaagggcggguacaaguucugcgccgaccucguggagcaccugaagaacaucucccggaacagcgaccgcuucgucuccaugaagguggacuucauccggcucaagagcuaccgcaacgaccaguccaugggcgagaugcagaucaucgggggcgacgaccugagcacccuggccgggaagaacgugcugaucgucgaggacguggugggcacgggccggaccaugaaggcccuccuguccaacaucgagaaguacaagcccaacaugaucaaggucgccagccugcucgugaagcgcaccucccggagcgacggguuccgcccggacucccacaugcggcaccaguga

SEQ ID NO: 35147 - RNA, 3453 nt, Artificial Sequence
  derived and/or modified sequence opt1 from PRTG__Homo_sapiens__NP_776175
auggcccccccgcugcgcccccucgcccggcugcgcccccccggcaugcugcuccgggcgcugcugcuccugcugcuccugagcccgcugcccgggguguggugcuucuccgagcucagcuucgucaaggagccccaggacgugaccgugacccgcaaggaccccgucgugcuggacugccaggcccacggcgaggugccgaucaaggucacguggcugaagaacggggccaagauguccgagaacaagcggaucgaggugcucagcaacggcucccuguacaucagcgagguggaggggcgccggggcgagcaguccgacgagggcuucuaccagugccuggccaugaacaaguacggggccauccucagccagaaggcgcaccuggcccuguccaccaucagcgccuucgagguccagcccaucuccaccgaggugcacgagggcgggguggcccgcuucgcgugcaagaucagcucccacccccccgccgucaucaccugggaguucaaccggacgacccucccgaugaccauggaccgcaucaccgcccugcccacgggcgugcugcagaucuacgacgugagccagcgggacuccgggaacuaccgcugcaucgccgccaccgucgcgcaccggcgcaagagcauggaggccucccucaccgugauccccgccaaggagagcaaguccuuccacacccccacgaucaucgccggcccgcagaacaucaccaccagccugcaccagaccgugguccuggagugcauggccacgggcaaccccaagcccaucaucagcuggucccggcucgaccacaagagcaucgacguguucaacacccgcgugcuggggaacggcaaccugaugaucuccgacguccggcuccagcacgcggggguguacgugugccgcgccaccacccccggcacgcggaacuucaccgucgccauggccacccugaccgugcuggccccgcccagcuucgucgaguggcccgagucccucacgcgcccccgggcgggcaccgcccgcuucgugugccaggccgaggggaucccgagccccaagauguccuggcugaagaacggccgcaagauccacagcaacgggcggaucaagauguacaacuccaagcuggugaucaaccagaucauccccgaggacgacgccaucuaccagugcauggccgagaacagccagggcuccauccucagccgcgcgcggcugaccgucgugauguccgaggaccgccccagcgccccguacaacgugcacgccgagaccauguccagcuccgccauccugcucgcgugggagcggccccuguacaacagcgacaaggucaucgccuacuccgugcacuacaugaaggccgaggggcugaacaacgaggaguaccagguggucaucggcaacgacacgacccacuacaucaucgacgaccucgagcccgccagcaacuacaccuucuacaucguggccuacaugccgaugggcgcgagccagauguccgaccacgugacccagaacacgcuggaggacgucccccugcgcccccccgagaucagccucaccucccggagcccgaccgacauccugaucuccuggcugcccauccccgccaaguaccgccgggggcagguggugcucuaccgccugagcuuccggcuguccaccgagaacagcauccagguccuggagcuccccggcacgacccacgaguaccugcuggaggggcucaagccggacuccguguaccuggugcgcaucaccgccgccacccgggucggccugggggagagcuccguguggaccagccaccgcacgcccaaggccaccuccgugaaggcgcccaagagccccgagcuccaccuggagccgcugaacugcaccaccaucuccguccgguggcagcaggacguggaggacacggccgccauccagggcuacaagcucuacuacaaggaggagggccagcaggagaacgggcccaucuuccuggacaccaaggaccugcucuacacccugagcggccuggacccccgccggaaguaccacgugcgccuccuggccuacaacaacaucgacgacggguaccaggccgaccagaccgucuccacgcccggcugcgugagcgugcgggaccgcauggucccgcccccccccccgccccaccaccuguacgcgaaggccaacaccagcuccagcaucuuccuccacuggcgccggcccgccuucaccgccgcgcagaucaucaacuacaccauccgcugcaaccccguggggcugcagaacgccucccuggugcucuaccugcagacgagcgagacccacaugcugguccagggccucgagccgaacaccaaguacgaguucgccgugcggcugcacguggaccagcuguccagccccuggucccccgucguguaccacagcacccucccggaggcccccgccggcccccccgugggggucaaggugacgcugaucgaggacgacaccgcgcugguguccuggaagccgcccgacggccccgagaccgucgugacccgcuacacgauccucuacgccagccggaaggccuggaucgccggggaguggcaggugcugcaccgcgagggcgccaucaccauggcgcugcucgagaaccuggucgccggcaacguguacaucgugaagaucuccgccagcaacgaggucggggagggccccuucuccaacagcguggagcuggccgugcucccgaaggagaccuccgagagcaaccagcggcccaagcgccuggacuccgccgacgcgaaggucuacagcggguacuaccaccuggaccagaaguccaugaccggcaucgccgugggggugggcaucgcccucacgugcauccugaucugcguccugauccucaucuaccggagcaaggcccgcaagagcuccgcgagcaagaccgcccagaacggcacccagcagcugccccggaccuccgccagccuggccuccgggaacgaggugggcaagaaccucgagggggccgucggcaacgaggagagccugaugcccaugaucaugccgaacuccuucaucgacgcgaaggggggcacggaccugaucaucaacagcuacggccccaucaucaagaacaacuccaagaagaagugguucuucuuccaggacagcaagaagauccagguggagcagccccagcgccgguucacccccgccgugugcuucuaccagccggggaccaccguccucaucuccgacgaggacagccccuccagccccggccagacgaccuccuucagccgccccuucgggguggccgccgacaccgagcacuccgccaacagcgagggcucccacgagaccggggacagcggccgguucagccacgaguccaacgacgagauccaccugagcuccgugaucagcacgaccccgcccaaccuguga

SEQ ID NO: 35148 - RNA, 771 nt, Artificial Sequence
  derived and/or modified sequence opt1 from PRTN3__Homo_sapiens__NP_002768
auggcccaccggcccccgagccccgcccuggcguccgugcuccuggcccugcuccugagcggcgccgcccgcgccgcggagaucgucgggggccacgaggcccagccccacucccgccccuacauggccagccugcagaugcgggggaacccgggcucccacuucugcgggggcacccucauccaccccagcuucgugcugaccgccgcgcacugccugcgcgacaucccccagcggcucgugaacgucgugcugggcgcccacaacgugcgcacgcaggagcccacccagcagcacuucuccgucgcccagguguuccugaacaacuacgacgccgagaacaagcucaacgacgugcugcugauccagcucagcuccccggccaaccugagcgcguccgucgccaccgugcagcugccccagcaggaccagcccgugccccacgggacccagugccucgccaugggcugggggcgggucggcgcccacgacccgcccgcccaggugcugcaggagcugaacgugacggucgugaccuucuucugccgcccccacaacaucugcaccuucgugccccggcgcaaggcggggaucugcuucggcgacagcggcgggccgcucaucugcgacggcaucauccaggggaucgacuccuucgucaucuggggcugcgccacccggcuguuccccgacuucuucacgcgcguggcccuguacguggacuggauccggagcacccuccgccgggucgaggccaagggccgccccuga

SEQ ID NO: 35149 - RNA, 9267 nt, Artificial Sequence
  derived and/or modified sequence opt1 from PRUNE2__Homo_sapiens__NP_056040
auggaggaguuccugcagcgcgccaagagcaagcugaaccggagcaagcgccuggagaaggugcacguggugaucggccccaagagcugcgaccuggacucccucaucagcaccuucaccuacgccuacuuccuggacaagguguccccgcccgggguccugugccuccccgugcugaacaucccccggaccgaguucaacuacuucaccgagacccgcuucauccuggaggagcucaacaucagcgaguccuuccacaucuuccgggacgagaucaaccugcaccagcugaacgacgagggcaagcucagcaucacccuggugggguccagcguccuggccuccgaggacaagacccucgagagcgccguggugaaggucaucaaccccguggagcaguccgacgccaacguggaguuccgcgagagcuccagcucccugguccugaaggagauccuccaggaggcccccgagcugaucaccgagcagcuggcccaccggcuccgcggcagcauccuguucaaguggaugaccauggaguccgagaagaucagcgagaagcaggaggagauccugagcauccucgaggagaaguuccccaaccugccgccccgggaggacaucaucaacgugcugcaggagacccaguucuccgcgcaggggcucagcaucgagcagacgaugcugaaggaccugaaggagcucuccgacggcgagaucaagguggccaucagcaccgucuccaugaaccuggagaacugccuguuccacagcaacaucaccuccgaccucaaggccuucaccgacaaguucggcuucgacgugcugauccuguucagcuccuaccucagcgaggagcagcagccccgccggcagaucgccguguacuccgagaacauggagcugugcagccagaucugcugcgagcuggaggagugccagaaccccugccucgagcuggagcccuucgacugcgggugcgacgagauccuggucuaccagcaggaggaccccuccgugacgugcgaccaggugguccucguggugaaggaggucaucaaccgccggugccccgagauggugagcaacucccgcaccagcuccaccgaggcggucgccggcagcgcgccccugucccaggggagcagcggcaucauggagcuguacggguccgacaucgagccccagccgagcuccgugaacuucaucgagaacccgcccgaccucaacgacagcaaccaggcccagguggacgccaacgucgaccuggugucccccgacagcggccuggcgaccauccgguccagccgcuccagcaaggaguccagcguguuccucuccgacgacagcccggucggcgagggggccggcccccaccacacgcugcugcccgggcuggacuccuacagccccaucccggagggcgccguggccgaggagcacgccugguccggcgagcacggggagcacuucgaccucuucaacuucgaccccgcgcccauggccagcggccagagccagcaguccagccacuccgccgacuacagccccgccgacgacuucuucccgaacuccgaccugagcgaggggcagcugcccgccggccccgaggggcucgacggcaugggcaccaacauguccaacuacagcuccagcucccugcugagcggggcgggcaaggacucccucguggagcacgacgaggaguucguccagcggcaggacagcccgcgcgacaacuccgagcggaaccugagccugaccgacuucgugggggacgagucccccagccccgagcgccucaagaacaccggcaagcggaucccgcccacgcccaugaacucccugguggagagcagccccuccaccgaggagcccgccagccuguacaccgaggacaugacccagaaggccacggacaccgggcacaugggcccgccccagacccacgcccgcugcuccagcugguggggcgggcucgagaucgacuccaagaacaucgccgacgcguggagcuccagcgagcaggaguccgucuuccagagccccgaguccuggaaggagcacaagcccagcuccaucgaccgccgggccagcgacuccguguuccagcccaagucccuggaguucaccaaguccggccccugggagagcgaguucgggcagcccgagcugggcuccaacgacauccaggacaagaacgaggagagccuccccuuccagaaccugcccauggagaaguccccgcugcccaacacgagcccccaggggaccaaccaccucaucgaggacuucgccagccuguggcacuccggccgcagccccaccgccaugcccgagcccuggggcaaccccaccgacgacggggagccggcggccguggcccccuuccccgccugguccgccuucggcaaggaggaccacgacgaggcgcugaagaacacguggaaccuccacccgaccagcuccaagacccccagcguccgggaccccaacgagugggccauggccaaguccggguucgccuucagcuccagcgagcugcuggacaacucccccagcgagaucaacaacgaggccgcgccggagaucuggggcaagaagaacaacgacucccgcgaccacaucuucgcccccggcaaccccagcuccgaccucgaccacaccuggacgaacagcaagcccccgaaggaggaccagaacgggcugguggaccccaagacccggggcaagguguacgagaaggucgacuccuggaaccuguucgaggagaacaugaagaagggcgggagcgacgugcucgugcccugggaggacagcuuccuguccuacaagugcagcgacuacuccgccagcaaccugggggaggacuccguccccagcccgcucgacaccaacuacuccaccagcgacuccuacaccagccccacguucgccggcgacgagaaggagaccgagcacaagcccuucgccaaggaggagggcuucgaguccaaggacgggaacagcaccgcggaggagaccgacaucccgccccagucccugcagcagagcucccgcaaccggaucagcuccggccccgggaaccuggacaugugggccagcccccacacggacaacuccagcgagaucaacaccacccacaaccucgacgagaacgagcugaagaccgagcacacggacggcaagaacaucagcauggaggacgacgugggggaguccagccaguccagcuacgacgaccccuccaugaugcagcuguacaacgagaccaaccgccagcucacccugcugcacagcuccaccaacagccggcagacggccccggacucccucgaccuguggaaccgcgugauccuggaggacacccagagcaccgccaccaucuccgacauggacaacgaccucgacugggacgacugcagcggcggcgcggccauccccuccgacgggcagacggagggcuacauggccgaggggagcgagcccgagacccgguucaccguccgccagcuggagcccuggggccuggaguaccaggaggccaaccagguggacugggagcucccggccuccgacgagcacaccaaggacagcgcgcccuccgagcaccacacgcugaacgagaaguccgggcagcugaucgccaacagcaucugggacagcgugaugcgggacaaggacaugagcuccuucaugcuccccggcagcucccacaucaccgacagcgagcagcgcgagcugcccccggagauccccucccacagcgccaacgucaaggacacccacucccccgacgccccggccgcgagcggcaccuccgagagcgaggcccugaucucccaccucgacaagcaggacacggagcgggagacccugcagagcgacgccgccucccuggccacccgccucgagaaccccggguacuucccccaccccgacccguggaagggccacggggacggccagagcgaguccgagaaggaggcgcagggggccaccgaccggggccaccuggacgaggaggaggugaucgccagcggcguggagaacgccuccgggaucagcgagaagggccagagcgaccaggagcuguccagccucgucgcguccgagcaccaggagaucugcaucaagagcgggaagaucuccagccuggccgugacguucagcccccagaccgaggagcccgaggaggugcuggaguacgaggagggcagcuacaaccucgacucccgcgacguccagaccggcaugagcgccgacaaccugcagcccaaggacacccacgagaagcaccugaugucccagcggaacagcggggagacgaccgagaccuccgacggcaugaacuucaccaaguacgugagcgugccggagaaggaccucgagaagacggaggagugcaacuuccuggagcccgagaacgucgggggcgggccgccccaccgcgugccgcgcucccuggacuucggcgacgugcccaucgacagcgacguccacguguccuccacgugcuccgagaucaccaagaaccucgacgugaagggcagcgagaacagccugcccggggccggcuccagcgggaacuucgaccgggacaccaucuccagcgaguacacccacuccagcgccuccagccccgagcugaacgacuccagcgucgcgcucuccagcuggggccagcagccguccagcggguaccaggaggagaaccagggcaacugguccgagcagaaccaccaggagagcgagcugaucaccaccgacggccagguggagaucgugaccaaggucaaggaccuggagaagaaccgcaucaacgaguucgagaaguccuucgaccggaagacccccacguuccucgagaucuggaacgacagcguggacggggacuccuucagcagccuguccagccccgagaccggcaaguacuccgagcacagcgggacccaccaggaguccaaccugaucgccagcuaccaggagaagaacgagcacgacaucuccgccaccgugcagcccgaggacgcccgcgucaucagcacguccagcggcuccgacgacgacagcgucggcggggaggaguccaucgaggaggagauccagguggccaacugccacgucgcggaggacgagagccgggccugggacucccucaacgagagcaacaaguuccuggugaccgccgacccgaaguccgagaacaucuacgacuaccuggacagcuccgagcccgccgagaacgagaacaagagcaaccccuucugcgacaaccagcagagcucccccgacccguggaccuucagcccccucaccgagacggagaugcagaucaccgccgucgagaaggagaagcgcuccagccccgagaccgggaccacgggggacguggcguggcagaucucccccaaggccagcuucccgaagaacgaggacaacucccagcuggagaugcugggcuucagcgccgacuccaccgagugguggaaggccagcccccaggaggggcggcucaucgagucccccuucgagcgcgagcugagcgacuccagcggcgugcuggagaucaacuccagcguccaccagaacgccuccccguggggcgugcccgugcagggggacaucgagcccgucgagacccacuacaccaaccccuucagcgacaaccaccaguccccguuccucgagggcaacgggaagaacagccacgagcagcuguggaacauccagccccggcagcccgaccccgacgcggacaaguucagccagcuggugaagcucgaccagaucaaggagaaggacucccgcgagcagacguucgugagcgccgccggcgacgagcugaccccggagacccccacccaggagcagugccaggacacgaugcugcccgucugcgaccaccccgacaccgccuucacccacgcggaggagaacuccugcgugaccagcaacguguccacgaacgaggggcaggagaccaaccagugggagcaggagaaguccuaccucggcgagaugaccaacuccagcaucgccaccgagaacuucccggccgucuccagccccacgcagcugaucaugaagcccggcuccgagugggacgggagcacccccuccgaggacagccggggcaccuucgugccggacauccugcacgggaacuuccaggagggcgggcagcucgccuccgccgcgcccgaccuguggaucgacgccaagaagcccuucagccugaaggccgacggcgagaaccccgacauccugacccacugcgagcacgacuccaacagccaggccuccgacagcccggacaucugccacgacagcgaggccaagcaggagacggagaagcaccucuccgcgugcaugggccccgagguggagagcuccgagcugugccugaccgagcccgagaucgacgaggagcccaucuacgagccggggcgcgaguucguccccagcaacgccgagcucgacuccgagaacgccaccgugcugcccccgaucggcuaccaggccgacaucaaggggagcucccagcccgccagccacaagggcucccccgagcccagcgagaucaacggggacaacuccaccggccuccaggugagcgagaagggcgcguccccggacauggcccccauccucgagcccgucgaccggcgcaucccccggaucgagaacguggccaccagcaucuucgugacgcaccaggagccgacccccgagggggacggcuccuggaucagcgacuccuucagccccgagagccagcccggggcccgcgcgcuguucgacggcgacccgcaccuguccaccgagaaccccgcccucguccccgacgcccugcuggccagcgacacgugccucgacaucuccgaggccgcguucgaccacagcuucuccgacgccagcgggcugaacacguccaccggcaccaucgacgacaugagcaagcugacccucuccgagggccaccccgagacgccgguggacggggaccugggcaagcaggacaucugcagcuccgaggccagcuggggcgacuucgaguacgacgugaugggccagaacaucgacgaggaccugcuccgggagcccgagcacuuccuguacggcggggacccgccccuggaggaggacucccucaagcagagccuggccccguacacgccgcccuucgaccuguccuaccucaccgagcccgcccagagcgcggagaccaucgaggaggccggcuccccggaggacgagagccuggggugccgcgccgccgagaucguccuguccgcccuccccgaccggcgcagcgagggcaaccaggcggagacgaagaaccggcugcccgggagccagcuggccgugcuccacauccgcgaggaccccgaguccguguaccugccggucggcgccggcagcaacauccugucccccagcaacguggacugggagguggagaccgacaacuccgaccuccccgccgggggcgacaucgggccgcccaacggcgcgagcaaggagaucuccgagcuggaggaggagaagaccauccccaccaaggagcccgagcagaucaagagcgaguacaaggaggagcgcugcacggagaagaacgaggaccggcacgcccugcacauggacuacauccucgucaaccgcgaggagaacucccacagcaagccggagaccugcgaggagcgggaguccaucgccgagcuggagcuguacguggggagcaaggagaccggccuccagggcacccagcuggccuccuuccccgacacgugccagcccgccagccugaacgagcgcaaggggcucuccgcggagaagaugagcuccaagagcgacacccgguccagcuucgagagccccgcccaggaccaguccuggauguuccugggccacagcgaggugggggacccgucccuggacgcccgcgacagcggccccgggugguccggcaagaccgucgagcccuucagcgagcucggccugggggagggcccccagcugcagauccucgaggagaugaagccgcuggagucccuggcccucgaggaggccagcgggcccgugucccagagccagaaguccaagagccggggccgcgcggggcccgacgccgugacccugcaggccgucacgcacgacaacgagugggagaugcugagcccccagccggugcagaagaacaugauccccgacaccgagauggaggaggagaccgaguuccucgagcugggcacccggaucagccgccccaacggccugcucuccgaggacguggggauggacauccccuucgaggagggcguccugagcccguccgccgccgacaugcggcccgagccgcccaacagccuggaccucaacgacacgcacccccgccggaucaagcugaccgcgcccaacaucaaccugucccucgaccagagcgaggggagcauccuguccgacgacaaccuggacagccccgacgagaucgacaucaacguggacgagcucgacacccccgacgaggccgacuccuucgaguacaccggccacgacccgacggccaacaaggacagcggccaggaguccgagagcauccccgaguacaccgccgaggaggagcgcgaggacaaccggcuguggcgcaccguggucaucggggagcaggagcagcggaucgacaugaaggugaucgagcccuaccgccgggugaucucccacggcggguacuacggcgacgggcugaacgccaucaucgucuucgcggccugcuuccucccggacagcucccgcgccgacuaccacuacgugauggagaaccuguuccuguacgugaucagcacccucgagcugauggucgccgaggacuacaugaucguguaccugaacggcgcgacgccccgccggcgcaugcccggccucggguggaugaagaagugcuaccagaugaucgaccggcgccugcggaagaaccugaaguccuucaucaucgugcaccccagcugguucauccgcaccauccucgccgucacccggccguucaucuccagcaaguucuccagcaagaucaaguacgugaacucccugagcgagcuguccggccucauccccauggacugcauccacauccccgagagcaucaucaagcuggacgaggagcugcgcgaggccagcgaggccgccaagaccuccugccucuacaacgaccccgagaugagcuccauggagaaggacaucgaccugaagcugaaggagaagccguga

SEQ ID NO: 35150 - RNA, 816 nt, Artificial Sequence
  derived and/or modified sequence opt1 from PRUNE__Homo_sapiens__NP_001290158
auggaccugaagaucggcaaggccacccccaaggacagcaaguacguggagaagcucgaggcccuguucccggaccugcccaagcgcaacgacaucuucgacucccuccagaaggcgaaguucgacgucagcgggcugaccacggagcagaugcugcggaaggaccagaagaccaucuaccgccagggcgugaagguggccaucuccgccaucuacauggaccucgaggccuuccugcagcggagcaaccugcucgccgaccugcacgcguucugccaggcccacuccuacgacguccugguggccaugaccaucuucuucaacacccacaacgagcccgugcgccagcucgccaucuucugcccccacgucgcgcugcagacgaccaucugcgaggugcuggagcggagccacuccccgccccucaagcugacccccgccagcuccacccaccccaaccugcacgccuaccuccaggggaacacccaggugagccgcaagaagcugcugccgcuccugcaggaggcccuguccgccuacuucgacagcaugaagauccccuccggccagcccgagacggcggacgucagccgggagcaggucgacaaggagcucgaccgcgccuccaacagccugaucuccgggcugagccaggacgaggaggacccgccccucccgcccacccccaugaacucccugguggacgagugcccccuggaccagggccuccccaagcugagcgccgaggccguguucgagaagugcagccagaucucccugagccaguccaccacggccagccucuccaagaaguga

SEQ ID NO: 35151 - RNA, 444 nt, Artificial Sequence
  derived and/or modified sequence opt1 from PRX__Homo_sapiens__NP_066007
auggaggcccgcagccgguccgccgaggagcugcgccgggcggagcucguggagaucaucgucgagaccgaggcccagaccggcgugagcgggaucaacguggccggcgggggcaaggaggggaucuucguccgcgagcugcgggaggacucccccgccgcccgcagccugucccuccaggagggcgaccagcugcugagcgcgcggguguucuucgagaacuucaaguacgaggacgcccuccgccugcugcagugcgccgagccguacaagguguccuucugccucaagcggacgguccccaccggcgaccuggcccugcgccccgggaccgugagcggcuacgagaucaaggggccccgggcgaagguggccaagcucguccgcgugcuguccccggcccccgcccuggacugccccagcgaccccguguccgccccguga

SEQ ID NO: 35152 - RNA, 444 nt, Artificial Sequence
  derived and/or modified sequence opt1 from PRY__Homo_sapiens__XP_011529813
augggcgccaccgggcugggcuuccuccugagcuggcgccaggacaaccugaacgggaccgacugccagggcugcaacauccucuacuucuccgagacgaccgggagcaugugcuccgagcugagccugaaccggggccucgaggcccgccggaagaaggaccugaaggacuccuuccuguggcgcuacggcaagguggggugcaucagccucccccugcgggagaugaccgcguggaucaacccgccccagaucuccgagaucuuccagggcuaccaccagcgcguccacggggccgacgcccugagccuccagaccaacucccugcggagccgccuguccagccagugccucggccaguccuuccugcugcggacgcucgagcgcgggcggggcuuccgcgcccugggcgacaucugcgggcacgugcacgaggaggacuga

SEQ ID NO: 35153 - RNA, 1584 nt, Artificial Sequence
  derived and/or modified sequence opt1 from PSAP__Homo_sapiens__NP_001035930
auguacgcccuguuccuccuggccagccugcucggcgcggcccuggccgggcccgugcugggccucaaggagugcacccgcggguccgccgucuggugccagaacgugaagaccgccagcgacugcggcgcggugaagcacugccugcagacggucuggaacaagccgaccgugaagucccugcccugcgacaucugcaaggacguggucaccgccgccggggacaugcucaaggacaacgccaccgaggaggagauccugguguaccuggagaagacgugcgacuggcuccccaagcccaacaugagcgcguccugcaaggagaucguggacagcuaccugccggucauccuggacaucaucaagggcgagaugucccggcccggcgaggugugcagcgcccucaaccugugcgagucccugcagaagcaccucgccgagcugaaccaccagaagcagcuggagagcaacaagauccccgagcucgacaugaccgagguggucgcccccuucauggccaacaucccgcugcugcucuacccccaggacgggccccgcuccaagccccagccgaaggacaacggcgacgugugccaggacugcauccagauggugaccgacauccagaccgcgguccggacgaacagcaccuucgugcaggcccugguggagcacgucaaggaggagugcgaccgccuggggcccggcauggccgacaucugcaagaacuacaucucccaguacagcgagaucgccauccagaugaugaugcacaugcaggaccagcagcccaaggagaucugcgcccucgugggguucugcgacgaggugaaggagaugcccaugcagacccuggucccggcgaagguggccuccaagaacgugauccccgcccuggagcucgucgagcccaucaagaagcacgaggugcccgccaagagcgacgucuacugcgaggugugcgaguuccuggugaaggaggucaccaagcugaucgacaacaacaagacggagaaggagauccucgacgccuucgacaagaugugcuccaagcugcccaagagccuguccgaggagugccaggaggugguggacaccuacggcagcagcauccucuccauccugcuggaggaggucagcccggagcucgugugcuccaugcugcaccugugcagcggcacccggcuccccgcgcugaccgugcacgucacgcagcccaaggacgggggcuucugcgaggugugcaagaagcuggugggguaccucgaccgcaaccuggagaagaacuccaccaagcaggagauccuggccgcccucgagaagggcugcagcuuccugccggaccccuaccagaagcagugcgaccaguucgucgccgaguacgagcccgugcugaucgagauccugguggaggucauggaccccuccuucgugugccucaagaucggcgccugcccgagcgcgcacaagccccugcuggggaccgagaagugcaucuggggccccuccuacuggugccagaacaccgagacggccgcccagugcaacgccguggagcacugcaagcggcacgucuggaacuga

SEQ ID NO: 35154 - RNA, 975 nt, Artificial Sequence
  derived and/or modified sequence opt1 from PSAT1__Homo_sapiens__NP_066977
auggacgcgccccgccagguggucaacuucggcccggggcccgccaagcugccccacagcgugcuccuggagauccagaaggagcugcucgacuacaagggcguggggaucuccguccuggagaugagccaccgguccagcgacuucgccaagaucaucaacaacaccgagaaccuggugcgcgagcuccuggccgugcccgacaacuacaaggucaucuuccugcagggcgggggcugcggccaguucuccgccgugccgcucaaccugaucgggcugaaggccggccggugcgccgacuacguggucaccggggcguggagcgccaaggccgccgaggaggcgaagaaguucggcacgaucaacaucgugcaccccaagcucggguccuacaccaagauccccgaccccagcaccuggaaccugaacccggacgccuccuacguguacuacugcgccaacgagaccguccacggcguggaguucgacuucauccccgacgugaagggcgccguccuggugugcgacaugagcuccaacuuccucagcaagcccguggacgucuccaaguucggggugaucuucgccggcgcgcagaagaacguggggagcgccggcgucacgguggugaucguccgcgacgaccugcugggcuucgcccuccgggagugccccuccgugcuggaguacaagguccaggccgggaacagcucccuguacaacaccccgcccugcuucagcaucuacgugaugggccucgugcuggaguggaucaagaacaacgggggcgccgcggccauggagaagcuguccagcaucaagagccagaccaucuacgagaucaucgacaacucccagggguucuacgucagcgugggcggcauccgcgccucccucuacaacgccgugaccaucgaggacguccagaagcuggccgcguucaugaagaaguuccuggagaugcaccagcucuga

SEQ ID NO: 35155 - RNA, 345 nt, Artificial Sequence
  derived and/or modified sequence opt1 from PSCA__Homo_sapiens__NP_005663
auggccggccuggcccuccagcccgggaccgcgcugcugugcuacagcugcaaggcccagguguccaacgaggacugccuccaggucgagaacugcacccagcugggcgagcagugcuggaccgcccgcauccgggccguggggcugcucaccgugaucagcaagggcugcucccugaacugcgucgacgacagccaggacuacuacguggggaagaagaacaucacgugcugcgacaccgaccugugcaacgccuccggcgcgcacgcccuccagccggccgccgcgauccuggcccugcuccccgcccugggccugcuccugugggggcccggccagcuguga

SEQ ID NO: 35156 - RNA, 3144 nt, Artificial Sequence
  derived and/or modified sequence opt1 from PSD3__Homo_sapiens__NP_056125
auggagggccgcagcgccgccgcggagaccuucgugugggucaacaacgccuccgcccacagccaguccguggccaaggccaaguacgaguuccuguucgggcggagcgagggcaaggcgcccgacaccuccgaccacgggggcagcacgcuccugccgcccaacgugaccaacgaguuccccgaguacgggaccauggaggagggcggcgaggggcugcgcgccucccucgaguucgacggcgaggcccugcccugccacccgcaggagcagcaggggguccagccccugaccggcugccacagcgggcucgacuccgugacggagggccccaaggacgugcgggaggcccccagccagucccaccugaaggagcagagccugcagccgaucgacucccucaucagcgcgcugaaggccaccgaggcccgcaucaucuccggcacccugcaggccaccaagguccucgaccaggacgccgugagcuccuucagcgugcagcaggucgagaaggagcuggacacggcgucccggaagacccagcgcgugaacaagacccugcccgccgggcagaagaaccuccccgagaucccccugagcgccgaggugaccacggaggagagcuucuaccuguccauccagaaggaccucaccgcccugcugaccggcgacacccaggccgagaucagccagaucaugaacaacgggcggaagggcgcggucugcgugcaggagccguccugcccccucgccagccugggcuccagcgccgugacgugccacuccgccgggagcgucggcuuccugaaggagcagcgcuccgcccucgggcgggagcaccccggcgggugcgaccgcagcuccagcaugggccggcccggccgcgugaagcacguggaguuccagggggucgagauccuguggaccggcggggacaagcgggagacccagcacccgaucgacuucgagaccucccugcagcgcacggcgagccccgacuccaaggagagcuccaaggugccccggcaccucaucagcuccgccggccugugcaacagcagcucccugaccgagaacgugugggacgagagcuggaaggcccccuccgagcgcccggggaccagcuccggcaccuucagccccguccggcucgacgaguccggcgaggacgagguguuccugcaggagaacaagcagcaccuggagaagacgcccaagcccgagcgcgaccgggagcgcaucagcgagcaggaggagcacgugaagggggaggacgaggacauccucggcccgggguacaccgaggacuccaccgacgucuacagcucccaguucgagaccauccuggacaacacgagccuguacuacuccgccgagagccucgagacccuguacuccgagcccgacagcuacuucuccuucgagaugccccugacccccaugauccagcagcggaucaaggagggcgggcaguuccucgagcgcaccagcggcggcgggcaccaggacauccugagcguguccgccgacggcgggaucgucaugggcuacagcuccggcgugacgaacgggcugaacgacgcgagcgacuccaucuacaccaagggcaccccggagaucgccuucugggggagcaacgccggcgugaagaccacgcgccucgaggcccacuccgagauggggagcaccgagauccuggagaaggagacccccgagaaccuguccaacggcaccagcuccaacgucgaggcggccaagcggcucgccaagcgccuguaccagcuggaccgguucaagcgcagcgacguggccaagcaccucggcaagaacaacgaguucuccaagcugguggccgaggaguaccugaaguucuucgacuucaccgggaugacgcuggaccagagccuccgguacuucuucaaggcguucucccuggucggcgagacccaggagcgcgagcgggugcugauccacuucagcaaccgcuacuucuacugcaaccccgacaccaucgccucccaggacggggugcacugccugaccugcgccaucaugcuccugaacacggaccuccacggccacaacaucgggaagaagaugaccugccaggaguucaucgccaaccugcagggcgucaacgagggcguggacuucagcaaggaccugcucaaggcccuguacaacuccaucaagaacgagaagcuggagugggcgguggacgacgaggagaagaagaaguccccgagcgagagcaccgaggagaaggccaacgggacccaccccaagacgaucagccggaucggcuccaccaccaaccccuuccucgacaucccccacgacccgaacgccgccgucuacaagagcggguuccuggcccgcaagauccacgcggacauggacggcaagaagacgccccgggggaagcgcggcuggaagaccuucuacgccgugcugaagggcaccgugcucuaccugcagaaggacgaguacaagcccgagaaggcccuguccgaggaggaccucaagaacgccgucagcgugcaccacgcgcuggccuccaaggccaccgacuacgagaagaagcccaacguguucaagcugaagaccgccgacuggcggguccuccuguuccagacgcagagcccggaggagaugcagggguggaucaacaagaucaacugcguggccgcgguguucuccgccccgcccuuccccgccgccaucggcagccagaagaaguucucccgcccccugcuccccgccaccaccaccaagcugagccaggaggagcagcugaagucccacgagagcaagcucaagcagaucacgaccgagcuggcggagcaccgguccuacccgcccgacaagaaggucaaggccaaggacguggacgaguacaagcugaaggaccacuaccucgaguucgagaagacccgcuacgagauguacgugagcauccugaaggagggcgggaaggagcugcucuccaacgacgagagcgaggccgccgggcugaagaagucccacagcagccccucccugaaccccgacaccagccccaucacggccaaggucaagcggaacguguccgagcgcaaggaccaccggcccgagaccccgagcaucaagcagaaggugaccuga

SEQ ID NO: 35157 - RNA, 3171 nt, Artificial Sequence
  derived and/or modified sequence opt1 from PSD4__Homo_sapiens__NP_036587
augaugggcgacuaccgccugcccgaccacccgcagcccauggagauccucaaccuguaccugggggacagccucgagccccaccccggcgagugcccgcgggagaccugcucccacgaggacccgcccgagcccuucgaggagcagaccugggccacggacccgcccgagcccacccgccagaacgugcccccgugggggagcggcgucgagcugacccaccugggguccugggugcaccaggacggccucgagcccugccaggagcagacccgggccacggacccgcccgagagcacccgccaggacgcgccgcccuggggcuccgggguggagcugacccaccugggcagccccuccgcccagcgggagcaccgccagaacaccgccagccccggguccccggucaacagccaccuccccggcucccccaagcagaaccggagcacguccacccaggugguguucugggccgggauccugcaggcccagaugugcguccuggaccucgaggaggagcuggagaagaccgagggccugaaggcgggccucaagugcugccugcccaccccgcccguggaccugcccggggacacgggccuccacagcuccccgcccgagaacgaggacagcggggaggacuccagcgagcccgagggcgagggccaggccuggcugcgcgaggggacccccgacuccagcccccaguggggcgccgaggaggagagcauguucuucuccaacccccuguuccucgccagccccugcuccgagaacagcgcguccggggagugcuucagcuggggcgccuccgacagccacgccggggugcggaccggccccgaguccccggccacccuggagccgccccugcccgaggacacgguccucugggagcuggagagcgagcccgaccugggcgacggggccgcgaucuccggccacugcaccccgcccuuccccgugcccaucuacaagccccacagcaucugcugggccuccguggccgccgccgagggggcgcccgccgccccgcccggccacggggagagcgagggcgaccgccucggccccgcccccuccgccgcgcccugcgucgacgaggcccugaccugggagagcgggugcgugggcuccgaccuggggcccgccgcccaccccgugcagcccugggccagccucucccccgagggcuggcagcgcgggggcccguucuggccccaggucacccugaacagccaggaccgggacgagcgggagggcgggcacccccaggagagccugccgugcacgcucgcgcccugccccuggcgcucccccgccagcuccccggagcccagcucccccgagagcgagucccggggccccgggccgcgccccagccccgccuccagccaggagggcagcccccagcugcagcaccacuccuccggcauccugccgaaguggacccucgacgccagccaguccagccugcuggagaccgacggggagcagcccuccagccucaagaagaaggaggcgggcgaggcccccaagcccggggaggaggucaagagcgagggcaccgcccggccggccgagacgggggacgugcagcccgacauccaccugaccuccgccgagcacgagaaccugcgcacccccaugaacagcuccuggcuccccggcagcccgaugccccaggcgcagucccccgaggagggccagcggcccccggccggggacaagcuggccaacggcgugcgcaacaacaagguggccuggaaccuggccagccggcucuaccgccuggagggguuccgcaaguccgagguggcggccuaccugcagaagaacaacgacuucagccgggccgucgccgaggaguaccucuccuucuuccaguucggcgggcagagccuggaccgcgcccugcgguccuuccugcaggcgcucgugcugagcggcgagacccaggagcgcgagcggauccuguaccaguucucccgccgguuccaccacugcaaccccggcaucuuccccagcguggacuccguccacacgcugaccugcgccaucaugcuccugaacaccgaccuccacgggcagaacaucggcaagagcauguccugccaggaguucaucaccaaccugaacgggcugcgcgacggcgggaacuuccccaaggagcuccugaaggcccuguacuggagcauccgguccgagaagcucgagugggccguggacgaggaggacacggcgcgcccggagaaggcccagcccagccugcccgccggcaagaugagcaagccguuccugcagcucgcccaggaccccaccguccccaccuacaagcagggcauccuggcccggaagaugcaccaggacgcggacgggaagaagacccccuggggcaagcgcggguggaagauguuccacacgcugcuccggggcauggugcuguacuuccugaagcagggggaggaccacugccucgagggcgagucccuggugggccagauggucgacgagccggugggggugcaccacagccuggccacccccgccacccacuacaccaagaagccccacgucuuccagcuccgcaccgccgacuggcggcuguaccuguuccaggcccccacggcgaaggagauguccagcuggaucgcccgcaucaaccucgccgccgccacccacuccgcgccgcccuuccccgccgccgugggcagccagcggcgcuucgugcggcccauccugccggucgggcccgcccaguccagccuggaggagcagcaccgcucccacgagaacugccucgacgcggccgccgacgaccugcuggaccuccagcgcaaccugcccgagcggcgcggccggggccgcgagcuggaggagcaccggcuccgcaaggaguaccuggaguacgagaagacccgguacgagaccuacgugcagcugcucguggcccgccugcacugccccagcgacgcccuggaccucugggaggagcagcuggggcgggaggcgggcgggacgcgcgagccgaagcugucccucaagaagucccacagcagccccucccugcaccaggacgaggcccccaccaccgccaaggucaagcggaacaucagcgagcgccggaccuaccgcaagaucauccccaagcggaaccgcaaccagcuguga

SEQ ID NO: 35158 - RNA, 3075 nt, Artificial Sequence
  derived and/or modified sequence opt1 from PSD__Homo_sapiens__NP_002770
auggcccagggcgccaugcgcuucugcagcgagggggacugcgcgaucucccccccgcggugcccccgccgguggcugcccgagggccccgugccgcagagcccccccgccuccauguacgggagcaccggcucccuccugcgccgggucgccgggcccggcccgcgcggccgggagcuggggcgcgugaccgcccccugcacgccccuccggggccccccgagcccccgcguggcccccucccccugggcgccgagcucccccaccgggcagccccccccgggcgcccagagcuccgucgugaucuuccgguucguggagaaggccagcguccgcccccugaacgggcugcccgcccccggcggccucucccggagcugggaccuggggggcguguccccgccccgccccacccccgcgcuggggccgggcagcaaccggaagcuccgccuggaggccuccaccagcgacccccugcccgcccggggcggguccgcccucccgggcagccgcaaccuggugcacgggccccccgcccccccgcaggucggcgcggacgggcuguacagcucccuccccaacggccugggcgggccccccgagcggcuggccacgcucuucggcgggccggccgacaccggcuuccugaaccagggggacaccuggagcuccccccgcgaggugagcucccacgcccagcggaucgcccgcgcgaagugggaguucuucuacggcagccuggacccccccuccagcggcgccaagccgcccgagcaggccccccccuccccgcccggggugggcagccgccagggguccggcgucgccguggggcgggccgcgaaguacagcgagaccgaccucgacacggugccccugcgcugcuaccgggagaccgacaucgacgagguccuggccgagcgcgaggaggccgacuccgccaucgagagccagcccuccagcgagggcccgcccggcaccgccuacccccccgcgccgcggcccgggccccucccgggcccccaccccucccuggggagcggcaacgaggacgaggacgacgacgaggccggcggggaggaggacguggacgacgagguguucgaggccuccgagggcgcccgccccgggagccggaugccgcugaagagccccguccccuuccuccccggcaccuccccgagcgcggacgggcccgacuccuucagcugcguguucgaggccauccuggagucccaccgcgccaagggcacgagcuacaccucccuggccagccucgaggcccuggcgucccccggccccacccagagcccguucuucaccuucgagcugcccccccagcccccggccccccggcccgaccccccggcccccgccccccucgccccccuggagccggacuccgggacgagcuccgcggccgacggccccuggacccagcgcggggaggaggaggaggccgaggcccgggccaagcuggcgcccggccgcgagcccccgagccccugccacuccgaggacagccucgggcugggcgccgccccccugggcuccgagccgccccucagccagcuggugagcgacuccgacagcgagcuggacuccaccgagcggcucgcccuggggagcaccgacacgcuguccaacggccagaaggcggaccucgaggccgcccagcgccuggccaagcggcuguaccgccucgacggguuccggaaggccgacgucgcgcgccaccugggcaagaacaacgacuucagcaagcugguggccggggaguaccugaaguucuucguguucaccggcaugacccucgaccaggcccugcgggucuuccugaaggagcucgcccugaugggcgagacccaggagcgcgagcgcgugcuggcccacuucucccagcgguacuuccagugcaaccccgaggcgcucagcuccgaggacggggcccacacgcugaccugcgcccugaugcuccugaacaccgaccugcacggccacaacaucgggaagcgcaugaccugcggcgacuucaucgggaaccucgagggccugaacgacggcggggacuucccccgggagcugcucaaggcccuguacagcuccaucaagaacgagaagcugcagugggccaucgacgaggaggagcuccgccggagccuguccgagcuggcggacccgaaccccaaggucaucaagcgcaucagcggcggguccggcagcggcuccagccccuuccucgaccugacgcccgagccgggggccgccguguacaagcacggcgcccuggugcggaagguccacgcggaccccgacugccgcaagaccccccgggggaagcgcggcuggaaguccuuccacgggauccucaagggcaugauccuguaccugcagaaggaggaguacaagcccggcaaggcccucagcgagaccgagcugaagaacgccaucagcauccaccacgcccuggccacccgggcguccgacuacagcaagcgcccgcacguguucuaccuccggacggccgacuggcgcguguuccuguuccaggcccccucccuggagcagaugcagagcuggaucacccggaucaacgucguggccgccauguucuccgcgccccccuucccggccgccgugagcucccagaagaaguucagccgcccccuccugcccuccgccgccacccggcugagccaggaggagcagguccgcacccacgaggcgaagcucaaggccauggccuccgagcugcgggagcaccgcgccgcccagcuggggaagaagggccgggggaaggaggcggaggagcagcgccagaaggaggccuaccucgaguucgagaagagccgcuacuccacguacgccgcccugcugcgggugaagcucaaggcgggcagcgaggagcuggacgccguggaggccgcccuggcccaggcgggguccaccgaggacggccuccccccgagccacuccagccccucccugcagcccaagcccagcagccagccgcgcgcccagcggcacuccagcgagccccgccccggcgccggguccggccggcgcaagcccuga

SEQ ID NO: 35159 - RNA, 1404 nt, Artificial Sequence
  derived and/or modified sequence opt1 from PSEN1__Homo_sapiens__XP_011535274
augaccgagcugcccgccccgcucagcuacuuccagaacgcccagauguccgaggacaaccaccugagcaacaccgugcgcucccagaacgacaaccgggagcgccaggagcacaacgaccggcgcagccugggccaccccgagccccucuccaacgggcggccccagggcaacagccgccaggucguggagcaggacgaggaggaggacgaggagcugacgcugaaguacggggcgaagcacgugaucaugcuguucgucccggugacccugugcaugguggucgugguggccaccaucaaguccgucagcuucuacacccggaaggacggccagcugaucuacacgcccuucaccgaggacaccgagaccguggggcagcgcgcccuccacuccauccugaacgccgccaucaugaucagcgugaucgucgugaugacgauccugcucgugguccuguacaaguaccggugcuacaaggugauccacgcguggcugaucaucuccagccuccugcuccucuucuucuucuccuucaucuaccugggcgagguguucaagaccuacaacgucgccguggacuacaucaccguggcccugcucaucuggaacuucggcgucguggggaugaucagcauccacuggaagggcccccugcgccugcagcaggccuaccucaucaugaucuccgcgcugauggcccugguguucaucaaguaccuccccgaguggaccgccuggcugauccuggccgucaucagcguguacgaccucgucgccgugcugugcccgaaggggccccugcggaugcucguggagacggcgcaggagcgcaacgagacccuguuccccgcccugaucuacuccagcaccauggucuggcucgugaacauggccgagggcgaccccgaggcccagcggcgcguguccaagaacagcaaguacaacgccgagagcaccgagcgggagucccaggacacggucgcggagaacgacgacgggggcuucagcgaggagugggaggcccagcgcgacucccaccugggcccgcaccggagcacccccgagucccgcgccgccgugcaggagcugagcuccagcauccucgccggggaggaccccgaggagcggggcgugaagcuggggcugggcgacuucaucuucuacuccguccucgugggcaaggcgagcgccaccgccuccggggacuggaacaccacgaucgccugcuucguggccauccugaucggccugugccucacccugcugcuccuggcgaucuucaagaaggcccugcccgcccugccgaucagcaucaccuucgggcucgucuucuacuucgccaccgacuaccuggugcagcccuucauggaccagcuggcguuccaccaguucuacaucuga

SEQ ID NO: 35160 - RNA, 1344 nt, Artificial Sequence
  derived and/or modified sequence opt1 from PSEN2__Homo_sapiens__NP_036618
augcugaccuucauggccagcgacuccgaggaggaggugugcgacgagcgcaccagccucauguccgccgagagccccacgccgcgguccugccaggagggccgccaggggcccgaggacggcgagaacaccgcgcaguggcggagccaggagaacgaggaggacggggaggaggaccccgaccgcuacgucugcuccggcgugcccgggcggccgcccggccuggaggaggagcugacccucaaguacggcgccaagcacgugaucaugcuguucguccccgugacccugugcaugaucguggucguggccacgaucaagagcgugcgcuucuacaccgagaagaacgggcagcucaucuacacccccuucaccgaggacacgccguccgucggccagcggcugcugaacagcgugcucaacacccugaucaugaucuccgugaucgucgugaugaccaucuuccuggugguccucuacaaguaccgcugcuacaaguucauccacggguggcugaucaugagcucccugaugcuccuguuccuguucaccuacaucuaccucggcgaggugcugaagacguacaacguggccauggacuaccccacccugcuccugaccgucuggaacuucggggccgugggcauggugugcauccacuggaagggcccccugguccuccagcaggcguaccugaucaugaucagcgcccugauggcccucguguucaucaaguaccugcccgagugguccgccugggugauccugggggcgaucagcgucuacgaccucguggccguccugugcccgaagggcccccugcggaugcucguggagaccgcccaggagcgcaacgagcccaucuuccccgcccugaucuacuccagcgccaugguguggacggucgggauggcgaagcuggacccguccagccagggcgcccuccagcugcccuacgaccccgagauggaggacagcuacgacuccuucggcgagcccagcuacccggagguguucgagccgccccugaccggguaccccggcgaggagcucgaggaggaggaggagcgcggggugaagcugggccugggggacuucaucuucuacuccguccucgugggcaaggccgccgccaccggcagcggggacuggaacaccacgcuggcgugcuucguggccauccugaucggccucugccugacccugcuccugcuggccgucuucaagaaggcccugcccgcccuccccaucuccaucaccuucgggcugaucuucuacuucagcaccgacaaccuggugcggcccuucauggacacgcucgcgucccaccagcuguacaucuga

SEQ ID NO: 35161 - RNA, 306 nt, Artificial Sequence
  derived and/or modified sequence opt1 from PSENEN__Homo_sapiens__NP_001268461
augaaccuggagcgcgugagcaacgaggagaagcucaaccugugccggaaguacuaccugggcggguucgccuuccuccccuuccuguggcuggucaacaucuucugguucuuccgcgaggccuuccucgugccggcguacaccgagcagucccagaucaagggcuacguguggcggagcgccgucggguuccuguucugggugaucgugcugaccuccuggaucacgaucuuccagaucuaccgcccccgguggggcgcccucggggacuaccugagcuucaccaucccccugggcacccccuga

SEQ ID NO: 35162 - RNA, 1260 nt, Artificial Sequence
  derived and/or modified sequence opt1 from PSG1__Homo_sapiens__NP_001171754
augggcacccugagcgcgcccccgugcacccagcgcaucaaguggaaggggcuccugcugacggccucccuccugaacuucuggaaccugcccaccaccgcccaggugaccaucgaggccgagcccacgaaggucagcgagggcaaggacgugcuccugcuggugcacaaccucccccagaaccugaccggguacaucugguacaagggccagaugcgggaccuguaccacuacaucaccuccuacgucguggacggggagaucaucaucuacggcccggccuacagcggccgcgagaccgccuacuccaacgccagccuccugauccagaacgugacgcgggaggacgcgggguccuacacccugcacaucaucaagggcgacgacgggacccgcggcgucaccgggcgguucacguucacccuccaccuggagacccccaagcccagcaucuccagcuccaaccugaacccccgcgagaccauggaggccgugagccucacgugcgacccggagacccccgacgccuccuaccugugguggaugaacggccagagccugcccaugacccacucccucaagcugagcgagaccaaccggacgcuguuccuccugggcgugaccaaguacaccgccgggcccuacgagugcgagauccgcaacccggucuccgcgagccgguccgaccccgugacccugaaccuccugcccaagcugcccaagccguacaucacgaucaacaaccucaacccccgcgagaacaaggacgugcugaacuucacgugcgagcccaagagcgagaacuacaccuacaucugguggcugaacggccagagccuccccgucuccccgcgggugaagcgccccaucgagaaccggauccugauccugcccagcgugacccgcaacgagaccgggcccuaccagugcgagauccgggaccgcuacggcggcauccgguccgacccggucacccucaacgugcuguacgggcccgaccugccccgcaucuaccccagcuucaccuacuaccgguccggcgaggugcucuaccugagcugcuccgccgacagcaacccgcccgcccaguacuccuggaccaucaacgagaaguuccagcugcccgggcagaagcuguucauccgccacaucacgaccaagcacagcggccucuacgucugcuccgugcggaacagcgccaccgggaaggaguccagcaaguccaugaccguggaggucagcgacuggacggugccguga

SEQ ID NO: 35163 - RNA, 1008 nt, Artificial Sequence
  derived and/or modified sequence opt1 from PSG2__Homo_sapiens__NP_112536
augggcccccugagcgccccgcccugcaccgagcacaucaaguggaaggggcuccuggugaccgccucccugcucaacuucuggaaccugcccacgaccgcgcaggucaccaucgaggcccagcccccgaaggugagcgagggcaaggacgugcugcuccugguccacaaccugccccagaaccucaccggguacaucugguacaagggccagauccgcgaccuguaccacuacaucacguccuacgugguggacgggcagaucaucaucuacggccccgccuacagcggccgggagaccgccuacuccaacgccagccugcucauccagaacgucacccgcgaggacgcgggguccuacacccugcacaucaucaagcggggcgacgggacgcgcggcgugaccggguacuucaccuucacccuguaccucgagacgcccaagccgagcaucuccagcuccaaccugaacccccgggaggccauggagaccgugauccugaccugcgaccccgagacccccgacacgagcuaccagugguggaugaacggccagucccucccgaugacccaccgcuuccagcugagcgagaccaaccggacccuguuccucuucggcgucacgaaguacaccgccgggcccuacgagugcgagauccgcaacuccggcagcgccucccggagcgaccccgugacccugaaccugcuccacgggcccgaccugccgcgcauccaccccuccuacaccaacuaccggagcggcgacaaccuguaccucagcugcuucgcgaacuccaacccgcccgcccaguacagcuggacgaucaacggcaaguuccagcaguccgggcagaaccuguucaucccccagaucaccaccaagcacagcggccuguacgugugcuccguccgcaacagcgccaccggggaggaguccagcacgucccucaccgugaaggugagcgccuccacccggaucggccugcugccccuccugaaccccaccuga

SEQ ID NO: 35164 - RNA, 1008 nt, Artificial Sequence
  derived and/or modified sequence opt1 from PSG5__Homo_sapiens__NP_001123486
augggcccccugagcgccccgcccugcacccagcacaucaccuggaaggggcuccugcugaccgccucccuccugaacuucuggaaccugcccaucaccgcccaggugaccaucgaggcgcugcccccgaaggucagcgagggcaaggacgugcuccugcucgugcacaaccugccccagaaccuggccggguacaucugguacaagggccagcucauggaccuguaccacuacaucaccuccuacgucguggacgggcagaucaacaucuacggccccgccuacacgggccgcgagaccguguacagcaacgccucccugcucauccagaacgucacccgggaggacgcggggagcuacacccugcacaucaucaagcgcggcgaccggacgcgcggggugaccggcuacuucaccuucaaccuguaccucaagcugcccaagccguacaucaccaucaacaacuccaagccccgggagaacaaggacgugcuggccuucacgugcgagcccaagagcgagaacuacaccuacaucugguggcucaacgggcagucccugcccgucagcccgcgcgugaagcggcccaucgagaaccgcauccugauccuccccuccgugacccggaacgagaccggccccuacgagugcgagauccgcgaccgggacggcgggaugcgcagcgacccggucacgcugaacgugcuguacggccccgaccuccccuccaucuaccccagcuucaccuacuaccgguccggggagaaccuguaccugagcugcuucgccgaguccaacccgcccgccgaguacuucuggaccaucaacggcaaguuccagcagagcggccagaagcucuccaucccccagaucaccacgaagcaccgcgggcuguacacgugcagcgugcggaacagcgcgaccggcaaggaguccagcaaguccaugaccgucgaggugagcgcccccuccgggaucggccgccugccgcuccugaaccccaucuga

SEQ ID NO: 35165 - RNA, 1275 nt, Artificial Sequence
  derived and/or modified sequence opt1 from PSG6__Homo_sapiens__NP_001027020
augggcccccugagcgccccgcccugcacccagcacaucaccuggaaggggcuccugcugacggccucccuccugaacuucuggaaccugcccaccaccgcccaggugaucaucgaggcgaagcccccgaaggucagcgagggcaaggacgugcuccugcuggugcacaaccucccccagaaccugaccggguacaucugguacaagggccagaugacggaccuguaccacuacaucaccuccuacgucgugcacgggcagaucaucuacggccccgccuacagcggccgcgagaccguguacuccaacgccagccuccugauccagaacgucacccaggaggacgccggguccuacacgcugcacaucaucaagcggggcgacgggaccggcggggugaccggcuacuucaccgugacgcucuacagcgagacccccaagccguccaucagcuccagcaaccugaacccccgcgaggucauggaggcggugcggcugaucugcgaccccgagacccccgacgccuccuaccucuggcugcugaacggccagaaccucccgaugacccaccgccugcagcugagcaagacgaaccggacccucuaccuguucggggugaccaaguacaucgccggccccuacgagugcgagauccgcaaccccgucuccgccagccgguccgaccccgugacccugaaccuccugccgaagcugcccaugcccuacaucacgaucaacaaccucaacccccgcgagaagaaggacgugcuggcguucacgugcgagcccaagagccggaacuacaccuacaucugguggcugaacgggcagucccuccccgucagcccccgcgugaagcggcccaucgagaaccgcauccugauccugccgagcgugacccggaacgagaccggccccuaccagugcgagauccgcgaccgguacggcgggauccgcuccaaccccgucacccucaacgugcuguacggccccgaccugccgcggaucuaccccagcuucaccuacuaccgcuccggggagaaccucgaccugagcugcuucgccgacuccaacccgccggccgaguacagcuggaccaucaacggcaaguuccagcuguccgggcagaagcuguucaucccccagaucacgaccaaccacagcggccucuacgccugcuccgugcggaacagcgccaccggcaaggagaucuccaagagcaugaucgucaagguguccgggcccugccacggcaaccagaccgagagccacuga

SEQ ID NO: 35166 - RNA, 1260 nt, Artificial Sequence
  derived and/or modified sequence opt1 from PSG8__Homo_sapiens__NP_001123639
augggccugcucagcgcgcccccgugcacccagcgcaucaccuggaaggggcugcugcucacggccucccugcugaacuucuggaacccgcccaccaccgcccaggugaccaucgaggcccagcccacgaaggucagcgagggcaaggacgugcuccugcuggugcacaaccucccccagaaccugaccggguacaucugguacaagggccagauccgggaccuguaccacuacaucaccuccuacgucguggacgggcagaucaucaucuacggccccgccuacagcggccgcgagaccaucuacuccaacgccagccuccugauccagaacgugacgcaggaggacgccggguccuacacccugcacaucaucaugggcggggacgagaaccggggcgucaccgggcacuucaccuucacgcucuaccuggagacccccaagcccagcaucuccagcuccaagcugaacccgcgcgaggcgauggaggccgugagccugaccugcgaccccgagacccccgacgccuccuaccucugguggaugaacggccagagccugcccaugucccaccggcuccagcugagcgagacgaaccgcacccuguuccuccugggcgugaccaaguacaccgccgggccguacgagugcgagauccggaaccccgucuccgcgagccgcuccgaccccuucacgcugaaccuccugcccaagcugccgaagcccuacaucaccaucaacaaccucaagccccgggagaacaaggacgugcugaacuucacgugcgagcccaagagcgagaacuacaccuacaucugguggcugaacggccagagccucccggugagcccccgcgucaagcggcccaucgagaaccgcauccugauccugcccuccgugacccggaacgagaccgggccguaccagugcgagauccgcgaccaguacggcggcauccgguccuaccccgugacccucaacguccuguacgggcccgaccugccccgcaucuacccgagcuucaccuacuaccgguccggcgaggugcucuaccugagcugcuccgccgacagcaacccgcccgcccaguacuccuggacgaucaacgggaaguuccagcugagcggccagaagcuguucaucccccagaucaccaccaagcacuccgggcucuacgccugcagcgugcgcaacuccgccaccggcaaggagagcuccaagagcaugacggucaagguguccgacuggacccugcccuga

SEQ ID NO: 35167 - RNA, 1002 nt, Artificial Sequence
  derived and/or modified sequence opt1 from PSG9__Homo_sapiens__NP_001288636
augggcccccugccggcccccagcugcacccagcgcaucaccuggaaggggcuccugcugacggccucccuccugaacuucuggaacccgcccaccaccgcggaggugaccaucgaggcccagccgcccaaggucagcgagggcaaggacgugcugcuccuggugcacaaccugccccagaaccuccccggguacuucugguacaagggcgagaugacggaccuguaccacuacaucaucuccuacaucgucgacgggaagaucaucaucuacggcccggccuacagcggccgggagaccguguacuccaacgccagccugcucauccagaacgugacccgcaaggacgccgggaccuacacgcugcacaucaucaagcggggcgacgagacccgcgaggagauccggcacuucaccuucacccuguacuccaagcuccccauccccuacaucacgaucaacaaccugaacccccgcgagaacaaggacguccuggcguucacgugcgagcccaagagcgagaacuacaccuacaucugguggcucaacgggcagucccugcccgugagccccggcgugaagcggcccaucgagaaccgcauccugauccucccguccgucacccggaacgagaccgggcccuaccagugcgagauccgcgaccgguacggcggccugcgcagcaaccccgugauccugaacgugcucuacgggcccgaccugccgcggaucuaccccuccuucaccuacuaccgcagcggcgagaaccuggaccucuccugcuucaccgagagcaacccgcccgccgaguacuucuggaccaucaacgggaaguuccagcaguccggccagaagcuguucaucccccagaucacgcggaaccacagcggccuguacgccugcuccguccacaacagcgccaccgggaaggagaucagcaaguccaugaccgugaaggugagcggccccugccacggggaccucaccgagucccagagcuga

SEQ ID NO: 35168 - RNA, 1593 nt, Artificial Sequence
  derived and/or modified sequence opt1 from PSIP1__Homo_sapiens__NP_001121689
augacccgcgacuucaagcccggcgaccugaucuucgccaagaugaagggguacccgcacuggcccgcccggguggacgagguccccgacggcgcggugaagcccccgaccaacaagcuccccaucuucuucuucgggacgcacgagaccgccuuccugggccccaaggacaucuuccccuacagcgagaacaaggagaaguacgggaagccgaacaagcgcaagggcuucaacgagggccugugggagaucgacaacaaccccaaggugaaguucuccagccagcaggccgccaccaagcaguccaacgccagcuccgacgucgagguggaggagaaggagaccagcguguccaaggaggacacggaccacgaggagaaggcgagcaacgaggacgucaccaaggccguggacaucaccacccccaaggccgcccggcgcgggcggaagcgcaaggcggagaagcaggucgagacggaggaggccggcguggugaccaccgccaccgccuccgugaaccucaaggucagccccaagcgggggcgcccggccgcgacggaggugaagauccccaagccccggggccgccccaagauggugaagcagccgugccccuccgagagcgacaucaucaccgaggaggacaaguccaagaagaaggggcaggaggagaagcagcccaagaagcagcccaagaaggacgaggagggccagaaggaggaggacaagccgcggaaggagcccgacaagaaggagggcaagaaggaggucgagagcaagcgcaagaaccuggccaagaccggggugaccuccacgagcgacuccgaggaggagggcgacgaccaggagggggagaagaagcggaagggcggccgcaacuuccagaccgcccaccggcgcaacaugcugaaggggcagcacgagaaggaggccgccgaccggaagcgcaagcaggaggagcagauggagaccgagcagcagaacaaggacgagggcaagaagcccgaggugaagaaggucgagaagaagcgggagaccagcauggacucccgccuccagcggauccacgcggagaucaagaacagccugaagaucgacaaccuggacgugaaccgcugcaucgaggcccucgacgagcuggccagccuccaggugacgaugcagcaggcccagaagcacaccgagaugaucaccacccugaagaagauccgccgguucaaggucucccaggugaucauggagaaguccacgaugcuguacaacaaguucaagaacauguuccuggugggggagggcgacagcgucaucacccaggugcucaacaagagccuggccgagcagcgccagcacgaggaggcgaacaagaccaaggaccaggggaagaagggccccaacaagaagcuggagaaggagcagaccggcuccaagacgcucaacgggggcagcgacgcccaggacgggaaccagccgcagcacaacggcgaguccaacgaggacagcaaggacaaccacgaggccuccaccaagaagaagcccagcuccgaggagcgggagaccgagaucagccugaaggacuccacccuggacaacuga

SEQ ID NO: 35169 - RNA, 1275 nt, Artificial Sequence
  derived and/or modified sequence opt1 from PSKH1__Homo_sapiens__NP_006733
augggcugcgggaccagcaaggugcugcccgagccgcccaaggacguccagcucgaccuggugaagaagguggagcccuucuccggcaccaagagcgacgucuacaagcacuucaucacggagguggacuccguggggcccgucaaggccggcuucccggccgcgagccaguacgcccaccccugccccgggcccccgaccgccggccacaccgagccgcccuccgagcccccgcgccgggcccgcguggccaaguaccgggcgaaguucgacccccgcgugaccgccaaguacgacaucaaggcccugaucggccgggggagcuucucccgcgucgugcggguggagcaccgcgccacgcggcagcccuacgcgaucaagaugaucgagaccaaguaccgcgagggccgggaggucugcgagagcgagcuccgcgugcugcggcgcgugcggcacgccaacaucauccagcuggucgagguguucgagacccaggagcgcguguacauggucauggagcucgccaccgggggcgagcuguucgaccggaucaucgccaagggguccuucacggagcgcgacgccacccgggugcugcagauggugcucgacggcguccgcuaccugcacgcgcugggcaucacccaccgggaccucaagcccgagaaccugcuguacuaccaccccgggaccgacagcaagaucaucaucacggacuucggccucgccuccgcccgcaagaagggggacgacugccugaugaagacgaccugcggcacccccgaguacaucgcccccgaggugcuggugcgcaagcccuacaccaacagcgucgacaugugggcccucggcgugaucgcguacauccugcuguccgggaccaugccguucgaggacgacaaccggacccgccucuaccggcagauccugcgcggcaaguacagcuacuccggggagcccuggcccagcgucuccaaccuggccaaggacuucaucgaccggcuccugaccguggaccccggcgcccgcaugacggcccugcaggcccuccggcacccguggguggucagcauggcggccuccagcagcaugaagaaccugcaccgcuccaucagccagaaccugcucaagcgggccuccagccgcugccaguccaccaagagcgcccaguccacccggagcucccgcagcacccgguccaacaagagccgccgggugcgcgagcgggagcugcgcgagcugaaccuccgguaccagcagcaguacaacggguga

SEQ ID NO: 35170 - RNA, 393 nt, Artificial Sequence
  derived and/or modified sequence opt1 from PSMA1__Homo_sapiens__NP_001137409
auguuccgcaaccaguacgacaacgacgugaccgucuggagcccccagggccggauccaccagaucgaguacgccauggaggccgugaagcagggguccgcgaccgugggccucaagagcaagacgcacgccguccugguggcccugaagcgcgcccaguccgagcuggccgcgcaccagaagaagauccuccacguggacaaccacaucgggaucagcaucgccggccugaccgccgacgcccggcugcucugcaacuucaugcgccaggagugccuggacucccgguucgucuucgaccgcccgcugcccgugagccggcucgugucccugaucgggagcuccauccuguucaugcucgcguucauggacaugaacuucgagggcuucuga

SEQ ID NO: 35171 - RNA, 705 nt, Artificial Sequence
  derived and/or modified sequence opt1 from PSMA2__Homo_sapiens__NP_002778
auggccgagcgcggcuacagcuucucccugaccaccuucagccccuccgggaagcucgugcagaucgaguacgcccuggcggccgucgccggcggggccccgagcgugggcaucaaggccgcgaacggggugguccuggccacggagaagaagcagaaguccauccucuacgacgagcggagcgugcacaagguggagcccaucaccaagcacaucggccuggucuacuccggcauggggcccgacuaccgcgugcuggugcaccgggcccgcaagcucgcccagcaguacuaccuggucuaccaggagcccaucccgaccgcgcagcuggugcagcggguggccagcgucaugcaggaguacacccaguccggcggggugcgccccuucggcgugagccuccugaucugcggguggaacgagggccggcccuaccuguuccaguccgaccccagcggcgccuacuucgccuggaaggccacggcgauggggaagaacuacgucaacggcaagaccuuccucgagaagcgcuacaacgaggaccuggagcuggaggacgccauccacaccgccauccucacccugaaggaguccuucgaggggcagaugacggaggacaacaucgaggugggcaucugcaacgaggccggcuuccggcgccugaccccgaccgaggugaaggacuaccucgccgcgaucgccuga

SEQ ID NO: 35172 - RNA, 768 nt, Artificial Sequence
  derived and/or modified sequence opt1 from PSMA3__Homo_sapiens__NP_002779
augagcuccaucggcaccggguacgaccugagcgccuccaccuucagccccgacggccgcguguuccaggucgaguacgccaugaaggcgguggagaacuccagcacggccaucgggauccggugcaaggacggcguggucuucgggguggagaagcucgugcuguccaagcuguacgaggagggcagcaacaagcgccucuucaacgucgaccggcacgugggcauggccguggccgggcugcuggccgacgcgcgcucccucgccgacaucgcccgggaggaggccagcaacuuccgcuccaacuucggcuacaacaucccgcugaagcaccuggcggaccgggucgccauguacgugcacgccuacacccucuacagcgccgugcgccccuucgggugcuccuucaugcugggcagcuacuccgucaacgacggggcccagcuguacaugaucgaccccagcggcguguccuacggcuacugggggugcgcgaucggcaaggcccggcaggccgccaagaccgagaucgagaagcuccagaugaaggagaugaccugccgcgacaucgugaaggaggucgccaagaucaucuacaucgugcacgacgaggugaaggacaaggcguucgagcuggagcugagcugggucggggagcucacgaacggccggcacgagaucgugcccaaggacauccgcgaggaggccgagaaguacgccaaggagucccugaaggaggaggacgagagcgacgacgacaacauguga

SEQ ID NO: 35173 - RNA, 786 nt, Artificial Sequence
  derived and/or modified sequence opt1 from PSMA4__Homo_sapiens__NP_001096137
augagccgccgguacgacucccgcaccaccaucuucagccccgagggccggcuguaccagguggaguacgccauggaggccaucgggcacgcgggcacgugccucgggauccuggccaacgacggcguccugcucgccgccgagcgccggaacauccacaagcugcuggacgagguguucuucuccgagaagaucuacaagcucaacgaggacauggccugcagcguggcggggaucaccuccgacgccaacguccugaccaacgagcugcgccucaucgcccagcgguaccugcugcaguaccaggagccgauccccugcgagcagcucgugaccgcccugugcgacaucaagcaggcguacacgcaguucggcggcaagcgccccuucggggugagccugcucuacaucggcugggacaagcacuacggguuccagcuguaccaguccgaccccagcggcaacuacgggggcuggaaggcgaccugcaucggcaacaacuccgccgccgccgucagcaugcugaagcaggacuacaaggagggggagaugacccucaaguccgcccuggcccuggccaucaaggugcucaacaagaccauggacgugagcaagcuguccgccgagaaggucgagaucgccacgcugacccgggagaacggcaagaccgugauccgcgugcucaagcagaaggaggucgagcagcugaucaagaagcacgaggaggaggaggcgaaggccgagcgggagaagaaggagaaggagcagaaggagaaggacaaguga

SEQ ID NO: 35174 - RNA, 504 nt, Artificial Sequence
  derived and/or modified sequence opt1 from PSMA6__Homo_sapiens__NP_001269161
augaccggcaugaccgccgacagccgcucccaggugcagcgggcccgcuacgaggcggccaacuggaaguacaaguacggguacgagauccccgucgacaugcugugcaagcggaucgccgacaucagccagguguacacgcagaacgccgagaugcgcccgcucggcugcugcaugauccugaucgggaucgacgaggagcagggcccccagguguacaagugcgaccccgccggguacuacugcggcuucaaggcgaccgccgccggcgucaagcagaccgaguccaccagcuuccuggagaagaaggugaagaagaaguucgacuggacguucgagcagaccguggagaccgccaucacgugccucuccaccguccugagcaucgacuucaagcccuccgagaucgagguggggguggucaccguggagaacccgaaguuccggauccugaccgaggcggagaucgacgcccaccucguggcccuggccgagcgcgacuga

SEQ ID NO: 35175 - RNA, 747 nt, Artificial Sequence
  derived and/or modified sequence opt1 from PSMA7__Homo_sapiens__NP_002783
augagcuacgaccgcgccaucaccguguucucccccgacggccaccuguuccaggucgaguacgcccaggaggcggugaagaaggggagcaccgccgugggcguccgggggcgcgacaucguggugcucggcgucgagaagaaguccguggccaagcugcaggacgagcggacggugcgcaagaucugcgcccuggacgacaacgucugcauggccuucgcggggcucaccgccgacgcccggaucgugaucaaccgcgcccggguggagugccagagccaccgccugaccgucgaggacccggugaccguggaguacaucacgcgguacaucgcgucccugaagcagcgcuacacccagagcaacggccggcgccccuucggcaucuccgcccucaucgucggguucgacuucgacggcacgccccggcuguaccagaccgaccccagcgggaccuaccacgccuggaaggccaacgccaucggccgcggggcgaaguccgugcgggaguuccuggagaagaacuacaccgacgaggccaucgagaccgacgaccucaccaucaagcuggugaucaaggcccugcucgaggucgugcagagcggcggcaagaacaucgagcuggccgugaugcgccgggaccagucccugaagauccucaacccggaggagaucgagaaguacgucgccgagaucgagaaggagaaggaggagaacgagaagaagaagcagaagaaggcgagcuga

SEQ ID NO: 35176 - RNA, 822 nt, Artificial Sequence
  derived and/or modified sequence opt1 from PSMB10__Homo_sapiens__NP_002792
augcugaagcccgcccucgagccgcgcggcggguucagcuucgagaacugccagcggaacgccucccuggagcgcgugcugcccggccucaaggucccccacgcgcggaagaccgggaccacgaucgccggccugguguuccaggacggggugauccugggcgccgacacccgcgccaccaacgacagcgucguggccgacaaguccugcgagaagauccacuucaucgcgcccaagaucuacugcugcggcgccgggguggccgccgacgcggagaugaccacgcggauggucgccagcaagauggagcuccacgcccuguccaccggccgcgagccgcggguggccaccgugacccgcauccugcggcagacccucuuccgcuaccaggggcacgucggcgccagccugaucgucgggggcguggaccugacgggcccccagcucuacggggugcacccccacggcuccuacagccggcugcccuucaccgcgcugggguccggccaggacgccgcccucgccgugcuggaggaccgcuuccagccgaacaugacccuggaggccgcgcagggccuccugguggaggccgucacggccgggauccugggcgaccucgggagcggcgggaacguggacgccugcgugaucaccaagaccggcgccaagcugcugcggacccucuccagccccacggagcccgucaagcgcuccggccgguaccacuucgugcccgggaccaccgcggugcugacccagacggucaagccgcugacccucgagcugguggaggagaccgugcaggccauggaggucgaguga

SEQ ID NO: 35177 - RNA, 726 nt, Artificial Sequence
  derived and/or modified sequence opt1 from PSMB1__Homo_sapiens__NP_002784
augcugagcuccaccgccauguacagcgcccccggccgcgaccucgggauggagccgcaccgggcggccggcccccugcagcugcgcuucucccccuacguguucaacgggggcaccauccucgccaucgccggggaggacuucgccaucgucgcgagcgacacgcggcuguccgagggcuucagcauccacacccgcgacucccccaagugcuacaagcugaccgacaagaccgugaucggcugcagcggguuccacggcgacugccucacgcugaccaagaucaucgaggcccggcugaagauguacaagcacuccaacaacaaggccaugaccaccggggccaucgcggccaugcucagcacgauccuguacucccgccgguucuucccguacuacguguacaacaucaucggcgggcuggacgaggagggcaagggcgccgucuacagcuucgaccccgugggguccuaccagcgcgacagcuucaaggccggcggguccgccagcgcgaugcuccagccccugcuggacaaccaggugggcuucaagaacaugcagaacgucgagcacgugccccucucccuggaccgggccaugcgccuggugaaggacgucuucaucagcgccgccgagcgggacguguacaccggcgacgcccuccgcaucugcaucgugaccaaggaggggauccgggaggagaccgucucccugcgcaaggacuga

SEQ ID NO: 35178 - RNA, 795 nt, Artificial Sequence
  derived and/or modified sequence opt1 from PSMB4__Homo_sapiens__NP_002787
auggaggccuuccugggcagccgcuccgggcucugggccggcgggcccgcgccgggccaguucuaccggauccccagcacccccgacuccuucauggaccccgccagcgcccuguaccgcgggccgaucacccggacgcagaaccccauggugaccggcaccuccguccugggcgugaaguucgagggcgggguggucaucgccgccgacaugcucgggagcuacggcucccuggcgcgcuuccggaacaucagccgcaucaugcgggugaacaacuccaccaugcugggggccagcggcgacuacgccgacuuccaguaccucaagcagguccugggccagauggugaucgacgaggagcugcucggggacggccacuccuacagcccccgcgccauccacuccuggcugacgcgggcgauguacagccgccgguccaagaugaacccccuguggaacaccauggugaucgggggcuacgccgacggcgagagcuuccucggguacguggacaugcugggcgucgccuacgaggccccgucccuggccaccggguacggcgcguaccucgcccagccccugcugcgcgaggugcucgagaagcagcccgugcugagccagaccgaggcccgggaccuggucgagcgcugcaugcgggugcucuacuaccgcgacgcccgguccuacaaccgcuuccagaucgccacggugaccgagaagggggucgagaucgagggcccccugagcaccgagaccaacugggacaucgcgcacaugaucagcggcuucgaguga

SEQ ID NO: 35179 - RNA, 483 nt, Artificial Sequence
  derived and/or modified sequence opt1 from PSMB5__Homo_sapiens__NP_001124197
auggccggcggggccgcggacugcagcuucugggagcgccugcucgcccggcagugccgcaucuacgagcugcggaacaaggagcgcaucuccguggccgccgccagcaagcugcucgcgaacauggucuaccaguacaagggcauggggcuguccaugggcaccaugaucugcgggugggacaagcggggccccggccuguacuacguggacagcgaggggaaccgcaucuccggcgccaccuucagcgugggguccggcagcgucuacgccuacggggugauggaccggggcuacuccuacgaccucgagguggagcaggccuacgaccuggcgcgccgggccaucuaccaggccacguaccgcgacgccuacagcggcggggccgucaaccuguaccacgugcgggaggacggcuggauccgcguguccagcgacaacgucgcggaccuccacgagaaguacuccgggagcaccccguga

SEQ ID NO: 35180 - RNA, 720 nt, Artificial Sequence
  derived and/or modified sequence opt1 from PSMB6__Homo_sapiens__NP_002789
auggccgccacccugcucgcggcccgcggcgccgggcccgcccccgccuggggccccgaggcguucacccccgacugggagagccgggagguguccacggggaccaccaucauggccguccaguucgacggcgggguggugcugggcgccgacagccgcaccacgaccggcuccuacaucgccaaccgggucaccgacaagcugacccccauccacgaccgcaucuucugcugccggagcggguccgcggccgacacgcaggccguggccgacgccgugaccuaccagcucggcuuccacagcaucgagcugaacgagccgccccugguccacaccgcggccucccucuucaaggagaugugcuaccgcuaccgggaggaccugauggccgggaucaucaucgccggcugggacccccaggagggcgggcaggucuacagcgugcccaugggcgggaugauggugcgccaguccuucgccaucggcgggagcggcuccagcuacaucuacggcuacguggacgcgaccuaccgggaggggaugacgaaggaggagugccugcaguucaccgccaacgcccucgcccuggccauggagcgcgacggcuccagcgggggcgugauccggcuggcggccaucgccgaguccggggucgagcgccaggugcuccugggcgaccagaucccgaaguucgccguggccacccugccgcccgcguga

SEQ ID NO: 35181 - RNA, 834 nt, Artificial Sequence
  derived and/or modified sequence opt1 from PSMB7__Homo_sapiens__NP_002790
auggccgccgugagcgucuacgcgcccccggugggcggguucuccuucgacaacugccgccggaacgccgugcuggaggccgacuucgccaagcgcggcuacaagcuccccaagguccggaagaccgggaccacgaucgccggcgugguguacaaggacgggaucguccugggcgcggacacccgcgccaccgagggcauggugguggccgacaagaacugcagcaagauccacuucaucucccccaacaucuacugcugcggggccggcaccgcggccgacacggacaugaccacccagcugaucagcuccaaccucgagcugcacagccuguccaccgggcggcucccccgcgucgugacggccaaccggaugcugaagcagaugcuguuccgcuaccagggcuacaucggggccgcccucgugcugggcggcgucgacgugaccgggccgcaccuguacagcaucuacccccacggcuccaccgacaagcuccccuacgugaccauggggagcggcucccuggcggccauggccgucuucgaggacaaguuccggcccgacauggaggaggaggaggccaagaaccuggugagcgaggccaucgcggccggcaucuucaacgaccucggguccggcagcaacaucgaccugugcgugaucuccaagaacaagcuggacuuccuccgcccguacacgguccccaacaagaaggggacccggcugggccgcuaccggugcgagaaggggaccaccgccgugcugacggagaagaucacgccccucgagaucgaggugcuggaggagaccguccagaccauggacaccagcuga

SEQ ID NO: 35182 - RNA, 819 nt, Artificial Sequence
  derived and/or modified sequence opt1 from PSMB8__Homo_sapiens__NP_004150
augcugaucggcacccccaccccgcgcgacacgacccccagcuccuggcucaccagcucccugcugguggaggccgcgccccucgacgacaccacgcugcccaccccggucagcuccgggugccccggccuggagcccaccgaguucuuccagagccucgggggcgacggggagcggaacgugcagaucgagauggcccacggcaccacgacccuggccuucaaguuccagcacggcgugaucgccgccgucgacucccgcgccagcgcgggguccuacaucagcgcccugcgggugaacaaggugaucgagaucaaccccuaccuccugggcaccauguccgggugcgccgccgacugccaguacugggagcgccugcucgcgaaggagugccggcuguacuaccugcgcaacggcgagcggaucagcgucuccgccgccagcaagcuccuguccaacaugaugugccaguaccgcgggaugggccugagcaugggcuccaugaucugcgggugggacaagaagggcccggggcucuacuacguggacgagcacggcacccggcugagcggcaacauguucuccacggggagcggcaacaccuacgccuacggggugauggacagcggcuaccgccccaaccugucccccgaggaggccuacgaccucgggcggcgcgcgaucgccuacgccacccaccgggacagcuacuccggcggcgucgugaacauguaccacaugaaggaggacgggugggugaaggucgagagcaccgacguguccgaccugcugcaccaguaccgcgaggccaaccaguga

SEQ ID NO: 35183 - RNA, 660 nt, Artificial Sequence
  derived and/or modified sequence opt1 from PSMB9__Homo_sapiens__NP_002791
augcugcgcgccggcgcccccaccggggaccucccgcgggcgggcgaggugcacaccgggacgaccaucauggccgucgaguucgacggcgggguggugaugggcagcgacucccgcgucagcgccggcgaggccguggugaaccgggucuucgacaagcugagcccccugcacgagcgcaucuacugcgcccucuccggguccgcggccgacgcccaggccguggcggacauggccgccuaccagcuggagcugcacggcaucgagcucgaggagccgccccuggugcuggccgccgcgaacgucgugcggaacaucagcuacaaguaccgcgaggaccucuccgcccaccugaugguggccgggugggaccagcgggagggcgggcaggucuacggcacccugggcgggaugcucacccgccagcccuucgccaucggcgggagcggcuccacguucaucuacggcuacguggacgccgcguacaagcccgggaugagccccgaggagugccggcgcuucaccaccgacgccaucgcccuggccaugucccgggacggcagcuccgggggcgugaucuaccuggucaccaucacggccgcggggguggaccaccgcgugauccucggcaacgagcugcccaaguucuacgacgaguga

SEQ ID NO: 35184 - RNA, 1323 nt, Artificial Sequence
  derived and/or modified sequence opt1 from PSMC1__Homo_sapiens__NP_002793
augggccagagccagagcgggggccacgggcccggcgggggcaagaaggacgacaaggacaagaagaagaaguacgagccgcccgugcccacccgcgucggcaagaagaagaagaagaccaaggggcccgacgccgccagcaagcugccgcucgugacgccccacacccagugccggcugaagcugcucaagcuggagcgcaucaaggacuaccugcucauggaggaggaguucauccggaaccaggagcagaugaagccccuggaggagaagcaggaggaggagcgcuccaagguggacgaccugcggggcacccccaugagcgucgggacccucgaggagaucaucgacgacaaccacgcgaucguguccacgagcgugggcuccgagcacuacgucagcauccuguccuucguggacaaggaccugcucgagccggggugcagcgugcugcugaaccacaagguccacgccgugaucggcgugcucauggacgacaccgacccccuggucaccgugaugaagguggagaaggcgccccaggagaccuacgccgacaucggcgggcuggacaaccagauccaggagaucaaggaguccgucgagcucccccugacgcacccggaguacuacgaggagaugggcaucaagccgcccaagggggugauccuguacggcccgcccggcaccgggaagacccuccuggccaaggccguggccaaccagaccagcgccacguuccugcgcgucgugggcuccgagcucauccagaaguaccugggggacggccccaagcuggugcgggagcuguuccgcgucgccgaggagcacgcgcccagcaucguguucaucgacgagaucgacgccaucgggaccaagcgguacgacuccaacagcggcggcgagcgcgagauccagcggaccaugcucgagcugcucaaccagcuggacggguucgacucccgcggcgacgugaaggucaucauggccaccaaccggaucgagacgcuggaccccgcccucauccgccccgggcggaucgaccgcaagaucgaguucccccugcccgacgagaagaccaagaagcggaucuuccagauccacaccagccgcaugacccuggccgacgacgugacgcucgacgaccugaucauggcgaaggacgaccuguccggcgccgacaucaaggccaucugcaccgaggccgggcucauggcccugcgggagcgccggaugaaggucaccaacgaggacuucaagaaguccaaggagaacgugcuguacaagaagcaggagggcacccccgagggccucuaccuguga

SEQ ID NO: 35185 - RNA, 426 nt, Artificial Sequence
  derived and/or modified sequence opt1 from PSMC2__Homo_sapiens__NP_001191382
augcccgacuaccugggcgccgaccagcgcaagaccaaggaggacgagaaggacgacaagccgauccgggcccuggacgagggggacaucgcgcugcugaagaccuacggccagagcacguacucccgccagaucaagcaggucgaggacgacauccagcagcuccugaagaagaucaacgagcugaccgggaucaaggagagcgacaccggccucgccccgcccgcccugugggaccuggccgccgacaagcagacccuccaguccgagcagccccuccagguggcgcggugcacgaagaucaucaacgccgacagcgaggaccccaaguacaucaucaacgugaagcaguucgccaaguucguggucgaccuguccgaccagguggcccccaccgacaucgaggaggggaugcgcgugggcuga

SEQ ID NO: 35186 - RNA, 1320 nt, Artificial Sequence
  derived and/or modified sequence opt1 from PSMC3__Homo_sapiens__NP_002795
augaaccugcuccccaacaucgagagcccggugacccgccaggagaagauggccaccgucugggacgaggccgagcaggacggcaucggggaggaggugcugaagauguccacggaggagaucauccagcggacccgccugcucgacagcgagaucaagaucaugaaguccgaggugcugcgggucacccacgagcugcaggcgaugaaggacaagaucaaggagaacagcgagaagaucaaggugaacaagacccuccccuaccugguguccaacgucaucgagcugcucgacguggaccccaacgaccaggaggaggacggcgccaacaucgaccuggacagccagcgcaaggggaagugcgccgugaucaagacguccacccggcagaccuacuuccugcccgucaucggccucguggacgccgagaagcugaagccgggggaccuggugggcgucaacaaggacagcuaccucauccuggagacccugcccacggaguacgacucccgcgugaaggccauggagguggacgagcggcccaccgagcaguacagcgacaucggcgggcucgacaagcagauccaggagcuggucgaggcgaucgugcugcccaugaaccacaaggagaaguucgagaaccucggcauccagccgcccaagggggugcugauguacggcccgcccgggaccggcaagacccugcucgcccgcgccugcgccgcgcagacgaaggccaccuuccugaagcuggccggcccccagcucguccagauguucaucggggacggcgccaagcuggugcgggacgccuucgcgcuggccaaggagaaggcccccuccaucaucuucaucgacgagcucgacgccaucgggaccaagcgcuucgacagcgagaaggccggcgaccgggaggugcagcgcaccaugcuggagcugcucaaccagcuggacggcuuccagcccaacacgcaggucaaggugaucgcggccaccaaccggguggacauccuggaccccgcccuccugcgcuccgggcggcuggaccgcaagaucgaguucccgaugcccaacgaggaggcccgggcccgcaucaugcagauccacagccggaagaugaacgucucccccgacgugaacuacgaggagcucgcgcgcugcaccgacgacuucaacggcgcccagugcaaggccgucugcguggaggccgggaugaucgcccugcggcgcggcgcgaccgagcugacgcacgaggacuacauggaggggauccucgaggugcaggccaagaagaaggccaaccugcaguacuacgccuga

SEQ ID NO: 35187 - RNA, 465 nt, Artificial Sequence
  derived and/or modified sequence opt1 from PSMC3IP__Homo_sapiens__NP_001242943
auguacggcaagcagaagaucuacuucgccgaccaggaccaguucgacauggugagcgacgccgaccugcagguccucgacgggaagaucguggcgcugaccgccaaggugcagucccugcagcagagcugccgcuacauggaggccgagcucaaggagcuguccagcgcccugaccacgcccgagaugcagaaggagauccaggagcucaagaaggagugcgccggcuaccgggagcgccugaagaacaucaaggcggccaccaaccacgucaccccggaggagaaggagcaggucuaccgggagcgccagaaguacugcaaggaguggcggaagcgcaagcggauggccaccgagcuguccgacgccauccucgagggguaccccaagagcaagaagcaguucuucgaggaggugggcaucgagacggacgaggacuacaacgugacccugcccgaccccuga

SEQ ID NO: 35188 - RNA, 1257 nt, Artificial Sequence
  derived and/or modified sequence opt1 from PSMC4__Homo_sapiens__NP_006494
auggaggagaucggcauccugguggagaaggcccaggacgagauccccgcccucagcgucucccgcccgcagaccgggcugagcuuccugggccccgagcccgaggaccucgaggaccuguacucccgguacaagaagcugcagcaggagcucgaguuccuggaggugcaggaggaguacaucaaggacgagcagaagaaccugaagaaggaguuccuccacgcgcaggaggaggugaagcgcauccagagcaucccccuggucaucgggcaguuccuggaggccguggaccagaacaccgccaucgugggcuccacgaccgggagcaacuacuacguccggauccucuccaccaucgaccgcgagcugcugaagccgaacgccagcguggcccuccacaagcacuccaacgcgcugguggacguccugccgcccgaggccgacagcuccaucaugaugcucaccagcgaccagaagcccgacgugauguacgccgacaucggcggcauggacauccagaagcaggaggugcgggaggccgucgagcugccccugacgcacuucgagcucuacaagcagaucgggaucgacccgccccgcggcgugcugauguacgggccgcccggcugcgggaagaccaugcuggcgaaggccguggcccaccacaccaccgccgccuucauccgggucgugggcuccgaguucgugcagaaguaccucggcgaggggccccgcaugguccgggacguguuccgccuggcgaaggagaacgcccccgccaucaucuucaucgacgagaucgacgccaucgccacgaagcgguucgacgcgcagaccggcgccgaccgcgaggugcagcggauccugcucgagcugcugaaccagauggacggguucgaccagaacgucaacgugaaggugaucauggccaccaaccgcgccgacacccucgaccccgcccugcugcggcccggccgccucgaccggaagaucgaguucccccugcccgaccgccggcagaagcgccugaucuucagcacgaucaccuccaagaugaaccucagcgaggaggucgaccuggaggacuacguggcgcggcccgacaagaucuccggcgccgacaucaacagcaucugccaggaguccgggaugcuggccguccgcgagaaccgcuacaucgugcucgccaaggacuucgagaaggccuacaagaccgugaucaagaaggacgagcaggagcacgaguucuacaaguga

SEQ ID NO: 35189 - RNA, 1197 nt, Artificial Sequence
  derived and/or modified sequence opt1 from PSMC5__Homo_sapiens__NP_001186092
auggagcuggaggagggcaaggccgggagcggccuccgccaguacuaccuguccaagaucgaggagcugcagcucaucgugaacgacaagagccagaaccugcggcgccugcaggcccagcggaacgagcucaacgcgaagguccgccugcugcgggaggagcuccagcugcugcaggagcagggguccuacgugggcgaggugguccgcgccauggacaagaagaaggugcucgugaagguccaccccgaggggaaguucgugguggacgucgacaagaacaucgacaucaacgacgugacccccaacugccggguggcccugcgcaacgacagcuacacccugcacaagauccuccccaacaaggucgacccccuggugucccugaugaugguggagaagguccccgacagcacguacgagaugaucggcggccucgacaagcagaucaaggagaucaaggaggugaucgagcugccggugaagcaccccgagcuguucgaggcccucgggaucgcccagcccaagggcguccugcuguacgggcccccgggcaccgggaagacccuccuggcgcgggccguggcccaccacaccgacugcacguucauccgcguguccggcagcgagcugguccagaaguucaucggcgagggggcccggauggugcgcgagcuguucgugauggcgcgggagcacgcccccuccaucaucuucauggacgagaucgacagcaucggcuccagccgccucgagggcggguccggcggggacagcgagguccagcggaccaugcuggagcuccugaaccagcuggacggcuucgaggccaccaagaacaucaaggugaucauggccaccaaccgcaucgacauccucgacuccgcccugcugcggcccgggcgcaucgaccggaagaucgaguucccgccgcccaacgaggaggcgcgccucgacauccugaagauccacagccggaagaugaaccugacgcgcggcaucaaccuccgcaagaucgccgagcugaugcccggggccuccggcgccgaggucaagggcgugugcaccgaggccgggauguacgcgcugcgggagcgccgggugcacgucacccaggaggacuucgagauggccguggccaaggugaugcagaaggacagcgagaagaacauguccaucaagaagcucuggaaguga

SEQ ID NO: 35190 - RNA, 1212 nt, Artificial Sequence
  derived and/or modified sequence opt1 from PSMC6__Homo_sapiens__NP_002797
auggccauccccggcaucccguacgagcgccggcugcucaucauggccgacccccgcgacaaggcgcugcaggacuaccggaagaagcugcucgagcacaaggagaucgacgggcgccugaaggagcugcgggagcagcucaaggagcugaccaagcaguacgagaaguccgagaacgaccugaaggcccuccagagcgugggccagaucgucggggaggugcugaagcagcugaccgaggagaaguucaucgugaaggccacgaacggcccccgcuacgucguggggugccggcgccagcucgacaagagcaagcugaagcccggcacccggguggcccuggacaugaccacccucacgaucaugcgcuaccugccgcgggaggucgacccccugguguacaacaugucccacgaggaccccggcaacgugagcuacuccgagaucgggggccucagcgagcagauccgcgagcugcgggaggucaucgagcugccccucaccaacccggagcuguuccagcgcguggggaucaucccgcccaagggcugccugcucuacgggccgcccggcaccggcaagacccugcuggcccgggcgguggccucccagcucgacugcaacuuccugaaggucgugagcuccagcaucguggacaaguacaucggggaguccgcccgccugauccgggagauguucaacuacgcccgcgaccaccagcccugcaucaucuucauggacgagaucgacgcgaucggcgggcggcgcuucagcgagggcacguccgccgaccgggagauccagcgcacccucauggagcugcugaaccagauggacggcuucgacacccuccaccgcgucaagaugaucauggccaccaaccggcccgacacgcuggaccccgcccugcuccgccccgggcggcuggaccgcaagauccacaucgaccugcccaacgagcaggcccggcucgacauccugaagauccacgcgggccccaucaccaagcacggggagaucgacuacgaggccaucgugaagcugagcgacggcuucaacggggccgaccuccgcaacgugugcaccgaggccggcauguucgccauccgggcggaccacgacuucgucgugcaggaggacuucaugaaggccgugcgcaaggucgccgacuccaagaagcuggagagcaagcuggacuacaagcccguguga

SEQ ID NO: 35191 - RNA, 681 nt, Artificial Sequence
  derived and/or modified sequence opt1 from PSMD10__Homo_sapiens__NP_002805
auggagggcugcgugagcaaccugauggucugcaaccucgccuacuccgggaagcuggaggagcugaaggagagcauccucgccgacaagucccuggcgacccgcaccgaccaggacagccggaccgcccugcacugggccugcuccgccggccacaccgagaucguggaguuccuccugcagcugggggugcccgucaacgacaaggacgacgccggcuggagcccgcuccacaucgcggccuccgccgggcgcgacgagaucgugaaggcccugcugggcaagggcgcccaggugaacgcggucaaccagaacgggugcacgccccuccacuacgccgccagcaagaaccggcacgagaucgccgugaugcugcuggagggcggggcgaaccccgacgccaaggaccacuacgaggccaccgccaugcaccgcgccgcggccaagggcaaccucaagaugauccacauccugcuguacuacaaggccuccaccaacauccaggacaccgaggggaacacgccccuccaccuggccugcgacgaggagcggguggaggaggccaagcugcucgucagccagggcgcguccaucuacaucgagaacaaggaggagaagaccccgcuccagguggccaagggcgggcugggccugauccugaagcgcaugguggagggguga

SEQ ID NO: 35192 - RNA, 1371 nt, Artificial Sequence
  derived and/or modified sequence opt1 from PSMD12__Homo_sapiens__NP_002807
auggccgacggcgggagcgagcgcgccgacggccggaucgugaagauggaggucgacuacuccgcgaccguggaccagcgccugcccgagugcgccaagcucgccaaggaggggcggcugcaggaggugaucgagacccugcucagccuggagaagcagacgcgcaccgccuccgacauggucagcaccucccggauccugguggccguggucaagaugugcuacgaggcgaaggagugggaccuccugaacgagaacaucaugcugcucagcaagcgccggucccagcugaagcaggccguggccaagauggugcagcagugcugcaccuacgucgaggagaucacggaccugccgaucaagcuccgccugaucgacacccugcggauggugaccgagggcaagaucuacguggagaucgagcgcgcccggcucaccaagacgcuggcgaccaucaaggagcagaacggggacgucaaggaggccgccagcauccugcaggagcuccagguggagaccuacggcuccauggagaagaaggagcgcguggaguucauccuggagcagaugcggcugugccucgccgucaaggacuacauccgcacccagaucaucagcaagaagaucaacacgaaguucuuccaggaggagaacaccgagaagcugaagcugaaguacuacaaccucaugauccagcuggaccagcacgagggcuccuaccugagcaucugcaagcacuaccgggccaucuacgacacccccugcauccaggcggaguccgagaaguggcagcaggcccucaagagcguggugcuguacgucauccuggcccccuucgacaacgagcaguccgaccucgugcaccgcaucagcggggacaagaagcuggaggagauccccaaguacaaggaccugcucaagcuguucaccacgauggagcugaugcggugguccacccucguggaggacuacggcauggagcugcgcaaggggagccuggaguccccggccaccgacgucuucggcagcaccgaggagggggagaagcgguggaaggaccucaagaaccgcgugguggagcacaacauccggaucauggccaaguacuacacgcgcaucaccaugaagcgcauggcgcagcugcuggaccucagcgucgacgaguccgaggccuuccugagcaaccugguggucaacaagaccaucuucgccaagguggaccggcucgccggcaucaucaacuuccagcgccccaaggaccccaacaaccugcugaacgacuggucccagaagcucaacagccugaugucccuggugaacaagaccacgcaccugaucgccaaggaggagaugauccacaaccuccaguga

SEQ ID NO: 35193 - RNA, 1131 nt, Artificial Sequence
  derived and/or modified sequence opt1 from PSMD13__Homo_sapiens__NP_002808
augaaggacgugcccggcuuccugcagcagagccagaacuccgggccgggccagcccgccgucuggcaccgccucgaggagcuguacaccaagaagcuguggcaccagcucacccuccaggugcuggacuucgugcaggaccccugcuucgcccagggggacggccugaucaagcuguacgagaacuucaucagcgaguucgagcaccgggucaacccccugucccucguggagaucauccugcacgugguccgccagaugacggacccgaacguggcgcugaccuuccucgagaagacccgggagaaggucaagagcuccgacgaggccgugauccugugcaagaccgccaucggggcccugaagcucaacaucggcgaccuccaggugacgaaggagaccaucgaggacguggaggagaugcugaacaaccugcccggcgucaccagcgugcacucccgcuucuacgaccugagcuccaaguacuaccagaccaucgggaaccacgccagcuacuacaaggacgcgcugcgguuccucggcugcguggacaucaaggaccugcccgucuccgagcagcaggagcgcgccuucacgcuggggcucgccggccugcugggggagggcguguucaacuucggcgagcuccugaugcaccccgugcuggagagccuccggaacaccgaccgccaguggcugaucgacacccuguacgccuucaacuccgggaacgucgagcgguuccagacccucaagacggcguggggccagcagccggaccuggccgccaacgaggcccagcugcuccgcaagauccagcugcugugccucauggagaugaccuucacccggcccgccaaccaccgccagcugaccuucgaggagaucgccaagagcgcgaagaucacggugaacgagguggagcugcucgucaugaaggcccuguccguggggcuggugaagggcagcaucgacgaggucgacaagcgggugcacaugaccuggguccagccccgcgugcucgaccugcagcagaucaagggcaugaaggaccggcuggaguucuggugcaccgacgugaaguccauggagaugcucgucgagcaccaggcccacgacauccugaccuga

SEQ ID NO: 35194 - RNA, 933 nt, Artificial Sequence
  derived and/or modified sequence opt1 from PSMD14__Homo_sapiens__NP_005796
auggaccgccugcuccggcugggcgggggcaugcccgggcugggccaggggccgcccaccgacgcccccgccguggacaccgcggagcaggucuacaucagcucccucgcccugcugaagaugcucaagcacggccgcgccggcgugcccauggaggugauggggcugaugcugggcgaguucgucgacgacuacacggugcgggugaucgacgucuucgccaugccgcagagcgggaccggcguguccguggaggccgucgaccccguguuccaggcgaagaugcucgacaugcugaagcagaccgggcgccccgagaugguggucggcugguaccacagccaccccggcuucgggugcuggcuguccggcguggacaucaacacccagcagagcuucgaggcccucuccgagcgggccguggccgucgugguggacccgauccagagcgucaaggggaagguggugaucgacgcguuccgccugaucaacgccaacaugaugguccugggccacgagccccggcagacgaccuccaaccucggccaccugaacaagcccagcauccaggcccugauccacgggcucaaccgccacuacuacuccaucaccaucaacuaccggaagaacgagcuggagcagaagaugcugcucaaccugcacaagaaguccuggauggagggccugacccuccaggacuacagcgagcacugcaagcacaacgagagcguggugaaggagaugcuggagcuggccaagaacuacaacaaggccgucgaggaggaggacaagaugacgcccgagcagcucgcgaucaagaacguggggaagcaggacccgaagcgccaccuggaggagcacgucgacgugcugaugaccuccaacaucgugcagugccucgccgccaugcuggacaccgucguguucaaguga

SEQ ID NO: 35195 - RNA, 2769 nt, Artificial Sequence
  derived and/or modified sequence opt1 from PSMD1__Homo_sapiens__NP_001177966
augaucaccagcgccgccggcaucaucucccugcucgacgaggacgagccccagcugaaggaguucgcgcugcacaagcucaacgccguggucaacgacuucugggccgagaucagcgaguccguggacaagaucgaggugcuguacgaggacgagggguuccgcagccggcaguucgccgcccuggucgcguccaagguguucuaccaccucggcgccuucgaggagagccugaacuacgcccugggggccggcgaccucuucaacgugaacgacaacuccgaguacgucgagaccaucaucgcgaagugcaucgaccacuacacgaagcagugcguggagaacgccgaccugccggagggggagaagaagcccaucgaccagcgccuggagggcaucgugaacaagauguuccagcggugccucgacgaccacaaguacaagcaggccaucggcaucgcccuggagacccgccggcuggacgucuucgagaagaccauccucgagagcaacgacgugcccgggaugcuggccuacucccugaagcucugcaugagccugaugcagaacaagcaguuccgcaacaaggugcugcggguccucgugaagaucuacaugaaccuggagaagcccgacuucaucaacgugugccagugccugaucuuccucgacgacccgcaggcggucuccgacauccuggagaagcuggugaaggaggacaaccuccugauggccuaccagaucugcuucgaccuguacgagagcgccucccagcaguuccucagcuccgugauccagaaccugcgcaccgucggcacgcccaucgccagcgugcccggguccaccaacaccggcaccgugcccgggagcgagaaggacuccgacagcauggagacggaggagaagaccagcuccgccuucgucggcaagaccccggaggcgagccccgagcccaaggaccagacccugaagaugaucaagauccucuccggcgagauggccaucgagcugcaccuccaguuccugauccggaacaacaacacggaccugaugauccugaagaacaccaaggacgccgugcgcaacagcgugugccacaccgccaccgucaucgccaacuccuucaugcacugcgggacgaccagcgaccaguuccuccgggacaaccuggaguggcuggcgcgcgccaccaacugggccaaguucaccgccacggccucccucggcgugauccacaaggggcacgagaaggaggcgcugcagcugauggccaccuaccuccccaaggacaccagcccgggcuccgccuaccaggagggcgggggccuguacgcccuggggcucauccacgcgaaccacggcggggacaucaucgacuaccugcugaaccagcugaagaacgccagcaacgacaucguccggcacggcggcucccucgggcugggccuggccgccauggggaccgcccgccaggacguguacgaccuccugaagacgaaccuguaccaggacgacgcggugaccggcgaggccgccgggcucgcccugggccuggucaugcucggcagcaagaacgcccaggcgaucgaggacauggugggguacgcccaggagacccagcacgagaagauccugcggggccuggccguggggaucgcccucgucauguacggccgcauggaggaggccgacgcgcugaucgagucccugugccgggacaaggaccccauccuccgccggagcgggauguacaccguggccauggccuacugcggcuccggcaacaacaaggccauccgccggcugcugcacguggcggucagcgacgugaacgacgacgugcgccgcgccgccgucgagucccucggguucauccuguuccggacgcccgagcagugccccagcguggugucccugcucagcgagagcuacaacccgcacguccgcuacggcgccgccauggcgcuggggaucugcugcgccggcaccggcaacaaggaggccaucaaccugcucgagcccaugaccaacgaccccgugaacuacgugcggcagggggcccugaucgccuccgcgcugaucaugauccagcagaccgagaucacgugccccaaggucaaccaguuccgccagcucuacagcaaggugaucaacgacaagcacgacgacgugauggccaaguucggcgccauccuggcccaggggauccuggacgccggcgggcacaacgucaccaucucccuccagagccggaccggccacacccacaugccguccguggugggcguccugguguucacgcaguucugguucugguucccccugagccacuuccucucccuggcguacaccccgaccugcgugaucgggcugaacaaggaccucaaggucagcaccgccgugcuguccaucaccgccaaggccaagaagaaggagaaggagaaggagaagaaggaggaggagaagauggagguggacgaggcggagaagaaggaggagaaggagaagaagaaggagcccgagcccaacuuccagcugcucgacaaccccgcccgcgucaugcccgcccagcugaaggugcugacgaugcccgagaccugccgguaccagccguucaagccccucagcaucggcgggaucaucauccugaaggacaccuccgaggacaucgaggagcugguggagcccgucgccgcccacggcccgaagaucgaggaggaggagcaggagcccgagccgcccgagcccuucgaguacaucgacgacuga

SEQ ID NO: 35196 - RNA, 2250 nt, Artificial Sequence
  derived and/or modified sequence opt1 from PSMD2__Homo_sapiens__NP_001265638
augagcauguccggcgagguggccaaggaguggcaggagcuggacgacgccgagaagguccagcgcgagccccuccugacccuggugaaggagaucgugccguacaacauggcgcacaacgccgagcacgaggccugcgaccuccugauggagaucgagcaggucgacaugcuggagaaggacaucgacgagaacgccuacgccaaggugugccucuaccugaccagcugcgugaacuacguccccgagcccgagaacuccgcgcugcuccggugcgcccuggggguguuccgcaaguucagccgguuccccgaggcccugcgccucgcccugaugcugaacgacauggagcucguggaggacaucuucacguccugcaaggacgucguggugcagaagcagauggcguucaugcugggccggcacggggucuuccuggagcucagcgaggacguggaggaguacgaggaccugaccgagaucauguccaacgugcagcugaacagcaacuuccucgcccuggcccgcgagcuggacaucauggagccgaagguccccgacgacaucuacaagacccaccucgagaacaaccgguucggcggguccggcagccagguggacuccgcccgcaugaaccuggccagcuccuucgugaacggcuucgucaacgcggccuucgggcaggacaagcugcucaccgacgacggcaacaaguggcuguacaagaacaaggaccacgggaugcugagcgccgccgccucccucggcaugauccugcugugggacguggacgggggccucacgcagaucgacaaguaccuguacagcuccgaggacuacaucaagagcggcgcgcugcucgccugcgggaucgugaacuccggcguccggaacgagugcgaccccgcccuggcccugcucagcgacuacgugcugcacaacagcaacaccaugcgccugggguccaucuucggccucggccuggccuacgcggggagcaaccgggaggacgugcugacccuccugcugcccgucaugggcgacuccaagagcuccauggagguggccggggucaccgcccucgccugcggcaugaucgccguggggagcugcaacggcgacgugacguccaccauccugcagaccaucauggagaaguccgagaccgagcugaaggacacguacgcgcgcuggcugccgcucggccuggggcugaaccaccucggcaagggggaggccaucgaggccauccuggccgcgcuggaggucgugagcgagcccuuccggagcuucgccaacacccucguggacgucugcgccuacgccggcuccgggaacgugcugaaggugcagcagcugcuccacaucugcagcgagcacuucgacuccaaggagaaggaggaggacaaggacaagaaggagaagaaggacaaggacaagaaggaggcccccgcggacaugggcgcccaccagggcgucgccgugcuggggaucgcccugaucgccaugggcgaggagaucggggcggagauggcccuccgcaccuucggccaccuccugcgguacggggagcccacccugcgccgggccgugccgcuggcccuggcccucaucagcgucuccaacccccgccugaacauccuggacacgcucagcaaguucucccacgacgcggaccccgaggugagcuacaacuccaucuucgccaugggcauggugggcagcgggaccaacaacgcccggcuggccgcgaugcugcgccagcucgcccaguaccacgccaaggaccccaacaaccuguucaugguccggcuggcccagggccucacccaccuggggaagggcacccugacgcucugcccguaccacagcgaccgccagcugaugucccagguggccguggcgggccugcucaccguccuggugagcuuccuggacgugcgcaacaucauccucgggaagucccacuacguccuguacggccugguggccgccaugcagccccggaugcucgugaccuucgacgaggagcugcgcccccugcccgucagcgugcggguggggcaggccgucgacguggugggccaggccgggaagccgaagaccaucacgggcuuccagacccacaccacccccguccuccuggcgcacggcgagcgcgccgagcuggccacggaggaguuccuccccgugacccccauccuggagggguucgugauccugcggaagaacccgaacuacgaccucuga

SEQ ID NO: 35197 - RNA, 1605 nt, Artificial Sequence
  derived and/or modified sequence opt1 from PSMD3__Homo_sapiens__NP_002800
augaagcaggagggcagcgcccgccggcgcggggccgacaaggcgaagcccccgcccggcgggggcgagcaggagcccccgcccccgcccgcgccccaggacguggagaugaaggaggaggccgccaccgggggcggcuccaccggggaggccgacggcaagacggccgccgccgccgcggagcacagccagcgggagcuggacaccgucacccucgaggacaucaaggagcacgugaagcagcuggagaaggccguguccgggaaggagccccgcuucguccugcgggcccuccgcaugcugcccagcaccucccggcgccugaaccacuacgugcucuacaaggccgugcagggcuucuucacgagcaacaacgccacccgggacuuccugcugcccuuccucgaggagcccauggacaccgaggcggaccugcaguuccgcccgcggaccgggaaggccgccuccacgccccugcuccccgaggucgaggccuaccugcagcugcucguggugaucuucaugaugaacagcaagcgcuacaaggaggcccagaagaucuccgacgaccugaugcagaagaucagcacccagaaccggcgcgcgcuggaccucgucgccgccaagugcuacuacuaccacgcccggguguacgaguuccuggacaagcuggacgugguccgcuccuuccuccacgcccggcugcgcaccgcgacccugcggcacgacgccgacggccaggccacgcuccugaaccugcuccugcgcaacuaccugcacuacagccucuacgaccaggccgagaagcugguguccaagagcguguuccccgagcaggccaacaacaacgagugggcgcgguaccuguacuacaccggccgcaucaaggccauccagcucgaguacuccgaggcccgccggaccaugaccaacgcccugcgcaaggcgccgcagcacacggccgucggguucaagcagaccgugcacaagcugcucaucguggucgagcugcugcucggcgagauccccgaccggcugcaguuccgccagcccagccugaagcggucccucaugcccuacuuccugcugacccaggccgugcgcaccgggaaccucgccaaguucaaccaggugcuggaccaguucggcgagaaguuccaggccgacggcacguacacccugaucauccggcuccgccacaacgucaucaagaccggggugcggaugaucagccuguccuacagccgcaucagccuggcggacaucgcccagaagcugcagcucgacuccccggaggacgccgaguucaucguggccaaggccauccgggacggcgucaucgaggcgagcaucaaccacgagaagggguacgugcaguccaaggagaugaucgacaucuacagcacccgcgagccccagcuggccuuccaccagcggaucuccuucugccuggacauccacaacaugagcgucaaggccaugcgcuucccgcccaaguccuacaacaaggaccucgagagcgccgaggagcggcgcgagcgggagcagcaggaccuggaguucgccaaggagauggcggaggacgacgacgacuccuuccccuga

SEQ ID NO: 35198 - RNA, 1134 nt, Artificial Sequence
  derived and/or modified sequence opt1 from PSMD4__Homo_sapiens__NP_002801
auggugcuggagagcaccauggucugcguggacaacuccgaguacaugcgcaacggcgacuuccuccccacccggcugcaggcccagcaggacgccgugaacaucgucugccacagcaagacgcgcuccaacccggagaacaacguggggcugaucacccucgcgaacgacugcgaggugcugaccacccugacgcccgacaccggccggauccucagcaagcugcacaccguccagcccaaggggaagaucaccuucugcacgggcauccgcguggcccaccuggcccucaagcaccggcaggggaagaaccacaagaugcgcaucaucgccuucgugggcucccccgucgaggacaacgagaaggaccuggugaagcuggccaagcggcucaagaaggagaaggugaacgucgacaucaucaacuucggcgaggaggaggugaacaccgagaagcugaccgcguucgugaacacccugaacgggaaggacggcacggggagccaccucgucaccgugccgcccggccccucccuggccgacgcccugaucagcucccccauccucgccggggagggcggcgcgaugcuggggcugggcgccagcgacuucgaguucgggguggacccguccgccgaccccgagcucgcccuggcccugcgcgucagcauggaggagcagcggcagcgccaggaggaggaggcgcggcgcgccgccgccgccuccgcggccgaggccggcaucgccaccaccggcacggaggacagcgacgacgcccuccugaagaugaccaucucccagcaggaguucgggcggaccggccugcccgaccucagcuccaugaccgaggaggagcagaucgcguacgccaugcagaugagccugcagggggccgaguucggccaggccgaguccgccgacaucgacgcgagcagcgccauggacacguccgagcccgccaaggaggaggacgacuacgacgugaugcaggacccggaguuccugcagagcgugcucgagaaccugcccggggucgaccccaacaacgaggccauccgcaacgcgaugggcucccuggccagccaggccaccaaggacggcaagaaggacaagaaggaggaggacaagaaguga

SEQ ID NO: 35199 - RNA, 1329 nt, Artificial Sequence
  derived and/or modified sequence opt1 from PSMD6__Homo_sapiens__NP_001258708
augccccuggagaaccucgaggaggagggccugccgaagaaccccgaccugcgcaucgcccagcuccgguuccugcugagccuccccgagcaccgcggggacgccgcggugcgggacgagcugauggccgccguccgcgacaacaacuucuggaaccggauccgccaggagcagaccgaggacugcccgcccuccagccccucccggggcuggcacugccaggacuggcccagccgcaagcccccgaccuccauccggcugugcuucgccaagcccaucaucaagcgccaccggaugcccagcuacauggcccccuacuacgaggcgcucugcaagucccuggacuggcagaucgacguggaccugcucaacaagaugaagaaggccaacgaggacgagcugaagcgccuggacgaggagcucgaggacgccgagaagaaccugggggagagcgagauccgggacgccaugauggcgaaggccgaguaccugugccgcaucggcgacaaggagggggcccucacggccuuccggaagaccuacgacaagaccguggcccugggccaccgccuggacaucgucuucuaccuccugcggaucggccuguucuacauggacaacgaccucaucacccgcaacacggagaaggcgaagucccugaucgaggagggcggggacugggaccggcgcaaccggcugaagguguaccaggggcucuacugcguggccauccgcgacuucaagcaggccgccgagcuguuccuggacaccgucagcaccuucaccuccuacgagcucauggacuacaagacguucgugaccuacaccguguacgucagcaugaucgcccuggagcgcccggaccugcgggagaaggugaucaagggcgcggagauccucgaggugcugcacucccugcccgccguccgccaguaccucuucagccuguacgagugccgguacuccguguucuuccagagccuggccguggucgagcaggagaugaagaaggacuggcuguucgcgccccacuaccgcuacuacgugcgggagaugcgcauccacgccuacucccagcuccuggagagcuaccggucccucacccugggguacauggccgaggccuucggcgugggcgucgaguucaucgaccaggagcugagccgcuucaucgccgccgggcggcuccacugcaagaucgacaaggugaacgagaucguggagacgaaccgccccgacagcaagaacuggcaguaccaggagaccaucaagaagggcgaccugcugcucaaccggguccagaagcugucccgcgugaucaacauguga

SEQ ID NO: 35200 - RNA, 975 nt, Artificial Sequence
  derived and/or modified sequence opt1 from PSMD7__Homo_sapiens__NP_002802
augcccgagcuggccgugcagaaggucguggugcacccgcucguccugcugagcgugguggaccacuucaaccgcaucggcaaggucgggaaccagaagcggguggugggcguccuccuggggagcuggcagaagaaggugcuggacgugagcaacuccuucgccguccccuucgacgaggacgacaaggacgacagcgugugguuccucgaccacgacuaccuggagaacauguacggcauguucaagaaggugaacgcgcgcgagcggaucgucgggugguaccacaccggccccaagcugcacaagaacgacaucgccaucaacgagcucaugaagcgcuacugccccaacuccgugcuggugaucaucgacgucaagccgaaggaccugggccuccccaccgaggccuacaucagcguggaggaggugcacgacgacgggacgcccaccuccaagaccuucgagcacgucaccagcgagaucggcgccgaggaggccgaggagguggggguggagcaccuccugcgggacaucaaggacacgaccgucggcacccugucccagcgcaucaccaaccaggugcacgggcugaagggccugaacagcaagcuccuggacauccgguccuaccuggagaaggucgcgacgggcaagcuccccaucaaccaccagaucaucuaccagcugcaggacguguucaaccugcucccggacgugagccugcaggaguucgucaaggccuucuaccugaagaccaacgaccagauggugguggucuaccucgccucccugauccgcagcgugguggcccugcacaaccucaucaacaacaagaucgcgaaccgggacgccgagaagaaggaggggcaggagaaggaggaguccaagaaggaccgcaaggaggacaaggagaaggacaaggacaaggagaaguccgacgucaagaaggaggagaagaaggagaagaaguga

SEQ ID NO: 35201 - RNA, 1053 nt, Artificial Sequence
  derived and/or modified sequence opt1 from PSMD8__Homo_sapiens__NP_002803
auguucaucaagggccgcgcgccccgggccccgccccgcgagcggcgccgggccacccgcgggggccugcgccaggugguggccccgccccgggcccucgggagcaccucccggccccacuuccgccgggccagcgugugccgccggcgcugccggaaguccggcgggcugcuggccgcgagccgcaagauggccgccgccgcggugaacggcgccgccggcuucuccagcuccgggcccgccgccacgagcggcgcgguccuccaggccgccaccgggauguacgagcagcugaagggcgaguggaaccggaagucccccaaccugagcaagugcggggaggagcucggccgccugaagcuggugcuccuggagcugaacuuccuccccaccaccggcacgaagcugaccaagcagcagcugauccucgcccgggacauccuggagaucggggcccagugguccauccugcgcaaggacaucccgagcuucgagcgguacauggcgcagcucaagugcuacuacuucgacuacaaggagcagcugcccgaguccgccuacaugcaccagcugcucggccugaaccuccuguuccugcugagccagaaccgcguggccgaguuccacaccgagcucgagcgccugcccgccaaggacauccagaccaacgucuacaucaagcaccccgugucccuggagcaguaccucauggaggggagcuacaacaagguguuccuggccaagggcaacaucccggcggaguccuacacguucuucaucgacauccugcucgacaccauccgggacgagaucgccggcugcaucgagaaggccuacgagaagauccuguucaccgaggccacccgcauccuguucuucaacacgcccaagaagaugaccgacuacgccaagaagcggggguggguccucggccccaacaacuacuacagcuucgcgucccagcagcagaagcccgaggacaccaccaucccgagcacggagcuggccaagcaggucaucgaguacgcccgccagcuggagaugaucguguga

SEQ ID NO: 35202 - RNA, 672 nt, Artificial Sequence
  derived and/or modified sequence opt1 from PSMD9__Homo_sapiens__NP_002804
augagcgacgaggaggcccgccaguccggcgggagcucccaggccggcguggucaccgugagcgacgugcaggagcugaugcggcgcaaggaggagaucgaggcgcagaucaaggccaacuacgacguccucgagucccagaaggggaucggcaugaacgagccccugguggacugcgagggguacccgcggagcgacguggaccuguaccagguccgcaccgcccggcacaacaucaucugccuccagaacgaccacaaggccgugaugaagcaggucgaggaggcccugcaccagcugcacgcgcgcgacaaggagaagcaggcccgggacauggccgaggcccacaaggaggcgaugucccgcaagcucggccagagcgagucccagggcccgccccgggccuucgccaaggugaacagcaucucccccgggagccccgccuccaucgccggccuccagguggacgacgagaucguggaguucgggagcgucaacacgcagaacuuccagucccugcacaacaucggcagcguggugcagcacuccgaggggaagccccugaacgucaccgugauccgccggggcgagaagcaccagcugcgccuggugcccacccggugggcgggcaaggggcuccugggcugcaacaucaucccccugcagcgcuga

SEQ ID NO: 35203 - RNA, 750 nt, Artificial Sequence
  derived and/or modified sequence opt1 from PSME1__Homo_sapiens__NP_006254
auggccaugcugcgcgugcagcccgaggcccaggcgaaggucgacguguuccgggaggaccucugcaccaagaccgagaaccugcugggcagcuacuucccgaagaagaucuccgagcucgacgccuuccugaaggagcccgcccugaacgaggccaaccucagcaaccugaaggcgccccuggacauccccgugccggaccccgucaaggagaaggagaaggaggagcgcaagaagcagcaggagaaggaggacaaggacgagaagaagaagggggaggacgaggacaagggcccgcccugcgggcccgugaacugcaacgagaagaucgugguccuccugcagcggcugaagcccgagaucaaggacgugaucgagcagcucaaccuggugacgaccuggcugcagcuccagaucccccgcaucgaggacggcaacaacuucggggucgccgugcaggagaagguguucgagcugaugaccucccugcacaccaagcucgagggcuuccacacgcagaucagcaaguacuucuccgagcggggcgacgccgucaccaaggccgccaagcagccccacgugggggacuaccgccagcuggugcacgagcuggacgaggcggaguaccgggacauccgccucauggucauggagauccggaacgccuacgccgugcuguacgacaucauccugaagaacuucgagaagcucaagaagccgcgcggcgagaccaaggggaugaucuacuga

SEQ ID NO: 35204 - RNA, 720 nt, Artificial Sequence
  derived and/or modified sequence opt1 from PSME2__Homo_sapiens__NP_002809
auggccaagcccugcggcgugcgccugagcggggaggcccggaagcaggucgagguguuccgccagaaccucuuccaggaggcggaggaguuccuguaccgguuccugccgcagaagaucaucuaccucaaccagcugcugcaggaggacucccucaacguggccgaccugaccagccugcgcgcgccccucgacauccccauccccgacccgccgcccaaggacgacgagauggagaccgacaagcaggagaagaaggagguccacaagugcggcuuccugcccgggaacgagaaggugcugucccuccuggcccuggugaagcccgaggucuggacgcucaaggagaagugcauccuggugaucaccuggauccagcaccugauccccaagaucgaggacggcaacgacuucgggguggccauccaggagaagguccucgagcgggugaacgccgugaagaccaaggucgaggccuuccagaccacgaucagcaaguacuucuccgagcgcggcgacgccguggccaaggcgagcaaggagacccacgugauggacuaccgggcccugguccacgagcgcgacgaggccgccuacggcgagcugcgggccauggugcucgaccugcgcgcguucuacgccgagcuguaccacaucaucuccagcaaccucgagaagaucgugaaccccaagggggaggagaagcccuccauguacuga

SEQ ID NO: 35205 - RNA, 798 nt, Artificial Sequence
  derived and/or modified sequence opt1 from PSME3__Homo_sapiens__NP_001253974
auggagaaguggauccugaagaagaucaaguaccuccagagcggcgggcuguccgccagcuacuacuccuacaagguggacagcuuccgcgagcggaucaccuccgaggccgaggaccuggucgcgaacuucuuccccaagaagcuccuggagcuggacagcuuccucaaggagccgauccugaacauccacgaccugacccagauccacuccgacaugaaccuccccgugcccgaccccauccugcugacgaacagccacgacggccucgacgggccgaccuacaagaagcgccggcuggacgagugcgaggaggccuuccagggcaccaagguguucgucaugcccaacgggaugcugaaguccaaccagcagcucguggacaucaucgagaaggugaagcccgagauccgccugcugaucgagaagugcaacaccgucaagaugugggugcagcuccugaucccccggaucgaggacggcaacaacuucggcgugagcauccaggaggagacggucgccgagcugcgcaccguggaguccgaggccgccagcuaccucgaccagaucucccgguacuacaucacccgcgcgaagcuggugagcaagaucgccaaguacccgcacgucgaggacuaccggcgcaccgugacggagaucgacgagaaggaguacaucucccugcggcucaucaucagcgagcugcgcaaccaguacgugacccugcacgacaugauccucaagaacaucgagaagaucaagcggccccgcuccagcaacgccgagacccuguacuga

SEQ ID NO: 35206 - RNA, 5532 nt, Artificial Sequence
  derived and/or modified sequence opt1 from PSME4__Homo_sapiens__NP_055429
auggagcccgccgagcgcgccggggugggggagccgcccgagcccggcgggcggcccgagcccggcccccgcggguucgucccccagaaggagaucguguacaacaagcugcuccccuacgcggagcggcuggacgccgagagcgaccugcagcucgcccagaucaagugcaaccugggccgcgccgugcagcugcaggagcucuggcccggcgggcuguucuggacccggaagcugagcaccuacauccgccucuacggccggaaguucagcaaggaggaccacguccuguucaucaagcugcucuacgagcugguguccauccccaagcuggagaucagcaugaugcagggguucgcccgccuccugaucaaccugcucaagaagaaggagcugcugucccgggcggaccucgagcugcccuggcgcccccuguacgacaugguggagcggauccucuacagcaagacggagcaccugggccugaacugguuccccaacuccgucgagaacauccucaagacccuggugaaguccugccgccccuacuuccccgccgacgccaccgccgagaugcuggaggaguggcggccccucaugugcccguucgacgugaccaugcagaaggcgaucacguacuucgagaucuuccugcccaccucccugccgcccgagcuccaccacaagggguucaagcugugguucgacgagcugaucggccucugggucagcgugcagaaccugccgcagugggagggccagcuggugaaccucuucgcccgccuggccaccgacaacaucggguacaucgacugggaccccuacguccccaagaucuucacccggauccugcgcucccucaaccugcccgugggcagcucccaggugcuggucccgcgguuccucacgaacgccuacgacaucgggcacgccgugaucuggaucaccgcgaugaugggcggccccagcaagcuggugcagaagcaccuggccggccuguucaacuccaucaccagcuucuaccaccccuccaacaacggccgcuggcugaacaagcugaugaagcugcuccagcggcugcccaacagcgucgugcgccggcugcaccgcgagcgcuacaagaagccguccuggcucacccccgugcccgacagccacaagcugacggaccaggacgucaccgacuucgugcagugcaucauccagccggugcugcucgccauguucagcaagaccgggucccuggaggccgcccaggcgcugcagaaccucgcccugaugcggcccgagcuggucaucccgcccgugcucgagcgcaccuacccggcccuggagacgcugaccgagccccaccagcucaccgccacccugagcugcgucaucggcguggcccggucccuggugagcgggggccgcugguuccccgagggccccacgcacaugcucccgcugcugaugcgggcgcuccccggggucgaccccaacgacuucuccaagugcaugaucaccuuccaguucaucgccaccuucagcacccuggugccccugguggacugcuccagcguccuccaggagcgcaacgaccugacggagguggagcgggagcugugcuccgccaccgccgaguucgaggacuucgugcuccaguucauggaccgcugcuucggccugaucgagagcuccacccuggagcagacccgggaggagacggagaccgagaagaugacccaccucgagagccuggucgagcuggggcucuccagcaccuucuccacgauccugacccagugcagcaaggagaucuucaugguggcccugcagaagguguucaacuucuccaccagccacaucuucgagacccgcgucgcgggccggaugguggccgacaugugccgcgccgccgugaagugcugcccggaggagucccucaagcuguucgucccccacugcugcagcgugaucacgcagcugaccaugaacgacgacgugcucaacgacgaggagcuggacaaggagcugcucuggaaccugcagcugcucagcgagaucacccgggucgacgggcgcaagcugcugcucuaccgggagcagcuggugaagauccugcagcgcacccuccaccugaccugcaagcagggcuacacgcuguccugcaaccuccugcaccaccuccuccggagcaccacccugaucuaccccaccgaguacugcuccgugcccggcggguucgacaagccgcccagcgaguacuuccccaucaaggacuggggcaagcccggggaccuguggaaccucggcauccaguggcacgucccguccagcgaggagguguccuucgcguucuaccugcuggacagcuuccuccagcccgagcuggugaagcugcagcacugcggggacggcaagcucgagaugucccgcgacgacauccugcagagccugacgaucguccacaacugccucaucggcuccgggaaccugcugccgccccucaagggcgagccggugaccaaccuggugcccagcauggucucccuggaggagaccaagcucuacaccgggcuggaguacgaccugagccgggagaaccaccgcgaggugaucgccacggugauccgcaagcuccugaaccacauccuggacaacuccgaggacgacaccaagagccucuuccugaucaucaagaucaucggcgaccugcuccaguuccagggcucccacaagcacgaguucgacagccgguggaaguccuucaaccuggucaagaaguccauggagaaccgccugcacgggaagaagcagcacauccgggcccuccugaucgaccgcgugaugcugcagcacgagcuccggacccugaccguggagggcugcgaguacaagaagauccaccaggacaugauccgcgaccugcuccggcugagcacguccagcuacucccagguccgcaacaaggcccagcagaccuucuucgccgcgcugggggccuacaacuucugcugccgggacaucaucccccuggugcucgaguuccugcgcccggaccggcagggcgugacccagcagcaguucaagggggcccuguacugccuccugggcaaccacagcggcgucugccuggccaaccuccacgacugggacugcaucgugcagaccuggcccgccaucguguccagcgggcugucccaggcgaugagccuggagaagcccuccaucguccgccucuucgacgaccuggccgagaagauccaccggcaguacgagacgaucggccuggacuucaccauccccaagagcugcguggagaucgccgagcuccugcagcaguccaagaacccgagcaucaaccagauccugcucucccccgagaagaucaaggaggggaucaagcgccagcaggagaagaacgccgacgcccugcggaacuacgagaaccugguggacacccuccuggacggcgucgagcagcgcaaccugcccuggaaguucgagcacaucgggaucggccuccugagccugcuccugcgggacgaccgcgugcugccccuccgggcgauccgcuucuucguggagaaccugaaccacgacgccaucgucgugcggaagauggccaucuccgccguggcgggcauccugaagcagcucaagcgcacccacaagaagcugacgaucaacccgugcgagaucagcgggugccccaagcccacccagaucaucgccggcgaccgccccgacaaccacuggcugcacuacgacuccaagaccaucccgcggaccaagaaggagugggagagcagcugcuucgucgagaagacgcacuggggguacuacaccuggcccaagaacauggugguguacgccggcgucgaggagcagcccaagcucgggcgcucccgggaggacaugaccgaggccgagcagaucaucuucgaccacuucagcgaccccaaguucguggagcagcugaucaccuuccugucccucgaggaccgcaagggcaaggacaaguucaacccgcggcgcuucugccuguucaagggcaucuuccggaacuucgacgacgccuuccugcccguccucaagccccaccuggagcaccugguggcggacagccacgaguccacgcagcgcugcguggccgagaucaucgccgggcucauccggggcagcaagcacuggaccuucgagaaggucgagaagcugugggagcugcucugcccccugcugcgcaccgcccucuccaacaucaccguggagacguacaacgacuggggcgccugcaucgcgaccagcugcgagucccgggacccgcgcaagcugcacuggcuguucgagcuccugcuggagagcccccucuccggcgagggcgggagcuucguggacgccugccggcuguacguccugcagggcgggcucgcccagcaggaguggcgcgugcccgagcugcugcaccggcuccugaaguaccuggagcccaagcucacccagguguacaagaacguccgcgagcggaucggguccgugcugaccuacaucuucaugaucgacgugagccugccgaacacgacccccaccaucagcccccacguccccgaguucaccgcccgcauccucgagaagcugaagccgcugauggacguggacgaggagauccagaaccacgugauggaggagaacgggaucggcgaggaggacgagcggacccagggcaucaagcuccugaagacgauccugaaguggcucauggccagcgcggggcgcuccuucagcaccgccgucaccgagcagcugcagcugcucccccuguucuucaagaucgcccccguggagaacgacaacuccuacgacgagcugaagcgcgacgccaagcucugccugagccugaugagccagggccuccuguacccgcaccaggugccccugguccuccaggugcugaagcagaccgcgcgguccagcuccuggcacgcccgcuacacggugcugaccuaccuccagaccauggucuucuacaaccuguucaucuuccugaacaacgaggacgccgugaaggacauccgguggcucgugaucagccugcuggaggacgagcagcucgagguccgcgagauggccgccaccacgcuguccgggcugcuccagugcaacuuccugaccauggacagccccaugcagauccacuucgagcagcugugcaagaccaagcuccccaagaagcggaagcgcgacccgggcuccgugggggacaccauccccagcgcggagcuggugaagcggcacgccggcguccugggccugggggccugcgugcucuccagccccuacgacgugcccacguggaugccgcagcugcugaugaaccucuccgcccaccugaacgacccccagcccaucgagaugaccgucaagaagacccugagcaacuuccgccggacccaccacgacaacuggcaggagcacaagcagcaguucacggacgaccagcuccuggugcugaccgaccuccuggugucccccugcuacuacgccuga

SEQ ID NO: 35207 - RNA, 816 nt, Artificial Sequence
  derived and/or modified sequence opt1 from PSMF1__Homo_sapiens__NP_848693
auggccggccuggaggugcucuucgccagcgcggcccccgccaucaccugccgccaggacgcccuggucugcuuccugcacugggagguggugacccacggguacuucggccucggggucggcgaccagccggggcccaacgacaagaaguccgagcugcugcccgccggcuggaacaacaacaaggaccucuacgugcugcgguacgaguacaaggacggcagccgcaagcugcucgugaaggcgaucacggucgaguccagcaugauccugaacgugcuggaguacgggucccagcagguggccgaccucacccugaaccuggacgacuacaucgacgccgagcaccucggcgacuuccaccggaccuacaagaacagcgaggagcugcgcucccggaucgucagcgggaucaucacccccauccacgagcagugggagaaggccaacguguccagcccgcaccgcgaguucccccccgcgacggcccgggagguggacccccugcgcaucccgccccaccacccccacaccucccggcagcccccguggugcgacccccucggccccuucgucguggggggcgaggaccuggaccccuucggcccgcgccgggggggcaugaucguggacccccugcgcagcggguucccccgggcccucaucgaccccuccagcggccugccgaaccgccugccccccggcgccguccccccgggggcccgguucgaccccuucggccccaucgggaccucccccccgggccccaaccccgaccaccucccgccccccggguacgacgacauguaccuguga

SEQ ID NO: 35208 - RNA, 867 nt, Artificial Sequence
  derived and/or modified sequence opt1 from PSMG1__Homo_sapiens__NP_003711
auggccgccaccuucuucggcgagguggucaaggcgcccugccgcgccgggaccgaggacgaggaggaggaggaggagggccggcgcgagacgccggaggaccgggaggugcgccugcagcucgcccggaagcgcgaggugcggcugcugcgccggcagaccaagaccagccucgaggucucccugcuggagaaguaccccugcagcaaguucaucaucgccaucgggaacaacgccguggcguuccucuccagcuucgugaugaacuccggcgucugggaggagguggggugcgccaagcuguggaacgaguggugccgcaccacggacaccacccaccugagcuccaccgaggccuucugcguguucuaccaccucaagagcaaccccuccgucuuccugugccagugcagcugcuacguggccgaggaccagcaguaccaguggcuggagaagguguucggcuccugcccccggaagaacaugcagaucacgauccugaccugccgccacgucaccgacuacaagaccagcgaguccacgggcagccucccgucccccuuccugcgggcgcucaagacccagaacuucaaggacagcgccugcugcccccugcuggagcagcccaacaucgugcacgaccucccggccgccgugcuguccuacugccaggucuggaagauccccgccauccuguaccucugcuacaccgacgugaugaagcuggaccugaucaccguggaggcguucaagcccauccucagcacgcgcucccugaaggggcuggucaagaacaucccccagagcaccgagauccucaagaagcugaugaccaccaacgagauccagagcaacaucuacacguga

SEQ ID NO: 35209 - RNA, 795 nt, Artificial Sequence
  derived and/or modified sequence opt1 from PSMG2__Homo_sapiens__NP_064617
auguucgugcccugcggcgagagcgcccccgaccuggccggguucacccuccugaugcccgcggucuccgugggcaacguggggcagcuggccauggaccucaucaucagcacccugaacauguccaagaucggcuacuucuacacggacugccugguccccaugguggggaacaaccccuacgccaccaccgagggcaacagcaccgagcucuccaucaacgccgagguguacagccugccgucccgcaagcuggucgcccuccagcugcggagcaucuucaucaaguacaaguccaagcccuucugcgagaagcugcucagcugggugaaguccagcggcugcgcgcgcgugaucguccuguccagcucccacagcuaccagcggaacgaccugcagcuccgcuccacgcccuuccgguaccugcugacccccagcaugcagaaguccgugcagaacaagaucaagagccucaacugggaggagauggagaagucccgcugcaucccggagaucgacgacagcgaguucugcauccggauccccgggggcgggaucaccaagacccuguacgacgagagcugcuccaaggagauccagauggccgugcugcucaaguucgucagcgagggcgacaacauccccgacgcccuggggcugguggaguaccucaacgaguggcugcagauccugaagccccucuccgacgacccgacggugagcgccucccgcuggaagauccccagcuccuggcggcugcuguucggcagcggccucccgcccgcgcuguucuga

SEQ ID NO: 35210 - RNA, 369 nt, Artificial Sequence
  derived and/or modified sequence opt1 from PSMG3__Homo_sapiens__XP_011513881
auggaggacacgccccuggugaucagcaagcagaagaccgaggucgugugcggcgugccgacccaggucgugugcaccgccuucuccagccacauccucguggucgugacccaguucgggaagaugggcacccuggugucccuggagcccagcuccgucgccagcgacguguccaagcccgugcucacgaccaagguccugcuggggcaggacgagccccucauccacguguucgcgaagaaccugguggccuucgucagccaggaggccggcaaccgcgccgugcugcucgccguggcggucaaggacaaguccauggaggggcugaaggcccugcgggaggugauccgcgugugccaggucugguga

SEQ ID NO: 35211 - RNA, 459 nt, Artificial Sequence
  derived and/or modified sequence opt1 from PSORS1C1__Homo_sapiens__NP_054787
augaccugcaccgaccagaagucccacagccagcgcgcccugggcacgcagacccccgcccuccaggggccccagcugcugaacaccgaccccagcuccgaggagacccggccgccccacgugaaccccgaccgccucugccacauggagcccgcgaaccacuucuggcacgccggcgaccugcaggccaugaucagcaaggaguuccaccuggccgccacgcaggacgacugccggaaggggcgcacccaggaggacauccucguccccuccagccaccccgagcuguucgcguccgugcugccgauggcccccgaggaggccgcccggcuccagcagccccagccccugccgccgcccagcggcauccaccuguccgcgagccgcacccucgcccccacccugcuguacuccagcccgcccucccacagccccuucgggcucuccagccugaucuga

SEQ ID NO: 35212 - RNA, 411 nt, Artificial Sequence
  derived and/or modified sequence opt1 from PSORS1C2__Homo_sapiens__NP_054788
augauccugaacuggaagcuccugggcauccuggugcucugccugcacacccgcgggaucagcggcuccgaggggcaccccagccacccgcccgccgaggaccgggaggaggccggcucccccacccugccccaggggccgcccguccccggcgaccccuggccgggcgcgcccccccucuucgaggaccccccgcccacgcgccccagccggcccuggcgcgaccugccggagaccgggguguggcugcccgagcccccccggaccgacccgccccagcccccccgcccggacgaccccuggcccgccggcccccagccgcccgagaaccccuggccgcccgcccccgagguggacaaccggccccaggaggagccggaccucgaccccccccgcgaggaguaccgguga

SEQ ID NO: 35213 - RNA, 1572 nt, Artificial Sequence
  derived and/or modified sequence opt1 from PSPC1__Homo_sapiens__XP_006719907
augaugcugcgcggcaaccucaagcagguccggaucgagaagaaccccgcccgccugcgggcccuggagagcgcggugggggaguccgagccggccgccgccgccgcgauggcccucgcccuggccggcgagcccgcgccgcccgcccccgccccgcccgaggaccaccccgacgaggagaugggguucaccaucgacaucaagagcuuccugaagcccggcgagaagaccuacacgcagcgcugccgccucuucguggggaaccugcccaccgacaucaccgaggaggacuucaagcggcuguucgagcgguacggcgagcccuccgagguguucaucaaccgcgaccggggcuucggguucauccgccucgagagccggacccuggccgagaucgccaaggcggagcuggacggcacgauccucaagucccgcccccugcggauccgcuucgccacccacggggccgcccugaccgucaagaaccucagcccggugguguccaacgagcugcuggagcaggccuucagccaguucggccccgucgagaaggcggugguggucguggacgaccgggggcgcgccaccggcaagggcuucguggaguucgccgccaagccgcccgcccggaaggcgcucgagcgcugcggggacggcgccuuccugcugacgaccacgccccggcccgucaucguggagcccauggagcaguucgacgacgaggacgggcuccccgagaagcugaugcagaagacccagcaguaccacaaggagcgcgagcagccgccccgguucgcccagcccggcaccuucgaguucgaguacgccucccgcuggaaggcccuggacgagauggagaagcagcagcgcgagcaggucgaccggaacauccgcgaggcgaaggagaagcucgaggccgagauggaggccgcccggcacgagcaccagcugaugcugaugcgccaggaccucaugcggcgccaggaggagcugcggcgccuggaggagcuccggaaccaggagcugcagaagcgcaagcagauccagcugcggcacgaggaggagcaccgccggcgcgaggaggagaugauccggcaccgcgagcaggaggagcuccggcgccagcaggagggcuucaagcccaacuacauggagaaccgggagcaggagaugcgcaugggggacaugggcccgcgcggggcgaucaacaugggcgacgccuucagccccgcccccgccgggaaccaggggcccccgcccaugaugggcaugaacaugaacaaccgggccaccauccccgggccgcccaugggccccgggcccgcgaugggcccggagggggccgccaacaugggcacccccaugaugcccgacaacggcgccgugcacaacgaccgcuucccccaggggccgcccucccagaugggcagccccauggggucccggaccggcagcgagacgccccaggccccgauguccggggugggccccgugagcggcgggcccggcggguucggccgcggcucccagggcggcaacuucgaggggcccaacaagcggcgccgguacuga

SEQ ID NO: 35214 - RNA, 678 nt, Artificial Sequence
  derived and/or modified sequence opt1 from PSPH__Homo_sapiens__XP_011513763
auggugagccacuccgagcugcgcaagcuguucuacagcgccgacgccgucugcuucgacguggacuccaccgugauccgggaggagggcaucgacgagcucgcgaagaucugcggggucgaggacgccgugagcgagaugacccgccgggccaugggcggggccgugcccuucaaggccgcgcugacggagcgccucgcccugauccagcccucccgggagcagguccagcgccugaucgccgagcagccgccccaccucacccccggcauccgggagcuggugagccgccugcaggagcggaacgugcaggucuuccucaucuccgggggcuuccgcagcaucguggagcacguggccuccaagcugaacauccccgcgaccaacgucuucgccaaccggcugaaguucuacuucaacggcgaguacgccggguucgacgagacccagcccacggccgagagcggcgggaagggcaaggugaucaagcuccugaaggagaaguuccacuucaagaagaucaucaugaucggggacggcgccaccgacauggaggcgugcccgcccgccgacgccuucaucggcuucgggggcaacgugauccgccagcaggucaaggacaacgccaagugguacaucaccgacuucguggagcugcucggggagcuggaggaguga

SEQ ID NO: 35215 - RNA, 471 nt, Artificial Sequence
  derived and/or modified sequence opt1 from PSPN__Homo_sapiens__NP_004149
auggccgugggcaaguuccugcucgggagccugcugcuccugucccugcagcucggccagggguggggccccgacgcccgcggggucccgguggcggacggcgaguucagcuccgagcaggucgccaaggccggcgggaccuggcugggcacccaccggccccuggcccgccuccggcgcgcccugagcgggcccugccagcuguggucccucacgcugagcguggcggagcugggccucggguacgccuccgaggagaaggugaucuuccgguacugcgccggcagcugcccccgcggcgcccggacccagcacgggcuggcgcuggcccgccuccagggccaggggcgggcccacggcggcccgugcugccgccccacccgguacaccgacguggccuuccuggacgaccgccaccgguggcagcgccugccccagcucuccgccgcggccugcgggugcggcggguga

SEQ ID NO: 35216 - RNA, 1251 nt, Artificial Sequence
  derived and/or modified sequence opt1 from PSTPIP1__Homo_sapiens__NP_003969
augaugccccagcugcaguucaaggacgccuucuggugccgcgacuucaccgcccacaccggcuacgaggugcuccugcagcggcugcucgacgggcgcaagaugugcaaggacauggaggagcugcugcggcagcgcgcgcaggccgaggagcgguacggcaaggagcucguccagaucgcccgcaaggccgggggccagacggagaucaacagccugcgggccuccuucgacagccugaagcagcagauggagaacgugggguccagccacauccagcucgcgcugacccugcgcgaggagcuccggucccuggaggaguuccgcgagcggcagaaggagcagcgcaagaaguacgaggccgugauggaccggguccagaaguccaagcugagccucuacaagaaggccauggagagcaagaagaccuacgagcagaagugccgcgacgccgacgacgcggagcaggccuucgagcggaucuccgccaacggccaccagaagcaggucgagaagucccagaacaaggcccgccagugcaaggacagcgccaccgaggcggagcggguguaccgccagagcaucgcccagcuggagaaggugcgggccgagugggagcaggagcaccgcacgaccugcgaggccuuccagcugcaggaguucgaccggcucaccauccugcgcaacgcccugugggugcacuccaaccagcucagcaugcagugcgugaaggacgacgagcuguacgaggagguccgccugacccucgagggcugcuccaucgacgcggacaucgacagcuucauccaggccaaguccacggggaccgagccgcccgcccccgugcccuaccagaacuacuacgaccgggaggugaccccgcugaccagcucccccggcauccagcccagcugcgggaugaucaagcgcuucagcggccugcuccacgggucccccaagacgaccagccuggccgccuccgcggccagcaccgagacccugacgccgacccccgagcggaacgagggcgucuacaccgccaucgccgugcaggagauccagggcaaccccgccucccccgcgcaggaguaccgcgcccucuacgacuacaccgcccagaacccggacgagcuggaccugagcgccggggacauccucgaggugauccuggagggcgaggacgggugguggacggucgagcggaacggccagcgcggcuucgugcccggguccuaccuggagaagcucuga

SEQ ID NO: 35217 - RNA, 1005 nt, Artificial Sequence
  derived and/or modified sequence opt1 from PSTPIP2__Homo_sapiens__NP_077748
augacccgcagccuguucaagggcaacuucugguccgccgacauccucagcaccaucggguacgacaacaucauccagcaccugaacaacggccggaagaacugcaaggaguucgaggacuuccugaaggagcgcgccgcgaucgaggagcgguacgggaaggaccuccugaaccugucccgcaagaagcccugcggccagagcgagaucaacacgcucaagcgggcccuggagguguucaagcagcaggucgacaacguggcccagugccacauccagcuggcccagucccuccgcgaggaggcccggaagauggaggaguuccgcgagaagcagaagcugcagcggaagaagaccgagcugaucauggacgcgauccacaagcagaagucccuccaguucaagaagaccauggacgccaagaagaacuacgagcagaagugccgcgacaaggacgaggccgagcaggccgugagccggagcgcgaaccuggucaacccgaagcagcaggagaagcuguucgugaagcucgccaccuccaagacggccguggaggacagcgacaaggccuacaugcugcacaucgggacccuggacaagguccgcgaggaguggcaguccgagcacaucaaggccugcgaggcguucgaggcccaggagugcgagcggaucaacuucuuccgcaacgcccucuggcugcacgugaaccagcugagccagcagugcgugaccuccgacgagauguacgagcagguccgcaagagccucgagaugugcuccauccagcgggacaucgaguacuucgugaaccagcggaagaccggccagaucccgcccgcccccaucauguacgagaacuucuacagcucccagaagaacgccgugccggcgggcaaggccacggggcccaaccuggcccgccggggcccccugcccauccccaagagcucccccgacgaccccaacuacagccucgucgacgacuacagccugcuguaccaguga

SEQ ID NO: 35218 - RNA, 1674 nt, Artificial Sequence
  derived and/or modified sequence opt1 from PTBP1__Homo_sapiens__NP_002810
auggacggcaucgugcccgacaucgccgucgggaccaagcgcggcagcgacgagcuguucuccacgugcgugaccaacgggccguucaucaugagcuccaacagcgccuccgcggccaacggcaacgacagcaagaaguucaagggggacucccggagcgccggcgugcccucccgcgucauccacauccggaagcugcccaucgacgugaccgagggcgaggugaucagccuggggcugcccuucggcaaggucaccaaccuccugaugcugaaggggaagaaccaggccuucaucgagaugaacaccgaggaggccgcgaacacgauggugaacuacuacaccuccgugaccccgguccuccgcggccagcccaucuacauccaguucagcaaccacaaggagcugaagaccgacuccagccccaaccaggcccgggcccaggccgcgcugcaggccgugaacuccgugcagagcgggaaccucgcccuggccgccuccgcggccgccgucgacgccggcauggccauggcgggccagagccccgugcugcgcaucaucguggagaaccucuucuacccggucacgcuggacgugcugcaccagaucuucuccaaguucgggaccgugcucaagaucaucaccuucaccaagaacaaccaguuccaggcccugcugcaguacgccgaccccgucagcgcccagcacgccaagcucagccuggacggccagaacaucuacaacgcgugcugcacgcugcggaucgacuucuccaagcucaccagccugaacgugaaguacaacaacgacaagucccgcgacuacacccggcccgaccugcccagcggggacucccagccgagccucgaccagaccauggccgccgccuucggcgcccccggcaucaucuccgcgagccccuacgccggggccggcuucccgcccacguucgccaucccccaggcggccgggcuguccgugcccaacguccacggcgcccuggcgccccucgccaucccgagcgccgccgccgccgccgcggccgccgggcgcaucgccauccccggccuggccggcgcggggaacuccgugcugcucgugagcaaccugaaccccgagcgggucacgccccagucccuguucauccucuucggcguguacggggacguccagcgcgugaagauccuguucaacaagaaggagaacgcccuggugcagauggccgacggcaaccaggcccagcucgcgaugagccaccugaacgggcacaagcugcacggcaagccgauccggaucacccucuccaagcaccagaacguccagcugccccgcgagggccaggaggaccaggggcugaccaaggacuacggcaacagcccccuccaccgguucaagaagcccggguccaagaacuuccagaacaucuucccgcccagcgccacccugcaccuguccaacaucccgcccagcgugagcgaggaggaccucaaggugcuguucuccagcaacggcggggucgugaagggcuucaaguucuuccagaaggaccgcaagauggcccugauccagaugggcuccguggaggaggccguccaggcccucaucgaccugcacaaccacgaccugggggagaaccaccaccuccgggugagcuucuccaagagcaccaucuga

SEQ ID NO: 35219 - RNA, 1614 nt, Artificial Sequence
  derived and/or modified sequence opt1 from PTBP2__Homo_sapiens__NP_001287914
auggacggcaucgugaccgaggucgccgugggggugaagcgcggcagcgacgagcugcuguccgggagcguccuguccagccccaacuccaacaugagcuccaugguggugaccgccaacggcaacgacagcaagaaguucaagggggaggacaagauggacggcgcgcccucccggguccugcacauccgcaagcuccccggcgaggugacggagaccgaggugaucgcccuggggcugcccuucggcaaggucaccaacauccucaugcugaaggggaagaaccaggccuuccuggagcucgccaccgaggaggccgcgaucacgauggugaacuacuacagcgccgugacgccccaccuccggaaccagccgaucuacauccaguacuccaaccacaaggagcugaagaccgacaacacccugaaccagcgcgcccaggccguccugcaggcggugaccgccgugcagaccgccaacacgccccugagcggcaccaccgucuccgagagcgccgugacccccgcccagucccccgugcuccggaucaucaucgacaacauguacuacccggucacccuggacgugcugcaccagaucuucagcaaguucggggcggugcucaagaucaucaccuucacgaagaacaaccaguuccaggcccugcugcaguacggcgaccccgucaacgcccagcaggccaagcucgcccuggacggccagaacaucuacaacgcgugcugcacccugcgcaucgacuucuccaagcucgugaaccugaacgugaaguacaacaacgacaagagccgggacuacacccgccccgaccugcccuccggggacggccagccggcccucgaccccgccaucgccgccgcguucgccaaggagaccagccugcuggggcuccccgucgccgccgugcccggcgcccugagcccgcuggcgauccccaacgccgccgccgcggccgccgccgccgcggccggccgggucgggaugcccggcguguccgccgggggcaacacggugcuccuggucagcaaccugaacgaggagauggugacgccccagucccucuucacccuguucgggguguacggcgacguccagcgcgugaagauccuguacaacaagaaggacagcgcccucauccagauggccgacggcaaccagucccagcuggcgaugaaccaccugaacgggcagaagauguacggcaagaucauccgggugacccucagcaagcaccagaccguccagcugccgcgcgaggggcuggacgaccagggccucaccaaggacuucgggaacagcccccugcaccgguucaagaagcccggcuccaagaacuuccagaacaucuucccgcccuccgccacccugcaccucagcaacaucccgcccuccguggccgaggaggaccugcgcacccuguucgccaacacgggcgggaccgugaaggccuucaaguucuuccagcgggaccacaagauggcgcugcuccagauggccaccgucgaggaggccauccaggcccugaucgaccugcacaacuacaaccucggcgagaaccaccaccuccgcgugagcuucuccaagagcaccaucuga

SEQ ID NO: 35220 - RNA, 2103 nt, Artificial Sequence
  derived and/or modified sequence opt1 from PTCD1__Homo_sapiens__NP_056360
auggacuucgugcgccuggcccgccucuucgcccgggcgcggcccaugggccuguucauccugcagcaccucgacccgugccgcgcccggugggccgggggccgcgaggggcugaugcggcccaugugggcccccuucagcuccagcuccagccagcugccccucggccaggagcgccaggagaacaccgggucccugggcagcgacccgucccacagcaacuccaccgccacgcaggaggaggacgaggaggaggaggagagcuucggcacccuguccgacaaguacagcucccggcgccucuuccgcaagagcgcggcccaguuccacaaccugcgguucggggagcggcgcgacgagcagauggagcccgagcccaagcuguggcggggccgccggaacacccccuacugguacuuccuccagugcaagcaccugaucaaggaggggaagcuggucgaggcccucgaccuguucgagcgccagaugcugaaggaggagcggcuccagccgauggaguccaacuacaccgugcugaucggcgggugcggccgcgugggcuaccugaagaaggccuucaaccucuacaaccagaugaagaagcgggaccuggagcccagcgacgcgacguacaccgcccuguucaacgucugcgccgagucccccuggaaggacagcgcccuccaguccgcccugaagcugcgccagcagcuccaggcgaagaacuucgagcugaaccugaagaccuaccacgcccuccugaagauggccgccaagugcgccgaccugcgcaugugccucgacguguucaaggagaucauccacaaggggcacguggucaccgaggagacguucagcuuccugcugaugggcugcauccaggacaagaagaccggguuccgguacgcgcuccagguguggcgccugaugcugagccucggccugcagcccucccgggacagcuacaaccugcuccugguggccgcccgcgacugcggccugggggacccgcaggucgccuccgagcuccugcugaagccccgggaggaggccaccgugcuccagccgcccgugagccgccagcggccccgccggaccgcgcaggccaaggccggcaaccugauguccgccaugcugcacgucgaggcccuggagcgccagcuguuccucgagcccagccaggcgcuggggccgcccgagccgcccgaggcccgggugcccggcaaggcccagcccgagguggacacgaaggccgagcccucccacaccgcggcccucaccgccgucgcccugaagcccccgcccguggagcuggaggugaaccuccugacccccggggccgucccgcccacgguggugagcuucggcaccgucaccacccccgcggaccgccuggcccucaucggcgggcuggagggcuuccuguccaagauggccgagcaccggcagcagcccgacauccgcacgcucacccugcuggccgaggugguggagagcgggucccccgccgagagccuccugcuggcgcuccuggacgagcaccaggucgaggccgaccugaccuucuucaacacccucgugcggaagaaguccaagcugggcgaccuggagggggccaaggcccuccugcccguccuggccaagcgcggccucgugccgaaccugcagacguucugcaaccuggcgaucggcugccaccggcccaaggacgggcuccagcugcugaccgacaugaagaagucccaggugacccccaacacccacaucuacagcgcccucaucaacgccgccauccgcaagcugaacuacacguaccugaucagcauccucaaggacaugaagcagaaccggguccccgugaacgagguggucauccgccagcuggaguucgcggcccaguacccgcccaccuucgaccgcuaccagggcaagaacaccuaccuggagaagaucgacggguuccgggccuacuacaagcaguggcucaccgugaugcccgccgaggagacgccccacccguggcagaaguuccgcaccaagccccagggcgaccaggacaccgggaaggaggccgacgacggcugcgcgcugggcgggcgguga

SEQ ID NO: 35221 - RNA, 4344 nt, Artificial Sequence
  derived and/or modified sequence opt1 from PTCH1__Homo_sapiens__NP_000255
auggccagcgccggcaacgcggccgagccccaggaccgcgggggcgggggcuccgggugcaucggcgccccgggccggcccgccgggggcgggcgccggcgccggaccggcgggcugcgccgggccgcggcccccgaccgcgacuaccuccaccggcccagcuacugcgacgccgccuucgcgcuggagcagaucuccaagggcaaggccaccggccgcaaggccccgcuguggcuccgggccaaguuccagcgccugcuguucaagcucgggugcuacauccagaagaacugcggcaaguuccugguggucgggcugcucaucuucggcgccuucgcggugggccugaaggccgccaaccuggagacgaacguggaggagcucugggucgaggucgggggccgggugagccgcgagcugaacuacacccggcagaagaucggggaggaggccauguucaacccccagcugaugauccagacccccaaggaggagggcgccaacgugcucaccacggaggcgcugcugcagcaccucgacuccgcccugcaggccagccgcgugcacguguacauguacaaccggcaguggaagcuggagcaccucugcuacaaguccggggagcugaucaccgagaccggcuacauggaccagaucaucgaguaccuguaccccugccucaucaucaccccgcuggacugcuucugggagggcgccaagcugcagagcgggacggccuaccuccugggcaagccgccccugcgcuggaccaacuucgacccccucgaguuccuggaggagcugaagaagaucaacuaccaggucgacuccugggaggagaugcucaacaaggcggagguggggcacggcuacauggaccggcccugccugaaccccgccgaccccgacugccccgccaccgccccgaacaagaacagcaccaagccccuggacauggcccucgugcugaacgggggcugccacggccugucccgcaaguacaugcacuggcaggaggagcucaucgucgggggcacggugaagaacagcaccgggaagcugguguccgcgcacgcccugcagaccauguuccagcucaugacccccaagcagauguacgagcacuucaagggcuacgaguacgucagccacaucaacuggaacgaggacaaggccgccgcgauccuggaggccuggcagcggacguacguggaggugguccaccaguccguggcccagaacagcacccagaaggugcuguccuucaccaccacgacccucgacgacauccucaagagcuucuccgacgucagcgugauccgcguggccagcggguaccugcucaugcuggccuacgcgugccugaccaugcugcgcugggacugcuccaagagccagggcgccgucggccucgccggggugcugcuggucgcccucuccguggccgcgggccuggggcugugcagccugaucggcaucuccuucaacgccgccaccacccaggugcugcccuuccuggcccucggcgucgggguggacgacguguuccugcuggcccacgcguucagcgagacgggccagaacaagcggaucccguucgaggaccgcaccggggagugccucaagcggaccggcgccuccgucgcccugacgagcaucuccaacgugaccgccuucuucauggcggcccugauccccauccccgcccuccgcgccuucagccugcaggccgcgguggucgugguguucaacuucgccaugguccugcucaucuuccccgccauccuguccauggaccuguaccggcgcgaggaccggcgccucgacaucuucugcugcuucaccagcccgugcgugucccgggugauccaggucgagccccaggccuacaccgacacgcacgacaacacccgcuacagcccgccgccgcccuacuccagccacuccuucgcccacgagacccagaucaccaugcagagcacggugcagcugcggaccgaguacgacccccacacccacguguacuacaccaccgcggagccccgcuccgagaucagcguccagcccgugacggugacccaggacacccugagcugccagucccccgagagcaccuccagcacgcgggaccuccugucccaguucagcgacuccagccugcacugccucgagccgcccugcaccaaguggacccuguccagcuucgccgagaagcacuacgcccccuuccugcucaagcccaaggccaaggucguggugaucuuccuguuccuggggcuccugggcgucucccuguacggcaccacgcgcgugcgggacgggcucgaccugaccgacaucgugccccgcgagacccgggaguacgacuucaucgccgcgcaguucaaguacuucagcuucuacaacauguacaucgucacccagaaggccgacuaccccaacauccagcaccuccuguacgaccugcaccgcuccuucagcaacgugaaguacgugaugcuggaggagaacaagcagcuccccaagauguggcugcacuacuuccgggacuggcugcagggccuccaggacgccuucgacuccgacugggagacggggaagaucaugcccaacaacuacaagaacggcagcgacgacgggguccuggccuacaagcugcucgugcagaccggcucccgcgacaagcccaucgacaucagccagcugaccaagcagcgccugguggacgcggacggcaucaucaacccgagcgccuucuacaucuaccucaccgccugggucuccaacgaccccguggccuacgccgcgagccaggccaacauccggccccaccgccccgagugggugcacgacaaggccgacuacaugccggagacgcggcugcgcauccccgccgccgagcccaucgaguacgcgcaguuccccuucuaccugaacgggcuccgggacaccuccgacuucgucgaggccaucgagaaggugcgcaccaucugcagcaacuacaccucccugggccugagcuccuacccgaacggguaccccuuccucuucugggagcaguacaucggccugcggcacuggcugcuccuguucaucagcgugguccuggccugcacguuccucgugugcgccguguuccugcugaaccccuggaccgccgggaucaucgucauggugcucgcgcugaugaccguggagcuguucggcaugaugggccucaucgggaucaagcuguccgccguccccguggugauccugaucgccagcgucggcaucgggguggaguucaccgugcacgucgcccucgccuuccugacggcgaucggcgacaagaaccgccgggccgugcuggcccucgagcacauguucgccccgguccuggacggggcgguguccacccugcucggcgugcugaugcuggccggcagcgaguucgacuucaucguccgcuacuucuucgccgugcucgccauccugaccauccugggggugcucaacggccugguccugcuccccgugcugcuguccuucuucgggcccuacccggaggugagccccgccaacggccucaaccggcugcccacccccuccccggagcccccgcccagcgucgugcgcuucgcgaugccgcccggccacacgcacuccgggagcgacuccagcgacagcgaguacuccagccagaccaccguguccggccugagcgaggagcuccggcacuacgaggcccagcagggggccggcgggcccgcccaccaggucaucguggaggccaccgagaaccccguguucgcgcacuccacggucgugcaccccgagagccgccaccacccgcccuccaacccccggcagcagccccaccuggacagcggcucccugccgcccggccgccaggggcagcagccccggcgcgacccgccccgggagggccuguggcccccgcccuaccgcccccggcgcgacgccuucgagaucagcaccgaggggcacuccggccccagcaaccgcgcccggugggggccccgcggcgcccggucccacaacccccgcaaccccgccagcaccgcgaugggcuccagcgugcccggguacugccagccgaucaccacggucaccgccuccgccagcgugaccguggccguccacccgccgcccgugcccggccccgggcggaacccccgcggcgggcucugccccggcuaccccgagaccgaccacggccuguucgaggacccccacgugcccuuccacguccggugcgagcgccgggacuccaagguggaggugaucgagcugcaggacgucgagugcgaggagcgcccccgggggagcagcuccaacuga

SEQ ID NO: 35222 - RNA, 2667 nt, Artificial Sequence
  derived and/or modified sequence opt1 from PTCHD1__Homo_sapiens__NP_775766
augcugcgccaggugcuccaccggggccugcggaccugcuucagccgccuggggcacuucaucgccucccaccccgucuucuucgccagcgcgccggugcucaucuccauccugcugggcgccagcuucucccgcuaccagguggaggagagcgucgagcaccuccuggcgccccagcacucccuggccaagaucgagcggaaccucgugaacagccuguuccccgugaaccgcuccaagcaccggcuguacagcgaccuccagacccccgggcgcuacggccgggucaucgugacguccuuccagaaggccaacaugcuggaccagcaccacaccgaccugauccucaagcugcacgccgccgugaccaagauccaggucccgcgccccggguucaacuacaccuucgcccacaucugcauccugaacaacgacaagacgugcaucguggacgacaucgugcacguccucgaggagcugaagaacgcccgggcgaccaaccgcaccaacuucgccaucaccuaccccaucacgcaccugaaggacggccgggccguguacaacggccaccagcucgggggcgugaccguccacagcaaggaccgcgugaaguccgccgaggccauccagcugaccuacuaccugcagagcaucaacucccucaacgacaugguggcggagcggugggagagcuccuucugcgacaccguccgccuguuccagaaguccaacagcaaggugaagauguaccccuacacgagcagcucccugcgggaggacuuccagaagaccagccgcguguccgagcgguaccucgucaccagccugauccugguggugaccauggccauccucugcugcuccaugcaggacugcguccgcagcaagccguggcuggggcugcucggccuggugacgaucucccuggccacccucaccgccgccgggaucaucaaccugaccggcggcaaguacaacagcacguuccuggggguccccuucgugaugcucggccacgggcuguacggcaccuucgagaugcuguccagcuggcggaagacccgcgaggaccagcacgugaaggagcgcaccgcggccgucuacgccgacuccaugcucagcuucucccugacgaccgccauguaccuggugaccuucggcaucggggccagccccuucaccaacaucgaggcggcccggaucuucugcugcaacuccugcaucgccaucuucuucaacuaccucuacgugcugagcuucuacggcuccagccuggucuucacgggguacaucgagaacaacuaccagcacuccaucuucugccgcaaggugcccaagccggaggcccuccaggagaagcccgccugguaccgguuccugcugaccgcgcgcuucagcgaggacaccgccgagggcgaggaggccaacaccuacgagagccaccuccucgugugcuuccugaagcgguacuacugcgacuggaucacgaacaccuacgucaagcccuucguggugcuguucuaccucaucuacaucuccuucgcccugaugggguaccugcaggucagcgagggcuccgaccucagcaacaucguggcgaccgccacccagacgaucgaguacaccaccgcccagcagaaguacuucuccaacuacagccccgugaucggcuucuacaucuacgaguccaucgaguacuggaacaccagcguccaggaggacgugcuggaguacaccaagggguucgugcgcaucuccugguucgagagcuaccugaacuaccuccggaagcugaacgucuccacgggccugccgaagaagaacuucaccgacaugcuccgcaacagcuuccugaaggcgccccaguucucccacuuccaggaggacaucaucuucagcaagaaguacaacgacgagguggacguggucgccucccggauguuccugguggccaagaccauggagaccaaccgcgaggagcucuacgaccugcuggagacgcuccggcgccugagcgugaccuccaaggucaaguucaucguguucaaccccagcuucguguacauggaccgguacgccagcucccugggggcgccccuccacaacagcugcaucuccgcccuguuccuccuguucuucagcgccuuccuggucgccgacucccugaucaacguguggaucacccucaccguggucagcguggaguucggcgugaucggguucaugacgcuguggaaggucgagcuggacugcaucuccgugcucugccugaucuacggcaucaacuacaccaucgacaacugcgccccgaugcugagcaccuucgugcucggcaaggacuucacccgcacgaagugggucaagaacgcccuggaggugcacgggguggccauccugcaguccuaccucugcuacaucgucggccugaucccccuggccgcggugcccagcaaccugaccugcacccuguuccggugccuguuccucaucgccuucgugaccuucuuccacugcuucgccauccugcccgucauccugacguuccucccgcccuccaagaagaagcgcaaggagaagaagaaccccgagaaccgggaggagaucgagugcguggagaugguggacaucgacagcacccgcgucguggaccagaucaccaccguguga

SEQ ID NO: 35223 - RNA, 2541 nt, Artificial Sequence
  derived and/or modified sequence opt1 from PTCHD4__Homo_sapiens__NP_001013754
augugcuuccugcgccggcccggcgccccggccagcuggaucugguggcgcaugcuccgccaggugcugcggcgggggcugcaguccuucugccaccgccucggccugugcgucagccggcaccccguguucuuccugaccgugcccgcgguccucaccaucacguucgggcuguccgcccugaaccgcuuccagcccgagggcgaccucgagcggcugguggccccgagccacucccuggccaagaucgagcgcagccucgccuccagccuguucccccuggaccaguccaagagccagcucuacuccgaccugcacacccccgggcgguacggccgcgugauccugcucagccccaccggcgacaacauccugcugcaggcggaggggauccuccagacccaccgggccguccuggagaugaaggacggccgcaacuccuucaucgggcaccagcugggcggggugguggaggucccgaacagcaaggaccagcgggugaaguccgcccgcgccauccagaucacguacuaccuccagaccuacggcagcgcgacccaggaccugaucggcgagaagugggagaacgaguucugcaagcugauccggaagcuccaggaggagcaccaggagcugcagcuguacucccucgccagcuucucccuguggcgcgacuuccacaagaccagcauccuggcccggagcaaggugcucgucucccuggugcugauccucacgaccgccacccugagcuccagcaugaaggacugccugcgcuccaagcccuuccucgggcugcugggcgugcucaccgucugcaucagcaucaucacggccgcggggaucuucuucaucaccgacggcaaguacaacuccacccugcugggcauccccuucuucgccauggggcacggcaccaaggggguguucgagcuccugagcggcuggcggcgcacgaaggagaaccugcccuucaaggaccgcaucgccgacgccuacuccgacgugauggucaccuacaccaugaccagcucccucuacuucaucacguucgggaugggcgccagcccguucaccaacaucgaggcggugaagguguucugccagaacaugugcgucuccauccugcugaacuacuucuacaucuucagcuucuucggcuccugccugguguucgccgggcagcucgagcagaaccgguaccacagcaucuucugcugcaagauccccuccgccgaguaccuggaccgcaagcccgugugguuccagaccgucaugagcgacggccaccagcagaccucccaccacgagacgaaccccuaccagcaccacuucauccagcacuuccugcgggagcacuacaacgaguggaucaccaacaucuacgugaagccguucgucgugauccucuaccugaucuacgccagcuucagcuucauggggugccugcagaucuccgacggcgccaacaucaucaaccuccuggcgagcgacucccccagcguguccuacgccaugguccagcagaaguacuucagcaacuacucccccgugaucggguucuacguguacgagccccuggaguacuggaacagcuccguccaggacgaccuccgccggcugugcagcggcuucaccgccguguccuggguggagcaguacuaccaguuccugaaggucagcaacguguccgccaacaacaagagcgacuucaucuccgugcuccagagcuccuuccugaagaagccggaguuccagcacuuccgcaacgacaucaucuucagcaaggccggcgacgagagcaacaucaucgcgucccggcuguaccucgucgcccgcaccagccgggacaagcagaaggagaucacggaggugcuggagaagcugcgcccccucucccugagcaaguccauccgguucaucguguucaaccccagcuucgucuucauggaccacuacucccugagcgugaccgugcccguccucaucgccggguucggcgugcugcuggugcucauccugaccuucuuccuggucauccacccgcucgggaacuucuggcugauccuguccgugaccagcaucgagcucggcgugcuggggcugaugacgcucuggaacgucgacauggacugcaucuccauccugugccugaucuacacccucaacuucgccaucgaccacugcgcgccccugcuguucaccuucgugcucgccaccgagcacacgcgcacccagugcaucaagagcucccugcaggaccacggcaccgccauccugcagaacgugaccagcuuccucaucggccuggucccccuccuguucgugcccuccaaccugaccuucacgcuguucaagugccuccugcugaccgggggcugcacccuccugcacugcuucgugauccugccggucuuccucaccuucuucccgcccagcaagaagcaccacaagaagaagaagcgggccaagcgcaaggagcgggaggagaucgagugcaucgagauccaggagaaccccgaccacgugacgaccguguga

SEQ ID NO: 35224 - RNA, 771 nt, Artificial Sequence
  derived and/or modified sequence opt1 from PTCRA__Homo_sapiens__NP_001230098
auggccggcaccuggcugcuccugcugcucgcccuggggugccccgcgcugccgaccggccccgugagcuuccccuccagccccgaggccgccacgaccgggccgaucugguucuccgccggcaacgggagcgcccucgacgcguucaccuacggccccucccccgccaccgacggcacguggaccaaccuggcccaccugagccuccccuccgaggagcuggccagcugggagccgcuggucugccacaccgggcccggcgcggaggggcacucccgcagcacccagcccaugcaccucuccggcgaggccagcacggcccggaccugcccccaggagccgcugcgcgggacccccggcggcgcccuguggcucggggugcugcggcugcuccuguucaagcugcuccuguucgaccugcuccugaccugcuccugccugugcgaccccgccggcccccucccgagccccgcgacgaccacccgccugcgggcccuggggucccaccgccuccaccccgccaccgagacgggcggccgggaggccaccagcagcccccgcccgcagccccgggaccgccgguggggcgacaccccgcccgggcgcaagcccgggucccccguguggggcgagggguccuaccugagcagcuacccgaccugccccgcccaggcguggugcucccggagcgcccugcgcgcccccuccagcucccucggcgccuucuucgccggcgaccugcccccgccccugcaggcgggggccgccuga

SEQ ID NO: 35225 - RNA, 984 nt, Artificial Sequence
  derived and/or modified sequence opt1 from PTDSS1__Homo_sapiens__NP_001277154
auggaguacgccgugaacugccacgucaucaccugggagcgcaucaucagccacuucgacaucuucgccuucggccacuucugggggugggcgaugaaggcccugcucauccgguccuacggccugugcuggaccaucagcaucacgugggagcugaccgagcuguucuucaugcaccuccugcccaacuucgccgagugcuggugggaccaggugauccucgacauccugcugugcaacgggggcgggaucuggcucggcaugguggucugccgcuuccuggagaugcggaccuaccacugggccuccuucaaggacauccacaccacgaccggcaagaucaagcgcgccgugcugcaguucacccccgcgagcuggaccuacgugcggugguucgaccccaaguccagcuuccagcgcgucgccgggguguaccucuucaugaucaucuggcagcugacggagcugaacaccuucuuccucaagcacaucuucguguuccaggccucccacccccugagcuggggccggauccuguucaucgggggcaucaccgcccccaccguccgccaguacuacgcguaccucacggacacccagugcaagcggguggggacccagugcuggguguucggcgucaucggcuuccuggaggccaucgugugcaucaaguucgggcaggaccuguucuccaagacccagauccucuacgugguccuguggcugcucugcguggccuucacgaccuuccugugccuguacggcaugaucugguacgccgagcacuacgggcaccgcgagaagaccuacagcgagugcgaggacggcaccuacuccccggagaucagcuggcaccaccggaagggcacgaagggguccgaggacagcccgcccaagcacgccggcaacaacgagucccacagcucccgccggcgcaaccggcacagcaaguccaaggugaccaacggggucggcaagaaguga

SEQ ID NO: 35226 - RNA, 1212 nt, Artificial Sequence
  derived and/or modified sequence opt1 from PTEN__Homo_sapiens__NP_000305
augaccgccaucaucaaggagaucgugagccgcaacaagcggcgcuaccaggaggacggcuucgaccuggaccucaccuacaucuaccccaacaucaucgccaugggguucccggcggagcggcuggagggcgucuaccgcaacaacaucgacgacguggugcgguuccuggacuccaagcacaagaaccacuacaagaucuacaaccucugcgccgagcgccacuacgacacggccaaguucaacugccgggucgcccaguaccccuucgaggaccacaacccgccccagcuggagcugaucaagcccuucugcgaggaccucgaccaguggcugagcgaggacgacaaccacguggccgcgauccacugcaaggccgggaagggccgcaccggggugaugaucugcgccuaccugcuccaccggggcaaguuccugaaggcccaggaggcgcuggacuucuacggcgagguccgcacccgggacaagaagggggugaccauccccucccagcgccgguacguguacuacuacagcuaccuccugaagaaccaccuggacuaccgccccgucgcccuccuguuccacaagaugauguucgagacgauccccauguucuccggcgggaccugcaacccgcaguucguggugugccagcugaaggucaagaucuacagcuccaacagcggccccacccggcgcgaggacaaguucauguacuucgaguucccccagccccucccggugugcggggacaucaagguggaguucuuccacaagcagaacaagaugcugaagaaggacaagauguuccacuucugggucaacaccuucuucauccccggccccgaggagacguccgagaagguggagaacggcagccugugcgaccaggagaucgacuccaucugcagcaucgagcgggccgacaacgacaaggaguaccucgugcugacccugaccaagaacgaccucgacaaggccaacaaggacaaggccaaccgcuacuucucccccaacuucaaggucaagcuguacuucaccaagacgguggaggagccgagcaaccccgaggcguccagcuccaccagcgugacccccgacgucuccgacaacgagcccgaccacuaccgguacagcgacaccacggacagcgacccggagaacgagcccuucgacgaggaccagcacacccagaucaccaagguguga

SEQ ID NO: 35227 - RNA, 909 nt, Artificial Sequence
  derived and/or modified sequence opt1 from PTER__Homo_sapiens__NP_001248766
augagcucccugagcggcaaggugcagaccguccucgggcugguggagcccuccaagcugggccgcacccucacgcacgagcaccuggccaugaccuucgacugcugcuacugcccgcccccgcccugccaggaggccaucagcaaggagcccaucgugaugaagaaccuguacuggauccagaagaacgcguacucccacaaggagaaccuccagcugaaccaggagaccgaggccaucaaggaggagcugcucuacuucaaggccaacgggggcggggcccuggucgagaacaccacgaccggcaucagccgggacacccagacccugaagcgccucgccgaggagacgggcgugcacaucaucuccggggcgggcuucuacguggacgccacccacagcuccgagacccgggccaugagcgucgagcagcugaccgacgugcugaugaacgagauccuccacggggccgacggcacguccaucaagugcgggaucaucggcgagaucggcugcagcuggccccugaccgaguccgagcgcaaggugcugcaggcgaccgcccacgcccaggcccagcucgggugccccgucaucauccaccccggccggagcucccgcgccccguuccagaucauccggauccugcaggaggcgggggccgacaucagcaagaccgugaugucccaccuggaccgcgugcggcuccuggucgaggagggcugcgaggaccgcauccugguggcccacgacauccacacgaagacccggcucaugaaguacggcgggcacggcuacagccacauccugaccaacgugguccccaagaugcugcuccgcgggaucaccgagaacgugcuggacaagauccugaucgagaaccccaagcaguggcucacguucaaguga

SEQ ID NO: 35228 - RNA, 987 nt, Artificial Sequence
  derived and/or modified sequence opt1 from PTF1A__Homo_sapiens__NP_835455
auggacgccgugcugcucgagcacuuccccggcgggcuggacgccuuccccagcuccuacuucgacgaggacgacuucuucaccgaccagagcucccgcgacccccuggaggacggcgacgagcuccuggcggacgagcaggccgaggucgaguuccugagccaccagcuccacgaguacugcuaccgggacggggccugccugcugcuccagcccgccccgccggccgcgccccuggcccuggccccgcccuccagcggcgggcucggcgagcccgacgacggcgggggcgggggcuacugcugcgagaccggggccccgcccggcggcuuccccuacucccccgggagcccgcccuccugccuggcguaccccugcgccggcgccgccgugcugagccccggggcccgccuccggggccuguccggcgcggccgccgccgccgcgcgccggcgccggcgcgugcggagcgaggccgagcugcagcagcuccgccaggccgccaacguccgggagcgccggcgcaugcaguccaucaacgacgccuucgaggggcugcggagccacauccccacgcugcccuacgagaagcgccucuccaagguggacacccugcggcuggcgaucggcuacaucaacuuccucagcgagcuggugcaggccgaccugccccuccgcgggggcggggccggcggcugcgggggccccgggggcgggggccggcugggcggggacucccccggcagccaggcccagaaggucaucaucugccaccgcgggacccggucccccagccccagcgacccggacuacggccugccgccccucgccgggcacucccugagcuggaccgacgagaagcagcugaaggagcagaacaucauccgcacggcgaagguguggacccccgaggacccccgcaagcucaacuccaagagcuccuucaacaacaucgagaacgagccgcccuucgaguucgugagcuga

SEQ ID NO: 35229 - RNA, 1188 nt, Artificial Sequence
  derived and/or modified sequence opt1 from PTGDR2__Homo_sapiens__NP_004769
augagcgccaacgccacccugaagccccucugcccgauccuggagcagaugucccgccugcagagccacuccaacaccagcauccgguacaucgaccacgcggccgugcuccugcacggccuggccucccuccuggggcuggucgagaacggcgugauccucuucguggucgggugccgcaugcggcagacgguggugaccaccuggguccugcaccuggcccucagcgaccugcuggccuccgcgagccuccccuucuucaccuacuuccuggccgugggccacuccugggagcuggggacgaccuucugcaagcuccacagcuccaucuucuuccugaacauguucgccagcggcuuccugcucuccgccaucagccuggaccgcugccuccaggugguccggcccgugugggcgcagaaccaccgcaccguggccgccgcccacaaggucugccucgugcugugggcccuggcggugcucaacaccguccccuacuucguguuccgggacacgaucucccgccuggacggccggaucaugugcuacuacaacgugcugcuccugaacccggggcccgaccgcgacgcgaccugcaacagccggcaggucgcccuggccguguccaaguuccuccuggccuuccuggugccccucgccaucaucgccagcucccacgccgccgucagccugcgccugcagcaccggggccgccggcgccccgggcgguucgugcgccucguggccgcggucguggccgccuucgcccugugcuggggcccguaccacgucuucagccugcucgaggcccgggcgcacgccaaccccgggcugcgcccccugguguggcggggccuccccuucgugaccucccuggccuucuucaacagcgucgccaacccggugcuguacgugcugaccugccccgacaugcugcgcaagcugcgccggucccugcgcacgguccucgagagcgugcugguggacgacuccgagcugggcggggcgggcagcucccggcgccggcgcaccagcuccaccgcccggagcgccagcccccucgcccugugcucccgccccgaggagccgcgggggcccgcccgccugcucggcuggcugcugggcuccugcgcggccagcccccagaccgggccccucaaccgggcccuguccagcacguccagcuga

SEQ ID NO: 35230 - RNA, 1080 nt, Artificial Sequence
  derived and/or modified sequence opt1 from PTGDR__Homo_sapiens__XP_005267948
augaagucccccuucuaccgcugccagaacaccaccuccguggagaagggcaacagcgccgucaugggcggggugcuguucuccacggggcuccugggcaaccugcucgcccuggggcugcucgcgcggagcggccugggcuggugcucccgccggccgcugcgcccccuccccagcguguucuacaugcuggucugcgggcugaccgugaccgaccuccugggcaagugccugcucucccccgugguccuggccgccuacgcccagaaccggagccugcgcgugcucgccccggcgcuggacaacucccugugccaggccuucgccuucuucaugagcuucuucgggcucuccagcacccugcagcugcucgccauggcgcuggagugcuggcugucccucggccaccccuucuucuaccggcgccacaucacgcugcggcugggggcccucguggcccccgucgugagcgccuucucccuggccuucugcgcgcugcccuucaugggcuucggcaaguucgugcaguacugcccggggaccuggugcuucauccagaugguccacgaggagggcagccucuccgugcugggguacagcgugcuguacuccagccucauggcccugcugguccucgccaccgugcugugcaaccugggcgccaugcgcaaccucuacgccaugcaccggcgccugcagcggcacccccgcagcugcacccgggacugcgcggagccccgcgccgacggccgggaggccagcccccagccgcuggaggagcucgaccaccuccugcugcuggcccugaugacggugcuguucaccaugugcagccuccccgucaucuaccgcgccuacuacggggcguucaaggacgugaaggagaagaaccggaccuccgaggaggccgaggaccugcgcgcccugcgguuccucagcgugaucuccaucgucgaccccuggaucuucaucaucuuccgcagccccguguuccgcaucuucuuccacaagaucuucauccggccgcugcgcuaccggucccgcugcagcaacuccaccaacauggagagcucccuguga

SEQ ID NO: 35231 - RNA, 573 nt, Artificial Sequence
  derived and/or modified sequence opt1 from PTGDS__Homo_sapiens__NP_000945
auggccacccaccacacccuguggaugggccucgcccugcugggggugcucggcgaccugcaggcggcccccgaggcccaggucagcgugcagccgaacuuccagcaggacaaguuccuggggcgcugguucuccgccggccucgccagcaacuccagcuggcugcgggagaagaaggcggcccuguccaugugcaagagcguggucgcccccgccacggacgggggccucaaccugaccuccaccuuccugcgcaagaaccagugcgagacccggacgaugcuccugcagcccgcgggcagccugggguccuacagcuaccgcagcccccacuggggcuccaccuacuccgugagcguggucgagaccgacuacgaccaguacgcccuccuguacucccaggggagcaagggcccgggggaggacuuccggauggccacccuguacucccgcacgcagacgccccgggccgagcucaaggagaaguucaccgccuucugcaaggcgcagggcuucaccgaggacaccaucguguuccugccccagaccgacaagugcaugaccgagcaguga

SEQ ID NO: 35232 - RNA, 1209 nt, Artificial Sequence
  derived and/or modified sequence opt1 from PTGER1__Homo_sapiens__NP_000946
augagccccugcggcccgcugaaccucucccuggccggggaggccacgaccugcgcggcccccugggugcccaacaccagcgccgucccgcccuccggcgccagccccgcccugcccaucuucuccaugacccucggggcggugagcaaccugcuggcccucgcccugcuggcccaggcggccggccgccuccggcgccggcgcuccgccgccaccuuccugcuguucguggccagccuccuggcgaccgaccuggccgggcacgucauccccggcgcccucgugcugcggcuguacacggccggccgcgcccccgccgggggcgcgugccacuuccucgggggcugcaugguguucuucgggcugugcccccugcuccugggcugcggcauggccgucgagcggugcgugggggugacccgcccccugcuccacgccgcccgggucuccguggcgcgcgcccggcuggcccuggccgccguggcggccgucgcccucgccguggcgcugcugccccucgcccgcgugggccgguacgagcugcaguacccggggaccuggugcuucaucggccugggcccgcccgggggcuggcgccaggcccuccuggccgggcuguucgccagccucggccuggucgcgcugcucgccgcccuggugugcaacacccuguccgggcucgcccugcugcgggcccgcuggcggcgccggagccgccggcccccgcccgcguccggccccgacagccgccgccgguggggcgcccacgggccccgcuccgccagcgccuccagcgccuccagcaucgcgagcgccuccacguucuucggcgggagccgguccagcggcuccgcccgccgggcccgcgcgcacgacguggagauggucgggcagcucgugggcaucaugguggucagcugcaucugcugguccccgaugcuggugcugguggcccucgccgucggcggguggagcuccaccagccugcagcggccccuguuccuggccgugcgccucgccuccuggaaccagauccuggaccccugggucuacauccugcuccggcaggcggugcugcgccagcugcuccggcugcugcccccgcgcgccggcgccaagggcgggcccgccgggcucggccugacccccagcgccugggaggcguccagccugcgguccagccgccacuccggccucagccacuucuga

SEQ ID NO: 35233 - RNA, 1077 nt, Artificial Sequence
  derived and/or modified sequence opt1 from PTGER2__Homo_sapiens__NP_000947
augggcaacgccagcaacgacucccagagcgaggacugcgagacccgccaguggcugcccccgggggagucccccgccaucagcuccgugauguucagcgcgggcguccucgggaaccugaucgcccuggcccuccuggcccggcgcuggcggggcgacguggggugcuccgccggccgccggagcucccugagccucuuccacgugcuggucaccgagcugguguucacggaccuccuggggaccugccugaucucccccgugguccucgcgagcuacgcccgcaaccagacccugguggcccuggcccccgagucccgggcgugcaccuacuucgccuucgccaugacguucuucagccucgccaccaugcugaugcuguucgccauggcgcucgagcgcuaccuguccaucggccacccguacuucuaccagcggcgcgugagccgguccggcgggcuggccguccuccccgugaucuacgccgugagccugcuguucugcucccucccccugcuggacuacggccaguacguccaguacugccccgggaccuggugcuucauccgccacggccggaccgccuaccuccagcuguacgccacgcugcuccugcugcucaucgugagcgugcuggcgugcaacuucagcgucauccugaaccucauccgcaugcaccggcgcucccggcgcagccggugcggcccgucccuggggagcggccgcgggggccccggcgcccggcgccgcggggagcggguguccauggccgaggagaccgaccaccugauccuccuggccaucaugaccaucaccuucgccgugugcagccugcccuucacgaucuucgcguacaugaacgagaccuccagccgcaaggagaagugggaccuccaggcccugcgguuccuguccaucaacagcaucaucgaccccugggucuucgccauccuccgcccgcccgugcugcggcugaugcgcuccgugcucugcugccggaucagccugcgcacccaggacgccacccagacguccugcagcacccaguccgacgccagcaagcaggcggaccuguga

SEQ ID NO: 35234 - RNA, 1257 nt, Artificial Sequence
  derived and/or modified sequence opt1 from PTGER3__Homo_sapiens__XP_011540111
augaaggagacccgcggcuacgggggcgacgcccccuucugcacccggcugaaccacagcuacacggggaugugggccccggagcgcuccgcggaggcccggggcaaccucacccgcccgcccgggagcggcgaggacugcggcuccgugagcgucgccuuccccaucaccaugcugcugaccggguucgugggcaacgcccucgccaugcugcuggugucccggagcuaccgccggcgcgaguccaagcggaagaaguccuuccuccugugcaucggguggcuggcgcucacggaccuggucggccagcugcucaccacccccguggugaucgucguguaccuguccaagcagcgcugggagcacaucgaccccagcgggcggcugugcaccuucuucggccucacgaugaccguguucggccuguccagccuguucaucgccuccgccauggccgucgagcgcgcgcucgccauccgggcgccccacugguacgccagccacaugaagacccgcgccacccgggccgugcugcuggggguguggcucgccguccuggccuucgcccugcuccccgugcugggcguggggcaguacacgguccaguggccgggcaccuggugcuucaucuccaccggccgcgggggcaacgggaccagcuccagccacaacuggggcaaccuguucuucgccuccgcguucgccuuccucgggcugcuggcccucacggugaccuucagcugcaaccuggccaccaucaaggcccuggugagccggugccgcgcgaaggccaccgccucccagagcuccgcccaguggggccggaucacgaccgagaccgccauccagcucaugggcaucaugugcguccugagcgugugcuggagcccccugcucaucaugaugcugaagaugaucuucaaccagaccagcguggagcacugcaagacgcacaccgagaagcagaaggagugcaacuucuuccugaucgcgguccgccucgccucccugaaccagauccuggaccccuggguguaccuccugcugcggaagauccuccugcgcaaguucugccagaugcgcaagcggcgccugcgggagcaggcgccccuccugccgaccagcaccgugaucgaccccucccgcuucugcgcccagcccuuccggugguuccuggaccugagcuuccccgccauguccagcucccacccgcagcucccccugacgcuggccagcuucaagcuccuguccaaguga

SEQ ID NO: 35235 - RNA, 1467 nt, Artificial Sequence
  derived and/or modified sequence opt1 from PTGER4__Homo_sapiens__NP_000949
augagcacccccggcgugaacuccagcgccucccugagcccggaccgccucaacucccccgucaccauccccgccgugauguucaucuucgggguggucggcaaccugguggcgaucgugguccugugcaagagccggaaggagcagaaggagacgaccuucuacacccucgugugcgggcuggccgugaccgaccugcucggcacgcugcuggucucccccgugaccaucgccaccuacaugaaggggcaguggccgggcggccagccccucugcgaguacagcaccuucauccugcuguucuucucccucagcgggcuguccaucaucugcgccaugagcguggagcgcuaccuggccaucaaccacgcguacuucuacucccacuacgucgacaagcggcucgccggccugacgcuguucgccguguacgccagcaacgugcuguucugcgcgcugcccaacauggggcugggcuccagccgccuccaguaccccgacaccuggugcuucaucgacuggaccaccaacgucacggcccacgccgccuacuccuacauguacgccggguucagcuccuuccugauccuggcgaccgugcucugcaacgugcuggucugcggcgcccugcuccggaugcaccgccaguucaugcggcgcaccagccugggcaccgagcagcaccacgccgccgccgcggccagcguggccucccgggggcacccggccgccagccccgcgcugccccgccucuccgacuuccggcgccggcgcagcuuccggcgcaucgccggcgccgagauccagauggugauccugcugaucgccacgucccucgucgugcugaucugcagcaucccccuggugguccggguguucgucaaccagcucuaccagccgucccuggagcgcgaggugagcaagaaccccgaccugcaggccauccggaucgcguccgugaaccccauccucgaccccuggaucuacauccugcugcgcaagaccguccucagcaaggccaucgagaagaucaagugccuguucugccggaucgggggcucccgccgcgagcggagcggccagcacugcuccgacagccagcgcaccuccagcgccauguccgggcacagccgguccuucaucagccgcgagcugaaggagaucagcuccaccagccagacgcuccugccggaccugucccuccccgaccugagcgagaacggccucgggggccggaaccugcuccccggggugcccggcaugggccuggcccaggaggacaccaccucccugcgcacccuccggaucagcgagacguccgacagcucccaggggcaggacagcgaguccgugcugcuggucgacgaggcgggcgggagcggccgcgccgggccggcccccaagggcuccagccuccaggugaccuuccccuccgagacccugaaccugagcgagaagugcaucuga

SEQ ID NO: 35236 - RNA, 1134 nt, Artificial Sequence
  derived and/or modified sequence opt1 from PTGES2__Homo_sapiens__NP_079348
auggaccccgccgcccgcgugguccgggcgcuguggccgggcgggugcgcccucgccuggcgccugggcgggcggccccagccccugcuccccacccagagccgcgccggcuucgccggggcggccggcggcccgucccccguggccgccgcgcggaaggggagcccccgccugcugggcgccgccgcccucgcccucgggggcgcgcuggggcuguaccacaccgcccgguggcaccuccgcgcccaggaccugcacgccgagcgguccgccgcgcagcugagccuguccagccgccugcagcucacgcuguaccaguacaagaccugccccuucugcuccaaggugcgggccuuccuggacuuccacgcccucccguaccaggucguggaggugaaccccguccgccgggccgagaucaaguucagcuccuaccgcaaggugcccauccugguggcccaggagggcgagagcucccagcagcugaacgacagcuccgucaucaucagcgcgcucaagaccuaccugguguccggccagccccuggaggagaucaucaccuacuacccggccaugaaggccgugaacgagcaggggaaggaggucacggaguucggcaacaaguacuggcucaugcugaacgagaaggaggcccagcaggucuacgggggcaaggaggcccggaccgaggagaugaaguggcgccagugggcggacgacuggcuggugcaccucaucagccccaacguguaccggacccccaccgaggcccuggccuccuucgacuacaucgugcgcgagggcaaguucggggccguggagggcgcggucgccaaguacaugggggccgccgccauguaccugaucagcaagcggcucaagucccgccaccggcugcaggacaacgugcgcgaggaccuguacgaggcggccgacaaguggguggccgccgucggcaaggaccgccccuucaugggcgggcagaagccgaaccucgccgaccuggcgguguacggcgugcugcgggucauggaggggcucgacgccuucgacgaccugaugcagcacacgcacauccagcccugguaccugcgcguggagcgggccaucaccgaggccagccccgcccacuga

SEQ ID NO: 35237 - RNA, 483 nt, Artificial Sequence
  derived and/or modified sequence opt1 from PTGES3__Homo_sapiens__NP_006592
augcagcccgccagcgccaagugguacgaccgccgggacuacguguucaucgaguucugcgucgaggacuccaaggacgugaacgugaacuucgagaaguccaagcugaccuucagcugccucggcgggagcgacaacuucaagcaccugaacgagaucgaccuguuccacugcaucgacccgaacgacuccaagcacaagcgcaccgaccggagcauccucugcugccugcgcaagggcgaguccgggcagagcuggccccggcugacgaaggagcgcgcgaagcucaacuggcuguccgucgacuucaacaacuggaaggacugggaggacgacagcgacgaggacauguccaacuucgaccgguucagcgagaugaugaacaacaugggcggggacgaggacguggaccugcccgagguggacggcgccgacgacgacucccaggacagcgacgacgagaagaugcccgaccucgaguga

SEQ ID NO: 35238 - RNA, 459 nt, Artificial Sequence
  derived and/or modified sequence opt1 from PTGES__Homo_sapiens__NP_004869
augcccgcccacagccuggugauguccagcccggcccuccccgcguuccugcugugcuccacccuccuggucaucaagauguacgugguggccaucaucaccggccagguccgccugcggaagaaggccuucgccaaccccgaggacgcccuccgccacgggggcccccaguacugccggagcgacccggacguggagcgcugccugcgggcgcaccgcaacgacauggagacgaucuaccccuuccuguuccucggguucguguacuccuuccugggccccaaccccuucgucgccuggaugcacuuccugguguuccucguggggcgggucgcccacaccguggccuaccugggcaagcugcgcgcgccgauccggagcgugaccuacacccucgcccagcugcccugcgccuccauggcccugcagauccucugggaggccgcgcgccaccuguga

SEQ ID NO: 35239 - RNA, 1161 nt, Artificial Sequence
  derived and/or modified sequence opt1 from PTGIR__Homo_sapiens__NP_000951
auggccgacagcugccgcaaccugaccuacgugcggggcuccgucgggcccgccaccagcacgcucauguucguggcgggcguggucgggaacggccuggcccuggggauccucuccgcccgccggccggcccgccccagcgccuucgcggugcuggugaccggccuggccgccaccgaccuccugggcaccuccuuccugagccccgccgucuucguggcguacgcccggaacuccagccuccuggggcuggcccgcggcgggcccgcccucugcgacgccuucgcguucgccaugacguucuucggccuggccuccaugcugauccucuucgccauggccguggagcggugccuggcgcugagccacccguaccucuacgcccagcuggacgggccccgcugcgcccggcuggcccuccccgccaucuacgcguucugcguccuguucugcgcccugccccuccugggccugggccagcaccagcaguacugcccgggguccuggugcuuccuccgcaugcggugggcccagcccggcggggccgccuucagccuggcguacgccggccugguggcccuccugguggccgcgaucuuccugugcaacggcuccgucacccucagccugugccgcauguaccggcagcagaagcgccaccaggggucccugggcccccggccccgcaccggggaggacgagguggaccaccucauccugcuggcccucaugaccguggucauggccgugugcagccugccgcugacgauccggugcuucacccaggccguggcccccgacuccagcuccgagaugggcgaccuccuggcguuccgcuucuacgccuucaaccccauccuggaccccugggucuucauccucuuccggaaggccguguuccagcgccugaagcugugggugugcugccucugccuggggccggcccacggcgacagccagacgccccugagccagcuggccuccggccggcgcgacccccgcgcgcccagcgccccggucgggaaggagggcuccugcgugccccucagcgccuggggcgagggccagguggagccccugcccccgacccagcaguccagcggguccgccgucgggaccagcuccaaggccgaggcgagcguggccugcucccugugcuga

SEQ ID NO: 35240 - RNA, 1503 nt, Artificial Sequence
  derived and/or modified sequence opt1 from PTGIS__Homo_sapiens__NP_000952
auggccugggccgcgcugcucggccugcuggccgcccuccugcugcuccugcugcucagccgccggcgcacccggcgccccggggagccgccccuggaccugggcuccauccccuggcucggguacgcccuggacuucggcaaggacgccgcgagcuuccugacccggaugaaggagaagcacggggacaucuucacgauccucgugggcggccgcuacgucaccgugcugcuggacccccacuccuacgacgccguggucugggagccgcggacccgccucgacuuccacgccuacgccaucuuccugauggagcggaucuucgacgugcagcugccccacuacagccccuccgacgagaaggcgcgcaugaagcucacccugcugcaccgggagcuccaggcccugacggaggccauguacaccaaccugcacgccgugcuccugggggacgccaccgaggcgggcagcggguggcacgagaugggccugcucgacuucuccuacagcuuccugcugcgcgccggguaccucacccuguacggcaucgaggcccugccccggacgcacgagucccaggcccaggaccgcguccacagcgccgacguguuccacaccuuccggcagcucgaccgccugcugccgaagcucgcgcggggcucccugagcgugggggacaaggaccacaugugcuccgucaagagccgccuguggaagcuccugucccccgcccggcuggcccgccgggcccaccgcagcaaguggcucgaguccuaccugcugcaccucgaggagaugggcgugagcgaggagaugcaggcccgcgcgcuggugcugcagcugugggccacccaggggaacaugggccccgccgccuucuggcuccugcuguuccuccugaagaaccccgaggcccuggcggccguccggggcgagcucgaguccauccuguggcaggccgagcagccggugagccagaccacgacccugccccagaaggugcucgacagcacccccguccuggacuccgugcugagcgagucccuccgccugaccgccgcgcccuucaucacgcgggagguggucguggaccuggccaugccgauggccgacgggcgcgaguucaaccuccggcgcggcgaccggcugcuccuguuccccuuccugagcccccagcgcgaccccgagaucuacaccgacccggagguguucaaguacaaccgguuccugaaccccgacggguccgagaagaaggacuucuacaaggacggcaagcgccucaagaacuacaacaugcccuggggcgccgggcacaaccacugccugggccggagcuacgccgucaacuccaucaagcaguucguguuccuggugcucguccaccuggaccuggagcucaucaacgcggacguggagauccccgaguucgaccugagccgcuacggguucggccugaugcagccggagcacgacguccccgugcgguaccgcauccggcccuga

SEQ ID NO: 35241 - RNA, 906 nt, Artificial Sequence
  derived and/or modified sequence opt1 from PTGR1__Homo_sapiens__NP_001139581
auggugcgcaccaagaccuggacgcugaagaagcacuucgucggcuaccccaccaacagcgacuucgagcucaagaccgccgagcugccgccccugaagaacggggaggugcuccuggaggcccuguuccucaccguggaccccuacaugcgggucgcggccaagcgccugaaggagggcgacacgaugauggggcagcaggucgccaaggugguggaguccaagaacguggcccugcccaagggcaccaucgugcucgccagccccggguggaccacccacuccaucagcgacggcaaggaccuggagaagcugcucacggaguggcccgacaccaucccccugucccuggcgcucggcaccgucgggaugcccggccugaccgccuacuucgggcugcucgagaucugcggcgugaagggcggggagacggugauggucaacgccgccgcgggcgccguggggagcguggucggccagaucgccaagcugaaggggugcaagguggugggcgccgucggcuccgacgagaagguggccuaccugcagaagcucggguucgacguggucuucaacuacaagaccguggagagccuggaggagacccugaagaaggcguccccggacggcuacgacugcuacuucgacaacgucgggggcgaguucagcaacaccgugaucgggcagaugaagaaguucggccggaucgccaucugcggcgccaucuccacguacaaccgcaccgggccccucccgcccgggcccccgcccgagaucgugaucuaccaggagcugcggauggaggccuucgucguguaccgcuggcagggcgacgcccggcagaaggcgcugaaggaccuccugaagugggugcuggagaucaagcgcgagaacgaggaggacuga

SEQ ID NO: 35242 - RNA, 1800 nt, Artificial Sequence
  derived and/or modified sequence opt1 from PTGS1__Homo_sapiens__NP_000953
augagccgcucccugcuccugugguuccuccuguuccugcugcuccugcccccgcugcccgugcuccuggccgaccccggcgcccccaccccggucaaccccugcugcuacuaccccugccagcaccaggggaucugcgugcgguucggccuggaccgcuaccagugcgacugcacccggacgggguacagcggccccaacugcaccaucccggggcucuggaccuggcugcgcaacucccugcggcccagccccuccuucacccacuuccuccugacgcacggccgcugguucugggaguucgugaacgcgaccuucauccgggagaugcugaugcgccucguccugaccgugcggagcaaccugauccccuccccgcccaccuacaacagcgcccacgacuacaucuccugggagagcuucuccaacgugagcuacuacacgcgcauccuccccuccguccccaaggacugcccgacccccaugggcaccaaggggaagaagcagcugcccgacgcccagcugcucgcccggcgcuuccugcugcggcgcaaguucauccccgacccgcagggcaccaaccucauguucgccuucuucgcgcagcacuucacgcaccaguucuucaagaccagcgggaagaugggccccggguucaccaaggcccugggccacggcguggaccuggggcacaucuacggcgacaaccucgagcggcaguaccagcugcgccuguucaaggacgggaagcucaaguaccaggugcuggacggcgagauguacccgcccuccgucgaggaggcccccgugcugaugcacuacccccggggcaucccgccccagagccagauggccguggggcaggaggucuucggccuccugcccgggcugaugcucuacgcgacccuguggcugcgcgagcacaaccgggugugcgaccuccugaaggccgagcaccccacguggggcgacgagcagcuguuccagaccacccgccucauccugaucggggagaccaucaagaucgugaucgaggaguacguccagcagcuguccggcuacuuccuccagcugaaguucgaccccgagcugcuguucggcgugcaguuccaguaccggaaccgcaucgccauggaguucaaccaccucuaccacuggcacccgcugaugcccgacagcuucaagguggggucccaggaguacagcuacgagcaguuccuguucaacacgagcaugcucgucgacuacggcguggaggcccugguggacgccuucucccgccagaucgcggggcggaucggcgggggccgcaacauggaccaccacauccugcacgucgccguggacgugauccgggagagccgcgagaugcggcuccagcccuucaacgaguaccgcaagcgguucggcaugaagcccuacaccuccuuccaggagcuggucggggagaaggagauggccgccgagcuggaggagcucuacggcgacaucgacgcccuggaguucuacccggggcugcuccuggagaagugccaccccaacagcaucuucggcgaguccaugaucgagaucggggcgcccuucagccugaagggccuccugggcaaccccaucugcuccccggaguacuggaagcccagcaccuucgggggcgaggugggguucaacaucgucaagaccgccacgcugaagaagcucgugugccugaacaccaagaccugccccuacguguccuuccgcguccccgacgccagccaggacgacggcccggccguggagcggcccuccaccgagcuguga

SEQ ID NO: 35243 - RNA, 1815 nt, Artificial Sequence
  derived and/or modified sequence opt1 from PTGS2__Homo_sapiens__NP_000954
augcuggcccgcgcccuccugcugugcgcggugcucgcccugagccacaccgccaaccccugcugcucccacccgugccagaaccggggcgucugcaugagcgugggguucgaccaguacaagugcgacugcacccgcacgggcuucuacggggagaacugcuccacccccgaguuccugacccggaucaagcuguuccucaagcccacccccaacacggugcacuacauccugacccacuucaagggcuucuggaacgucgugaacaacaucccguuccuccgcaacgccaucaugagcuacgugcugaccucccggagccaccugaucgacuccccgcccaccuacaacgccgacuacggguacaagagcugggaggcguucuccaaccucagcuacuacacgcgcgcccugccgcccguccccgacgacugccccacgccccugggcgugaagggcaagaagcagcuccccgacuccaacgagaucguggagaagcugcugcuccggcgcaaguucauccccgacccccaggggagcaacaugauguucgccuucuucgcccagcacuucacccaccaguucuucaagaccgaccacaagcggggccccgcguucaccaacgggcugggccacggggucgaccugaaccacaucuacggcgagacccucgcccgccagcggaagcugcgccuguucaaggacggcaagaugaaguaccagaucaucgacggggagauguacccgcccaccgugaaggacacccaggccgagaugaucuacccgccccaggugcccgagcaccuccgguucgccgucggccaggagguguucgggcuggugcccggccugaugauguacgccacgaucuggcuccgcgagcacaaccgggucugcgacgugcugaagcaggagcaccccgaguggggcgacgagcagcuguuccagaccucccgccucauccugaucggggagaccaucaagaucgugaucgaggacuacguccagcaccugagcggcuaccacuucaagcucaaguucgaccccgagcugcuguucaacaagcaguuccaguaccagaaccggaucgcggccgaguucaacacccucuaccacuggcacccgcugcugcccgacacguuccagauccacgaccagaaguacaacuaccagcaguucaucuacaacaacuccauccuccuggagcacgggaucacccaguucguggagagcuucacccgccagaucgccggccggguggccgggggccgcaacgucccgcccgccgugcagaaggugucccaggcgagcaucgaccagucccggcagaugaaguaccagagcuucaacgaguaccgcaagcgcuucaugcugaagcccuacgagagcuucgaggagcucaccggcgagaaggagauguccgccgagcuggaggcccuguacggggacaucgacgccgucgagcucuaccccgcccugcugguggagaagccccggccggacgcgaucuucggcgagacgauggucgaggugggggcccccuucagccucaagggccugauggggaacgugaucugcucccccgccuacuggaagcccagcaccuucggcggcgaggucggguuccagaucaucaacaccgccuccauccagagccugaucugcaacaacgugaagggcugcccguucaccuccuucagcgugcccgaccccgagcugaucaagacggucaccaucaacgccuccagcucccgcagcgggcucgacgacaucaaccccaccgugcugcugaaggagcgguccaccgagcucuga

SEQ ID NO: 35244 - RNA, 1782 nt, Artificial Sequence
  derived and/or modified sequence opt1 from PTH1R__Homo_sapiens__NP_000307
augggcaccgcccgcaucgcccccgggcuggcgcuccugcugugcugccccgugcucagcuccgccuacgcccuggucgacgccgacgacgugaugaccaaggaggagcagaucuuccugcuccaccgggcccaggcgcagugcgagaagcgccugaaggaggugcugcagcggcccgccagcaucauggaguccgacaagggcuggacgagcgccuccaccagcgggaagccccgcaaggacaaggccuccggcaagcucuaccccgagagcgaggaggacaaggaggcgccgaccgggucccgguaccgcggccggcccugccugcccgagugggaccacauccugugcuggccccucggcgccccgggggaggucguggccgugcccugccccgacuacaucuacgacuucaaccacaagggccacgccuaccgccggugcgaccgcaacgggagcugggagcugguccccggccacaaccggaccugggccaacuacuccgagugcgugaaguuccugacgaacgagacccgcgagcgggagguguucgaccgccucgggaugaucuacaccgucggcuacagcgugucccuggcgagccugaccguggccguccucauccuggccuacuuccggcgccugcacugcacgcggaacuacauccacaugcaccucuuccuguccuucaugcugcgcgccgugagcaucuucgugaaggacgccguccucuacuccggcgcgacccuggacgaggccgagcggcugaccgaggaggagcuccgcgccaucgcccaggccccgcccccgcccgcgaccgccgccgccggguacgccggcugccggguggcggugacguucuuccuguacuuccuggccaccaacuacuacuggauccucgucgaggggcuguaccugcacagccucaucuucauggccuucuucuccgagaagaaguaccuguggggcuucaccguguucggcugggggcugcccgccguguucgucgcggugugggugagcguccgcgccacccucgccaacacgggcugcugggaccugagcuccgggaacaagaaguggaucauccaggugcccauccuggccagcaucguccucaacuucauccuguucaucaacaucgugcgcgugcuggccaccaagcuccgggagaccaacgcgggccgcugcgacacccggcagcaguaccgcaagcugcugaaguccacgcucguccugaugccccuguucggggugcacuacaucguguucauggccacccccuacaccgaggucagcggcacccucuggcagguccagaugcacuacgagaugcuguucaacuccuuccagggcuucuucguggccaucaucuacugcuucugcaacggggaggugcaggccgagaucaagaaguccuggucccgguggacgcuggcccuggacuucaagcgcaaggcgcggagcggcuccagcuccuacagcuacgggccgauggugucccacaccagcgugaccaacgucggcccccgcguggggcucggccugccccugagcccccggcuccugccgaccgccacgaccaacggccacccccagcugcccgggcacgccaagcccggcaccccggcccucgagacccuggagacgaccccgcccgccauggcggcccccaaggacgacggguuccugaacggcagcugcuccgggcucgacgaggaggccagcggccccgagcgcccgcccgcccugcugcaggaggagugggagaccgugauguga

SEQ ID NO: 35245 - RNA, 303 nt, Artificial Sequence
  derived and/or modified sequence opt1 from PTH2__Homo_sapiens__NP_848544
auggagacccgccaggugagccggagcccccgcguccggcugcuccugcugcuccugcugcuccugguggugccguggggcguccgcaccgccuccgggguggcccugccgcccgugggcguccucucccugcggccgcccgggcgcgcgugggccgaccccgccacgccccggccccgccggagccuggcccucgccgacgacgcggccuuccgcgagcgggcccgccugcuggccgcgcucgagcggcgccacuggcugaacuccuacaugcacaagcugcucgugcuggacgcccccuga

SEQ ID NO: 35246 - RNA, 1653 nt, Artificial Sequence
  derived and/or modified sequence opt1 from PTH2R__Homo_sapiens__NP_005039
auggccggccugggggccagccuccacguguggggcuggcugaugcugggguccugccuccuggcgcgcgcccagcuggacagcgacggcaccaucaccaucgaggagcagaucguccucgugcugaaggccaaggugcagugcgagcugaacaucacggcccagcuccaggagggggagggcaacugcuuccccgagugggacggccugaucugcuggccgcgggggaccgucggcaagaucuccgccgugcccugcccgcccuacaucuacgacuucaaccacaaggggguggcguuccgccacugcaaccccaacggcaccugggacuucaugcacagccugaacaagaccugggccaacuacuccgacugccuccgguuccugcagcccgacaucagcaucgggaagcaggaguucuucgagcgccuguacgucauguacacggugggcuacuccaucagcuucggcucccucgccguggccauccugaucaucggguacuuccggcgccugcacugcacccggaacuacauccacaugcaccucuucgucagcuucaugcugcgcgcgaccuccaucuucgugaaggaccgggugguccacgcccacaucggcgugaaggagcuggagagccucaucaugcaggacgacccccagaacuccaucgaggccaccagcguggacaagucccaguacaucgggugcaagaucgccgucgugauguucaucuacuuccuggccacgaacuacuacuggauccugguggagggccucuaccugcacaaccugaucuucgucgcguucuucagcgacaccaaguaccucuggggcuucauccugaucggguggggcuuccccgccgccuucguggccgccugggcgguggcccgcgccacccuggccgacgcccggugcugggagcucuccgcgggggacaucaaguggaucuaccaggccccgauccuggccgccaucggccugaacuucauccucuuccugaacaccguccgcgugcuggccacgaagaucugggagaccaacgcgguggggcacgacacccggaagcaguaccgcaagcucgccaagagcacccugguccuggugcucgucuucggcgugcacuacaucguguucgucugccugccccacuccuucacgggccuggggugggagauccggaugcacugcgagcuguucuucaacagcuuccagggcuucuucgugagcaucaucuacugcuacugcaacggggaggugcaggccgaggucaagaagauguggucccgcuggaaccucagcguggacuggaagcggaccccgcccugcggcucccgccggugcgggagcgugcugaccaccgucacgcacuccaccagcucccagagccagguggccgcguccacccgcauggugcucaucagcggcaaggccgccaagaucgccucccggcagcccgacagccacaucacccugcccggcuacgucugguccaacagcgagcaggacugccugccccacuccuuccacgaggagacgaaggaggacagcgggcgccagggcgacgacauccucauggagaagcccucccgcccgauggagagcaaccccgacaccgaggggugccagggcgagaccgaggacgugcuguga

SEQ ID NO: 35247 - RNA, 348 nt, Artificial Sequence
  derived and/or modified sequence opt1 from PTH__Homo_sapiens__NP_000306
augauccccgccaaggacauggccaaggugaugaucgucaugcuggcgaucugcuuccucaccaagagcgacggcaaguccgugaagaagcgcagcguguccgagauccagcugaugcacaaccuggggaagcaccucaacagcauggagcgggucgaguggcugcgcaagaagcugcaggacgugcacaacuucguggcccucggcgccccgcuggcgccccgggacgccgggucccagcgcccccggaagaaggaggacaacguccugguggagagccacgagaagucccucggcgaggccgacaaggccgacgugaacguccugaccaaggccaagagccaguga

SEQ ID NO: 35248 - RNA, 528 nt, Artificial Sequence
  derived and/or modified sequence opt1 from PTHLH__Homo_sapiens__NP_945315
augcagcgccggcuggugcagcaguggagcgucgccguguuccuccuguccuacgccgugcccagcugcggccgcuccgucgaggggcugagccggcgccucaagcgggcgguguccgagcaccagcugcugcacgacaagggcaagagcauccaggaccuccgccggcgcuucuuccugcaccaccugaucgccgagauccacaccgccgagauccgggccaccuccgaggugagcccgaacuccaagcccagccccaacacgaagaaccaccccguccgcuucggguccgacgacgagggccgguaccucacccaggagaccaacaagguggagaccuacaaggagcagccgcugaagacgcccgggaagaagaagaagggcaagcccggcaagcgcaaggagcaggagaagaagaagcggcgcacccggagcgccuggcuggacuccggggugaccggcagcgggcucgagggcgaccaccuguccgacaccagcacgaccucccuggagcucgacagccgcuga

SEQ ID NO: 35249 - RNA, 2904 nt, Artificial Sequence
  derived and/or modified sequence opt1 from PTK2B__Homo_sapiens__NP_775267
augagcggcguguccgagccccugagccgcgucaagcucgggacccugcggcgccccgagggccccgccgagcccaugguggugguccccguggacguggagaaggaggacguccggauccugaaggugugcuucuacuccaacagcuucaacccggggaagaacuucaagcucgugaagugcaccguccagacggagauccgcgagaucaucaccuccauccugcugagcggccggaucgggcccaacauccgccucgccgagugcuacggccugcggcugaagcacaugaaguccgacgagauccacuggcuccacccccagaugaccgugggcgaggugcaggacaaguacgagugccugcacgucgaggcggaguggcgcuacgaccugcagauccgguaccuccccgaggacuucauggagagccugaaggaggaccgcaccacgcugcucuacuucuaccagcagcugcggaacgacuacaugcagcgcuacgccuccaaggugagcgaggggauggcccugcagcucggcugccuggagcugcggcgcuucuucaaggacaugccgcacaacgcccucgacaagaaguccaacuucgagcugcuggagaaggagguggggcucgaccuguucuuccccaagcagaugcaggagaaccugaagcccaagcaguuccggaagaugauccagcagaccuuccagcaguacgccagccuccgcgaggaggagugcgucaugaaguucuucaacacccuggcgggcuucgccaacaucgaccaggagaccuaccggugcgagcugauccagggguggaacaucacgguggaccucgugaucggccccaagggcauccgccagcugaccucccaggacgccaagccgaccugccuggccgaguucaagcagauccggagcauccgcugccucccccuggaggaggggcaggcgguccugcagcucggcaucgagggggcgccccaggcccuguccaucaagaccagcucccuggccgaggccgagaacauggccgaccucaucgacggcuacugccggcugcagggcgagcaccaggggagccugaucauccacccccgcaaggacggcgagaagcgcaacucccucccgcagauccccaugcugaaccuggaggcccggcgcagccaccucagcgaguccugcagcaucgaguccgacaucuacgccgagauccccgacgagacgcugcggcgccccgggggcccgcaguacgggaucgcccgggaggacguggugcugaaccgcauccucggcgagggcuucuucggggaggucuacgagggcguguacaccaaccacaagggggagaagaucaacguggccgucaagaccugcaagaaggacugcacccuggacaacaaggagaaguucaugagcgaggcggugaucaugaagaaccuggaccacccccacaucgucaagcugaucggcaucaucgaggaggagcccacguggaucaucauggagcucuaccccuacggggagcugggccacuaccuggagcggaacaagaacucccucaaggugcugacccuggugcucuacagccugcagaucugcaaggccauggccuaccuggaguccaucaacugcguccaccgcgacaucgccgugcggaacauccucguggccagcccggagugcgucaagcugggcgacuucgggcugucccgcuacaucgaggacgaggacuacuacaaggcgagcgugacccggcuccccaucaaguggaugucccccgagagcaucaacuuccgccgguucaccacggccuccgacguguggauguucgccgucugcaugugggagauccugagcuucggcaagcagcccuucuucuggcuggagaacaaggacgugaucggggugcucgagaagggcgaccgccugccgaagcccgaccugugcccgcccguccucuacacccugaugacccggugcugggacuacgaccccuccgaccgcccccgguucaccgagcuggugugcagccucuccgacguguaccagauggagaaggacaucgccauggagcaggagcgcaacgcccgguaccgcacgcccaagauccuggagccgaccgcguuccaggagcccccgcccaagcccagccgccccaaguaccggccgccgccccagaccaaccugcucgcccccaagcugcaguuccaggaggaggacuucauccagcccuccagccgcgaggaggcccagcagcugugggaggccgagaaggucaagaugcggcagauccucgacaagcagcagaagcagaugguggaggacuaccaguggcugcgccaggaggagaagucccuggaccccaugguguacaugaacgacaagagcccccucacccccgagaaggaggucggguaccuggaguucacgggcccgccccagaagccgccccggcugggcgcgcagagcauccagcccaccgccaaccucgaccgcaccgacgaccugguguaccugaacgugauggagcucguccgggccgugcuggagcugaagaacgagcucugccagcugccgcccgagggguacguggucguggugaagaacgucggccugacccuccgcaagcugaucggguccguggacgaccugcuccccagccugcccuccagcucccggacggagaucgagggcacccagaagcugcucaacaaggaccuggccgagcugaucaacaagaugcgccucgcccagcagaacgcggugaccagccuguccgaggagugcaagcggcagaugcugaccgccagccacacgcucgccgucgacgccaagaaccugcuggacgccguggaccaggcgaaggugcucgccaaccuggcccacccgcccgccgaguga

SEQ ID NO: 35250 - RNA, 3198 nt, Artificial Sequence
  derived and/or modified sequence opt1 from PTK2__Homo_sapiens__NP_001186578
auggccgccgcguaccuggaccccaaccucaaccacacccccaacagcuccaccaagacgcaccugggcaccgggauggagcgcagccccggcgccauggagcgggugcugaaggucuuccacuacuucgaguccaacagcgagcccaccaccugggccuccaucauccgccacggggacgccacggacgugcggggcaucauccagaagaucguggacagccacaaggucaagcacguggccugcuacggguuccgccucucccaccuccggagcgaggaggugcacuggcugcacgucgacaugggcguguccagcgugcgcgagaaguacgagcucgcgcacccgcccgaggaguggaaguacgagcugcggauccgcuaccugcccaagggcuuccucaaccaguucaccgaggacaagcccacccugaacuucuucuaccagcaggucaaguccgacuacaugcuggagaucgccgaccagguggaccaggagaucgcccucaagcuggggugccuggagauccggcgcagcuacugggagaugcggggcaacgcccucgagaagaaguccaacuacgaggugcuggagaaggacgucgggcugaagcgcuucuuccccaagagccuccuggacuccgugaaggcgaagacccugcggaagcucauccagcagacguuccgccaguucgccaaccugaaccgggaggagagcauccugaaguucuucgagauccucuccccgguguaccgcuucgacaaggagugcuucaagugcgcccugggcagcuccuggaucaucagcgucgagcuggccaucgggcccgaggagggcaucagcuaccucaccgacaagggcugcaaccccacccaccuggccgacuucacccaggugcagacgauccaguacuccaacagcgaggacaaggaccggaaggggaugcugcagcucaagaucgcgggcgcccccgagccgcugaccgugaccgcccccucccugaccaucgccgagaacauggccgaccucaucgacggguacugccgccuggucaacggcacgagccaguccuucaucauccggccccagaaggagggcgagcgcgcgcugcccagcaucccgaagcuggccaacuccgagaagcaggggaugcggacccacgccgugagcguguccgagaccgacgacuacgccgagaucaucgacgaggaggacaccuacacgaugcccagcacccgcgacuacgagauccagcgcgagcggaucgagcugggccgcugcaucggggagggccaguucggggacguccaccagggcaucuacaugucccccgagaaccccgcccuggcgguggccaucaagaccugcaagaacugcaccagcgacuccgugcgggagaaguuccuccaggaggcccugacgaugcgccaguucgaccacccgcacaucgucaagcugaucggcgugaucaccgagaaccccgucuggaucaucauggagcucugcacccugggggagcugcggagcuuccuccaggugcgcaaguacucccuggaccuggccagccucauccuguacgccuaccagcuguccaccgcgcuggccuaccucgagagcaagcgguucgugcaccgcgacaucgccgcccggaacguccugguguccagcaacgacugcgugaagcugggcgacuucgggcucagccgcuacauggaggacuccacguacuacaaggcgagcaagggcaagcugcccaucaaguggauggcccccgaguccaucaacuuccggcgcuucaccagcgccuccgacgucuggauguucggggugugcaugugggagauccugaugcacggcgugaagccguuccagggcgucaagaacaacgacgugaucgggcggaucgagaacggcgagcgccuccccaugccgcccaacugcccgcccacccuguacagccugaugaccaagugcugggccuacgaccccucccggcgcccccgguucacggagcucaaggcccagcugagcaccauccuggaggaggagaaggcgcagcaggaggagcgcaugcggauggagucccgccgccaggccaccgugagcugggacuccgggggcagcgacgaggccccgcccaagcccucccggcccggguaccccagcccccgcuccagcgagggcuucuaccccuccccgcagcacaugguccagaccaaccacuaccaggugagcggcuaccccgggagccacggcaucacggccauggccggguccaucuaccccggccaggcgagccuccuggaccagaccgacuccuggaaccaccggccccaggagaucgccauguggcagccgaacguggaggacagcaccguccuggaccuccgcggcaucggccaggugcugcccacccaccugauggaggagcggcucauccgccagcagcaggagauggaggaggaccagcgguggcuggagaaggaggagcgcuuccugaagcccgacgugcggcucucccgcgggagcaucgaccgggaggacgggucccugcagggccccaucgggaaccagcacaucuaccagccggucggcaagcccggcaaggaggagaagaacugggccgagcgcaaccccgccgcgcccccgaagaagccgccccggcccggggcccccggccaccuggggagccucgccucccugagcucccccgccgacagcuacaacgagggcgugaagcccuggcgccugcagccgcaggagaucuccccgccgcccaccgccaaccucgaccggagcaacgacaagguguacgagaacgucacggggcuggugaaggcggugaucgagauguccagcaagauccagcccgccccgcccgaggaguacguccccauggugaaggaggugggccuggcccuccgcacccugcuggccaccgucgacgagaccaucccccuccugcccgccuccacgcaccgggagaucgagauggcgcagaagcugcucaacagcgaccugggcgagcugaucaacaagaugaagcucgcccagcaguacgugaugaccucccugcagcaggaguacaagaagcagaugcugaccgccgcccacgcccucgcgguggacgccaagaaccugcuggacgucaucgaccaggcccgccucaagaugcuggggcagacccggccccacuga

SEQ ID NO: 35251 - RNA, 405 nt, Artificial Sequence
  derived and/or modified sequence opt1 from PTK6__Homo_sapiens__NP_001243287
auggugagccgcgaccaggcccaccugggccccaaguacgucgggcucugggacuucaagucccggaccgacgaggagcugagcuuccgcgccggcgacguguuccacguggcgcggaaggaggagcagugguggugggccacccugcucgacgaggccgggggcgccgucgcccagggguacgugccgcacaacuaccuggcggagcgcgagacgguggaguccgagcccgccggccacgccggcugcgccgcgcugcaggaccucgccgccugccgggggcccgccgcccccgagcgcggcgggguccugccgcagcccgcgcgggccugcgagcugccccagggccccgagccggugccccgccccgccgccgggcgggcccuccccgaggcgcgcgccuga

SEQ ID NO: 35252 - RNA, 3237 nt, Artificial Sequence
  derived and/or modified sequence opt1 from PTK7__Homo_sapiens__NP_001257327
augggcagcuuccuguccggggagaagcgccccagcgccccgaccgugggcuccgccauggagaagaaggaguuccccaccccgcccgggcgggucggccccgggacgcagaccgcgaucguguucaucaagcagcccagcucccaggacgcccuccagggccgccgggcccugcugcgcugcgagguggaggcccccggccccguccacguguacuggcuccuggacggggccccggugcaggacaccgagcggcgcuucgcgcagggcagcucccugagcuucgccgccgucgaccggcuccaggacuccgggaccuuccagugcguggcccgcgacgacgugacgggcgaggaggcgcggagcgccaacgccuccuucaacaucaaguggaucgaggccgggcccgucgugcugaagcaccccgccagcgaggcggagauccagccccagacccaggugacccugcgcugccacaucgacggccacccgcggcccaccuaccagugguuccgcgacggcacgccccucuccgacgggcagagcaaccacaccgucuccagcaaggagcggaaccugacccugcgccccgccggcccggagcacuccgggcucuacagcugcugcgcccacuccgccuucggccaggccugcagcagccagaacuucacccuguccaucgcggacgagagcuucgcccggguggugcuggcgccccaggacgucgugguggcccgcuacgaggaggccauguuccacugccaguucuccgcccagcccccgcccagccuccaguggcuguucgaggacgagacgcccaucaccaaccggucccgcccgccccaccuccggcgcgccaccgucuucgccaacggcagccuccugcugacccaggugcggccccgcaacgccgggaucuaccgcugcaucggccaggggcagcggggcccgcccaucauccucgaggccacgcugcaccuggcggagaucgaggacaugccccucuucgagccccgcguguucaccgccggguccgaggagcgggugaccugccugccgcccaagggccugcccgagcccagcgucuggugggagcacgccggcgugcgccugcccacccacgggcgggucuaccagaagggccacgagcuggugcuggccaacaucgcggaguccgacgccggggucuacacgugccacgccgccaaccucgccggccagcgccggcaggacgugaacaucaccguggcgaccguccccagcuggcugaagaagccgcaggacucccagcuggaggaggggaagcccggcuaccucgacugccugacccaggccacgcccaagcccaccguggugugguaccgcaaccagaugcugaucagcgaggacucccgguucgaggucuucaagaacggcacccuccgcaucaacagcguggagguguacgacgggaccugguaccggugcauguccagcacgccggccggcuccaucgaggcccaggcccgcguccaggugcuggagaagcugaaguucaccccgccgccccagccccagcagugcauggaguucgacaaggaggcgaccgugcccugcagcgccaccgggcgggagaagcccacgaucaagugggagcgcgccgacggcuccagccuccccgagugggucaccgacaacgccgggacccugcacuucgcccgggugacccgcgacgacgcgggcaacuacacgugcaucgccagcaacggcccccaggggcagauccgggcccacgugcagcugaccgucgccguguucaucaccuucaagguggagcccgagcgcaccaccgucuaccagggccacacggcgcuccugcagugcgaggcccagggggaccccaagccccugauccaguggaagggcaaggaccggauccucgacccgaccaagcugggcccccgcaugcacaucuuccagaacgggucccuggugauccacgacguggcccccgaggacagcggccgcuacacgugcaucgccgggaacuccugcaacaucaagcacaccgaggcgccccucuacgucguggacaagccggugcccgaggagagcgagggccccggguccccgccgcccuacaagaugauccagacgaucggccugagcgucggcgccgccguggccuacaucaucgccgugcuggggcugauguucuacugcaagaagcggugcaaggccaagcgccuccagaagcagcccgagggcgaggagcccgagauggagugccugaacgggggcccccugcagaacgggcagcccuccgcggagauccaggaggaggucgcccucaccagccugggcuccggccccgccgccaccaacaagcggcacagcaccuccgacaagaugcacuucccgcgcagcucccugcagcccaucacgacccucggcaagagcgaguucggggagguguuccuggccaaggcgcaggggcuggaggagggcguggccgagacccucguccuggugaagucccugcagagcaaggacgagcagcagcagcucgacuuccggcgcgagcuggagauguucgggaagcugaaccacgccaacgugguccggcuccugggccugugccgcgaggccgagccccacuacauggugcucgaguacguggaccugggcgaccugaagcaguuccuccggaucuccaagagcaaggacgagaagcucaagagccagccccuguccaccaagcagaaggucgcgcugugcacccagguggcccuggggauggagcaccugagcaacaaccgcuucgugcacaaggaccucgccgcccggaacugccuggucuccgcccagcgccaggugaaggugagcgcgcugggccucuccaaggacgucuacaacagcgaguacuaccacuuccggcaggccugggugccgcugcgcuggaugucccccgaggccauccuggagggggacuucagcaccaaguccgacgugugggccuucggcguccucaugugggagguguucacccacggggagaugccccacggcggccaggccgacgacgaggugcuggcggaccugcaggccgggaaggcccggcucccccagccggagggcugccccagcaagcuguaccgccugaugcagcggugcugggcccucucccccaaggaccgccccagcuucuccgagaucgccagcgcgcugggggacuccaccgucgacagcaagccguga

SEQ ID NO: 35253 - RNA, 336 nt, Artificial Sequence
  derived and/or modified sequence opt1 from PTMA__Homo_sapiens__NP_001092755
augagcgacgccgccguggacaccuccagcgagaucaccacgaaggaccugaaggagaagaaggaggucguggaggaggcggagaacggccgcgacgcccccgccaacgggaacgccgagaacgaggagaacggcgagcaggaggccgacaacgagguggacgaggaggaggaggagggcggggaggaggaggaggaggaggaggagggggacggcgaggaggaggacggcgacgaggacgaggaggcggaguccgccaccgggaagcgggccgccgaggacgacgaggacgacgacgucgacaccaagaagcagaagaccgacgaggacgacuga

SEQ ID NO: 35254 - RNA, 309 nt, Artificial Sequence
  derived and/or modified sequence opt1 from PTMS__Homo_sapiens__NP_002815
augagcgagaaguccguggaggccgccgcggagcugagcgccaaggaccucaaggagaagaaggagaaggucgaggagaaggccucccgcaaggagcggaagaaggaggugguggaggaggaggagaacggcgccgaggaggaggaggaggagaccgccgaggacggggaggaggaggacgagggcgaggaggaggacgaggaggaggaggaggaggacgacgaggggcccgcgcugaagcgcgccgccgaggaggaggacgaggccgacccgaagcggcagaagaccgagaacggcgcgagcgccuga

SEQ ID NO: 35255 - RNA, 507 nt, Artificial Sequence
  derived and/or modified sequence opt1 from PTN__Homo_sapiens__XP_005250572
augcaggcccagcaguaccagcagcagcgccggaaguucgccgcggccuuccuggccuucaucuucauccucgccgccguggacaccgcggaggccggcaagaaggagaagcccgagaagaaggucaagaaguccgacugcggggaguggcaguggagcgugugcgugccgaccagcggcgacugcgggcugggcacgcgcgaggggacccggaccggcgccgagugcaagcagaccaugaagacgcagcgcugcaagauccccugcaacuggaagaagcaguucggcgccgagugcaaguaccaguuccaggcguggggcgagugcgaccugaacaccgcccucaagacccggaccgggucccugaagcgcgcccugcacaacgccgagugccagaagacggucaccaucagcaagcccugcgggaagcucaccaagcccaagccgcaggccgaguccaagaagaagaagaaggagggcaagaagcaggagaagaugcuggacuga

SEQ ID NO: 35256 - RNA, 1251 nt, Artificial Sequence
  derived and/or modified sequence opt1 from PTOV1__Homo_sapiens__NP_059128
auggugcgcccccggcgcgccccguaccggagcggcgccgggggcccccucgggggccgcgggcggccgccccgcccccucgucgugcgggcggugcgcucccggagcuggcccgccagcccccgcggcccccagccgccccggauccgcgcccggagcgccccgcccauggagggcgcccgcgucuucggggcgcugggccccaucgggcccuccagccccggccugacccucgggggccuggccguguccgagcaccggcugagcaacaagcuccuggccugguccggcgugcuggaguggcaggagaagcgccggcccuacagcgacuccaccgccaagcucaagcgcacgcugccgugccaggcguacgucaaccagggggagaaccuggagaccgaccaguggccccagaagcucaucaugcagcugaucccccagcagcugcucaccacccugggcccccuguuccggaacagccagcucgcccaguuccacuucacgaaccgcgacugcgacucccugaaggggcugugccggaucaugggcaacggcuucgccgggugcaugcuguucccgcacaucagccccugcgaggugcgcgugcugaugcugcucuacuccagcaagaagaagaucuucaugggccugauccccuacgaccaguccggguucgucagcgccauccgccaggugaucaccacccggaagcaggccgugggccccgggggcgucaacuccggcccggugcagaucgugaacaacaaguuccuggcguggagcggggucauggaguggcaggagccccgccccgagcccaacagccgguccaagcgcuggcucccgagccacguguacgugaaccagggcgagauccugcggaccgagcaguggccccgcaagcuguacaugcagcucaucccccagcagcugcugacgacccucgucccgcuguuccggaacucccgccuggugcaguuccacuucaccaaggaccucgagacccugaagucccugugccggaucauggacaacggguucgccggcugcgugcacuucuccuacaaggccagcugcgagauccgcguccucaugcugcuguacuccagcgagaagaagaucuucaucgggcucaucccccacgaccagggcaacuucgugaacggcauccggcgcgugaucgccaaccagcagcagguccugcagcggaaccuggagcaggagcagcagcagcgcgggaugggcggguga

SEQ ID NO: 35257 - RNA, 522 nt, Artificial Sequence
  derived and/or modified sequence opt1 from PTP4A1__Homo_sapiens__XP_011534414
auggcccgcaugaaccggcccgccccgguggaggucaccuacaagaacaugcgcuuccugaucacccacaaccccacgaacgcgacccucaacaaguucaucgaggagcugaagaaguacggcgugaccaccaucgugcgggucugcgaggccacguacgacaccacccugguggagaaggaggggauccacgugcucgacuggcccuucgacgacggcgcgcccccgagcaaccagaucgucgacgacuggcugucccuggugaagaucaaguuccgcgaggagcccgggugcugcaucgccgugcacugcgucgccggccucgggcgggcccccgugcugguggcccuggcccucaucgagggcggcaugaaguacgaggacgccguccaguucauccgccagaagcggcgcggggcguucaacagcaagcagcugcuguaccucgagaaguaccggcccaagaugcgccugcgguucaaggacuccaacggccaccgcaacaacugcugcauccaguga

SEQ ID NO: 35258 - RNA, 447 nt, Artificial Sequence
  derived and/or modified sequence opt1 from PTP4A3__Homo_sapiens__XP_005250824
auggcccgcaugaaccggcccgccccgguggaggucagcuacaagcacaugcgcuuccugaucacccacaaccccaccaacgcgacgcucuccaccuucaucgaggaccugaagaaguacggcgccaccaccguggugcgggucugcgaggugacguacgacaagacgccccuggagaaggacgggaucaccguggucgacuggcccuucgacgacggcgccccgccgcccgggaaggugguggaggacuggcucagccuggucaaggccaaguucugcgaggcccccggcuccugcguggcggugcacugcgucgccgggcugggccgcaagcggcgcggcgccaucaacagcaagcagcucaccuaccuggagaaguaccggcccaagcagcgccugcgguucaaggacccccacacccacaagacccgcugcugcgugauguga

SEQ ID NO: 35259 - RNA, 456 nt, Artificial Sequence
  derived and/or modified sequence opt1 from PTPMT1__Homo_sapiens__NP_001137456
auggccgccaccgcgcugcucgaggccggccuggcccgcgugcuguucuaccccacccuccuguacacgcuguuccgggggaaggucccgggccgcgcccaccgggacugguaccaccgcaucgaccccaccgugcuccugggggcccugccccuccggagccugacccgccaggugucccgggcgggcgagcccgggccgcugccccgcccccggcgcagcguccccgugggcccgcucggcuccccgcccagccugcugucccaccucuucgccagcgccgccgggaccggccgggagcgcgcgcgcggggaccaccacgagcggggcgugcgggacgagguccccgugcagcuguucacgggggcccagauggagucccgcggcggcugcaagagccaccggcaggaccccgugauccacccccaccaggccuggcccgccgggugcuccuga

SEQ ID NO: 35260 - RNA, 1782 nt, Artificial Sequence
  derived and/or modified sequence opt1 from PTPN11__Homo_sapiens__NP_002825
augaccagccgccggugguuccaccccaacaucaccggcguggaggccgagaaccugcuccugacgcgcggggucgacggcuccuuccuggcccggcccagcaaguccaaccccggggacuucacccucagcgugcgccggaacggcgcggugacccacaucaagauccagaacaccggggacuacuacgaccuguacggcggcgagaaguucgccacgcuggccgagcucguccaguacuacauggagcaccacgggcagcugaaggagaagaacggcgacgugaucgagcugaaguacccccucaacugcgccgaccccaccuccgagcgcugguuccacgggcaccugagcggcaaggaggccgagaagcugcucaccgagaaggggaagcacggcuccuuccuggugcgggagagccagucccacccgggcgacuucguccugagcgugcgcaccggggacgacaagggcgaguccaacgacgggaaguccaaggugacgcacgucaugauccggugccaggagcucaaguacgacgugggcggcggggagcgcuucgacucccugaccgaccugguggagcacuacaagaagaaccccauggucgagacccucggcaccgugcugcagcugaagcagccccucaacacgacccggaucaacgcggccgagaucgagagccgcgugcgggagcuguccaagcuggccgagaccaccgacaaggucaagcagggguucugggaggaguucgagacgcuccagcagcaggagugcaagcugcuguacagccgcaaggagggccagcggcaggagaacaagaacaagaaccgcuacaagaacauccuccccuucgaccacacccggguggugcugcacgacggggacccgaacgagcccgucuccgacuacaucaacgccaacaucaucaugcccgaguucgagaccaagugcaacaacagcaagcccaagaaguccuacaucgcgacccagggcugccugcagaacacggugaacgacuucuggcgcaugguguuccaggagaacagccgggucaucgugaugaccaccaaggagguggagcgcggcaagagcaagugcgucaaguacuggccggacgaguacgcccucaaggaguacggggugaugcggguccgcaacgugaaggaguccgccgcccacgacuacacccugcgcgagcugaagcucagcaaggugggccaggggaacacggagcggaccgucuggcaguaccacuuccgcaccuggcccgaccacggcgugcccuccgaccccgggggcgugcuggacuuccuggaggagguccaccacaagcaggagagcaucauggacgccggcccgguggugguccacugcuccgcggggaucggccggaccgggacguucaucgugaucgacauccucaucgacaucauccgcgagaagggcguggacugcgacaucgacguccccaagaccauccagauggugcggagccagcgcuccgggauggugcagaccgaggcccaguaccgguucaucuacauggccguccagcacuacaucgagacccugcagcgccggaucgaggaggagcagaaguccaagcgcaagggccacgaguacacgaacaucaaguacagccuggccgaccagaccagcggcgaccagagcccccugcccccgugcacccccaccccgcccugcgccgagaugcgggaggacagcgcgcgcguguacgagaacguggggcucaugcagcagcagaaguccuuccgguga

SEQ ID NO: 35261 - RNA, 1986 nt, Artificial Sequence
  derived and/or modified sequence opt1 from PTPN12__Homo_sapiens__NP_001124480
augaucugggaguacaacguggucaucaucgugauggccugccgcgaguucgagaugggccggaagaagugcgagcgcuacuggccccuguacggggaggaccccaucaccuucgcccccuucaagaucagcugcgaggacgagcaggcgcggaccgacuacuucauccgcacgcuccugcuggaguuccagaacgagucccggcgccucuaccaguuccacuacgugaacuggcccgaccacgacguccccagcuccuucgacagcauccuggacaugaucucccugaugcggaaguaccaggagcacgaggacgugccgaucugcauccacugcagcgccggcugcgggcgcaccggcgccaucugcgccaucgacuacaccuggaaccuccugaaggccgggaagauccccgaggaguucaacguguucaaccugauccaggagaugcggacccagcgccacuccgcgguccagacgaaggagcaguacgagcucgugcaccgggccaucgcccagcuguucgagaagcagcugcagcucuacgagauccacggcgcccagaagaucgcggacggcgugaacgagaucaacaccgagaacauggucagcuccaucgagcccgagaagcaggacagcccgccgcccaagccgccccgcacccgguccugccugguggagggggacgccaaggaggagauccugcagccgcccgagccccaccccgugccgcccauccucacccccuccccgcccuccgccuuccccacggucaccaccguguggcaggacaacgaccgcuaccaccccaagcccgugcugcacauggucagcuccgagcagcacagcgccgaccugaaccggaacuacuccaagagcaccgagcuccccggcaagaacgaguccacgaucgagcagaucgacaagaagcuggagcgcaaccugagcuucgagaucaagaaggugccccuccaggaggggcccaagagcuucgacggcaacacccugcugaaccgggggcacgccaucaagaucaaguccgcgagccccugcaucgccgacaagaucuccaagccccaggagcucagcuccgaccugaacgugggcgacaccagccagaacuccugcgucgacugcagcgugacccaguccaacaaggugagcgucacgccgcccgaggagucccagaacagcgacaccccgccccgccccgaccggcugccccucgacgagaagggccacgugaccugguccuuccacgggccggagaacgccauccccauccccgaccugagcgagggcaacuccagcgacaucaacuaccagacccgcaagacggugucccugacccccagcccgaccacccaggucgagacgcccgaccucguggaccacgacaacaccagcccccuguuccggacgccccugagcuucaccaacccgcuccacagcgacgacuccgacagcgacgagcgcaacuccgacggggccgucacccagaacaagaccaacaucagcaccgccuccgcgaccgugagcgccgccacguccaccgagagcaucuccacccgcaaggugcugcccaugagcaucgcccggcacaacaucgccggcaccacgcacuccggcgcggagaaggacgucgacgugagcgaggacuccccgccgccccugcccgagcgcacccccgagagcuucgugcucgccuccgagcacaacacccccguccggagcgagugguccgagcugcagagccaggagcgcagcgagcagaagaaguccgaggggcugaucaccagcgagaacgagaagugcgaccaccccgccggcgggauccacuacgagaugugcaucgagugcccgcccaccuucuccgacaagcgggagcagaucagcgagaaccccacggaggccaccgacaucggcuucgggaaccgcugcggcaagcccaagggcccccgggacccgcccuccgaguggaccuga

SEQ ID NO: 35262 - RNA, 7401 nt, Artificial Sequence
  derived and/or modified sequence opt1 from PTPN13__Homo_sapiens__NP_006255
augcacgugagccuggccgaggcccucgagguccgcggcgggccccugcaggaggaggagaucugggcggugcugaaccaguccgccgagagccuccaggagcuguuccggaaggugucccuggccgacccggccgcccucggcuucaucaucagccccuggucccugcugcuccugcccagcggguccgucagcuucaccgacgagaacaucuccaaccaggaccugcgcgcguucaccgcccccgaggugcuccagaaccagagccugaccucccugagcgacguggagaagauccacaucuacucccucggcaugacccuguacuggggcgccgacuacgaggucccgcagagccagcccaucaagcugggcgaccaccucaacuccauccugcugggcaugugcgaggacgugaucuacgcccgggugagcguccgcaccgugcucgacgcgugcuccgcccacauccggaacagcaacugcgcccccuccuucagcuacgugaagcaccuggucaagcuggugcucgggaaccugagcggcaccgaccagcuguccugcaacagcgagcagaagcccgaccgcucccaggccauccgggaccgccuccgggggaagggccugccgaccgggcgcagcuccaccagcgacgugcuggacauccagaagccgccccugucccaccagaccuuccugaacaagggccugagcaaguccaugggcuuccucagcaucaaggacacccaggacgagaacuacuucaaggacauccuguccgacaacagcgggcgggaggacuccgagaacacguucagccccuaccaguucaagaccuccggcccggagaagaagcccauccccgggaucgacguccugagcaagaagaagaucugggccuccagcauggaccuccugugcaccgcggaccgcgacuucuccagcggcgagaccgccacguaccggcgcugccaccccgaggccgugaccgugcggaccagcaccacgccgcgcaagaaggaggcccgguacuccgacggcagcaucgcccuggacaucuucgggccccagaagauggaccccaucuaccacacccgcgagcuccccaccuccagcgcgaucuccagcgcccuggaccggauccgcgagcggcagaagaagcugcagguccuccgcgaggccaugaacguggaggagccggugcgccgguacaagaccuaccacggcgacgucuucuccacgagcuccgagagccccuccaucaucagcuccgagagcgacuuccgccaggugcggcgcuccgaggccagcaagcgguucgaguccagcagcgggcugcccggcguggacgagacccugucccaggggcagagccagcgccccucccggcaguacgagaccccguucgagggcaaccucaucaaccaggagaucaugcugaagcgccaggaggaggagcugaugcagcuccaggccaagauggcgcugcggcagagccgccugucccuguaccccggcgacaccaucaaggccagcaugcucgacaucacgcgggacccccugcgcgagaucgcccuggagaccgccaugacccagcggaagcuccgcaacuucuucgggcccgaguucgucaagaugaccaucgagccguucaucucccuggaccugccccggagcauccucacgaagaagggcaagaacgaggacaaccgccggaaggugaacaucaugcugcugaacgggcagcgccucgagcugaccugcgacaccaagaccaucugcaaggacgucuucgacauggugguggcccacaucggccuggucgagcaccaccucuucgcgcuggccacgcugaaggacaacgaguacuucuucguggaccccgaccucaagcugaccaagguggccccggagggguggaaggaggagcccaagaagaagaccaaggccaccgucaacuucacgcuguucuuccggaucaaguucuucauggacgacgugucccucauccagcacacccugaccugccaccaguacuaccugcagcuccgcaaggacauccuggaggagcgcaugcacugcgacgacgagaccagccugcuccuggcgucccuggcccuccaggccgaguacggcgacuaccagcccgaggugcacggcgucagcuacuuccggauggagcacuaccugcccgcccgcgugauggagaagcuggaccucuccuacaucaaggaggagcugccgaagcugcacaacaccuacgugggggccagcgagaaggagacggagcucgaguuccugaaggucugccagcggcugaccgaguacggcgugcacuuccaccgcgugcaccccgagaagaagucccagaccgggauccuccugggcgucugcagcaagggggugcugguguucgagguccacaacggcgugcggacccucgugcugcgcuuccccuggcgggagacgaagaagaucuccuucagcaagaagaagaucacccugcagaacaccuccgacggcaucaagcacggguuccagaccgacaacagcaagaucugccaguaccuccugcaccugugcagcuaccagcacaaguuccagcuccagaugcgcgcgcggcaguccaaccaggacgcccaggacaucgagcgcgccagcuuccggucccugaaccugcaggccgagagcguccgcggcuucaacauggggcgggccaucuccacgggcagccucgcguccagcacccugaacaagcuggccgugcgcccccucuccgugcaggccgagauccugaagcggcugagcugcuccgagcucagccuguaccagccgcugcagaacuccagcaaggagaagaacgacaaggccuccugggaggagaagccccgcgagaugagcaaguccuaccacgaccucagccaggccucccuguacccccaccggaagaacgucaucgugaacauggagcccccgccccagaccguggcggagcuggucggcaagcccagccaccagaugagccgcuccgacgccgagagccucgccggggugaccaagcugaacaacuccaagagcguggccucccugaaccggagccccgagcgccggaagcacgaguccgacagcuccagcaucgaggacccgggccaggcguacguccucgacgugcugcacaagcgcugguccaucgugagcucccccgagcgcgagaucacgcuggucaaccucaagaaggacgccaaguacgggcugggcuuccagaucaucgggggcgagaagaugggccggcuggaccucgggaucuucaucagcuccguggcccccggcgggcccgccgaccuggacggcugccugaagccgggggaccgccucaucagcgugaacuccgucagccuggagggcgugucccaccacgccgcgaucgagauccugcagaacgcccccgaggacgugacccucgucaucagccagcccaaggagaagaucagcaaggugcccuccaccccggugcaccugaccaacgagaugaagaacuacaugaagaaguccuccuacaugcaggacagcgccaucgacuccagcuccaaggaccaccacuggagccggggcacgcugcgccacaucuccgagaacagcuucgggcccuccggcgggcuccgggagggcagccuguccagccaggacucccgcaccgagagcgccucccugagccagucccaggucaacggguucuucgccagccaccucggcgaccagaccuggcaggagagccagcacggcucccccagcccguccgugaucagcaaggcgaccgagaaggagacguucaccgacuccaaccagagcaagaccaagaagcccgggaucuccgacgugaccgacuacagcgaccggggcgacuccgacauggacgaggccacguacagcuccagccaggaccaccagacccccaagcaggaguccagcuccagcgucaacaccuccaacaagaugaacuucaagaccuucagcuccagcccgcccaagcccggggacaucuucgagguggagcuggccaagaacgacaacagccugggcaucuccgugaccggcggggucaacaccagcgugcgccacggcgggaucuacgugaaggccgucaucccccagggggccgcggaguccgacgggcggauccacaagggcgaccgcgugcucgccgucaacggcgugagccuggagggggccacccacaagcaggccguggagacccugcggaacacgggccaggucgugcaccuccugcuggagaaggggcagucccccaccagcaaggagcacgugccggucacgccccagugcacccucuccgaccagaacgcgcagggccaggggcccgagaaggugaagaagacgacccaggugaaggacuacagcuucgucaccgaggagaacaccuucgaggugaagcuguucaagaacuccagcggccugggcuucuccuucagccgcgaggacaaccucauccccgagcagaucaacgccuccaucgugcgggucaagaagcuguucccggggcagcccgccgccgagagcggcaagaucgacgugggggacgugauccugaaggucaacggcgccucccugaaggggcucagccagcaggaggugaucuccgcgcugcgcggcaccgcccccgagguguuccugcuccugugccggcccccgcccggcguccugcccgagaucgacacggcccuccugacgccccugcagagcccggcccaggugcuccccaacagcuccaaggacagcucccagcccagcugcguggagcaguccaccagcuccgacgagaacgagaugagcgacaaguccaagaagcagugcaagagccccucccgccgggacagcuacuccgacagcuccgggagcggcgaggacgaccuggucaccgccccggcgaacaucuccaacagcacgugguccagcgcccugcaccagacccucagcaacauggugucccaggcccagagccaccacgaggcccccaagucccaggaggacaccaucugcaccauguucuacuacccccagaagauccccaacaagccggaguucgaggacagcaaccccagcccccugccgcccgacauggcccccgggcagagcuaccagccccaguccgagagcgcguccagcuccagcauggacaaguaccacauccaccacaucuccgagccgacgcgccaggagaacuggacgccccugaagaacgaccucgagaaccaccuggaggacuucgagcuggagguggagcuccugaucacccugaucaagagcgagaagggcucccucggguucaccgucacgaagggcaaccagcggaucggcugcuacgugcacgacgugauccaggaccccgccaagagcgacgggcgccugaagcccggcgaccgccugaucaaggucaacgacaccgacgugaccaacaugacccacacggacgccgugaaccuccugcgggccgccuccaagaccguccgccuggugaucgggcgggugcucgagcugccgcgcauccccaugcugccccaccuccugcccgacaucacccugaccugcaacaaggaggagcucggcuucagccugugcggcgggcacgacucccuguaccaggucguguacaucagcgacaucaacccgcggagcguggcggccaucgagggcaaccuccagcugcuggacgucauccacuacgugaacgggguguccacgcagggcaugacccucgaggaggucaaccgcgcccuggacaugagccugcccucccucgugcugaaggccacccggaacgaccugcccgugguccccagcuccaagcgcagcgcgguguccgcccccaagagcaccaaggggaacggcuccuacagcgugggcuccugcagccagcccgcccucacgcccaacgacuccuucagcaccgucgccggggaggagaucaacgagaucuccuaccccaagggcaagugcagcaccuaccagaucaagggguccccgaaccugacccugcccaaggagagcuacauccaggaggacgacaucuacgacgacucccaggaggccgaggugauccagagccuccuggacguggucgacgaggaggcgcagaaccugcucaacgagaacaacgccgccggcuacagcugcgggcccggcacgcugaagaugaacggcaagcuguccgaggagcggaccgaggacaccgacugcgacgggagcccccucccggaguacuucaccgaggccacgaagaugaacggcugcgaggaguacugcgaggagaaggugaaguccgagagccugauccagaagccccaggagaagaagaccgacgacgacgagaucaccugggggaacgacgagcugcccaucgagcgcaccaaccacgaggacuccgacaaggaccacagcuuccucacgaacgacgagcuggccgugcugcccgucgugaagguccucccguccggcaaguacaccggggcgaaccucaagagcgugauccgggugcugcgcggccuccuggaccagggcauccccuccaaggagcuggagaaccuccaggagcugaagccccuggaccagugccucaucgggcagaccaaggagaaccggcgcaagaaccgguacaagaacauccugccguacgacgccacccgcgucccccugggcgacgagggcggguacaucaacgccagcuucaucaagauccccguggggaaggaggaguucguguacaucgccugccagggcccccucccgaccacggucggcgacuucuggcagaugaucugggagcagaaguccaccgugaucgccaugaugacccaggagguggagggggagaagaucaagugccagcgguacuggcccaacauccugggcaagaccacgauggucagcaaccgccugcggcucgcgcuggugcgcaugcagcagcugaagggguucgugguccgggccaugacccucgaggacauccagacccgcgaggugcgccacaucucccaccugaacuucaccgccuggcccgaccacgacacgcccagccagccggacgaccugcucaccuucaucuccuacaugcggcacauccaccgcagcggccccaucaucacccacugcuccgccggcaucgggcggagcggcacccugaucugcaucgacgugguccuggggcucaucucccaggaccuggacuucgacaucagcgaccuggugcgcugcaugcggcuccagcgccacggcauggugcagacggaggaccaguacaucuucugcuaccaggucauccuguacgugcugacccggcuccaggcggaggaggagcagaagcagcagccccagcugcugaaguga

SEQ ID NO: 35263 - RNA, 3564 nt, Artificial Sequence
  derived and/or modified sequence opt1 from PTPN14__Homo_sapiens__NP_005392
augcccuucggccugaagcuccgccggacccgccgguacaacgugcugagcaagaacugcuucgucacccgcauccggcugcucgacuccaacgugaucgagugcacgcugagcguggaguccaccgggcaggagugccuggaggccgucgcccagcgccucgagcugcgggagacccacuacuucggccugugguuccucagcaagucccagcaggcgcgcuggguggagcuggagaagccccugaagaagcaccucgacaaguucgccaacgagccccugcuguucuucggggugauguucuacguccccaacgugagcuggcuccagcaggaggccacccgguaccaguacuaccuccaggugaagaaggacguccuggagggccgccugcggugcacgcuggaccaggugauccgccuggccgggcucgccgugcaggcggacuucggcgacuacaaccaguucgacucccaggacuuccugcgggaguacguccuguuccccauggaccucgcccuggaggaggccgugcuggaggagcucacccagaagguggcccaggagcacaaggcgcacagcggcauccugccggccgaggccgagcugauguacaucaacgaggucgagcgccucgacggguucggccaggagaucuuccccgugaaggacaaccacgggaacugcgugcaccugggcaucuucuucauggggaucuucguccggaaccgcaucggccggcaggccgugaucuaccgcuggaacgacaugggcaacaucacccacaacaaguccaccauccugguggagcucaucaacaaggaggagacggcccuguuccacaccgacgacaucgagaacgcgaaguacaucagccggcuguucgccacccgccacaaguucuacaagcagaacaagaucugcaccgagcaguccaacagcccgccgcccauccggcgccagcccacguggucccgcagcucccucccccggcagcagcccuacauccugccgcccguccacgugcagugcggggagcacuacagcgagacccacaccucccaggacagcaucuuccacggcaacgaggaggcccuguacugcaacucccacaacagccucgaccugaacuaccugaacgggaccgugacgaacggcagcgucugcuccgugcacagcgucaacucccucaacugcagccaguccuucauccaggccagccccguguccagcaaccuguccauccccggcagcgacaucaugcgcgccgacuacauccccucccaccggcacagcgcgaucaucgugcccuccuaccgccccacccccgacuacgagaccgucaugcggcagaugaagcgcgggauccugcacaccgacagccagucccagagccuccggaaccugaacaucaucaacacgcacgccuacaaccagccggaggaccugguguacucccagcccgagaugcgcgagcggcaccccuacaccgugcccuacggcccgcagggggucuacagcaacaagcucgugucccccagcgaccagcgcaaccccaagaacaacgugguccccagcaagccgggcgccuccgccaucagccacaccguguccacccccgagcuggccaacaugcagcugcaggggagccacaacuacuccacggcgcacaugcugaagaacuaccucuuccggcccccgccgcccuacccccgcccccggcccgccaccagcacccccgaccuggccucccaccgccacaaguacgugagcggcuccagccccgaccuggucacccggaaggugcagcucuccgugaagacguuccaggaggacagcuccccggucgugcaccagagccugcaggagguguccgagccccugaccgccaccaagcaccacggcaccgucaacaagcgccacagccucgaggugaugaacuccauggugcgggggauggaggccaugacgcugaagucccugcaccuccccauggcgcgccggaacacccugcgcgagcaggggcccccggaggaggggagcggcagccacgaggucccccagcugccccaguaccaccacaagaagaccuucagcgacgccaccaugcucauccacuccagcgaguccgaggaggaggaggaggaggcccccgagagcgugccgcagauccccaugcugcgcgagaagauggaguacuccgcccagcugcaggcggcccucgcccggauccccaacaagcccccgcccgaguaccccgggccccgcaagagcguguccaacggcgcccugcggcaggaccaggccagccugccgcccgcgauggcccgcgcccggguccuccgccacggccccgccaaggccaucuccaugagccggacggacccgcccgcggugaacggggccucccugggccccagcaucuccgagcccgaccugaccagcgugaaggagcgcgucaagaaggagccggugaaggagcggcccguguccgagauguucagccucgaggacuccaucaucgagcgcgagaugaugauccggaaccuggagaagcagaagauggccgggcuggaggcccagaagcgcccccucaugcuggccgcgcugaacggccucagcgucgcccgggugagcgggcgcgaggagaaccggguggacgccacccgcguccccauggacgagcgguuccgcacccugaagaagaagcuggaggagggcaugguguucaccgaguacgagcagaucccgaagaagaaggccaacggcaucuucuccacggcggcccuccccgagaacgccgagcggagccgcauccgggaggugguccccuacgaggagaaccgcguggagcugauccccaccaaggagaacaacaccggguacaucaacgccucccacaucaagguggucgugggcggggccgaguggcacuacaucgcgacccagggcccgcugccccacacgugccacgacuucuggcagauggugugggagcagggcgucaacgugaucgccauggugaccgccgaggaggagggcggccgcaccaagagccaccgguacuggcccaagcucggguccaagcacagcuccgccaccuacggcaaguucaaggucacgaccaaguuccgcaccgacagcgugugcuacgccaccacggggcugaaggugaagcaccuccuguccggccaggagcggaccgucuggcaccuccaguacaccgacuggcccgaccacggcugcccggaggacgugcagggguuccugagcuaccuggaggagauccaguccgugcgccggcacaccaacagcaugcuggagggcacgaagaaccgccacccgcccaucgucgugcacugcuccgcgggggucggccggaccggggugcugauccucagcgagcugaugaucuacugccuggagcacaacgagaagguggagguccccaugaugcuccgccugcugcgggagcagcgcauguucaugauccagaccaucgcccaguacaaguucguguaccaggugcucauccaguuccugcagaacucccggcugaucuga

SEQ ID NO: 35264 - RNA, 1062 nt, Artificial Sequence
  derived and/or modified sequence opt1 from PTPN18__Homo_sapiens__NP_001135842
augagccgcucccuggacagcgcccgguccuuccucgagcgccuggaggcccggggcgggcgcgagggcgcggugcuggccggggaguucagcaagcggugcgagcgcuacugggcccaggagcaggagccccuccagaccggccuguucugcaucacccugaucaaggagaaguggcucaacgaggacaucaugcugcggacgcugaaggucaccuuccagaaggagucccgcagcguguaccagcuccaguacauguccuggcccgaccgcggggugcccagcucccccgaccacaugcuggccauggucgaggaggcccggcggcugcagggcagcggccccgagccgcucugcgugcacugcuccgcggggugcggccgcaccggggugcugugcaccgucgacuacgugcggcagcugcuccugacgcagaugaucccgcccgacuucagccuguucgacgugguccucaagaugcgcaagcagcggcccgccgccgugcagaccgaggagcaguaccgcuuccuguaccacaccguggcccagauguucugcuccacccugcagaacgcgagcccccacuaccagaacaucaaggagaacugcgcgccccucuacgacgacgcccuguuccugcggacgccccaggcccuccuggccaucccccgcccgcccggcgggguccugcgguccaucagcgugcccggcucccccggccacgccauggccgacaccuacgccgugguccagaagcgcggggccccggccggcgcggggagcggcacccagaccggcacggggaccggcaccggggcccgguccgccgaggaggcgccccucuacagcaaggugacgccccgcgcccagcgccccggcgcccacgccgaggacgcccgggggacccugccgggccgcgugcccgccgaccagagccccgccggcuccggggcguacgaggacgucgccggcggggcccagaccggcgggcugggcuucaaccuccggaucggccgccccaaggggccgcgggacccgcccgccgaguggacccgcguguga

SEQ ID NO: 35265 - RNA, 1089 nt, Artificial Sequence
  derived and/or modified sequence opt1 from PTPN1__Homo_sapiens__NP_001265547
auggaggaggcccagcgcagcuacauccugacccagggcccccucccgaacacgugcgggcacuucugggagauggugugggagcagaagucccggggcgucgugaugcugaaccgcgugauggagaaggggagccugaagugcgcccaguacuggccccagaaggaggagaaggagaugaucuucgaggacaccaaccucaagcugacccugaucuccgaggacaucaagagcuacuacaccguccggcagcucgagcuggagaaccugaccacgcaggagacccgcgagauccuccacuuccacuacaccaccuggcccgacuucggcgugcccgaguccccggcgagcuuccugaacuuccuguucaaggugcgggaguccgggagccucucccccgagcacggccccgucguggugcacugcagcgccggcaucgggcgcuccggcacguucugccuggccgacacgugccugcuccugauggacaagcggaaggaccccagcuccgucgacaucaagaaggugcugcucgagaugcgcaaguuccggauggggcugauccagaccgccgaccagcugcgcuucagcuaccucgccgugaucgagggcgcgaaguucaucaugggggacuccagcguccaggaccaguggaaggagcugucccacgaggaccuggagccgccgcccgagcacaucccgcccccgccccggccgcccaagcgcauccucgagccccacaacggcaagugccgggaguucuuccccaaccaccagugggugaaggaggagacccaggaggacaaggacugccccaucaaggaggagaagggcagcccccugaacgccgcccccuacgggaucgaguccaugagccaggacaccgaggugcgcagccgggucgugggcgggucccugcgcggcgcccaggcggccagccccgccaagggcgagcccucccuccccgagaaggacgaggaccacgcccugagcuacuggaagcccuuccuggugaacaugugcgucgccaccgugcucaccgcgggggccuaccugugcuaccgguuccuguucaacuccaacaccuga

SEQ ID NO: 35266 - RNA, 3525 nt, Artificial Sequence
  derived and/or modified sequence opt1 from PTPN21__Homo_sapiens__XP_011534669
augccccugccguucggccucaagcugaagcgcacccggcgcuacaccgugagcuccaagagcugccuggucgcccggauccagcuccugaacaacgaguucguggaguucacgcuguccguggagagcaccgggcaggagucccucgaggccgucgcgcagcgccuggagcugcgggaggugaccuacuucagccucugguacuacaacaagcagaaccagcgccgguggguggaccuggagaagccccugaagaagcagcucgacaaguacgcccuggagcccaccgucuacuucggcgugguguucuacguccccuccgugagccagcugcagcaggagaucacgcgcuaccaguacuaccuccagcugaagaaggacauccuggagggguccaucccgugcacccucgagcaggccauccagcuggccggccuggccgugcaggcggacuucggggacuucgaccaguacgagagccaggacuuccuccagaaguucgcccuguuccccgucggcuggcugcaggacgagaaggugcucgaggaggccacccagaagguggcccugcugcaccagaaguaccggggccucaccgcgcccgacgccgagaugcuguacaugcaggaggucgagcgcauggacggguacggcgaggaguccuaccccgccaaggacagccagggguccgacaucagcaucggcgccugccuggaggggaucuucgugaagcacaagaacggccggcacccgguggucuuccgcuggcacgacaucgccaacaugucccacaacaagagcuucuucgcgcucgagcuggccaacaaggaggagacgauccaguuccagaccgaggacauggagaccgccaaguacaucuggcggcugugcguggcccgccacaaguucuaccggcucaaccagugcaaccugcagacccagacggugaccgucaaccccauccgccggcgcuccagcucccggaugagccugcccaagccccagccguacgugaugcccccccccccgcagcuccacuacaacggccacuacaccgagcccuacgccagcucccaggacaaccuguucgugcccaaccagaacggguacuacugccacagccagaccucccuggaccgcgcgcagaucgaccucaacggccggauccgcaacgggagcgucuacuccgcccacagcacgaacucccugaacaacccccagccguaccugcagcccagccccauguccagcaaccccuccaucaccggcagcgacgugaugcgcccggacuaccuccccucccaccggcacagcgccgucaucccccccuccuaccgcccgacccccgacuacgagaccgugaugaagcagcugaaccggggccuggugcacgccgagcgccagagccacucccuccggaaccugaacaucgggagcuccuacgccuacagccgccccgcggcccuggucuacagccagccggagauccgggagcacgcccagcuccccucccccgccgccgcgcacugccccuucagccuguccuacagcuuccacuccccgagccccuaccccuaccccgccgagcgccggccgguggugggcgccgucuccgugcccgagcugacgaacgcccagcugcaggcgcaggacuaccccagccccaacaucaugcgcacccagguguaccggccgcccccccccuacccgcccccccgccccgccaacuccaccccggaccucagccggcaccuguacaucuccagcuccaaccccgaccugaucacccgccggguccaccacagcgugcagacguuccaggaggacucccuccccguggcccacagccugcaggaggucuccgagccccugaccgccgcccgccacgcgcagcuccacaagcggaacagcaucgagguggccgggcugagccacggccuggaggggcuccgccugaaggagcggacccuguccgccagcgccgccgagguggcgccgcgcgccgucuccgugggcagccagcccuccguguucaccgagcgcacgcagcgggagggccccgaggaggccgaggggcuccgcuacggccacaagaagagccuguccgacgccaccaugcugauccacagcuccgaggaggaggaggacgaggacuucgaggaggagagcggggcccgggcgccgcccgcccgcgcccgggagccccgccccggccucgcccaggacccgcccgggugcccccggguccugcuggcgggcccccuccacauccuggagccgaaggcccacgugcccgacgccgagaagcgcaugauggacuccagccccgugcggaccaccgccgaggcccagcgccccuggcgggacggccugcucaugccguccaugagcgaguccgaccugacgaccagcgggcgcuaccgggcgcgccgggacucccugaagaagcgccccgucagcgaccuccuguccggcaagaagaacaucguggaggggcugcccccccucggcgggaugaagaagacccggguggacgccaagaagaucggcccgcugaagcuggccgcccucaacggccugagccugagccgcgucccccuccccgacgaggggaaggagguggccacccgggcgacgaacgacgagcgcugcaagauccuggagcagcggcuggagcagggcaugguguucaccgaguacgagcgcauccucaagaagcgccuggucgacggggagugcuccaccgcccggcugcccgagaacgccgagcgcaaccgguuccaggacgugcucccguacgacgacgugcgcgucgagcuggugcccaccaaggagaacaacaccggcuacaucaacgccagccacaucaagguguccgucagcggcaucgagugggacuacaucgccacgcaggggccccugcagaacaccugccaggacuucuggcagauggugugggagcagggcaucgcgaucaucgccauggugaccgccgaggaggaggggggccgggagaaguccuuccgcuacuggccccggcucgggagccgccacaacaccgucacguacggccgguucaagaucaccacccgcuuccggaccgacuccggcugcuacgccacgaccgggcugaagaugaagcaccugcucaccggccaggagcgcaccguguggcaccugcaguacacggacuggccggagcacgggugccccgaggaccugaagggcuuccucagcuaccuggaggagauccaguccgugcggcgccacaccaacagcaccuccgacccccagagccccaacccgccccugcucguccacugcuccgcgggggugggccggaccggcguggucauccugagcgagaucaugaucgccugccuggagcacaacgaggugcucgacaucccccgcgugcuggacaugcugcggcagcagcgcaugaugcucguccagacgcugugccaguacaccuucguguaccgggugcugauccaguuccucaaguccagccgccugaucuga

SEQ ID NO: 35267 - RNA, 1980 nt, Artificial Sequence
  derived and/or modified sequence opt1 from PTPN22__Homo_sapiens__XP_011539526
augcagcuggaguucggccccuucagcguguccugcgaggccgagaagcgcaagagcgacuacaucauccggacccucaaggucaaguucaacuccgagacccgcacgaucuaccaguuccacuacaagaacuggcccgaccacgacgugcccagcuccaucgaccccauccuggagcugaucugggacgugcggugcuaccaggaggacgacagcguccccaucugcauccacugcuccgccgggugcggccgcaccggggugaucugcgcgaucgacuacaccuggaugcuccugaaggacggcaucauccccgagaacuucagcguguucucccugauccgggagaugcgcacccagcggcccagccucguccagacgcaggagcaguacgagcugguguacaacgccgugcuggagcuguucaagcgccagauggacgucauccgggacaagcacuccgggaccgagagccaggccaagcacugcauccccgagaagaaccacacccugcaggccgacuccuacagccccaaccugccgaaguccaccacgaaggccgcgaagaugaugaaccagcagcgcaccaagauggagaucaaggagagcuccagcuucgacuuccggaccuccgagaucagcgccaaggaggagcucgugcugcaccccgccaagagcuccaccagcuucgacuuccucgagcucaacuacuccuucgacaagaacgccgacacgaccaugaaguggcagaccaaggcguuccccaucgugggcgagccccugcagaagcaccagagccuggaccucggcucccugcuguucgaggggugcagcaacuccaagccggucaacgccgccggccgcuacuucaacagcaaggugcccaucacccggacgaaguccacccccuucgagcucauccagcagcgcgagaccaaggagguggacagcaaggagaacuucuccuaccuggagagccagccccacgacuccugcuucgucgagaugcaggcccagaaggugaugcacgugagcuccgccgagcugaacuacagccucccguacgacuccaagcaccagauccggaacgcgagcaacgucaagcaccacgacuccagcgcccuggggguguacagcuacaucccccugguggagaaccccuacuucuccagcuggcccccguccggcaccagcuccaagaugagccucgaccugcccgagaagcaggacgggacggucuuccccuccagccugcuccccaccuccagcaccucccuguucagcuacuacaacucccacgacagccugucccucaacagcccgaccaacaucuccagccugcugaaccaggagagcgccgugcucgccacggcgccccgcaucgacgacgagaucccgccgccccugcccguguggacccccgaguccuucaucgucguggaggaggccggcgaguucagccccaacguccccaagucccugagcuccgccgugaaggugaagaucggcaccagccucgaguggggcgggaccuccgagcccaagaaguucgacgacagcgucauccugcggcccuccaagagcgugaagcugcgcucccccaagagcgagcuccaccaggaccgguccagcccgcccccgccccugcccgagcgcacgcuggaguccuucuuccucgccgacgaggacugcaugcaggcccagagcaucgagaccuacuccaccagcuaccccgacaccauggagaacuccacgagcagcaagcagacccugaagacccccgggaaguccuucacccggagcaagucccugaagauccuccgcaacaugaagaaguccaucugcaacagcugcccgcccaacaagcccgccgagagcgugcaguccaacaacagcuccagcuuccugaacuucggcuucgcgaaccgcuucuccaagcccaagggcccgcggaacccgccgcccacguggaacaucuga

SEQ ID NO: 35268 - RNA, 4533 nt, Artificial Sequence
  derived and/or modified sequence opt1 from PTPN23__Homo_sapiens__NP_001291411
augcugggcgccauggacaagcgcgugagcgaggaggggaugaaggugagcugcacccacuuccagugcgccgccggcgccuucgccuaccugcgggagcacuucccccaggccuacagcguggacaugagccgccagauccugacccugaacgugaaccugaugcuggggcaggcccaggagugccugcucgagaaguccaugcuggacaaccgcaagagcuuccuggucgcccggaucagcgcccaggugguggacuacuacaaggaggccugccgggcccucgagaaccccgacaccgccucccugcugggccgcauccagaaggacuggaagaagcucguccagaugaagaucuacuacuucgccgccguggcccaccuccacauggggaagcaggccgaggagcagcagaaguucggcgagcggguggccuacuuccagagcgcccuggacaagcucaacgaggccaucaagcuggccaagggccagcccgacaccguccaggacgcccugcgcuucaccauggacgugaucgggggcaaguacaacuccgccaagaaggacaacgacuucaucuaccacgaggccgugcccgcccucgacacccugcagcccgucaagggggcgccccuggugaagccccuccccgugaaccccacggaccccgccgucaccggccccgacaucuucgccaagcuggugcccauggccgcccacgaggccagcucccuguacagcgaggagaaggccaagcuccugcgggagaugauggccaagaucgaggacaagaacgaggugcuggaccaguucauggacuccaugcagcucgaccccgagaccgucgacaaccuggacgccuacagccacaucccgccccagcugauggagaagugcgccgcccucuccgugcgccccgacaccgugcggaaccugguccagagcaugcagguccuguccgggguguucacggacgucgaggcgagccucaaggacauccgcgaccugcuggaggaggacgagcuccuggagcagaaguuccaggaggccgugggccaggccggcgccaucuccaucaccagcaaggccgagcuggcggagguccggcgcgagugggccaaguacauggaggugcacgagaaggccagcuucaccaacuccgagcuccaccgggccaugaaccugcacguggggaaccugcgccuccugagcggcccccuggaccagguccgggccgcgcuccccacccccgcccugucccccgaggacaaggccgugcugcagaaccucaagcgcauccuggccaaggugcaggagaugcgggaccagcgcgucagccuggagcagcagcugcgggagcucauccagaaggacgacaucacggccucccuggugaccaccgaccacagcgagaugaagaagcuguucgaggagcagcucaagaaguacgaccagcugaagguguaccuggagcagaaccucgcggcccaggaccgcguccugugcgcccugaccgaggccaacgugcaguacgcggccgugcgccggguccucuccgaccuggaccagaaguggaacagcacgcugcagacccucguggccuccuacgaggccuacgaggaccugaugaagaagucccaggaggggcgcgacuucuacgccgaccuggaguccaagguggcggcccuccuggagcggacccagagcacgugccaggcccgcgaggccgcccggcagcagcugcucgaccgcgagcugaagaagaagcccccgccccggcccaccgcgcccaagccccugcucccccgccgggaggaguccgaggccgucgaggccggcgacccgcccgaggagcugcgcucccugccgcccgacaugguggccggcccccggcuccccgacaccuuccugggguccgccacgccccugcacuucccgcccagccccuuccccuccagcaccggccccgggccccacuaccucuccggcccccugccgcccgggacguacagcggccccacccagcugauccagccccgcgcgcccggcccccacgccaugcccguggcccccgggcccgcccucuaccccgcgcccgccuacacccccgagcugggccuggucccccggagcagcccccagcacgggguggugagcucccccuacgucggcguggggcccgcgccgcccguggccggccuccccagcgcgcccccgccccaguucuccggccccgagcuggcgauggccguccgccccgccaccacgaccguggacagcauccaggcccccauccccucccacaccgcgccccggcccaaccccacccccgcgcccccgccgcccugcuucccggugccgccgccccagccgcugcccacgcccuacaccuaccccgccggggccaagcagccgauccccgcccagcaccacuucagcuccggcauccccgccggguuccccgccccgcgcaucggcccccagccccagccgcacccccagccccaccccagccaggccuucgggccgcagccgccccagcagccccucccgcugcagcacccccaccuguucccgccccaggccccgggccuccugccgccccagucccccuacccguacgcgccccagcccggcguccuggggcagcccccgccgccccugcacacccagcuguaccccggcccggcccaggacccccugcccgcgcacagcggggcccuccccuucccgucccccggcccgccccagccgccccacccgccccuggccuacggccccgcccccagcacccggcccauggggccccaggcggcgccccugacgauccgcggccccuccagcgccgggcaguccacccccagcccccaccucgugcccagccccgcccccuccccgggccccgggcccgugcccccgcggccgcccgccgcggagcccccgcccugccugcgccgcggcgccgccgccgccgaccugcucagcuccagccccgagucccagcacggcgggacccagagcccgggcgggggccagccccugcugcagcccaccaaggucgacgcggccgaggggcggcgcccccaggcccuccggcugaucgagcgcgacccguacgagcaccccgagcggcugcgccagcuccagcaggagcuggaggccuuccggggccagcugggcgacgugggggcccucgacaccguguggcgcgagcugcaggacgcgcaggagcacgacgcccggggccgcuccaucgccaucgcccggugcuacagccugaagaaccgccaccaggacgucaugcccuacgacuccaaccggguggugcuccgcagcgggaaggacgacuacaucaacgcguccugcgucgagggccugagccccuacugcccgccccugguggccacgcaggcgccccugcccgggaccgccgccgacuucuggcugauggugcacgagcagaaggucuccgugaucgugaugcuggucagcgaggcggagauggagaagcagaagguggcccgguacuucccgaccgagcgcggccagcccauggugcacggcgcccucucccuggcccugagcuccguccggagcaccgagacgcacguggagcgcgugcucucccugcaguuccgggaccagagccugaagcgcagccucguccaccuccacuuccccaccuggcccgagcuggggcucccggacucccccagcaaccugcugcgguucauccaggaggugcacgcccacuaccuccaccagcgcccccugcacacccccaucaucgugcacugcuccagcggcgucgggcgcaccggcgcguucgcccugcucuacgccgccgugcaggaggucgaggccgggaacggcaucccggagcugccccagcuggugcggcgcaugcggcagcagcgcaagcacaugcuccaggagaagcugcaccuccgguucugcuacgaggcggugguccgccacguggagcagguccuccagcggcacggcgugccgccgcccugcaagccccuggccuccgccagcaucucccagaagaaccaccucccccaggacagccaggaccucgugcucgggggcgacgugcccaucuccagcauccaggccacgaucgcgaagcuguccauccgcccgcccgggggccuggagagccccgucgccucccuccccggccccgccgagccgcccgggcugccgcccgccagccugcccgaguccacccccaucccgagcuccuccccgccgccccuguccagcccgcugcccgaggcgccccagcccaaggaggagccgcccgugcccgaggcgcccagcuccggcccgcccagcuccagccuggagcuccuggccucccugacccccgaggccuucagccucgacuccagccugcgggggaagcagcgcauguccaagcacaacuuccugcaggcccacaacggccaggggcuccgggccacccgccccagcgacgacccgcugucccugcucgacccccuguggacgcugaacaagaccuga

SEQ ID NO: 35269 - RNA, 1233 nt, Artificial Sequence
  derived and/or modified sequence opt1 from PTPN2__Homo_sapiens__NP_001193942
augcccaccaccaucgagcgcgaguucgaggagcuggacacgcagcggcgcuggcagccgcucuaccuggagauccggaacgagagccacgacuacccccaccgcguggccaaguuccccgagaaccggaaccgcaaccgguaccgcgacgucucccccuacgaccacagccgggugaagcugcagaacgccgagaacgacuacaucaacgcgucccucguggacaucgaggaggcccagcgcagcuacauccugacccagggcccgcugcccaacacgugcugccacuucuggcucauggucuggcagcagaagaccaaggccguggugaugcugaaccggaucgucgagaaggaguccgugaagugcgcccaguacuggcccaccgacgaccaggagaugcuguucaaggagaccggguucagcgugaagcuccuguccgaggacgucaagagcuacuacaccgugcaccuccugcagcuggagaacaucaacuacaucgagaaccuguggaucacccucuaccugaagcugcucaugcuggacgugaagcgcucccucaagagcggcgagacgcggaccaucucccacuuccacuacaccaccuggcccgacuucggggucccggagagccccgccuccuuccugaacuuccuguucaaggugcgcgagagcggcucccugaaccccgaccacgggcccgcggugauccacugcagcgccggcaucggccgguccgggacguucagccucgucgacacgugccuggugcugauggagaagggcgacgacaucaacaucaagcagguccuccugaacaugcgcaaguaccggauggggcugauccagaccccggaccagcuccgcuucuccuacauggccaucaucgagggcgccaagugcaucaagggggacagcagcauccagaagcgguggaaggagcuguccaaggaggaccugagccccgcguucgaccacucccccaacaagaucaugaccgagaaguacaacggcaaccgcaucggccucgaggaggagaagcugaccggggaccggugcaccggccugagcuccaagaugcaggacaccauggaggagaacagcgaguccgcccuccgcaagcgcauccgggaggaccgcaaggccaccacggcccagaaggugcagcagaugaagcagcggcugaacgagaacgagcgcaagcggaagcgcccccggcugaccgacaccuga

SEQ ID NO: 35270 - RNA, 2607 nt, Artificial Sequence
  derived and/or modified sequence opt1 from PTPN3__Homo_sapiens__NP_001138840
augaccagccgccugcgggcccucggcgggcgcaucaacaacauccggaccuccgagcugcccaaggagaagacgcgcagcgaggugaucugcuccauccacuuccuggacggcgucgugcagaccuucaaggugaccaagcaggacaccgggcagguccuccuggacauggugcacaaccaccugggcgugacggagaaggaguacuucgggcuccagcacgacgacgacagcgucgacuccccgcgguggcuggaggccagcaaggcgauccgcaagcagcugaagggcggcuuccccugcacccuccacuuccgggugcgcuucuucauccccgaccccaacacccugcagcaggagcagacccggcaccuguacuuccuccagcugaagauggacaucugcgaggggcgccugacgugcccgcucaacuccgccgugguccuggccagcuacgccgugcagucccacuucggcgacuacaacagcuccauccaccaccccggguaccugagcgacucccacuucauccccgaccagaacgaggacuuccucaccaagguggagagccugcacgagcagcacuccggccugaagcagagcgaggccgaguccugcuacaucaacaucgcgcggacccucgacuucuacggggucgagcugcacagcggccgcgaccugcacaaccucgaccugaugaucggcaucgccuccgccgggguggccguguaccggaaguacaucugcaccagcuucuaccccugggucaacauccugaagaucagcuucaagcgcaagaaguucuucauccaccagcggcagaagcaggcggagucccgcgagcacaucguggccuucaacaugcucaacuaccggagcugcaagaaccuguggaaguccugcguggagcaccacacguucuuccaggccaagaagcugcucccgcaggagaagaacguccugagccaguacuggaccaugggcucccgcaacaccaagaagcggagcccccgccugcggcacgagauccgcaagccccgccacuccagcgccgacaaccucgccaacgagaugaccuacaucacggagaccgaggacguguucuacaccuacaaggggucccuggcgccccaggacagcgacuccgaggugagccagaaccgguccccgcaccaggagagccuguccgagaacaaccccgcccagagcuaccucacccagaaguccagcuccagcgucagccccuccagcaacgcccccggcuccugcagcccggacggcguggaccagcagcugcuggacgacuuccaccgcgugacgaagggcggguccaccgaggacgccagccaguacuacugcgacaagaacgacaacggggacuccuaccucguccugauccggaucacccccgacgaggacggcaaguucggguucaaccugaagggcggcguggaccagaagaugccccucgucgugagccgcaucaaccccgaguccccggccgacacgugcauccccaagcugaacgagggggaccagaucgugcugaucaacggccgggacaucagcgagcacacccacgaccaggucgugauguucaucaaggcgucccgcgagagccacucccgggagcucgcccuggugauccgccggcgcgccguccggagcuucgccgacuucaaguccgaggacgagcugaaccagcuguuccccgaggccaucuuccccaugugcccggagggcggggacacccucgaggggagcauggcgcagcugaagaagggccuggaguccggcaccgugcucauccaguucgagcagcuguaccgcaagaagcccgggcuggccaucaccuucgccaagcucccccagaaccuggacaagaaccgguacaaggacgugcugcccuacgacacgacccgcguccuccugcagggcaacgaggacuacaucaacgccagcuacgugaacauggagaucccggccgcgaaccuggugaacaaguacaucgccacccaggggccccucccccacacgugcgcccaguucuggcaggucgugugggaccagaagcugagccugaucgugaugcucaccacccugaccgagcggggccgcaccaagugccaccaguacuggccggacccgcccgacgucaugaaccacgggggcuuccacauccagugccaguccgaggacugcacgaucgccuacgugagccgggagaugcuggugaccaacacccagaccggcgaggagcacaccgucacgcaccuccaguacguggcguggcccgaccacggggugcccgacgacuccagcgacuuccuggaguucgucaacuacgugcgcucccugcggguggacagcgagcccguccucgugcacugcuccgccggcaucgggcgcaccggcgugcuggucaccauggagaccgccaugugccugacggagcgcaaccuccccaucuacccccuggacaucgugcggaagaugcgcgaccagcgggccaugauggugcagaccagcucccaguacaaguucgucugcgaggccauccugcgcguguacgaggagggccucgugcagaugcuggacccgagcuga

SEQ ID NO: 35271 - RNA, 2781 nt, Artificial Sequence
  derived and/or modified sequence opt1 from PTPN4__Homo_sapiens__NP_002821
augaccagccgcuuccggcugcccgccggccgcaccuacaacgugcgggccuccgagcucgcgcgcgaccggcagcacacggaggucgugugcaacauccugcugcucgacaacaccgugcaggccuucaaggucaacaagcacgaccagggccaggugcugcuggacguggucuucaagcaccucgaccugaccgagcaggacuacuucgggcugcagcucgccgacgacagcaccgacaacccgcgcuggcuggaccccaacaagcccauccggaagcagcugaagcgcgggucccccuacagccucaacuuccgggugaaguucuucguguccgacccgaacaagcugcaggaggaguacacgcgcuaccaguacuuccugcagaucaagcaggacauccucaccggccggcugcccugccccagcaacaccgccgcccugcucgcguccuucgccguccagagcgagcugggggacuacgaccaguccgagaaccugagcggcuaccucuccgacuacagcuucauccccaaccagccgcaggacuucgagaaggagaucgccaagcugcaccagcagcacaucggccugucccccgccgaggcggaguucaacuaccucaacaccgcccgcacgcuggagcuguacgggguggaguuccacuacgcccgggaccagagcaacaacgagaucaugaucggcgugauguccgggggcauccucaucuacaagaaccgcguccggaugaacaccuuccccuggcugaagaucgugaagaucagcuucaagugcaagcaguucuucauccagcugcgcaaggagcuccacgagucccgggagacccugcugggguucaacauggugaacuaccgcgccugcaagaaccucuggaaggccugcgucgagcaccacaccuucuuccggcuggaccgcccccugccgccccagaagaacuucuucgcgcacuacuucacgcucggcagcaaguuccgguacugcggccgcaccgaggugcaguccgugcaguacgggaaggagaaggccaacaaggaccgcgucuucgcccggagccccagcaagccccuggcccgcaagcugauggacugggagguggugucccggaacagcaucuccgacgaccgccucgagacccagagccugccgucccggagcccgcccggcacccccaaccaccgcaacuccacguucacccaggaggggacccggcugcgccccagcuccgucggccaccucguggaccacauggugcacaccagccccuccgaggucuucgugaaccagcggagccccuccagcacgcaggccaacuccaucguccuggagagcucccccagccaggagaccccgggcgacgggaagccgcccgcgcugccgcccaagcaguccaagaagaacagcuggaaccagauccacuacagccacucccagcaggaccucgagagccacaucaacgagaccuucgacauccccuccagccccgagaagcccacccccaacggcgggaucccccacgacaaccuggugcugauccgcaugaagcccgacgagaacggccgguucggguucaacgugaagggcggcuacgaccagaagaugccggucaucgugucccgcguggcccccgggacgcccgccgaccucugcgucccccggcugaacgagggcgaccagguggugcugaucaacgggcgcgacaucgccgagcacacccacgaccaggucgugcuguucaucaaggccagcugcgagcggcacuccggcgagcucaugcugcuggugcgcccgaacgcggucuacgacgugguggaggagaagcucgagaacgagcccgacuuccaguacauccccgagaaggcgccccuggacagcguccaccaggacgaccacucccugcgggagagcaugauccagcucgccgaggggcugaucaccggcaccgugcugacgcaguucgaccagcucuaccgcaagaagccgggcaugaccauguccugcgccaagcugccccagaacaucagcaagaaccgguaccgcgacaucucccccuacgacgccacccgcgugauccugaaggggaacgaggacuacaucaacgccaacuacaucaacauggagauccccagcuccagcaucaucaaccaguacaucgccugccagggcccgcucccccacacgugcaccgacuucuggcagaugaccugggagcagggguccagcauggucgugaugcugaccacccagguggagcggggccgcgucaagugccaccaguacuggcccgagcccacggggagcuccagcuacggcugcuaccaggugaccugccacuccgaggagggcaacaccgccuacaucuuccggaagaugacccuguucaaccaggagaagaacgagagccgcccgcucacccagauccaguacaucgccuggcccgaccacggggugcccgacgacuccagcgacuuccuggacuucgucugccacgugcggaacaagcgcgcgggcaaggaggagcccguggucgugcacugcuccgccgggaucggccggacgggcgugcugaucaccauggagaccgccaugugccucaucgagugcaaccagccggucuacccccuggacaucgugcgcaccaugcgggaccagcgcgccaugaugauccagacgcccagccaguaccgguucgugugcgaggccauccugaaggucuacgaggagggguucgugaagccgcucaccaccuccaccaacaaguga

SEQ ID NO: 35272 - RNA, 1602 nt, Artificial Sequence
  derived and/or modified sequence opt1 from PTPN5__Homo_sapiens__NP_001265165
augaacuacgagggcgcccgcagcgagcgggagaaccacgccgcggacgacuccgagggcggggcccuggacaugugcugcagcgagcgccuccccgggcugccgcagcccaucgugauggaggcccuggacgaggccgagggccuccaggacucccagcgggagaugcccccgcccccgccgcccagcccgcccuccgaccccgcccagaagcccccgccccgcggggcgggcagccacucccugaccguccggagcucccugugccucuucgccgccagccaguuccugcuggagcccaccgccuggcucgacuccggcacguggggcgugcccagccugcugcucguguuccuguccgucgggcuggugcucgugaccacccuggucuggcaccuccuccgcaccccgcccgagccgcccacgccccugccgcccgaggaccggcgccagagcgugucccggcagcccagcuucaccuacuccgaguggauggaggagaagaucgaggacgacuuccuggaccucgaccccgugcccgagacccccgucuucgacugcgugauggacaucaagcccgaggcggaccccaccagccugaccgugaaguccauggggcugcaggagcgccggggcagcaacgucagccugacccuggacaugugcacccccgggugcaacgaggagggcuucggcuaccugaugagcccccgcgaggaguccgcccgggaguaccuccuguccgccagccgcgugcugcaggccgaggagcuccacgagaaggcccuggaccccuuccugcuccaggcggaguucuucgagauccccaugaacuucguggaccccaaggaguacgacauccccgggcugguccggaagaaccgcuacaagaccauccugccgaacccccacucccgggugugccucacgagccccgaccccgacgacccgcuguccagcuacaucaacgccaacuacauccgcggcuacgggggcgaggagaagguguacaucgccacccagggccccaucgucuccaccguggccgacuucuggcggaugguguggcaggagcacacccccaucaucgucaugaucacgaacaucgaggagaugaacgagaagugcaccgaguacuggcccgaggagcaggucgccuacgacgggguggagaucaccgugcagaaggugauccacaccgaggacuaccgccugcggcucaucagccugaaguccggcacggaggagcgcgggcugaagcacuacugguucaccagcuggccggaccagaagacccccgaccgcgcgccgccccuccugcaccugguccgggagguggaggaggccgcccagcaggagggcccccacugcgcccccaucaucgugcacugcuccgccgggaucggccgcaccggcugcuucaucgcgacgagcaucugcugccagcagcuccggcaggagggggucguggacauccugaagacgaccugccagcugcgccaggaccggggcgggaugauccagaccugcgagcaguaccaguucgugcaccacgucaugucccucuacgagaagcagcugagccaccagucccccgaguga

SEQ ID NO: 35273 - RNA, 1788 nt, Artificial Sequence
  derived and/or modified sequence opt1 from PTPN6__Homo_sapiens__NP_002822
auggugcgcugguuccaccgggaccugagcggccucgacgccgagacccugcugaaggggcgcggcguccacggguccuuccucgcccggcccagccgcaagaaccagggcgacuucucccugagcgugcgggugggggaccaggucacccacauccgcauccagaacuccggcgacuucuacgaccuguacggcggggagaaguucgcgacgcucaccgagcugguggaguacuacacccagcagcagggcgugcugcaggaccgggacgggaccaucauccaccucaaguacccccugaacugcagcgaccccacguccgagcgcugguaccacggccacaugagcgggggccaggccgagacccugcuccaggccaagggcgagcccuggaccuuccugguccgggagucccugagccagcccggggacuucgugcucuccgugcugagcgaccagccgaaggccggccccgggagcccccugcgcgucacccacaucaaggugaugugcgagggcggccgguacacggucgggggccucgagaccuucgacucccugaccgaccugguggagcacuucaagaagaccgggaucgaggaggccuccggcgcguucguguaccuccgccagcccuacuacgccacgcgggugaacgccgccgacaucgagaaccgcguccuggagcugaacaagaagcaggagagcgaggacaccgcgaaggccggguucugggaggaguucgagucccuccagaagcaggaggugaagaaccugcaccagcggcuggagggccagcgcccggagaacaagggcaagaaccgguacaagaacauccuccccuucgaccacagccgcgugauccugcaggggcgggacuccaacauccccggcagcgacuacaucaacgccaacuacaucaagaaccagcugcucgggcccgacgagaacgccaagaccuacaucgccagccagggcugccuggaggcgaccgucaacgacuucuggcagauggccuggcaggagaacucccgcgugaucgugaugacgacccgggaggucgagaaggggcgcaacaagugcgugccguacuggcccgaggugggcaugcagcgcgccuacggccccuacagcgucaccaacugcggggagcacgacaccacggaguacaagcugcggacccuccaggugagcccccuggacaacggcgaccugauccgcgagaucuggcacuaccaguaccucuccuggccggaccacgggguccccuccgagcccggcggggugcugagcuuccuggaccagaucaaccagcggcaggagucccucccccacgccggcccgaucaucgugcacugcagcgccggcaucgggcgcaccggcaccaucaucgucaucgacaugcugauggagaacaucuccacgaaggggcuggacugcgacaucgacauccagaagaccauccagauggugcgggcgcagcgcagcggcauggugcagaccgaggcccaguacaaguucaucuacgucgccaucgcccaguucaucgagaccacgaagaagaagcucgaggugcugcagucccagaagggccaggagagcgaguacgggaacaucaccuacccgcccgccaugaagaacgcgcacgccaaggccucccggaccagcuccaagcacaaggaggacguguacgagaaccugcacaccaagaacaagcgcgaggagaaggucaagaagcagcggagcgccgacaaggagaaguccaagggcagccucaagcgcaaguga

SEQ ID NO: 35274 - RNA, 1305 nt, Artificial Sequence
  derived and/or modified sequence opt1 from PTPN7__Homo_sapiens__NP_001186726
augaaccgccugggcugcuggcccgcccggagccucccgcgcuccgggcggggcagcgggcagcgcucccugggccucgggggccaccccagcggcccccggcaccccgggaccccggccgcgaagcgcaccugggagucccccggcgugcgggcccgcgacugcccccugagcacguccuggcugagcgagcccccgcuggggcccgcgccccaccucuccaugguccaggcccacggcgggcggagccgcgcccagccccugacccugucccucggcgccgccaugacccagccgccgcccgagaagacccccgccaagaagcacgugcggcugcaggagcgccggggcagcaacguggcccugaugcucgacguccgcucccugggggcgguggagcccaucugcagcgugaacacgccccgggaggucacccugcacuuccuccgcaccgccggccacccccugacccggugggcccugcagcgccagcccccgucccccaagcagcucgaggaggaguuccugaagauccccagcaacuucgugucccccgaggaccuggacaucccggggcacgccagcaaggaccgguacaagacgauccuccccaacccccagucccgcgugugccugggccgggcccagagccaggaggacggcgacuacaucaacgcgaacuacauccgcggguacgacggcaaggagaaggucuacaucgccacccaggggcccaugccgaacaccgugagcgacuucugggagaugguguggcaggaggaggucucccugaucgugaugcucacccagcugcgcgagggcaaggagaagugcgugcacuacuggcccacggaggaggagaccuacgggcccuuccagauccggauccaggacaugaaggagugcccggaguacaccguccgccagcugaccauccaguaccaggaggagcggcgcagcgugaagcacauccucuucuccgccuggcccgaccaccagacgcccgagagcgccggcccccugcugcggcucguggccgaggucgaggaguccccggagaccgcggcccaccccggccccaucguggugcacugcagcgccgggaucggccgcaccgggugcuucaucgccacccggaucggcugccagcagcugaaggcccgcggggaggucgacauccugggcaucgugugccagcuccggcuggaccgcggcgggaugauccagacggcggagcaguaccaguuccugcaccacacccucgcccuguacgccggccagcugcccgaggagccgucccccuga

SEQ ID NO: 35275 - RNA, 1782 nt, Artificial Sequence
  derived and/or modified sequence opt1 from PTPN9__Homo_sapiens__NP_002824
auggagcccgccaccgccccgcgccccgacauggcgcccgagcugacccccgaggaggagcaggccacgaagcaguuccucgaggagaucaacaaguggaccgugcaguacaacgucagcccgcuguccuggaacguggccgugaaguuccugauggcccggaaguucgacguccuccgcgccaucgagcuguuccacagcuaccgggagacccgccggaaggagggcaucgugaagcugaagccccacgaggagccccuccgcuccgagauccugagcgggaaguucaccauccugaacgugcgggaccccacgggcgcguccaucgcccucuucaccgcccgccugcaccacccgcacaagagcguccagcacguggugcugcaggcccucuucuaccugcuggaccgggcggucgacuccuucgagacccagcgcaacgggcucguguucaucuacgacaugugcggcagcaacuacgccaacuucgagcuggaccuggggaagaaggugcucaaccugcugaagggcgccuuccccgcccggcucaagaagguccugaucgugggcgcccccaucugguuccgcgugcccuacuccaucaucagccugcuccugaaggacaagguccgggagcgcauccagauccugaagaccuccgaggugacgcagcaccucccgcgggagugccugcccgagaaccucgggggcuacgugaagaucgaccuggcgaccuggaacuuccaguuccugccccaggucaacgggcaccccgacccguucgacgagaucauccuguucagccucccgcccgcccuggacugggacuccgugcacgugcccggcccccacgccaugaccauccaggagcuggucgacuacgugaacgcccgccagaagcaggggaucuacgaggaguacgaggacauccggcgcgagaaccccgugggcaccuuccacugcagcaugucccccggcaaccucgagaagaaccgguacggggacguccccugccuggaccagacgcgcgugaagcugaccaagcggagcggccacacccagaccgacuacaucaacgccuccuucauggacggguacaagcagaagaacgcguacaucggcacgcagggcccgcucgagaacaccuaccgcgacuucuggcugauggucugggagcagaaggugcuggugaucgucaugaccacccgcuucgaggagggcgggcggcgcaagugcgggcaguacuggccccucgagaaggacagccggauccgcuucggcuuccugacggugaccaaccuggggguggagaacaugaaccacuacaagaagaccacccucgagauccacaacacggaggagcggcagaagcgccaggucacccacuuccaguuccuguccuggcccgacuacggcgugcccagcagcgccgccucccugaucgacuuccuccgggugguccgcaaccagcagagccuggccguguccaacaugggcgcccggagcaaggggcagugcccggagccgcccaucgugguccacugcuccgcgggcaucgggcgcaccggcaccuucugcagccuggacaucugccuggcccagcucgaggagcuggggacgcugaacguguuccagaccgugucccggaugcgcacccagcgggccuucagcauccagacccccgagcaguacuacuucugcuacaaggccauccucgaguucgccgagaaggagggcauggucuccagcggccagaaccugcuggcgguggagucccaguga

SEQ ID NO: 35276 - RNA, 2409 nt, Artificial Sequence
  derived and/or modified sequence opt1 from PTPRA__Homo_sapiens__NP_002827
auggacagcugguucauccuggugcuccugggcuccgggcugaucugcgucagcgccaacaacgccaccaccguggcgcccuccgugggcaucacgcgccucaucaacagcuccaccgccgagccggucaaggaggaggccaagaccagcaaccccaccuccagccugacgucccugagcguggcccccaccuucucccccaacaucacccucgggccgaccuaccugacgaccgugaacagcuccgacagcgacaacggcaccacccggacggccuccaccaacagcaucgggaucaccaucucccccaacggcaccuggcugcccgacaaccaguucacggacgcgcgcaccgagcccugggagggcaacagcuccaccgccgccaccacgccggagaccuucccgcccagcgggaacagcgacuccaaggaccggcgcgacgagacccccaucaucgccgucaugguggcgcucagcucccugcuggugaucgucuucaucaucaucgugcucuacaugcugcgguucaagaaguacaagcaggccggcagccacuccaacagcuuccgccuguccaacgggcggaccgaggacguggagccccagagcgucccccuccuggcccgcucccccagcacgaaccggaaguacccgccccugcccguggacaagcucgaggaggagaucaaccgccggauggccgacgacaacaagcuguuccgcgaggaguucaacgcccugcccgcgugccccauccaggcgaccugcgaggccgccuccaaggaggagaacaaggagaagaaccgguacgugaacauccucccguacgaccacagccgcguccaccugacccccguggagggcgugcccgacuccgacuacaucaacgccagcuucaucaacggguaccaggagaagaacaaguucaucgccgcccagggccccaaggaggagaccgucaacgacuucuggcggaugaucugggagcagaacacggccaccaucgugauggugaccaaccugaaggagcgcaaggagugcaagugcgcccaguacuggccggaccagggcugcuggaccuacgggaacauccgggucuccguggaggacgugacgguccucguggacuacaccguccgcaaguucugcauccagcaggucggcgacaugaccaaccggaagccccagcgccugaucacccaguuccacuucacgagcuggcccgacuucggggugcccuucaccccgaucggcaugcugaaguuccucaagaaggugaaggccugcaacccccaguacgcgggcgccaucguggugcacugcuccgccggggucggccggaccgggaccuucguggugaucgacgccaugcuggacaugaugcacaccgagcgcaaggucgacguguacggcuucgugagccgcauccgggcccagcgcugccagaugguccagacggacaugcaguacguguucaucuaccaggcgcugcucgagcacuaccuguacggggacaccgagcuggaggugaccucccucgagacccaccuccagaagaucuacaacaagauccccggcacgagcaacaacggccuggaggaggaguucaagaagcugaccagcaucaagauccagaacgacaagaugcggaccgggaaccugccggccaacaugaagaagaaccgcguccugcagaucauccccuacgaguucaaccgggugaucauccccgugaagcgcggcgaggagaacaccgacuacgucaacgccuccuucaucgacggguaccggcagaaggacagcuacaucgccucccagggcccccuccugcacacgaucgaggacuucuggcgcaugaucugggaguggaaguccugcagcaucgugaugcugaccgagcucgaggagcgggggcaggagaagugcgcgcaguacuggccgagcgacggccugguguccuacggcgacaucaccgucgagcugaagaaggaggaggagugcgagagcuacaccgugcgcgaccuccuggugacgaacacccgggagaacaagucccgccagauccggcaguuccacuuccacggguggcccgaggucggcauccccagcgacgggaagggcaugaucuccaucaucgccgccgugcagaagcagcagcagcagagcgggaaccaccccaucaccgugcacugcuccgccggcgccggccgcaccgggacguucugcgcgcugagcaccguccucgagcgggugaaggccgagggcauccuggacguguuccagaccgucaagucccugcgccugcagcggccgcacauggugcagacccucgagcaguacgaguucugcuacaaggugguccaggaguacaucgacgccuucagcgacuacgccaacuucaaguga

SEQ ID NO: 35277 - RNA, 6648 nt, Artificial Sequence
  derived and/or modified sequence opt1 from PTPRB__Homo_sapiens__NP_001103224
auggaggccgaguucuacauggugauccugaccugccucaucuuccgcaacagcgagggcuuccagaucgugcacgugcagaagcagcagugccuguucaagaacgagaagguggucguggggagcugcaaccgcaccauccagaaccagcaguggauguggacggaggacgagaagcugcuccacgucaagagcgcccugugccuggccaucuccaacagcucccgcggccccagccgguccgccauccucgaccgcugcagccaggcgccccgguggaccugcuacgaccaggagggguuccuggaggucgagaacgccucccuguuccuccagaagcagggcagccgcgugguggucaagaaggcccggaaguaccugcacuccuggaugaagaucgacgugaacaaggaggggaagcuggugaacgagagccucugccugcagaaggcgggccugggcgccgaggucuccgugcgcagcacccggaacaccgcgccgccccagauccucacgaccuucaacgccgugcccgacgggcuggucuuccugauccgcaacaccaccgaggcguucauccggaacgccgccgagaacuacucccagaacagcuccgagcgccagcaccccaaccuccacaugacgggcaucaccgacaccagcugggugcuguccaccacgcagcccuucagcagcaccaccgaggagaccgggcuggccgagcccgagcggugcaacuucacgcucgccgaguccaaggcgagcucccacagcguguccauccaguggcgcauccugggcagccccugcaacuucucccugaucuacagcuccgacacccucggggccgcccugugccccaccuuccggaucgacaacaccacguacggcugcaaccugcaggaccuccaggccggcaccaucuacaacuuccgcaucaucagccuggacgaggagcggaccgucgugcugcagaccgacccccugccgcccgcccgcuucgggguguccaaggagaagacgaccagcaccucccugcacgucugguggacccccagcuccggcaaggugacgagcuacgaggugcagcuguucgacgagaacaaccagaagauccaggggguccagauccaggaguccaccagcuggaacgaguacaccuucuucaaccucaccgcgggcuccaaguacaacaucgccaucacggccgugagcggcgggaagcggagcuucuccgucuacaccaacggcagcaccgugcccucccccgugaaggacaucgggaucagcaccaaggccaacucccugcugaucagcuggucccacggcagcgggaacgucgagcgcuaccggcucaugcugauggacaagggcauccuggugcacggcgggguggucgacaagcacgccacguccuacgcguuccacggccucacccccggguaccuguacaaccugaccgugaugaccgaggccgccggccuccagaacuaccgcuggaagcuggugcgcaccgcccccauggaggucagcaaccugaaggugacgaacgacgggucccucaccagccugaaggugaaguggcagcggccgcccggcaacgucgacuccuacaacaucacccugagccacaagggcaccaucaaggagucccgcgugcucgcccccuggaucacggagacccacuucaaggagcuggugcccgggcggcuguaccaggucaccgugagcugcguguccggcgagcugagcgcgcagaagauggccgucgggcgcaccuuccccgacaagguggccaaccucgaggccaacaacaacggccggaugcgcagccugguggucuccugguccccgcccgcgggggacugggagcaguaccggauccuccuguucaacgacuccguggugcugcugaacaucacggucggcaaggaggagacccaguacgugauggacgacaccggccucgugccggggcgccaguacgaggucgaggugaucguggagagcggcaaccugaagaacuccgagcggugccaggggcgcaccgucccccuggccgugcuccagcugcgggugaagcacgccaacgagacgagccuguccaucauguggcagacccccgucgccgagugggagaaguacaucaucagccucgccgaccgcgaccugcugcucauccacaagucccugagcaaggacgcgaaggaguucaccuucaccgaccuggugcccggccggaaguacauggccacggugaccuccaucagcggcgaccucaagaacuccagcuccgucaaggggcgcaccgugcccgcccaggugaccgaccugcacgucgccaaccagggcaugacgagcucccuguucaccaacuggacccaggcccagggggacguggaguucuaccaggugcuccugauccacgagaacgucgugaucaagaacgagagcaucuccagcgagaccagccgguacuccuuccacagccugaaguccggcagccucuacuccguggucgugacgaccgugagcgggggcaucuccagccgccaggucgugguggagggccggaccguccccuccagcguguccggggucaccgugaacaacagcggccgcaacgacuaccuguccgugagcuggcugcucgcgcccggggacgucgacaacuacgaggugacgcugucccacgacggcaaggugguccagagccuggugaucgccaaguccgugcgggagugcagcuucuccagccucaccccggggcgccuguacaccgucaccaucacgacccgcagcggcaaguacgagaaccacuccuucagccaggagcggaccgugcccgacaaggugcagggcgucuccgugagcaacuccgcccgcagcgacuaccugcggguguccuggguccacgccaccggggacuucgaccacuacgaggugacgaucaagaacaagaacaacuucauccagaccaagagcauccccaaguccgagaacgagugcguguucguccagcucgugcccggccgccuguacagcgugaccgucaccaccaaguccgggcaguacgaggccaacgagcagggcaacgggcggacgaucccggagcccgugaaggaccugacccuccgcaaccggagcaccgaggaccugcacgugaccugguccggcgcgaacggcgacgucgaccaguacgagauccagcuccuguucaacgacaugaagguguucccgcccuuccaccuggugaacacggccaccgaguaccgcuucaccagccugaccccggggcggcaguacaagauccucguccugacgaucuccggcgacgugcagcagagcgccuucaucgagggguucaccgugcccuccgccgucaagaacauccacaucagccccaacggcgcgaccgacucccugaccgugaacuggacgcccgggggcggcgacguggacagcuacaccgucagcgccuuccgccacucccagaagguggacagccagaccaucccgaagcacguguucgagcacaccuuccaccggcucgaggccggggagcaguaccagaucaugaucgccuccgucagcggcucccugaagaaccagaucaacgugguggggcgcacgguccccgccagcgugcagggcgugaucgcggacaacgccuacuccagcuacucccugaucgucagcuggcagaaggccgccggcguggccgagcgguacgacauccuccugcugaccgagaacgggauccuccugcgcaacaccuccgagcccgcgaccacgaagcagcacaaguucgaggaccugacccccggcaagaaguacaagauccagauccucaccgugagcgggggccuguucuccaaggaggcccagaccgaggggcggacggucccggccgccgugaccgaccugcgcaucaccgagaacagcacccggcaccucuccuuccgcuggacggccagcgagggcgagcuguccugguacaacaucuuccuguacaaccccgacggcaaccuccaggagcgggcccagguggacccccugguccagagcuucuccuuccagaaccugcuccaggggcgcauguacaagauggugaucgugacccacagcggcgagcugagcaacgaguccuucaucuucgggcggaccguccccgccagcgugucccaccuccgcggcagcaaccgcaacaccacggacucccucugguucaacuggagcccggccuccggggacuucgacuucuacgagcugauccuguacaaccccaacggcaccaagaaggagaacuggaaggacaaggaccucaccgaguggcgguuccagggccugguccccgggcgcaaguacgugcuguggguggucacccacagcggcgaccucuccaacaaggugacggccgagagccggaccgcgcccuccccgcccagccugauguccuucgccgacaucgccaacaccagccuggccaucaccuggaaggggcccccggacuggaccgacuacaacgacuucgagcuccaguggcugccccgcgacgcccugacgguguucaaccccuacaacaaccggaaguccgagggccgcaucgucuacgggcuccggcccggccgcagcuaccaguucaacgugaagaccguguccggcgacagcuggaagaccuacuccaagccgaucuucgggagcguccggaccaagcccgacaagauccagaaccugcacugccgcccccagaacagcacggcgaucgccugcuccuggaucccgcccgacagcgacuucgacggcuacuccaucgagugccggaagauggacacccaggagguggaguucagccgcaagcuggagaaggagaagucccuccugaacaucaugaugcuggugccccacaagcgguaccucgucagcaucaaggugcaguccgccgggaugaccagcgagguggucgaggacuccaccaucacgaugaucgaccggccgcccccgcccccgccccacauccgggugaacgagaaggacgugcugaucagcaaguccagcaucaacuucaccgucaacugcuccugguucagcgacaccaacggcgccgugaaguacuucaccguggucgugcgcgaggccgacggcuccgacgagcugaagccggagcagcagcacccccuccccagcuaccuggaguaccggcacaacgcguccauccgcguguaccagacgaacuacuucgccagcaagugcgccgagaaccccaacagcaacuccaagagcuucaacaucaagcugggggccgagauggagucccucggcgggaagugcgacccgacccagcagaaguucugcgacggcccccugaagccccacaccgccuaccggaucagcauccgcgcguucacccagcuguucgacgaggaccucaaggaguucacgaagccccuguacuccgacaccuucuucagccugccgaucaccaccgaguccgagccccuguucggggccaucgagggcgucagcgccggccucuuccugaucgggaugcugguggccguggucgcccuccugaucugccgccagaaggugucccacggccgggagcgccccagcgcgcggcuguccauccgccgggaccgcccccucagcgugcaccugaaccuggggcagaagggcaaccggaagacguccugcccgaucaagaucaaccaguucgaggggcacuucaugaagcuccaggccgacagcaacuaccugcuguccaaggaguacgaggagcucaaggacgucggccgcaaccagagcugcgacaucgcccugcugcccgagaaccggggcaagaaccgcuacaacaacauccuccccuacgacgccacccgggugaagcuguccaacguggacgacgacccgugcagcgacuacaucaacgcguccuacauccccgggaacaacuuccgccgggaguacaucgucacccagggcccccugcccgggaccaaggacgacuucuggaagauggugugggagcagaacgugcacaacaucgucauggugacgcagugcguggagaagggccgcgucaagugcgaccacuacuggccggccgaccaggacagccucuacuacggggaccugauccugcagaugcucagcgaguccgugcugcccgaguggaccauccgggaguucaagaucugcggcgaggagcagcuggacgcccaccgccucauccggcacuuccacuacaccguguggcccgaccacggcguccccgagaccacgcagagccugauccaguucgugcgcaccgugcgggacuacaucaaccgcuccccgggggccggccccaccgucgugcacugcagcgccggggugggccggaccgggacguucaucgcgcuggaccgcauccuccagcagcuggacuccaaggacagcgucgacaucuacggcgccgugcacgaccugcgccuccaccgggugcacaugguccagaccgagugccaguacguguaccugcaccagugcguccgcgacgugcugcgggcccgcaagcuccgguccgagcaggagaacccccuguuccccaucuacgagaacgugaacccggaguaccaccgcgaccccgucuacagccggcacuga

SEQ ID NO: 35278 - RNA, 621 nt, Artificial Sequence
  derived and/or modified sequence opt1 from PTPRCAP__Homo_sapiens__NP_005599
auggcccugcccugcacccucggccuggggaugcugcucgcccugccgggcgcgcuggggagcggcggguccgccgaggacagcgugggcuccagcuccgucaccguggugcuccugcugcuccugcugcuccugcuggccacgggccucgcccuggccuggcgccggcugagccgcgacuccgggggcuacuaccaccccgcgcggcucggggccgcccuguggggccgcacccggcgccugcucugggccagcccgcccgggcgguggcugcaggcgcgcgccgagcugggcuccaccgacaacgaccucgagcggcaggaggacgagcaggacaccgacuacgaccacgucgccgacggcgggcugcaggccgaccccggcgagggggagcagcagugcggcgaggccagcucccccgagcagguccccgugcgcgcggaggaggcccgggacagcgacacggagggcgaccuggugcucgggucccccggcccggccagcgccgggggcuccgccgaggcgcugcugagcgaccuccacgccuucgccggguccgccgccugggacgacagcgcgcgcgccgccggcggccaggggcugcacgugaccgcccuguga

SEQ ID NO: 35279 - RNA, 4509 nt, Artificial Sequence
  derived and/or modified sequence opt1 from PTPRD__Homo_sapiens__NP_001035802
auggugcacgucgcccgccugcuccugcugcuccugaccuucuuccugcggaccgacgccgagacgcccccgcgcuucacccggacccccguggaccagaccggcgugagcgggggcgucgcguccuucaucugccaggccacgggggacccccgccccaagaucguguggaacaagaagggcaagaaggugagcaaccagcgguucgaggucaucgaguucgacgacggguccggcagcgugcuccgcauccagccgcugcggacgccccgcgacgaggccaucuacgagugcguggccuccaacaacgucggcgagaucagcguguccacccggcugaccgugcuccgcgaggaccagaucccccggggguuccccacgaucgacaugggcccgcagcugaaggucguggagcgcacccggaccgccaccaugcugugcgcggccagcgggaaccccgaccccgagaucacgugguucaaggacuuccuccccguggacaccuccaacaacaacggccgcaucaagcagcugcggagcgggggcaccccgauccgcggcgcccugcagaucgagcaguccgaggagagcgaccaggggaaguacgagugcgucgccaccaacuccgcgggcacgcgguacagcgcccccgccaaccucuacgugcgcgagcugcgggaggugcgccgggucccgccccgcuucuccaucccgcccaccaaccacgagaucaugcccgggggcagcgugaacaucacgugcguggccgucggcucccccaugccguacgugaaguggaugcugggggccgaggaccucacccccgaggacgacaugcccaucggccgcaacgugcuggagcugaacgacguccggcagagcgcgaacuacacgugcguggccauguccacccucggggucaucgaggccaucgcccagaucaccgugaaggcccugcccaagccgcccggcacccccguggucacggagagcaccgcgaccagcaucacccugacgugggacuccgggaaccccgagccggugagcuacuacaucauccagcacaagcccaagaacuccgaggagcucuacaaggagaucgacggcguggccaccacccgcuacagcgucgccggccugucccccuacagcgacuacgaguuccgggugguggccgucaacaacaucgggcgcggcccgcccuccgagcccgugcugacccagacgagcgagcaggcccccuccagcgcgccgcgggacgugcaggcccgcaugcucuccagcaccaccauccugguccaguggaaggagcccgaggagcccaacgggcagauccagggcuaccggguguacuacaccauggaccccacgcagcacgugaacaacuggaugaagcacaacgucgccgacucccagaucaccaccaucgggaaccuggugccgcagaagaccuacagcgugaagguccucgccuucaccuccaucggcgacggcccccugagcuccgacauccaggugaucacccagaccggggugcccggccagccccugaacuucaaggccgagcccgagagcgagaccuccauccuccugagcuggaccccgccccgcagcgacaccaucgcgaacuacgagcuggucuacaaggacggggagcacggcgaggagcagcggaucaccaucgagcccgggaccuccuaccgccuccagggccugaagcccaacagccuguacuacuuccggcucgccgcccgcagcccccagggccugggggccuccaccgcggagaucuccgcccggacgaugcagagcauguucgccaagaacuuccacgugaaggccgugaugaagaccuccguccugcucagcugggagauccccgagaacuacaacuccgccaugcccuucaagauccuguacgacgacggcaagaugguggaggagguggacgggcgcgcgacccagaagcugaucgucaaccucaagccggagaaguccuacagcuucgugcugaccaaccggggcaacagcgccggcgggcugcagcaccgcgugacggccaagaccgcccccgacguccuccggaccaagcccgccuucaucggcaagaccaaccuggacgggaugaucacggugcagcugcccgaggugccggcgaacgagaacaucaagggcuacuacaucaucaucgucccccugaagaagucccgcgggaaguucaucaagcccugggagagcccggacgagauggagcucgacgagcugcugaaggagaucucccggaagcgccgcagcauccgguacggccgcgagguggagcucaagcccuacaucgccgcccacuucgacgugcugcccaccgaguucacccugggcgacgacaagcacuacgggggcuucaccaacaagcagcuccaguccgggcaggaguacgucuucuucgugcuggccgugauggagcacgccgagagcaagauguacgcgacgagccccuacuccgacccggucgugagcauggaccuggacccccagcccaucaccgacgaggaggagggccucaucuggguggucgggcccgugcuggccguggucuucaucaucugcaucgugaucgccauccugcucuacaaguccaagccggaccggaagcgcgccgagagcgacucccgcaagagcuccauccccaacaacaaggagauccccagccaccaccccaccgacccgguggagcugcggcggcugaacuuccagacccccggcauggcgucccacccgcccauccccauccucgagcuggccgaccacaucgagcgccugaaggccaacgacaaccucaaguucagccaggaguacgaguccaucgaccccggccagcaguucacgugggagcacagcaaccuggaggucaacaagcccaagaaccgguacgccaacgugaucgccuacgaccacucccgcgugcugcucagcgcgaucgaggggauccccggcuccgacuacgucaacgccaacuacaucgacggguaccggaagcagaacgccuacaucgccacccagggcagccugccggagaccuucggggacuucuggcgcaugaucugggagcagcgguccgccaccguggucaugaugacgaagcuggaggagcgcagccgggugaagugcgaccaguacuggcccucccgcggcaccgagacccacggccucgugcaggucacccugcuggacacgguggagcucgcgaccuacugcgugcggaccuucgcccuguacaagaacgggagcagcgagaagcgcgagguccggcaguuccaguucaccgccuggcccgaccacggcgugcccgagcacccgacgcccuuccuggccuuccuccgccgggugaagaccugcaacccgcccgacgccgggcccauggucgugcacugcuccgcgggcguggggcgcaccggcugcuucaucgucaucgacgccaugcuggagcgcaucaagcacgagaagaccguggacaucuacggccacgugacccugaugcgggcccagcgcaacuacaugguccagacggaggaccaguacaucuucauccacgacgcccuccuggaggcggugaccugcgggaacaccgaggugcccgcccggaaccuguacgccuacauccagaagcucacccagaucgagacgggcgagaacgucaccgggauggagcuggaguucaagcgccuggccagcuccaaggcccacaccagccgguucaucuccgcgaaccuccccugcaacaaguucaagaaccgccuggugaacaucaugccguacgagagcacccgggugugccugcagcccauccgcggcgucgagggcuccgacuacaucaacgccagcuucaucgacggguaccggcagcagaaggccuacaucgccacgcagggcccccucgccgagaccaccgaggacuucuggcgcaugcugugggagcacaacuccaccaucguggugaugcugacgaagcuccgggagauggggcgcgagaagugccaccaguacuggcccgcggagcggagcgcccgcuaccaguacuucgucguggacccgauggccgaguacaacaugccccaguacauccugcgggaguucaaggugaccgacgcccgcgacggccagucccggaccguccgccaguuccaguucaccgacuggcccgagcagggggugcccaagagcggcgagggcuucaucgacuucaucggccaggugcacaagacgaaggagcaguucgggcaggacgggccgaucuccguccacugcagcgccggcguggggcggaccggcguguucaucacccuguccaucguccucgagcgcaugcgcuacgagggcgugguggacaucuuccagaccgucaagaugcugcggacgcagcgccccgcgauggugcagaccgaggaccaguaccaguucagcuaccgggccgcccuggaguaccucggguccuucgaccacuacgccaccuga

SEQ ID NO: 35280 - RNA, 2103 nt, Artificial Sequence
  derived and/or modified sequence opt1 from PTPRE__Homo_sapiens__NP_006495
auggagccccugugcccgcuccugcuggugggcuucagccucccccuggcccgcgcccugcgggggaacgagaccaccgcggacuccaacgagacgaccaccaccagcggcccgcccgaccccggggccucccagccccuccuggccuggcugcuccugccccugcuccugcugcuccugguccugcuccuggccgccuacuucuuccgcuuccggaagcagcgcaaggcgguggugagcacguccgacaagaagaugcccaacggcauccuggaggagcaggagcagcagcgggucaugcuccugagccgcuccccgagcgggcccaagaaguacuuccccauccccguggagcaccuggaggaggagauccggauccgcuccgccgacgacugcaagcaguuccgggaggaguucaacagccucccguccggccacauccagggcaccuucgagcuggccaacaaggaggagaaccgcgagaagaaccgguaccccaacauccugcccaacgaccacagccgcgugauccucucccagcuggacgggauccccugcagcgacuacaucaacgccuccuacaucgacggcuacaaggagaagaacaaguucaucgcggcccaggggccgaagcaggagaccgucaacgacuucuggcggauggugugggagcagaaguccgccaccaucgugaugcugacgaaccucaaggagcgcaaggaggagaagugccaccaguacuggcccgaccagggcugcuggaccuacgggaacauccgggucugcguggaggacugcgugguccugguggacuacaccauccgcaaguucugcauccagccccagcugcccgacggcugcaaggccccgcggcucgugagccagcugcacuucaccagcuggcccgacuucggcguccccuucacgcccaucgggaugcugaaguuccucaagaaggugaagacccugaacccggugcacgccggccccaucgucgugcacugcuccgcgggggugggccgcaccggcaccuucaucgucaucgacgccaugauggccaugaugcacgccgagcagaagguggacguguucgaguucgucagccggauccgcaaccagcggccccagauggugcagacggacaugcaguacaccuucaucuaccaggcccugcucgaguacuaccuguacggggacaccgagcuggacgucagcucccucgagaagcaccuccagaccaugcacggcacgaccacccacuucgacaagaucgggcuggaggaggaguuccgcaagcugaccaacgugcgcaucaugaaggagaacaugcggacgggcaaccugcccgcgaacaugaagaaggcccgcgugauccagaucaucccguacgacuucaaccgggucauccugagcaugaagcgcgggcaggaguacaccgacuacaucaacgccuccuucaucgacggcuaccggcagaaggacuacuucaucgccacccagggcccccucgcccacaccguggaggacuucuggcgcaugaucugggaguggaagucccacacgaucgugaugcugaccgagguccaggagcgggagcaggacaagugcuaccaguacuggcccaccgaggggagcgugacccacggcgagaucacgaucgagaucaagaacgacacccugagcgaggcgaucuccauccgcgacuuccuggugacccucaaccagccgcaggcccggcaggaggagcagguccgcguggugcggcaguuccacuuccacggguggcccgagaucggcauccccgccgaggggaagggcaugaucgaccugaucgccgccguccagaagcagcagcagcagaccggcaaccaccccaucacggugcacugcagcgcgggggccggccgcaccgggaccuucaucgcccuguccaacauccucgagcgggugaaggccgagggccugcuggacgucuuccaggcggucaagagccuccgccugcagcggccgcacauggugcagacccuggagcaguacgaguucugcuacaagguggugcaggacuucaucgacaucuucuccgacuacgccaacuucaaguga

SEQ ID NO: 35281 - RNA, 4338 nt, Artificial Sequence
  derived and/or modified sequence opt1 from PTPRG__Homo_sapiens__NP_002832
augcgccggcugcucgagcccugcugguggauccuguuccugaagaucaccagcuccgugcuccacuacgucgugugcuucccggcccugaccgagggcuacgugggggcccugcacgagaaccgccacggcagcgcgguccagauccggcgccggaaggccuccggggaccccuacugggccuacagcggcgccuacgggcccgagcacugggugacguccagcguguccugcggcggccgccaccagagccccaucgacauccucgaccaguacgcccgggucggggaggaguaccaggagcugcagcuggacggcuucgacaacgaguccagcaacaagaccuggaugaagaacaccgggaagaccguggcgauccuccugaaggacgacuacuucguguccggcgccgggcugccgggccgcuucaaggccgagaaggucgaguuccacuggggccacagcaacggguccgccggcagcgagcacuccaucaacgggcggcgcuuccccguggagaugcagaucuucuucuacaaccccgacgacuucgacagcuuccagacggcgaucuccgagaaccggaucaucggcgccauggccaucuucuuccaggugagcccccgcgacaacuccgcccucgacccgaucauccacggccugaagggggucgugcaccacgagaaggagaccuuccuggaccccuucgugcuccgggaccugcugcccgccagccucggcagcuacuaccgcuacaccgggucccugaccacgcccccgugcagcgagaucgucgaguggaucguguuccggcgccccgugcccaucuccuaccaccagcuggaggcguucuacagcaucuucaccaccgagcagcaggaccacgucaaguccguggaguaccuccggaacaacuuccgcccccagcagcggcugcacgaccgcguggucagcaaguccgccgugcgggacagcuggaaccacgacaugaccgacuuccuggagaacccgcucggcacggaggccuccaaggugugcagcuccccgcccauccacaugaagguccagccccugaaccagaccgcccuccaggugagcuggucccagcccgagaccaucuaccacccgcccaucaugaacuacaugaucagcuacuccuggaccaagaacgaggacgagaaggagaagacguucaccaaggacagcgacaaggaccucaaggccaccaucucccacgucagccccgacucccuguaccuguuccgcgugcaggcggugugccgcaacgacaugcggagcgacuucagccagaccaugcuguuccaggccaacacgacccgcaucuuccaggggacccggaucgucaagaccggcgugcccacggccucccccgccagcuccgccgacauggcgcccaucagcuccggcagcuccaccuggaccagcuccgggauccccuucagcuucguguccauggccaccggcauggggccgagcuccagcggcucccaggccacggucgccagcguggugaccuccacccugcuggccgggcucggcuucggcgggggcgggaucagcagcuuccccuccaccgucuggcccacgcgccugccgaccgcggccagcgccuccaagcaggccgcgcggcccgugcuggccaccaccgaggcccucgccagccccggccccgacggggacuccagcccgacgaaggacggcgagggcaccgaggagggggagaaggacgagaaguccgagagcgaggacggcgagcgcgagcacgaggaggacggggagaaggacuccgagaagaaggagaaguccggcgugacccacgccgcggaggagcggaaccagaccgagcccagccccacccccagcuccccgaaccgcacggccgagggcgggcaccagaccauccccggccacgagcaggaccacaccgccguccccaccgaccagaccgggggccggcgcgacgccgggcccggccuggacccggacauggugacgagcacccaggugccgcccaccgccacggaggagcaguacgcgggcuccgaccccaagcggcccgagaugcccagcaagaagcccaugucccgcggggaccgguucagcgaggacucccgcuucaucaccgucaaccccgccgagaagaacaccagcggcaugaucagccggccggcccccgggcgcauggaguggaucaucccccugaucgugguguccgcccucaccuucgucugccugauccugcucaucgccgugcugguguacuggcggggcugcaacaagaucaagagcaagggguucccccgccgguuccgcgaggucccguccagcggcgagcgcggcgagaaggggucccggaagugcuuccagacggcgcacuucuacguggaggacagcuccagcccccgcgugguccccaacgaguccaucccgaucauccccauccccgacgacauggaggccauccccgugaagcaguucgugaagcacaucggcgagcuguacagcaacaaccagcacggguucuccgaggacuucgaggagguccagcggugcaccgccgacaugaacaucaccgccgagcacagcaaccacccggagaacaagcacaagaaccgcuacaucaacauccucgcguacgaccacucccgggugaagcugcgcccccugcccggcaaggacagcaagcacuccgacuacaucaacgccaacuacguggacggguacaacaaggccaaggccuacaucgccacccagggcccccucaagagcacguucgaggacuucuggcggaugaucugggagcagaacaccggcaucaucgucaugaucaccaaccugguggagaaggggcgccggaagugcgaccaguacuggccgaccgagaacuccgaggaguacggcaacaucaucgugacgcucaagagcaccaagauccacgcgugcuacaccguccgccgguucuccauccgcaacaccaaggugaagaaggggcagaagggcaaccccaaggggcggcagaacgagcgcguggucauccaguaccacuacacgcaguggcccgacaugggcgugcccgaguacgcccugccggugcugaccuucguccggcgcagcagcgccgcccggaugcccgagaccggccccgugcuggugcacugcuccgccggggucggccgcaccgggacguacaucgugaucgacagcaugcugcagcagaucaaggacaaguccaccgugaacguccucggcuuccugaagcacauccggacccagcgcaacuaccuggugcagaccgaggagcaguacaucuucauccacgacgcgcuccuggaggccauccugggcaaggagacggaggugagcuccaaccagcuccacagcuacgucaacuccauccugauccccggggugggcgggaagacccggcuggagaagcaguucaagcucgugacccagugcaacgccaaguacgucgagugcuucagcgcccagaaggagugcaacaaggagaagaaccgcaacuccagcguggucccguccgagcgcgcccgggugggccuggcgccccugcccgggaugaagggcaccgacuacaucaacgccagcuacaucaugggcuacuaccgcuccaacgaguucaucaucacgcagcacccccucccgcacaccaccaaggacuucuggcggaugaucugggaccacaacgcccagaucaucgugaugcugcccgacaaccagagccuggccgaggacgaguucgucuacuggcccucccgcgaggagagcaugaacugcgaggcguucaccgugacccucaucuccaaggaccggcugugccugagcaacgaggagcagaucaucauccacgacuucauccucgaggccacgcaggacgacuacgugcuggagguccgccacuuccagugccccaaguggccgaaccccgacgcccccaucuccagcaccuucgagcugaucaacgugaucaaggaggaggcccucacccgggacgggcccaccaucgugcacgacgaguacggcgccgucagcgcggggaugcugugcgcccugacgacccucucccagcagcuggagaacgagaacgccguggacguguuccaggucgccaagaugaucaaccugaugcgcccgggcguguucaccgacaucgagcaguaccaguucaucuacaaggccaugcucagccugguguccaccaaggagaacgggaacggccccaugacggucgacaagaacggcgcggugcugaucgccgacgagagcgaccccgccgaguccauggagagccucguguga

SEQ ID NO: 35282 - RNA, 2814 nt, Artificial Sequence
  derived and/or modified sequence opt1 from PTPRH__Homo_sapiens__NP_001154912
auggccggcgccgggggcgggcugggcgugugggggaaccucguccugcugggccucugcagcuggaccggcgcgcgcgcccccgccccgaaccccgggcggaaccugaccguggagacgcagaccaccuccagcaucucccugagcugggaggugcccgacggccucgacucccagaacagcaacuacuggguccagugcaccggggacggcgggacgaccgagacccgcaacaccacggccaccaacgugaccguggacggccugggccccgggucccuguacacgugcagcgucuggguggagaaggacggcgugaacuccagcgucgggaccgugaccaccgccaccgcgccgaaccccgugcggaaccucacggucgaggcccagaccaacuccagcaucgcccugaccugggaggugcccgacggccccgacccgcagaacuccaccuacggcguggaguacacgggggacggcgggcgcgccggcacccggagcaccgcgcacaccaacaucacggucgaccgccuggagcccgggugccucuacguguucuccgugugggucggcaagaacggcaucaacagcucccgggagacccgcaacgccaccaccgcccccaaccccgugcggaaccugcacauggagacgcagaccaacagcuccaucgcccugugcugggaggugccggacgggcccuacccccaggacuacaccuacugggucgaguacaccggcgacgggggcgggacggagacccgcaacaccaccaacacgagcgugaccgccgagcggcucgagcccggcacccuguacaccuucagcgugugggcggagaagaacggcgcccgcgggucccggcagaacgucagcaucuccaccgugccgaacgccgucacgagccuguccaagcaggacuggaccaacagcaccaucgcccuccgcuggaccgcgccccagggccccgggcaguccagcuacuccuacugggugagcugggugcgggagggcaugacggacccccgcacccaguccaccagcgggaccgacaucacgcugaaggagcuggaggccggcucccucuaccaccugaccgucugggccgagcggaacgaggugcgcggcuacaacagcacccugaccgccgccacggccccgaacgaggugaccgaccuccagaacgagacccagaccaagaacuccgucaugcugugguggaaggcgcccggggacccccacagccagcuguacguguacugggugcagugggccuccaagggccacccccggcgcgggcaggacccgcaggccaacugggucaaccagacgagccggaccaacgagaccugguacaagguggaggcccucgagcccggcacccuguacaacuucacggugugggccgagcgcaacgacgucgcguccagcacccagagccugugcgccuccaccuaccccgacaccgugacgaucaccagcugcguguccaccagcgccggcuacggggucaaccucaucugguccugcccccagggcggguacgaggccuucgagcuggaggugggcgggcagcgcggcagccaggaccgguccagcugcggcgaggcgguguccguccuggggcucggcccggcccgcagcuaccccgccaccaucacgaccaucugggacgggaugaagguggugucccacagcgucgugugccacaccgaguccgccggcgugaucgccggggcguucgucggcauccugcuguuccucauccuggugggccugcucaucuucuuccugaagcggcgcaacaagaagaagcagcagaagcccgagcugcgggaccucguguucagcuccccgggggacauccccgccgaggacuucgccgaccacguccgcaagaacgagcgggacagcaacugcggcuucgccgacgaguaccagcagcugucccugguggggcacagccagagccagaugguggccuccgcgagcgagaacaacgccaagaaccgcuaccggaacguccuccccuacgacuggucccgcgugccccugaagccgauccacgaggagcccggcagcgacuacaucaacgccuccuucaugcccgggcuguggagcccccaggaguucaucgccacccagggcccgcucccccagacggugggcgacuucuggcggcuggucugggagcagcagucccacacccuggugaugcugaccaacugcauggaggccgggcgcgugaagugcgagcacuacuggccccucgacagccagcccugcacccacggccaccuccgggucacgcuggugggggaggaggugauggagaacuggaccguccgcgagcugcugcugcuccagguggaggagcagaagacccuguccgugcggcaguuccacuaccaggcguggccggaccacggcguccccagcucccccgacacccugcucgccuucuggcgcaugcugcggcaguggcuggaccagaccauggagggcgggcccccgaucgugcacugcagcgccggcguggggcgcacgggcacccucaucgcccuggacguccugcuccggcagcugcaguccgaggggcugcucggccccuucagcuucgugcgcaagaugcgcgagucccggccccugauggugcagaccgaggcgcaguacgucuuccugcaccagugcauccuccgcuuccugcagcagagcgcccaggcccccgccgagaaggaggugccguacgaggacguggagaaccugaucuacgagaacgucgccgcgauccaggcccacaagcucgagguguga

SEQ ID NO: 35283 - RNA, 1620 nt, Artificial Sequence
  derived and/or modified sequence opt1 from PTPRJ__Homo_sapiens__NP_001091973
augaagcccgccgcccgcgaggcgcggcugccgccccgcagccccggccuccggugggcccugccccugcuccugcugcuccugcgccuggggcagauccucugcgccggcgggaccccgucccccauccccgaccccagcguggccaccgucgccacgggcgagaacgggaucacccagaucuccagcaccgcggaguccuuccacaagcagaacggcaccggcacgccccagguggagaccaacaccagcgaggacggggaguccagcggcgccaacgacucccugcggacccccgagcaggggagcaacggcacggacggggccucccagaagacccccagcuccaccggccccagcccgguguucgacaucaaggccgucuccaucagccccaccaacgugauccugacguggaaguccaacgacaccgcggccagcgaguacaaguacguggucaagcacaagauggagaacgagaagaccaucaccguggugcaccagcccuggugcaacaucacgggccuccgccccgccaccuccuacgucuucagcaucaccccggggaucggcaacgagaccuggggcgacccccgggugaucaaggugaucacggagcccauccccgucagcgaccugcgcguggcccugaccggggugcggaaggccgcgcucuccuggagcaacggcaacgggaccgccuccugccgcguccugcuggagagcaucggcucccacgaggagcucacccaggacagccggcuccaggugaacaucuccgggcugaagccgggcgugcaguacaacaucaaccccuaccugcugcagagcaacaagacgaagggggacccccugggcaccgagggcgggcucgacgccuccaacaccgagcgcagccgggccggcucccccaccgccccgguccacgacgagagccugguggggcccguggaccccuccagcggccagcagucccgcgacacggagguccugcucguggggcuggagcccggcacccgguacaacgcgaccguguacagccaggccgccaacggcaccgaggggcagccgcaggccaucgaguuccgcacgaacgccauccaggucuucgacgugaccgcggucaacaucuccgccaccagccugacccucaucuggaagguguccgacaacgagagcagcuccaacuacacguacaagauccacguggccggcgagaccgacagcuccaaccugaacgucagcgagccccgggccgugauccccgggcugcgcuccagcaccuucuacaacaucaccgugugcccgguccucggcgacaucgaggggacccccggcuuccuccaggugcacacgccgcccgugccggucuccgacuuccgggugaccguggucagcaccaccgagaucggccuggccugguccagccacgacgcggaguccuuccagaugcacaucacgcaggagggggccggcaacagccgcguggagaucaccaccaaccaguccaucaucaucgggggccuguuccccggcaccaaguacugcuucgagaucgugcccaaggggcccaacggcacggagggggccagccggaccgucugcaaccgcaccggcuga

SEQ ID NO: 35284 - RNA, 4341 nt, Artificial Sequence
  derived and/or modified sequence opt1 from PTPRK__Homo_sapiens__NP_001129120
auggacaccaccgccgccgcggcccugcccgccuucguggcccuccugcugcucagcccguggccccugcugggcuccgcccaggggcaguucagcgcgggcgggugcacguucgacgacggccccggggccugcgacuaccaccaggaccucuacgacgacuucgaguggguccacguguccgcccaggagccccacuaccugccgcccgagaugccccagggcagcuacaugaucguggacuccagcgaccacgaccccggcgagaaggcccgccugcagcucccgaccaugaaggagaacgacacccacugcaucgacuucuccuaccugcuguacagccagaaggggcucaaccccggcacccugaacauccugguccgggugaacaaggggccccucgcgaaccccaucuggaacgugacgggcuucaccgggcgcgacuggcugcgggccgagcuggccgucuccaccuucuggccgaacgaguaccaggugaucuucgaggccgaggugagcggcggccgcuccggguacaucgccaucgacgacauccagguccucagcuaccccugcgacaagagcccccacuuccugcggcugggcgacguggaggugaacgcggggcagaacgccaccuuccagugcaucgccacgggccgcgacgccguccacaacaagcucuggcugcagcggcgcaacggcgaggacauccccguggcccagaccaagaacaucaaccaccggcgcuucgcggccagcuuccggcugcaggaggugaccaagaccgaccaggaccucuaccgcugcgucacgcaguccgagcgggggagcggcguguccaacuucgcccagcugaucgugcgcgagccgccccggcccaucgcgcccccgcagcugcucggggucggccccaccuaccugcugauccagcucaacgccaacagcaucaucggggacggccccaucauccugaaggagguggaguaccgcaugaccuccggcagcuggaccgagacgcacgccgugaacgcccccaccuacaagcuguggcaccucgacccggacaccgaguacgagauccggguccugcugacccgccccggggagggcgggacgggccuccccgggcccccgcugaucacccggaccaagugcgccgagcccaugcgcacccccaagacgcugaagaucgccgagauccaggcccggcgcaucgcgguggacugggagagccucggcuacaacaucacccgcugccacaccuucaacgugaccaucugcuaccacuacuuccggggccacaacgaguccaaggccgacugccuggacauggacccgaaggcgccccagcacgucgugaaccaccucccgcccuacacgaacgucagccugaagaugauccugaccaaccccgaggggcgcaaggaguccgaggagaccaucauccagaccgacgaggacgugcccggccccgugcccgucaagagccugcaggggacguccuucgagaacaagaucuuccucaacuggaaggagccgcuggaccccaacggcaucaucacccaguacgagaucagcuacuccagcauccgguccuucgaccccgccgugcccguggccgggccgccccagaccgucagcaaccuguggaacuccacccaccacguguucaugcaccuccaccccggcacgaccuaccaguucuucauccgcgccagcaccgugaagggcuucgggcccgccaccgccaucaacgucaccacgaacaucuccgccccgacccugcccgacuacgagggcguggacgcgagccugaacgagaccgccaccacgaucaccgugcugcuccggcccgcccaggccaagggggcccccaucuccgcguaccagaucgucguggaggagcugcacccgcaccgcaccaagcgggaggccggcgccauggagugcuaccaggugcccgucaccuaccagaacgccaugagcggcggggcccccuacuacuucgcggccgagcugcccccgggcaaccuccccgagcccgccccguucacggugggggacaaccgcaccuaccagggcuucuggaacccgccccuggcgccccggaagggguacaacaucuacuuccaggccauguccagcguggagaaggagaccaagacccagugcguccgcaucgccacgaaggccgccgccaccgaggagcccgaggugauccccgaccccgcgaagcagaccgaccggguggucaagaucgccggcaucuccgccggcauccugguguucauccuccugcugcucguggucauccugaucgugaagaaguccaagcuggccaagaagcgcaaggacgccauggggaacacccggcaggagaugacgcacauggugaacgcgauggaccgcagcuacgccgaccaguccacccuccacgccgaggacccccugagcaucaccuucauggaccagcacaacuucuccccgcgguacgagaaccacagcgccaccgccgaguccagccgccugcucgacgucccccgguaccugugcgagggcacggagucccccuaccagaccgggcagcugcaccccgcgauccgcguggccgaccuccugcagcacaucaaccugaugaagaccagcgacuccuacggcuucaaggaggaguacgagagcuucuucgaggggcaguccgccagcugggacguggccaagaaggaccagaaccgggcgaagaaccgcuacggcaacaucaucgccuacgaccacucccgcgucauccuccagccgguggaggacgaccccagcuccgacuacaucaacgccaacuacaucgacaucuggcuguaccgggacggcuaccagcgccccagccacuacaucgccacccaggggcccgugcacgagacggucuacgacuucuggcggaugaucuggcaggagcaguccgccugcaucgugauggugaccaaccuggucgaggugggccgcgugaagugcuacaaguacuggccggacgacaccgaggucuacggggacuucaaggugaccugcguggagauggagccccucgcggaguacgucgugcggacguucacccuggagcgccggggcuacaacgagauccgcgaggugaagcaguuccacuucaccggguggcccgaccacggcguccccuaccacgccaccggccugcucagcuucauccggcgcgugaagcugagcaacccgcccuccgccgggcccaucgugguccacugcagcgccggcgccgggcggacgggcugcuacaucgugaucgacaucaugcuggacauggcggagcgcgaggggguggucgacaucuacaacugcgugaaggcccuccggucccgccggaucaacaugguccagaccgaggagcaguacaucuucauccacgacgccauccuggaggccugccugugcggcgagaccgccauccccgugugcgaguucaaggcggccuacuucgacaugauccgcaucgacagccagaccaacuccagccaccucaaggacgaguuccagacgcugaacuccgugaccccgcggcugcaggccgaggacugcagcaucgccugccucccccgcaaccacgacaagaaccgguucauggacaugcugccgcccgaccgcugccugcccuuccucaucaccaucgacggcgaguccagcaacuacaucaacgccgcgcugauggacuccuaccggcagcccgccgccuucaucgucacccaguacccccugccgaacaccgugaaggacuucuggcgccucguguacgacuacgggugcacgagcaucgucaugcugaacgagguggaccugucccagggcugcccccaguacuggcccgaggaggggaugcuccgcuacggccccauccagguggagugcaugagcugcuccauggacugcgacgucaucaaccggaucuuccgcaucugcaaccugacccggccgcaggagggcuaccugauggugcagcaguuccaguaccucgggugggccagccaccgcgaggugcccggcuccaagcggagcuuccugaagcugauccuccaggucgagaaguggcaggaggagugcgaggagggggagggccgcaccaucauccacugccugaacgggggcggccgguccgggauguucugcgcgaucggcaucgugguggagauggucaagcgccagaacgugguggacgucuuccacgccgugaagacccugcggaacagcaagcccaacaugguggaggcccccgagcaguaccgcuucugcuacgacgucgcccucgaguaccuggagagcuccuga

SEQ ID NO: 35285 - RNA, 4398 nt, Artificial Sequence
  derived and/or modified sequence opt1 from PTPRM__Homo_sapiens__NP_001098714
augcgcggccuggggaccugccucgccacccuggccggccugcuccugacggcggccggggagaccuucagcggcgggugccuguucgacgagcccuacuccaccugcggcuacagccaguccgagggcgacgacuucaacugggagcaggugaacacccucacgaagccgaccagcgaccccuggaugcccuccgggagcuucaugcuggucaacgccuccggccggcccgaggggcagcgcgcccaccugcuccugccgcagcugaaggagaacgacacccacugcaucgacuuccacuacuucgugagcuccaagagcaacuccccccccggccuccugaacguguacgucaaggugaacaacgggccccugggcaacccgaucuggaacaucagcggcgaccccacccggacguggaaccgcgccgagcucgcgaucuccaccuucuggcccaacuucuaccaggugaucuucgaggucaucaccagcgggcaccagggcuaccuggccaucgacgaggugaaggugcuggggcaccccugcacccggacgccgcacuuccuccgcauccagaacgucgaggugaacgccggccaguucgccaccuuccagugcuccgcgaucggccggaccguggccggggaccgccuguggcugcagggcaucgacguccgggacgccccccucaaggagaucaaggugaccagcucccgccgguucaucgccagcuucaacguggucaacacgaccaagcgcgacgccgggaaguaccggugcaugauccgcaccgagggcggggugggcaucuccaacuacgcggagcugguggucaaggagccccccgugccgaucgcccccccccagcuggccagcgugggcgccaccuaccucuggauccagcugaacgccaacagcaucaacggggacggccccaucgucgcgcgggagguggaguacugcacggccuccgggagcuggaacgaccgccagccgguggacuccaccagcuacaagaucggccaccuggaccccgacaccgaguacgagaucuccguccuccugacccggcccggggagggcggcacggggagccccggcccggcccugcgcacccggaccaagugcgccgaccccaugcgcgggccccggaagcucgagguggucgaggugaagucccgccagaucaccauccgcugggagcccuucggcuacaacgugacgcggugccacagcuacaaccugaccguccacuacugcuaccagguggggggccaggagcaggugcgcgaggaggucuccugggacaccgagaacagccacccgcagcacaccaucacgaaccugucccccuacaccaacgugagcgugaagcucauccugaugaaccccgagggccggaaggagucccaggagcugaucguccagaccgacgaggaccucccgggggccgugcccaccgagagcauccagggcuccacguucgaggagaagaucuuccugcaguggcgcgagcccacccagaccuacggggugaucacccuguacgagaucaccuacaaggcggucagcuccuucgaccccgagaucgaccucagcaaccaguccggccgggugagcaagcugggcaacgagacgcacuuccuguucuucgggcucuacccgggcaccaccuacagcuucaccauccgcgccuccacggccaagggguucggcccccccgccaccaaccaguucaccaccaagaucagcgcccccuccaugccggcguacgagcuggagacgccccugaaccagaccgacaacaccgugaccgucaugcucaagcccgcccacagccggggggcccccguguccguguaccagaucgucguggaggaggagcgcccgcggcgcacgaagaagaccaccgagauccugaagugcuaccccgugcccauccacuuccagaacgccagccugcucaacucccaguacuacuucgcggccgaguuccccgccgacagccugcaggccgcccagccguucaccaucggcgacaacaagacguacaacggcuacuggaacaccccccugcugcccuacaaguccuaccggaucuacuuccaggcggccagccgcgccaacggggagaccaagaucgacugcguccagguggccaccaagggcgccgcgacgcccaagccggugcccgagcccgagaagcagaccgaccacaccgucaagaucgccggggugaucgccggcauccuccuguucgugaucaucuuccugggggucgugcucgugaugaagaagcggaagcuggccaagaagcgcaaggagaccauguccagcacgcggcaggagaugaccgucauggugaacuccauggacaagagcuacgccgagcagggcaccaacugcgacgaggcguucuccuucauggacacccacaaccugaacggccgcagcguguccagccccagcuccuucacgaugaagaccaacacccucagcaccuccgucccgaacagcuacuaccccgaccccuucgugccgacggccauccuggugcccaucaacgacgagacccacaccauggccuccgacaccagcucccugguccagagccacacguacaagaagcgggagcccgccgacgugcccuaccagaccgggcagcuccacccggcgauccgcguggccgaccugcugcagcacaucacccagaugaagugcgccgagggcuacggguucaaggaggaguacgaguccuucuucgagggccagagcgcccccugggacuccgccaagaaggacgagaaccggaugaagaaccgcuacgggaacaucaucgcguacgaccacagccgcguccggcuccagaccaucgagggcgacaccaacuccgacuacaucaacggcaacuacaucgacggguaccaccgccccaaccacuacaucgccacgcagggccccaugcaggagaccaucuacgacuucuggcggaugguguggcacgagaacaccgccagcaucaucauggugaccaaccuggucgagguggggcgcgugaagugcugcaaguacuggccggacgacacggagaucuacaaggacaucaaggucacccugaucgagaccgagcuccuggccgaguacgugauccggaccuucgccguggagaagcgcggcguccacgagauccgggagauccgccaguuccacuucacgggguggcccgaccacggcgugcccuaccacgcgaccggccugcucggguucgugcggcaggucaaguccaagagccccccguccgccggcccccuggugguccacugcagcgccggggccggccgcaccggcugcuucaucgugaucgacaucaugcuggacauggccgagcgggaggggguggucgacaucuacaacugcgugcgcgagcuccggucccgccgggugaacaugguccagaccgaggagcaguacguguucauccacgacgcgauccuggaggccugccugugcggcgacacgagcgugcccgccagccagguccgcucccucuacuacgacaugaacaagcuggacccccagaccaacagcucccagaucaaggaggaguuccggacccugaacauggugaccccgacgcuccgcguggaggacugcagcaucgcccugcugccccggaaccacgagaagaaccgcugcauggacauccucccccccgaccggugccugccguuccugaucaccaucgacggggaguccagcaacuacaucaacgcggcccucauggacuccuacaagcagcccagcgccuucaucgucacccagcacccccugcccaacaccgugaaggacuucuggcgccuggugcucgacuaccacugcacguccgucgugaugcugaacgacguggacccggcccagcugugcccccaguacuggcccgagaacggcguccaccgccacgggcccauccagguggaguucgugagcgccgaccucgaggaggacaucaucucccggaucuuccgcaucuacaacgcggcccggccgcaggacggcuaccgcaugguccagcaguuccaguuccugggcuggcccauguaccgggacacccccgugagcaagcgcuccuuccugaagcucauccggcagguggacaaguggcaggaggaguacaacgggggcgaggggcgcaccgucgugcacugccugaacggcgggggccggagcggcaccuucugcgccaucuccaucgugugcgagaugcugcgccaccagcggacggucgacguguuccacgccgugaagacccuccgcaacaacaagccgaacauggucgaccugcuggaccaguacaaguucugcuacgagguggcccucgaguaccugaacagcggguga

SEQ ID NO: 35286 - RNA, 3048 nt, Artificial Sequence
  derived and/or modified sequence opt1 from PTPRN2__Homo_sapiens__NP_002838
auggggcccccgcugccccuccugcugcuccugcugcuccugcugccgccccgcgugcuccccgccgcccccagcuccgucccccggggccgccagcugcccggccggcuggggugccuccuggaggagggccugugcggggcgagcgaggccugcgugaacgacggcguguucggccgcugccagaaggucccggccauggacuucuaccgguacgaggugucccccguggcccuccagcgccugcgggucgcccugcagaagcucagcgggaccggcuucaccuggcaggacgacuacacgcaguacgugauggaccaggagcuggcggaccugcccaagaccuaccuccgccggcccgaggccuccagcccggcccgccccuccaagcacagcgugggguccgagcggcgcuacagccgggagggcggggccgcgcuggccaacgcccugcgccggcaccuccccuuccuggaggcccugucccaggcccccgcgagcgacguccucgcccgcacccacaccgcccaggaccggccgcccgccgagggcgacgaccgcuucuccgagagcauccugacguacguggcccacaccuccgcgcugaccuacccgcccggcagccggacccagcuccgcgaggaccugcugccccggacgcucgggcagcugcagcccgacgagcugucccccaagguggacagcggcgucgaccgccaccaccucauggccgcccuguccgccuacgccgcgcagcggcccccggccccgcccggggagggcagccuggagccccaguaccuccugcgcgcccccagccgcaugccccggccccugcucgccccggccgcgccccagaaguggcccagcccccugggcgacuccgaggacccguccagcaccggggacggcgcccgcauccacacccugcucaaggaccugcagcggcagcccgccgaggugcgcgggcuguccggccucgagcuggacgggauggccgagcugauggcgggccugaugcagggcguggaccacggggucgcccggggcagccccgggcgcgccgcccucggcgaguccggggagcaggccgacggccccaaggcgacccugcggggcgacagcuucccggacgacggggugcaggacgacgacgaccgccuguaccaggaggugcaccggcucuccgccacgcugggcgggcugcuccaggaccacggcagccgccugcugcccggggcccuccccuucgcccggccccuggacauggagcgcaagaaguccgagcacccggagagcucccugagcuccgaggaggagaccgccggcgucgagaacgucaagagccagaccuacuccaaggaccuccugggccagcagccccacagcgagcccggggcggccgccuucggcgagcugcagaaccagaugcccgggccguccaaggaggagcagagccuccccgccggcgcccaggaggcgcugagcgacggccugcagcucgaggugcagcccuccgaggaggaggcccggggguacaucgugaccgaccgcgacccccugcggccggaggagggccgccggcugguggaggacguggcccgccuccugcagguccccagcuccgccuucgcggacguggagguccuggggcccgccgugacguucaaggugagcgccaacguccagaacgugaccaccgaggacguggagaaggccaccgucgacaacaaggacaagcucgaggagacguccggccugaagauccugcagaccggggugggcagcaaguccaagcucaaguuccugcccccgcaggccgagcaggaggacagcaccaaguucaucgcgcugacccucgugucccuggccugcauccugggcguccuccuggccagcgggcugaucuacugccuccgccacuccagccagcaccggcugaaggagaagcuguccggccucgggggcgaccccggggccgacgccacggcggccuaccaggagcugugccgccagcggauggccacccggcccccggaccgccccgagggcccccacaccagccgcaucuccagcguguccagccaguucagcgacggccccaucccgucccccagcgcccgguccagcgccuccagcugguccgaggagcccgugcagagcaacauggacaucuccaccgggcacaugauccugagcuacauggaggaccaccucaagaacaagaaccgccuggagaaggagugggaggcgcugugcgccuaccaggccgagcccaacuccagcuucgucgcccagcgggaggagaacgugccgaagaaccgcucccucgcggugcugacguacgaccacagccggguccugcucaaggccgagaacucccacagccacuccgacuacaucaacgccagccccaucauggaccacgacccccgcaaccccgccuacaucgccacccagggcccgcugcccgcgaccguggccgacuucuggcagauggugugggaguccgggugcgucgugaucgugaugcugacgccccucgccgagaacggcguccggcagugcuaccacuacuggcccgacgaggggagcaaccuguaccacaucuacgaggugaaccuggugagcgagcacaucuggugcgaggacuuccucguccgcuccuucuaccugaagaaccugcagaccaacgagacccggaccgugacccaguuccacuuccucagcugguacgaccgcggcgugccguccagcucccggagccugcuggacuuccgccggaaggucaacaagugcuaccgcggccgguccugccccaucaucgugcacugcagcgacggggccggccgcuccgggacguacgugcucaucgacaugguccugaacaagauggccaagggcgcgaaggagaucgacaucgccgccacccuggagcaccuccgcgaccagcggcccgggauggugcagaccaaggagcaguucgaguucgcccugaccgccguggcggaggaggucaacgccauccugaaggcccucccccaguga

SEQ ID NO: 35287 - RNA, 2853 nt, Artificial Sequence
  derived and/or modified sequence opt1 from PTPRN__Homo_sapiens__NP_001186692
augcgccggccccgccggccgggcgggcugggcgggagcggcgggcuccgccugcugcucugccugcugcuccuguccagccggcccggcggcugcuccgccgugagcgcccacgggugccuguucgaccgccggcucugcucccaccuggaggucugcauccaggacggccuguucgggcagugccaggugggcguggggcaggcgcgcccccuccugcaggucaccagccccgugcugcagcggcuccagggcgugcugcgccagcugaugucccagggccucagcuggcacgacgaccugacccaguacgucaucucccaggagauggagcggaucccgcgccugcggccgcccgagccccgcccccgggaccgcagcgggcucgcccccaagcggcccggccccgccggggagcugcugcuccaggacaucccgacgggcuccgcccccgccgcgcagcaccgccugccccagcccccggugggcaagggcggggccggggccagcuccagccugagcccccuccaggccgagcugcugccgccccuccuggagcaccuccuccugccgccccagccgccccaccccucccuguccuacgagcccgcgcuccugcagcccuaccuguuccaccaguucggcagccgggacgggucccgcgugagcgagggcagccccggcauggucuccguggggccgcuccccaaggccgaggcccccgcccuguucagccggaccgccuccaagggcaucuucggggaccacccgggccacagcuacggggaccugcccggccccucccccgcgcagcuguuccaggacagcggccugcuguaccucgcccaggagcugccggcccccucccgcgcccgcgugccccggcugcccgagcaggggagcuccagccgcgccgaggacuccccggagggcuacgagaaggaggggcucggcgaccgcggggagaagcccgcgagccccgccguccagcccgacgccgcccuccagcggcuggccgcggugcuggccggcuacggcguggagcugcggcagcugacccccgagcagcuguccacccuccugacgcugcuccagcugcugcccaagggggccggccgcaaccccgggggcgucgugaacgugggcgccgacaucaagaagaccauggaggggcccgucgagggccgggacaccgccgagcucccggcgcgcaccagccccaugcccgggcaccccacggccuccccgaccagcuccgaggugcagcagguccccagccccguguccagcgagcccccgaaggccgcccggccgcccgugacccccgugcugcuggagaagaaguccccgcucggccagagccagcccaccgucgcggggcagcccagcgcccgccccgccgccgaggaguacggcuacaucgugacggaccagaacgucgugggccccgcccugaccuuccggauccgccacaacgagcagaaccugucccucgcggacgugacccagcaggccgggcuggucaagagcgagcuggaggcccagaccggccuccagauccugcagacgggggugggccagcgggaggaggccgccgcggugcugccccagaccgcccacuccaccagccccaugcgcuccguccuccugacccugguggcccucgccgggguggccggccugcuggucgcgcucgccguggcccugugcgugcggcagcacgcccgccagcaggacaaggagcggcuggcggcccucggcccggagggggcccacggcgacacgaccuucgaguaccaggaccugugccgccagcacauggccaccaagagccuguucaaccgggccgaggggccgcccgagcccucccgcgucagcuccgugagcucccaguucagcgacgcggcccaggccucccccagcucccacagcagcacccccuccuggugcgaggagcccgcccaggccaacauggacaucagcacgggccacaugauccucgcguacauggaggaccaccuccggaaccgcgaccgccuggccaaggaguggcaggcccugugcgccuaccaggccgagcccaacacgugcgcgaccgcccagggggagggcaacaucaagaagaaccggcacccggacuuccugcccuacgaccacgcccgcaucaagcugaagguggaguccagccccucccggagcgacuacaucaacgccucccccaucaucgagcacgacccgcgcaugcccgcguacaucgccacccagggcccccucagccacaccaucgccgacuucuggcagauggucugggaguccgggugcaccgugaucgugaugcugacgccccuggucgaggacggcgugaagcagugcgaccgguacuggccggacgagggggccagccucuaccacguguacgaggucaaccugguguccgagcacaucuggugcgaggacuuccuggugcgcagcuucuaccucaagaacguccagacccaggagacccggacccugacccaguuccacuuccuguccuggcccgccgagggcacccccgcgagcacgcgcccccuccuggacuuccggcgcaaggugaacaagugcuaccgggggcgcuccugcccgaucaucgugcacugcagcgacggcgccggccggaccgggaccuacauccugaucgacaugguccucaaccgcauggccaagggcgugaaggagaucgacaucgccgccacccuggagcacgugcgggaccagcgccccgggcugguccgguccaaggaccaguucgaguucgcgcucaccgccguggccgaggaggugaacgccauccugaaggcccugccccaguga

SEQ ID NO: 35288 - RNA, 3567 nt, Artificial Sequence
  derived and/or modified sequence opt1 from PTPRO__Homo_sapiens__NP_002839
augggccaccugcccaccgggauccacggcgcccgccggcuccugccgcugcucuggcuguucgugcuguucaagaacgccaccgcguuccacgucacggugcaggacgacaacaacaucguggucagccucgaggccuccgacgugaucagccccgccuccguguacgucgugaagaucaccggggagagcaagaacuacuucuucgaguucgaggaguucaacuccacccugccccccccggugaucuucaaggccagcuaccacggccuguacuacaucaucacccucgucguggugaacgggaacgucgugacgaagcccucccgcagcaucaccgugcugaccaagccccugcccgucaccuccgugagcaucuacgacuacaagccgucccccgagacgggcgugcucuucgagauccacuaccccgagaaguacaacgucuucacccgggugaacaucagcuacugggagggcaaggacuuccgcaccaugcuguacaaggacuucuucaaggggaagaccguguucaaccacuggcugcccggcaugugcuacuccaacaucacguuccagcucgucagcgaggccaccuucaacaaguccacccugguggaguacagcggggugucccacgagccgaagcagcaccggaccgcgcccuaccccccccagaacaucagcguccgcaucgugaaccugaacaagaacaacugggaggagcaguccggcaacuucccggaggagagcuucaugcggagccaggacacgaucgggaaggagaagcucuuccacuucaccgaggagacccccgagauccccuccggcaacaucagcuccggcuggcccgacuucaacagcuccgacuacgagaccacgagccagccguacuggugggacuccgccagcgccgcccccgaguccgaggacgaguucgucagcgugcugcccauggaguacgagaacaacuccacccugagcgagaccgagaaguccaccagcggguccuucagcuucuuccccgugcagaugauccucacguggcugccgcccaagccccccaccgcguucgacggcuuccacauccacaucgagcgcgaggagaacuucaccgaguaccugauggucgacgaggaggcccacgaguucguggccgagcucaaggagccggggaaguacaagcuguccgugaccacguucagcuccagcggcagcugcgagacccggaagucccagagcgccaagucccugagcuucuacaucucccccagcggcgaguggaucgaggagcucaccgagaagccccagcacgucuccgugcacgugcugagcuccaccacggcccugaugagcuggaccuccagccaggagaacuacaacuccaccaucgucagcguggugucccucaccugccagaagcagaaggagagccagcgccuggagaagcaguacugcacgcaggucaacuccagcaagccgaucaucgagaaccuggugcccggggcgcaguaccagguggucaucuaccuccggaagggcccccugaucgggcccccgagcgaccccgugaccuucgccaucgugcccaccggcaucaaggaccugaugcucuacccccuggggccgaccgccgucgugcuguccuggacccgccccuaccucggcguguuccggaaguacgucguggagauguucuacuucaaccccgccacgaugaccagcgaguggaccaccuacuacgagaucgccgcgacggugucccugaccgccagcguccgcaucgccaaccugcuccccgccugguacuacaacuuccgggugaccauggugaccuggggcgacccggagcuguccugcugcgacagcuccacgaucagcuucaucaccgcccccgucgcgcccgagaucaccuccguggaguacuucaacagccugcucuacaucuccuggaccuacggggacgacacgaccgaccugagccacucccgcaugcugcacuggaugguggucgccgagggcaagaagaagaucaagaagagcgugacccggaacgugaugaccgccauccucucccugcccccgggggacaucuacaaccugagcgucacggccugcaccgagcgcggcuccaacaccagcaugcugcggcucgugaagcuggagcccgccccccccaagucccuguucgcggugaacaagacccagacgagcgucacccuccuguggguggaggaggggguggccgacuucuucgaggucuucugccagcaggugggcagcucccagaagaccaagcugcaggagccgguggccgucagcucccacguggugaccaucagcucccuccugcccgccacggcguacaacugcagcgucaccuccuucagccacgacucccccagcgugcccaccuucaucgccguguccaccauggucacggagaugaacccgaacgugguggucaucagcgugcuggccauccucuccacccugcugaucggccuccugcuggucacccucaucauccugcgcaagaagcaccugcagauggcccgggagugcggggccggcaccuucgugaacuucgcgagccucgagcgcgacgggaagcugcccuacaacugguccaagaacggccugaagaagcgcaagcucacgaaccccgugcagcuggacgacuucgacgccuacaucaaggacauggccaaggacagcgacuacaaguucucccugcaguucgaggagcucaagcugaucgggcuggacaucccgcacuucgccgccgaccucccccugaaccggugcaagaaccgcuacaccaacauccugcccuacgacuucagccggguccgccucguguccaugaacgaggaggagggcgcggacuacaucaacgccaacuacauccccggcuacaacagcccgcaggaguacaucgccacccaggggccccugcccgagacccggaacgacuucuggaagauggugcugcagcagaagagccagaucaucgucaugcucacgcagugcaacgagaagcgccgggugaagugcgaccacuacuggcccuucaccgaggagccgaucgccuacggcgacaucaccguggagaugaucuccgaggaggagcaggacgacugggccugccgccacuuccggaucaacuacgcggacgagaugcaggacgucaugcacuucaacuacaccgccuggcccgaccacggggugcccaccgccaacgccgcggagagcauccugcaguucgugcacaugguccgccagcaggccacgaaguccaagggccccaugaucauccacugcagcgccggcguggggcggaccggcaccuucaucgcccuggaccgccuccugcagcacauccgggaccacgaguucguggacauccuggggcucgucuccgagaugcgcagcuaccggauguccauggugcagaccgaggagcaguacaucuucauccaccagugcgugcagcugauguggaugaagaagaagcagcaguucugcaucagcgacgucaucuacgagaacguguccaagagcuga

SEQ ID NO: 35289 - RNA, 6900 nt, Artificial Sequence
  derived and/or modified sequence opt1 from PTPRQ__Homo_sapiens__NP_001138498
auggacuuccugaucaucuuccuccugcuguucaucggcaccagcgagacccagguggacgucuccaacguggugcccggcacccgcuacgacaucaccaucagcuccaucagcaccaccuacaccucccccgucacccgcaucgugaccaccaacgugacgaagcccgggccgcccgucuuccucgccggcgagcgcgugggcagcgccgggauccugcuguccuggaacaccccgcccaaccccaacggccggaucaucagcuacaucgugaaguacaaggaggucugccccuggaugcagaccguguacacccaggugcgcuccaagcccgacagccucgagguccugcugacgaaccucaaccccggcaccaccuacgagaucaagguggcggccgagaacuccgccgggaucggcguguucagcgaccccuuccuguuccagaccgccgaguccgcccccgggaaggucgugaaccugacgguggaggcguacaacgccagcgccgucaagcucaucugguaccugccccggcagcccaacggcaagaucaccuccuucaagaucagcgugaagcacgcccgcuccgggaucguggucaaggacgugagcauccggguggaggacauccugaccggcaagcuccccgagugcaacgagaacuccgagagcuuccuguggagcaccgccucccccagccccacgcugggccgcgucacgccgcccucccggaccacccacagcuccagcacgcucacccagaacgagaucuccagcguguggaaggagcccaucuccuucgucgugacccaccuccgccccuacaccacguaccuguucgaggugagcgccgccaccaccgaggccggguacaucgacuccaccaucguccggacgcccgagagcgugcccgagggcccgccccagaacugcgugaccgggaacaucaccggcaaguccuucagcauccucugggacccgcccaccaucgucacgggcaaguucuccuaccgcguggagcuguacgggcccagcggccggauccuggacaacuccaccaaggaccucaaguucgccuucaccaaccugacccccuucaccauguacgacguguacaucgcggccgagacgagcgccgggaccggccccaaguccaacaucagcgucuucacgccgcccgacgugcccggggccguguucgaccugcagcucgccgaggucgagagcacccaggugcgcaucacguggaagaagccccggcagcccaacggcaucaucaaccaguaccgcgugaagguccuggugcccgagaccggcaucauccuggagaacacccuccugaccgggaacaacgaguacaucaacgaccccauggcgcccgagaucgugaacaucgucgagcccauggugggccuguacgagggguccgccgagaugagcuccgaccuccacagccuggccacguucaucuacaacucccaccccgacaagaacuuccccgcccggaaccgcgccgaggaccagaccagccccguggucaccacccggaaccaguacaucacggacaucgcggccgagcagcuguccuacgugauccgccggcucgugcccuucaccgagcacaugaucagcgucuccgccuucaccaucaugggcgaggggccgcccaccgugcugagcgugcgcacgcgccagcagguccccuccagcaucaagaucaucaacuacaagaacaucuccagcuccagcauccugcucuacugggacccgcccgaguaccccaacggcaagaucacccacuacaccaucuacgccauggagcuggacaccaaccgggccuuccagaucacgaccaucgacaacuccuuccugaucaccggccucaagaaguacaccaaguacaagaugcgcguggcggccagcacgcacgugggggagagcucccugagcgaggagaacgacaucuucguccggaccuccgaggacgagcccgagagcagcccccaggacguggaggugaucgacgucaccgccgacgagauccgccugaaguggagcccgcccgagaagcccaacggcaucaucaucgccuacgaggugcucuacaagaacaucgacacccuguacaugaagaacacguccaccaccgacaucauccugcggaaccuccgcccccacacccuguacaacaucagcgugcgguccuacacgcgcuucgggcacggcaaccaggucagcucccugcugagcgugcggaccuccgagaccgugcccgacagcgcgcccgagaacaucaccuacaagaacaucuccagcggggagaucgagcucuccuuccugccgcccagcucccccaacggcaucauccagaaguacacgaucuaccugaagcgcagcaacggcaacgaggagcggaccaucaacaccaccagccucacccagaacaucaagguccugaagaaguacacgcaguacaucaucgagguguccgccagcacccugaagggggagggcgugcgcuccgcccccaucagcauccucaccgaggaggacgcccccgacuccccgccccaggacuucagcgucaagcagcuguccggggugaccgugaagcugagcuggcagccgccccuggagcccaacggcaucauccuguacuacacggucuacguguggaaccgguccagccugaagaccaucaacgugaccgagaccucccucgagcugagcgaccuggacuacaacgucgaguacuccgccuacgugacggcgagcacccgcuucggcgacgggaagacccgguccaacaucaucagcuuccagacccccgagggcgcccccuccgacccgcccaaggacguguacuacgccaaccucagcuccagcagcaucauccuguucuggacgccgcccuccaagcccaacgggaucauccaguacuacagcgucuacuaccgcaacaccuccggcaccuucaugcagaacuucacccugcacgaggugacgaacgacuucgacaacaugaccgucagcaccaucaucgacaagcucaccaucuucuccuacuacacguucuggcugaccgccagcaccuccguggggaacggcaacaagagcuccgacaucaucgagguguacaccgaccaggacauccccgagggcuucgucgggaaccugacguacgagagcaucuccagcaccgccaucaacguguccugggugccgcccgcgcagcccaacggccucgucuucuacuacgugagccugauccugcagcagaccccgcggcacgugcggccgccccucgucaccuacgagcgguccaucuacuucgacaaccuggagaaguacacggacuacauccugaagaucacccccagcaccgagaagggguucuccgacaccuacacggcccagcucuacaucaagaccgaggaggacgugccggagaccagccccaucaucaacaccuucaagaaccuguccagcacgagcgugcugcucuccugggacccgcccgucaagcccaacggcgccaucaucagcuacgaccugacccugcaggggcccaacgagaacuacuccuucaucaccagcgacaacuacaucauccucgaggagcugucccccuucacccuguacagcuucuucgccgccgcgcgcacccgcaagggccucggcccguccagcauccuguucuucuacacggacgaguccgugccccuggcgccgccccagaaccucacccugaucaacugcaccagcgacuucguguggcugaagugguccccgagcccccuccccgggggcaucgucaagguguacuccuucaagauccacgagcacgagaccgacacgaucuacuacaagaacaucagcggguucaagaccgaggccaagcuggugggccuggagcccgucuccaccuacagcauccggguguccgccuucaccaagguggggaacggcaaccaguucagcaacgucgugaaguucacgacccaggaguccgugccggacgucgugcagaacaugcagugcauggcgaccagcuggcagagcgugcucgucaagugggacccgcccaagaaggccaacggcaucaucacccaguacauggugacgguggagcgcaacuccaccaaggucagcccccaggaccacauguacaccuucaucaagcugcuggccaacaccuccuacguguucaaggugcgggccagcacguccgccggggagggcgacgaguccacgugccacgucuccacccucccggagaccgugcccagcgugcccaccaacaucgcguucuccgacguccagagcaccuccgccacccugaccuggauccgccccgacacgauccugggguacuuccagaacuacaagaucaccacccagcuccgggcccagaagugcaaggagugggagagcgaggagugcguggaguaccagaagauccaguaccuguacgaggcccaccugaccgaggagacgguguacggccucaagaaguuccgcugguaccgguuccaggucgccgcguccaccaacgccggguacggcaacgccagcaacuggaucuccaccaagacccugccggggccgcccgacgggcccccggagaacgugcacguggucgccacgagccccuucuccaucagcaucuccuggagcgagcccgccgugaucaccggcccgaccugcuaccugaucgacgugaaguccgucgacaacgacgaguucaacaucuccuucaucaagagcaacgaggagaacaagaccaucgagaucaaggaccucgagaucuucacgcgcuacuccguggugaucaccgcguucaccgggaacaucagcgccgccuacgucgagggcaaguccagcgccgagaugaucgugaccacgcuggaguccgcgccgaaggacccgcccaacaacaugaccuuccagaagauccccgacgaggugaccaaguuccagcugaccuuccucccgcccagccagcccaacggcaacauccaggucuaccaggcccugguguaccgggaggacgacccgaccgccguccagauccacaaccuguccaucauccagaagacgaacaccuucgugaucgccaugcucgaggggcugaagggcgggcacaccuacaacaucagcguguacgccgucaacuccgcgggcgccgggcccaaggugcccaugcgcaucaccauggacaucaaggcccccgcccggccgaagacgaagcccacccccaucuacgacgccaccggcaagcugcucgugaccagcacgaccaucaccauccgcaugcccaucugcuacuacuccgacgaccacggcccgaucaagaacguccaggugcuggugaccgagacgggggcgcagcacgacggcaacgucaccaagugguacgacgccuacuucaacaaggcccggcccuacuucaccaacgagggguuccccaacccgcccugcaccgagggcaagacgaaguucagcgggaacgaggagaucuacaucaucggcgccgacaacgccugcaugauccccggcaacgaggacaagaucugcaacgggccccugaagcccaagaagcaguaccucuucaaguuccgcgcgaccaacaucaugggccaguucaccgacuccgacuacagcgaccccgugaagacccugggggagggccuguccgagcggacgguggagaucauccucagcgucacccugugcauccugagcaucauccuccuggggaccgccaucuucgccuucgcccgcauccggcagaagcagaaggagggcggcaccuacagcccccaggacgccgagaucaucgacacgaagcugaagcucgaccagcugaucaccguggcggaccuggagcucaaggacgagcgccugacccggcugcucagcuaccgcaaguccaucaagcccaucagcaagaaguccuuccugcagcacguggaggagcugugcaccaacaacaaccucaaguuccaggaggaguucagcgagcugcccaaguuccugcaggaccucuccagcacggacgccgaccugccguggaaccgggccaagaaccgcuuccccaacaucaagcccuacaacaacaaccgcgucaagcugaucgccgacgcguccgugcccgggagcgacuacaucaacgccuccuacaucagcggcuaccucugcccgaacgaguucaucgccacccaggggccccugcccggcaccgugggcgacuucuggcggauggucugggagacccgcgccaagacgcuggugaugcugacccagugcuucgagaaggggcggauccgcugccaccaguacuggccggaggacaacaagcccgugaccgucuucggcgacaucgugaucaccaagcucauggaggacgugcagaucgacuggacgauccgggaccugaagaucgagcgccacggggacugcaugaccguccggcagugcaacuucaccgccuggcccgagcacggcgugcccgagaacuccgcgccgcugauccacuucgugaagcucguccgcgccagccgggcccacgacaccacccccaugaucgugcacugcuccgccggggugggccgcacgggcgucuucaucgcccuggaccaccugacccagcacaucaacgaccacgacuucguggacaucuacgggcucguggcggagcugcggagcgagcgcaugugcaugguccagaaccuggcccaguacaucuuccuccaccagugcauccuggaccugcucuccaacaagggcagcaaccagcccaucugcuucgugaacuacuccgcccugcagaagauggacagccuggacgccauggagggggacguggagcucgagugggaggagaccaccauguga

SEQ ID NO: 35290 - RNA, 1638 nt, Artificial Sequence
  derived and/or modified sequence opt1 from PTPRR__Homo_sapiens__NP_001193944
augcagagcaucuccaagcagacccugcagauggacgugaacaagcucaacaucacccugcugcgcaucuuccggcagggcgucgccgccgcgcucgggcugcugccccagcagguccacaucaaccgccucaucggcaagaagaacagcaucgagcuguucguguccccgaucaaccggaagacggggaucagcgacgcccugcccuccgaggaggugcuccgcagccugaacaucaacgugcugcaccagucccucagccaguucggcaucaccgaggugucccccgagaagaacguccugcaggggcagcacgaggccgacaagaucuggagcaaggagggcuucuacgccguggugaucuuccuguccaucuucgucaucaucgugaccugccucaugauccuguaccggcugaaggagcgcuuccagcucagccugcggcaggacaaggagaagaaccaggagauccaccugucccccaucacccuccagccggcccugagcgaggcgaagacggugcacuccaugguccagcccgagcaggcccccaaggugcugaacguggucguggacccccagggccgcggggccccggagaucaaggccaccaccgcgaccagcgugugccccucccccuucaagaugaagcccaucggccuccaggagcggcgcgggagcaacgucucccugacgcuggacaugagcagccucggcaacaucgagccguucguguccauccccacgccccgggagaagguggccauggaguaccugcagagcgccucccgcauccugacccggagccagcuccgcgacgucguggccuccagccaccuccugcaguccgaguucauggagauccccaugaacuucguggacccgaaggagaucgacaucccccggcacgggaccaagaaccgcuacaagaccauccugcccaacccccugagccgggucugccugcgcccgaagaacgugaccgacucccucagcaccuacaucaacgccaacuacauccggggcuacuccggcaaggagaaggcguucaucgccacccaggggcccaugaucaacacggucgacgacuucuggcagaugguguggcaggaggacagccccgugaucgucaugaucaccaagcugaaggagaagaacgagaagugcgugcuguacuggcccgagaagcgcggcaucuacgggaagguggagguccucgugaucuccgugaacgagugcgacaacuacaccauccggaaccugguccugaagcagggcagccacacccagcacgugaagcacuacugguacacguccuggccggaccacaagacccccgacagcgcccagccccuccugcagcugaugcucgacguggaggaggaccgccuggccucccagggccgcgggcccgucguggugcacugcagcgccggcaucgggcggaccggcugcuucaucgcgaccuccaucgggugccagcagcugaaggaggagggcgucguggacgcccucagcaucgugugccagcugcgcauggaccggggcgggaugguccagacgagcgagcaguacgaguucgugcaccacgcccugugccuguacgagucccgccucagcgccgagaccgugcaguga

SEQ ID NO: 35291 - RNA, 5847 nt, Artificial Sequence
  derived and/or modified sequence opt1 from PTPRS__Homo_sapiens__NP_002841
auggcccccaccuggggccccgggauggugagcgucgugggccccauggggcugcuggugguccugcuggugggcgggugcgccgccgaggagccgccccgguucaucaaggagcccaaggaccagaucggcgugagcggcggggucgccagcuucgugugccaggccaccggcgaccccaagccccgggugaccuggaacaagaaggggaagaaggucaacucccagcgcuucgagaccaucgaguucgacgagagcgccggcgccgugcuccggauccagccccugcgcaccccgcgggacgagaacguguacgagugcgucgcgcagaacuccgugggggagaucaccgugcacgccaagcugacgguccuccgcgaggaccagcugcccagcggcuuccccaacaucgacaugggcccccagcugaaggugguggagcggacccgcaccgccaccaugcucugcgccgcguccgggaaccccgaccccgagaucacgugguucaaggacuuccugcccgucgaccccagcgccuccaacggccggaucaagcagcugcgcagcgagaccuucgaguccacccccauccgcggcgcccuccagaucgagagcuccgaggagaccgaccagggcaaguacgagugcguggccacgaacagcgccggcgugcgcuacuccagccccgcgaaccuguacguccgggagcugcgcgaggugcggcgcguggcgccccgguucuccauccuccccaugagccacgagaucaugcccggcgggaacgucaacaucacgugcguggccgucgggucccccaugcccuacgugaaguggaugcagggggccgaggaccugacccccgaggacgacaugcccguggggcgcaacguccuggagcucaccgacgugaaggacagcgccaacuacacgugcguggcgaugagcucccugggcgucaucgaggccguggcccagaucaccgucaagagccugcccaaggcccccggcacccccauggugaccgagaacacggccaccuccaucaccaucaccugggacagcgggaaccccgaccccguguccuacuacgugaucgaguacaagagcaagucccaggacggccccuaccagaucaaggaggacaucacgaccacccgguacagcaucgggggccucuccccgaacagcgaguacgagaucugggucuccgcggugaacagcaucgggcaggggccgcccuccgagagcguggucacccgcacgggcgagcaggcccccgccuccgcgccccggaacgugcaggcccgcaugcugagcgccaccaccaugaucgugcagugggaggagcccgucgagcccaacgggcugauccgcggcuaccggguguacuacaccauggagcccgagcacccgguggggaacuggcagaagcacaacgucgacgacucccuccugacgaccgugggcagccugcucgaggacgagaccuacaccgugcgcguccuggccuucacguccgugggggacggcccccugagcgaccccauccaggugaagacccagcagggcguccccgggcagccgaugaaccuccgggccgaggcccgcagcgagaccuccaucacccugagcuggagcccgccccggcaggagagcaucaucaaguacgagcuccuguuccgcgagggcgaccacgggcgggaggugggccgcaccuucgaccccacgaccuccuacguggucgaggaccugaagccgaacaccgaguacgcguuccggcuggccgcccgcagcccccagggccucggggccuucacccccguggugcggcagcgcacgcugcaguccaagcccagcgccccgccccaggacgucaagugcguguccgugcggagcaccgcgauccuggucuccuggcggccgcccccgcccgagacccacaacggcgcccucgugggguacagcgugcgguaccgcccccugggcuccgaggaccccgagcccaaggaggucaacgggaucccgcccaccacgacccagauccugcucgaggcccuggagaaguggacccaguaccggaucaccacgguggcccacaccgaggugggcccgggccccgagagcucccccgucguggugcgcaccgacgaggacguccccagcgccccgccccggaagguggaggcggaggcccugaacgccaccgccauccgcgugcucuggcgcucccccgcccccgggcggcagcacggccagauccgcggguaccagguccacuacgugcggauggagggcgcggaggcccgcgggccgccccggaucaaggacgugaugcuggccgacgcccagugggagacggacgacaccgcggaguacgagauggucaucaccaaccugcagcccgagaccgccuacagcaucacgguggccgccuacaccaugaagggcgacggcgcccgcagcaagcccaaggucguggugaccaagggggcgguccucggccggccgacccuguccgugcagcagacgcccgaggggagccugcuggcccgcugggagccgcccgccggcaccgccgaggaccaggugcucggguaccggcugcaguucggccgcgaggacuccaccccgcuggccacccucgaguucccgcccagcgaggaccgguacacggcguccggcguccacaagggggccaccuacguguuccgccuggccgcccggagccgcggcgggcugggcgaggaggccgcggaggugcucuccauccccgaggacaccccgcgggggcacccccagauccuggaggccgccggcaacgccagcgcgggcaccguccugcuccgcuggcugccgcccgugccggccgagcggaacggggccaucgugaaguacacggucgccgugcgcgaggccggcgcgcuggggcccgcccgggagaccgagcuccccgccgccgccgagccgggcgcggagaacgcccugacccugcagggccucaagcccgacaccgccuacgaccuccaggugcgcgcccacacgcggcgcgggcccggccccuucuccccgcccguccgcuaccggaccuuccugcgcgaccaggugagccccaagaacuucaaggugaagaugaucaugaagaccuccguccuccugagcugggaguuccccgacaacuacaacuccccgacccccuacaagauccaguacaacgggcugacccucgacguggacggccggacgaccaagaagcugaucacccaccugaagccccacaccuucuacaacuucgugcucacgaaccgcgggagcucccugggcggccugcagcagaccgucaccgccuggaccgcguucaaccuccugaacgggaagcccagcguggccccgaagcccgacgccgacggcuucaucaugguguaccugcccgacgggcagucccccgucccggugcagagcuacuucaucgugauggucccccuccggaagucccgcggcgggcaguuccugacgccccugggcagccccgaggacauggaccucgaggagcugauccaggacaucagccggcugcagcgccggucccuccgccacagccggcagcuggaggugccgcgccccuacaucgccgcccgguucuccgugcugccgcccaccuuccacccgggcgaccagaagcaguacgggggcuucgacaaccgcgggcucgagcccggccaccgguacguccuguucgugcuggcggugcuccagaaguccgagcccaccuucgccgccucccccuucagcgacccguuccagcuggacaaccccgacccccagccgaucgucgacggggaggagggccugaucugggugaucggccccgugcucgccgucguguucaucaucugcaucgugaucgcgauccugcuguacaagaacaagcccgacuccaagcgcaaggacagcgagccccggaccaagugccuccugaacaacgccgaccuggccccgcaccaccccaaggaccccgucgagaugcgccggaucaacuuccagacgcccgacuccgggcuccgcagcccgcugcgcgagcccggcuuccacuucgaguccaugcugagccacccgcccaucccgaucgccgacauggccgagcacaccgagcggcucaaggcgaacgacucccugaagcugagccaggaguacgaguccaucgaccccgggcagcaguucaccugggagcacagcaaccucgaggugaacaagcccaagaaccgcuacgccaacgugaucgccuacgaccacucccgggucauccugcagcccaucgagggcaucaugggcagcgacuacaucaacgccaacuacguggacggguaccgcugccagaacgccuacaucgcgacccagggcccgcugcccgagacguucggggacuucuggcggauggugugggagcagcgcuccgccaccaucgucaugaugacccggcucgaggagaagucccgcaucaagugcgaccaguacuggcccaaccggggcaccgagacguacggguucauccaggugacccugcuggacaccaucgagcucgccaccuucugcgugcgcacguucagccugcacaagaacggcuccagcgagaagcgggagguccgccaguuccaguucaccgccuggcccgaccacggcgugccggaguaccccacccccuuccuggccuuccuccggcgcgugaagaccugcaacccgcccgacgcggggcccaucgucgugcacugcuccgccggcgucgggcggacgggcugcuucaucgugaucgacgccaugcuggagcgcaucaagcccgagaagaccguggacgucuacgggcacgugacccugaugcggagccagcgcaacuacauggugcagaccgaggaccaguacuccuucauccacgaggcccuccuggaggcggucggcugcggcaacacggaggugcccgcccggagccuguacgccuacauccagaagcucgcccagguggagcccggggagcacgucaccggcauggagcuggaguucaagcgccuggccaacuccaaggcgcacaccagccgguucaucuccgccaaccuccccugcaacaaguucaagaaccgccuggugaacaucaugcccuacgagagcacccgcgugugccugcagccgauccgcggggucgagggcuccgacuacaucaacgccagcuucaucgacggguaccgccagcagaaggccuacaucgccacgcagggcccccucgcggagaccaccgaggacuucuggcggaugcugugggagaacaacuccaccaucguggugaugcugaccaagcuccgcgagaugggccgggagaagugccaccaguacuggcccgccgagcgcagcgcccgguaccaguacuucgucguggaccccauggccgaguacaacaugccgcaguacauccugcgcgaguucaaggugacggacgcccgggacgggcagucccgcaccguccggcaguuccaguucaccgacuggcccgagcagggcgugcccaagagcggggagggcuucaucgacuucaucggccaggugcacaagaccaaggagcaguucggccaggacggccccaucuccguccacugcagcgcgggggugggccgcacggggguguucaucacccuguccaucguccucgagcggaugcgcuacgagggcgugguggacaucuuccagaccgucaagaugcugcggacccagcgcccggccauggugcagacggaggacgaguaccaguucugcuaccaggccgcccuggaguaccucggcagcuucgaccacuacgcgaccuga

SEQ ID NO: 35292 - RNA, 4326 nt, Artificial Sequence
  derived and/or modified sequence opt1 from PTPRT__Homo_sapiens__NP_008981
auggccagccuggccgcgcucgcccugucccugcuccugcgccugcagcugcccccgcuccccggcgcccgggcccagagcgccgccgggggcugcuccuucgacgagcacuacagcaacugcggguacuccguggcccugggcaccaacggguucaccugggagcagaucaacacgugggagaagcccaugcucgaccaggccguccccaccggcagcuucaugauggugaacuccagcggccgcgccuccgggcagaaggcgcaccuccugcucccgacccugaaggagaacgacacccacugcaucgacuuccacuacuacuucagcucccgggaccgcagcucccccggcgcccugaacguguacgucaaggugaacgggggcccccaggggaaccccguguggaacgucagcggcguggugacggagggcugggucaaggccgagcucgccaucuccaccuucuggccgcacuucuaccaggugaucuucgagagcgugucccugaaggggcaccccggcuacaucgccgucgacgaggugcgggugcuggcgcaccccugccgcaaggcgccccacuuccuccggcugcagaacgucgaggugaacguggggcagaacgccaccuuccagugcaucgccggcggcaaguggagccagcacgacaagcuguggcuccagcaguggaacgggcgcgacaccgcccugauggucacgcggguggugaaccaccgccgguucuccgcgaccgucagcguggccgacaccgcccagcgcagcguguccaaguaccggugcgucauccgcagcgacggcggguccggcgugagcaacuacgccgagcugaucgucaaggagccgcccacccccaucgcgccgcccgagcuccuggccgugggggccacguaccuguggaucaagcccaacgccaacuccaucaucggcgacggccccaucauccucaaggagguggaguaccggaccaccaccgggacgugggccgagacccacaucgucgacagccccaacuacaagcuguggcaccuggaccccgacguggaguacgagauccgcgugcuccugacccggcccggcgagggcgggaccgggccgcccggcccgccccugacgacccgcaccaagugcgccgaccccguccacggcccccagaacguggagaucguggacauccgggcgcgccagcucacccugcagugggagccguucggguacgccgucacgcggugccacuccuacaaccugaccgugcaguaccaguacguguucaaccagcagcaguacgaggccgaggaggucauccagaccagcucccacuacacccuccgcggccugcgccccuucaugacgauccggcugcgccuccugcugagcaaccccgaggggcggauggaguccgaggagcucguggugcagaccgaggaggacgucccgggcgccgugccccuggagagcauccagggcgggcccuucgaggagaagaucuacauccaguggaagcccccgaacgagaccaacggcgugaucacccuguacgagaucaacuacaaggcggucgggucccuggaccccagcgccgaccuguccagccagcgcggcaagguguucaagcugcggaacgagacgcaccaccucuucguggggcuguaccccggcaccaccuacuccuucaccaucaaggccagcacggccaagggcuucgggcccccggucaccacccgcaucgccaccaagaucuccgcgcccagcaugcccgaguacgacaccgacacgccccugaacgagaccgacaccaccaucacggugaugcugaagccggcccagagccggggcgcccccguguccgucuaccagcucguggugaaggaggagcgccugcagaagucccggcgcgccgccgacaucaucgagugcuucagcguccccgugagcuaccggaacgcguccagccuggacucccuccacuacuucgccgccgagcugaagcccgccaaccugccggugacccagcccuucaccgucggggacaacaagaccuacaacggcuacuggaacccgccccucagcccccugaaguccuacagcaucuacuuccaggcccuguccaaggcgaacggggagacgaagaucaacugcgugcgccucgccaccaagggcgccagcacccagaacuccaacaccguggagcccgagaagcaggucgacaacacggugaagauggccggcgugaucgcggggcugcugauguucaucaucauccuccugggcgucaugcugaccaucaagcggcgccggaacgccuacagcuacuccuacuaccucaagcuggccaagaagcagaaggagacccagagcggggcccagcgcgagaugggccccguggccuccgcggacaagcccaccacgaagcugagcgccagccggaacgacgagggguucuccagcuccagccaggacgugaacggcuucaccgacggcucccgcggggagcucagccagccgacccugaccauccagacgcaccccuaccggaccugcgaccccgucgagauguccuacccgcgcgaccaguuccagcccgccauccgcguggccgaccugcuccagcacaucacccagaugaagcggggccagggguacggcuucaaggaggaguacgaggcccugcccgaggggcagaccgcgagcugggacacggccaaggaggacgagaaccgcaacaagaaccgguacggcaacaucaucuccuacgaccacagccgcgugcggcugcucguccuggacggcgacccccacuccgacuacaucaacgccaacuacaucgacggguaccaccgcccgcggcacuacaucgccacccagggccccaugcaggagaccgugaaggacuucuggcgcaugaucuggcaggagaacagcgccuccaucgugauggucaccaaccugguggagguggggcgggucaagugcgugcgcuacuggcccgacgacacggagguguacggcgacaucaaggucacccucaucgagaccgagccccuggcggaguacgugauccggaccuucacgguccagaagaagggguaccacgagauccgcgagcugcgccucuuccacuucaccagcuggccggaccacggcgugcccugcuacgccaccggccugcugggguucgugcggcaggucaaguuccucaacccgcccgaggccggccccaucguggugcacugcuccgccggggcgggccggaccggcugcuucaucgccaucgacacgaugcuggacauggccgagaacgagggggucguggacaucuucaacugcgugcgcgagcugcgggcccagcgcgucaaccucgugcagaccgaggagcaguacguguucguccacgacgccauccuggaggcgugccugugcggcaacaccgccauccccgugugcgaguuccggagccucuacuacaacaucucccgccuggacccccagaccaacagcucccagaucaaggacgaguuccagacccugaacaucgugacgccccggguccgcccggaggacugcagcaucgggcuccugccccgcaaccacgacaagaaccggagcauggacgugcugccccucgaccgcugccugcccuuccugaucuccguggacggcgagagcuccaacuacaucaacgccgcccucauggacagccacaagcagccggccgcguucgucgugacccagcacccccugcccaacaccguggccgacuucuggcggcuggucuucgacuacaacugcuccagcguggugaugcucaacgagauggacaccgcccaguucugcaugcaguacuggcccgagaagacguccgggugcuacggcccgauccaggucgaguucgugagcgccgacaucgacgaggacaucauccaccgcaucuuccggaucugcaacauggcccgcccccaggacggcuaccggaucgugcagcaccuccaguacaucggguggcccgcguaccgcgacacgcccccguccaagcggagccugcugaaggucgugcgccggcuggagaaguggcaggagcaguacgacggccgcgaggggcggaccgugguccacugccugaacggcgggggccgcuccggcaccuucugcgccaucugcagcgugugcgagaugauccagcagcagaacaucaucgacguguuccacaucgucaagacccuccggaacaacaaguccaacaugguggagacccuggagcaguacaaguucguguacgaggucgcccuggaguaccucagcuccuucuga

SEQ ID NO: 35293 - RNA, 4347 nt, Artificial Sequence
  derived and/or modified sequence opt1 from PTPRZ1__Homo_sapiens__NP_001193768
augcgcauccugaagcgguuccucgccugcauccagcugcugugcgugugccgccucgacugggccaacggcuacuaccggcagcagcgcaagcuggucgaggagaucggguggagcuacaccggcgcgcugaaccagaagaacugggggaagaaguacccgaccugcaacucccccaagcagagccccaucaacaucgacgaggaccucacccaggugaacgugaaccugaagaagcugaaguuccagggcugggacaagaccucccucgagaacaccuucauccacaacaccgggaagacggucgagaucaaccugaccaacgacuaccgggugagcggcggcguguccgagauggucuucaaggccagcaagaucaccuuccacugggggaagugcaacauguccagcgacggcuccgagcacagccuggaggggcagaaguucccccucgagaugcagaucuacugcuucgacgccgaccgcuucuccagcuucgaggaggccgugaagggcaaggggaagcugcgggcccuguccauccucuucgaggugggcaccgaggagaaccuggacuucaaggcgaucaucgacggcgucgagagcgugucccgcuucgggaagcaggccgcccuggaccccuucauccuccugaaccugcucccgaacagcacggacaaguacuacaucuacaacggcucccugaccagcccgcccugcaccgacaccguggacuggaucgucuucaaggacacgguguccaucagcgagagccagcuggccguguucugcgagguccucaccaugcagcaguccggguacgugaugcugauggacuaccugcagaacaacuuccgggagcagcaguacaaguucagccgccagguguucuccagcuacaccggcaaggaggagauccacgaggcggucugcuccagcgagcccgagaacgugcaggccgaccccgagaacuacaccucccuccuggugacgugggagcggccccgcgucguguacgacaccaugaucgagaaguucgccgugcuguaccagcagcucgacggcgaggaccagaccaagcacgaguuccugaccgacggguaccaggaccugggcgccauccucaacaaccugcugcccaacaugagcuacguccuccagaucguggccaucugcacgaacgggcuguacggcaaguacuccgaccagcugaucgucgacaugcccaccgacaacccggagcucgaccuguuccccgagcugaucgggaccgaggagaucaucaaggaggaggaggagggcaaggacaucgaggagggcgcgaucgugaaccccgggcgggacagcgccaccaaccagauccgcaagaaggagccccagaucuccacgaccacccacuacaaccggaucggcaccaaguacaacgaggccaagacgaaccgcagcccgacccggggguccgaguucagcggcaagggggacgugcccaacaccucccucaacagcaccucccagcccgucacgaagcuggccaccgagaaggacaucagccugaccucccagaccgugacggagcugcccccgcacaccguggagggcaccagcgccagccucaacgacggcuccaagaccguccugcgcagcccccacaugaaccucuccgggaccgcggagagccugaacacgguguccaucaccgaguacgaggaggagagccugcugaccuccuucaagcucgacaccggcgccgaggacagcuccgggagcucccccgccacgagcgccauccccuucaucuccgagaacaucagccagggcuacaucuucuccagcgagaacccggagaccaucaccuacgacgugcugauccccgaguccgcccggaacgcgagcgaggacagcaccuccagcggguccgaggagagccugaaggaccccuccauggagggcaacgucugguuccccagcuccacggacaucaccgcccagccggacgugggcagcgggcgcgaguccuuccuccagaccaacuacaccgagauccggguggacgagagcgagaagacgaccaaguccuucagcgccggccccgucaugucccaggggcccagcgugaccgaccuggagaugccgcacuacuccaccuucgccuacuuccccacggaggugacgccccacgccuucacccccagcucccgccagcaggaccuggucagcaccgugaacguggucuacucccagacgacccagccgguguacaacgaggcgagcaacagcucccacgagagccgcaucggccucgccgagggccuggaguccgagaagaaggccgugaucccccuggucaucgugagcgcccucaccuucaucugccuggugguccugguggggauccucaucuacuggcggaagugcuuccagaccgcgcacuucuaccuggaggacuccacgagcccccgcgugaucuccacgcccccgacccccaucuuccccaucagcgacgacgucggcgccauccccaucaagcacuucccgaagcacguggccgaccugcacgccuccagcggguucaccgaggaguucgaggaggugcaguccugcaccgucgaccucggcaucaccgccgacagcuccaaccaccccgacaacaagcacaagaaccgguacaucaacaucguggcguacgaccacagccgcgugaagcuggcccagcuggccgagaaggacgggaagcucaccgacuacaucaacgccaacuacgucgacggcuacaaccggcccaaggccuacaucgcggcccagggcccccugaaguccaccgccgaggacuucuggcgcaugaucugggagcacaacguggaggugaucgucaugaucacgaaccugguggagaaggggcggcgcaagugcgaccaguacuggccggccgacggcagcgaggaguacgggaacuuccucgugacccagaaguccguccaggugcuggccuacuacaccgugcggaacuucacccugcgcaacacgaagaucaagaagggcagccagaaggggcggcccuccggccgcgucgugacccaguaccacuacacccaguggcccgacaugggcgugcccgaguacagccucccgguccugaccuucgugcggaaggcggccuacgccaagcgccacgccguggggcccgucguggugcacugcagcgcgggcgucgggcggaccggcacguacaucgugcuggacuccaugcuccagcagauccagcacgaggggaccgucaacaucuucggcuuccugaagcacauccgcagccagcggaacuaccuggugcagaccgaggagcaguacguguucauccacgacacccucgucgaggccauccuguccaaggagacggaggugcuggacagccacauccacgccuacgugaacgcccuccugauccccggccccgccgggaagaccaagcuggagaagcaguuccagcuccugucccagagcaacauccagcaguccgacuacagcgcggcccugaagcagugcaaccgcgagaagaaccggaccuccagcaucaucccggucgagcgcucccgcgugggcaucagcucccucagcggggagggcaccgacuacaucaacgccuccuacaucaugggguacuaccagagcaacgaguucaucaucacgcagcacccccugcugcacaccaucaaggacuucuggcggaugaucugggaccacaacgcccagcucguggucaugauccccgacggccagaacauggccgaggacgaguucguguacuggccgaacaaggacgagcccaucaacugcgaguccuucaaggugacccugauggcggaggagcacaagugccugagcaacgaggagaagcucaucauccaggacuucauccuggaggccacccaggacgacuacguccuggaggugcgccacuuccagugccccaaguggcccaacccggacucccccaucagcaagacguucgagcucaucagcgugaucaaggaggaggccgccaaccgggacggccccaugaucguccacgacgagcacgggggcgugaccgccgggaccuucugcgcgcugaccacgcugaugcaccagcucgagaaggagaacuccguggacgucuaccagguggccaagaugaucaaccugaugcgccccggcguguucgccgacaucgagcaguaccaguuccuguacaaggucauccucagccugguguccacccggcaggaggagaacccgagcaccucccuggacagcaacggcgccgcgcuccccgacgggaacaucgccgagucccuggagagccugguguga

SEQ ID NO: 35294 - RNA, 1173 nt, Artificial Sequence
  derived and/or modified sequence opt1 from PTRF__Homo_sapiens__NP_036364
auggaggaccccacccuguacaucguggagcgcccgcuccccggcuaccccgacgccgaggcccccgagccgagcuccgcgggggcccaggccgccgaggagcccagcggcgccggguccgaggagcugaucaagagcgaccaggucaacggcgugcuggugcucucccugcuggacaagaucaucggggcggucgaccagauccagcucacccaggcccagcuggaggagcggcaggccgagauggagggcgccgugcagagcauccagggcgagcuguccaagcucgggaaggcgcacgccacgaccagcaacaccguguccaagcugcuggagaagguccgcaaggugagcgugaacgucaagaccgugcggggcucccucgagcgccaggccgggcagaucaagaagcuggaggugaacgaggccgagcugcuccggcgccggaacuucaaggucaugaucuaccaggacgaggugaagcugcccgccaagcugagcaucuccaagagccucaaggaguccgaggcgcugcccgagaaggagggcgaggagcugggggagggcgagcgcccggaggaggacgccgccgcccucgagcugagcuccgacgaggccguggaggucgaggaggugaucgaggagagccgggcggagcgcaucaagcgguccggccugcgccggguggacgacuucaagaaggccuucagcaaggagaagauggagaagacgaagguccgcacccgggagaaccucgagaagacccgccugaagaccaaggagaaccuggagaagacgcggcacacccucgagaagcgcaugaacaagcuggggacccggcuggugcccgccgagcgccgggagaagcucaagaccagccgcgacaagcugcgcaaguccuucacgcccgaccacguggucuacgcccggagcaagaccgccguguacaaggugcccccguucaccuuccacgucaagaagauccgcgagggccagguggagguccugaaggcgaccgagaugguggaggugggggccgacgacgacgagggcggcgccgagcgcggggaggccggcgaccuccggcggggguccagccccgacguccacgcccugcuggagaucacggaggaguccgacgcggugcucguggacaagagcgacuccgacuga

SEQ ID NO: 35295 - RNA, 645 nt, Artificial Sequence
  derived and/or modified sequence opt1 from PTRH1__Homo_sapiens__NP_001002913
augcgccccggcggguuccugggcgccgggcagcggcucagccgcgccaugucccggugcgugcuggagccgcgcccgcccggcaagcgguggauggucgcggggcugggcaaccccggccuccccgggacccgccacagcgugggcauggccgugcuggggcagcuggcccggcgccucggcgucgccgaguccuggacccgggaccgccacugcgccgcggaccuggcccuggcgccccucggggacgcccagcuggugcugcuccggccccgccggcugaugaacgccaacggccgcagcguggcccgggccgccgagcuguucggccucacggccgaggaggucuaccuggugcacgacgagcuggacaagccccucgggcgccuggcgcugaagcucggcggguccgcccggggccacaacggcgugcgcagcugcaucuccugccugaacagcaacgccaugccgcggcugcgcgucgggaucggccggcccgcccaccccgaggccgugcaggcgcacgugcucgggugcuucucccccgccgagcaggagcugcugccgcuccugcuggaccgcgccaccgaccucauccuggaccacauccgcgagcggagccagggccccucccuggggcccuga

SEQ ID NO: 35296 - RNA, 540 nt, Artificial Sequence
  derived and/or modified sequence opt1 from PTRH2__Homo_sapiens__NP_057161
augcccagcaagucccuggugauggaguaccucgcccacccgagcacccugggccuggccgucgggguggcgugcggcaugugccucggguggucccugcgcgugugcuucggcaugcugcccaagagcaagaccuccaagacgcacaccgacaccgagagcgaggccuccauccucggggacagcggcgaguacaagaugauccuggucgugcggaacgaccugaagaugggcaaggggaagguggccgcccagugcucccacgccgcggucagcgccuacaagcagauccagcgccggaaccccgagaugcucaagcagugggaguacugcggccagcccaaggugguggucaaggccccggacgaggagacccugaucgcccugcucgcgcacgccaagaugcuggggcugacggugucccucauccaggacgccggccgcacccagaucgcccccgggagccagaccgugcugggcaucggccccgggcccgccgaccugaucgacaaggucaccggccaccucaagcuguacuga

SEQ ID NO: 35297 - RNA, 423 nt, Artificial Sequence
  derived and/or modified sequence opt1 from PTRHD1__Homo_sapiens__NP_001013685
augcaccgcggcguggggcccgccuuccgggucgugcgcaagauggccgcgagcggcgccgagccccaggugcugguccaguaccucgugcugcggaaggaccugucccaggccccguucagcuggcccgccggggcccucguggcgcaggccugccacgccgccaccgcggcccugcacacccaccgcgaccacccccacacggccgccuaccugcaggagcucggccggaugcgcaaggucgugcuggaggccccggacgagaccacccugaaggagcucgcggagacccugcagcagaagaacaucgaccacaugcuguggcucgagcagcccgagaacaucgccacgugcaucgcccugcggcccuaccccaaggaggagguggggcaguaccugaagaaguuccgccucuucaaguga

SEQ ID NO: 35298 - RNA, 438 nt, Artificial Sequence
  derived and/or modified sequence opt1 from PTS__Homo_sapiens__NP_000308
augagcaccgagggcgggggccgccggugccaggcccaggugucccgccggaucagcuucuccgccagccaccgccuguacuccaaguuccucagcgacgaggagaaccugaagcuguucgggaagugcaacaaccccaacggccacgggcacaacuacaaggucguggugaccguccacggcgagaucgacccggcgacgggcauggugaugaaccucgccgaccugaagaaguacauggaggaggccaucaugcagccccuggaccacaagaaccucgacauggacgugcccuacuucgccgacgucguguccaccaccgagaacguggccgucuacaucugggacaaccugcagaaggugcugcccguggggguccucuacaaggugaagguguacgagaccgacaacaacaucgucguguacaagggcgaguga

SEQ ID NO: 35299 - RNA, 609 nt, Artificial Sequence
  derived and/or modified sequence opt1 from PTTG1__Homo_sapiens__NP_001269312
auggccacccugaucuacguggacaaggagaacggcgagcccgggacccgcgucguggccaaggacggccucaagcuggggagcggccccuccaucaaggcgcuggacgggcggagccagguguccacgccccgcuucggcaagaccuucgacgccccgcccgcccuccccaaggccacccggaaggcccugggcaccgucaaccgcgcgacggagaaguccgugaagaccaaggggccccugaagcagaagcagcccagcuucagcgccaagaagaugaccgagaagaccgugaaggccaaguccagcguccccgccuccgacgacgcguacccggagaucgagaaguucuuccccuucaacccccucgacuucgagagcuucgaccugcccgaggagcaccagaucgcccaccucccgcuguccggcgugccccugaugauccuggacgaggagcgggagcucgagaagcuguuccagcuggggccgcccagccccgugaagaugcccuccccgcccugggagagcaaccuccugcagucccccagcuccauccugagcacgcucgacgucgagcugccgcccgugugcugcgacaucgacaucuga

SEQ ID NO: 35300 - RNA, 429 nt, Artificial Sequence
  derived and/or modified sequence opt1 from PTTG1IP__Homo_sapiens__NP_001273751
auggcccccggcguggcccgcgggccgacccccuacuggcggcugcgccucggcggggcggcccugcugcuccugcugauccccgucgccgccgcccaggagcccccgggcgcggccugcucccagaacaccaacaagacgugcgaggagugccucaagaacguguccgccugccugaagaagaagacccggaugcuggaccucaagaccaccaaggcccugcagcacaucagccccgacgcguccugcgaggugcacgcgccccagcccagcccggccgggcgcccccggggccacugcggccugcucacgcuggccuccgagcccgccagccugcccgggcaggccgccggcgagcucccgcugaaggacagcccccugguccuccagaccggggaccugcuguuccccgugcaccucugcuucuga

SEQ ID NO: 35301 - RNA, 576 nt, Artificial Sequence
  derived and/or modified sequence opt1 from PTTG2__Homo_sapiens__NP_006598
auggccacccugaucuacguggacaaggagaucggcgagcccgggacccgcgucgccgcgaaggacgugcucaagcuggagagccggccguccaucaaggcccuggacggcaucagccaggugcucacgcgccgguucgggaagaccuacgacgcccccuccgcccugcccaaggccacccgcaaggcgcugggcaccgucaaccgggccacggagaaguccgugaagaccaacgggccccgcaagcagaagcagccguccuucagcgccaagaagaugaccgagaagaccgugaagacgaaguccagcguccccgccuccgacgacgcguaccccgagaucgagaaguucuuccccuucaaccuccuggacuucgagagcuucgaccugccggaggagcggcagaucgcccaccucccccuguccggcgugccccugaugauccucgacgaggagggcgagcuggagaagcuguuccagcucgggcccccgagccccgugaagaugcccagcccgcccugggagugcaaccuguucgccgucagcuucaagcacuccguggaccccggcugcuga

SEQ ID NO: 35302 - RNA, 1146 nt, Artificial Sequence
  derived and/or modified sequence opt1 from PTX3__Homo_sapiens__NP_002843
augcaccuccuggccauccuguucugcgcccuguggagcgcggugcucgccgagaacuccgacgacuacgaccugauguacgucaaccuggacaacgagaucgacaacggccuccaccccaccgaggacccgacccccugcgccugcgggcaggagcacagcgagugggacaagcuguucaucaugcuggagaacucccagaugcgcgagcggaugcuccugcaggccacggacgacgugcugcgcggcgagcuccagcggcugcgcgaggagcuggggcggcucgccgagagccuggcgcgccccugcgcccccggcgccccggccgaggcgcggcugaccuccgcccucgacgagcugcugcaggccacccgcgacgccgggcggcgccucgcccggauggagggcgcggaggcccagcgccccgaggaggccggccgggcccuggccgcggugcuggaggagcuccgccagacccgggccgaccugcacgccguccaggggugggccgcccgcagcuggcugcccgcgggcugcgagacggccauccucuuccccaugcgguccaagaagaucuucgggagcgugcacccggugcgccccaugcggcuggaguccuucagcgccugcaucugggucaaggccaccgacgugcugaacaagaccauccucuucuccuacggcaccaagcgcaaccccuacgagauccagcuguaccugagcuaccaguccaucguguucgucgucgggggcgaggagaacaagcucguggccgaggcgauggugagccugggccgguggacgcaccugugcgggaccuggaacuccgaggagggccucaccagccugugggugaacggggagcuggccgccaccacgguggagauggccaccggccacaucguccccgagggcgggauccuccagaucggccaggagaagaacgggugcugcgugggcgggggcuucgacgagacccuggcguucuccggccgccugaccggguucaacaucugggacagcgugcucuccaacgaggagauccgcgagacgggcggggccgagagcugccacauccggggcaacaucgucggguggggcgugaccgagauccagccgcacggcggggcccaguacgugagcuga

SEQ ID NO: 35303 - RNA, 1551 nt, Artificial Sequence
  derived and/or modified sequence opt1 from PUF60__Homo_sapiens__NP_001129505
auggagaacggccagagcaccgccgccaagcuggggcugcccccgcucacccccgagcagcaggaggcgcugcagaaggccaagaaguacgccauggagcaguccaucaagagcgugcucgucaagcagacgaucgcccaccagcagcagcagcugaccaaccugcagauggccgcggugaccaugggcuucggggacccccucagcccccugcaguccauggccgcccagcgccagcgggcccuggcgaucaugugccgcguguacgucggcuccaucuacuacgagcucggggaggacaccauccggcaggccuucgccccguucggccccaucaagagcaucgacauguccugggacagcgugacgaugaagcacaagggcuucgccuucguggaguacgagguccccgaggccgcgcagcuggcccuggagcagaugaacuccgugaugcucgggggccgcaacaucaagguggggcggcccagcaacaucggccaggcccagccgaucaucgaccagcuggccgaggaggcccgcgcguucaaccggaucuacgucgccuccgugcaccaggaccugagcgacgacgacaucaaguccguguucgaggccuucgggaagaucaagagcugcacccucgcccgcgaccccaccaccggcaagcacaagggcuacggguucaucgaguacgagaaggcccaguccagccaggacgcggucuccagcaugaaccuguucgaccugggcgggcaguaccuccgggugggcaaggccgugacgccgcccaugccccugcugacccccgccacccccggcgggcugcccccggccgccgcggucgccgccgccgcggccaccgccaagaucacggcccaggaggccguggcgggcgccgccgugcucgggacccugggcacccccgggcucgucucccccgcccugacccuggcccagccccucggcacgcugccgcaggcggugauggccgcccaggcccccggcgugaucaccggggucacccccgcccggcccccgauccccgugaccauccccagcgugggcgucgugaaccccauccuggcgagcccgcccacgcucgggcugcuggagcccaagaaggagaaggaggaggaggagcuguucccggaguccgagcgccccgagaugcucagcgagcaggagcacauguccaucagcggcuccagcgcccgccacauggucaugcagaagcugcuccggaagcaggaguccaccgugauggugcugcgcaacauggucgaccccaaggacaucgacgacgaccuggagggggaggugaccgaggagugcggcaaguucggcgccgugaaccgggucaucaucuaccaggagaagcagggggaggaggaggacgccgagaucaucgugaagaucuucguggaguucagcaucgcguccgagacccacaaggccauccaggcccucaacggccgcugguucgccgggcggaaggucguggccgagguguacgaccaggagcgcuucgacaacagcgaccuguccgcguga

SEQ ID NO: 35304 - RNA, 3027 nt, Artificial Sequence
  derived and/or modified sequence opt1 from PUM2__Homo_sapiens__NP_001269681
augagccagcccaucauggugcagcgccgguccggccagggguuccacggcaacagcgaggucaacgccauccuguccccgcgcagcgaguccgggggccucggggugagcaugguggaguacguccuguccagcucccccgccgacaagcuggacagccgguuccgcaagggcaacuucggcacccgggacgcggagaccgacgggcccgagaagggcgaccagaaggggaaggccucccccuucgaggaggaccagaaccgcgaccucaagcagggcgacgacgacgacagcaagaucaacgggcggggccugccgaacggcauggacgccgacugcaaggacuucaaccgcacgcccgggucccggcaggccagccccaccgaggugguggagcgccugggccccaacaccaacccguccgaggggcucggcccccugcccaaccccaccgccaacaagccgcuggucgaggaguucagcaaccccgagacgcagaaccucgacgcgauggagcaggucggccuggagucccugcaguucgacuaccccgggaaccaggugcccauggacagcuccggcgccaccgugggccucuucgacuacaacagccagcagcagcuguuccagcggaccaacgcccugaccgugcagcagcucacggccgcgcagcagcagcaguacgcccuggccgccgcccagcagccgcacaucgcggggguguucagcgccgggcuggcccccgccgccuucguccccaaccccuacaucaucuccgcggccccgcccggcaccgaccccuacaccgccgccggccucgccgcggccgccacccuggccgggcccgccguggugccgccccaguacuacggcguccccuggggcguguaccccgcgaaccuguuccagcagcaggccgccgccgcggccaacaacacggccagccagcaggccgccucccaggcgcagccggggcagcagcagguccuccgcgccggggccggccagcggccccugacccccaaccagggccagcaggggcagcaggccgagagccuggccgcggccgccgccgccaacccgacccucgcguucggccaggggcuggccaccggcaugcccggguaccaggugcuggcccccacggccuacuacgaccagaccggcgcgcucguggugggccccggggcccgcaccggccugggggccccgguccggcugauggcccccacccccgugcucaucuccagcgccgcggcccaggccgccgccgcggccgccgccggcggcacggccuccagccugaccggguccaccaacggccuguuccgccccaucgggacccagccgccccagcagcagcagcagcagcccagcacgaaccuccaguccaacagcuucuacggcuccagcucccugaccaacagcucccagagcuccagccuguucagccacgggcccggccagccgggcuccaccagccucggguucggcuccgggaacagccugggcgcggccaucggguccgcccugagcggcuucggcuccagcgugggguccagcgccuccagcuccgcgacccggcgcgagagccucuccacgagcuccgaccuguacaagcggagcagcuccagccuggcccccaucggccagcccuucuacaacucccucggguucagcuccagccccuccccgaucggcaugccccugcccagccagacccccgggcacucccugaccccgccgcccagccucuccagccacggcuccagcuccagccugcaccugggcgggcucaccaacggcuccgggcgcuacaucagcgccgcccccggcgccgaggcgaaguaccgguccgccagcagcacguccagccuguucuccagcuccagccagcuguucccgcccucccgccugcgcuacaaccggagcgacaucaugcccuccgggcgcagccggcuccuggaggacuuccgcaacaaccgguuccccaaccugcagcuccgcgaccugaucggccacaucgucgaguucucccaggaccagcacggcagccgguucauccagcagaagcuggagcgcgccacccccgccgagcggcagaugguguucaacgagauccuccaggccgcguaccagcugaugaccgacgucuucgggaacuacgugauccagaaguucuucgaguucggcucccuggaccagaagcucgcccuggccacccgcauccgggggcacgugcugccccucgcccugcagauguacggcugccgcgucauccagaaggcccuggagagcaucuccagcgaccagcaguccgagauggugaaggagcucgacggccacgugcugaagugcgucaaggaccagaacgggaaccacguggugcagaagugcaucgagugcguccagccccagagccugcaguucaucaucgacgcguucaagggccagguguucgugcucuccacgcacccguacgggugccgggucauccagcgcauccuggagcacugcaccgccgagcagacccugcccauccucgaggagcugcaccagcacaccgagcagcuggugcaggaccaguacggcaacuacgugauccagcacguccucgagcacgggcggcccgaggacaagagcaagaucgugagcgagauccgcggcaaggugcuggcccugucccagcacaaguucgccagcaacgucguggagaagugcgugacccacgccucccgggcggagcgcgcccuccugaucgacgaggucugcugccagaacgacggcccccacagcgcccuguacacgaugaugaaggaccaguacgccaacuacguggugcagaagaugaucgacauggcggagccggcccagcggaagaucaucaugcacaagauccgcccccacaucaccacccuccgcaaguacaccuacgggaagcacauccuggccaagcuggagaaguacuaccucaagaacucccccgaccugggccccaucgggggcccgcccaacgggaugcuguga

SEQ ID NO: 35305 - RNA, 969 nt, Artificial Sequence
  derived and/or modified sequence opt1 from PURA__Homo_sapiens__NP_005850
auggccgaccgcgacagcggcuccgagcagggcggggccgcgcuggggagcggcgggucccucggccaccccggcagcggguccggcagcgggggcgggggcggcgggggcgggggcggcgggggcuccgggggcgggggcggcggggccccgggcgggcugcagcacgagacccaggagcuggccagcaagcggguggacauccagaacaagcgcuucuaccucgacgucaagcagaacgccaagggccgguuccugaagaucgccgaggugggggcgggcggcaacaagucccgccugacccucagcauguccguggccgucgaguuccgggacuaccugggggacuucaucgagcacuacgcccagcugggccccagccagccgcccgaccucgcccaggcgcaggacgagccccgccgggcccugaaguccgaguuccuggugcgcgagaaccggaaguacuacauggaccucaaggagaaccagcgcgggcgguuccugcgcauccggcagacggugaaccgcggccccgggcugggcagcacccagggccagaccaucgcccuccccgcccaggggcugaucgaguuccgggacgcccuggcgaagcucaucgacgacuacggcgucgaggaggagcccgccgagcugccggaggggaccucccugacgguggacaacaagcgcuucuucuucgacgugggcagcaacaaguacggcgucuucaugcggguguccgaggugaagcccaccuaccgcaacagcaucaccguccccuacaaggugugggccaaguucgggcacaccuucugcaaguacuccgaggagaugaagaagauccaggagaagcagcgggagaagcgcgccgccugcgagcagcuccaccagcagcagcagcagcagcaggaggagacggcggccgccacccugcugcuccagggcgaggaggagggggaggaggacuga

SEQ ID NO: 35306 - RNA, 939 nt, Artificial Sequence
  derived and/or modified sequence opt1 from PURB__Homo_sapiens__NP_150093
auggccgacggcgacagcggguccgagcgcggcgggggcgggggccccugcggcuuccagccggccagccgcgggggcggggagcaggagacccaggagcuggcguccaagcggcucgacauccagaacaagcgguucuaccuggacgugaagcagaacgccaagggccgcuuccugaagaucgccgaggucggggccggcggcagcaagucccggcucacccugagcauggccguggcggccgaguuccgcgacucccugggggacuucaucgagcacuacgcccagcucggccccagcucccccgagcagcuggccgcgggggccgaggagggcggcgggccccggcgcgcccucaagagcgaguuccuggugcgggagaaccgcaaguacuaccuggaccugaaggagaaccagcggggccgcuuccuccggauccgccagacggucaaccgcgggggcgggggcuucggcgccgggccgggccccgggggccugcaguccgggcagaccaucgcccugcccgcgcagggccucaucgaguuccgggacgcccuggccaagcugaucgacgacuacggcggggaggacgacgagcucgccggcgggcccggcgggggcgccggcgggccgggcgggggccuguacggcgagcugcccgaggggaccagcaucaccguggacuccaagcgguucuucuucgacgugggcugcaacaaguacggggucuuccuccgcgugagcgaggugaagcccuccuaccggaacgcgaucacgguccccuucaaggccuggggcaaguucgggggcgccuucugccgcuacgccgacgagaugaaggagauccaggagcggcagcgcgacaagcuguacgagcgccggggcgggggcagcgggggcggggaggaguccgagggcgaggagguggacgaggacuga

SEQ ID NO: 35307 - RNA, 1590 nt, Artificial Sequence
  derived and/or modified sequence opt1 from PUS10__Homo_sapiens__XP_011530879
auguucccccugaccgaggagaacaagcacguggcccagcuccugcugaacaccggcacgugcccgcgcugcaucuuccgguucugcggggucgacuuccacgcccccuacaagcuccccuacaaggagcugcugaacgagcuccagaaguuccuggagaccgagaaggacgagcugauccucgaggugaugaacccgccgcccaagaagauccgccugcaggagcuggaggacagcaucgacaaccucucccagaacggcgaggggcggaucagcgugucccacgucggcagcaccgcguccaagaacagcaaccugaacgugugcaacgugugccuggggauccuccaggaguucugcgagaaggacuucaucaagaaggucugccagaagguggaggccuccggcuucgaguucaccagccugguguucuccgucagcuucccgccccagcuguccgugcgcgagcacgccgccuggcuccuggugaagcaggagaugggcaagcagagccugucccucgggcgggacgacaucguccagcugaaggaggccuacaaguggaucacgcacccccuguucagcgaggagcucggcgugcccaucgacgggaagucccuguucgaggugagcgucguguucgcgcaccccgagaccguggaggacugccacuuccuggccgccaucugccccgacugcuucaagcccgccaagaacaagcaguccgucuucacccgcauggcggugaugaaggcccucaacaagaucaaggaggaggacuuccugaagcaguuccccugcccgcccaacagccccaaggccgugugcgccguccuggagaucgagugcgcccacggcgcgguguucguggccgggcgguacaacaaguacucccgcaaccucccccagacccccuggaucaucgacggcgagcggaagcuggagagcagcgucgaggagcugaucuccgaccaccuccuggccguguucaaggccgagagcuucaacuucuccagcuccggccgcgaggacgucgacgugcggacgcuggggaacggccgccccuucgccaucgagcucgugaacccgcaccggguccacuucaccagccaggagaucaaggagcugcagcagaagaucaacaacuccagcaacaagauccaggugcgcgaccugcagcucgugacccgggaggcgaucgggcacaugaaggagggcgaggaggagaagaccaagacguacuccgcccugaucuggaccaacaaggccauccagaagaaggacaucgaguuccugaacgacaucaaggaccucaagaucgaccagaagacgccccugcgcguccugcaccggcgcccccucgccgugcgggcccgcgugauccacuucauggagacccaguacgucgacgagcaccacuuccggcugcaccugaagacccaggcgggcaccuacaucaaggaguucgugcacggggacuucggccgcaccaagcccaacaucgggagccucaugaacgugaccgccgacauccuggagcuggacgucgaguccguggacguggacuggccgcccgcccuggacgacuga

SEQ ID NO: 35308 - RNA, 1200 nt, Artificial Sequence
  derived and/or modified sequence opt1 from PUS1__Homo_sapiens__NP_001002019
auggccggcaacgccgagcccccgcccgcgggggccgccugcccccaggaccgccggagcugcuccggccgcgccgggggcgaccgggugugggaggacggggagcaccccgccaagaagcucaagagcggcggcgacgaggagcgccgggagaagccgcccaagcgcaagaucguccugcugauggcguacuccgggaagggcuaccacgggaugcagcggaacgugggcagcucccaguucaagaccaucgaggacgaccuggugagcgcccucguccgcuccgggugcauccccgagaaccacggcgaggacaugcggaagaugagcuuccagcgcugcgcccggaccgacaagggcguguccgccgcgggccagguggucagccugaagguguggcugaucgacgacauccucgagaagaucaacucccaccuccccagccacauccgcauccuggggcugaagcgggugaccgggggcuucaacuccaagaaccgcugcgacgcccggacguacugcuaccugcugccgaccuucgccuucgcccacaaggaccgcgacguccaggacgagaccuaccggcucagcgccgagacgcugcagcaggucaaccgccugcucgcgugcuacaagggcacccacaacuuccacaacuucaccucccagaaggggccccaggaccccagcgccugccgguacauccuggagauguacugcgaggagcccuucgugcgcgagggccuggaguucgccgugauccgggugaaggggcaguccuucaugaugcaccagauccgcaagauggugggccucgucguggccaucgugaagggguacgccccggagagcguccuggagcgcuccuggggcaccgagaagguggacgugcccaaggcgcccggccuggggcucguccuggagcgggugcacuucgagaaguacaaccagcgcuucggcaacgacgggcugcacgagccccucgacugggcccaggaggagggcaagguggccgccuucaaggaggagcacaucuacccgacgaucaucgggaccgagcgggacgagcgcagcauggcccaguggcugagcacccugcccauccacaacuucuccgcgaccgcccucacggccggcggcaccggggccaagguccccagcccccuggagggcuccgagggggacggcgacaccgacuga

SEQ ID NO: 35309 - RNA, 324 nt, Artificial Sequence
  derived and/or modified sequence opt1 from PVALB__Homo_sapiens__XP_011545203
augagcaugaccgaccugcucaacgccgaggacaucaagaaggccgugggcgcguucuccgccaccgacagcuucgaccacaagaaguucuuccagauggucgggcugaagaagaaguccgccgacgacgugaagaagguguuccacaugcuggacaaggacaagagcggcuucaucgaggaggacgagcucggguucauccugaagggcuucucccccgacgcccgcgaccugagcgccaaggagacgaagaugcucauggcggccggggacaaggacggcgacggcaagaucggggucgacgacccggccgacguggacuga

SEQ ID NO: 35310 - RNA, 1119 nt, Artificial Sequence
  derived and/or modified sequence opt1 from PVR__Homo_sapiens__NP_001129240
auggcccgcgccauggcggccgccuggccccugcuccugguggcccugcucguccugagcuggccgccgcccggcaccggggacguggugguccaggcccccacccaggugcccggcuuccugggggacuccgugacgcuccccugcuaccugcagguccccaacauggaggugacccacgugagccagcugaccugggcgcggcacggcgaguccgggagcauggccgucuuccaccagacccagggccccuccuacagcgaguccaagcgccucgaguucguggccgcccggcugggcgcggagcugcgcaacgccagccuccggauguucgggcugcgcguggaggacgagggcaacuacacgugccuguucgucaccuucccgcaggggucccggagcguggacaucuggcuccgcgugcuggccaagccccagaacaccgccgagguccagaaggugcagcugaccggcgagcccgugcccauggcccggugcgucuccacgggcggccgcccgcccgcgcagaucaccuggcacagcgaccucggcgggaugcccaacaccucccaggugcccggcuuccugagcgggaccgugacggucaccucccuguggauccucgugccgagcucccagguggacggcaagaacgugaccugcaaggucgagcacgagagcuucgagaagccccagcugcugaccgucaaccucacgguguacuacccgcccgagguguccaucagcggcuacgacaacaacugguaccuggggcagaacgaggccacccugaccugcgacgcccggagcaaccccgagcccaccggcuacaacugguccacgaccauggggccccugcccccguucgccgucgcccagggcgcgcagcuccugauccgccccguggacaagcccaucaacaccacccucaucugcaacgugacgaacgcccugggggcccggcaggccgagcugaccguccaggugaaggaggggcccccgagcgagcacuccggcaccgagcacgccagcgcguccgccaacgggcacgugagcuacuccgccgucagccgcgagaacuccagcucccaggacccccagaccgagggcacgcgguga

SEQ ID NO: 35311 - RNA, 1554 nt, Artificial Sequence
  derived and/or modified sequence opt1 from PVRL1__Homo_sapiens__NP_002846
auggcccgcaugggccuggccggggcggccggccgguggugggggcucgcccugggccugaccgccuucuuccuccccggggugcacagccaggucguccaggugaacgacuccauguacggcuucaucggcaccgacguggugcugcacugcagcuucgccaacccgcugcccuccgugaagaucacgcaggucaccuggcagaaguccaccaacgggagcaagcagaacguggcgaucuacaaccccagcaugggcguguccguccucgcccccuaccgcgagcggguggaguuccugcgcccgagcuucaccgacgggacgauccggcugucccgccucgagcuggaggacgagggcguguacaucugcgaguucgccaccuuccccaccgggaaccgggagagccagcugaaccucaccgucauggccaagcccacgaacuggaucgagggcacccaggcggugcugcgcgccaagaagggccaggacgacaaggugcuggucgcgaccugcaccuccgccaacgggaagcccccgagcgugguguccugggagacgcggcucaagggcgaggccgaguaccaggagauccgcaaccccaacgggaccgucaccgugaucagccgguaccgccuggugcccucccgggaggcccaccagcagagccuggccugcaucgucaacuaccacauggaccgcuucaaggagucccucacccugaacgugcaguacgagcccgaggugacgaucgagggcuucgacggcaacugguaccugcagcggauggacgucaagcugaccugcaaggccgacgccaacccgcccgccaccgaguaccacuggaccacgcugaacgggagccugcccaagggcguggaggcgcagaaccgcacccucuucuucaaggggcccaucaacuacucccuggccggcaccuacaucugcgaggccaccaacccgaucgggacgcggagcggccaggucgaggugaacaucaccgaguuccccuacacccccagcccgcccgagcacggccgccgggccgggcccgugcccaccgccaucaucggcggggucgcgggcuccauccugcucgugcugaucguggucgggggcaucgugguggcccugcgccggcgccgccacacguucaagggcgacuacagcaccaagaagcacgucuacgggaacggcuacuccaaggccgggaucccccagcaccacccgcccauggcccagaaccuccaguaccccgacgacagcgacgacgagaagaaggccggcccccucgggggcuccagcuacgaggaggaggaggaggaggaggagggcgggggcgggggcgagcggaaggugggcgggccgcaccccaaguacgacgaggacgcgaagcgccccuacuucaccguggacgaggccgaggcccggcaggacggcuacggggaccgcacccugggcuaccaguacgacccggagcagcucgaccuggccgagaacauggucucccagaacgacgggagcuucaucuccaagaaggagugguacguguga

SEQ ID NO: 35312 - RNA, 1617 nt, Artificial Sequence
  derived and/or modified sequence opt1 from PVRL2__Homo_sapiens__NP_001036189
auggcccgcgccgcggcccugcuccccagccgguccccgcccacgccccugcuguggccccuccugcugcuccugcugcucgagaccggcgcccaggacgugcgcguccaggugcugcccgaggugcgggggcagcugggcgggacggucgagcuccccugccaccuccugccgcccgugcccggccuguacaucagccuggugaccuggcagcgccccgacgcccccgccaaccaccagaacgucgcggccuuccaccccaagauggggccguccuuccccagccccaagcccggcuccgagcggcugagcuucguguccgccaagcagagcaccggccaggacaccgaggccgagcuccaggacgcgacgcuggcccugcacgggcucaccguggaggacgagggcaacuacacgugcgaguucgccaccuucccgaagggguccguccgcggcaugaccuggcugcgggugaucgccaagcccaagaaccaggccgaggcgcagaaggugaccuucagccaggaccccaccaccgucgcccugugcaucuccaaggaggggcggcccccggcccgcaucagcuggcucuccagccuggacugggaggccaaggagacccagguguccggcacccuggccggcaccgugaccgucacgagccgcuucacccucgugcccuccgggcgggcggacggcgugaccgugaccugcaagguggagcacgagagcuucgaggagcccgcccugauccccgugacgcuguccguccgcuacccgcccgaggugagcaucagcggguacgacgacaacugguaccucggccggaccgacgccacccuguccugcgacgugcgcagcaaccccgagcccaccggcuacgacugguccacgaccagcgggaccuucccgaccuccgccgucgcccagggcagccagcuggugauccacgcggucgacucccucuucaacacgaccuucgugugcaccgugaccaacgccgucgggaugggccgggccgagcaggucaucuucgugcgcgagacgcccaacaccgccggggccggcgcgaccggcgggaucaucggcgggaucaucgccgccaucaucgccaccgcggucgccgccacgggcauccugaucugccggcagcagcgcaaggagcagacccugcagggggccgaggaggacgaggaccucgaggggcccccgagcuacaagccgcccacccccaaggccaagcuggaggcgcaggagaugcccucccagcuguucacccucggcgccagcgagcacagcccccugaagacccccuacuucgacgccggcgccuccugcacggagcaggagaugccccgguaccacgagcugccgacccucgaggagcgcuccggcccccugcaccccggggccaccagccugggcucccccaucccggugccgcccgggccgcccgcgguggaggacgucagccucgaccuggaggacgaggagggcgaggaggaggaggaguaccuggacaagaucaaccccaucuacgacgcccucuccuacagcucccccagcgacagcuaccagggcaagggguucgugaugucccgggccauguacguguga

SEQ ID NO: 35313 - RNA, 1101 nt, Artificial Sequence
  derived and/or modified sequence opt1 from PVRL3__Homo_sapiens__NP_001230215
auggcccgcacccugcggcccagcccccucugccccggcgggggcaaggcccagcuguccagcgcgucccugcucggggccggccugcugcuccagccgcccacgcccccgccccugcugcuccugcuguucccccuccugcuguucagccgccucugcggggcccuggccggccccaucaucguggagccccacgucaccgccguguggggcaagaacgugucccugaagugccucaucgaggucaacgagaccaucacccagaucagcugggagaagauccacgggaaguccagccagaccguggcggugcaccacccccaguacggcuucuccguccagggggaguaccagggccgggugcuguucaagaacuacagccugaacgacgccacgaucacccuccacaacaucggguucuccgacagcggcaaguacaucugcaaggccgugaccuucccccugggcaacgcccaguccagcaccacggucaccgugcugguggagccgaccgucucccucaucaaggggcccgacagccugaucgacggcgggaacgagaccguggcggccaucugcaucgccgccacgggcaagcccguggcccacaucgacugggagggcgaccugggggagauggaguccaccaccaccagcuuccccaacgagacggcgaccaucaucucccaguacaagcuguucccgacccgcuucgcccggggccgccggaucacgugcgucgugaagcaccccgcccucgagaaggacauccgcuacagcuucauccuggacauccaguacgcccccgaggugagcgucaccggguacgacggcaacugguucguggggcggaagggcgugaaccucaagugcaacgccgacgcgaacccgccgcccuucaaguccgucuggagccgccuggacggccaguggcccgacgggcugcucgccuccgacaacacccugcacuucgugcacccccugaccuucaacuacagcggcguguacaucugcaaggucaccaacucccucgggcagcggagcgaccagaaggugaucuacaucuccgccuacaacagcgucgccucccugaacugcuga

SEQ ID NO: 35314 - RNA, 1533 nt, Artificial Sequence
  derived and/or modified sequence opt1 from PVRL4__Homo_sapiens__NP_112178
augccccugagccucggcgccgagaugugggggccggaggccuggcugcugcuccugcugcuccuggcguccuucaccggccgcugccccgccggggagcuggagaccagcgacguggucacgguggugcucggccaggacgccaagcugcccugcuucuaccgcggggacuccggcgagcaggucggccagguggccugggcccggguggacgcgggggagggcgcccaggagcuggcccuccugcacagcaaguacgggcugcacgucucccccgccuacgagggccggguggagcagccgcccccgccccgcaacccccucgacgggagcgugcugcugcggaacgcgguccaggccgacgagggcgaguacgagugccgcguguccaccuuccccgccggcagcuuccaggcccggcuccgccugcgggugcuggucccgccccuccccucccugaaccccgggcccgcccuggaggagggccaggggcucacccuggcggccagcugcaccgccgagggcucccccgccccgagcgugacgugggacaccgaggugaagggcaccaccuccagccgcuccuucaagcacagccgguccgccgcggucacgagcgaguuccaccuggugcccucccgcagcaugaacgggcagccccugaccugcguggucagccaccccggccuccugcaggaccagcggaucacccacauccuccacguguccuuccuggccgaggccagcgugcgcgggcuggaggaccagaaccucuggcacaucggccgggagggggccaugcugaagugccuguccgagggccagccgccgcccagcuacaacuggacccgccucgacggcccccugcccuccgggguccggguggacggcgacacgcugggguucccgccccucaccaccgagcacagcggcaucuacgugugccacgucuccaacgaguucagcucccgcgacagccaggugaccgucgacgugcuggacccccaggaggacuccgggaagcaggucgaccuggugagcgccuccgugguggucgugggcgugaucgcggcccuccuguucugccugcucgucgugguggucgugcugaugagccgguaccaccgccggaaggcccagcagaugacgcagaaguacgaggaggagcugacccucacccgcgagaacuccauccgccggcugcacagccaccacaccgacccccgcucccagcccgaggagagcgugggccugcgggccgaggggcaccccgacucccugaaggacaacagcagcugcuccgucaugagcgaggagccggagggccgcuccuacagcacgcucaccaccgugcgggagaucgagacccagacggagcugcugucccccgggagcggccgcgccgaggaggaggaggaccaggacgaggggaucaagcaggcgaugaaccacuucgugcaggagaacggcacccuccgggccaagcccaccggcaacgggaucuacaucaacggccgcgggcaccuggucuga

SEQ ID NO: 35315 - RNA, 2760 nt, Artificial Sequence
  derived and/or modified sequence opt1 from PWP2__Homo_sapiens__NP_005040
augaaguucgccuaccgcuucagcaaccugcugggcaccguguaccggcgcgggaaccugaacuucacgugcgacggcaacuccgucaucagccccguggggaaccgggugaccgucuucgaccugaagaacaacaaguccgacacccucccgcuggccacccgcuacaacgugaagugcgugggccugagccccgacgggcggcucgcgaucaucgucgacgagggcggcgacgcccugcuggugucccucgugugccgcagcguccugcaccacuuccacuucaagggguccgugcacagcguguccuucagccccgacggccggaaguucgucgugaccaaggggaacaucgcccagauguaccacgcccccggcaagaagcgcgaguucaacgccuucgugcuggacaagacguacuucgggccguacgacgagacgaccugcaucgacuggaccgacgacucccggugcuucgucgugggcagcaaggacauguccaccuggguguucggcgcggagcgcugggacaaccucaucuacuacgcccucgggggccacaaggacgccaucgucgccugcuucuucgagagcaacucccuggaccuguacagccugucccaggacggggugcugugcauguggcagugcgacaccccgcccgagggccuccggcugaagccgcccgcgggcuggaaggccgaccugcuccagcgcgaggaggaggaggaggaggaggaggaccaggagggggaccgggagaccaccauccgcggcaaggccacgcccgccgaggaggagaagaccgggaaggugaaguacagccggcuggccaaguacuucuucaacaaggagggcgacuucaacaaccugaccgcggccgccuuccacaagaagucccaccuccuggucaccggguucgccagcggcaucuuccaccuccacgagcugcccgaguucaaccugauccacagccuguccaucagcgaccaguccaucgccagcguggcgaucaacuccagcggcgacuggaucgccuucgggugcuccggccucgggcagcugcuggugugggaguggcagagcgaguccuacguccucaagcagcagggccacuucaacagcaugguggcccuggccuacucccccgacgggcaguacaucgucacgggcggcgacgacgggaaggugaagguguggaacacccugagcggcuucugcuucgucaccuucaccgagcacuccagcggggugacgggcgugaccuucaccgccaccggguacgucguggugacguccagcauggacggcaccguccgcgcguucgaccuccaccgguaccgcaacuuccggaccuucaccagcccccgccccacgcaguucuccugcguggccguggacgccuccggcgagaucgucagcgccggggcccaggacagcuucgagaucuucgugugguccaugcagaccggccggcugcuggacgugcucagcgggcacgagggccccaucuccggccugugcuucaaccccaugaaguccguccuggcgagcgccagcugggacaagaccgugcgccucugggacauguucgacuccuggcgcaccaaggagacgcuggcccugaccagcgacgcccucgcggugaccuuccggccggacggggccgagcuggccgucgccacccugaacucccagaucacguucugggaccccgagaacgccgugcagaccggcagcaucgaggggcgccacgaccucaagaccggccggaaggagcuggacaagaucaccgcgaagcacgccgccaaggggaaggccuucaccgcccugugcuacuccgcggacggccacagcauccuggccggcgggauguccaaguucgugugcaucuaccacguccgcgagcagauccucaugaagcgguucgagaucagcugcaaccugucccuggacgccauggaggaguuccucaaccgccggaagaugacggaguucggcaaccuggcccugaucgaccaggacgccgggcaggaggacggcguggcgaucccccuccccggggugcgcaagggcgacaugagcucccggcacuucaagccggagauccgcgucaccagccugcgguucagccccaccggccgcugcugggccgccaccacgaccgaggggcugcucaucuacucccuggacacccgggugcuguucgaccccuucgagcucgacaccagcgugacgcccggccgcguccgggaggcccugcgccagcaggacuucacccgggcgauccugauggcccuccgccugaacgaguccaagcuggugcaggaggcccucgaggccgugccgcgcggggagaucgaggucgugaccagcucccugcccgagcuguacguggagaagguccucgaguuccuggccagcuccuucgaggugagccggcaccuggaguucuaccuccuguggacccacaagcugcucaugcugcacggccagaagcugaagucccgcgcggggacgcuccugcccgugauccaguuccugcagaaguccauccagcggcaccucgacgaccugagcaagcugugcagcuggaaccacuacaacaugcaguacgcccucgccgucuccaagcagcgcggcaccaagcggagccuggacccccugggcuccgaggaggaggccgaggccagcgaggacgacucccuccaccuccucgggggcgggggccgcgacagcgaggaggagaugcuggcguga

SEQ ID NO: 35316 - RNA, 1500 nt, Artificial Sequence
  derived and/or modified sequence opt1 from PWWP2B__Homo_sapiens__NP_001092107
auggagccccgcgccggcugccggcugccggugcgcgucgagcagguggugaacggggcccucgucgugaccgugagcugcggcgagcgguccuucgcggggauccugcuggacugcaccaagaagagcggccucuucgggcugcccccccuggccccccucccgcaggucgacgagucccccgugaacgacagccacggccgcgcccccgaggagggcgacgccgaggugaugcagcugggguccagcucccccccgcccgcccggggcguccagccccccgagacgacccgcccggagcccccccccccgcuggugcccccccuccccgcggggagccugccgcccuacccccccuacuucgagggcgccccguucccccacccccuguggcuccgggacaccuacaagcugugggugccccagccgcccccccgcaccaucaagcggacgcgccggcgccugucccggaaccgcgacccggggcggcucauccugagcaccauccgccugcggccccgccagguccucugcgagaagugcaaguccacccugagcccccccgaggccuccccgggcccccccgccgcgccccgggcccgccggcgccugggcagcgggccggaccgcgagcuccggaagcccgaggagcccgagaacggcgagcccaccgccgccgccacggcgcgccgguccaagcgcgagcggcgcgaggaggaccgggccccggccgagcaggugccccgcagccccgugaucaagaucuccuacagcaccccccaggggaagggcgaggucgugaagaucccgucccgggugcacggcagccuggagcccuuccgcccccagcaggccccccaggacgacgggagccaggacccggagguccuggaccgggagucccgcgaccggcccagcugcgcccccuccgcgagcauccccaagcucaagcugacccgcccggugcccgccggcgccgaccugcccccgcccaagauccggcucaagccccaccgccugggggacuccgagcacgagcccguguaccgggccgagcuggucggcgagcucaacggguaccugcgcgacagcuccccggcccccugcgcggacggccccgccggcgggcuggccgaccucagcuccggcagcuccggggaggacgacgacuucaagagcugcccccagggcccgcaggggcgggagggccuggccuuccugguguccugccccgagggccgcgccgacugcgcgagcgaguccgccugcagcuccgacagccucgacgaggcccgcuccagcgggagcgagggcacccccgccgacacgggggaccugucccccggccacggggcgagcgccccguccgugagccgggaggcccgccagaccguccccccccugaccgugcggcuccacacccaguccgucagcgagugcaucacggaggacggccgcaccguggccgugggcgacaucgucugggggcaccggcgcuga

SEQ ID NO: 35317 - RNA, 4440 nt, Artificial Sequence
  derived and/or modified sequence opt1 from PXDN__Homo_sapiens__NP_036425
auggccaagcgcagccggggccccgggcgccggugccugcucgcccuggugcuguucugcgcguggggcacccucgccgucguggcccagaagccgggggccggcugccccucccgcugccugugcuuccggaccacggugcgcugcaugcaccugcuccuggaggccguccccgcgguggccccccagaccagcauccuggaccuccgguucaaccgcauccgggagauccagccgggggccuuccgccggcugcgcaaccugaacacccuccugcugaacaacaaccagaucaagcggauccccuccggcgccuucgaggaccucgagaaccugaaguaccuguaccucuacaagaacgagauccagagcaucgaccgccaggcguucaagggccuggccucccuggagcagcucuaccugcacuucaaccagaucgagacccuggaccccgacagcuuccagcaccuccccaagcuggagcggcuguuccuccacaacaaccgcaucacgcaccuggugccggggaccuucaaccaccuggaguccaugaagcggcuccgccuggacagcaacacccugcacugcgacugcgagauccucuggcuggccgaccugcucaagaccuacgccgaguccggcaacgcccaggcggccgccaucugcgaguacccccggcgcauccaggggcggagcgucgccacgaucacccccgaggagcugaacugcgagcgcccccgcaucaccuccgagccgcaggacgccgacgugaccagcggcaacacgguguacuucaccugccgggcggaggggaaccccaagcccgagaucaucuggcugcgcaacaacaacgagcucuccaugaagaccgacagccggcugaaccugcucgacgacggcacccugaugauccagaacacgcaggagaccgaccagggcaucuaccagugcauggccaagaacgucgccggggaggugaagacccaggaggugacccugcgcuacuucggcucccccgcccggccgacguucgucauccagccccagaacaccgaggugcucgugggggagagcgucacccuggagugcuccgccaccggccacccccccccgcgcaucagcuggacgcggggcgaccgcaccccccugcccguggacccccgggugaacaucaccccguccgggggccucuacauccagaacgucgugcagggggacagcggcgaguacgcgugcagcgccaccaacaacaucgacuccgugcacgccacggccuucaucaucguccaggcccugccccaguucaccgugaccccccaggaccgcguggucaucgaggggcagaccguggacuuccagugcgaggcgaagggcaaccccccgcccgucaucgccuggacgaagggcgggagccagcuguccguggaccggcgccaccuggugcucagcuccggcacccugcggaucagcggggucgcccugcacgaccagggccaguacgagugccaggccgugaacaucaucgggucccagaagguggucgcgcaccucaccgugcagccccgcgugaccccggucuucgccagcauccccuccgacacgaccguggaggugggcgccaacguccagcugcccugcagcucccagggcgagcccgagccggccaucaccuggaacaaggacggggugcaggugaccgagagcggcaaguuccacaucucccccgagggguuccugaccaucaacgacgucggccccgccgacgcggggcgguacgagugcguggcccgcaacacgaucggcagcgccuccgugagcaugguccucuccgugaacgugcccgacgucagccggaacggcgacccguucguggccaccuccaucguggaggccaucgcgaccgucgaccgcgccaucaacagcacccggacgcaccuguucgacagccgcccccgcucccccaacgaccugcucgcccuguuccgguacccccgcgacccguacaccguggagcaggcccgggccggggagaucuucgagcgcacccugcagcucauccaggagcacgugcagcacggccugauggucgaccugaacgggaccagcuaccacuacaacgaccucguguccccccaguaccugaaccugaucgcgaaccucagcggcugcacggcccaccggcgcgugaacaacugcuccgacaugugcuuccaccagaaguaccggacccacgacggcaccugcaacaaccugcagcaccccauguggggggccagccugaccgccuucgagcgccuccugaaguccgucuacgagaacggcuucaacacgccccgggggaucaacccgcaccgccuguacaacggccacgcgcuccccaugccccggcuggugagcaccacccugaucgggaccgagacggugacccccgacgagcaguucacccacaugcucaugcaguggggccaguuccuggaccacgaccuggacuccaccgucguggcccucagccaggcccgcuucuccgacggccagcacugcagcaacgugugcuccaacgacccgcccugcuucagcgucaugaucccccccaacgacucccgggcccgcagcggggcccggugcauguucuucgugcgcuccagcccggugugcggcagcgggaugacgucccugcugaugaacagcgucuacccccgggagcagaucaaccagcucaccuccuacaucgacgcgagcaacguguacggcuccaccgagcacgaggcccgcagcauccgggaccuggccucccaccgcgggcugcuccggcagggcaucgugcagcgcagcggcaagccccugcugccguucgccaccgggccccccacggagugcaugcgcgacgagaacgagucccccaucccgugcuuccucgccggcgaccaccgggcgaacgagcagcuggggcugaccagcaugcacacccucugguuccgcgagcacaaccggaucgccaccgagcugcugaagcucaacccccacugggacggcgacacgaucuacuacgagacccgcaagaucgucggggccgagauccagcacaucaccuaccagcacuggcugcccaagauccugggcgaggugggcaugcggacccucggggaguaccacggcuacgaccccgggaucaacgccggcaucuucaacgccuucgcgacggccgccuuccgcuucgggcacacccuggugaacccgcugcucuaccggcuggacgagaacuuccagcccaucgcccaggaccaccugccccuccacaaggcguucuucucccccuuccgcaucgucaacgagggcggcaucgacccgcugcugcgggggcucuucggcguggccgggaagaugcgcgugcccagccagcugcugaacaccgagcucaccgagcggcuguucuccauggcccacacggucgcccuggaccucgccgcgaucaacauccagcgcggccgggaccacggcaucccccccuaccacgacuaccgcguguacugcaaccugagcgccgcccacaccuucgaggaccugaagaacgagaucaagaacccggagauccgggagaagcucaagcgccuguacggguccacccugaacaucgaccucuuccccgcccugguggucgaggaccuggugcccggcagccggcucgggcccacccugaugugccugcucuccacccaguucaagcgccugcgggacggcgaccgccugugguacgagaacccgggggucuucagccccgcccagcucacgcagaucaagcagaccucccuggcgcgcauccugugcgacaacgccgacaacaucacccgggugcagagcgacguguuccgcgucgccgaguucccccacggcuacggcagcugcgacgagaucccccggguggaccuccgcguguggcaggacugcugcgaggacugccggacccgcgggcaguucaacgccuucuccuaccacuuccggggccgccggagccuggaguucuccuaccaggaggacaagccgacgaagaagacccgcccccggaagauccccagcgucgggcgccagggcgagcaccuguccaacagcaccuccgccuucagcacccgguccgacgcgagcgggacgaacgacuuccgcgaguucgugcucgagaugcagaagaccaucaccgaccugcggacccagaucaagaagcuggagucccgccucagcacgaccgagugcguggacgccggcggcgagucccacgccaacaacaccaaguggaagaaggacgccugcaccaucugcgagugcaaggacgggcaggucacgugcuucguggaggccugccccccggcgaccugcgccgugcccgucaacauccccggcgccugcugcccggugugccugcagaagcgggccgaggagaagcccuga

SEQ ID NO: 35318 - RNA, 4392 nt, Artificial Sequence
  derived and/or modified sequence opt1 from PXDNL__Homo_sapiens__NP_653252
auggagccccgccuguucugcuggaccacccucuuccugcuggccggcuggugccucccggggcugcccugccccagccggugccugugcuucaaguccacggugcgcugcaugcaccucaugcuggaccacaucccccaggucccgcagcagaccaccgugcuggaccuccgguucaaccgcauccgggagauccccggcagcgccuucaagaagcugaagaaccugaacacccuccugcugaacaacaaccacauccgcaagaucucccggaacgcguucgaggggcucgagaaccugcuguaccucuaccuguacaagaacgagauccacgcccuggacaagcagacguucaagggccucaucagccuggagcaccuguacauccacuucaaccagcucgagaugcugcagcccgagaccuucggggaccugcuccgccuggagcggcuguuccuccacaacaacaagcuguccaagauccccgccggcagcuucuccaaccuggacagccucaagcgccugcggcuggacuccaacgcccucgugugcgacugcgaccugauguggcugggcgagcuccugcagggguucgcccagcacggccacacccaggcggccgccaccugcgaguacccgcgccggcugcacgggcgcgccgucgcgagcgugacgguggaggaguucaacugccaguccccccggaucaccuucgagccccaggacgucgaggugcccagcggcaacaccguguacuucaccugccgcgccgaggggaacccgaagcccgagaucaucuggauccacaacaaccacucccucgaccuggaggacgacacgcggcugaacgucuucgacgacggcacccucaugauccgcaacacccgggagagcgaccagggcguguaccagugcauggcccgcaacuccgccggggaggccaagacccagagcgcgaugcugcgguacuccagccugcccgccaagcccuccuucgugauccagccgcaggacacggagguccucaucggcaccagcaccacccuggagugcauggccacggggcacccccacccccugaucaccuggacccgcgacaacggccuggagcucgacggcagccgccacguggccaccuccagcgggcuguaccugcagaacaucacgcagcgggaccacggccgcuucaccugccacgccaacaacucccacgggaccgugcaggcggccgccaacaucaucguccaggcccccccgcaguucaccgugacgcccaaggaccaggugguccucgaggagcacgccguggaguggcugugcgaggcggacggcaacccccccccggugaucgucuggaccaagaccgggggccagcugcccguggagggccagcacaccgugcucagcuccgggacgcugcggaucgaccgcgccgcccagcacgaccagggccaguacgagugccaggccgucagcucccugggggugaagaaggucagcgugcagcucaccgugaagcccaaggcccuggcggucuucacccagcugccccaggacaccuccguggaggugggcaagaacaucaacaucagcugccacgcccagggggagccgcagcccaucaucacguggaacaaggagggcguccagaucaccgaguccggcaaguuccacguggacgacgaggggacccucaccaucuacgacgccggcuuccccgaccaggggcgguacgagugcguggcccgcaacagcuucggccuggcggucaccaacauguuccugacggugaccgccauccaggggcggcaggccggcgacgacuucguggaguccagcauccucgacgccguccagcgcguggacuccgccaucaacagcacccggcgccaccuguucucccagaagccgcacaccagcuccgaccugcucgcgcaguuccacuacccccgggacccccugaucguggagauggcccgcgccggcgagaucuucgagcacacgcugcagcucauccgggagcgcgucaagcaggggcugaccguggaccuggagggcaaggaguuccgguacaacgaccucgugagcccccgcagccugucccugaucgccaaccucagcgggugcaccgcccggcgcccgcugcccaacugcuccaaccggugcuuccacgcgaaguaccgcgcccacgacggcaccugcaacaaccugcagcagcccacguggggcgccgcccucaccgccuucgcgcgccugcugcagcccgccuaccgggacgggauccgcgccccgcggggccucgggcugcccgucggcagccgccagccccugcccccgccccggcucguggccaccgugugggcgcgcgccgccgccgucacccccgaccacuccuacacgcggaugcugaugcacugggggugguuccuggagcacgaccucgaccacaccgugcccgcccugagcaccgcgcgcuucuccgacggccggccgugcagcuccgugugcaccaacgacccccccugcuuccccaugaacacgcgccacgccgacccgcggggcacccacgcccccugcaugcuguucgcccgcagcucccccgccugcgcgagcgggcggcccuccgccaccgucgacagcguguacgcccgcgagcagaucaaccagcagaccgccuacaucgacggcuccaacguguacgggagcuccgagcgggagagccaggcccuccgcgacccgagcgucccccggggccugcugaagacgggguuccccuggccgcccuccggcaagccccuccugcccuucagcaccggcccgcccaccgagugcgcgcgccaggagcaggagucccccugcuuccuggccggggaccaccgggccaacgagcaccucgcccuggcggccaugcacacccugugguuccgcgagcacaaccggguggccacggagcucagcgcccugaacccccacugggagggcaacaccguguaccaggaggcccgcaagaucgucggggcggagcugcagcacaucaccuacucccacuggcucccgaaggugcugggcgaccccgggacccgcaugcugcggggcuaccgcggcuacaaccccaacgugaacgccgggaucaucaacagcuucgccacggccgccuuccgguucggccacacccucaucaaccccauccuguaccgccugaacgcgacccucggggagaucuccgagggccaccugccguuccacaaggcccuguucagccccucccggaucaucaaggaggggggcaucgaccccguccuccgcggccuguucgggguggccgccaaguggcgggcccccagcuaccugcucuccccggagcugacccagcgccuguucagcgcggccuacuccgccgccguggacagcgccgcgacgaucauccagcggggccgcgaccacgggaucccccccuacgucgacuuccggguguucugcaaccucaccuccgugaagaacuucgaggaccugcagaacgagaucaaggacagcgagauccgccagaagcugcggaagcucuacggcucccccggcgacaucgaccuguggccggcccugauggucgaggaccucauccccgggacccgcgugggccccacccugaugugccuguucgugacgcaguuccagcggcuccgcgacggggaccgguucugguacgagaaccccggcgucuucaccccggcccagcugacccagcugaagcaggccagccucucccgcgugcugugcgacaacggggacagcauccagcaggugcaggcggacgucuucgugaaggccgaguacccccaggacuaccugaacugcagcgagauccccaagguggaccuccgggucuggcaggacugcugcgccgacugccgcucccgcggccaguuccgggccgugacccaggagagccagaagaagcgcuccgcccaguacagcuaccccguggacaaggacauggagcugucccaccugcggagccgccagcaggacaagaucuacgucggcgaggacgcgcggaacgugaccguccucgccaagacgaaguucucccaggacuucagcaccuucgccgccgagauccaggagaccaucaccgcccugcgcgagcagaucaacaagcuggaggcgcggcuccgccaggccgggugcacggacgugcggggcgugccgcgcaaggccgaggagcgguggaugaaggaggacugcacccacugcaucugcgaguccgggcaggucaccugcgugguggagaucugcccccccgccccgugccccagccccgagcuggucaagggcaccugcugccccgugugccgcgaccgggggaugccguccgacagccccgagaagcgcuga

SEQ ID NO: 35319 - RNA, 1638 nt, Artificial Sequence
  derived and/or modified sequence opt1 from PXK__Homo_sapiens__NP_001276025
auggccuucauggagaagccgcccgccggcaaggugcugcucgacgacaccgucccccugaccgcggccaucgaggccagccagucccugcagagccacacgaucgccgggcucucccugccccugccgcccaagaagcucaucggcaacauggaccgcgaguucaucgccgagcggcagaaggggcugcagaacuaccugaacgugaucaccaccaaccacauccucagcaacugcgagcuggugaagaaguuccuggaccccaacaacuacuccgcgaacuacaccgagaucgcccuccagcaggucagcauguucuuccgcuccgagcccaagugggaggugguggagccccugaaggacaucggcuggcggauccgcaagaaguacuuccugaugaagaucaagaaccagcccaaggagcggcucguccugagcugggccgaccuggggcccgacaaguaccucuccgacaaggacuuccagugccugaucaagcugcuccccagcugccugcaccccuacaucuaccgcgugacguucgccaccgcgaacgaguccagcgcccugcucauccggauguucaacgagaagggcacccugaaggaccugaucuacaaggccaagcccaaggaccccuuccucaagaaguacugcaaccccaagaagauccagggccuggagcugcagcagaucaagaccuacgggcgccagauccucgaggugcugaaguuccugcacgacaagggcuuccccuacgggcaccuccacgccuccaacgucaugcuggacggcgacacgugccggcugcucgaccuggagaacagccugcucgggcugcccuccuucuaccgcagcuacuucucccaguuccggaagaucaacacccuggagagcguggacgugcacugcuucggccaccuccuguacgagaugaccuacggccgcccgcccgacuccguccccguggacagcuucccgcccgcccccagcauggcgguggucgccgugcuggaguccacccucagcugcgaggccugcaagaacgggaugcccacgaucucccggcugcugcagaugccccucuucagcgacgugcugcugaccaccuccgagaagccccaguucaagauccccaccaagcugaaggaggcccuccgcaucgccaaggagugcaucgagaagcggcugaucgaggagcagaagcagauccaccagcaccgccggcugacgcgcgcgcagagccaccacggcuccgaggaggagcggaagaagcgcaagauccucgcccggaagaaguccaagcgcagcgcccuggagaacagcgaggagcacuccgccaaguacagcaacuccaacaacagcgccggguccggcgcgagcagcccccugaccucccccuccagccccaccccgcccagcaccuccggcaucagcgcccugcccccgccgcccccgccgccgcccccgcccgccgcgccccucccgcccgccuccacggaggcccccgcccagcugagcucccaggccgucaacgggaugagccgcggcgcccuccuguccagcauccagaacuuccagaaggggacccugcggaaggcgaagaccugcgaccacuccgcccccaagaucggcuga

SEQ ID NO: 35320 - RNA, 588 nt, Artificial Sequence
  derived and/or modified sequence opt1 from PXMP2__Homo_sapiens__NP_061133
auggcccccgccgcgagccgccugcgggccgaggccggccucggggcccugccgcgccgggcccuggcgcaguaccuccuguuccugcgccucuaccccgugcugaccaaggccgccaccuccggcauccugagcgcccucgggaacuuccuggcgcagaugaucgagaagaagcggaagaaggagaacucccgcagccuggacgucggcgggccccuccgguacgccguguacggcuucuucuucaccggcccccugucccacuucuucuacuucuucauggagcacuggaucccgcccgaggugccccuggccgggcuccgccggcugcugcucgaccgccuggucuucgcccccgccuuccugaugcuguucuuccucaucaugaacuuccuggagggcaaggacgcgagcgccuucgccgccaagaugcgcgggggcuucuggccggcccuccggaugaacuggcggguguggacgccccugcaguucaucaacaucaacuacgugccccugaaguuccgcguccucuucgcgaaccuggccgcccuguucugguacgccuaccucgccucccuggggaaguga

SEQ ID NO: 35321 - RNA, 1776 nt, Artificial Sequence
  derived and/or modified sequence opt1 from PXN__Homo_sapiens__NP_001074324
auggacgaccuggacgcccuccuggccgaccuggagagcaccaccucccacaucagcaagcgccccguguuccucuccgaggagacgccguacagcuaccccaccggcaaccacaccuaccaggagaucgcggucccgccgcccgugcccccgccgcccuccagcgaggcccugaacgggaccauccuggacccccucgaccaguggcagcccuccagcucccgguucauccaccagcagccccagagcuccagccccguguacggcuccagcgccaagacguccagcgucuccaacccccaggacagcguggggucccccugcagccgcgugggcgaggaggagcacgucuacagcuuccccaacaagcagaaguccgccgagcccagccccaccgugauguccaccagccugggguccaaccugagcgagcucgaccggcugcugcucgagcugaacgccgugcagcacaacccgcccggcuuccccgcggacgaggccaacuccagcccgccccugcccggcgcccucuccccgcuguacgggguccccgagaccaacagcccccugggcgggaaggccggcccccucacgaaggagaagcccaagcgcaacgggggccggggccucgaggacgugcgccccuccguggagagccugcucgacgagcuggaguccagcguccccuccccggugcccgcgaucaccgugaaccagggggagaugagcagcccccagcgggucaccuccacccagcagcagacgcgcaucuccgccagcagcgccacccgggagcuggacgagcucauggccucccugagcgacuucaagauccagggccuggagcagcgcgccgacggggagcggugcugggcggccggcuggccccgcgacggcgggcgguccagcccgggcgggcaggacgagggcggguucauggcccagggcaagaccggcuccagcuccccgcccggcgggccgcccaagcccgggagccagcucgacuccaugcugggcagccugcaguccgaccucaacaagcuggggguggccaccguggccaagggcgucugcggcgcgugcaagaagcccaucgccggccagguggugacggccauggggaagaccuggcaccccgagcacuucgucugcacccacugccaggaggagaucgggagccgcaacuucuucgagcgggacggccagcccuacugcgagaaggacuaccacaaccuguucagcccccgcugcuacuacugcaacgggcccauccucgacaagguggugaccgcccuggaccggacguggcaccccgagcacuucuucugcgcccagugcggcgcguucuucggcccggagggguuccacgagaaggacggcaaggccuacugccgcaaggacuacuucgacauguucgcccccaagugcgggggcugcgcccgggccauccuggagaacuacaucuccgcgcucaacacccuguggcaccccgagugcuucgucugccgcgagugcuucacccccuucgugaacggcuccuucuucgagcacgacgggcagccguacugcgagguccacuaccacgagcggcgcggcagccugugcuccgggugccagaagcccaucaccggccgcugcaucacggccauggccaagaaguuccaccccgagcacuucgugugcgccuucugccucaagcagcugaacaaggggaccuucaaggagcagaacgacaagcccuacugccagaacugcuuccugaagcuguucugcuga

SEQ ID NO: 35322 - RNA, 420 nt, Artificial Sequence
  derived and/or modified sequence opt1 from PXT1__Homo_sapiens__XP_011512702
augaagggcaagaacaugaagaagaagcacgacgggaucguguacgagaccaaggaggugcugaaccccagcccgaaggugacccacugcugcaagucccucuggcugaaguacagcuuccagaaggccuacaugacgcagcugguguccagccagcccguccccgccaugucccgcaaccccgaccacaaccuccugagccagccgaaggagcacuccaucgugcagaagcaccaccaggaggagaucauccacaagcuggcgaugcagcuccggcacaucggcgacaacaucgaccaccgcauggugcgggaggaccugcagcaggacgggcgcgacgcccuggaccacuucgucuucuucuucuuccggcgcguccaggugcuccugcacuucuucuggaacaaccaccuccuguga

SEQ ID NO: 35323 - RNA, 588 nt, Artificial Sequence
  derived and/or modified sequence opt1 from PYCARD__Homo_sapiens__NP_037390
augggccgcgcccgggacgccauccuggacgcgcucgagaaccugaccgccgaggagcugaagaaguucaagcucaagcugcugagcgugccccuccgcgagggguacggccggaucccgcgcggggcccugcuguccauggacgcccucgaccugaccgacaagcuggucagcuucuaccucgagacguacggcgccgagcugaccgcgaacgugcugcgggacauggggcuccaggagauggccggccagcugcaggccgccacccaccagggcuccggggcggcccccgccggcauccaggccccgccccagagcgccgcgaagcccgggcugcacuucaucgaccagcaccgcgccgcccucaucgcccgggugaccaacgucgaguggcugcuggacgcccucuacggcaaggugcugacggacgagcaguaccaggcggugcgcgccgagcccaccaaccccuccaagaugcggaagcuguucagcuucacccccgccuggaacuggaccugcaaggaccuccugcugcaggcccuccgcgagucccagagcuaccuggucgaggaccuggagcgguccuga

SEQ ID NO: 35324 - RNA, 867 nt, Artificial Sequence
  derived and/or modified sequence opt1 from PYCR1__Homo_sapiens__NP_001269208
augagcgugggcuucaucggggccggccagcuggccuucgcgcucgccaagggguucaccgccgccggcguccuggccgcgcacaagaucauggccuccagccccgacauggaccuggccaccguguccgcccuccgcaagaugggggugaagcugacgccgcacaacaaggagaccguccagcacagcgacgugcuguuccucgcggugaagccccacaucauccccuucauccuggacgagaucggcgccgacaucgaggaccggcacaucgucguguccugcgccgccggcgugaccaucagcuccaucgagaagaagcugagcgccuuccgccccgcgccgcgggucauccgcugcaugaccaacacgcccguggugguccgggagggggccaccguguacgccaccggcacccacgcccagguggaggacgggcgccucauggagcagcugcuguccagcgucggcuucugcacggagguggaggaggaccucaucgacgccgugaccgggcuguccggcagcggccccgcguacggggccgccaagaugcugcuccacuccgagcagcaccccggccagcugaaggacaacgucagcucccccgggggcgccaccauccacgcccugcacgugcucgagagcggcggguuccggucccugcugaucaacgcgguggaggccagcugcauccgcacccgggagcuccaguccauggccgaccaggagcaggucagcccggccgccaucaagaagacgauccuggacaaggugaagcuggacagccccgcgggcaccgcccucucccccagcgggcacaccaagcugcugccgcgcucccucgcccccgccggcaaggacuga

SEQ ID NO: 35325 - RNA, 270 nt, Artificial Sequence
  derived and/or modified sequence opt1 from PYDC1__Homo_sapiens__NP_690865
augggcaccaagcgcgaggccauccugaaggugcucgagaaccugacccccgaggagcugaagaaguucaagaugaagcucgggacggucccgcugcgggagggcuucgagcgcaucccccgcggggcccugggccagcucgacaucguggaccugaccgacaagcugguggcgagcuacuacgaggacuacgccgccgagcucgucguggccgugcugcgggacaugcggaugcuggaggaggccgcgcgccuccagcgggccgccuga

SEQ ID NO: 35326 - RNA, 294 nt, Artificial Sequence
  derived and/or modified sequence opt1 from PYDC2__Homo_sapiens__NP_001076777
auggccagcuccgccgagcuggacuucaaccuccaggcgcugcuggagcagcucagccaggacgagcuguccaaguucaagagccugauccgcaccaucucccucggcaaggagcugcagaccgugccccagacggaggucgacaaggccaacgggaagcagcugguggagaucuucaccagccacuccugcagcuacugggccggcauggccgccauccagguguucgagaagaugaaccagacccaccucuccgggcgggcggacgagcacugcgucaugcccccgcccuga

SEQ ID NO: 35327 - RNA, 2532 nt, Artificial Sequence
  derived and/or modified sequence opt1 from PYGB__Homo_sapiens__NP_002853
auggccaagccccugaccgacagcgagaagcgcaagcagaucuccgugcggggccucgccgggcugggcgacgucgcggaggugcgcaagagcuucaaccggcaccuccacuucacccuggugaaggaccgcaacgucgccacgccccgggacuacuucuucgcccuggcccacaccgugcgcgaccaccugguggggcgguggauccgcacccagcagcacuacuacgagcgggaccccaagcgcaucuacuaccucucccuggaguucuacaugggccggacccugcagaacacgauggucaaccucgggcugcagaacgccugcgacgaggcgaucuaccagcugggccucgaccuggaggagcuggaggagaucgaggaggacgccggccucgggaacggcgggcugggccgccuggccgccugcuuccucgacagcauggcgacccuggggcuggccgccuacggcuacggcauccgguacgaguucgggaucuucaaccagaagaucgugaacggcuggcaggucgaggaggccgacgacuggcuccgcuacgggaaccccugggagaaggcccggcccgaguacaugcugccggugcacuucuacggccgcguggagcacacccccgacggcgugaaguggcuggacacccaggucgugcucgcgaugcccuacgacacgcccgugccgggguacaagaacaacaccgucaacaccaugcggcugugguccgccaaggcccccaacgacuucaagcugcaggacuucaacgugggcgacuacaucgaggccgugcucgaccgcaaccuggccgagaacaucagccggguccuguaccccaacgacaacuucuucgaggggaaggagcuccgccugaagcaggaguacuucgugguggcggccacccugcaggacaucauccggcgcuucaaguccagcaaguucggcugccgcgaccccguccggacgugcuucgagaccuucccggacaagguggccauccagcucaacgacacccaccccgcccuguccauccccgagcugaugcgcauccucguggacgucgagaagguggacugggacaaggccugggagaucaccaagaagacgugcgcguacaccaaccacaccguccugcccgaggcccuggagcgguggccggugagcauguucgagaagcuccugccccgccaccuggagaucaucuacgccaucaaccagcggcaccucgaccacguggccgcccuguuccccggggacgucgaccgccugcggcgcauguccgugaucgaggagggcgacugcaagcggaucaacauggcgcaccucugcgugaucggcagccacgccgucaacgggguggcccgcauccacuccgagaucgugaagcagagcgucuucaaggacuucuacgagcuggagcccgagaaguuccagaacaagaccaacggcaucacgccgcggcgcuggcugcuccugugcaaccccgggcuggccgacaccaucguggagaagaucggcgaggaguuccugaccgaccucucccagcugaagaagcugcucccccuggugagcgacgaggucuucauccgggacguggcgaaggugaagcaggagaacaagcugaaguucuccgccuuccucgagaaggaguacaaggucaagaucaaccccagcuccauguucgacgugcacgugaagcgcauccacgaguacaagcggcagcugcugaacugccuccacgucgugacccuguacaaccgcaucaagcgggacccggccaaggccuucgugccccgcacggucaugaucgggggcaaggccgcgcccggcuaccacauggccaagcugaucaucaagcucgugaccagcaucggggacguggucaaccacgaccccguggugggcgaccggcugaaggucaucuuccuggagaacuaccgcgugagccucgccgagaaggugaucccggccgccgaccugucccagcagaucagcaccgcggggaccgaggccuccggcacggggaacaugaaguucaugcugaacggcgcccucaccaucggcaccauggacggggccaacgucgagauggccgaggaggcgggcgccgagaaccuguucaucuucgggcugcgcguggaggacguggaggcccucgaccggaagggcuacaacgcccgcgaguacuacgaccaccuccccgagcugaagcaggcggucgaccagaucagcuccggcuucuucagccccaaggagccggacugcuucaaggacaucgugaacaugcugaugcaccacgaccgguucaagguguucgccgacuacgaggccuacaugcagugccaggcccaggucgaccagcuguaccgcaaccccaaggaguggaccaagaaggugauccggaacaucgccugcuccgggaaguucagcuccgaccgcacgaucaccgaguacgcgcgggagaucuggggcguggagcccagcgaccugcagaucccgccgcccaacaucccccgcgacuga

SEQ ID NO: 35328 - RNA, 2442 nt, Artificial Sequence
  derived and/or modified sequence opt1 from PYGL__Homo_sapiens__NP_001157412
auggccaagccccugaccgaccaggagaagcgccggcagaucagcauccgcggcaucgugggggucgagaacguggccgagcucaagaaguccuucaaccggcaccuccacuucacccuggugaaggaccgcaacgucgcgacgacccgggacuacuacuucgcccucgcccacaccgugcgcgaccaccuggugggccgguggauccgcacccagcagcacuacuacgacaagugcccgaagcuggggcucgacaucgaggagcuggaggagaucgaggaggacgccggccuggggaacggcggccucgggcggcuggccgcgugcuuccuggacagcauggccacgcucggccuggccgccuacggguacggcauccgcuacgaguacgggaucuucaaccagaagauccgggacggcuggcaggucgaggaggcggacgacuggcugcgcuacggcaaccccugggagaagucccggcccgaguucaugcuccccgugcacuucuacgggaagguggagcacaccaacaccggcaccaaguggaucgacacgcaggucgugcuggcccugccguacgacacccccgugcccggguacaugaacaacaccgucaacaccaugcgccucuggagcgcccgggcccccaacgacuucaaccugcgcgacuucaacgugggcgacuacauccaggccgugcuggaccggaaccucgcggagaacaucucccgcguccuguacccgaacgacaacuucuucgagggcaaggagcugcggcucaagcaggaguacuucgugguggccgccacgcugcaggacaucauccgccgguucaaggccagcaaguucggguccacccgcggcgccgggaccgucuucgacgcguuccccgaccagguggccauccagcugaacgacacccaccccgcccucgccauccccgagcugaugcgcaucuucguggacaucgagaagcugccguggagcaaggccugggagcucacgcagaagaccuucgcguacaccaaccacaccguccugcccgaggcccuggagcgguggcccguggaccucguggagaagcugcugccccgccaccucgagaucaucuacgagaucaaccagaagcaccuggaccggaucgucgcccuguucccgaaggacguggaccgccuccggcgcaugucccugaucgaggaggagggcagcaagcggaucaacauggcccaccugugcaucgucgggucccacgccgugaacggcguggcgaagauccacagcgacaucgucaagacgaagguguucaaggacuucuccgagcucgagcccgacaaguuccagaacaagaccaacggcaucacgccccgccgguggcugcugcucugcaaccccgggcuggccgagcugaucgccgagaagaucggcgaggacuacgugaaggaccucagccagcugaccaagcugcacuccuuccugggggacgacgucuuccuccgcgagcuggccaaggugaagcaggagaacaagcugaaguucagccaguuccucgagaccgaguacaaggugaagaucaacccguccagcauguucgacguccaggugaagcggauccacgaguacaagcgccagcugcugaacugccuccacgugaucaccauguacaaccggaucaagaaggaccccaagaagcuguucgucccccgcaccgugaucaucggcgggaaggcggcccccggcuaccacauggccaagaugaucaucaagcugaucaccuccguggccgacgucgugaacaacgacccgauggugggcagcaagcucaaggucaucuuccuggagaacuaccgggugagccuggccgagaaggugauccccgcgacggaccucuccgagcagaucagcaccgccgggaccgaggccuccggcaccgggaacaugaaguucaugcugaacggcgcccugacgaucgggaccauggacggcgccaacgucgagauggcggaggaggccggcgaggagaaccucuucaucuucgggaugcgcaucgacgacguggccgcccuggacaagaagggcuacgaggccaaggaguacuacgaggcgcugcccgagcucaagcuggugaucgaccagaucgacaacggguucuucagccccaagcagccggaccuguucaaggacaucaucaacaugcuguucuaccacgaccgguucaaggucuucgccgacuacgaggccuacgugaagugccaggacaaggugucccagcuguacaugaaccccaaggccuggaacaccaugguccugaagaacaucgcggccagcggcaaguucuccagcgaccgcaccaucaaggaguacgcccagaacaucuggaacguggagcccuccgaccucaagaucagccuguccaacgagagcaacaaggugaacggcaacuga

SEQ ID NO: 35329 - RNA, 2265 nt, Artificial Sequence
  derived and/or modified sequence opt1 from PYGM__Homo_sapiens__NP_001158188
augagccgcccccuguccgaccaggagaagcggaagcagaucagcgugcgcgggcucgccggggucgagaacgugaccgagcugaagaagaacuucaaccggcaccuccacuucacccuggugaaggaccgcaacgucgccacgccgcgggacuacuacuucgcgcuggcccacaccgugcgcgaccaccuggugggccgguggauccgcacccagcagcacuacuacgagaaggaccccaagaagaucuccgggggcuggcagauggaggaggccgacgacuggcuccgguacgggaaccccugggagaaggcccgccccgaguucacccugccgguccacuucuacggccacguggagcacacgagccagggcgccaaguggguggacacccaggucgugcuggcgaugcccuacgacacccccgugcccggguaccggaacaacgucgugaacaccaugcgccucugguccgccaaggccccgaacgacuucaaccugaaggacuucaacgugggcggguacauccaggccguccuggaccggaaccucgcggagaacaucagccgcgugcuguaccccaacgacaacuucuucgagggcaaggagcugcggcucaagcaggaguacuucguggucgccgccacgcugcaggacaucauccgccgguucaaguccagcaaguucgggugccgcgaccccgugcggaccaacuucgacgccuuccccgacaagguggccauccagcugaacgacacccacccgucccucgcgauccccgagcugaugcgcauccuggucgaccucgagcggauggacugggacaaggccugggacgugaccgugcgcacgugcgccuacaccaaccacaccguccugcccgaggcccuggagcgcuggcccgugcaccuccuggagacccugcucccgcggcaccuccagaucaucuacgagaucaaccagcgcuuccugaaccgggucgccgcggccuuccccggcgacguggaccgccugcggcgcaugagccugguggaggagggcgccgucaagcggaucaacauggcccaccugugcaucgccgggucccacgcggugaacggcguggcccgcauccacagcgagauccucaagaagacgaucuucaaggacuucuacgagcuggagccccacaaguuccagaacaagaccaacgggaucacgccccggcgcuggcugguccucugcaacccgggccuggccgaggugaucgccgagcggaucggcgaggacuucaucuccgaccuggaccagcuccgcaagcugcugagcuucguggacgacgaggccuucauccgggacgucgcgaaggugaagcaggagaacaagcucaaguucgccgccuaccuggagcgcgaguacaaggugcacaucaaccccaacucccuguucgacauccaggucaagcggauccacgaguacaagcgccagcuccugaacugccugcacgugaucacccucuacaaccggaucaagcgcgagcccaacaaguucuucgugccccggaccgucaugaucgggggcaaggccgcgccgggguaccacauggccaagaugaucauccgccuggugaccgccaucggcgacguggucaaccacgaccccgccgugggggaccgccugcgggugaucuuccuggagaacuaccgcgucagccucgccgagaaggugauccccgcggccgaccuguccgagcagaucagcaccgccggcaccgaggccuccggcacggggaacaugaaguucaugcugaacggcgcccucaccaucgggaccauggacggcgcgaacguggagauggccgaggaggccggggaggagaacuucuucaucuucggcaugcgggucgaggacguggacaagcuggaccagcgcggcuacaacgcccaggaguacuacgaccggauccccgagcugcgccaggugaucgagcagcucagcagcggguucuucuccccgaagcagcccgaccuguucaaggacaucgucaacaugcugaugcaccacgaccgguucaagguguucgccgacuacgaggacuacaucaagugccaggagaaggugagcgcgcucuacaagaacccccgcgaguggacccggauggucauccgcaacaucgccacguccggcaaguucagcuccgaccggaccaucgcccaguacgcccgcgagaucuggggcguggagccgagccggcagcgccugcccgcgcccgacgaggccaucuga

SEQ ID NO: 35330 - RNA, 1260 nt, Artificial Sequence
  derived and/or modified sequence opt1 from PYGO1__Homo_sapiens__NP_056432
augcccgccgagaacagccccgcccccgcguacaagguguccagccacggcggggacuccggccuggacgggcucggcgggcccggcguccagcugggcagccccgacaagaagaagcgcaaggccaacacccaggggccguccuucccgccccugagcgaguacgcgcccccgcccaaccccaacuccgaccaccucguggccgccaaccccuucgacgacaacuacaacaccaucagcuacaagccgcugcccuccagcaaccccuaccugggccccggguacccgggcuucgggggcuacuccacguuccggaugccgccccacgugccgccccgcaugagcucccccuacugcggccccuacagccuccggaaccagccccaccccuucccccagaacccccuggggaugggcuucaaccgcccccacgccuucaacuucgggccgcacgacaacuccagcuucggcaaccccuccuacaacaacgcccugagccagaacgucaacaugcccaaccagcacuuccggcagaacccggccgagaacuucucccagaucccgccccagaacgccagccaggugagcaaccccgaccucgcguccaacuucgugcccggcaacaacagcaacuucaccagcccccuggaguccaaccacuccuucaucccgccgcccaacaccuucgggcaggccaaggcgcccccgcccaagcaggacuucacccagggcgccaccaagaacaccaaccagaacagcuccgcccacccgccccaccugaacauggacgacaccgucaaccagagcaacaucgagcucaagaacgugaaccgcaacaacgccgugaaccaggagaacucccggagcuccagcaccgaggccacgaacaacaaccccgccaacgggacccagaacaagccccgccagccccggggcgccgccgacgcgugcaccaccgagaaguccaacaagagcucccugcaccccaaccgccacgggcacagcuccagcgaccccgucuaccccugcggcaucugcacgaacgaggugaacgacgaccaggacgccauccugugcgaggccuccugccagaagugguuccaccggaucugcaccggcaugaccgagaccgccuacgggcuccugacggccgaggcgagcgccguguggggcugcgacacgugcauggccgacaaggacguccagcugaugcgcacccgggagaccuucgggcccagcgccgugggcuccgacgccuga

SEQ ID NO: 35331 - RNA, 1221 nt, Artificial Sequence
  derived and/or modified sequence opt1 from PYGO2__Homo_sapiens__NP_612157
auggccgccagcgcgcccccgccccccgacaagcuggagggcgggggcgggcccgccccgccccccgcccccccguccaccggccgcaagcaggggaaggccggccuccagaugaagagccccgagaagaagcggcgcaaguccaacacccagggccccgccuacagccaccugacggaguucgcgcccccgcccacccccaugguggaccaccuggucgccuccaaccccuucgaggacgacuucggggccccgaaggugggcguggccgcgccccccuuccucgggagccccgucccguucggcggguuccgggugcagggcggcauggccgggcaggugccccccggcuacuccaccgggggcggcgggggcccccagccgcugcgccggcagcccccccccuucccgcccaaccccauggggccggccuucaacaugcccccccagggccccggguacccgccccccggcaacaugaacuuccccagccagccguucaaccagccccugggccagaacuucuccccccccagcgggcagaugaugccgggccccgucgggggcuucgggcccaugaucucccccaccaugggccagccgccccgcgccgagcucggcccccccagccugucccagcgguucgcccagccgggggcgcccuucggccccagcccccugcagcgcccggggcagggccuccccucccugcccccgaacacgagccccuuccccgggcccgacccgggcuuccccggccccgggggcgaggacgggggcaagccccugaacccgcccgccuccaccgccuucccccaggagccccacagcggcuccccggccgccgcggugaacgggaaccagcccagcuucccccccaacagcuccggccgggggggcgggaccccggacgccaacagccucgccccccccggcaaggccggcgggggcuccgggccccagccgccccccggccugguguaccccugcggggccugccgcagcgaggucaacgacgaccaggacgcgauccugugcgaggccuccugccagaagugguuccaccgggagugcaccggcaugacggagagcgccuacggccuccugaccaccgaggccuccgccgugugggcgugcgaccugugccucaagaccaaggagauccagagcguguacauccgcgaggggaugggccagcuggucgccgccaacgacggguga

SEQ ID NO: 35332 - RNA, 1479 nt, Artificial Sequence
  derived and/or modified sequence opt1 from PYHIN1__Homo_sapiens__NP_689714
auggccaacaacuacaagaagaucgugcugcucaagggccuggaggucaucaacgacuaccacuuccgcaucgucaagagccugcucuccaacgaccugaagcugaaccccaagaugaaggaggaguacgacaagauccagaucgccgaccucauggaggagaaguucccgggggacgcgggccuggggaagcugaucgaguucuucaaggagauccccacccucggcgaccuggccgagacccugaagcgggagaagcucaagguggccaacaagaucgagagcauccccgugaaggggaucauccccuccaagaagacgaagcagaaggagguguacccggccacccccgccugcacccccagcaaccgccugaccgcgaagggcgccgaggagacgcugggcccccagaagcggaagaagccguccgaggaggagaccgggaccaagcgcagcaagauguccaaggagcagacccggcccagcugcuccgccggcgccagcacguccaccgcgauggggcgcagcccgccgccccagaccuccagcuccgccccgcccaacaccagcuccacggagagccucaagccccuggccaaccggcacgccaccgccuccaagaacaucuuccgcgaggaccccaucaucgcgauggugcugaacgccaccaaggucuucaaguacgagagcagcgagaacgagcagcggcgcauguuccacgccaccguggccacgcagacccaguucuuccacgugaagguccucaacaucaaccugaagcggaaguucaucaagaagcgcaucaucaucaucuccaacuacagcaagcggaacucccugcucgaggugaacgaggccagcuccgugagcgaggcgggccccgaccagaccuucgagguccccaaggacaucauccgccgggccaagaagauccccaagaucaacauccugcacaagcagaccuccggguacaucguguacggccuguucaugcuccacacgaagaucgugaaccgcaagaccaccaucuacgagauccaggacaagaccggcagcauggccgucguggggaagggcgagugccacaacauccccugcgagaagggggacaagcugcggcuguucugcuuccgccuccggaagcgcgagaacauguccaagcugaugagcgagaugcacuccuucauccagauccagaagaacacgaaccagcggagccacgacucccgcagcauggcccugccccaggagcagucccagcaccccaagcccagcgaggccuccaccacccucccggagagccaccugaagacgccccagaugccgcccaccacccccuccagcagcuccuucaccaagaaggacgagacccaccccggcgcgcagagcucccccgccaacuuccgcaucacgagcccgaccguggccccgccccuguccagcgacaccuccaccaaccggcaccccgccguccccuga

SEQ ID NO: 35333 - RNA, 1503 nt, Artificial Sequence
  derived and/or modified sequence opt1 from PYROXD1__Homo_sapiens__NP_079130
auggaggccgcccggcccccgcccaccgcgggcaaguucguggucgucgggggcgggaucgccggcgugaccugcgccgagcagcuggccacgcacuuccccagcgaggacauccuccuggugaccgccucccccgugaucaaggcggugaccaacuucaagcagaucagcaagauccuggaggaguucgacgucgaggagcaguccagcaccaugcucgggaagcgcuucccgaacaucaaggugaucgaguccggcgugaagcagcucaagagcgaggagcacugcaucgucacggaggacggcaaccagcacguguacaagaagcugugccucugcgccggggccaagcccaagcugaucugcgagggcaaccccuacgugcuggggauccgcgacaccgacuccgcccaggaguuccagaagcagcucaccaaggcgaagcggaucaugaucaucggcaacgggggcaucgcccuggagcuggucuacgagaucgagggcugcgaggugaucugggccaucaaggacaaggccaucgggaacaccuucuucgacgccggcgcggccgaguuccucacgagcaagcugaucgccgagaaguccgaggccaagaucgcccacaagcgcacccgguacaccaccgaggggcgcaagaaggaggcgcggagcaaguccaaggccgacaacgugggcagcgcccugggccccgacuggcacgaggggcucaaccugaagggcacgaaggaguucucccacaagauccaccuggagaccaugugcgaggucaagaagaucuaccuccaggacgaguuccgcauccugaagaagaaguccuucaccuucccgcgggaccacaagagcgugaccgccgacacggagauguggcccguguacgucgagcugaccaacgagaagaucuacgggugcgacuucaucgugagcgccaccggcgugacccccaacgucgagcccuuccuccacgggaacuccuucgaccugggcgaggacggcgggcugaagguggacgaccacaugcacacgagccucccggacaucuacgcggccggcgacaucugcaccaccuccuggcagcugagccccguguggcagcagaugcgccuguggacccaggcccggcagauggggugguacgccgccaagugcauggcggccgccagcuccggcgacagcaucgacauggacuucuccuucgagcuguucgcccacgucacgaaguucuucaacuacaaggugguccugcuggggaaguacaacgcgcagggccucggcagcgaccacgagcugaugcugcgcugcaccaaggggcgggaguacaucaagguggugaugcagaacggccgcaugaugggggccguccucaucggcgagaccgaccuggaggagaccuucgagaaccugauccucaaccagaugaaccuguccagcuacggggaggaccugcucgaccccaacaucgacaucgaggacuacuucgacuga

SEQ ID NO: 35334 - RNA, 294 nt, Artificial Sequence
  derived and/or modified sequence opt1 from PYY__Homo_sapiens__NP_004151
augguguucguccgccggcccuggccggcccugaccaccgugcuccuggcccugcucgugugccugggcgcgcuggucgacgccuaccccaucaagcccgaggcccccggggaggacgccagcccggaggagcucaaccgcuacuacgccucccugcggcacuaccugaaccucgugacgcgccagcgguacggcaagcgcgacgggcccgacacccugcugagcaagaccuucuuccccgacggcgaggaccggcccgugcgcucccggagcgaggggccggaccucugguga

SEQ ID NO: 35335 - RNA, 4449 nt, Artificial Sequence
  derived and/or modified sequence opt1 from PZP__Homo_sapiens__NP_002855
augcgcaaggaccggcugcuccaccugugccuggugcuccugcugauccuccugagcgccuccgacagcaacuccaccgagccccaguacaugguccuggugccgagccuccugcacaccgaggcccccaagaagggcugcgugcugcucucccaccugaacgagacggucaccgugagcgcgucccuggagagcgggcgcgagaaccggucccucuucaccgaccugguggccgagaaggaccuguuccacugcgucagcuucacccucccccgcaucuccgccagcuccgagguggccuuccugagcauccagaucaagggccccacgcaggacuuccggaagcgcaacaccgugcugguccucaacacccagucccugguguucgugcagaccgacaagccgauguacaagcccgggcagacgguccgguuccgcguggugagcgucgacgagaacuuccggccccgcaacgagcugaucccccucaucuaccuggagaacccgcggcgcaaccggaucgcccaguggcagucccugaagcucgaggcgggcaucaaccagcugagcuucccccuguccagcgagcccauccaggggagcuaccgcguggugguccagaccgaguccggcggccggauccagcaccccuucaccguggaggaguucgugcucccgaaguucgaggucaagguccaggugcccaagaucaucagcaucauggacgagaaggugaacaucaccgugugcggggaguacacguacggcaagcccguccccgggcuggccaccgugucccugugccgcaagcucagccgggugcugaacugcgacaagcaggaggucugcgaggaguucucccagcagcugaacagcaacggcugcaucacccagcagguccacaccaagaugcuccagaucacgaacaccggguucgagaugaagcugcgcguggaggcccggauccgcgaggagggcaccgaccuggaggugaccgccaaccggaucuccgagaucacgaacaucgugagcaagcucaaguucgugaaggucgacucccacuuccgccagggcaucccguucuucgcccaggugcugcugguggacgggaagggcguccccauccccaacaagcuguucuucaucagcgugaacgacgccaacuacuacuccaacgccaccaccaacgagcaggggcucgcccaguucagcaucaacaccacguccaucagcgugaacaagcuguucguccgcguguucaccgugcaccccaaccucugcuuccacuacuccugggucgccgaggaccaccagggcgcgcagcacaccgccaaccggguguucagccuguccggcagcuacauccaccuggagccgguggccgggacccuccccugcggccacacggagaccaucaccgcccacuacacccugaaccgccaggccaugggggagcuguccgagcugagcuuccacuaccucaucauggcgaagggcgucaucgugcggagcgggacgcacacccugcccguggaguccggcgacaugaagggcagcuucgcccuguccuuccccgucgagagcgacguggccccgaucgcccgcauguucaucuucgccauccuccccgacggggagguggucggcgacuccgagaaguucgagaucgagaacugccuggcgaacaagguggaccugagcuucucccccgcccagagcccgccggccucccacgcccaccuccagguggccgcggcgccccagagccugugcgcccugcgggccgucgaccaguccgugcuccugaugaagcccgaggcggagcugagcguguccagcgucuacaaccuccugaccgugaaggaccugaccaacuucccggacaacguggaccagcaggaggaggagcaggggcacugcccccgccccuucuucauccacaacggcgccaucuacgucccccucuccagcaacgaggccgacaucuacuccuuccugaaggggaugggccugaagguguucacgaacagcaagauccggaagcccaagagcugcuccgugauccccagcgucuccgccggcgccguggggcagggcuacuacggggcgggccucgggguggucgagcgccccuacgugccccagcugggcaccuacaacgugaucccgcugaacaacgagcagagcuccggccccguccccgagaccgugcggagcuacuuccccgagaccuggaucugggagcucguggccgucaacuccagcgggguggccgaggugggcgucaccgugccggacacgaucaccgaguggaaggccggggccuucugccuguccgaggacgcgggccugggcaucagcuccaccgccagccuccgcgccuuccagcccuucuucgucgagcugaccaugcccuacuccgugauccgcggggagguguucacgcugaaggccaccguccucaacuaccugcccaagugcauccgggugagcgugcagcugaaggccuccccggcguuccucgccagccagaacaccaagggcgaggaguccuacugcaucugcgggaacgagcggcagacccugagcuggacggucacccccaagacccugggcaacgugaacuucuccgugagcgccgaggccaugcagagccucgagcugugcgggaacgaggucguggaggugcccgagaucaagcgcaaggacaccgucaucaagacgcugcucguggaggcggagggcaucgagcaggagaagaccuucuccagcaugaccugcgccuccggcgccaacgugagcgagcagcugucccugaagcuccccagcaacgucgugaaggaguccgcccgggccagcuucuccgugcugggggacauccugggcagcgcgaugcagaacauccagaaccuccugcagaugccguacgggugcggcgagcagaacaugguccuguucgcccccaacaucuacgugcucaacuaccugaacgagacccagcagcugacgcaggagaucaaggccaaggccgugggguaccucaucaccggcuaccagcgccagcugaacuacaagcaccaggacggcuccuacagcaccuucggggagcgguacggccgcaaccaggggaacaccuggcugacggccuucguccucaagaccuucgcgcaggcccgguccuacaucuucaucgacgaggcccacaucacccagagccugaccuggcugucccagaugcagaaggacaacggcugcuuccgcagcuccgggagccuccugaacaacgccaucaagggcggcguggaggacgaggccacgcuguccgcguacgugaccaucgcccuccuggagaucccccugcccgucaccaacccgaucgugcgcaacgcccucuucugccuggagagcgccuggaacguggcgaaggaggggacccacggcagccacgucuacacgaaggcccugcucgccuacgccuucucccugcuggggaagcagaaccagaaccgggagauccucaacagccuggacaaggaggccgugaaggaggacaaccuggugcacugggagcgcccccagcggcccaaggcgccggucggccaccucuaccagacccaggcccccuccgccgagguggagaugaccagcuacgugcugcuggccuaccucaccgcccagcccgcgcccacguccggggaccugaccagcgccaccaacaucgucaaguggaucaugaagcagcagaacgcccagggcggcuucuccagcacccaggacacggugguggcccugcacgcccucucccgcuacggggcggccaccuucacccggaccgagaagaccgcccaggucacggugcaggacagccagaccuucuccaccaacuuccagguggacaacaacaaccugcugcuccugcagcagaucagccugccggagcuccccggcgaguacgucaucaccgugacgggggagcgcugcguguaccugcagaccuccaugaaguacaacauccugcccgagaaggaggacagccccuucgcccucaagguccagaccgugccgcagaccugcgacggccacaaggcccacacguccuuccagaucagccugaccaucuccuacaccggcaaccggcccgcgagcaacauggugaucgucgacgugaagaugguguccggguucaucccccugaagcccaccgucaagaugcucgagcgcagcagcuccgugagccggacggagguguccaacaaccacguccugaucuacguggagcaggucaccaaccagacccugagcuucuccuucauggugcuccaggacaucccggugggcgaccugaagcccgccaucgucaagguguacgacuacuacgagaccgacgagagcguggucgccgaguacaucgcccccugcuccacggacaccgagcacgggaacguguga

SEQ ID NO: 35336 - RNA, 2295 nt, Artificial Sequence
  derived and/or modified sequence opt1 from QARS__Homo_sapiens__NP_001259002
auggccgcccuggacagccucucccuguucaccagccugggccucuccgagcagaaggcgcgcgagacccugaagaacagcgcccuguccgcccagcuccgggaggccgccacgcaggcgcagcagacccuggggagcaccaucgacaaggccaccggcauccugcucuacgggcuggccucccgccugcgggacacgcgccggcucagcuuccugguguccuacaucgccaccgcgcuggaguacguccgcagccacccccucgacccgaucgacaccguggacuucgagcgggagugcggcgugggggucaucgugacccccgagcagaucgaggaggccguggaggccgccaucaaccgccaccggccccagcugcuggucgagcgcuaccacuucaacaugggccuccugaugggcgaggcccgggcggugcugaagugggccgacgggaagaugaucaagaacgagguggacaugcagguccuccaccuccugggccccaagcucgaggccgaccuggagaagaaguucaagguggccaaggcccgccuggaggagacggaccggcgcaccgcgaaggacguggucgagaacggggagaccgccgaccagacccucucccugauggagcagcugcggggcgaggcccucaaguuccacaagccgggggagaacuacaagacgcccggcuacguggugacgccccacaccaugaaccugcugaagcagcaccucgagaucaccggcgggcagguccgcacccgguucccgcccgagcccaacggcauccugcacaucgggcacgccaaggccaucaacuucaacuucggcuacgcgaaggccaacaacggcaucugcuuccugcgcuucgacgacaccaaccccgagaaggaggaggccaaguucuucaccgccaucugcgacaugguggccuggcucggguacacccccuacaaggugacguacgcgagcgacuacuucgaccagcuguacgccugggccgucgagcugauccggcgcggccucgccuacgugugccaccagcgcggggaggagcugaagggccacaacacccugccgucccccuggcgggaccgccccauggaggagagccuccugcuguucgaggcgaugcggaaggggaaguucuccgagggcgaggccacccuccgcaugaagcuggugauggaggacggcaagauggaccccgucgccuaccgggugaaguacaccccgcaccaccgcacgggggacaaguggugcaucuaccccaccuacgacuacacccacugccugugcgacagcaucgagcacaucacccacucccucugcacgaaggaguuccaggcccggcgcagcuccuacuucuggcugugcaacgcccuggacguguacugccccguccagugggaguacggccggcugaaccuccacuacgcgguggucagcaagcgcaagauccugcagcugguggccaccggggccgugcgggacugggacgacccccgccucuucacccugaccgcccugcggcgccggggcuucccgcccgaggccaucaacaacuucugcgcgcgcgucggggugacgguggcccagaccaccauggagccccaccuccuggaggccugcguccgggacgugcugaacgacaccgcgccccgcgccauggccgugcucgagagccugcgggucaucaucacgaacuucccggccgccaagucccuggacauccaggugcccaacuuccccgccgacgagaccaagggcuuccaccaggugcccuucgcgccgaucgucuucaucgagcgcaccgacuucaaggaggagcccgagcccggcuucaagcggcucgccugggggcagccggugggccugcgccacaccggguacgugaucgagcugcagcacgucgugaagggccccagcgggugcguggagucccucgaggugaccugccgccgggccgacgccggcgagaagcccaaggccuucauccacugggucagccagccccugaugugcgaggugcgccuguacgagcggcuguuccagcacaagaacccggaggaccccacggagguccccggcggguuccuguccgaccugaaccucgcgagccugcacgugguggacgccgcccuggucgacugcuccguggcccucgccaagcccuucgacaaguuccaguucgagcgccugggcuacuucagcguggacccggacucccaccaggggaagcuggucuucaaccggaccgugacccucaaggaggaccccggcaagguguga

SEQ ID NO: 35337 - RNA, 735 nt, Artificial Sequence
  derived and/or modified sequence opt1 from QDPR__Homo_sapiens__NP_000311
auggccgccgcggccgccgccggcgaggcccgccgggugcuggucuacgggggccgcggggcgcucggcagccggugcgugcaggccuuccgcgcccggaacugguggguggccuccgucgacgugguggagaacgaggaggcgagcgccuccaucaucgucaagaugaccgacagcuucaccgagcaggccgaccaggugacggccgagguggggaagcugcugggcgaggagaaggucgacgccauccucugcguggcgggcgggugggccggcgggaacgccaaguccaagagccuguucaagaacugcgaccugauguggaagcaguccaucuggaccagcaccaucuccagccaccucgccaccaagcaccugaaggagggcgggcugcucacgcuggccggcgcgaaggccgcccuggacggcacccccgggaugaucggcuacgggauggccaagggcgccgugcaccagcucugccagucccuggcgggcaagaacagcgggaugccgcccggcgccgccgccaucgccguccugcccgugacccucgacacccccaugaaccgcaaguccaugccggaggcggacuucagcuccuggacgccccuggaguuccugguggagaccuuccacgacuggaucaccgggaagaaccggcccagcuccggcagccucauccaggucgugaccacggaggggcgcaccgagcugacccccgccuacuucuga

SEQ ID NO: 35338 - RNA, 1002 nt, Artificial Sequence
  derived and/or modified sequence opt1 from QKI__Homo_sapiens__NP_001288014
auggugggcgagauggagaccaaggagaagcccaagccgacccccgacuaccugaugcagcucaugaacgacaagaagcugaugagcucccugcccaacuucugcgggaucuucaaccaccucgagcgccugcuggacgaggagaucagccggguccgcaaggacauguacaacgacacgcucaacggcuccaccgagaagcggagcgccgagcugcccgacgccguggggccgaucgugcagcugcaggagaagcucuacguccccgugaaggaguaccccgacuucaacuucgugggccgcauccuggggccccggggccugaccgcgaagcagcucgaggccgagaccggcugcaagaucaugguccgcgggaagggcuccaugcgggacaagaagaaggaggagcagaaccgcgggaagccgaacugggagcaccugaacgaggaccugcacgugcucaucacgguggaggacgcccagaaccgggccgagaucaagcugaagcgcgccgucgaggaggugaagaagcugcucgugcccgcggccgagggcgaggacagccugaagaagaugcagcugauggagcucgccauccugaacgggaccuaccgggacgccaacaucaagucccccaccgcgcaggccgcgccccgcaucaucaccggcccggcccccguccugccgcccgccgcccuccggacgcccacccccgccggccccaccaucaugccccugauccgccagauccagaccgccgugaugccgaacgggacgccccaccccaccgccgccaucgugcccccgggccccgaggcggggcugaucuacacccccuacgaguaccccuacacccucgccccggccacgagcauccuggaguaccccaucgagcccuccggcguccugggcgccguggccaccaaggugcggcgccacgacaugcggguccacccguaccagcgcaucgugaccgcggaccgggccgccaccgggaacuga

SEQ ID NO: 35339 - RNA, 1086 nt, Artificial Sequence
  derived and/or modified sequence opt1 from QPCT__Homo_sapiens__NP_036545
auggccggcgggcgccaccggcgcguggucggcacccugcaccuccugcugcucguggccgcgcugcccugggccagccgcgggguguccccgagcgccuccgccuggcccgaggagaagaacuaccaccagcccgccauccugaacagcuccgcgcuccggcagaucgccgagggcaccagcaucuccgagauguggcagaacgaccugcagccccugcucaucgagcgguacccggggagccccggcuccuacgccgcccgccagcacaucaugcagcggauccagcgccugcaggcggacuggguccuggagaucgacacguuccucagccagacccccuacggcuaccgguccuucagcaacaucaucuccacccugaaccccaccgccaagcgccaccuggugcucgccugccacuacgacagcaaguacuucucccacuggaacaaccggguguucgucggggccacggacagcgccgugccgugcgcgaugaugcuggagcuggcccgcgcccucgacaagaagcugcugucccucaagaccgugagcgacuccaagcccgaccugagccugcagcucaucuucuucgacggcgaggaggccuuccugcacuggagcccccaggacucccuguacgggagccggcaccucgccgcgaagauggccuccacgccccacccgcccggcgcccgcgggaccagccagcugcacggcauggaccugcucguccugcuggaccucaucggcgcccccaaccccaccuucccgaacuucuuccccaacuccgcccggugguucgagcgccugcaggcgaucgagcacgagcugcacgagcucgggcugcugaaggaccacagccucgagggccgguacuuccagaacuacuccuacgggggcgugauccaggacgaccacauccccuuccugcgccggggcgugcccguccugcaccucaucccgagccccuuccccgagguguggcacaccauggacgacaacgaggagaaccuggacgaguccaccaucgacaaccugaacaagauccuccagguguucguccuggaguaccugcaccucuga

SEQ ID NO: 35340 - RNA, 867 nt, Artificial Sequence
  derived and/or modified sequence opt1 from QPCTL__Homo_sapiens__NP_001156849
augcgcagcggcgggcggggccgcccccggcugcgccucggggagcggggccugauggagccgcugcucccgcccaagcgccggcugcugccccgcgugcggcuccugccccugcuccuggcccuggccgucggguccgcguucuacaccaucuggagcggcuggcaccgccggaccgaggagcucccccugggccgcgagcugcgggugccccucaucgggucccugcccgaggcccgccugcggcgcguggucggccagcucgacccgcagcggcuguggagcacguaccugcgcccccuccugguggugcggacccccgggucccccggcaaccugcagguccgcaaggccgccccggugacccuccagcugcuguuccucgacggggaggaggcccugaaggaguggggccccaaggacagccuguacggcucccggcaccucgcgcagcugauggagagcaucccccacucccccgggccgacccgcauccaggccaucgagcuguucaugcuccuggaccugcucggcgcccccaaccccacguucuacagccacuucccccgcaccgugcggugguuccaccgccugcgguccaucgagaagcgccugcaccggcucaaccugcugcagagccacccgcaggaggucauguacuuccagcccggggagcccuucggcuccguggaggacgaccacauccccuuccuccgccggggcgugccgguccugcaccugaucagcacccccuuccccgccguguggcacacccccgcggacacggaggugaaccuccacccgcccaccguccacaaccugugccgcauccuggccguguuccucgccgaguaccuggggcuguga

SEQ ID NO: 35341 - RNA, 894 nt, Artificial Sequence
  derived and/or modified sequence opt1 from QPRT__Homo_sapiens__NP_055113
auggacgccgagggccuggcccuccugcugcccccggugacccucgcggcccuggucgacagcuggcugcgcgaggacugccccgggcucaacuacgccgcccugguguccggcgccgggcccagccaggcggcccugugggccaagucccccggcgugcucgccgggcagccguucuucgacgcgaucuucacccagcugaacugccaggucagcugguuccugcccgagggcuccaagcucgugcccguggcccgggucgccgaggugcgcggccccgcccacugccugcugcucggggagcggguggcccugaacacgcuggcgcgcugcagcggcaucgccuccgccgccgccgcggccgucgaggccgcccgcggggccggcuggaccgggcacguggcgggcacccggaagaccacgccgggcuuccggcucguggagaaguacgggcugcuggucggcggggccgccagccaccgcuacgaccucggcggccuggugauggugaaggacaaccacgucguggccgccgggggcguggagaaggcgguccgggccgcccgccaggccgcggacuucgcccugaagguggagguggagugcuccagccuccaggaggccguccaggccgccgaggcgggggccgaccuggugcugcucgacaacuucaagcccgaggagcugcaccccaccgccaccgugcugaaggcccaguuccccuccgucgccguggaggcgagcggcgggaucacccucgacaaccugccgcaguucugcggcccccacaucgacgucaucuccaugggcaugcugacgcaggccgcccccgcccucgacuucagccugaagcuguucgccaaggagguggcgcccgugccgaagauccacuga

SEQ ID NO: 35342 - RNA, 411 nt, Artificial Sequence
  derived and/or modified sequence opt1 from QRFP__Homo_sapiens__NP_937823
auggugcgccccuacccgcugaucuacuuccucuuccugccccugggcgccugcuucccccuccuggaccggcgcgagcccaccgacgccaugggcgggcugggggcgggcgagcggugggccgaccucgccauggggccgcgcccccacagcgucuggggcuccagccgguggcugcgcgccucccagccccaggcccugcucgugaucgcgcggggccugcagaccagcgggcgcgagcacgccggcugccgguuccgcuucgggcggcaggacgagggcuccgaggccacgggguuccugcccgccgcgggcgagaagaccagcggcccgcucgggaaccuggccgaggagcugaacggcuacucccgcaagaagggcggguucagcuuccgguucggccgccgguga

SEQ ID NO: 35343 - RNA, 1296 nt, Artificial Sequence
  derived and/or modified sequence opt1 from QRFPR__Homo_sapiens__NP_937822
augcaggcccugaacaucacccccgagcaguucagccgccuccugcgggaccacaaccugacccgcgagcaguucaucgcccucuaccggcugcgcccgcugguguacacgcccgagcuccccggccgggcgaagcuggcccugguccucaccggggugcugaucuucgcccuggcccucuucggcaacgcccugguguucuacgucgugacccgcuccaaggcgaugcggaccgugacgaacaucuucaucugcagccuggcccucuccgaccugcugaucaccuucuucugcauccccgucaccaugcuccagaacaucagcgacaacuggcucgggggcgccuucaucugcaagauggugccguucgugcaguccaccgccgucgugacggagauccugaccaugaccugcaucgcgguggagcgccaccaggggcucguccaccccuucaagaugaaguggcaguacaccaaccggcgcgccuucacgaugcugggcgugguguggcuggucgccgugaucgugggcagccccauguggcacguccagcagcucgagaucaaguacgacuuccuguacgagaaggagcacaucugcugccuggaggaguggaccucccccgugcaccagaagaucuacaccaccuucauccucgugauccuguuccugcucccgcugauggucaugcugauccucuacagcaagaucggguacgagcuguggaucaagaagcgggugggcgacggguccgugcugcgcacgauccacggcaaggagaugagcaagaucgcccggaagaagaagcgcgccgucaucaugauggugaccgucguggcgcuguucgccgugugcugggcccccuuccacgucgugcacaugaugaucgaguacuccaacuucgagaaggaguacgacgacgugaccaucaagaugaucuucgccaucguccagaucaucggguucagcaacuccaucugcaaccccaucguguacgccuucaugaacgagaacuucaagaagaacgugcugagcgcggucugcuacugcaucgugaacaagaccuucucccccgcccagcggcacggcaacagcggcaucacgaugaugcgcaagaaggccaaguucucccugcgggagaacccgguggaggagaccaagggggaggccuucagcgacggcaacaucgaggucaagcucugcgagcagaccgaggagaagaagaagcugaagcgccaccuggcccucuuccgguccgagcuggcggagaacagcccccuggacagcgggcacuga

SEQ ID NO: 35344 - RNA, 1587 nt, Artificial Sequence
  derived and/or modified sequence opt1 from QRSL1__Homo_sapiens__NP_060762
augcugggccgcagccuccgggagguguccgccgcccugaagcaggggcagaucacccccaccgagcugugccagaagugccucagccugaucaagaagacgaaguuccugaacgcguacaucaccgucuccgaggagguggcccucaagcaggccgaggagagcgagaagcgcuacaagaacggccagucccugggggaccuggacggcaucccgaucgccgugaaggacaacuucagcaccuccgggaucgagaccacgugcgccagcaacaugcucaagggcuacaucccgcccuacaacgcgaccgucgugcagaagcugcuggaccagggcgcccuccugauggggaagaccaaccuggacgaguucgccaugggcuccgggagcaccgacggcguguucgggcccgucaagaaccccugguccuacagcaagcaguaccgggagaagcgcaagcagaacccccacuccgagaacgaggacagcgacuggcucaucacgggcggcuccagcgggggcuccgccgcggccgugagcgccuucacgugcuacgccgcccugggguccgacaccggcggcagcacccggaaccccgcggcccacugcgggcuggugggcuucaagcccagcuacgggcucgucucccgccacggccugaucccgcuggugaacagcauggacgugcccgggauccucacccggugcgucgacgacgccgccaucgugcugggcgcccuggcgggccccgacccccgcgacuccaccaccgugcacgagccgaucaacaagcccuucaugcuccccagccuggccgacgucuccaagcugugcaucgggauccccaaggaguaccucgugccggagcugagcuccgaggugcagagccugugguccaaggccgccgaccucuucgagagcgagggcgccaaggucaucgaggugucccugccccacaccagcuacuccaucgugugcuaccacguccugugcacgagcgagguggcguccaacauggcccgguucgacgggcuccaguacggccaccgcugcgacaucgacgugagcaccgaggccauguacgccgccacccggcgcgagggguucaacgacgucgugcggggccgcauccuguccggcaacuucuuccugcucaaggagaacuacgagaacuacuucgucaaggcgcagaaggugcggcgccugaucgccaacgacuucgugaacgccuucaacagcggggucgacgugcugcucacccccacgacccuguccgaggccgugcccuaccuggaguucaucaaggaggacaaccggacccgcagcgcgcaggacgacaucuucacccaggccgucaacauggccggccucccggccgugagcauccccguggcccuguccaaccaggggcugcccaucggccuccaguucaucgggcgggcguucugcgaccagcagcugcugacggucgccaagugguucgagaagcagguccaguuccccgugauccagcuccaggagcugauggacgacugcagcgccgugcuggagaacgagaagcuggccuccgugagccucaagcaguga

SEQ ID NO: 35345 - RNA, 1815 nt, Artificial Sequence
  derived and/or modified sequence opt1 from QSOX1__Homo_sapiens__NP_001004128
augcgccggugcaacagcggcagcgggcccccgcccagccugcuccugcugcuccuguggcugcucgccgugcccggcgccaacgcggcgccccgcuccgcccuguacagcccguccgacccccugacccuccugcaggccgacaccguccgcggggccgugcugggcagccgguccgccugggccguggaguucuucgccagcuggugcgggcacugcaucgccuucgcgcccaccuggaaggcccucgccgaggacgucaaggccuggcggcccgcccuguaccuggcggcccucgacugcgccgaggagaccaacuccgccgugugccgcgacuucaacaucccgggcuuccccaccgugcgguucuucaaggccuucaccaagaacggcagcggggcggucuuccccguggccggcgccgacgugcagacgcugcgcgagcggcugaucgacgcccucgagucccaccacgacaccuggcccccggccugcccgccccuggagcccgcgaagcuggaggagaucgacggguucuucgcccgcaacaacgaggaguaccucgcccugaucuucgagaagggcgggagcuaccugggccgggaggucgcccucgaccugucccagcacaagggcguggccgugcgccggguccugaacaccgaggcgaacguggugcgcaaguucggggucaccgacuuccccagcugcuaccuccuguuccggaacggcuccgugagccgcgugcccguccugauggagucccggagcuucuacacggccuaccuccagcgccuguccgggcugacccgggaggccgcccagaccaccguggcgcccacgaccgccaacaagaucgcccccaccguguggaagcucgccgaccgcagcaagaucuacauggccgaccuggagagcgcgcugcacuacauccuccggaucgaggucggccgcuucccggugcuggagggccagcgccugguggcccucaagaaguucgucgccgugcuggccaaguacuuccccgggcggccccugguccagaacuuccuccacuccgugaacgaguggcugaagcgccagaagcggaacaagauccccuacagcuucuucaagaccgcccuggacgaccgcaaggagggcgcggugcucgccaagaaggucaacuggaucgggugccagggcuccgagccgcacuuccggggguuccccugcagccugugggugcuguuccacuuccucacggugcaggccgcccgccagaacgucgaccacucccaggaggccgcgaaggccaaggaggugcugcccgccauccggggcuacgugcacuacuucuucggcugccgcgacugcgccagccacuucgagcagauggcggccgccuccaugcaccgggucgggagccccaacgccgccgugcuguggcugugguccagccacaaccgcgugaacgcgcggcucgccggcgccccguccgaggacccccaguuccccaagguccaguggccgccccgcgagcugugcagcgccugccacaacgagcggcuggacgugcccgugugggacgucgaggccacccucaacuuccugaaggcgcacuucucccccagcaacaucauccuggacuucccggccgccggguccgccgcccgccgggacgugcagaacguggcggccgcccccgagcucgccaugggcgcgcuggagcuggagagccgcaacuccacccucgaccccgggaagcccgagaugaugaaguccccgaccaacacgacgccccacguccccgccgagggccccgagcugaucuga

SEQ ID NO: 35346 - RNA, 2097 nt, Artificial Sequence
  derived and/or modified sequence opt1 from QSOX2__Homo_sapiens__NP_859052
auggccgccgcgggcgccgccguggcccgcagccccgggaucggcgccgggccggcgcugcgggcccgccgguccccgccgccccgcgccgcccggcucccccgccugcugguccuccuggcggccgccgccgugggccccggggccggcggcgcggcccggcuguaccgcgccggggaggacgccguguggguccucgacagcggcuccgugcgcggggccaccgcgaacagcuccgccgccuggcuggugcaguucuacagcuccuggugcggccacugcaucggguacgcccccaccuggcgggcccuggcgggcgacguccgggacugggccagcgccauccgcguggccgcccucgacugcauggaggagaagaaccaggcggugugccacgacuacgacauccacuucuaccccacguuccgguacuucaaggccuucaccaaggaguucaccaccggcgagaacuucaaggggcccgaccgcgagcugcggacgguccgccagaccaugaucgacuuccugcagaaccacaccgagggcucccggccgcccgccugcccccgccucgaccccauccagcccagcgacgugcugucccugcucgacaaccgggggagccacuacguggccaucgucuucgaguccaacagcuccuaccugggccgcgaggugauccuggaccucauccccuacgagagcaucguggucacccgggcgcuggacggcgacaaggccuuccuggagaagcucgggguguccagcgugcccuccugcuaccugaucuacccgaacggcagccacgggcugaucaacgucgugaagccccuccgcgccuucuucagcuccuaccucaagagccugcccgacgugcgcaagaagucccucccccugccggagaagccccacaaggaggagaacagcgagaucgucguguggcgggaguucgacaaguccaagcuguacacgguggaccucgagagcggccugcacuaccugcuccgcgucgagcuggccgcccacaagucccuggcgggggccgagcucaagacccugaaggacuucgugaccguccuggccaagcuguuccccggccggcccccggugaagaagcugcuggagaugcuccaggaguggcuggccagccugccccucgaccgcauccccuacaacgccgugcuggaccuggucaacaacaagaugcggaucuccggcaucuuccucaccaaccacaucaaguggguggggugccagggcagccgcuccgagcugcggggguaccccugcagccuguggaagcuguuccacacgcucaccguggaggcguccacccacccggacgcccuggucggcaccggguucgaggacgacccccaggccgugcugcagacgaugcgccgguacgugcacaccuucuucggcugcaaggagugcggcgagcacuucgaggagauggccaaggagagcauggacuccgucaagacccccgaccaggccauccucuggcuguggaagaagcacaacauggugaacgggcgccuggcgggccaccucagcgaggacccgcgguuccccaagcugcaguggcccacccccgaccugugcccggccugccacgaggagaucaaggggcucgccuccugggacgagggccacgugcugacguuccugaagcagcacuacgggcgcgacaaccuccuggacaccuacagcgccgaccagggcgacuccagcgagggcgggacccuggcgcggggcgaggaggaggagaagcgccucaccccgcccgaggucagccacggggaccgggacacgcaguccgugcgcccgcccggcgcccugggcccccggcccgcccugcccgagagccuccaccacucccuggacgggaagcugcagagccucgacggccccggggcccacaaggaggugggcggggccgcgcccuuccugggcgucgacuucuccagccuggacaugucccucugcguggugcuguacgucgccagcucccuguuccucauggugauguacuucuucuuccgcgugcggagccgccgcuggaaggucaagcaccaccaccccgccguguga

SEQ ID NO: 35347 - RNA, 1212 nt, Artificial Sequence
  derived and/or modified sequence opt1 from QTRT1__Homo_sapiens__NP_112486
auggccggcgccgcgacccaggccagccuggaguccgcgccccgcaucaugcggcucguggccgagugcagccgcucccgggcccgcgccggggagcuguggcugccgcacggcaccgucgccacgcccguguucaugcccguggggacccaggccaccaugaagggcaucaccacggagcagcucgacgcccuggggugccggaucugccugggcaacaccuaccaccucggccugcgccccgggccggagcugauccagaaggcgaacggccuccacggguucaugaacuggccccacaaccugcugaccgacagcggcggguuccagauggucucccucgugagccuguccgaggugaccgaggagggcguccgguuccgcagccccuacgacggcaacgagacgcugcucucccccgagaaguccgugcagauccagaacgcccuggggagcgacaucaucaugcagcuggacgacguggucagcuccaccgugaccggcccgcggguggaggaggccauguaccgcagcauccgguggcucgaccgcugcaucgccgcccaccagcggcccgacaagcagaaccuguucgcgaucauccagggcgggcuggacgccgaccuccgcgcgaccugccuggaggagaugacgaagcgggacguccccggcuucgccaucgggggccuguccgggggcgagagcaagucccaguucuggcgcaugguggcccucagcaccucccggcugcccaaggacaagccgcgcuaccugaugggggugggcuacgccaccgaccucgucgugugcguggcccugggcugcgacauguucgacugcgucuuccccacccggacggcccgcuucgggagcgcccuggugcccaccggcaaccuccagcugcggaagaagguguucgagaaggacuucgggcccaucgacccggagugcacgugcccgaccugccagaagcacagccgcgccuuccugcacgcgcuccugcacuccgacaacaccgccgcccugcaccaccucaccguccacaacaucgccuaccagcugcagcugaugagcgccgugcgcaccuccaucguggagaagcgguuccccgacuucguccgcgacuucaugggcgcgauguacggggaccccacccucugccccacgugggccaccgacgcccuggccagcgugggcaucacccugggcuga

SEQ ID NO: 35348 - RNA, 1323 nt, Artificial Sequence
  derived and/or modified sequence opt1 from R3HCC1__Homo_sapiens__NP_001129580
auggcccugcucugccuggacggcguguuccugagcuccgccgagaacgacuucguccaccgcauccaggaggagcucgaccgguuccugcugcagaagcagcucagcaaggugcugcuguucccgccccucuccagccgccugcgguaccugauccaccgcaccgcggagaacuucgaccuccuguccagcuucuccgugggggagggcuggaagcggcgcaccgucaucugccaccaggacauccgggugcccagcuccgacgggcugagcggccccugccgcgcccccgccuccugcccgagccgguaccacgggccccgccccaucuccaaccagggcgccgccgcggugccccggggcgcccgcgccgggcggugguaccgcggccggaagccggaccagccccucuacgucccccgcgugcugcggcgccaggaggagugggggcugacgagcaccuccgugcucaagcgggaggcccccgcgggccgcgacccggaggagcccggggacgucggcgccggcgaccccaacagcgaccaggggcugcccgugcugaugacccagggcaccgaggaccucaaggggccgggccagcggugcgagaacgagccccugcuggaccccgugggccccgagccgcucgggcccgagucccagagcggcaagggggacauggucgagauggccacgcgcuucggcuccacccugcagcuggaccucgagaaggggaaggagagccugcuggagaagcgccucguggccgaggaggaggaggacgaggaggagguggaggaggacggccccagcuccugcagcgaggacgacuacuccgagcugcugcaggagaucaccgacaaccucaccaagaaggagauccagaucgagaagauccaccuggacacgagcuccuucgucgaggagcugcccggcgagaaggaccucgcccacgugguggagaucuacgacuucgagccggcgcugaagaccgaggaccugcucgccaccuucagcgaguuccaggagaagggguuccggauccagugggucgacgacacccacgcccugggcaucuuccccugccuggccuccgccgcggaggcccucacgcgcgaguucagcgugcugaagauccggccccugacccaggggaccaagcaguccaagcucaaggcccugcagcgccccaagcugcuccggcuggugaaggagcgcccgcagaccaacgccacggucgcccggcgccugguggcgcgggcccugggccuccagcacaagaagaaggagcgccccgccgugcgggggccccugccgcccuga

SEQ ID NO: 35349 - RNA, 2379 nt, Artificial Sequence
  derived and/or modified sequence opt1 from R3HCC1L__Homo_sapiens__NP_001243548
augcagcaggagagcgagcgcugccgggugcgcgcccggcgccccgacauggcccuguacgucccgaaggcgcggcgcggcgccgugcuccugaagaccggggacgaggaggaguccugcggcagccccaacuccguggucaaggagaagcagaaggagagcucccugagccagaaggagguguucaaggacaagcccgaggcccggcgccucaacaucaaccccgaccggaaggagcacaacugccgcgaggagaagaaguccagcaccaagcugcggauggacacgugccugcagaagaccaaccgcgugugcuccaagcgggggaccaccgagagcaaggagguccucucccagggccagcagcagggggccccgaacgccggcgugaucacgaacgcgccccugcagcgccacuucaagcccaagaagguggagugccuggaggucgagaccaccgacgugaccggccacgagcggauccuccugagccaggccugccuggagaucuccgaggcccaggugcccagcaagccguuccagaacgucgaguucugcgacuucucccgccacgagcccgacggggaggccuucgaggacaaggaccucgagggccggaucgagacggacaccaaggugcuggagauccuguacgaguucccccgcguguucagcuccgucaugaagcccgagaacaugaucgugccgaucaagcucagcuccgacagcgagaucgugcagcagagcaugcagaccuccgacgggauccugaaccccagcuccggcgggaucaccacgaccagcguccccggcucccccgacggcguguucgaccagaccugcguggacuucgaggucgagagcgucgggggcaucgcgaacuccaccggguucauccuggaccagaaggacacggacagcaucccggccaccaugggccacaucucccucagcgaguccaccaacgacaccgugagccccgugaugauccgggagugcgagaagaacgacuccacggccgacgagcugcacgugaagcacgagccgcccgacaccgccguccuggcccacgagacccaccgcgacagcggcuucaagaacgugggggacaucaccaacaaggcgugcaugauggacacgaccggcauguccugcagcgaccacgugaccgucgacucccccuacgugguggccguccggaucgccgacgagaccagcaucaacacgcgcuccuucagcaaguucguggggaugagcgccgacgccacgccccuccacguggcgcgcuccggcaacgacaccgaggacuucagcaaccccuccgccugcagcgacaucuacggggaguccaucagcucccacuucaccgagagcacgggcaagcugaucgagucccugagcgacugcgccuccagccuccccaucaagaagaucgccggcuccaacuacaacaccuuccuggacagcgagcuguccaugcucaacgggaccaagguccugagcgacuccgccgugggcaucgaccuggggagcaccggcgacacgaccgaggcgcuccacgagcugcggaccgccgaggaguucaagaccgaggagcaggacgacagcggguccaucgaguucggcgugagcuucccggaccgcgaguccagcuccauggagaccagcaucgagcccaaggccacggagaccucccacaccgagggcaucaccgccaucgaggagagcugggaguccauguucaacgacgacggggacugccuggacccccggcuccugcaggagggcauccugaugcacaucaagcccgagaaccacugcagcaagcucuccgggaacaccaagagccgcgaguccauccaggagccgcggagcgacuacuacaaccacgagguccccgacaucgaccuguccgacugcgaguucccccacgugaucgagaucuacgacuucccgcaggaguuccgcaccgaggaccugcuccggguguucugcagcuaccagaagaagggcuucgacaucaagugggucgacgacacccacgcccuggggguguucuccagccccaucaccgcgcgcgacgcccugggcaucaagcacacgauggugaagauccggccccucucccaggccacccgcgccgcgaaggccaaggcccgggccuacgccgaguuccugcagcccgcgaaggagcgcccggagaccagcgccgcccuggcccggcgccucgucaucagcgcccugggcgugcgguccaagcagagcaagaccgagcgcgaggcggagcugaagaagcuccaggaggcccgggagcgcaagcggcuggaggccaagcagcgcgaggacaucugggaggggcgcgaccaguccacgguguga

SEQ ID NO: 35350 - RNA, 2916 nt, Artificial Sequence
  derived and/or modified sequence opt1 from R3HDM1__Homo_sapiens__NP_001269728
augcgcaugagcgacaccgugaccgucaaggacgagacggccaccaugaaggaccuggaggccgaggugaaggacaccacccggguggagaaccucaucaaguccgagaacuacggcaagauccuggucgagaagaacgagcacugcaucgagaacaacaucgaccugcaggagaagauccagauccagcucacgcagagcuucgagaaggaggagaagcccuccaaggacgaggccgagaaggagaaggccagcgacaagcugccccgcaagaugcugucccgggacagcucccaggaguacaccgacagcaccgggaucgaccuccacgaguuccuggugaacacccugaagaacaacccccgcgaccggaugaugcuccugaagcuggagcaggagauccucgacuucaucggcaacaacgagagcccccgcaagaaguucccgcccaugacgagcuaccaccggaugcugcugcaccgcguggccgccuacuucgggcucgaccacaacgucgaccaguccggcaagagcgugaucgugaacaagaccuccaacacccggauccccgaccagaaguucaacgagcacaucaaggacgacaagggggaggacuuccagaagcgcuacauccugaagcgggacaacagcuccuucgacaaggacgacaaccagaugcgcauccggcugaaggacgaccgccggagcaaguccaucgaggagcgcgaggaggaguaccagcgggcccgcgaccggaucuucagccaggacucccucugcagccaggagaacuacaucaucgacaagcgccugcaggacgaggacgcgagcuccacccagcagcggcgccagaucuuccgcgucaacaaggacgccagcggccgguccacgaacagccaccaguccagcaccgagaacgagcugaaguacuccgagccccgccccuggagcuccaccgacagcgacuccagccuccggaaccugaagcccgccgugaccaaggccuccagcuucuccggcaucagcgugcugacgcgcggggacuccagcggcuccagcaagagcaucgggcggcucuccaagaccggccagcccuucaucaaccccgacgggagccccgucguguacaacccgcccaugacccagcagcccgugcgcucccagguccccggcccgccccagccgccccugcccgcgccgccccagcagcccgccgccaaccacaucuucagccagcaggacaaccugggcucccaguucagccacaugucccucgcccggcagcccagcgccgacggguccgacccccacgcggccauguuccagagcaccguggugcugcagagcccccagcaguccggcuacaucaugacggccgcgcccccgccccacccgcccccgccgcccccgccgcccccgcccccgccgccccugccgcccgggcagcccguccccaccgccggcuaccccgcguccggccaccccgugagccagcccgugcuccagcagcagggguacauccagcagcccagcccccagaugcccgccugcuacugcgcccccggccacuaccacuccucccagccccaguaccgccccguccccagcgugcacuacaacagccaccugaaccagccccugccccagcccgcccagcagaccggguaccaggugauccccaaccagcagcagaacuaccagggcaucgucggggugcagcagccccagucccagagccucgucuccggccagcccaacagcaucggcaaccagauccaggggguggugauccccuacaccuccguccccacguaccaggugagccugccccagggcucccaggggaucccccaccagaccuaccagcagcccgugauguuccccaaccagagcaaccagggcuccaugcccaccaccgggaugcccgucuacuacagcgugaucccgcccggccagcagaacaaccuguccagcuccgugggcuaccuccagcaccccgggagcgagcagguccaguucccccggacgaccucccccugcagcucccagcagcugcagggccaccagugcaccgccgggccgccgcccccgcccggcgggggcauggugaugaugcagcugagcgugcccaacaacccccaguccugcgcgcacuccccgccccaguggaagcagaacaaguacuacugcgaccaccagcgcggccagaagugcgucgaguucagcuccguggacaacaucgugcagcacagcccccagcucuccagcccgaucaucucccccgcccagagccccgccccggcccagcuguccacccugaagacgguccggcccagcgggccgccccucuccaucaugccgcaguucagccgccccuucgugcccggccagggggacucccgguacccccugcugggccagccgcuccaguacaacccgcccgccgugcugcacggccacauccccaaccagcaggggcagccgggcagccgccacgggaaccggggccgccggcaggcgaagaaggccgccuccaccgaccugggggccggcgagaccgucgugggcaaggugcucgagaucaccgagcugcccgacgggaucacgcgcauggaggcggagaagcuguucggcgagcuguucaagaucggggccaagauccgguggcuccgcgacccccagagccagccccgccggcacccgcugugcugcggcuccggggacaacaccgccaaccccgagcgcagcaagcccuccgaccuggccagcaccuacaccguccucgccaccuuccccuccaucagcgcggcccagaacgcccugaagaagcagaucaacagcgugaacaaguucaagcugcggacguccaagaagcacuacgacuuccacauccucgagcgcgccagcucccaguga

SEQ ID NO: 35351 - RNA, 762 nt, Artificial Sequence
  derived and/or modified sequence opt1 from R3HDML__Homo_sapiens__NP_848586
augccccugcugccgagcaccgugggccuggccgggcuccuguucugggccggccaggcggucaacgcccugaucaugcccaacgccacccccgcccccgcccagccggaguccaccgcgaugcgccugcucagcgggcuggaggugccccgguaccgccggaagcgccacaucuccgugcgggacaugaacgcccugcucgacuaccacaaccacauccgcgccagcgucuacccgcccgccgcgaacauggaguacauggugugggacaagcggcuggcccgcgccgccgaggccugggcgacccagugcaucugggcccacggccccucccagcugaugcgguacguggggcagaaccucagcauccacuccggccaguaccgcagcgucguggaccugaugaaguccuggagcgaggagaaguggcacuaccuguuccccgcgccccgggacugcaacccccacugcccguggcgcugcgacggccccacgugcucccacuacacccagauggugugggccagcuccaaccggcucgggugcgccauccacacgugcagcuccaucagcgucuggggcaacaccuggcaccgcgccgccuaccuggugugcaacuacgccaucaaggggaacuggaucggcgagucccccuacaagauggggaagcccugcagcuccugcccgcccagcuaccagggcagcugcaacuccaacaugugcuucaagggccucaagagcaacaaguucaccugguucuga

SEQ ID NO: 35352 - RNA, 468 nt, Artificial Sequence
  derived and/or modified sequence opt1 from RAB11A__Homo_sapiens__NP_001193765
augggcacccgcgacgacgaguacgacuaccuguucaaggugguccugaucggggacagcggcguggggaaguccaaccugcugagccgguucacccgcaacgaguucaaccucgaguccaagagcacgaucggcguggaguucgccacccgguccauccaggucgacgggaagaccaucaaggcccagaucugggacaccgcgggccaggagcgcuaccgggccaucacgagcgccuacuaccgcggcgccgugggggcccugcugguguacgacaucgcgaagcaccucaccuacgagaacgucgagcgguggcugaaggagcugcgcgaccacgccgacuccaacaucgugaucaugcucgugggcaacaagagcgaccugcggcaccuccgcgccguccccaccgacgaggcccgggcguucgccgagaagaacgaggccaacgugcgccagacccggaaguga

SEQ ID NO: 35353 - RNA, 657 nt, Artificial Sequence
  derived and/or modified sequence opt1 from RAB11B__Homo_sapiens__NP_004209
augggcacccgcgacgacgaguacgacuaccuguucaaggugguccucaucggggacagcggcguggggaaguccaaccugcugagccgguucacccgcaacgaguucaaccucgaguccaagagcacgaucggcguggaguucgccacccgguccauccaggucgacgggaagaccaucaaggcccagaucugggacaccgcgggccaggagcgcuaccgggccaucacgagcgccuacuaccgcggcgccgugggggcccugcugguguacgacaucgcgaagcaccucaccuacgagaacgucgagcgguggcugaaggagcugcgcgaccacgccgacuccaacaucgugaucaugcucgugggcaacaagagcgaccugcggcaccuccgcgccguccccaccgacgaggcccgggcguucgccgagaagaacaaccuguccuucaucgagaccagcgcccuggacuccacgaacguggaggaggccuucaagaacauccugaccgagaucuaccgcaucgugagccagaagcagaucgccgaccgggcggcccacgacgagucccccgggaacaacgucguggacaucagcgugccgcccaccaccgacggccagaagcccaacaagcuccagugcugccagaaccuguga

SEQ ID NO: 35354 - RNA, 3852 nt, Artificial Sequence
  derived and/or modified sequence opt1 from RAB11FIP1__Homo_sapiens__NP_001002814
augagccugaugguguccgccggccgcgggcucggcgccgucuggagccccacccacgugcaggugaccguccugcaggcgcgggggcugcgcgccaagggcccggggggcacguccgacgccuacgccgugauccaggugggcaaggagaaguacgccaccagcgucuccgagcggagccucggggcgcccguguggcgcgaggaggccaccuucgagcugcccucccugcucagcuccggccccgccgccgcggccacccugcagcugacggugcuccaccgggcccugcuggggcucgacaaguuccugggccgcgccgaggucgaccugcgggaccuccaccgcgaccaggggcggcgcaagacccagugguacaagcugaagagcaagccgggcaagaaggacaaggagcggggcgagaucgagguggacauccaguucaugcgcaacaacaugaccgccuccauguucgaccugagcaugaaggacaagucccggaaccccuucgggaagcucaaggacaagaucaagggcaagaacaaggacagcggguccgacaccgcgagcgccaucauccccuccacgacccccagcguggacuccgacgacgagagcgucgugaaggacaagaagaagaagagcaagaucaagacccugcuguccaagagcaaccuccagaagaccccgcugucccagagcauguccgugcugcccacgagcaagcccgagaagguccuccugcgccccggcgacuuccagucccagugggacgaggacgacaacgaggacgagagcuccagcgccuccgacgugaugagccacaagcggaccgccuccaccgaccugaagcagcucaaccaggugaacuucacccugccgaagaaggagggccugagcuuccucgggggccugcgcuccaagaacgacguccugagccgguccaacgugugcaucaacgggaaccacguguaccucgagcagcccgaggccaagggcgagaucaaggacagcucccccagcagcucccccagcccgaagggguuccgcaagaagcaccuguucuccagcacggagaaccuggcggccggcuccuggaaggagcccgccgagggcgggggccucagcuccgaccggcagcugagcgaguccagcaccaaggacucccugaagagcaugacccuccccuccuaccgccccgccccgcuggucagcggggaccugcgggagaacauggcccccgcgaacuccgaggccaccaaggaggccaaggagagcaagaagcccgagucccgccgcagcagccuccugucccugaugacgggcaagaaggacguggccaaggggagcgagggcgagaacccccucaccgugccgggccgggagaaggaggggaugcugaugggcgucaagcccggggaggacgccuccggccccgcggaggaccuggugcgccggagcgagaaggacaccgccgccgucgugucccgccaggggagcucccucaaccuguucgaggacgugcagaucaccgagcccgaggccgagccggagagcaaguccgagccccggcccccgaucagcuccccccgcgcgccccagacgcgggccgucaagccccgccuggaggugagcccggaggcccagcccaccgcccggcugcccucccccaccgacagcccguccagccuccccccccugcccuccagcuccggccaggccagcgugccgagcgagcugggccacggggcggacacccaguccagcgagucccccagcgucuucuccagccucuccagccccaucgccgcccccaucuccacgagcaccccgaucgaguccuggccccugguggaccgcggccaggccaagagcgaggggcccccccugcucccgaaggccgagcugcagaccgagucccugacccccgugcccaacagcggcuccagcgcgcucggcucccuguucaagcagcccagcuucccggccaacaaggggacggaggacucccugaugggccggacccgcgagaccgggaccgagaagaacacgagcagccucgagcuggaggagucccugcccgagcagcccgagaccggccggcaggaggaggagcucccgcgcuuccccugcaagaagcaggacuacagccccuccagcggggaggcccaggagguccccuucgcccugucccugagcuccgacggcgccgugagcccggugggcgagcucgcggccgggggcgaccgggaccuggagucccaggccgggagccuggucgaguccaaggcccgcgacgcggccgaggagguggcccccccccuccccaugggcgccagcgugccguccaucgacagcaugaugcggaagcuggaggagauggggcugaaccuccgcaaggaccagaagaagaccaagaagcgggucuccuucagcgagcagcuguucaccgaggaggccguggcgggcgccgcccugcucguggagggccacuccagcugcccccaggagcugaaccccgccugguccgucgccgggaacgcgagcgacggcgagcccccggagagcccccacgccgaggacuccgagcgcgagagcgugaccacgcccgggcccgccaccugcggcgccccggccucccccgcggaccaccugcuccugcccagccaggaggaguccuucagcgaggugcccauguccgaggccagcuccgccaaggacaccccgcuguuccgcauggagggggaggacgcccucgucacccaguaccagagcaaggcguccgaccacgagggccugcugagcgacccccucuccgaccugcagcuggugagcgacuucaagucccccaucauggccgaccucaaccugagccugcccuccaucccggagguggccagcgacgacgagcggaucgaccaggucgaggacgacggcgaccagguggaggacgacggggagacggccaaguccagcacccucgacaucggcgcccugagccuggggcucgugguccccugccccgagcgcggcaaggggcccuccggcgaggcggaccggcuggugcugggcgaggggcucugcgacuuccgccugcaggccccgcaggccagcgugaccgcccccuccgagcagaccacggaguucggcauccacaagccccaccuggggaagagcuccagccucgacaagcagcugccgggccccuccggcggggaggaggagaagcccaugggcaacgggagccccuccccgccccccggcaccagccuggacaaccccgucccgucccccagccccuccgagaucuuccccgugacccacagcuucccguccagcgcccacuccgacacccaccacacgagcaccgcggagucccagaagaaggccaccgccgaggggagcgccggccggguggagaacuucggcaagcgcaagccccuccugcaggccugggucagccccuccgagacccaccccgugagcgcgcagccgggggccggcacgggguccgccaagcaccggcugcaccccgugaagcccaugaacgccauggccaccaaggucgcgaacugcagccucggcaccgccaccaucaucuccgagaaccugaacaacgaggugaugaugaagaaguacagccccuccgacccggccuucgccuacgcgcagcugacgcacgacgagcucauccagcuggugcugaagcagaaggagaccaucagcaagaaggaguuccagguccgcgagcucgaggacuacaucgacaaccugcuggugcgggugauggaggagacccccaacauccuccgcauccccacccaggucgggaagaaggccggcaagauguga

SEQ ID NO: 35355 - RNA, 1539 nt, Artificial Sequence
  derived and/or modified sequence opt1 from RAB11FIP2__Homo_sapiens__NP_055719
augaugcugagcgagcaggcccagaagugguuccccacccacgugcaggucaccgugcuccaggccaaggaccugaagccgaagggcaaguccgggacgaacgacaccuacaccaucauccagcugggcaaggagaaguacagcaccuccguggcggagaagacgcucgagcccgucuggaaggaggaggccagcuucgagcugcccgggcugcucauccagggcucccccgagaaguacauccuguuccugaucgugaugcaccgcagccucguggggcuggacaaguuccugggccaggucgccaucaaccucaacgacaucuucgaggacaagcagcggcgcaagaccgagugguuccggcuggaguccaagcagggcaagcgcaucaagaaccgcggggagaucaaggugaacauccaguucaugcggaacaacaugaccgccagcauguucgaccuguccaugaaggacaagacccggagcccguucgccaagcucaaggacaagaugaagggccgcaagaacgacgggacguucuccgacaccagcuccgcgaucauccccagcacccacaugcccgacgccaacuccgaguucagcuccggcgagauccagaugaaguccaagcccaagaagccguuccugcuggggccccagcggcucuccagcgcccacagcauguccgaccugagcggcucccacaugagcuccgagaagcugaaggccggcaccaucgggcagacgcaccuccugggccaccagcuggacagcuucgggaccgugcccgaguccggcagccucaagagcccccaccgccggacccugagcuucgacaccuccaagaugaaccagccggacagcaucgucgacgagggcgagcugugcuucgggcgccagaacgaccccuucacgaacgugaccgcgucccucccccagaaguucgccacccugccccggaagaagaacccguucgaggagagcuccgagaccugggacagcuccaugaaccuguucagcaagcccaucgagauccgcaaggagaacaagcgggagaagcgcgagaaggugucccucuucgagcgggucacgggcaagaaggacagccgccggagcgacaagcugaacaacgggggcuccgacagccccugcgaccugaagucccccaacgccuucagcgagaaccgccaggacuacuucgacuacgaguccaccaacccguucaccgccaaguuccgggccagcaacaucaugcccuccagcuccuuccacaugagccccaccuccaacgaggaccuccgcaagauccccgacagcaacccguucgacgcgacggccggguaccgcucccugaccuacgaggaggugcugcaggagcucgugaagcacaaggagcugcugcggcgcaaggacacccacauccgggagcucgaggacuacaucgacaaccugcugguccgcgugauggaggagacccccagcauccuccgggugcccuacgagcccucccgcaaggccggcaaguucagcaacuccuga

SEQ ID NO: 35356 - RNA, 1383 nt, Artificial Sequence
  derived and/or modified sequence opt1 from RAB11FIP3__Homo_sapiens__NP_001135744
augcccuuccugaaggccaacgaggugaccgacagcgccuacaugggcuccgagagcaccuacuccgagugcgagacguucaccgacgaggacaccagcacccucguccacccggagcugcagcccgagggggacgcggacuccgccggcgggagcgccgugcccuccgagugccuggacgccauggaggagcccgaccacggcgcccuccugcugcucccggggcgcccccacccccacggccagagcgugaucacggucaucggcggggaggagcacuucgaggacuacggcgagggguccgaggcggagcugagccccgagacccugugcaacggccagcucgggugcuccgacccggccuuccugacccccagccccaccaagcggcuguccagcaagaagguggcccgcuaccuccaccaguccggcgcccugacgauggaggcgcuggaggaccccagcccggagcucauggagggccccgaggaggacaucgccgacaagguggucuuccuggagcggcgcgugcuggagcucgagaaggacaccgccgccaccggggagcagcacucccggcugcgccaggagaaccugcagcucgugcaccgggccaacgcgcuggaggagcagcugaaggagcaggagcuccgcgccugcgagaugguccuggaggagacccggcgccagaaggagcugcucugcaagauggagcgggagaaguccaucgagaucgagaaccugcagacgcgccugcagcagcucgacgaggagaacagcgagcugcggagcugcacccccugccugaaggccaacaucgagcgccucgaggaggagaagcagaagcugcuggacgagaucgagagccucacccugcggcuguccgaggagcaggagaacaagcgccggaugggcgaccgccucagccacgagcggcaccaguuccagcgcgacaaggaggccacccaggagcugaucgaggaccugcggaagcagcucgagcaccuccagcugcugaagcuggaggccgagcagcgccgcgggcgguccagcuccaugggccugcaggaguaccacagccgcgcgcgggaguccgagcucgagcaggaggugcgccggcugaagcaggacaaccgcaaccugaaggagcagaacgaggagcugaacggccagaucaucacgcucagcauccagggggccaagucccuguucagcaccgccuucuccgagagccuggccgccgagaucuccagcgugucccgggacgagcucauggaggcgauccagaagcaggaggagaucaacuuccgccugcaggacuacaucgaccggaucaucgucgccaucauggagaccaaccccagcauccuggaggugaaguga

SEQ ID NO: 35357 - RNA, 1914 nt, Artificial Sequence
  derived and/or modified sequence opt1 from RAB11FIP4__Homo_sapiens__NP_116321
auggccggcggggccggcuggagcggggcgcccgccgcccugcuccgcuccgugcggcgccugcgggaggucuucgaggugugcggccgcgacccggacggguuccugcggguggagcgcgucgccgcccucggccugcgguucggccagggggaggagguggagaagcuggugaaguaccucgaccccaacgaccugggccgcaucaacuucaaggacuucugccgcggggucuucgcgaugaagggcugcgaggagcugcucaaggacgugcugagcguggaguccgccgggacccugcccugcgcccccgagaucccggacugcgucgagcagggcagcgaggugaccggccccacguucgccgacggggagcucaucccccgggagcccggcuucuucccggaggacgaggaggaggcgaugacccuggccccgcccgaggggccccaggagcuguacaccgacucccccauggagagcacccagucccucgagggcagcgugggcucccccgccgagaaggacgggggccucgggggccuguuccugcccgaggacaagagccugguccacacgcccuccaugaccaccagcgaccuguccacccacagcacgaccucccucaucagcaacgaggagcaguucgaggacuacggggagggcgacgacguggacugcgccccguccagccccugccccgacgacgagacccggaccaacguguacuccgaccugggcagcagcgucuccagcuccgccgggcagacgccccgcaagaugcggcacguguacaacagcgagcugcucgacguguacugcucccagugcugcaagaagaucaaccugcugaacgaccucgaggcgcgccugaagaaccugaaggccaacagcccgaaccggaagaucuccagcaccgccuucggccgccagcucaugcacuccagcaacuucuccagcuccaacgggagcaccgaggaccuguuccgggacuccaucgacagcugcgacaacgacaucaccgagaaggucuccuuccuggagaagaaggugacggagcucgagaacgacagccugaccaacggcgaccugaaguccaagcucaagcaggagaacacccagcuggugcaccgcguccacgagcuggaggagauggugaaggaccaggagaccacggccgagcaggcccucgaggaggaggcgcggcgccaccgggaggccuacgggaagcuggagcgcgagaaggccaccgagguggagcugcucaacgcccgcguccagcagcuggaggaggagaacaccgagcugcggaccacggugacccgccucaagagccagaccgagaagcuggacgaggagcggcagcgcaugagcgaccggcuggaggacaccucccuccgccugaaggacgagauggaccuguacaagcggaugauggacaagcugcgccagaaccggcucgaguuccagaaggagcgcgaggccacgcaggagcugaucgaggaccugcggaaggagcucgagcaccuccagauguacaagcuggacugcgagcgccccggccggggccgcagcgcguccagcgggcugggcgaguucaacgcccgggcccgcgaggucgagcuggagcacgaggugaagcggcugaagcaggagaacuacaagcuccgcgaccagaacgacgaccugaacgggcagauccugucccucagccuguacgaggccaagaaccuguucgccgcgcagaccaaggcccagucccucgccgccgagaucgacaccgcgagccgggacgagcugauggaggcccugaaggagcaggaggagaucaacuuccgccuccgccaguacauggacaagaucauccuggccauccuggaccacaaccccuccauccucgagaucaagcacuga

SEQ ID NO: 35358 - RNA, 1962 nt, Artificial Sequence
  derived and/or modified sequence opt1 from RAB11FIP5__Homo_sapiens__NP_056285
auggcccuggugcgcggcgccgagcccgcggccgggcccagccgguggcuccccacccacguccaggugaccgugcugcgcgcccggggccugcgcgggaaguccagcggcgccggguccacgagcgacgccuacaccgucauccaggugggccgggagaaguacuccaccagcguggucgagaagacccacggcugccccgaguggcgcgaggagugcuccuucgagcugcccccgggggcgcucgacggccugcuccgggcccaggaggccgacgccgggcccgcgcccugggccgccagcuccgccgccgcgugcgagcuggugcugacgaccaugcaccgcagccucaucggcguggacaaguuccuggggcaggccaccgucgcccuggacgagguguucggcgccggccgggcccagcacacccagugguacaagcuccacuccaagcccgggaagaaggagaaggagcgcggcgagaucgaggugacgauccaguucacccggaacaaccugagcgcguccauguucgaccugagcaugaaggacaagccgcgcucccccuucagcaagauccgggacaagaugaaggggaagaagaaguacgaccucgaguccgccagcgccauccugcccuccagcgccaucgaggaccccgaccugggcagccucggcaagauggggaaggccaagggcuucuuccugcgcaacaagcugcggaaguccagccucacccaguccaacaccagccugggguccgacagcacgcuguccagcgcguccggcagccucgccuaccaggggccgggcgccgagcugcugacccgcucccccagccgguccagcuggcucuccaccgagggcgggcgcgacagcgcccagucccccaagcuguucacccacaagcggacguacagcgacgaggccaaccagaugcgcgucgcgcccccgcgggcccugcucgaccugcagggccaccuggacgccgccucccgcagcagccucugcgugaacgggucccacaucuacaacgaggagccccagggccccgugcgccaccggagcuccaucagcgggucccugcccagcuccggcagccugcaggcggucuccagccgcuucuccgaggagggcccgcggagcaccgacgacaccuggccccgcgggucccggagcaacuccagcuccgaggccgugcucggccaggaggagcugagcgcccaggccaaggugcuggcccccggggcgagccaccccggcgaggaggagggggcccgccucccggagggcaagcccguccagguggccacccccaucguggccuccagcgaggccgucgcggagaaggagggcgcccggaaggaggagcgcaagccccggauggggcuguuccaccaccaccaccagggccugucccgcagcgagcucgggcggcgcuccagccugggcgagaagggcgggccgauccugggcgccagcccccaccacuccuccagcggggaggagaaggccaaguccagcugguucggccuccgggaggccaaggaccccacgcagaagccgagcccccaccccgugaagccccuguccgcggccccgguggaggggucccccgaccgcaagcagagccgguccagccuguccaucgcccucagcagcggccuggagaagcugaagaccgucaccuccggcagcauccagcccgugacccaggcgccccaggccgggcagauggucgacacgaagcgccugaaggacuccgccgugcucgaccagagcgccaaguacuaccaccugacccacgacgagcugaucucccuccugcugcagcgggagcgcgagcucagccagcgggacgagcacgugcaggagcuggaguccuacaucgaccgccugcucguccgcaucauggagaccagcccgacccugcugcagaucccgcccggcccgcccaaguga

SEQ ID NO: 35359 - RNA, 735 nt, Artificial Sequence
  derived and/or modified sequence opt1 from RAB12__Homo_sapiens__NP_001020471
auggaccccggcgccgcccugcagcgccgggccgggggcgggggcgggcucggcgcgggcagcccggcccuguccgggggccaggggcgccggcgcaagcagccgccccggcccgccgacuucaagcuccaggugaucaucaucggcagccgcggggucggcaagaccucccugauggagcgguucaccgacgacacguucugcgaggccugcaagagcaccgugggcguggacuucaagaucaagaccgucgagcugcgcgggaagaagauccggcugcagaucugggacaccgcgggccaggagcgcuucaacuccaucacgagcgccuacuaccgguccgccaaggggaucauccucguguacgacaucaccaagaaggagaccuucgacgaccugcccaaguggaugaagaugaucgacaaguacgccagcgaggacgcggagcugcuccuggugggcaacaagcuggacugcgagaccgaccgcgagaucacgcggcagcagggcgagaaguucgcccagcagaucaccgggaugcgcuucugcgaggccuccgccaaggacaacuucaacgucgacgagaucuuccucaagcugguggacgacauccugaagaagaugccccucgacauccugcggaacgagcugagcaacuccauccucagccugcagcccgagcccgagaucccgcccgagcugcccccgccccgcccccacgugcggugcugcuga

SEQ ID NO: 35360 - RNA, 648 nt, Artificial Sequence
  derived and/or modified sequence opt1 from RAB14__Homo_sapiens__NP_057406
auggccaccgcccccuacaacuacagcuacaucuucaaguacaucaucaucggcgacaugggggugggcaaguccugccugcuccaccaguucaccgagaagaaguucauggccgacugcccgcacacgaucggggucgaguucggcacccgcaucaucgaggugagcgggcagaagaucaagcugcagaucugggacaccgccggccaggagcgguuccgcgccgugacccgguccuacuaccgcggcgccgccggggcgcugauggucuacgacaucacgcggcgcagcaccuacaaccaccucuccagcuggcugaccgacgcccggaaccugaccaaccccaacacggugaucauccucaucggcaacaaggccgaccuggaggcccagcgcgacgugaccuacgaggaggcgaagcaguucgccgaggagaacgggcuccuguuccuggaggccuccgccaagaccggcgagaacgucgaggacgccuuccuggaggcggccaagaagaucuaccagaacauccaggacgggagccucgaccugaacgccgccgaguccggcgugcagcacaagcccagcgcgccccagggcgggcggcugaccuccgagccgcagccccagcgcgagggcugcgggugcuga

SEQ ID NO: 35361 - RNA, 627 nt, Artificial Sequence
  derived and/or modified sequence opt1 from RAB15__Homo_sapiens__NP_941959
auggccaagcaguacgacgugcuguuccgccuccugcugaucggcgacagcggggucggcaagaccugccuccugugccgguucaccgacaacgaguuccacuccagccacaucuccacgaucgggguggacuucaagaugaagaccaucgagguggacggcaucaagguccgcauccagaucugggacaccgccgggcaggagcgguaccagaccaucacgaagcaguacuaccgccgggcgcagggcaucuuccugguguacgacaucagcuccgagcgcagcuaccagcacaucaugaaguggguguccgacgucgacgaggugggcgacgccaccagccuccccgggugcggcgagggggccuccccgggcaaggcccggcgcgggcccgacggcaaggccaacgcgagccggaagcugugccugccccagcccuggaugaagaccuccggcacccaccagaaggccagccgccggucccuccuggggauccgccugaugcggagccgcaacggccggugggaggaguccaaggggagcuccuggcgccggagcauggccuggacguccaugaagcaggucccggcccccaccagcacccucaagagccacucccgcguguga

SEQ ID NO: 35362 - RNA, 708 nt, Artificial Sequence
  derived and/or modified sequence opt1 from RAB18__Homo_sapiens__NP_001243339
auggacgaggacgugcugaccacccucaagauccugaucaucggcgagagcggggucggcaaguccagccugcuccugcgcuucacggacgacaccuucgaccccgagcuggccgccaccaucgggguggacuucaaggugaagaccaucuccgucgacggcaacaaggcgaagcucgccaucugggugacgcugcaccagcagaccgccaacuucuuccucaagagccagaucgggaacuccccgauccugaagugggccauguggcaguacgacaccgccggccaggagcgguuccgcacccugacgcccagcuacuaccggggcgcgcagggggugauccuggucuacgacgugacccgccgggacaccuucgugaagcucgacaacuggcugaacgagcuggagaccuacugcacgcgcaacgacaucgucaacaugcucgugggcaacaagaucgacaaggagaaccgggagguggaccgcaacgaggggcugaaguucgcccggaagcacuccaugcuguucaucgaggccagcgccaagaccugcgacggcguccagugcgcguucgaggagcucguggagaagaucauccagacccccgggcugugggaguccgagaaccagaacaagggcgugaagcugagccaccgcgaggagggccagggcggcggggccugcgggggcuacugcuccguccucuga

SEQ ID NO: 35363 - RNA, 618 nt, Artificial Sequence
  derived and/or modified sequence opt1 from RAB1A__Homo_sapiens__NP_004152
augagcuccaugaaccccgaguacgacuaccuguucaagcuccugcugaucggcgacagcggggugggcaaguccugccuccugcugcgcuucgccgacgacaccuacaccgagagcuacaucuccacgaucggggucgacuucaagauccggaccaucgagcucgacggcaagaccaucaagcugcagaucugggacaccgccgggcaggagcgcuuccggacgaucaccagcuccuacuaccgcggcgcgcacggcaucaucgugguguacgacgucaccgaccaggagagcuucaacaacgugaagcaguggcugcaggagaucgaccgguacgccuccgagaacgugaacaagcuccuggucgggaacaagugcgaccugaccacgaagaaggugguggacuacaccaccgccaaggaguucgccgacagccucggcaucccguuccuggagaccuccgccaagaacgcgacgaacgucgagcagagcuucaugaccauggccgccgagaucaagaagcgcauggggcccggcgccaccgccgggggcgcggagaaguccaacgugaagauccagagcacccccgugaagcaguccggcgggggcugcugcuga

SEQ ID NO: 35364 - RNA, 606 nt, Artificial Sequence
  derived and/or modified sequence opt1 from RAB1B__Homo_sapiens__NP_112243
augaaccccgaguacgacuaccuguucaagcuccugcugaucggcgacagcggggugggcaaguccugccuccugcugcgcuucgccgacgacaccuacaccgagagcuacaucuccacgaucggggucgacuucaagauccggaccaucgagcucgacggcaagaccaucaagcugcagaucugggacaccgccgggcaggagcgcuuccggacgaucaccagcuccuacuaccgcggcgcgcacggcaucaucgugguguacgacgucaccgaccaggagagcuacgccaacgugaagcaguggcugcaggagaucgaccgguacgccuccgagaacgugaacaagcuccuggucgggaacaagagcgaccugaccacgaagaaggugguggacaacaccaccgccaaggaguucgccgacucccucggcaucccguuccuggagaccagcgcgaagaacgccacgaacgucgagcaggccuucaugaccauggccgcggagaucaagaagcgcauggggcccggcgccgccuccgggggcgagcggcccaaccugaagaucgacagcacccccgugaagccggccggcgggggcugcugcuga

SEQ ID NO: 35365 - RNA, 705 nt, Artificial Sequence
  derived and/or modified sequence opt1 from RAB20__Homo_sapiens__NP_060287
augcgcaagcccgacagcaagaucgugcugcucggcgacaugaacgucgggaagaccucccugcugcagcgguacauggagcgccgguucccggacaccgugagcacggugggcggggccuucuaccucaagcaguggcgcuccuacaacaucagcaucugggacaccgccggccgggagcaguuccacgggcugggcuccauguacugccgcggcgcggccgccaucauccugaccuacgacgucaaccaccggcagagccucguggagcuggaggaccgcuuccuggggcucaccgacacggccuccaaggacugccuguucgccaucgugggcaacaaggucgaccugaccgaggagggggcgcucgccggccaggagaaggaggagugcagccccaacauggacgccggggaccgggugagcccccgcgcccccaagcagguccagcuggaggacgcgguggcccuguacaagaagauccucaaguacaagaugcuggacgagcaggacgugccggccgccgagcagaugugcuucgagaccuccgccaagaccggcuacaacguggaccuccuguucgagacgcuguucgaccuggucgugcccaugauccuccagcagcgggcggagcgccccucccacaccguggacaucagcucccacaagcccccgaagcggacccgcagcggcugcugcgccuga

SEQ ID NO: 35366 - RNA, 678 nt, Artificial Sequence
  derived and/or modified sequence opt1 from RAB21__Homo_sapiens__NP_055814
auggccgccgcgggcgggggcgggggcggggccgccgccgccggccgcgcguacagcuucaaggugguccugcucggcgaggggugcgugggcaagaccucccuggugcugcgguacugcgagaacaaguucaacgacaagcacaucaccacgcuccaggccagcuuccugaccaagaagcugaacaucgggggcaagcgcgucaaccucgccaucugggacaccgccgggcaggagcgguuccacgcgcugggccccaucuacuaccgcgacuccaacggcgccauccugguguacgacaucaccgacgaggacagcuuccagaaggugaagaacugggucaaggagcuccggaagaugcuggggaacgagaucugccugugcaucgugggcaacaagaucgaccucgagaaggagcgccacguguccauccaggaggccgagagcuacgccgaguccgucggggccaagcacuaccacacgagcgcgaagcagaacaagggcaucgaggagcuguuccuggaccucugcaagcggaugaucgagaccgcccagguggacgagcgcgccaagggcaacggguccagccagccgggcaccgcccggcgcggggugcagaucaucgacgacgagccccaggcccagaccuccggcgggggcugcugcagcuccggcuga

SEQ ID NO: 35367 - RNA, 585 nt, Artificial Sequence
  derived and/or modified sequence opt1 from RAB22A__Homo_sapiens__NP_065724
auggcccugcgcgagcucaaggugugccugcugggcgacaccggggucggcaagagcuccaucguguggcgguucguggaggacagcuucgaccccaacaucaacccgaccaucggggccuccuucaugacgaagaccguccaguaccagaacgagcuccacaaguuccugaucugggacaccgcgggccaggagcgcuuccgggcccuggcccccauguacuaccgcgggagcgccgccgcgaucaucguguacgacaucaccaaggaggagacguucuccacccucaagaacugggugaaggagcugcggcagcacggcccgcccaacaucgucguggccaucgccggcaacaagugcgaccugaucgacgugcgcgaggucauggagcgggacgccaaggacuacgcggacagcauccacgccaucuucguggagaccuccgccaagaacgccaucaacaucaacgagcuguucaucgagaucagccgccggauccccuccaccgacgccaaccuccccagcgggggcaagggguucaagcugcgccggcagcccuccgagcccaagcgcagcugcugcuga

SEQ ID NO: 35368 - RNA, 714 nt, Artificial Sequence
  derived and/or modified sequence opt1 from RAB23__Homo_sapiens__NP_001265595
augcuggaggaggacauggagguggccaucaagauggucguggugggcaacggggccgucggcaagagcuccaugauccagcgcuacugcaaggggaucuucaccaaggacuacaagaagaccaucggcguggacuuccucgagcggcagauccaggugaacgacgaggacguccgccugaugcugugggacacggcggggcaggaggaguucgacgccaucaccaaggccuacuaccggggcgcccaggccugcgugcucguguucagcaccaccgaccgcgaguccuucgaggcggucagcuccuggcgggagaaggugguggccgaggucggcgacauccccacggugcuggugcagaacaagaucgaccugcucgacgacagcugcaucaagaacgaggaggccgaggcccuggcgaagcgccugaagcuccgguucuaccgcaccuccgucaaggaggaccugaacgugaacgagguguucaaguaccuggccgagaaguaccuccagaagcugaagcagcagaucgccgaggacccggagcugacccacagcuccagcaacaagaucggggucuucaacaccuccggcgggagccacuccggccagaacagcgggacgcucaacggcggcgacgugaucaaccugcggcccaacaagcagcgcaccaagaagaaccggaaccccuucuccagcugcuccauccccuga

SEQ ID NO: 35369 - RNA, 612 nt, Artificial Sequence
  derived and/or modified sequence opt1 from RAB24__Homo_sapiens__NP_570137
augagcggccagcgcguggacgucaagguggugaugcuggggaaggaguacgucggcaagaccucccucguggagcgguacgugcacgaccgcuuccuggucgggcccuaccagaacaccaucggcgccgccuucguggcgaaggugaugagcgucggggaccggacggugacccugggcaucugggacaccgccggcuccgagcgcuacgaggccaugagccggaucuacuaccgcggggccaaggccgcgaucgugugcuacgaccucaccgacuccagcuccuucgagcgggccaaguucugggucaaggagcugcgcagccuggaggagggcugccagaucuaccucugcgggacgaaguccgaccugcuggaggaggaccggcgccggcgccggguggacuuccacgacgugcaggacuacgccgacaacaucaaggcccagcuguucgagaccagcuccaagaccggccagagcgucgacgagcuguuccagaagguggcggaggacuacguguccgucgccgccuuccaggugaugaccgaggacaaggggguggaccucggccagaagccgaaccccuacuucuacagcugcugccaccacuga

SEQ ID NO: 35370 - RNA, 642 nt, Artificial Sequence
  derived and/or modified sequence opt1 from RAB25__Homo_sapiens__NP_065120
augggcaacgggaccgaggaggacuacaacuucguguucaaggucgugcugaucggcgagagcggggugggcaagaccaaccuccugucccgcuucacgcggaacgaguucagccacgacucccgcaccaccaucggggucgaguucagcacccggacggugaugcugggcaccgccgccgugaaggcgcagaucugggacaccgccggccucgagcgcuaccgggccaucaccuccgccuacuaccgcggggccgucggcgcgcugcugguguucgaccucacgaagcaccagaccuacgccguggucgagcgguggcugaaggagcuguacgaccacgccgaggccaccaucguggugaugcucgucgggaacaagagcgaccugucccaggcgcgcgaggugcccaccgaggaggcccggauguucgccgagaacaacggccuccuguuccuggagacgagcgcccuggacuccaccaacguggagcucgccuucgagaccguccugaaggagaucuucgcgaaggugagcaagcagcgccagaacuccauccggaccaacgccaucacgcuggggagcgcccaggccggccaggagccgggccccggggagaagcgcgccugcugcaucucccucuga

SEQ ID NO: 35371 - RNA, 666 nt, Artificial Sequence
  derived and/or modified sequence opt1 from RAB27A__Homo_sapiens__NP_899059
augagcgacggcgacuacgacuaccugaucaaguuccucgcccugggggacuccggcguggggaagaccagcguccuguaccaguacaccgacggcaaguucaacuccaaguucaucacgaccguggggaucgacuuccgcgagaagcggguggucuaccgcgccagcggccccgacggcgcgaccgggcggggccagcgcauccaccuccagcugugggacaccgccgggcaggagcgguuccgcucccugacgaccgccuucuuccgggacgccaugggcuuccuccugcuguucgaccucaccaacgagcagagcuuccugaacgugcgcaacuggaucucccagcugcagaugcacgccuacugcgagaacccggacaucgugcucugcgggaacaagagcgaccuggaggaccagcgggucgugaaggaggaggaggcgaucgcccuggccgagaaguacggcauccccuacuucgagaccuccgccgcgaacggcacgaacaucagccaggccaucgagaugcuccuggaccugaucaugaagcgcauggagcggugcguggacaaguccuggauccccgagggggucgugcgcagcaacggccacgccuccaccgaccagcucagcgaggagaaggagaagggggccugcggcugcuga

SEQ ID NO: 35372 - RNA, 657 nt, Artificial Sequence
  derived and/or modified sequence opt1 from RAB27B__Homo_sapiens__XP_005266790
augaccgacggcgacuacgacuaccugaucaagcuccuggcccugggggacagcggcguggggaagaccacguuccucuaccgcuacaccgacaacaaguucaaccccaaguucaucaccaccgucggcaucgacuuccgggagaagcgcgugguguacaacgcccaggggcccaacggcuccagcggcaaggcguucaagguccaccuccagcugugggacacggccgggcaggagcgguuccgcucccugaccaccgccuucuuccgggacgccaugggcuuccugcugauguucgaccucaccagccagcaguccuuccugaacgugcgcaacuggaugagccagcugcaggccaacgcguacugcgagaaccccgacaucgugcucaucgggaacaaggccgaccugcccgaccagcgggaggucaacgagcgccaggcccgggagcuggccgacaaguacggcauccccuacuucgagacguccgcggccaccgggcagaacguggagaaggccguggagacccuccuggaccugaucaugaagcgcauggagcagugcgucgagaagacccagaucccggacacggugaacggcggcaacagcgggaaccucgacggcgagaagccgcccgagaagaagugcaucugcuga

SEQ ID NO: 35373 - RNA, 666 nt, Artificial Sequence
  derived and/or modified sequence opt1 from RAB28__Homo_sapiens__NP_001017979
augagcgacuccgaggaggagagccaggaccgccagcugaagaucgugguccucggcgacggggccuccggcaagaccagccugaccacgugcuucgcccaggagaccuucgggaagcaguacaagcagaccaucggccuggacuucuuccuccggcgcaucacccugcccgggaaccugaacgugacgcuccagaucugggacaucggcggccagaccaucgggggcaagaugcuggacaaguacaucuacggggcgcagggcgugcugcucgucuacgacaucaccaacuaccaguccuucgagaaccuggaggacugguacaccguggugaagaaggucagcgaggaguccgagacgcagccgcugguggcccucguggggaacaagaucgaccuggagcacaugcggaccaucaagcccgagaagcaccuccgcuucugccaggagaacggcuucagcucccacuucgucagcgccaagaccggcgacuccguguuccugugcuuccagaagguggccgccgagauccuggggaucaagcugaacaaggcggagaucgagcagagccagcgggucgugaaggccgacaucgugaacuacaaccaggagcccaugucccgcaccgucaacccgccccggagcuccaugugcgccgugcaguga

SEQ ID NO: 35374 - RNA, 540 nt, Artificial Sequence
  derived and/or modified sequence opt1 from RAB29__Homo_sapiens__NP_001129135
augggcagccgcgaccaccuguucaaggugcucgucgugggggacgccgccgugggcaagaccucccugguccagcgguacagccaggacuccuucagcaagcacuacaaguccaccgucgggggccaggagcgcuucacgagcaugacccggcuguacuaccgcgacgcguccgccugcgugaucauguucgacgugaccaacgccaccacguucagcaacucccagcgguggaagcaggaccucgacagcaagcugacccugcccaacggggagccggugcccugccuccugcuggccaacaagugcgaccucucccccugggccgugagccgcgaccagaucgaccgguucuccaaggagaacggcuucaccggcuggaccgagacgagcgucaaggagaacaagaacaucaacgaggcgaugcgcgugcugaucgagaagaugaugcggaacuccaccgaggacaucaugagccuguccacccagggggacuacaucaaccuccagaccaagagcuccagcuggagcugcugcuga

SEQ ID NO: 35375 - RNA, 567 nt, Artificial Sequence
  derived and/or modified sequence opt1 from RAB2A__Homo_sapiens__NP_001229573
auggccuacgccuaccuguucaaguacaucaucaucggcgacaccgggguggaguucggcgcgcgcaugaucaccaucgacgggaagcagaucaagcuccagaucugggacacggccggccaggagagcuuccgguccaucacccgcagcuacuaccgcggggccgccggcgcccugcuggucuacgacaucacccggcgggacaccuucaaccaccucacgaccuggcuggaggacgcgcgccagcacuccaacagcaacauggugaucaugcugaucggcaacaaguccgaccucgagagccggcgcgaggugaagaaggaggagggggaggccuucgcccgggagcacggccugaucuucauggagaccuccgccaagaccgcgagcaacgucgaggaggccuucaucaacacggccaaggagaucuacgagaagauccaggaggggguguucgacaucaacaacgaggccaacggcaucaagaucgggccccagcacgccgcgaccaacgccacccacgccggcaaccagggcgggcagcaggccggcgggggcugcugcuga

SEQ ID NO: 35376 - RNA, 588 nt, Artificial Sequence
  derived and/or modified sequence opt1 from RAB31__Homo_sapiens__NP_006859
augauggccauccgcgagcugaaggugugccuccugggcgacaccggggucggcaagagcuccaucgugugccgguucgugcaggaccacuucgaccacaacaucagccccaccaucggggccuccuucaugacgaagaccgucccgugcggcaacgagcugcacaaguuccucaucugggacaccgcggggcaggagcgcuuccacagccuggcccccauguacuaccggggcuccgccgccgccgugaucguguacgacaucaccaagcaggacagcuucuacacgcugaagaagugggucaaggagcucaaggagcacggccccgagaacaucgugauggcgaucgccgggaacaagugcgaccuguccgacauccgcgaggugccccugaaggacgccaaggaguacgccgagagcaucggcgcgaucgucguggagaccuccgccaagaacgccaucaacaucgaggagcuguuccaggggaucagccggcagaucccgccccucgacccccacgagaacggcaacaacgggaccaucaagguggagaagcccaccaugcaggccucccgccggugcugcuga

SEQ ID NO: 35377 - RNA, 678 nt, Artificial Sequence
  derived and/or modified sequence opt1 from RAB32__Homo_sapiens__NP_006825
auggccggcgggggcgccggggaccccggccugggggcggccgccgccccggcccccgagacccgcgagcaccucuucaaggugcuggucaucggcgagcugggcguggggaagaccagcaucaucaagcgguacgugcaccagcuguucucccagcacuaccgcgcgacgaucggcgucgacuucgcccugaaggugcugaacugggacagccggacccucgugcgccugcagcugugggacaucgccgggcaggagcgguucggcaacaugacccgcgucuacuacaaggaggccgugggggcguucguggucuucgacaucucccggagcuccaccuucgaggccgugcucaaguggaaguccgaccuggacagcaaggugcaccuccccaacggcagccccaucccggccguccuccuggccaacaagugcgaccagaacaaggacuccagccagucccccagccagguggaccaguucugcaaggagcacggcuucgccgggugguucgagacguccgcgaaggacaacaucaacaucgaggaggccgcccgcuuccugguggagaagauccucgucaaccaccagagcuuccccaacgaggagaacgacguggacaagaucaagcuggaccaggagacccugcgggccgagaacaagucccagugcugcuga

SEQ ID NO: 35378 - RNA, 690 nt, Artificial Sequence
  derived and/or modified sequence opt1 from RAB33B__Homo_sapiens__NP_112586
auggccgaggagauggagagcucccuggaggccagcuucuccagcuccggcgcggugagcggggccuccggcuuccugcccccggcccgcagccggaucuucaagaucaucgucaucggggacuccaacgugggcaagaccugccugaccuaccgcuucugcgccgggcgguuccccgaccgcacggaggccaccaucggcguggacuuccgggagcgcgcggucgagaucgacggcgagcggaucaagauccagcugugggacaccgccgggcaggagcgcuuccgcaagagcauggugcagcacuacuaccggaacgugcacgccgucguguucguguacgacaugaccaacauggccuccuuccacagccuccccuccuggaucgaggagugcaagcagcaccuccuggcgaacgacaucccccggauccucgucggcaacaagugcgaccugcgcagcgccauccaggugccgacggaccuggcccagaaguucgccgacacccacuccaugccccucuucgagaccagcgccaagaaccccaacgacaacgaccacguggaggcgaucuucaugacccuggcccacaagcugaagucccacaagccccucaugcugagccagccgcccgacaacgggaucauccugaagcccgagcccaagccggccaugacgugcuggugcuga

SEQ ID NO: 35379 - RNA, 927 nt, Artificial Sequence
  derived and/or modified sequence opt1 from RAB34__Homo_sapiens__NP_001136096
augagccaccuccccggccucgagcugcgccgggaggccccgccccugcucgggccccugcugucccccuucccgcuccccgccggcagcuggcaccgccagaugcugcgguccagccugcgcuuccccaucaccaacuccgcgggggcccccugcaaggccgccggccggaugaacauccucgccccggugcgccgggaccgcguccuggcggagcugccccagugccuccggaaggaggccgcccugcacgggcacaaggacuuccacccccgcgugaccugcgccugccaggagcaccggacgggcaccgugggcuucaagaucagcaaggucaucguggugggggaccuguccgucggcaagaccugccucaucaaccgcuucugcaaggacaccuucgacaagaacuacaaggcgacgaucgggguggacuucgagauggagcgguucgaggugcugggcauccccuucagccugcagcucugggacaccgccgggcaggagcgcuucaagugcaucgccuccaccuacuaccggggcgcccaggccaucaucaucgucuucaaccugaacgacguggcgagccuggagcacaccaagcaguggcucgccgacgcccugaaggagaacgacccguccagcgugcugcuguuccugacgcccgcccaguacgcccugauggagaaggacgcgcuccaggucgcccaggagaugaaggccgaguacugggccguguccagccugaccggcgagaacgugcgcgaguucuucuuccgggucgccgcgcugaccuucgaggccaacgugcucgccgagcuggagaaguccggggcccgccggaucggcgacgugguccgcaucaacagcgacgacuccaaccuguaccucaccgccagcaagaagaagcccacgugcugccccuga

SEQ ID NO: 35380 - RNA, 459 nt, Artificial Sequence
  derived and/or modified sequence opt1 from RAB35__Homo_sapiens__NP_001161078
auggcccgcgacuacgaccaccuguucaagcuccugaucaucggcgacagcggggugggcaaguccagccugcuccugcgguucgccgacaacaccuucuccgggagcuacaucaccacgaucggcgucgacuucaagauccgcaccguggagaucaacggggagaaggugaagcugcagaucugggacaccgcgggccaggagcgguuccgcaccaucacguccaccuacuaccggggcacccacggggucaucgugguguacgacgucaccagcgccgaguccuucgugaacgugaagcgcuggcuccacgagaucaaccagaacugcgacgacgucugccggauccuggacgugcagcugcaccacggcgccgggcccccgagcaaggagcgccagcccggcaagacggccgccgcgaccaccgagcggugcggggaggcccacgaggagcaguga

SEQ ID NO: 35381 - RNA, 1002 nt, Artificial Sequence
  derived and/or modified sequence opt1 from RAB36__Homo_sapiens__NP_004905
auggugaucgccggcgccagcuggaugcuggggcgcgcggccgccucccccacccagaccccgcccacgaccagcaccauccgggucgcccgccggucccgcguggcccucguggcgauggucaucgccgccgccggcagcgggggccccgggcgggcggagccccagcugucccagccgagccuggacugcggccgcaugcgguccagccucacgccccugggcccgcccgugucccgcgaccgggugaucgccagcuuccccaagugguacacccccgaggccugccugcagcuccgcgagcacuuccacgggcaggucuccgccgccugccagcggcgcaacaccggcaccguggggcugaagcugagcaagguggucguggugggcgaccucuacgucgggaagaccucccugauccaccgguucugcaagaacguguucgaccgcgacuacaaggcgacgaucggcguggacuucgagaucgagcgguucgagaucgccggcauccccuacagccugcagaucugggacaccgccgggcaggagaaguucaagugcaucgccuccgccuacuaccgcggcgcgcaggucaucaucaccgccuucgaccucaccgacgugcagacgcuggagcacacccggcaguggcuggaggacgcccuccgcgagaacgaggccgggagcugcuucaucuuccuggugggcaccaagaaggaccugcucuccggcgccgcgugcgagcaggccgaggccgacgccguccaccuggcccgggagaugcaggcggaguacuggagcguguccgccaagaccggggagaacgugaaggccuucuucagccgcgucgccgcgcuggccuucgagcagagcgugcuccaggaccuggagcggcaguccagcgcccgccuccaggugggcaacggggaccugauccagauggagggcuccccgcccgagacgcaggagagcaagcgccccuccagccuggggugcugcuga

SEQ ID NO: 35382 - RNA, 672 nt, Artificial Sequence
  derived and/or modified sequence opt1 from RAB37__Homo_sapiens__NP_001006639
augaccggcacccccggggccguggccacgcgcgacggcgaggcgccggagcggagcccgcccugcucccccagcuacgaccugaccgggaaggucaugcuccugggcgacaccggggugggcaagaccugcuuccugauccaguucaaggacggcgccuuccucuccgggacguucaucgccaccgugggcaucgacuuccgcaacaaggucgugaccguggacgggguccgggugaagcugcagaucugggacaccgccggccaggagcgcuuccggagcgugacgcacgccuacuaccgcgacgcgcaggcccugcuccugcuguacgacaucaccaacaaguccagcuucgacaacauccgggccuggcucaccgagauccacgaguacgcccagcgcgacgucgugaucaugcugcuggggaacaaggcggacauguccagcgagcgggugauccgcuccgaggacggcgagacccucgcccgggaguacggcguccccuuccuggagacgagcgccaagaccgggaugaacguggagcuggccuuccucgccaucgcgaaggagcugaaguaccgcgccggccaccaggccgacgagcccuccuuccagauccgggacuacguggagagccagaagaagcgcuccagcugcugcuccuucauguga

SEQ ID NO: 35383 - RNA, 636 nt, Artificial Sequence
  derived and/or modified sequence opt1 from RAB38__Homo_sapiens__NP_071732
augcaggcgccccacaaggagcaccuguacaagcuccuggugaucggcgaccugggggucggcaagaccagcaucaucaagcgcuacgugcaccagaacuucuccagccacuaccgggccaccaucgggguggacuucgcccucaagguccugcacugggacccggagacgguggugcgccugcagcucugggacaucgccggccaggagcgguucgggaacaugacccgcgucuacuaccgggaggccaugggcgccuucaucguguucgacgugacccgccccgccaccuucgaggcggucgccaaguggaagaacgaccuggacuccaagcugagccuccccaacggcaagcccguguccgugguccugcuggccaacaagugcgaccaggggaaggacgugcucaugaacaacggccugaagauggaccaguucugcaaggagcacggguucgugggcugguucgagacgagcgccaaggagaacaucaacaucgacgaggcgucccggugccuggucaagcacauccucgccaacgagugcgaccugauggagagcaucgagccggacguggugaagccccaccugaccuccaccaaggucgccagcugcuccgggugcgccaagagcuga

SEQ ID NO: 35384 - RNA, 654 nt, Artificial Sequence
  derived and/or modified sequence opt1 from RAB39A__Homo_sapiens__NP_059986
auggagaccaucuggaucuaccaguuccgccugaucgugaucggcgacagcaccgucgggaaguccugccuccugcaccgguucacgcagggccgcuuccccgggcugcggagcccggccugcgaccccaccgugggcguggacuucuucucccgccuccuggagaucgagcccgggaagcggaucaagcugcagcucugggacaccgccggccaggagcgcuuccggagcaucacccgcuccuacuaccggaacagcgucggcggguuccugguguucgacaucacgaaccgccgguccuucgagcacgugaaggacuggcuggaggaggcgaagauguacguccagcccuuccgcaucguguuccuccuggugggccacaagugcgaccuggccagccagcggcaggucacccgcgaggaggccgagaagcucuccgccgacugcgggaugaaguacaucgagaccagcgccaaggacgcgaccaacguggaggaguccuucacgauccugacccgggacaucuacgagcugaucaagaagggcgagaucugcauccaggacgggugggagggcgucaagagcggcuucgugccgaacaccgugcacuccagcgaggaggccgugaagccccgcaaggagugcuucugcuga

SEQ ID NO: 35385 - RNA, 642 nt, Artificial Sequence
  derived and/or modified sequence opt1 from RAB39B__Homo_sapiens__NP_741995
auggaggccaucuggcuguaccaguuccgccucaucgugaucggcgacagcaccgucgggaaguccugccugauccggcgcuucaccgagggccgguucgcccaggugagcgaccccacggugggggucgacuucuucucccgccugguggagaucgagccgggcaagcggaucaagcuccagaucugggacaccgcggggcaggagcgcuuccggagcaucacccgcgccuacuaccggaacuccgugggcggccugcuccuguucgacaucaccaaccgccggagcuuccagaacguccacgaguggcuggaggagacgaaggugcacgugcagcccuaccagaucgucuucgugcugguggggcacaagugcgaccucgacacccagcgccaggucacccggcacgaggccgagaagcuggccgccgcguacggcaugaaguacaucgagaccuccgcccgcgacgccaucaacguggagaaggccuucacggaccugacccgggacaucuacgagcucgugaagcgcggggagaucaccauccaggagggcugggagggggucaagagcggcuucgugcccaacgugguccacuccagcgaggagguggugaaguccgagcggcgcugccugugcuga

SEQ ID NO: 35386 - RNA, 663 nt, Artificial Sequence
  derived and/or modified sequence opt1 from RAB3A__Homo_sapiens__XP_011526466
auggccagcgccaccgacucccgcuacggccagaaggagagcuccgaccagaacuucgacuacauguucaagauccugaucaucgggaacagcuccgugggcaagaccagcuuccucuuccgguacgcggacgacuccuucacgcccgccuucgucagcaccguggggaucgacuucaaggugaagaccaucuaccgcaacgacaagcggaucaagcugcagaucugggacaccgccggccaggagcgcuaccggacgaucaccaccgccuacuaccgcggggccaugggcuucauccugauguacgacaucaccaacgaggaguccuucaacgcgguccaggacuggagcacgcagaucaagaccuacuccugggacaacgcccaggugcuccuggugggcaacaagugcgacauggaggacgagcgggucgugagcuccgagcgcgggcggcagcuggccgaccaccucggcuucgaguucuucgaggccagcgcgaaggacaacaucaacgugaagcagaccuucgagcgccuggucgacgugaucugcgagaagauguccgagagccuggacaccgccgaccccgccgugacgggggccaagcagggcccccagcucuccgaccagcaggucccgccccaccaggacugcgccugcuga

SEQ ID NO: 35387 - RNA, 660 nt, Artificial Sequence
  derived and/or modified sequence opt1 from RAB3D__Homo_sapiens__NP_004274
auggccagcgccggcgacacccaggcggggccccgcgacgccgccgaccagaacuucgacuacauguucaagcugcuccugaucggcaacuccagcguggggaagaccuccuuccuguuccgguacgccgacgacagcuucacgccggccuucgucuccaccgugggcaucgacuucaaggugaagaccgucuaccgccacgacaagcggaucaagcuccagaucugggacaccgcggggcaggagcgcuaccggacgaucaccaccgccuacuaccgcggcgccaugggcuuccugcugauguacgacaucgccaaccaggagagcuucgcggccgugcaggacugggccacccagaucaagacguacuccugggacaacgcccaggugauccucgucgggaacaagugcgaccuggaggacgagcggguggugcccgccgaggacggccgccggcuggcggacgaccucggguucgaguucuucgaggccagcgccaaggagaacaucaacgucaagcaggucuucgagcgccugguggacgugaucugcgagaagaugaacgagucccuggagcccagcuccagcuccggcagcaacgggaagggccccgccgugggcgacgccccggcgccccagcccuccagcugcuccugcuga

SEQ ID NO: 35388 - RNA, 2967 nt, Artificial Sequence
  derived and/or modified sequence opt1 from RAB3GAP1__Homo_sapiens__NP_001165906
auggccgccgacagcgagcccgaguccgagguguucgagaucaccgacuucaccacggcgagcgagugggagcgcuucaucuccaaggucgaggaggugcugaacgacuggaagcucaucggcaacagccuggggaagccgcuggagaagggcaucuucaccuccgggaccugggaggagaaguccgacgagaucuccuucgccgacuucaaguucagcgugacccaccacuaccucguccaggaguccacggacaaggagggcaaggacgagcugcuggaggacguggugccccagagcaugcaggaccuccuggggaugaacaacgacuucccgccccgggcccacugccugguccgcugguacggccuccgggaguucguggugaucgcccccgccgcgcacuccgacgccguccugagcgaguccaagugcaaccugcuccugagcuccgugagcaucgcccugggcaacaccgggugccaggugccccucuucguccagauccaccacaaguggcgccggauguacgugggcgagugccaggggcccggcgugcgcaccgacuucgagaugguccaccuccggaaggugcccaaccaguacacccaccuguccgggcuccuggacaucuucaagagcaagaucggcugcccgcugacgccccucccgcccguguccaucgccauccgcuucaccuacguccugcaggacuggcagcaguacuucuggccccagcagccgcccgacaucgacgcgcuggugggcggggaggugggcgggcucgaguucggcaagcugcccuucggcgccugcgaggaccccaucagcgagcugcaccucgccaccaccuggccccaccugacggaggggaucaucgucgacaacgacguguacagcgaccuggaccccauccaggcgccccacugguccgugcggguccgcaaggccgagaacccgcagugccuccugggcgacuucgugaccgaguucuucaagaucugccggcgcaaggagagcaccgacgagauccuggggcggagcgccuucgaggaggagggcaaggagaccgccgacaucacgcacgcccugagcaagcugaccgagcccgccuccguccccauccacaagcugagcguguccaacauggugcacaccgccaagaagaagauccgcaagcaccgcggggucgaggagagcccccucaacaacgacgugcugaacaccauccuccuguuccuguucccggacgcgguguccgagaagccccuggacggcacgaccagcaccgacaacaacaacccgcccuccgagagcgaggacuacaaccucuacaaccaguucaaguccgcccccagcgacucccugaccuacaagcuggcccucugccugugcaugaucaacuucuaccacggcgggcugaagggcgucgcccaccucuggcaggaguucgugcuggagaugcgguuccggugggagaacaacuuccugauccccgggcuggccagcgggcccccggaccuccgcugcugccugcugcaccagaagcuccagaugcugaacugcugcaucgagcggaagaaggcgcgcgacgagggcaagaagacguccgccagcgacgugaccaacaucuaccccggcgacgccggcaaggccggggaccagcugguccccgacaaccucaaggagaccgacaaggagaagggcgagguggggaaguccugggacagcuggagcgacuccgaggaggaguucuucgagugccugagcgacaccgaggagcugaagggcaacgggcaggaguccggcaagaagggcgggcccaaggagauggccaaccuccggccggagggccgccuguaccagcacgggaagcugacgcuccugcacaacggcgagccccuguacauccccgugacccaggagcccgcgccgaugaccgaggaccuccuggaggagcagagcgagguccuggccaagcucggcaccuccgccgagggggcccaccuccgcgcgcggaugcagagcgccugccugcuguccgacauggagagcuucaaggccgccaaccccggcugcucccuggaggacuucgugcgcugguacagcccccgggacuacaucgaggaggaggugaucgacgagaaggggaacgucgugcugaagggcgagcucuccgcccgcaugaagauccccagcaacauguggguggaggcgugggagacggccaagccgauccccgcccggcgccagcggcgccuguucgacgacacccgggaggccgagaagguccugcacuaccucgccauccagaagcccgcggaccuggcccgccaccuccugcccugcgugauccacgccgccgugcugaaggucaaggaggaggagucccuggagaacaucagcuccgugaagaagaucaucaagcagaucaucagccacuccagcaaggugcuccacuucccgaaccccgaggacaagaagcuggaggagaucauccaccagaucaccaacgucgaggcccugaucgcgcgggcccgcagccucaaggccaaguucgggaccgagaagugcgagcaggaggaggagaaggaggaccuggagcgguucguguccugccugcucgagcagcccgaggugcuggucacgggcgccggccgcgggcacgcgggccggaucauccacaagcuguucgugaacgcccagcgccucaccgagagcuccgacgaggccgccgccaugacgcccccggaggaggagcugaagcggauggggagccccgaggagcgccggcagaacuccgugagcgacuucccgccgcccgcgggccgcgaguucauccugcgcaccaccgucccccggcccgcccccuacuccaaggcccucccccagcgcauguacagcgugcugaccaaggaggacuuccggcuggccggggccuucuccagcgacaccuccuucuucuga

SEQ ID NO: 35389 - RNA, 4182 nt, Artificial Sequence
  derived and/or modified sequence opt1 from RAB3GAP2__Homo_sapiens__NP_036546
auggccugcagcaucgugcaguucugcuacuuccaggaccugcaggccgcgcgcgacuuccucuucccccaccuccgggaggagauccuguccggcgcccugcgccgggacccgagcaaguccaccgacugggaggacgacggguggggcgccugggaggagaacgagccccaggagcccgaggaggaggggaacacgugcaagacccagaagaccagcuggcugcaggacugcguccugucccucagccccaccaacgaccugauggugaucgcccgcgagcagaaggccguguuccuggucccgaaguggaaguacuccgacaagggcaaggaggagaugcaguucgcggugggguggagcggcucccucaacguggaggagggcgagugcgucaccagcgcccugugcaucccccuggccucccagaagcggagcuccacggggcgccccgacuggaccugcaucguggugggcuucaccagcggguacguccgguucuacaccgagaacggcgugcuccugcuggcccagcuccugaacgaggaccccgugcugcagcucaagugccgcacguacgagaucccgcggcaccccggggucaccgagcagaacgaggagcuguccauccuguaccccgcggccaucgugaccaucgacggcuucagccucuuccagucccugcgcgccugccggaaccagguggccaaggccgcggccagcggcaacgagaacauccagcccccgccccuggccuacaagaagugggggcuccaggacaucgacaccaucaucgaccacgccuccgucggcaucaugacgcugagccccuucgaccagaugaagaccgccagcaacaucgggggcuucaacgcggccaucaagaacuccccgcccgccaugagccaguacaucaccgugggcuccaaccccuucaccggguucuucuacgcccuggagggcagcacgcagccccuccugucccacguggcccuggcggucgccagcaagcucaccuccgcccuguucaacgccgccagcggguggcugggcuggaaguccaagcacgaggaggaggcggugcagaagcagaagcccaagguggagccggccacgccccucgccguccgcuucgggcugcccgacagccggcgccacggcgaguccaucugccugagccccugcaacacccucgccgcggugaccgacgacuucggccgggugauccugcuggacgucgcccgcgggaucgccauccggauguggaagggcuaccgcgacgcccagaucggguggauccagaccguggaggaccuccacgagcgggucccggagaaggccgacuucucccccuucggcaacagccaggggcccucccgcguggcgcaguuccuggugaucuacgcgccccggcgcggcauccuggaggucuggagcacccagcagggcccgcgcgugggggccuucaacgugggcaagcacugccggcuccuguaccccggguacaagaucaugggccugaacaacgucaccucccagagcuggcagccccagacguaccagaucugccucguggacccgguguccgggagcgucaagaccgugaacgugcccuuccaccuggcccugagcgacaagaaguccgagcgcgccaaggacaugcaccucgucaagaagcuggccgcccugcugaagaccaagagccccaaccucgaccugguggagaccgagaucaaggagcugauccucgacaucaaguaccccgccacgaagaagcaggcccuggaguccauccuggccagcgagcggcucccguucuccugccugcgcaacaucacccagacccugauggacacccucaagagccaggagcuggaguccguggacgagggccugcuccaguucugcgcgaacaagcugaagcugcuccagcuguacgagagcgucucccagcugaacagccucgacuuccaccuggacacgcccuucuccgacaacgaccuggcccuccugcugcggcucgacgagaaggagcugcugaagcuccaggcccugcuggagaaguacaagcaggagaacacccgcaccaacgugcgguucagcgacgacaaggacggcgugcuccccgucaagaccuuccuggaguaccuggaguacgagaaggacgugcucaacaucaagaagaucuccgaggaggaguacguggcccuggggagcuucuucuucuggaagugccugcacggcgaguccagcacggaggacaugugccacacccucgaguccgcggggcugagcccccagcugcuccugagccugcuccuguccgucuggcugagcaaggagaaggacauccucgacaagccgcaguccaucugcugccugcacaccaugcugagccuccuguccaagaugaagguggccaucgacgagaccugggacagccaguccgugagccccugguggcagcagaugcgcaccgccugcauccaguccgagaacaacggcgccgcccugcucagcgcgcacgucggccacuccguggccgcccagaucagcaacaacaugacggagaagaaguucucccagaccgugcugggggccgacagcgaggcccugaccgacuccugggaggcgcucagccuggacaccgaguacuggaagcugcuccugaagcagcuggaggacugccucauccugcagacgcugcuccacuccaagggcaacacccagaccagcaaggucuccagccugcaggccgagccccugccccggcucagcgugaagaagcugcuggagggcgggaagggcgggaucgccgacuccguggccaaguggaucuucaagcaggacuucagcccggagguccucaagcuggccaacgaggagcgcgacgcggagaaccccgacgagcccaaggagggcgugaaccgguccuuccuggaggugagcgagauggagauggaccucggggccauccccgaccugcugcaccucgccuacgagcaguucccgugcucccuggagcuggacguccuccacgcccacugcugcugggaguacguggugcaguggaacaaggaccccgaggaggcgcgcuucuucguccggagcaucgagcaccugaagcagaucuucaacgcccacgugcagaacggcaucgcccugaugauguggaacaccuuccucgugaagcgcuucuccgccgccacguaccugauggacaaggucggcaagagccccaaggaccggcugugccgccgggacguggggauguccgacaccgcgaugaccagcuuccucggguccugccuggaccugcuccagauccugauggaggccgacgugagccgcgacgagauccagguccccgugcuggacaccgaggacgccuggcucuccguggagggcccgaucagcaucgucgagcuggcccuggagcagaagcacauccacuacccccucguggagcaccacuccauccugugcagcauccuguacgccgugaugcgguucucccugaagacggucaagccccucagccuguucgacuccaagggcaagaacgcguucuucaaggaccugaccagcauccagcuccugcccagcggggagauggacccgaacuucaucuccgugcgccagcaguuccugcucaagguggucagcgccgccgugcaggcccagcacuccgccaccaaggucaaggaccccaccgaggaggcgacgcccaccccguucggcaaggaccaggacuggcccgcccuggccguggaccuggcccaccaccuccaggugagcgaggacgucgugcgccggcacuacgugggggagcuguacaacuacggcgucgaccaccugggggaggaggccauccuccaggugcacgacaaggaggugcuggcgucccagcugcucguccugaccggccagcgccuggcccacgcccuccugcacacccagacgaaggagggcauggagcugcucgcccggcugccgcccacccugugcaccuggcucaaggcgauggacccccaggaccugcagaacaccgaggugcccaucgccacgaccgccaagcuggugaacaaggucaucgagcuccugcccgagaagcacgggcaguacggccuggcccuccaccugaucgaggccguggaggcgaucagccugcccucccucuga

SEQ ID NO: 35390 - RNA, 1071 nt, Artificial Sequence
  derived and/or modified sequence opt1 from RAB3IL1__Homo_sapiens__NP_001258615
auggacagcuccgaggagcacgccggcugccccgcccgcgggaccugcccgguguuccuggcgaugagcgccggcaccguccgguacgcccccuccgggcucugccccgugcuggagggcaaccugcgcgaggagcccugggggacggacagcccgccccagcccgaccagggccugcccccgccccucgccgccgugcccguccccuggaaguccaccgacccgugccagggccaccgggagagccccggggcgcugguggagaccuccgccggcgaggaggcccaggggcaggagggccccgccgcggcccagcucgacgugcugcgccugcggagcuccagcauggagauccgcgagaagggguccgaguuccucaaggaggagcugcaccgggcccagaaggagcugaagcucaaggacgaggagugcgagcgccugagcaagguccgggagcagcuggagcaggagcucgaggagcugaccgccucccuguucgaggaggcccacaagauggugcgcgaggcgaacaugaagcaggccgccagcgagaagcagcucaaggaggcccggggcaagguggacacgauccuguucgccgaguuccaggcguggcgcgagucccccacccuggacaagaccugcccguuccucgagcgggucuaccgcgaggacgugggccccugccuggacuucaccaugcaggagcugagcgugcucguccgggccgccguggaggacaacacgcugaccaucgagcccguggccucccagacccugcccaccgucaagguggccgagguggacugcagcuccacgaacacgugcgcgcucagcgggcugacccggaccugccgccaccgcauccggcugggcgacagcaagucccacuacuacaucagcccguccagccgcgcccggaucaccgccgucugcaacuucuucaccuacauccgcuacauccagcaggggcucgugcgccaggacgccgagcccauguucugggagaucaugcggcugcgcaaggagaugucccuggccaagcucggcuucuucccccaggaggcguga

SEQ ID NO: 35391 - RNA, 765 nt, Artificial Sequence
  derived and/or modified sequence opt1 from RAB3IP__Homo_sapiens__NP_001019818
auggugcgcgaggccaacaucaagcaggccaccgcggagaagcagcugaaggaggcccagggcaagaucgacguccuccaggccgagguggccgcccugaagacccuggugcucagcuccagccccacguccccgacccaggagccccugcccgggggcaagacccccuucaagaaggggcacacccggaacaagagcacguccagcgcgauguccggcagccaccaggaccuguccgucauccagccgaucgugaaggacugcaaggaggccgaccucagccuguacaacgaguuccgccuguggaaggacgagcccaccauggaccggaccugccccuuccucgacaagaucuaccaggaggacaucuuccccugccugaccuucuccaagagcgagcuggccuccgccgugcucgaggcggucgagaacaacacgcugagcaucgagccgguggggcugcagcccauccgcuucgugaaggccuccgccgucgagugcggcggccccaagaagugcgcccucaccgggcagagcaaguccugcaagcaccggaucaagcugggcgacagcuccaacuacuacuacaucagccccuucugccgcuaccggaucaccagcgugugcaacuucuucaccuacauccgcuacauccagcaggggcuggugaagcagcaggacgucgaccagauguucugggaggugaugcagcuccggaaggagaugucccuggccaagcugggcuacuucaaggaggagcucuga

SEQ ID NO: 35392 - RNA, 837 nt, Artificial Sequence
  derived and/or modified sequence opt1 from RAB40AL__Homo_sapiens__NP_001027004
augagcgcccccggcucccccgaccaggccuacgacuuccugcucaaguuccugcuggugggggaccgcgacgucggcaagagcgagauccucgagucccugcaggacgggaccgcggagagccccuacucccaccugggcgggaucgacuacaagaccacgaccauccuccuggacggccagcgggugaagcugaagcucugggacaccagcggccaggggcgcuucugcaccaucuuccgguccuacagccgcggcgcccagggggugauccuggucuacgacaucgccaaccggugguccuucgagggcauggaccgcuggaucaagaagaucgaggagcacgcccccggggugcccaagauccuggugggcaaccggcuccaccuggccuucaagcgccaggucccgcgggagcaggcgcaggccuacgccgagcgccugggcgugacguucuucgaggugagcccccucugcaacuucaacaucaucgaguccuucaccgagcuggcccggaucguccugcuccgccaccggcugaacuggcuggggcgccccagcaaggugcucucccugcaggaccugugcugccggaccaucgugagcugcacccccguccaccucguggacaagcugccgcugcccaucgcgcuccgcucccaccucaagagcuucuccauggccaagggccugaacgcccggaugaugcgcgggcugagcuacucccugacgaccagcagcacccacaagcgguccagccugugcaaggugaagaucgucugcccgccccaguccccgcccaagaacugcacccgcaacagcugcaagaucuccuga

SEQ ID NO: 35393 - RNA, 837 nt, Artificial Sequence
  derived and/or modified sequence opt1 from RAB40B__Homo_sapiens__NP_006813
augagcgcccugggcucccccgugcgcgccuacgacuuccuccugaaguuccugcucgucggggacagcgacgugggcaagggggagauccuggcgucccugcaggacggcgccgccgagagccccuacgggcaccccgccggcaucgacuacaagaccaccacgauccuccuggacggccggcgcgugaagcugcagcucugggacaccuccgggcagggccgguucugcaccaucuuccgcagcuacucccgcggggcccagggcgucauccugguguacgacaucgcgaaccgguggagcuucgacgggaucgaccgguggaucaaggagaucgacgagcacgcccccggcgugcccaagauccuggucggcaaccgccuccaccuggccuucaagcgccaggugccgaccgagcaggcccaggcguacgccgagcggcugggggugacguucuucgaggucagcccccucugcaacuucaacaucaccgaguccuucaccgagcuggcccggaucgugcugcuccgccacggcauggaccggcuguggcgccccuccaaggugcugagccuccaggaccugugcugccgggccgucguguccugcacccccgugcaccuggucgacaagcucccgcugcccaucgcccugcgcagccaccucaaguccuucagcauggcgaacgggcugaacgcccggaugaugcacggcggcuccuacagccugacgaccuccagcacccacaagcgcagcucccuccggaaggugaagcuggugcgcccgccccagagcccgcccaagaacugcacccggaacuccugcaagaucagcuga

SEQ ID NO: 35394 - RNA, 846 nt, Artificial Sequence
  derived and/or modified sequence opt1 from RAB40C__Homo_sapiens__NP_001166136
augggcagccaggggucccccgucaagagcuacgacuaccugcucaaguuccugcuggugggcgacuccgacguggggaagggcgagauccucgagagccugcaggacggggccgccgagucccccuacgcguacagcaacggcaucgacuacaagaccaccacgauccugcucgacggccgccgggugaagcuggagcugugggacaccuccgggcagggccgcuucugcaccaucuuccggagcuacucccgcggggcccagggcauccuccuggucuacgacaucaccaaccgguggagcuucgacgggaucgaccgcuggaucaaggagaucgacgagcacgcccccggcgugccccggauccuggugggcaaccgccuccaccuggccuucaagcggcagguccccacggagcaggcccgcgcguacgccgagaagaacugcaugaccuucuucgagguguccccgcugugcaacuucaacgugaucgagagcuucaccgagcucucccggaucguccugaugcgccacgggauggagaagaucuggcggcccaaccgcguguucagccugcaggaccucugcugccgggccaucguguccugcacccccguccaccugaucgacaagcugccccucccggugacgaucaagagccaccugaaguccuucagcauggccaacggcaugaacgcggugaugaugcacgggcgcuccuacagccuggccagcggcgccggcgggggcggguccaagggcaacagccucaagcgguccaagagcauccgcccgccccaguccccgccccagaacugcagccgguccaacugcaagaucagcuga

SEQ ID NO: 35395 - RNA, 657 nt, Artificial Sequence
  derived and/or modified sequence opt1 from RAB4A__Homo_sapiens__NP_004569
augagccagaccgccauguccgagaccuacgacuuccuguucaaguuccucgugaucggcaacgccgggacgggcaagagcugccugcugcaccaguucaucgagaagaaguucaaggacgacuccaaccacaccaucggggucgaguucggcagcaagaucaucaacgucgggggcaaguacgugaagcuccagaucugggacaccgcgggccaggagcgcuuccgguccgugacccgcagcuacuaccgcggggccgccggcgcccugcugguguacgacaucacgucccgggagaccuacaacgcccucaccaacuggcugaccgacgcgcggaugcuggccagccagaacaucgugaucauccucugcgggaacaagaaggaccuggacgccgaccgcgaggucacguuccuggaggccucccgguucgcgcaggagaacgagcucauguuccuggagaccagcgcccugaccggcgagaacguggaggaggccuucgugcagugcgcccgcaagauccucaacaagaucgaguccggggagcuggaccccgagcggaugggcagcggcauccaguacggggacgccgcgcugcgccagcuccgguccccgcgccgggcccaggcccccaacgcccaggagugcggcugcuga

SEQ ID NO: 35396 - RNA, 642 nt, Artificial Sequence
  derived and/or modified sequence opt1 from RAB4B__Homo_sapiens__NP_057238
auggccgagaccuacgacuuccuguucaaguuccucgugaucggcagcgccgggaccggcaaguccugccugcugcaccaguucaucgagaacaaguucaagcaggacagcaaccacacgaucggggucgaguucggcucccgcguggugaacgucgggggcaagaccgugaagcuccagaucugggacaccgccggccaggagcgguuccgcagcgugacccgguccuacuaccgcggggccgccggcgcccugcuggucuacgacaucacgagccgggagaccuacaacucccucgccgcguggcugaccgacgcccgcacccuggccagccccaacaucguggugauccucugcgggaacaagaaggaccuggacccggagcgggaggucacguuccuggaggccucccgcuucgcgcaggagaacgagcucauguuccuggagaccagcgcccugaccggcgagaacguggaggaggccuuccucaagugcgcccggaccauccugaacaagaucgacuccggggagcuggaccccgagcgcaugggcagcggcauccaguacggggacgccucccuccggcagcugcgccagccccggagcgcgcaggccguggcgccccagccgugcggcugcuga

SEQ ID NO: 35397 - RNA, 606 nt, Artificial Sequence
  derived and/or modified sequence opt1 from RAB5A__Homo_sapiens__NP_001278977
auggccagccgcggcgccacccggcccaacgggccgaacaccggcaacaagaucugccaguucaagcuggugcuccugggggaguccgcggucggcaagagcucccuggugcuccgcuucgugaaggggcaguuccacgaguuccaggagagcacgaucggcgucaaguucgagaucugggacaccgccggccaggagcgguaccacucccuggcccccauguacuaccgcggggcccaggccgcgaucgugguguacgacaucaccaacgaggagagcuucgcccgggccaagaacugggucaaggagcugcagcgccaggccucccccaacaucgugaucgcgcucagcggcaacaaggccgaccuggccaacaagcgggccguggacuuccaggaggcccaguccuacgcggacgacaacagccuccuguucauggagaccuccgccaagacgagcaugaacgucaacgagaucuucauggccaucgccaagaagcugcccaagaacgagccgcagaaccccggggccaacuccgcgcgcggccgcgggguggaccugaccgagcccacccagcccacccggaaccagugcugcagcaacuga

SEQ ID NO: 35398 - RNA, 525 nt, Artificial Sequence
  derived and/or modified sequence opt1 from RAB5B__Homo_sapiens__NP_001238966
augaccagccgcuccaccgcccggcccaacggccagccgcaggccagcaagaucugccaguucaagcuggugcuccugggggaguccgcggucggcaagagcucccuggugcuccgcuucgugaaggggcaguuccacgaguaccaggagagcacgaucggcgccgccuuccugacccaguccgucugccuggacgacaccaccgugaaguucgagaucugggacacggccgggcaggagcgguaccacagccucgcccccauguacuaccgcggcgcgcaggccgccaucguggucuacgacaucaccaaccaggaggcccaggcguacgccgacgacaacucccugcuguucauggagaccagcgccaagaccgccaugaacgugaacgaccucuuccuggccaucgcgaagaagcugcccaaguccgagccccagaaccucggcggggccgccggccggagccgcgggguggaccugcacgagcagucccagcagaacaagagccagugcugcuccaacuga

SEQ ID NO: 35399 - RNA, 750 nt, Artificial Sequence
  derived and/or modified sequence opt1 from RAB5C__Homo_sapiens__NP_001238968
auggagcugagcuggcgcucccccagcccgcucuccgccagccugcacuccaccagcccccacccccacgcccuguggaccacgaccgcgggccgggccauggccgggcgcggcggggccgcccggcccaacggcccggcggccgggaacaagaucugccaguucaagcucgugcugcugggcgaguccgccgucggcaagagcucccucgugcugcgcuucgugaaggggcaguuccacgaguaccaggagagcaccaucggcgccgcguuccugacccagacggucugccucgacgacaccaccgugaaguucgagaucugggacaccgccgggcaggagcgguaccacucccuggcccccauguacuaccgcggcgcccaggccgcgaucguggucuacgacaucacgaacaccgacaccuucgcccgggccaagaacugggugaaggagcugcagcgccaggccagccccaacaucgugaucgcccucgcggggaacaaggccgaccuggccuccaagcgggccgucgaguuccaggaggcccaggcguacgccgacgacaacagccuccuguucauggagaccuccgccaagacggccaugaacgugaacgagaucuucauggccaucgcgaagaagcugcccaagaacgagccgcagaacgccaccggcgcccccggccgcaaccgcgggguggaccugcaggagaacaaccccgccagccggucccagugcugcagcaacuga

SEQ ID NO: 35400 - RNA, 315 nt, Artificial Sequence
  derived and/or modified sequence opt1 from RAB6A__Homo_sapiens__NP_001230647
augagcaccggcggggacuucggcaacccccugcgcaaguucaagcucguguuccugggggagcaguccgucggcaagaccagccugaucacgcgguucauguacgacuccuucgacaacaccuaccaggccaccaucgggaucgacuuccucagcaagaccauguaccuggaggaccgcacgcuguuccggcgcguggccgcggcccucccgggcauggaguccacccaggaccggagccgcgaggacaugaucgacaucaagcuggagaagccccaggagcagcccguguccgagggcgggugcagcugcuga

SEQ ID NO: 35401 - RNA, 627 nt, Artificial Sequence
  derived and/or modified sequence opt1 from RAB6B__Homo_sapiens__NP_057661
augagcgccggcggggacuucggcaacccccugcgcaaguucaagcucguguuccugggggagcaguccgucggcaagaccagccugaucacccgguucauguacgacuccuucgacaacacguaccaggccaccaucgggaucgacuuccucagcaagaccauguaccuggaggaccgcaccgugcggcugcagcucugggacacggcgggccaggagcgcuuccggucccugaucccgagcuacauccgcgacuccaccguggccgucgugguguacgacaucaccaaccugaacagcuuccagcagaccuccaaguggaucgacgacguccggacggagcgcggcagcgacgugaucaucaugcucguggggaacaagaccgaccuggccgacaagcggcagaucaccaucgaggagggcgagcagcgcgccaaggagcuguccgucauguucaucgagaccagcgccaagacgggguacaacgugaagcagcuguuccggcgcguggcguccgcccuccccggcauggagaacguccaggagaaguccaaggaggggaugaucgacaucaagcuggacaagccccaggagcccccggccagcgagggcggcugcagcugcuga

SEQ ID NO: 35402 - RNA, 765 nt, Artificial Sequence
  derived and/or modified sequence opt1 from RAB6C__Homo_sapiens__NP_115520
augagcgccggcggggacuucggcaacccccugcgcaaguucaagcucguguuccugggggagcaguccgucgccaagaccagccugaucacccgguuccgcuacgacuccuucgacaacacguaccaggcgaucaucggcaucgacuuccucagcaagaccauguaccuggaggacgggaccaucggccugcggcucugggacaccgccggccaggagcgccugcggucccugaucccgcgcuacauccgggacagcgccgccgccgugguggucuacgacaucacgaacgugaacuccuuccagcagaccaccaaguggaucgacgacgugcgcaccgagcgggggagcgacgucaucaucacgcucgugggcaaccgcaccgaccuggcggacaagcgccagguguccgucgaggagggggagcggaaggccaagggccugaacgugaccuucaucgagacccgggccaaggccggguacaacgugaagcagcuguuccgccgggucgcggccgcccuccccggcauggagagcacgcaggacggcucccgcgaggacaugagcgacaucaagcuggagaagccccaggagcagaccguguccgagggcgggugcagcugcuacucccccaugagcuccagcacccucccgcagaagccgcccuacuccuucaucgacugcagcgugaacaucgggcugaaccuguuccccagccucaucaccuucugcaacuccagccugcugcccgucuccuggcgguga

SEQ ID NO: 35403 - RNA, 624 nt, Artificial Sequence
  derived and/or modified sequence opt1 from RAB7A__Homo_sapiens__NP_004628
augaccagccgcaagaaggugcugcucaaggucaucauccugggcgacuccggggugggcaagaccagccugaugaaccaguacgugaacaagaaguucuccaaccaguacaaggccacgaucggggccgacuuccucaccaaggaggucaugguggacgaccggcuggugaccaugcagaucugggacaccgcgggccaggagcgcuuccagagccugggggucgccuucuaccggggcgccgacugcugcgugcucguguucgacgucacggcccccaacaccuucaagacccuggacuccuggcgcgacgaguuccugauccaggccagcccgcgggaccccgagaacuuccccuucguggugcucggcaacaagaucgaccuggagaaccgccaggucgcgaccaagcgggcccaggccuggugcuacuccaagaacaacauccccuacuucgagacgagcgccaaggaggcgaucaacguggagcaggccuuccagaccaucgcccgcaacgcccugaagcaggagaccgagguggagcucuacaacgaguucccggagcccaucaagcuggacaagaacgaccgggccaaggcguccgccgagagcugcuccugcuga

SEQ ID NO: 35404 - RNA, 624 nt, Artificial Sequence
  derived and/or modified sequence opt1 from RAB8A__Homo_sapiens__NP_005361
auggccaagaccuacgacuaccuguucaagcuccugcugaucggcgacagcggggugggcaagaccugcguccucuuccgcuucuccgaggacgccuucaacagcacguucaucuccaccaucgggaucgacuucaagauccggaccaucgagcuggacggcaagcgcaucaagcugcagaucugggacaccgcggggcaggagcgguuccgcacgaucaccaccgccuacuaccggggcgccaugggcaucaugcucguguacgacaucaccaacgagaaguccuucgacaacauccgcaacuggauccggaacaucgaggagcacgccagcgccgacguggagaagaugauccuggggaacaagugcgacgucaacgacaagcgccaggugagcaaggagcggggcgagaagcuggcgcucgacuacgggaucaaguucauggagacguccgccaaggccaacaucaacguggagaacgccuucuucacccuggcgcgcgacaucaaggccaagauggacaagaagcuggagggcaacagcccccagggguccaaccagggcgucaagaucaccccggaccagcagaagcggagcuccuucuuccgcugcgugcuccuguga

SEQ ID NO: 35405 - RNA, 624 nt, Artificial Sequence
  derived and/or modified sequence opt1 from RAB8B__Homo_sapiens__NP_057614
auggccaagaccuacgacuaccuguucaagcuccugcugaucggcgacagcggggugggcaagaccugccuccuguuccgcuucuccgaggacgccuucaacacgaccuucaucagcaccaucgggaucgacuucaagauccggaccaucgagcuggacggcaagaagaucaagcuccagaucugggacacggcggggcaggagcgcuuccggaccaucaccaccgccuacuaccgcggcgccaugggcaucaugcuggucuacgacaucacgaacgagaaguccuucgacaacaucaagaacuggauccggaacaucgaggagcacgccagcuccgacguggagcgcaugauccuggggaacaagugcgacaugaacgacaagcgccaggugagcaaggagcggggcgagaagcucgccaucgacuacgggaucaaguuccuggagaccuccgccaagagcuccgcgaacgucgaggaggccuucuucacccuggcccgggacaucaugaccaagcucaaccgcaagaugaacgacagcaacuccgcgggcgccgggggccccgugaagaucacggagaaccggagcaagaagaccuccuucuuccgcugcagccugcuguga

SEQ ID NO: 35406 - RNA, 606 nt, Artificial Sequence
  derived and/or modified sequence opt1 from RAB9A__Homo_sapiens__NP_001182257
auggccggcaagagcucccuguucaaggugauccuccugggggacggcggggucggcaagagcucccugaugaaccgcuacgugaccaacaaguucgacacccagcuguuccacacgaucgggguggaguuccucaacaaggaccuggaggucgacggccacuucgugaccaugcagaucugggacaccgccggccaggagcgguuccgcagccuccggacccccuucuaccgcggguccgacugcugccugcugacguucagcguggacgacucccagagcuuccagaaccucuccaacuggaagaaggaguucaucuacuacgcggacgucaaggagccggagagcuuccccuucgugauccugggcaacaagaucgacaucuccgagcgccaggugagcaccgaggaggcccaggccuggugccgggacaacggggacuaccccuacuucgagaccuccgccaaggacgccaccaacgucgcggccgccuucgaggaggccgugcggcgcgugcuggcgacggaggaccggagcgaccaccucauccagaccgacaccgucaaccugcaccgcaagcccaagccguccagcuccugcugcuga

SEQ ID NO: 35407 - RNA, 558 nt, Artificial Sequence
  derived and/or modified sequence opt1 from RABAC1__Homo_sapiens__NP_006414
auggccgcccagaaggaccagcagaaggacgcggaggccgagggccugagcgggaccacccuccugcccaagcugaucccguccggcgccgggcgcgaguggcucgagcggcgccgggccacgauccgccccuggagcaccuucguggaccagcagcgguucucccgcccccggaaccugggcgagcugugccagcgccucguccggaacguggaguacuaccagagcaacuacguguucgucuuccuggggcugauccucuacugcguggugaccucccccaugcugcuggucgcccucgcgguguucuucggcgccugcuacauccuguaccugcgcacccucgagagcaagcuggugcuguucggccgggaggucuccccggcccaccaguacgcccucgccgggggcaucagcuuccccuucuucuggcuggcgggggccggcuccgccguguucugggugcugggggccacgcucgucgugaucggcagccacgcggccuuccaccagaucgaggccguggacggcgaggagcugcagauggagcccgucuga

SEQ ID NO: 35408 - RNA, 2490 nt, Artificial Sequence
  derived and/or modified sequence opt1 from RABEP1__Homo_sapiens__NP_001077054
auggcccagcccggcccggccagccagcccgacgugucccugcagcagcgcgucgcggagcucgagaagaucaacgccgaguuccugcgggcccagcagcagcuggagcaggaguucaaccagaagcgcgccaaguucaaggagcucuaccuggccaaggaggaggaccugaagcggcagaacgcggugcuccaggccgcccaggacgaccuggggcaccuccgcacccagcugugggaggcccaggcggagauggagaacaucaaggccaucgccaccgugagcgagaacacgaagcaggaggccaucgacgaggucaagcggcaguggcgcgaggagguggccucccugcaggcggugaugaaggagaccguccgggacuacgagcaccaguuccaccuccgccuggagcaggagcggacccagugggcccaguaccgcgagagcgccgagcgggagaucgccgaccugcgccggcgccuguccgagggccaggaggaggagaaccucgagaacgagaugaagaaggcccaggaggacgcggagaagcugcggagcguggugaugcccauggagaaggagaucgccgcccugaaggacaagcucaccgaggccgaggacaagaucaaggagcuggaggccuccaaggucaaggagcugaaccacuaccucgaggcggagaaguccugccgcacggaccuggagauguacguggccgugcugaacacccagaaguccguccuccaggaggacgccgagaagcugcggaaggagcugcacgaggugugccaccuccuggagcaggagcgccagcagcacaaccagcugaagcacaccuggcagaaggccaacgaccaguuccucgagagccagcggcugcugaugcgcgacaugcagcggauggagaucgugcucaccagcgagcagcugcgccaggucgaggagcugaagaagaaggaccaggaggacgacgagcagcagcgccucaacaagcggaaggaccacaagaaggccgacguggaggaggagaucaagauccccguggucugcgcgcugacgcaggaggagagcuccgcccagcugagcaacgaggaggagcaccucgacuccacccgcgggagcgugcacucccuggacgccggccugcuccugccgagcggggaccccuucuccaagagcgacaacgacauguucaaggacggccugcggcgcgcccagagcaccgacucccucggcaccagcgggucccugcagagcaaggcgcugggcuacaacuacaaggccaaguccgccgggaaccucgacgagagcgacuucggcccccuggugggggccgacuccgucagcgagaacuucgacacggccucccugggcagccugcagaugcccuccggcuucaugcucaccaaggaccaggagcgggcgaucaaggccaugaccccggagcaggaggagaccgccagccugcuguccagcgugacgcaggggauggaguccgccuacgugagccccuccggcuaccgccucgucagcgagaccgaguggaaccugcugcagaaggaggugcacaacgccgggaacaagcucggccggcgcugcgacaugugcuccaacuacgagaagcagcugcagggcauccagauccaggaggcggagacccgggaccaggucaagaagcugcagcucaugcugcgccaggccaacgaccagcuggagaagaccaugaaggacaagcaggagcucgaggacuucaucaagcagagcagcgaggacuccagccaccagaucuccgcccuggugcugcgggcccaggccagcgagauccuccuggaggagcugcagcaggggcucucccaggcgaagcgcgacgugcaggagcagauggccguccugaugcagagccgggagcaggucuccgaggagcuggugcgccuccagaaggacaacgacagccugcagggcaagcacucccugcacgugagccuccagcaggccgaggacuucauccugcccgacacgaccgaggcccugcgggagcucgugcugaaguaccgcgaggacaucaucaacgugcggaccgcggccgaccacgucgaggagaagcugaaggccgagauccucuuccugaaggagcagauccaggccgagcagugccugaaggagaaccucgaggagacccugcagcuggagaucgagaacugcaaggaggagaucgccuccaucagcucccucaaggcggagcuggagcgcaucaagguggagaaggggcaggccacgguggagcagcugauguucgaggagaagaacaaggcccagcggcuccagaccgagcuggacgucagcgagcagguccagcgcgacuucgugaagcugucccagacccuccaggugcagcuggagcgcauccggcaggccgacagccuggagcgcauccgggccauccucaacgacaccaagcugacggacaucaaccagcugcccgagaccuga

SEQ ID NO: 35409 - RNA, 1710 nt, Artificial Sequence
  derived and/or modified sequence opt1 from RABEP2__Homo_sapiens__NP_079092
auggccgccgcggcccccguggccgccgacgacgacgagcgccggcgccggccgggcgccgcgcuggaggacagccgcucccaggagggggccaacggcgaggccgagagcggggagcucucccggcugcgcgccgagcuggcgggcgcccucgccgagauggagaccaugaaggccguggccgaggugagcgaguccaccaaggcggaggccguggccgccguccagcggcagugccaggaggagguggccagccugcaggcgauccugaaggacuccaucagcuccuacgaggcccagaucacggcccucaagcaggagcgccagcagcagcagcaggacugcgaggagaaggagcgggagcuggggcgccugaagcagcuccugagccgggccuacccccuggacucccucgagaagcagauggagaaggcccacgaggacagcgagaagcugcgcgagaucgugcugcccauggagaaggagaucgaggagcucaaggcgaagcugcugcgggccgaggagcucauccaggagauccagcgccggccccgccacgccccgucccugcacggcagcaccgagcugcucccccugucccgggaccccagcccgccccuggagccccucgaggagcuguccggcgacgggggccccgccgccgaggcguucgcccacaacugcgacgacagcgccuccaucagcagcuucucccucgggggcggggucggcagcuccagcucccugccccagagccgccagggccuguccccggagcaggaggagaccgccagccugguguccaccgggacgcucgugcccgagggcaucuaccugcccccgcccggguaccagcugguccccgacacccagugggagcagcuccagaccgagggccggcagcugcagaaggaccuggagagcgugucccgcgagcgggacgagcuccaggagggccugcgccgcagcaacgaggacugcgcgaagcagaugcagguccugcucgcccaggugcagaacuccgagcagcugcugcggacccuccaggggacggugagccaggcccaggagcgcgugcagcugcagauggccgagcuggucaccacccacaagugccuccaccacgaggugaagcggcugaacgaggagaaccagggccugcgcgccgagcagcuccccuccagcgcgccccaggggucccagcaggagcagggcgaggaggagagccugccguccagcgugcccgagcugcagcagcugcucugcugcacccggcaggaggcccgcgcccggcugcaggcccaggagcacggggccgagcgccugcggaucgagaucgucacgcuccgcgaggcgcuggaggaggagaccguggcccgggccagccuggagggccagcuccgcgugcagcgggaggagaccgagguccuggaggccucccugugcagccuccgcaccgagauggagcgggugcagcaggagcaguccaaggcccagcugcccgaccugcucagcgagcagcgcgcgaaggugcugcggcugcaggccgagcucgagacguccgagcagguccagcgcgacuucgugcggcugagccaggcccugcagguccgccucgagcgcauccggcaggccgagacccuggagcagguccgcuccaucauggacgaggcgccccugaccgacgugcgggacaucaaggacaccuga

SEQ ID NO: 35410 - RNA, 1119 nt, Artificial Sequence
  derived and/or modified sequence opt1 from RABEPK__Homo_sapiens__NP_001167623
augaagcagcugcccgugcucgagccgggcgacaagccccgcaaggccaccugguacacccugacgguccccggggacagccccugcgcccgggugggccacuccugcagcuaccugccgcccguggggaacgcgaagcgcggcaaggucuucaucgucgggggcgccaaccccaaccgguccuucagcgacgugcacaccauggaccucggcaagcaccagugggaccuggacacgugcaaggggcugcucccccgcuacgagcacgccuccuucaucccgagcugcacccccgaccggaucuggguguucggcggggccaaccaguccggcaaccgcaacugccuccaggugcugaaccccgagacccggaccuggaccacccccgaggugacgagcccgccgcccagcccccgcaccuuccacaccuccuccgccgcgaucgggaaccagcuguacgucuucggcggcggggagcggggcgcccagcccgugcaggacaccaagcugcacguguucgacgccaacacgcugaccuggagccagcccgagacccucgggaacccgcccagcccccgccacggccacgucaugguggccgcgggcaccaagcuguucauccacgggggccuggccggggaccgguucuacgacgaccuccacugcaucgacaucuccgacaugaaguggcagaagcugaaccccacgggcgccgcccccgccgggugcgcggcccacuccgccguggccaugggcaagcacgucuacaucuucggcgggaugacccccgccggcgcgcuggacaccauguaccaguaccacaccgaggagcagcacuggacgcuccugaaguucgacacccugcucccgcccgggcgccuggaccacagcaugugcaucauccccuggcccgugaccugcgccuccgagaaggaggacagcaacucccugacccucaaccacgaggccgagaaggaggacagcgccgacaaggugaugagccacuccggcgacagccacgaggagucccagacggccacccugcugugccucgucuucgggggcaugaacaccgagggcgagaucuacgacgacugcaucgugaccguggucgacuga

SEQ ID NO: 35411 - RNA, 219 nt, Artificial Sequence
  derived and/or modified sequence opt1 from RABGAP1L__Homo_sapiens__NP_001230692
augauggaggagaucagcaucaugguggccuacgacgcccacgucuucucccagcugcacgacgaggacuuccucaccagccugguggcgaucuccaagccccgcagcauggugccgaccaagaagcugaagaaguacgagaaggaguaccagacgaugcgggagucccagcuccagcaggaggaccccauggaccgcuacaaguucgucuaccuguga

SEQ ID NO: 35412 - RNA, 900 nt, Artificial Sequence
  derived and/or modified sequence opt1 from RABGEF1__Homo_sapiens__NP_001273989
augcagacccgcggcaaggugcccccggagcgggucgagaagaucauggaccagaucgagaaguacaucaugacccgccuguacaaguacguguucugccccgagacgaccgacgacgagaagaaggaccucgccauccagaagcggauccgcgcccugcggugggugacgccccagaugcugugcguccccgugaacgaggacaucccggaggugagcgacauggucgugaaggcgaucaccgacaucaucgagauggacuccaagcgcgugccccgggacaagcucgccugcaucaccaagugcagcaagcacaucuucaacgccaucaagaucaccaagaacgagcccgccuccgccgacgacuuccugcccacccugaucuacaucguccucaaggggaacccgccccgccugcagagcaacauccaguacaucacccgguucugcaaccccucccgccugaugacgggcgaggacggguacuacuucaccaaccucugcugcgcgguggccuucaucgagaagcuggacgcccagagccugaaccucucccaggaggacuucgaccgguacaugagcggccagaccagcccccgcaagcaggaggccgaguccugguccccggacgcgugccugggggugaagcagauguacaagaaccuggaccuccugagccagcugaacgagcggcaggagcgcaucaugaacgaggccaagaagcucgagaaggaccugaucgacuggaccgacggcaucgcccgggagguccaggacaucguggagaaguacccccuggagaucaagccgcccaaccagccccucgccgccaucgacuccgagaacguggagaacgacaagcugcccccgccccugcagccccaggucuacgcgggcuga

SEQ ID NO: 35413 - RNA, 372 nt, Artificial Sequence
  derived and/or modified sequence opt1 from RABIF__Homo_sapiens__NP_002862
auggagcccgccgagcagccgagcgagcugguguccgccgagggccgcaaccggaaggcgguccucugccagcgcugcgggagccgggugcugcagcccggcaccgcccuguucucccgccggcagcuguuccuccccagcaugcgcaagaagcccgcccuguccgacgggagcaacccggacggcgaccuccugcaggagcacuggcugguggaggacauguucaucuucgagaacgucggguucaccaaggacgugggcaacaucaaguuccucgugugcgccgacugcgagaucggccccaucggguggcacugccuggacgacaagaacuccuucuacgucgcccuggagcgggugagccacgaguga

SEQ ID NO: 35414 - RNA, 2193 nt, Artificial Sequence
  derived and/or modified sequence opt1 from RABL6__Homo_sapiens__NP_001167459
auguucagcgcccugaagaagcuggugggcuccgaccaggcccccgggcgcgacaagaacauccccgcgggccugcagagcaugaaccaggcccugcagcggcgcuucgccaaggggguccaguacaacaugaagaucgugauccggggcgaccgcaacaccgggaagaccgcccucuggcaccggcugcagggccgccccuucguggaggaguacauccccacgcaggagauccaggucaccuccauccacuggagcuacaagaccaccgacgacaucgugaagguggaggucugggacgugguggacaagggcaagugcaagaagcgcggggacggccugaagauggagaacgacccccaggaggccgaguccgagauggcgcucgacgccgaguuccuggacgucuacaagaacugcaacgggguggugaugauguucgacaucacgaagcaguggaccuucaacuacauccugcgcgagcucccgaagguccccacccacgugcccgugugcguccugggcaacuaccgggacaugggggagcaccgcgugauccugcccgacgacgugcgggacuucaucgacaaccucgacagccgcccgcccggcuccagcuacuuccgguacgccgaguccagcaugaagaacuccuucggccugaaguaccugcacaaguucuucaacauccccuuccuccagcugcagcgcgagacccugcuccggcagcuggagacgaaccagcuggacauggacgccacccucgaggagcugagcguccagcaggagaccgaggaccagaacuacgggaucuuccuggagaugauggaggcgcgcucccggggccacgccagcccccucgccgccaacgggcaguccccgagccccggcucccagagccccguggugcccgccggcgcggucuccaccgggagcagcuccccgggcacgccccagcccgcgccccagcugccgcugaacgccgccccgcccagcuccgugccgcccgugccgcccagcgaggcccugcccccgcccgccugccccuccgcccccgcgccccgccggagcaucaucucccgccucuucgggaccagccccgccaccgaggccgccccgccgccgcccgagcccguccccgccgccgagggccccgccaccgugcaguccgucgaggacuucgugcccgacgaccggcuggaccggagcuuccucgaggacacgacccccgcccgcgacgagaagaaggugggggcgaaggccgcccagcaggacuccgacagcgacggcgaggcccugggcgggaaccccauggucgcgggcuuccaggacgacguggaccuggaggaccagccccggggguccccgccccuccccgccggccccgugcccagccaggacaucacccuguccagcgaggaggaggccgaggucgccgcccccaccaaggggcccgcgcccgcgccccagcagugcuccgagcccgagacgaaguggagcuccaucccggccagcaagccccgccggggcaccgcccccacccgcaccgccgccccgcccuggcccggcggggugagcgugcggacgggccccgagaagcgcuccagcacccggccgcccgccgagauggagcccgggaagggcgagcaggccuccagcuccgagagcgaccccgaggggccgaucgccgcccagaugcuguccuucgucauggacgaccccgacuucgagagcgagggcuccgacacccagcgccgggcggacgacuuccccgugcgcgacgaccccagcgacgugaccgacgaggacgagggcccggccgagcccccgccgccgcccaagcucccccugcccgccuuccggcugaagaacgacuccgaccucuucgggcugggccuggaggaggccgggcccaaggagagcuccgaggagggcaaggagggcaagacgcccagcaaggagaagaagaagaagaagaagaaggggaaggaggaggaggagaaggcggccaagaagaaguccaagcacaagaaguccaaggacaaggaggagggcaaggaggagcgccggcgccggcagcagcgcccgccccggagccgcgagcggaccgccgccgacgagcucgaggccuuccucgggggcggggcgcccggcggccgccaccccgggggcggggacuacgaggagcuguga

SEQ ID NO: 35415 - RNA, 579 nt, Artificial Sequence
  derived and/or modified sequence opt1 from RAC1__Homo_sapiens__NP_008839
augcaggccaucaagugcguggucgugggcgacggggccgugggcaagaccugccugcucaucagcuacaccacgaacgcguuccccggggaguacauccccaccgucuucgacaacuacuccgccaacgugaugguggacggcaagcccgucaaccuggggcugugggacaccgccggccaggaggacuacgaccgccuccggccccugagcuacccccagaccgacguguuccugaucugcuucucccucgugagcccggccuccuucgagaacguccgcgccaagugguaccccgaggugcggcaccacugccccaacacgcccaucauccuggugggcaccaagcuggaccuccgcgacgacaaggacaccaucgagaagcugaaggagaagaagcugaccccgaucacguacccccaggggcucgcgauggccaaggagaucggcgccgucaaguaccuggagugcagcgcccugacccagcgggggcucaagaccguguucgacgaggcgauccgcgccgugcugugcccgccgcccgucaagaagcggaagcgcaagugccugcuccuguga

SEQ ID NO: 35416 - RNA, 579 nt, Artificial Sequence
  derived and/or modified sequence opt1 from RAC2__Homo_sapiens__NP_002863
augcaggccaucaagugcguggucgugggcgacggggccgugggcaagaccugccugcucaucagcuacaccacgaacgcguuccccggggaguacaucccgaccgucuucgacaacuacuccgccaacgugaugguggacagcaagcccgucaaccugggccugugggacaccgccgggcaggaggacuacgaccgccuccggccccuguccuacccccagaccgacguguuccugaucugcuucagccucguguccccggccagcuacgagaacguccgcgccaagugguuccccgaggugcggcaccacugccccuccacgcccaucauccuggugggcaccaagcuggaccuccgcgacgacaaggacaccaucgagaagcugaaggagaagaagcuggcgccgaucaccuacccccagggccucgcccuggccaaggagaucgacagcgucaaguaccuggagugcuccgcccucacgcagcgggggcugaagaccguguucgacgaggcgauccgcgccgugcugugcccccagcccacccggcagcagaagcgcgccugcagccuccuguga

SEQ ID NO: 35417 - RNA, 579 nt, Artificial Sequence
  derived and/or modified sequence opt1 from RAC3__Homo_sapiens__NP_005043
augcaggccaucaagugcguggucgugggcgacggggccgugggcaagaccugccugcucaucagcuacaccacgaacgcguuccccggggaguacauccccaccgucuucgacaacuacuccgccaacgugaugguggacggcaagcccgucaaccuggggcugugggacaccgccggccaggaggacuacgaccgccuccggccccugagcuacccccagaccgacguguuccugaucugcuucucccucgugagcccggccuccuucgagaacguccgcgccaagugguaccccgaggugcggcaccacugcccccacacgcccauccugcuggugggcaccaagcucgaccugcgcgacgacaaggacaccaucgagcggcugcgcgacaagaagcucgcgccgaucaccuacccccaggggcuggccauggcccgggagaucggcagcgucaaguaccuggagugcuccgcccucacgcagcgcgggcugaagaccguguucgacgaggcgauccgggccgugcugugcccgccgcccgucaagaagcccggcaagaagugcaccguguucuga

SEQ ID NO: 35418 - RNA, 1935 nt, Artificial Sequence
  derived and/or modified sequence opt1 from RACGAP1__Homo_sapiens__NP_001306935
augagcugccccugcuucugcccgguggcccugcgcauggacaccaugaugcucaacguccggaaccuguucgagcagcuggugcgccggguggagauccucuccgagggcaacgagguccaguucauccagcuggccaaggacuucgaggacuuccgcaagaaguggcagcggaccgaccacgagcuggggaaguacaaggaccuccugaugaaggcggagacggagcgcagcgcccuggacgugaagcucaagcacgcccggaaccagguggacgucgagaucaagcgccggcagcgcgccgaggccgacugcgagaagcuggagcggcagauccagcugauccgcgagaugcucaugugcgacaccuccggcagcauccagcuguccgaggagcagaaguccgcgcuggccuuccucaaccgggggcagcccagcagcuccaacgccggcaacaagcgccugagcaccaucgacgaguccgggagcauccuguccgacaucagcuucgacaagaccgacgagucccucgacugggacagcucccuggugaagacguucaagcugaagaagcgggagaagcgccggagcaccucccgccaguucguggacggcccgcccggccccgucaagaagacccggagcaucgggagcgccguggaccagggcaacgaguccaucguggcgaagaccacggucaccgugcccaacgacgggggccccaucgaggccgugagcaccaucgagaccguccccuacuggacgcgcucccggcgcaagaccgggacccuccagccguggaacagcgacuccacccugaacagccgccagcuggagccccggacggagaccgacuccgugggcacgccccagagcaacggcgggaugcgccuccacgacuucguguccaagaccgucaucaagcccgagagcugcgugccgugcggcaagcggaucaaguucgggaagcugucccugaagugccgcgacugccggguggucagccaccccgagugccgcgaccggugcccccuccccugcaucccgacccugaucggcacccccgugaagaucggcgaggggaugcuggccgacuucgugucccagaccagccccaugauccccuccaucgucgugcacugcgucaacgagaucgagcagcgcggccucaccgagacggggcuguaccggaucagcggcugcgaccgcaccgugaaggagcugaaggagaaguuccuccgggugaagaccgucccgcugcuguccaagguggacgacauccacgccaucugcagccuccugaaggacuuccugcgcaaccucaaggagccccugcugaccuuccggcucaaccgcgccuucauggaggcggccgagaucacggacgaggacaacuccaucgccgccauguaccaggccgugggggagcugccccaggcgaaccgggacacccuggccuuccucaugauccaccuccagcgcgucgcccagagcccccacaccaagauggacguggccaaccuggccaagguguucggcccgaccaucgucgcgcacgccgugcccaaccccgaccccgugacgaugcugcaggacaucaagcggcagccgaaggucguggagcgccugcugagccugccccucgaguacuggucccaguucaugaugguggagcaggagaacaucgacccccugcacgucaucgagaacagcaacgccuucuccaccccgcagacccccgacaucaaggugagccugcucggccccgugaccacgcccgagcaccagcugcugaagaccccguccagcuccagccucucccagcggguccgcagcacccugaccaagaacacgccccgcuucggguccaagagcaaguccgccaccaaccugggccggcaggggaacuucuucgccagccccaugcucaaguga

SEQ ID NO: 35419 - RNA, 2046 nt, Artificial Sequence
  derived and/or modified sequence opt1 from RAD17__Homo_sapiens__NP_579917
augagcaagaccuuccugcgccccaagguguccagcaccaaggucacggacuggguggacccguccuucgacgacuuccucgagugcagcggcguguccaccaucaccgccaccagccugggggucaacaacuccagccaccggcgcaagaacggccccuccacgcuggagagcucccgguuccccgcccgcaagcgggggaaccucagcucccuggagcagaucuacggccuggagaacagcaaggaguaccucuccgagaacgagcccuggguggacaaguacaagccggagacccagcacgagcuggcggugcacaagaagaagaucgaggaggucgagaccuggcugaaggcccaggugcucgagcgccagcccaagcagggcgggagcauccugcugaucaccggcccgcccgggugcggcaagacgaccacccucaagauccuguccaaggagcacgggauccaggugcaggaguggaucaaccccguccugcccgacuuccagaaggacgacuucaagggcauguucaacaccgagagcuccuuccacauguuccccuaccagagccagaucgccguguucaaggaguuccuccugcgggccacgaaguacaacaagcugcagaugcucggggacgaccugcgcaccgacaagaagaucauccugguggaggaccuccccaaccaguucuaccgggacagccacacccugcacgagguccugcgcaaguacgugcggaucggccgcugcccgcucaucuucaucaucuccgacagccuguccggcgacaacaaccagcggcuccuguuccccaaggagauccaggaggagugcagcaucuccaacaucagcuucaaccccguggcccccaccaucaugaugaaguuccugaaccgcaucgucacgaucgaggcgaacaagaacgggggcaagaucaccgugccggacaagaccucccuggagcuccugugccaggggugcagcggcgacauccgguccgccaucaacagccugcaguucuccagcuccaagggcgagaacaaccuccgcccccggaagaaggggaugagccugaaguccgacgccgugcugagcaaguccaagcgccggaagaagcccgaccgcgucuucgagaaccaggaggugcaggccaucggcgggaaggacgugagccucuuccuguuccgggcgcugggcaagauccucuacugcaagcgcgccucccugaccgagcuggacagcccccgccucccgagccaccuguccgaguacgagcgggacacgcugcucgucgagcccgaggaggugguggagaugagccacaugcccggggaccuguucaaccuguaccuccaccagaacuacaucgacuucuucauggagaucgacgacaucguccgcgccuccgaguuccugagcuucgccgacauccuguccggcgacuggaacacccggagccugcuccgcgaguacuccaccagcaucgccacccggggcgugaugcacuccaacaaggcgcgcggguacgcccacugccagggcgggggcagcuccuuccggccccugcacaagccgcagugguuccugaucaacaagaaguaccgcgagaacugccucgccgccaaggcccuguuccccgacuucugccugcccgcgcucugccugcagacgcagcugcuccccuaccuggcccugcucaccaucccgaugcggaaccaggcccagaucagcuucauccaggacaucgggcgccugccccugaagcggcacuucggccgccucaagauggaggcccugaccgaccgggagcacggcaugaucgaccccgacuccggggacgaggcccagcugaacggcgggcacagcgcggaggagucccucggcgagccgacccaggccacgguccccgagaccuggagccugccccugucccagaacagcgccagcgagcuccccgccucccagccgcagcccuucagcgcccagggggacauggaggagaacaucaucaucgaggacuacgaguccgacggcaccuga

SEQ ID NO: 35420 - RNA, 1488 nt, Artificial Sequence
  derived and/or modified sequence opt1 from RAD18__Homo_sapiens__NP_064550
auggacagccuggccgagucccgcuggcccccgggccucgccgugaugaagaccaucgacgaccugcugcggugcgggaucugcuucgaguacuucaacaucgcgaugaucaucccccagugcagccacaacuacugcucccucugcauccgcaaguuccugagcuacaagacccagugccccacgugcugcgucaccgugaccgagcccgaccugaagaacaaccggauccucgacgagcuggugaagucccugaacuucgcccgcaaccaccuccugcaguucgcccuggagagcccggccaagucccccgccagcuccagcuccaagaaccucgcggucaagguguacacccccguggccagccggcagucccugaagcagggcagccgccugauggacaacuuccucauccgggagauguccgggagcacguccgagcugcugaucaaggagaacaagagcaaguucagcccccagaaggaggccuccccggccgcgaagaccaaggagacccgcagcgucgaggagaucgcccccgaccccuccgaggccaagcggcccgagccgcccagcaccuccacgcucaagcaggucaccaagguggacugccccgugugcggcgugaacauccccgagagccacaucaacaagcaccuggacuccugccugagccgcgaggagaagaaggagucccuccggagcuccgugcacaagcgcaagccgcugcccaagaccgucuacaaccugcucagcgaccgggaccugaagaagaagcugaaggagcacgggcucuccauccagggcaacaagcagcagcugaucaagcgccaccaggaguucgugcacauguacaacgcccagugcgacgcccugcaccccaagagcgcggccgagaucgugcgggagaucgagaacaucgagaagacccgcaugcggcucgaggccuccaagcugaacgagagcgucaugguguucacgaaggaccagaccgagaaggagaucgacgagauccacuccaaguaccgcaagaagcacaagagcgaguuccagcugcucguggaccaggcccggaagggcuacaagaagaucgccgggaugucccagaagaccgucaccaucacgaaggaggacgagagcaccgagaagcuguccagcgugugcaugggccaggaggacaacaugaccagcgugaccaaccacuucucccagagcaagcuggacucccccgaggagcucgagccggaccgcgaggaggacagcuccagcugcaucgacauccaggagguccuguccagcuccgagagcgacuccugcaacagcuccagcuccgacaucauccgggaccugcucgaggaggaggaggcgugggaggccagccacaagaacgaccugcaggacacggagaucagcccccgccagaaccgccggacccgcgccgccgaguccgccgagaucgagccccggaacaagcgcaaccggaacuga

SEQ ID NO: 35421 - RNA, 849 nt, Artificial Sequence
  derived and/or modified sequence opt1 from RAD1__Homo_sapiens__NP_002844
augccccugcucacccagcagauccaggacgaggacgaccaguacagccugguggccucccuggacaacguccgcaaccucagcaccauccugaaggccauccacuuccgggagcacgcgacgugcuucgccaccaagaacggcaucaaggugaccguggagaacgccaagugcguccaggccaacgccuucauccaggcggggaucuuccaggaguucaaggugcaggaggaguccgugaccuuccgcaucaaccugacgguccuccuggacugccugagcaucuucggcuccagcccgaugcccgggacccucaccgcccugcggaugugcuaccagggcuacggguacccccugaugcuguuccucgaggagggcggcguggugaccgucugcaagaucaacacgcaggagcccgaggagacccuggacuucgacuucugcuccaccaacgugaucaacaagaucauccuccagagcgaggggcugcgcgaggccuucuccgagcuggacaugaccagcgaggugcuccagaucacgauguccccggacaagcccuacuuccggcugagcaccuucggcaacgccggguccagccaccuggacuaccccaaggacuccgaccucauggaggcguuccacugcaaccagacccaggucaaccgcuacaagaucagccugcugaagcccuccaccaaggcccucgugcugagcugcaagguguccauccggacggacaaccgcggcuuccugagccuccaguacaugauccggaacgaggacgggcagaucugcuucgucgaguacuacugcugcccggacgaggaggugcccgagagcgaguccuga

SEQ ID NO: 35422 - RNA, 1896 nt, Artificial Sequence
  derived and/or modified sequence opt1 from RAD21__Homo_sapiens__NP_006256
auguucuacgcccacuucgugcugagcaagcgcggcccccucgccaagaucuggcuggcggcccacugggacaagaagcugaccaaggcccacgucuucgagugcaaccucgaguccagcguggaguccaucaucagccccaaggugaagauggcccugcggaccuccgggcaccuccugcugggcgucgugcgcaucuaccaccggaaggccaaguaccugcuggcggacugcaacgaggccuucaucaagaucaagauggccuuccgccccgggguggucgaccugcccgaggagaaccgggaggccgcguacaacgccaucacgcugcccgaggaguuccacgacuucgaccagccgcuccccgaccuggacgacaucgacguggcccagcaguucagccugaaccagucccgcguggaggagaucaccaugcgggaggaggucggcaacaucagcauccuccaggagaacgacuucggggacuucggcauggacgaccgcgagaucaugcgggagggcuccgccuucgaggacgacgacaugcuggugagcaccaccacguccaaccugcuccuggagagcgagcaguccaccagcaaccugaacgagaagaucaaccaccucgaguacgaggaccaguacaaggacgacaacuucggggagggcaacgacgggggcauccucgacgacaagcugaucuccaacaacgacgggggcaucuucgacgacccgcccgcccucagcgaggcgggcgugaugcugcccgagcagcccgcccacgacgacauggacgaggacgacaacgucuccaugggcgggcccgacagccccgacuccguggacccgguggagcccaugcccaccaugaccgaccagacgacccugguccccaacgaggaggaggccuucgcccucgagccgaucgacaucaccgugaaggagaccaaggccaagcgcaagcggaagcugaucguggacagcgucaaggagcuggacagcaagacgauccgcgcgcagcucuccgacuacagcgacaucgugaccacccuggaccuggccccgcccaccaagaagcucaugauguggaaggagaccgggggcguggagaagcuguucucccugcccgcccagccccucuggaacaaccggcugcugaagcuguucacccgcugccucacgccccugguccccgaggaccuccggaagcgccggaagggcggggaggccgacaaccuggacgaguuccugaaggaguucgagaaccccgaggugccgcgcgaggaccagcagcagcagcaccagcagcgggacgugaucgacgagcccaucaucgaggagcccagccgccuccaggaguccgucauggaggccagccggaccaacaucgacgaguccgcgaugcccccgcccccgccccagggcgugaagcgcaaggccgggcagaucgaccccgagcccgucaugcccccgcagcaggucgagcagauggagaucccgcccguggagcugccgcccgaggagccgcccaacaucugccagcugauccccgagcucgagcugcugcccgagaaggagaaggagaaggagaaggagaaggaggacgacgaggaggaggaggacgaggacgccagcggcggggaccaggaccaggaggagcgccgguggaacaagcgcacgcagcagaugcugcacggccuccagcgggcccuggccaagaccggcgcggaguccaucagccugcucgagcugugccgcaacaccaaccggaagcaggccgccgccaaguucuacuccuuccuggugcucaagaagcagcaggcgaucgagcugacccaggaggagcccuacagcgacaucaucgccacgcccgggccccgcuuccacaucaucuga

SEQ ID NO: 35423 - RNA, 1671 nt, Artificial Sequence
  derived and/or modified sequence opt1 from RAD21L1__Homo_sapiens__NP_001130038
auguucuacacccacgugcugaugagcaagcgcggcccccucgccaagaucuggcuggccgcgcacugggagaagaagcugaccaaggcccacgucuucgagugcaaccucgagaucacgaucgagaagauccuguccccgaaggugaagaucgcccugcggaccagcgggcaccuccugcugggcgugguccgcaucuacaaccggaaggccaaguaccuccuggccgacugcuccgaggcguuccugaagaugaagaugaccuucugccccgggcucguggaccugcccaaggagaacuucgaggccagcuacaacgccaucacccugcccgaggaguuccacgacuucgacacgcagaacaugaacgccaucgacguguccgagcacuucacccagaaccagagccgcccggaggagaucacccuccgggagaacuucgacaacgaccugaucuuccaggcggaguccuucggcgaggagagcgagauccugcgccggcacuccuucuucgacgacaacauccuccugaacagcuccgggccccugaucgagcacagcuccggcagccucaccggcgagcgcucccuguucuacgacagcggggacggcuucggggacgagggcgccgccggggagaugaucgacaaccugcuccaggacgaccagaacauccugcuggaggacaugcaccucaaccgggagaucucccugcccagcgagcccccgaacucccuggccgucgagcccgacaacagcgagugcaucugcgugcccgagaacgagaagaugaacgagacgauccuccugagcaccgaggaggagggcuucacccuggaccccaucgacaucuccgacaucgccgagaagcgcaagggcaagaagcggcgccuccugaucgacccgaucaaggagcugagcuccaaggugauccacaagcagcucaccagcuucgcggacacgcugaugguccuggagcucgccccgcccacccagcggcugaugauguggaagaagcgcgggggcgugcacacccugcucuccaccgccgcccaggaccugauccacgccgagcugaagaugcuguucacgaagugcuuccucagcuccggguucaagcugggccggaagaugauccagaaggagagcgugcgcgaggaggucggcaaccagaacaucguggagaccuccaugaugcaggagcccaacuaccagcaggagcucagcaagccccagaccuggaaggacgugaucgggggcucccagcacagcucccacgaggacaccaacaagaacaucaacagcgagcaggacaucgucgagauggugucccuggcggccgaggagagcucccugaugaacgaccuguucgcccaggagaucgaguacagccccguggagcucgagucccugagcaacgaggagaacaucgagacggagcgguggaacgggcgcauccugcagaugcucaaccggcugcgcgagagcaacaagaugggcaugcaguccuucagccugaugaagcucugccggaacuccgaccgcaagcaggccgccgcgaaguucuacagcuuccugguccugaagaagcagcucgccaucgagcugucccagagcgcccccuacgccgacaucaucgccaccauggggcccauguucuacaacaucuga

SEQ ID NO: 35424 - RNA, 927 nt, Artificial Sequence
  derived and/or modified sequence opt1 from RAD23A__Homo_sapiens__NP_001257292
auggccgugaccaucacccugaagacgcuccagcagcagaccuucaagauccggauggagcccgacgagaccgucaaggugcugaaggagaagaucgaggccgagaagggccgggacgcguucccgguggccgggcagaagcugaucuacgccggcaagauccucagcgacgacguccccauccgcgacuaccggaucgacgagaagaacuucgugguggucauggugaccaagacgaaggccgggcagggcaccuccgccccgcccgaggcgagccccaccgccgcccccgaguccagcaccuccuucccgcccgcccccacgagcgggaugucccacccgccgcccgcggcccgcgaggacaagagccccuccgaggagagcgcccccaccaccucccccgagagcguguccggcagcguccccuccagcggcuccagcgggcgggaggaggacgccgccuccacccuggugacgggcagcgaguacgagaccaugcugaccgagaucaugagcaugggguacgagcgcgagcggguggucgcggcccuccgcgccuccuacaacaacccccaccgggccguggaguaccugcugaccggcauccccgggagccccgagcccgagcacggcuccgugcaggagagccaggucuccgagcagccggccacggaggcggccggcgagaacccccucgaguuccugcgcgaccagccccaguuccagaacaugcgccaggugauccagcagaaccccgcccugcucccggcccugcugcagcagcucgggcaggagaacccccagcugcugcagcucaaggcccugggcuuccccgagagccuggugauccaggcguacuucgccugcgagaagaacgagaaccucgccgccaacuuccugcugucccagaacuucgacgacgaguga

SEQ ID NO: 35425 - RNA, 1167 nt, Artificial Sequence
  derived and/or modified sequence opt1 from RAD23B__Homo_sapiens__NP_001231642
auggugaaggcccugaaggagaagaucgagagcgagaagggcaaggacgccuuccccgucgcggggcagaagcucaucuacgccggcaagauccugaacgacgacaccgcccugaaggaguacaagaucgacgagaagaacuucgugguggucauggugaccaagccgaaggccguguccacgcccgcccccgcgaccacccagcagagcgcccccgccuccaccacggccgucaccagcuccaccaccacgaccguggcgcaggccccgacccccgugcccgcccucgcccccaccagcacgccggccuccaucacccccgcgagcgccaccgccuccagcgagcccgcccccgccuccgcggccaagcaggagaagccggccgagaagcccgccgagacccccgucgccacgagccccaccgcgaccgacuccaccagcggggacuccagccgcuccaaccuguucgaggacgccacgagcgcccuggugaccggccaguccuacgagaacauggugaccgagaucaugagcaugggguacgagcgggagcaggucaucgccgcccuccgcgcgagcuucaacaacccggaccgggccguggaguaccugcugaugggcauccccggcgaccgcgagucccaggccguggucgacccgccccaggccgcgagcaccggggcgccccaguccagcgccguggccgccgccgccgccacgaccaccgccaccacgaccaccaccuccagcggcgggcacccccucgaguuccugcggaaccagccccaguuccagcagaugcgccagaucauccagcagaaccccucccugcucccggcccugcugcagcagaucggccgggagaacccccagcuccugcagcagaucagccagcaccaggagcacuucauccagaugcugaacgagcccgugcaggaggccgggggccagggcgggggcgggggcggcggguccggcgggaucgcggaggccggcagcgggcacaugaacuacauccaggucacgccccaggagaaggaggccaucgagcgccucaaggcccugggcuucccggagggccuggugauccaggcguacuucgccugcgagaagaacgagaaccucgccgccaacuuccugcugcagcagaacuucgacgaggacuga

SEQ ID NO: 35426 - RNA, 3939 nt, Artificial Sequence
  derived and/or modified sequence opt1 from RAD50__Homo_sapiens__NP_005723
augagccgcaucgagaagauguccauccugggcgugcggagcuucgggaucgaggacaaggacaagcagaucaucaccuucuucagcccccucaccauccuggucggcccgaacggggccggcaagacgaccaucaucgagugccugaaguacaucugcaccggggacuucccgcccggcaccaagggcaacacguucgugcacgaccccaagguggcccaggagaccgacguccgcgcgcagauccggcuccaguuccgcgacgugaacggggagcugaucgccgugcagcggagcauggucugcacccagaaguccaagaagaccgaguucaagacgcuggagggcgugaucacccgcaccaagcacggggagaaggugagccucuccagcaagugcgccgagaucgaccgggagaugaucuccagccugggcgucuccaaggccgugcugaacaacgugaucuucugccaccaggaggacagcaacuggccccucuccgaggggaaggcccugaagcagaaguucgacgagaucuucagcgcgacccgcuacaucaaggcccuggagacgcuccggcagguccgccagacccagggccagaaggugaaggaguaccagauggagcugaaguaccugaagcaguacaaggagaaggccugcgagauccgggaccagaucaccuccaaggaggcccagcucaccagcuccaaggagaucgucaagagcuacgagaacgagcuggacccccugaagaaccgccucaaggagaucgagcacaaccuguccaagaucaugaagcuggacaacgagaucaaggcgcucgacagccggaagaagcagauggagaaggacaacagcgagcuggaggagaagauggagaagguguuccagggcacggacgagcagcugaacgaccucuaccacaaccaccagcgcaccgugcgggagaaggagcgcaagcugguggacugccaccgggagcuggagaagcucaacaaggagucccgccugcugaaccaggagaaguccgagcuccuggucgagcaggggcggcugcagcuccaggccgaccgccaccaggagcacauccgggcccgcgacucccugauccagagccuggccacccagcucgagcuggacggcuucgagcgcgggcccuucuccgagcggcagaucaagaacuuccacaagcuggugcgcgagcggcaggagggcgaggccaagaccgcgaaccagcucaugaacgacuucgccgagaaggagacgcugaagcagaagcagaucgacgagauccgcgacaagaagaccggccuggggcggaucaucgagcucaagagcgagauccuguccaagaagcagaacgagcugaagaacgugaaguacgagcuccagcagcuggagggcagcuccgaccgcauccuggagcucgaccaggagcugaucaaggccgagcgggagcugagcaaggccgagaagaacuccaacgucgagacccugaagauggaggugaucagccuccagaacgagaaggccgaccuggaccgcacccugcggaagcucgaccaggagauggagcagcugaaccaccacacgaccacccgcacccagauggagaugcugacgaaggacaaggcggacaaggacgagcagauccggaagaucaagucccgccacagcgacgagcucaccucccugcugggguacuuccccaacaagaagcagcucgaggacuggcugcacagcaaguccaaggagaucaaccagacccgggaccgccuggccaagcucaacaaggagcuggccagcuccgagcagaacaagaaccacaucaacaacgagcugaagcggaaggaggagcagcucagcagcuacgaggacaagcuguucgacgugugcggcucccaggacuucgagagcgaccuggaccgccucaaggaggagaucgagaaguccagcaagcagcgggccaugcuggccggggcgaccgccgucuacucccaguucaucacgcagcugaccgacgagaaccagagcugcugcccggugugccagcgcgucuuccagaccgaggccgagcuccaggaggugaucuccgaccugcagagcaagcugcggcucgcccccgacaagcugaaguccaccgagagcgagcugaagaagaaggagaagcgccgcgacgagaugcucggccuggugcccaugcggcaguccaucaucgaccugaaggagaaggagauccccgagcuccgcaacaagcugcagaacgucaaccgggacauccagcgccugaagaacgacaucgaggagcaggagacgcuccugggcaccaucaugccggaggaggagagcgccaaggugugccugaccgacgugaccaucauggagcgguuccagauggagcucaaggacgucgagcgcaagaucgcgcagcaggccgccaagcugcaggggaucgaccuggaccggaccgugcagcaggucaaccaggagaagcaggagaagcagcacaagcucgacacgguguccagcaagaucgagcugaaccgcaagcugauccaggaccagcaggagcagauccagcaccucaaguccaccaccaacgagcucaagagcgagaagcugcagaucuccaccaaccugcagcggcgccagcagcuggaggagcagacgguggagcugagcaccgaggugcagagccucuaccgggagaucaaggacgccaaggagcaggucagcccccuggagaccacccuggagaaguuccagcaggagaaggaggagcucaucaacaagaagaacacgagcaacaagaucgcgcaggacaagcugaacgacaucaaggagaaggugaagaacauccacggcuacaugaaggacaucgagaacuacauccaggacgggaaggacgacuacaagaagcagaaggagaccgagcugaacaaggugaucgcccagcucuccgagugcgagaagcacaaggagaagaucaacgaggacaugcgccugaugcggcaggacaucgacacccagaagauccaggagcgcuggcugcaggacaaccucacccugcggaagcgcaacgaggagcugaaggaggucgaggaggagcggaagcagcaccucaaggagaugggccagaugcagguccugcagaugaaguccgagcaccagaagcuggaggagaacaucgacaacaucaagcgcaaccacaaccucgcccuggggcggcagaagggcuacgaggaggagaucauccacuucaagaaggagcugcgcgagccccaguuccgggacgccgaggagaaguaccgcgagaugaugaucgugaugcgcacgaccgagcucgugaacaaggaccuggacaucuacuacaagacccuggaccaggccaucaugaaguuccacuccaugaagauggaggagaucaacaagaucauccgggaccucuggcgcagcaccuaccggggccaggacaucgaguacaucgagauccgcuccgacgcggacgagaacgugagcgccuccgacaagcggcgcaacuacaacuaccggguggucaugcugaagggggacacggcccuggacaugcgcggccggugcagcgccgggcagaaggugcucgccucccugaucauccgccuggcgcucgccgagaccuucugccugaacugcggcaucaucgcccuggacgagcccaccaccaaccucgaccgggagaacaucgagagccuggcccacgcccugguggagaucaucaagucccgcagccagcagcggaacuuccagcuccuggucaucacgcacgacgaggacuucguggagcugcucgggcgcuccgaguacguggagaaguucuaccggaucaagaagaacaucgaccagugcagcgagaucgucaagugcuccgugagcucccugggcuucaacgugcacuga

SEQ ID NO: 35427 - RNA, 1059 nt, Artificial Sequence
  derived and/or modified sequence opt1 from RAD51AP1__Homo_sapiens__NP_001124334
auggugcgccccguccggcacaagaagccggugaacuacagccaguucgaccacuccgacagcgacgacgacuucguguccgccaccgucccccugaacaagaagucccgcaccgcccccaaggagcucaagcaggacaagcccaagccgaaccugaacaaccugcggaaggaggagauccccgugcaggagaagacgcccaagaagcgccuccccgagggcaccuucuccaucccggcgagcgccgugcccugcaccaagauggcccuggacgacaagcuguaccagcgggaccucgaggucgcccuggcccuguccgugaaggagcuccccaccgugacgaccaacguccagaacagccaggacaaguccaucgagaagcacgggagcuccaagaucgagaccaugaacaagagcccccacaucuccaacugcagcguggcguccgacuaccuggaccuggacaagaucaccguggaggacgacgucggcggggugcagggcaagcgcaaggccgccagcaaggccgcggcccagcagcggaagauccuccuggagggguccgacggcgacagcgccaacgacacggagccggacuucgcccccggcgaggacuccgaggacgacagcgacuucugcgagagcgaggacaacgacgaggacuucuccaugcgcaagagcaaggugaaggagaucaagaagaaggaggucaaggugaagucccccguggagaagaaggagaagaaguccaagagcaagugcaacgcccuggucaccagcguggacuccgcgcccgccgccgucaagagcgagucccagagccucccgaagaaggugucccugagcuccgacaccacccggaagccccuggagauccgcagccccuccgccgagagcaagaagcccaagugggugccgcccgccgcguccgggggcagccgguccagcagcagcccccucguggucgugagcgucaagucccccaaccagagccugcgccuggggcucucccggcuggcccgcgugaagccgcugcaccccaacgccacgagcaccuga

SEQ ID NO: 35428 - RNA, 1053 nt, Artificial Sequence
  derived and/or modified sequence opt1 from RAD51B__Homo_sapiens__NP_002868
augggcagcaagaagcugaagcgcguggggcucucccaggagcugugcgaccggcugagccgccaccagauccugaccugccaggacuuccucugccugagcccccucgagcugaugaaggucaccggccuguccuaccgcggggugcacgagcuccugugcauggugucccgggccugcgccccgaagaugcagacggcguacggcaucaaggcccagcggagcgccgacuucucccccgccuuccugagcaccacccucuccgcccuggacgaggcgcugcacgggggcgucgccugcggcagccucaccgagaucacggggccgcccggcugcgggaagacccaguucugcaucaugauguccauccuggccacccugcccaccaacaugggcgggcucgagggcgccgugguguacaucgacacggagagcgcguucuccgccgagcgccuggucgagaucgccgagagccgguucccccgcuacuucaacaccgaggagaagcugcuccugaccuccagcaaggugcaccuguaccgggagcugaccugcgacgaggugcuccagcgcaucgagucccuggaggaggagaucaucagcaagggcaucaagcucgucauccuggacuccguggccagcgugguccggaaggaguucgacgcccagcugcaggggaaccucaaggagcgcaacaaguuccuggcgcgggaggccagcucccugaaguaccucgccgaggaguucagcauccccgugauccugacgaaccagaucaccacccaccuguccggcgcccucgccagccaggcggaccuggugucccccgccgacgaccugagccucuccgaggggaccagcggcuccagcugcgucaucgccgcccugggcaacacguggucccacagcgugaacacccgccugauccuccaguaccuggacuccgagcggcgccagauccugaucgccaagagcccgcucgcgcccuucaccuccuucguguacaccaucaaggaggaggggcugguccugcaggccuacggcaacagcuga

SEQ ID NO: 35429 - RNA, 408 nt, Artificial Sequence
  derived and/or modified sequence opt1 from RAD51C__Homo_sapiens__NP_002867
augcgcggcaagaccuuccgguucgagaugcagcgcgaccuggugagcuucccccucuccccggccguccgggugaagcuggugagcgccggguuccagaccgcggaggagcugcucgaggucaagcccuccgagcugagcaaggaggugggcaucuccaaggccgaggcccuggagacgcuccagaucauccgccgggagugccugaccaacaagccccgcuacgccgggaccagcgagucccacaagaagugcaccgcccuggagcuccuggagcaggagcacacgcagggcuucaucaucaccuucugcagcgcgcuggacgacauccucgggggcggcgugccccugaugaagaccaccgagaucugcggggccccgggcgucgggaagacgcagcugugguga

SEQ ID NO: 35430 - RNA, 1047 nt, Artificial Sequence
  derived and/or modified sequence opt1 from RAD51D__Homo_sapiens__NP_001136043
augggcgugcugcgcgucgggcucugccccggccugaccgaggagaugauccagcugcuccggagccaccgcaucaagaccgugguggaccuggucuccgccgaccuggaggagguggcccagaagugcgggcucagcuacaagacguggcgggcgcacuccagcggcaaccucgggggccugcagcugccccaggugccggccggccgcuccuggagcgggguccggaacgcccugaagaaggccggccuggggcacggcgggaccgacggccucucccugaacgccuucgacgagcgcggcaccgcggugagcaccucccggcuggacaagcuccuggacgccgggcuguacacgggcgaggugaccgagaucgucgggggccccggcagcgggaagacccaggugugccucugcauggccgccaacguggcgcacggccugcagcagaacguccuguacguggacuccaacgggggccucaccgccagccgccugcugcagcuccugcaggccaagacgcaggacgaggaggagcaggccgaggcccugcggcgcauccaggugguccacgcguucgacaucuuccagaugcucgacgugcugcaggagcugcgggggaccguggcccagcaggucaccggcuccagcggcaccgugaagguggucgugguggacuccgucacggccguggucagcccccuccucgggggccagcagcgcgaggggcuggcccugaugaugcagcuggcccgggagcugaagacccucgcgcgcgaccugggcauggccgugguggucaccaaccacaucacccgggaccgcgacuccgggcggcugaagccggcccucggccgcagcugguccuucgugcccagcacgcggauccugcuggacaccaucgagggcgccggggccagcggcgggcgccggauggcgugccucgccaaguccagccgccagcccaccggcuuccaggagaugguggacaucgggaccuggggcacguccgagcagagcgccacccugcagggcgaccagaccuga

SEQ ID NO: 35431 - RNA, 843 nt, Artificial Sequence
  derived and/or modified sequence opt1 from RAD51__Homo_sapiens__NP_001157742
auggccaugcagaugcagcuggaggccaacgcggacaccagcguggaggaggaguccuucggcccccagccgaucagccgccucgagcagugcgggaucaacgccaacgacgucaagaagcuggaggaggccggcuuccacaccguggaggccguggccuacgcgcccaagaaggagcugaucaacaucaaggggaucuccgaggccaaggccgacaagauccucgccgaggcggccaagcugguccccaugggcuucacgaccgccaccgaguuccaccagcggcgcagcgagaucauccagaucaccacgggguccaaggagcuggacaagcuccugcagggcggcaucgagaccgggagcaucaccgagauguucggcgaguuccggaccgggaagacgcagaucugccacacccuggccgugaccugccagcuccccaucgaccgcggcgggggcgagggcaaggccauguacaucgacaccgaggggacguuccggccggagcgccugcuggcgguggccgagcgguacggccucuccgggagcgacguccuggacaacguggccuacgcccgcgccuucaacaccgaccaccagacccagcugcucuaccaggcguccgccaugaugguggagagccgguacgcccugcugaucgucgacuccgccaccgcccucuaccgcacggacuacagcggccggggcgagcuguccgcgcgccagaugcaccuggcccgguuccuccgcaugcugcugcggcucgccgacgagaucgugagcgaggagcgcaagcgggggaaccagaaccugcagaaccugcgccucucccugagcuccuga

SEQ ID NO: 35432 - RNA, 1257 nt, Artificial Sequence
  derived and/or modified sequence opt1 from RAD52__Homo_sapiens__NP_001284348
augagcggcaccgaggaggccauccucgggggccgcgacucccaccccgccgccgggggcgggagcgugcugugcuucggccagugccaguacaccgcggaggaguaccaggccauccagaaggcccugcggcagcgccugggcccggaguacaucuccagccggauggccgggggcgggcagaaggucugcuacaucgagggccaccgcgugaucaaccucgcgaacgagauguucggguacaacggcugggcccacuccaucacgcagcagaacguggacuucgucgaccugaacaacggcaaguucuacgugggggugugcgccuucguccgggugcagcugaaggacggcagcuaccacgaggacgugggguacggcgucuccgagggccucaagagcaaggcccugucccuggagaaggcgcgcaaggaggccgugaccgacgggcucaagcgggcccugcgcagcuucggcaacgcccuggggaacugcauccucgacaaggacuaccugcggucccugaacaagcucccccgccagcugccccuggagguggaccucaccaaggccaagcggcaggaccuggagcccagcgucgaggaggcgcgcuacaacuccugccggccgaacauggcccugggccacccccagcuccagcaggucaccagccccucccgccccagccacgccgugaucccggccgaccaggacugcuccagccggucccugagcagcuccgccguggagagcgaggcgacgcaccagcgcaagcugcggcagaagcagcuccagcagcaguuccgcgagcggauggagaagcagcagguccgcguguccacccccagcgccgagaaguccgaggccgccccgcccgccccgcccgugacccacagcacccccgugacgguguccgagccccugcuggagaaggacuuccucgcgggggucacccaggagcugaucaagacccuggaggacaacagcgagaagugggccgugacccccgacgccggcgacggcguggucaagcccuccagccgggccgaccccgcccagacguccgacacccucgcgcugaacaaccagauggugacccagaaccgcacgccccacagcgucugccaccagaagccgcaggccaaguccgggagcugggaccugcagaccuacuccgccgaccagcgcaccaccggcaacugggagagccaccggaagucccaggacaugaagaagcgcaaguacgaccccagcuga

SEQ ID NO: 35433 - RNA, 354 nt, Artificial Sequence
  derived and/or modified sequence opt1 from RAD54B__Homo_sapiens__NP_001192191
augcgccggagcgccgcccccucccagcugcagggcaacagcuucaagaagccgaaguucaucccgcccgggcgcuccaaccccggccucaacgaggagaucaccaagcugaaccccgacaucaagcuguucgaggggguggcgaucaacaacaccuuccuccccagccagaacgaccugcggaucugcucccugaaccuccccagcgaggaguccacgcgcgagaucaacaaccgggacaacugcagcggcaaguacugcuucgaggcccccacccuggccacccuggacccgccccacaccguccagacguggaugcgccggcaccgccucgugcccgugcacuaccgguga

SEQ ID NO: 35434 - RNA, 1176 nt, Artificial Sequence
  derived and/or modified sequence opt1 from RAD9A__Homo_sapiens__NP_004575
augaagugccuggugaccggcgggaacgucaaggugcucggcaaggccgugcacagccugucccgcaucggggacgagcuguaccucgagccccuggaggacggccugagccuccggaccgucaacuccagccgcuccgccuacgcgugcuuccuguucgccccgcuguucuuccagcaguaccaggccgccacccccgggcaggaccuccugcggugcaagauccugaugaaguccuuccucagcguguuccgcagccuggccaugcuggagaagaccguggagaagugcugcaucucccucaacggccggagcucccgccuggucgugcagcugcacugcaaguucggcgugcggaagacccacaaccucagcuuccaggacugcgagucccugcaggcggucuucgaccccgccagcugcccccacaugcugcgcgccccggcccgggugcucggggaggcggugcugcccuucucccccgcccuggccgaggucacccucggcaucgggcgcggccggcgcgugauccugcggagcuaccacgaggaggaggccgacuccacggccaaggcgauggugaccgagaugugccugggggaggaggacuuccagcagcuccaggcccaggagggcgucgccaucaccuucugccugaaggaguuccgcggccugcucagcuucgccgaguccgccaaccugaaccugagcauccacuucgacgcgcccgggcggccggccaucuucaccaucaaggacagccuccuggacggccacuucgugcuggccacgcucuccgacaccgacagccacucccaggaccuggggagccccgagcgccaccagcccgugccccagcugcaggcccacuccaccccgcaccccgacgacuucgccaacgacgacaucgacagcuacaugaucgcgauggagaccacgaucggcaacgagggcucccggguccuccccagcaucucccugagccccgggccgcagccgcccaagucccccggcccccacagcgaggaggaggacgaggccgagcccuccaccgugcccgggacgcccccgcccaagaaguuccgcagccuguucuucggcuccauccucgcccccgugcggagcccccaggggccgucccccguccuggccgaggacagcgagggcgagggcuga

SEQ ID NO: 35435 - RNA, 1038 nt, Artificial Sequence
  derived and/or modified sequence opt1 from RAD9B__Homo_sapiens__NP_001273461
augagcgagaacgagcuggacaccacccuccaccugaagugcaagcugggcaugaaguccauccuccccaucuuccgcugccugaacagccuggagcggaacaucgagaagugccgcaucuucacgcgguccgacaagugcaagguggucauccaguucuucuaccgccacgggaucaagcggacccacaacaucugcuuccaggagagccagccgcuccaggugaucuucgacaagaacgugugcaccaacacccugaugauccagccccgccugcucgccgacgccaucguccuguucacguccagccaggaggaggugacccuggcggugacgccccucaacuucugccugaaguccagcaacgaggaguccauggaccugagcaacgccguccacuccgagauguucgugggcagcgacgaguucgacuucuuccagaucgggauggacaccgagaucaccuucugcuucaaggagcucaagggcauccugaccuucuccgaggccacccacgcccccaucagcaucuacuucgacuucccggggaagccccuggcccucuccaucgacgacaugcugguggaggcgaacuucauccuggccacccucgccgacgagcagagccgggccuccagcccccagucccugugccugagccagaagcgcaagcggagcgaccucaucgagaagaaggcgggcaagaacgucacgggccaggcccuggagugcaucuccaagaaggccgcgccccgccggcuguacccgaaggagacccucaccaacaucagcgcccuggagaacugcgggucccccgccaugaagcgcguggacggcgacgugagcgaggucuccgagagcuccgugagcaacaccgaggaggugcccgggucccugugccuccggaaguucagcugcauguucuucggcgccgucuccagcgaccagcaggagcacuucaaccaccccuucgacucccuggcccgcgccagcgacuccgaggaggacaugaacaacgggagcuucuccaucuucuga

SEQ ID NO: 35436 - RNA, 1221 nt, Artificial Sequence
  derived and/or modified sequence opt1 from RAE1__Homo_sapiens__XP_005260640
auggcccccgccgaggcggagcugccgcccggcagcgcccuccugcgcgacgccggggcccgggccggccugcucaccaagcugcgcuacugggcgcuggaggcccgguucaagaugucccucuucgggaccacgagcggcuucgggaccuccggcaccagcauguucggcuccgccaccacggacaaccacaaccccaugaaggacaucgaggugaccagcucccccgacgacagcaucgggugccuguccuucagcccgcccacccugcccggcaacuuccucaucgccggguccugggcgaacgacguccgcugcugggaggugcaggacagcggccagaccauccccaaggcccagcagaugcacacggggccggugcuggacgucugcugguccgacgacggcagcaagguguucaccgccuccugcgacaagaccgccaagaugugggaccugagcuccaaccaggccauccagaucgcgcagcacgacgcccccgugaagaccauccacuggaucaaggcccccaacuacagcugcgucaugacgggcuccugggacaagacccucaaguucugggacacccggagcagcaaccccaugauggugcugcagcugccggagcgcugcuacugcgccgacgugaucuaccccauggccgucguggcgaccgccgagcgggggcucaucguguaccagcuggagaaccagcccuccgaguuccgccggaucgagagcccccugaagcaccagcaccgcugcgucgccaucuucaaggacaagcagaacaagccgacgggcuucgcccucggguccaucgagggccggguggccauccacuacaucaacccgcccaaccccgcgaaggacaacuucaccuucaagugccaccgcagcaacggcaccaacaccuccgcgccccaggacaucuacgccgugaacgggaucgccuuccaccccguccacggcacgcuggccaccguggggagcgacggccgguucuccuucugggacaaggacgcccgcaccaagcugaagaccagcgagcagcucgaccagcccaucuccgccugcugcuucaaccacaacgggaacaucuucgccuacgccagcuccuacgacuggagcaagggccacgaguucuacaacccccagaagaagaacuacaucuuccugcggaacgcggccgaggagcugaagccgcgcaacaagaaguga

SEQ ID NO: 35437 - RNA, 684 nt, Artificial Sequence
  derived and/or modified sequence opt1 from RAET1E__Homo_sapiens__NP_001230254
augcgccggaucagccugaccuccagccccgugcgccuccugcuguuccuccugcugcuccugaucgcccuggagaucauguacaacuccgacaacaacauggucaagccgcucggccugcuggggaagaagguguacgccaccagcacguggggcgagcucacccagacccugggggaggugggccgggaccugcgcaugcuccugugcgacaucaagccccagaucaagaccuccgaccccagcacgcugcaggucgagauguucugccagcgggaggcggagcgcugcaccggggccuccuggcaguucgccaccaacggcgagaagucccuccuguucgacgccaugaacaugaccuggacggugaucaaccacgaggccagcaagaucaaggagaccuggaagaaggaccggggccuggagaaguacuuccgcaagcucagcaagggggacugcgaccacuggcugcgggaguuccugggccacugggaggcgaugcccgagccgaccgugucccccgucaacgccagcgacauccacugguccagcuccagccuccccgaccgcuggaucauccugggggccuucauccugcucgugcugaugggcaucgugcugaucugcgucugguggcagaacggggaguggcaggccggccucuggccccugcggaccuccuga

SEQ ID NO: 35438 - RNA, 741 nt, Artificial Sequence
  derived and/or modified sequence opt1 from RAET1L__Homo_sapiens__NP_570970
auggccgccgcggccauccccgcccugcuccugugccugccgcuccuguuccuccuguucggcuggagccgcgcccggcgcgacgacccccacucccugugcuacgacaucaccgugauccccaaguuccggcccgggccgcgcuggugcgccguccagggccagguggacgagaagaccuuccugcacuacgacugcgggaacaagacggugacccccgucagcccccucggcaagaagcugaacgugaccauggcguggaaggcccagaaccccgugcugcgggaggucguggacauccucaccgagcagcugcuggacauccagcucgagaacuacacgccgaaggagccccugacccugcaggcccgcauguccugcgagcagaaggccgaggggcacagcuccggcagcuggcaguucuccaucgacggccagaccuuccuccuguucgacagcgagaagcggauguggaccacggugcaccccggggcgcgcaagaugaaggagaagugggagaacgacaaggacgucgccauguccuuccacuacaucagcaugggcgacugcaucggguggcuggaggacuuccucaugggcauggacuccacccuggagcccagcgccggggccccgcuggccauguccagcggcaccacccagcuccgggcgacggccaccacccugauccugugcugccuccugaucauccugcccugcuucauccuccccggcaucuga

SEQ ID NO: 35439 - RNA, 1947 nt, Artificial Sequence
  derived and/or modified sequence opt1 from RAF1__Homo_sapiens__NP_002871
auggagcacauccagggcgccuggaagaccaucagcaacggguucggcuucaaggacgccguguucgacggguccagcugcaucucccccaccaucguccagcaguucggcuaccagcgccgggcgagcgacgacgggaagcugacggacccguccaagaccagcaacaccauccgcguguuccuccccaacaagcagcggaccguggucaacgugcgcaacggcaugucccugcacgacugccugaugaaggcccucaaggugcggggccugcagcccgagugcugcgccgucuuccgccugcuccacgagcacaaggggaagaaggcccggcuggacuggaacacggacgccgcgagccugaucggcgaggagcuccagguggacuuccuggaccacgugccccugaccacccacaacuucgcccgcaagaccuuccucaagcuggccuucugcgacaucugccagaaguuccugcucaacggguuccggugccagacgugcggcuacaaguuccacgagcacugcuccaccaaggucccgaccaugugcguggacuggagcaacauccgccagcugcuccuguuccccaacuccaccaucggggacagcggcgugcccgcccugcccucccugacgaugcggcgcaugcgggagagcgucucccgcaugccggugagcucccagcaccgguacagcacgccccacgcguucaccuucaacaccuccagccccagcuccgagggcagccucucccagcgccagcggagcaccuccacccccaacgugcacauggucagcaccacccugccgguggacucccgcaugaucgaggacgccauccggagccacuccgagagcgccucccccagcgcccuguccagcucccccaacaaccucagccccacgggguggucccagccgaagacccccgugcccgcccagcgcgagcgggcgcccgucagcggcacccaggagaagaacaagauccgcccgcgcgggcagcgggacuccagcuacuacugggagaucgaggccagcgaggugaugcuguccacccgcaucggcagcggcuccuucgggacgguguacaagggcaaguggcacggggacgucgccgugaagauccugaagguggucgaccccacccccgagcaguuccaggccuuccggaacgagguggccguccuccgcaagacccggcacgugaacauccugcuguucaugggcuacaugaccaaggacaaccucgcgaucgugacgcaguggugcgaggggagcucccuguacaagcaccuccacguccaggagaccaaguuccagauguuccagcugaucgacaucgcccgccagaccgcccagggcauggacuaccugcacgccaagaacaucauccaccgggacaugaaguccaacaacaucuuccugcacgagggccucaccgugaagaucggggacuucggccuggccacggugaagucccgcuggagcgggagccagcaggucgagcagcccaccggcagcgugcuguggauggcgccggaggugauccggaugcaggacaacaaccccuucuccuuccagagcgacgucuacuccuacgggaucgugcucuacgagcugaugaccggcgagcugcccuacagccacaucaacaaccgcgaccagaucaucuucauggugggccggggguacgccucccccgaccucagcaagcuguacaagaacugcccgaaggccaugaagcgccuggucgccgacugcgugaagaaggugaaggaggagcggccccucuucccccagauccuguccagcaucgagcugcuccagcacagccugccgaagaucaaccgcuccgccagcgagcccucccugcaccgggcggcccacaccgaggacaucaacgccugcacgcugaccaccagcccccgccuccccgucuucuga

SEQ ID NO: 35440 - RNA, 3132 nt, Artificial Sequence
  derived and/or modified sequence opt1 from RAG1__Homo_sapiens__XP_005253098
auggccgccagcuucccgcccacccugggccucuccagcgcgcccgacgagauccagcacccccacaucaaguucuccgaguggaaguucaagcuguuccgcgugcggagcuucgagaagacccccgaggaggcccagaaggagaagaaggacuccuucgaggggaagccgagccuggagcagucccccgccguccucgacaaggccgacggccagaagcccgugcccacgcagccgcugcugaaggcccaccccaaguucagcaagaaguuccacgacaacgagaaggcgcgcgggaaggccauccaccaggccaaccuccggcaccugugccgcaucugcggcaacuccuuccgggccgacgagcacaaccgccgguaccccgugcacgggcccgucgacggcaagacccugggccuccugcgcaagaaggagaagcgggcgaccagcuggccggaccugaucgccaagguguuccgcaucgacgugaaggccgacgucgacuccauccaccccaccgaguucugccacaacugcuggagcaucaugcaccggaaguucuccagcgcccccugcgagguguacuucccccgcaacgugacgauggaguggcacccgcacacccccuccugcgacaucugcaacaccgcccggcgcgggcucaagcgcaagagccugcagcccaaccugcagcucuccaagaagcugaagaccguccuggaccaggcgcggcaggcccggcagcacaagcgccgggcccaggcccgcaucagcuccaaggacgugaugaagaagaucgccaacugcagcaagauccaccucagcacgaagcugcuggcgguggacuuccccgagcacuucgucaaguccaucagcugccagaucugcgagcacauccucgccgacccgguggagaccaacugcaagcacguguucugccgggucugcauccugcgcugccugaaggugaugggcuccuacugccccagcugccgcuaccccugcuuccccaccgaccucgaguccccggucaagagcuuccuguccgugcugaacagccucauggugaagugccccgccaaggagugcaacgaggaggugucccuggagaaguacaaccaccacaucagcucccacaaggagagcaaggagaucuucguccacaucaacaagggcgggcggccccgccagcaccuccucucccugacccggcgcgcccagaagcaccggcugcgcgagcucaagcuccaggugaaggccuucgcggacaaggaggagggcggggacgucaagagcgugugcaugacgcuguuccugcuggcccugcgggcccgcaacgagcaccggcaggccgacgagcucgaggccaucaugcagggcaagggguccggccugcagcccgcggugugccuggccauccgcgucaacaccuuccucagcugcucccaguaccacaagauguaccggaccgugaaggccaucaccgggcgccagaucuuccagccgcugcacgcccugcggaacgcggagaaggugcuccugcccggcuaccaccacuucgaguggcagcccccgcugaagaacgucagcuccagcacggacgugggcaucaucgacgggcucagcggccuguccagcuccguggacgacuaccccgucgacaccaucgccaagcgcuuccgguacgacagcgcccugguguccgcccugauggacauggaggaggacauccucgaggggaugcgcagccaggaccuggacgacuaccugaacggccccuucaccguggucgugaaggaguccugcgacgggaugggcgacgugagcgagaagcacggcuccgggcccgucgugccggagaaggccgugcgguucagcuucaccaucaugaagaucacgaucgcgcacuccagccagaacgucaagguguucgaggaggccaagcccaacuccgagcucugcugcaagccccugugccugaugcucgccgacgagagcgaccacgagacccugaccgccauccugagcccccucaucgccgagcgcgaggcgaugaaguccuccgagcugaugcuggagcucggcgggauccugcggaccuucaaguucaucuuccgcggcacgggguacgacgagaagcuggugcgcgaggucgagggccucgaggccagcggcagcguguacaucugcacccugugcgacgccacccggcuggaggccucccagaaccucguguuccacagcaucacccgcucccacgccgagaaccuggagcgguacgaggucuggcgcagcaacccguaccacgaguccguggaggagcugcgggaccgcgugaagggggucagcgcgaagcccuucaucgagacggugcccuccaucgacgcccuccacugcgacaucggcaacgccgccgaguucuacaagaucuuccagcuggagaucggggagguguacaagaaccccaacgcgagcaaggaggagcggaagcgcuggcaggccacccuggacaagcaccuccggaagaagaugaaccugaagccgaucaugcgcaugaacggcaacuucgcccggaagcugaugaccaaggagaccgucgacgccgugugcgagcucauccccuccgaggagcgccacgaggcccugcgggagcugauggaccucuaccugaagaugaagcccguguggcgcagcuccugccccgcgaaggagugcccggagagccugugccaguacuccuucaacagccagcgguucgccgagcuccuguccacgaaguucaaguaccgcuacgaggggaagaucaccaacuacuuccacaagacccuggcccacguccccgagaucaucgagcgggacggcagcaucggcgccugggccuccgaggggaacgagagcggcaacaagcuguuccgccgguuccgcaagaugaacgcgcggcaguccaagugcuacgagauggaggacgugcugaagcaccacuggcuguacaccagcaaguaccuccagaaguucaugaacgcccacaacgcccugaagacgagcggguucaccaugaacccccaggccucccugggcgacccccucggcaucgaggacagccuggagucccaggacagcauggaguucuga

SEQ ID NO: 35441 - RNA, 1584 nt, Artificial Sequence
  derived and/or modified sequence opt1 from RAG2__Homo_sapiens__NP_001230714
augagccugcagauggugaccgucagcaacaacaucgcccucauccagcccggcuucagccugaugaacuucgacggccagguguucuucuucgggcagaagggguggcccaagcgcuccugccccaccggcguguuccaccuggacgucaagcacaaccacgugaagcucaagcccacgaucuucagcaaggacuccugcuaccugcccccgcugcgguaccccgcgaccugcaccuucaaggggagccucgaguccgagaagcaccaguacaucauccacggcggcaagacccccaacaacgaggugagcgacaagaucuacgucauguccaucgugugcaagaacaacaagaaggugacguuccgcugcaccgagaaggaccuggucggggacgugcccgaggcccgguacggccacagcaucaacguggucuacucccgcggcaagagcaugggggugcuguucgggggccgguccuacaugccgagcacccaccgcaccacggagaaguggaacuccguggccgacugccuccccugcgucuuccugguggacuucgaguucggcugcgccaccagcuacauccugcccgagcuccaggacgggcuguccuuccacgugagcaucgccaagaacgacaccaucuacauccugggcgggcacucccucgccaacaacauccggcccgcgaaccuguaccgcauccgggucgaccugccgcucggcagccccgccgugaacugcaccgugcugcccggcgggaucagcgucuccagcgccauccugacgcagaccaacaacgacgaguucgugaucgugggcggguaccagcucgagaaccagaagcgcaugaucugcaacaucaucucccuggaggacaacaagaucgagauccgggagauggagacccccgacuggaccccggacaucaagcacagcaagaucugguucggcuccaacauggggaacggcacggucuuccugggcauccccggggacaacaagcaggucgugagcgagggcuucuacuucuacaugcucaagugcgccgaggacgacaccaacgaggagcagaccaccuucacgaacucccagaccagcaccgaggaccccggggacuccacccccuucgaggacagcgaggaguucugcuucuccgcggaggccaacagcuucgacggcgacgacgaguucgacacguacaacgaggacgacgaggaggacgaguccgagaccggguacuggaucacgugcugcccgaccugcgacguggacaucaacaccugggugcccuucuacagcaccgagcugaacaagcccgccaugaucuacugcucccacggcgacggccacuggguccacgcccagugcauggaccuggccgagcgcacccucauccaccugagcgcgggguccaacaaguacuacugcaacgagcacguggagaucgcccgggcccugcacacgccccagcgcgugcucccgcugaagaagccgcccaugaagucccugcggaagaagggcagcgggaagauccucacccccgccaagaaguccuuccugcgccggcuguucgacuga

SEQ ID NO: 35442 - RNA, 2943 nt, Artificial Sequence
  derived and/or modified sequence opt1 from RAI14__Homo_sapiens__NP_001138992
augaagucccugaaggccaaguuccgcaaguccgacaccaacgaguggaacaagaacgacgaccggcuccugcaggccguggagaacggcgacgcggagaaggucgccagccugcucgggaagaagggcgccuccgccaccaagcacgacagcgaggggaagacggccuuccaccuggcggccgccaagggccacguggagugccugcgcgugaugaucacccacggggucgacgugaccgcccaggacaccacgggccacuccgcgcuccaccuggccgccaagaacagccaccacgagugcauccggaagcugcuccaguccaagugccccgccgagagcguggacuccagcggcaagaccgcccugcacuacgcggccgcccaggggugccugcaggccguccagauccucugcgagcacaagucccccaucaaccugaaggaccuggacggcaacaucccccuccugcuggccgugcagaacgggcacagcgagaucugccacuuccuccuggaccacggcgcggacgugaacucccgcaacaagagcgggcggaccgcccugaugcucgccugcgagaucggcuccagcaacgccgucgaggcccugaucaagaagggcgcggaccugaaccucguggacucccugggguacaacgcccugcacuacagcaagcucuccgagaacgccggcauccagagccugcugcucagcaagaucucccaggacgccgaccugaagacccccacgaagcccaagcagcacgaccaggugagcaagaucuccagcgagcgcuccgggaccccgaagaagcggaaggcgcccccgccgcccaucagccccacccagcuguccgacgucagcagcccccgcuccaucaccuccacgccccucagcggcaaggaguccguguucuucgccgagccgcccuucaaggccgagaucagcuccauccgggagaacaaggaccgccugagcgacagcaccaccggcgccgacagccugcucgacaucuccagcgaggccgaccagcaggaccugcugagccuccugcaggcgaagguggccucccugacccuccacaacaaggagcugcaggacaagcugcaggccaagagccccaaggaggccgaggccgaccucuccuucgacagcuaccacuccacgcagaccgaccuggggcccagccugggcaagcccggggagaccuccccgcccgacagcaaguccagccccuccguccucauccacagccugggcaaguccaccacggacaacgacgugcggauccagcagcugcaggagauccugcaggaccuccagaagcgccuggagagcuccgaggcggagcggaagcagcuccagguggagcugcagagccgccgggccgagcuggucugccugaacaacaccgagaucuccgagaacagcagcgaccucucccagaagcugaaggagacccagagcaaguacgaggaggccaugaaggaggugcuguccgugcagaagcagaugaagcucgggcuggucagccccgaguccauggacaacuacagccacuuccacgagcugcgcgugaccgaggaggagaucaacgugcucaagcaggaccugcagaacgcccuggaggaguccgagcggaacaaggagaagguccgcgagcucgaggagaagcugguggagcgggagaagggcacggucaucaagccgcccguggaggaguacgaggagaugaaguccagcuacugcagcgugaucgagaacaugaacaaggagaaggccuuccuguucgagaaguaccaggaggcgcaggaggagaucaugaagcucaaggacacccugaagucccagaugacccaggaggccagcgacgaggccgaggacaugaaggaggccaugaaccgcaugaucgacgagcugaacaagcaggucuccgagcucagccagcuguacaaggaggcccaggcggagcuggaggacuaccggaagcgcaagucccucgaggacgugaccgccgaguacauccacaaggccgagcacgagaagcugaugcagcugacgaacgugagccgcgccaaggcggaggacgcccucuccgagaugaagucccaguacagcaagguccugaacgagcugacccagcucaagcagcugguggacgcccagaaggagaacagcgugagcaucaccgagcaccuccaggucaucaccacgcugcggaccgccgccaaggagauggaggagaagaucuccaaccugaaggagcaccuggcgagcaaggagguggagguggccaagcucgagaagcagcugcuggaggagaaggccgccaugaccgacgccauggucccccgcuccagcuacgagaagcuccaguccagccuggaguccgaggugagcgugcuggcguccaagcucaaggagagcgucaaggagaaggagaaggugcacuccgaggugguccagauccggagcgaggugucccaggugaagcgcgagaaggagaacauccagacccugcucaagagcaaggagcaggaggucaacgagcugcugcagaaguuccagcaggcccaggaggagcuggccgagaugaagcgguacgccgaguccagcuccaagcucgaggaggacaaggacaagaagaucaacgagaugagcaaggaggugacgaagcugaaggaggcccugaacucccucagccagcugagcuacuccaccagcuccagcaagcgccagucccagcagcuggaggcgcuccagcagcaggucaagcagcugcagaaccagcuggccgagugcaagaagcagcaccaggaggugaucagcguguaccggaugcaccuccuguacgccgugcagggccagauggacgaggacguccagaaggugcugaagcagauccucaccaugugcaagaaccagucccagaagaaguga

SEQ ID NO: 35443 - RNA, 5721 nt, Artificial Sequence
  derived and/or modified sequence opt1 from RAI1__Homo_sapiens__NP_109590
augcaguccuuccgcgagcggugcggcuuccacgggaagcagcagaacuaccagcagaccucccaggagaccucccgccuggagaacuaccggcagcccucccaggccggccucagcugcgaccgccagcggcugcuggccaaggacuacuacaacccccagcccuaccccuccuacgagggcggcgccgggacccccagcggcaccgccgccgccguggccgccgacaaguaccaccgcggcuccaaggcccuccccacccagcaggggcugcagggccggcccgccuuccccggguacggcgugcaggacagcucccccuaccccgggcgcuacgccggcgaggagagccugcaggcguggggcgcgccccagccgcccccgccccagccccagccccuccccgccgggguggccaaguacgacgagaaccugaugaagaagaccgccgugccgcccucccggcaguacgcggagcagggcgcccagguccccuuccgcacgcacagccugcacgugcagcagccgccgccgccccagcagccccucgccuaccccaagcugcagcggcagaagcugcagaacgacaucgccagcccccuccccuucccccaggggacccacuucccccagcacagccaguccuuccccaccagcuccaccuacagcuccagcgugcagggcggcgggcagggcgcccacagcuacaaguccugcacggcgcccaccgcccagccccacgaccgcccccugaccgccagcuccagccuggcccccgggcagcggguccagaaccuccacgccuaccaguccggccgccugagcuacgaccagcagcagcagcagcagcagcagcagcagcagcagcagcaggcgcugcagucccggcaccacgcccaggagacccuccacuaccagaaccuggccaaguaccagcacuacgggcagcagggccagggcuacugccagcccgacgccgccgugcgcacgcccgagcaguacuaccagaccuucagccccuccagcucccacagccccgcgcgguccguggggcgcagccccuccuacagcuccacccccagcccccugaugcccaaccucgagaacuuccccuacucccagcagccccugagcaccggcgccuuccccgccgggaucacggaccacagccacuucaugccccugcucaaccccucccccaccgacgccaccagcuccgucgacacccaggcgggcaacugcaagccccugcagaaggacaagcugcccgagaaccuccugagcgaccugucccuccagagccugacggcccugaccucccagguggagaacaucagcaacaccgugcagcagcuccugcuguccaaggccgccgucccgcagaagaagggggugaagaaccucgugagccggacccccgagcagcacaagucccagcacugcagccccgagggcuccggcuacagcgccgagcccgcggggacgccccuguccgagccgcccagcuccaccccgcagagcacccacgccgagccccaggaggccgacuaccugagcggcuccgaggacccccucgagcgcagcuuccuguacugcaaccaggcccgggggucccccgcccgcgucaacagcaacuccaaggcgaagccggagagcgugagcacgugcagcgugaccucccccgacgacaugagcaccaaguccgacgacagcuuccagucccugcacggcagccucccccuggacuccuucagcaaguucgucgccggggagcgcgacugcccccggcugcuccuguccgcccuggcccaggaggaccucgccagcgagauccugggccugcaggaggcgaucggcgagaaggccgacaaggccugggccgaggcgccgucccuggugaaggacagcagcaagccgcccuucucccucgagaaccacagcgccugccuggacuccguggccaagagcgccuggccccgcccgggggagcccgaggcccugcccgacucccuccagcuggacaagggcgggaacgcgaaggacuucagccccggccuguucgaggacccguccgucgccuucgccacccccgaccccaagaagaccacgggcccccucagcuucgggaccaagccgacccugggcgugcccgcccccgaccccaccacggccgcguucgacugcuucccggacaccaccgccgccuccagcgccgacuccgccaaccccuucgcguggcccgaggagaaccugggggacgccugcccccgguggggccuccacccgggggagcugaccaagggccuggagcagggcgggaaggccagcgacggcaucuccaagggggacacccacgaggccagcgcgugccucggcuuccaggaggaggacccgcccggggagaagguggccucccugccgggcgacuucaagcaggaggaggucggcggggugaaggaggaggccggcgggcugcuccagugccccgaggucgccaaggccgaccgcuggcuggaggacagccggcacugcugcuccacggcggacuucggcgaccugccccuccugcccccgaccagccgcaaggaggaccuggaggccgaggaggaguacuccagccucugcgagcugcuggggagccccgagcagcggcccggcaugcaggacccccucuccccgaaggcgccccugaucugcaccaaggaggagguggaggaggugcuggacagcaaggccggcugggggucccccugccaccucagcggcgaguccgucauccugcuggggcccaccgugggcacggagagcaaggugcaguccugguucgagagcucccucagccacaugaagccgggggaggagggccccgacggcgagcgcgcccccggggacuccaccaccagcgacgcgucccuggcccagaagcccaacaagccggccguccccgaggcccccaucgccaagaaggagcccgugccgcggggcaagagccugcgcucccggcgcgugcaccgggggcuccccgaggcggaggacagccccugccgcgcccccguccugccgaaggaccugcuccugcccgaguccugcaccgggccgccccagggccagauggagggggccggcgccccggggcggggcgccagcgaggggcugccccgcaugugcacgcggucccucaccgcgcugagcgagccccgcaccccggggccgcccggccugaccacgacccccgccccgcccgacaagcucgggggcaagcagcgggccgccuucaagagcgggaagcgcgugggcaagcccucccccaaggcggccagcuccccgagcaaccccgccgcccugcccguggccuccgacagcucccccauggggagcaagaccaaggagaccgacuccccgagcacgcccggcaaggaccagcgcuccaugauccugcggagccgcaccaagacccaggagaucuuccacuccaagcggcgccggcccagcgagggccgccuccccaacugccgggcgaccaagaagcugcuggacaacucccaccucccggccacguucaaggucagcuccagcccccagaaggaggggcgcgugucccagcgggcccgcgugcccaagcccggcgccgggagcaagcugagcgaccggccgcugcacgcccucaagcgcaaguccgcguucauggcccccguccccaccaagaagcggaaccuggugcugcgcagccgguccagcuccagcuccaacgccagcggcaacgggggcgacggcaaggaggagcgccccgagggguccccgacccucuucaagcggaugagcucccccaagaaggccaagcccaccaagggcaacggggagccggccacgaagcugccgccgcccgagaccccggacgcgugccugaagcucgccagccgcgccgccuuccagggcgcgaugaagaccaaggugcugccgccccggaagggccgcgggcugaagcucgaggccaucguccagaagaucaccucccccagccugaagaaguucgccugcaaggccccgggcgccucccccgggaacccccugagccccucccucagcgacaaggaccggggccugaagggggcgggcggcuccccgguggggguggaggagggccuggucaacguggggacgggccagaagcuccccaccagcggggccgacccccugugccgcaaccccaccaaccgcagccugaagggcaagcucaugaacuccaagaagcugagcuccaccgacugcuucaagacggaggccuucaccagcccggaggcccugcagcccggcgggaccgcccucgcgcccaagaagcggucccgcaagggccgggccggggcccacggccugagcaaggggccccuggagaagcgcccguaccucggccccgcccugcugcucacgccccgggaccgcgccuccggcacgcagggggcgagcgaggacaacuccggcgggggcgggaagaagcccaagauggaggagcugggccuggccagccagccgcccgagggccggcccugccagccccagacccgcgcccagaagcagccggggcacaccaacuacuccagcuacuccaagcggaagcgccucacccggggccgcgccaagaacaccacgagcucccccugcaaggggcgggcgaagcgccggcgccagcagcagguccugccccuggacccggccgagcccgagauccggcucaaguacaucagcuccugcaagcgccugcggagcgacagccgcacccccgccuucucccccuucguccgcguggagaagcgggacgccuucaccaccaucugcacgguggucaacagcccgggcgacgcccccaagccccaccgcaagcccuccagcuccgcgagcuccagcuccagcuccagcuccuucagccuggacgccgccggcgccucccucgccacccugcccggcggcagcauccugcagccccggcccucccucccccugagcuccaccaugcaccuggggccgguggugagcaaggcgcucagcaccuccugccuggucugcugccugugccagaaccccgccaacuucaaggaccugggcgaccucugcgggcccuacuaccccgagcacugccugccgaagaagaagcccaagcugaaggagaaggugcgccccgagggcacgugcgaggaggccagccucccccuggagcggacccugaagggcccggagugcgccgccgcggccaccgccgggaagccgccccgccccgacggcccggccgaccccgccaagcaggggccccuccggaccuccgcgcgcggccugagccggcgccugcaguccugcuacugcugcgacgggcgggaggacggcggcgaggaggccgcccccgccgacaaggggcgcaagcacgagugcagcaaggaggcgccggccgagcccggcggggaggcccaggagcacugggugcacgaggccugcgccgucuggacgggcgggguguaccucguggcgggcaagcuguucggccugcaggaggccaugaaggucgccguggacaugaugugcuccagcugccaggaggccggggccaccaucggcugcugccacaaggggugccuccacaccuaccacuaccccugcgcguccgacgccggcugcaucuucaucgaggagaacuucagccugaagugcccgaagcacaagcggcugcccuga

SEQ ID NO: 35444 - RNA, 1443 nt, Artificial Sequence
  derived and/or modified sequence opt1 from RAI2__Homo_sapiens__NP_001166203
auggacgaccugcagagccagaaccucuccauggacaugaccgacagcccgcccgcccuggccaacaaccgccuggagaacggcauggcgcagcucaucaccacggaggccuggaacaucaacuccaccgaccugguggaggggagcuccgcccccgagcugaaccccaacggcaacgccaccuacgucaugaccacgcaggggcccgugcagcucccggugguccuggagcagcacguguuccagcaccugaacagcccccucgugcugccccaggaggcccccugcuccagcuccaccauccacaacaaccuguuccagggcgcggaggacccggaggcccagccccagcuccuggaccugcggauccccagccagccccaggagccgacccuccccuucgaggccguccugcagaaccuguuccccucccaggggacccucgggcccccgcccugccagcccccgcccggcuacgcccccgugccgccccagcccuucagcagcccccugagcccccuggugcccccggcgacgcuccugguccccuaccccgugaucgugccgcugcccguccccgugcccaucccgauccccauccccgugccccaguccagcgaguccaaguucagcuccagcuucccgaagccgcccagcuccuucggccuccaccccuucaagggcacccagacgccccuggagaaggacgagcugaagcccuucgacauccuccagcccaaggaguacuuccagcugagccgccacaccgucaucaagaugggguccgagaacgaggcccuggaccucagcaugaaguccgugcccuggcugaaggccggcgaggugagcccgcccaucuuccaggaggacgccgcccuggaccucuccgucgcggcccaccggaaguccgagccgccgcccgagacccuguacgacuccggggccagcguggacuccagcggccacaccgugauggagaagcugcccuccggcauggagaucagcuucgcccccgccaccucccacgaggcgcccgccaugauggacagccacaucuccagcuccgacgccgccaccgagaugcucagccagcccaaccaccccagcggggaggucaaggccgagaacaacaucgagauggugggcgagucccaggcggccaaggugaucgucagcguggaggacgccguccccacgaucuucugcgggaagaucaagggccuguccggcgugagcaccaagaacuucuccuucaagcgcgaggacagcgugcugcagggguacgacaucaacucccagggcgaggagagcauggggaacgccgagccgcuccggaagcccaucaagaaccgcuccaucaagcugaagaaggucaacagccaggagauccacaugcugcccaucaagaagcagcggcucgccaccuucuucccccgcaaguga

SEQ ID NO: 35445 - RNA, 621 nt, Artificial Sequence
  derived and/or modified sequence opt1 from RALA__Homo_sapiens__XP_006715825
auggccgccaacaagcccaagggccagaacagccuggcgcuccacaaggugaucauggucggguccggcggggugggcaagagcgcccugacccugcaguucauguacgacgaguucguggaggacuacgagccgaccaaggccgacuccuaccgcaagaaggucgugcucgacggggaggaggugcagaucgacauccuggacacggccggccaggaggacuacgccgcgauccgggacaacuacuuccgcagcggcgagggguuccugugcgucuucuccaucaccgagauggagagcuucgccgccaccgccgacuuccgggagcagauccuccgcgugaaggaggacgagaacgugcccuuccugcuggucggcaacaaguccgaccucgaggacaagcgccaggugagcguggaggaggcgaagaaccgggccgagcaguggaacgucaacuacguggagaccuccgccaagacgcgggccaacguggacaaggucuucuucgaccugaugcgcgagauccgggcccgcaagauggaggacagcaaggagaagaacgggaagaagaagcggaagucccuggcgaagcgcauccgggagcgcugcugcauccucuga

SEQ ID NO: 35446 - RNA, 621 nt, Artificial Sequence
  derived and/or modified sequence opt1 from RALB__Homo_sapiens__NP_002872
auggccgccaacaagagcaagggccaguccagccuggcgcuccacaaggugaucauggucggguccggcggggugggcaagagcgcccugacccugcaguucauguacgacgaguucguggaggacuacgagcccaccaaggccgacuccuaccgcaagaaggucgugcucgacggggaggaggugcagaucgacauccuggacacggccggccaggaggacuacgccgcgauccgggacaacuacuuccgcagcggcgagggguuccugcucgucuucuccaucaccgagcacgagagcuucaccgccaccgccgaguuccgggagcagauccugcgcgugaaggccgaggaggacaagaucccgcugcucguggucggcaacaaguccgaccuggaggagcggcgccaggugcccguggaggaggcgcggagcaaggccgaggaguggggcguccaguacguggagacguccgccaagacccgcgccaacguggacaaggucuucuucgaccugaugcgggagauccgcaccaagaagaugagcgagaacaaggacaagaacgggaagaaguccagcaagaacaagaaguccuucaaggagcggugcugccuccuguga

SEQ ID NO: 35447 - RNA, 1968 nt, Artificial Sequence
  derived and/or modified sequence opt1 from RALBP1__Homo_sapiens__NP_006779
augaccgagugcuuccugcccccgaccagcucccccagcgagcaccgccggguggagcacggcuccgggcucacgcgcacccccagcuccgaggagaucagccccaccaaguucccgggccuguaccggaccggggagcccuccccgccccacgacauccugcacgagccgcccgacgucgugagcgacgacgagaaggaccacggcaagaagaaggggaaguucaagaagaaggagaagcgcacggagggcuacgccgccuuccaggaggacuccagcggcgacgaggcggagucccccagcaagaugaagcgguccaaggggauccacguguucaagaagcccagcuucuccaagaagaaggagaaggacuucaagaucaaggagaagcccaaggaggagaagcacaaggaggagaagcacaaggaggagaagcacaaggagaagaaguccaaggaccucaccgccgccgacgucgugaagcaguggaaggagaagaagaagaagaagaagcccauccaggagcccgaggugccccagaucgacgucccgaaccugaagcccaucuucggcaucccccuggccgacgccguggagcgcaccaugauguacgacgggauccggcuccccgcgguguuccgcgagugcaucgacuacgucgagaaguacggcaugaagugcgaggggaucuaccgggugagcggcaucaagagcaagguggacgagcugaaggccgccuacgaccgcgaggaguccaccaaccuggaggacuacgagccgaacacggucgccagccuccugaagcaguaccugcgggaccuccccgagaaccugcugaccaaggagcucaugccccgcuucgaggaggcgugcggccggaccaccgagacggagaaggugcaggaguuccagcgccugcugaaggagcuccccgagugcaacuaccugcugaucagcuggcucaucgugcacauggaccacgucaucgccaaggagcuggagaccaagaugaacauccagaacaucuccaucgugcugagcccgaccgugcagaucuccaaccggguccucuacguguucuucacccacgugcaggagcuguucgggaacgucgugcugaagcaggucaugaagccccuccgcuggagcaacauggccacgaugcccacccugcccgagacccaggccggcaucaaggaggagauccggcgccaggaguuccugcucaacugccugcaccgggaccugcagggcgggaucaaggaccucuccaaggaggagcgccugugggaggugcagcggauccugaccgcccucaagcgcaagcugcgcgaggcgaagcggcaggagugcgagacgaagaucgcccaggagaucgccagccuguccaaggaggacgugagcaaggaggagaugaacgagaacgaggaggucaucaacauccuccuggcccaggagaacgagauccugaccgagcaggaggagcuccuggccauggagcaguuccugcgccggcagaucgcguccgagaaggaggagaucgagcgccuccgggccgagaucgccgagauccagagccgccagcagcacggccgguccgagaccgaggaguacagcuccgagagcgaguccgagagcgaggacgaggaggagcugcagaucauccuggaggaccuccagcgccagaacgaggagcuggagaucaagaacaaccaccugaaccaggccauccacgaggagcgggaggccaucaucgagcugcgcgugcagcuccggcugcugcagaugcagcgcgcgaaggccgagcagcaggcccaggaggacgaggagccggaguggcgcgggggcgccgugcagccgccccgggacgggguccucgagcccaaggccgcgaaggagcagcccaaggccggcaaggagcccgccaagcccuccccgagccgggaccgcaaggagaccuccaucuga

SEQ ID NO: 35448 - RNA, 6150 nt, Artificial Sequence
  derived and/or modified sequence opt1 from RALGAPA1__Homo_sapiens__NP_001269972
auguucagcaagaagccccacggcgacgugaagaaguccacccagaaggugcuggacaccaagaaggacgcccucacgcggcugaagcaccuccggaucgugaucgagaacgccgagagcaucgaccucaagcaguucuucgaccagcacuucagccacaucuacuacguguucuucgagaacuucgucaccaucgaggccagccugaagcagaaggggcacaagucccagcgcgaggagcuggacgccauccucuucaucuucgagaagauccugcagcugcucccggagcggauccaccagcgcuggcaguuccacagcaucggccugauccugaagaagcuccugcacaccgggaacucccugaagauccggcgcgagggcgugcgccuguuccugcuguggcuccaggcccugcagaacaacugcagcaaggagcagcuguggauguucuccugccucauccccggguucagcgcgccgcaguccgagcacggcccccgcacccuggacaaccugaucaacccgccccucaaccugcaggagacccaggucaccaucgaggagaucacgccccuggugccgccccagagcggcgacaaggggcaggaggaccucaccuccuacuuccuggaggcccugcucaaguacaucgugauccaggucaagagccuggaguggaagaacaaggagaaccaggagcggggcuucuccuuccuguucagccacuucaagaaguacuaccuccccuacaucuuccccaacaucugcaaggagaacucccuguaccaccccauccuggacaucccccagaugcgccccaagccccacuacgucgugaucaagaaggacgcggagacgaacgaggccaucuacugcaccaaggagcccuucaucaaggcccgggugaucgucauccgcuggcucgugagcuucuggcuggagccgaagccccacaccgggccccacauccccggcauggagggggaggugcugccgaagaacauccagcgggccgcggccucccucgucagccgcgaggagagcaagaacgacaacgccgacaagaccgaccggacgaccgagcccgagcagucccacagcaacaccuccacccugacggagcgcgagcccagcuccagcucccugugcagcaucgacgaggagcaccucaccgacaucgagaucgugcggcgcguguucuccagcaagcgguccaacgucaacuucgugaccgagaucuuccgccaggccuuccugcugcccaucugcgaggccgcggccaugcggaagguggucaagguguaccaggaguggauccagcaggaggagaagccgcuguucaugcaggagcccgaggagaucgugaucaccagcuccgaccugcccugcaucgagaacgucacggaccacgacaucagcauggaggagggcgagaagcgcgaggaggagaacggcaccaacaccgccgaccacgugcgcaacuccagcugggccaagaacggguccuaccagggcgcccugcacaacgcgagcgaggaggccaccgagcagaacauccgggccgggacgcaggccguccuccagguguucaucaucaacuccagcaacaucuuccugcuggagcccgccaacgagaucaagaaccugcucgacgagcacaccgacaugugcaagcgcauccugaacaucuaccgguacauggugguccaggugagcauggacaagaagaccugggagcagaugcugcucgugcugcugcgcgucaccgaguccgugcucaagaugccgagccaggcguuccugcaguuccagggcaagaagaacaugacgcuggccggccggcucgccgggccccuguuccagacccugaucguggccuggaucaaggccaaccucaacgucuacaucucccgcgagcugugggacgaccugcucagcgugcuguccagccugaccuacugggaggagcucgcgaccgaguggucccugacgauggagacccugaccaaggugcucgcccggaaccuguacagccuggaccucuccgaccugccccuggacaagcucagcgagcagaagcagaagaagcacaagggcaagggggucggccacgaguuccagaagguguccguggacaagagcuucucccgcggguggagccgggaccagccgggccaggcccccaugcgccagcgguccgccaccacgaccggcagccccgggaccgagaaggcgcgcuccaucguccggcagaagaccguggacaucgacgacgcccagauccugccccgcagcacccgggugcgccacuucagccaguccgaggagacgggcaacgaggucuucggggcccugaacgaggagcagccgcucccccggagcuccagcaccuccgacauccuggagcccuucaccguggagcgcgccaaggaggccgagcagaacgcgacccggggcagcacggagggguccgugcagagcugcaacggccuguucuggaaggaguccugcagcgacaucggcggguccagcgccaacguccccgaccucauggacgaguucaucgccgagcgccugcgcuccggcaacgccagcaccaugacccggcgcggguccagcccgggcucccuggagauccccaaggaccuccccgacauccugaacaagcagaaccagaugcggcccaucgacgacccgggggugcccagcgaguggaccucccccgccagcgcgggcagcuccgaccugaucagcuccgacagccacuccgacagcuucuccgccuuccaguacgacggccgcaaguucgacaacuucggguucggcacggacaccggggugaccagcuccgccgacgucgacagcggcuccggccaccaccagagcgccgaggagcaggagguggccucccucaccacgcugcacaucgacagcgagaccuccagccugaaccagcaggcguucuccgccgagguggccaccaucaccgggagcgaguccgccagccccguccacagcccgcucggcucccggagccagacgcccucccccagcacccugaacaucgaccacauggagcagaaggaccugcagcucgacgagaagcugcaccacuccgugcugcagacccccgacgaccucgagaucagcgaguucccguccgagugcugcagcgugauggccggcgggacccugacgggguggcacgccgacgucgccaccgugauguggcgccggaugcuggggauccucggcgacgugaacuccaucauggaccccgagauccacgcccaggucuucgacuaccugugcgagcuguggcagaaccucgccaagauccgcgacaaccuggggaucagcaccgacaaccugaccucccccagcccgcccgugcucaucccgccccugcggauccugacgccguggcuguucaaggcgaccaugcugaccgacaaguacaagcagggcaagcugcacgccuacaagcucaucugcaacaccaugaagcgccggcaggacgugucccccaaccgcgacuuccugacgcacuucuacaacaucaugcacugcgggcugcuccacaucgaccaggacaucgucaacaccaucaucaagcacugcagcccccaguucuucucccugggccugcccggggccaccaugcucaucauggacuucaucguggccgccggccggguggcgagcuccgccuuccugaacgccccgcgcgucgaggcccaggugcugcucggcagccuggugugcuuccccaaccuguacugcgagcuccccucccugcaccccaacaucccggacgucgccgugagccaguucaccgacgugaaggagcugaucaucaagacgguccucagcuccgcgcgggacgagcccagcgggcccgcccgcugcguggcccugugcucccugggcaucuggaucugcgaggagcucgugcacgagagccaccacccccagaucaaggaggcccugaacgucaucugcgugucccugaaguucaccaacaagaccguggcgcacgucgccugcaacaugcuccacaugcuggugcacuacgucccgcggcugcagaucuaccagcccgacagcccccucaagaucauccagauccugaucgccaccaucacgcaccuccugcccuccaccgaggccagcuccuacgagauggacaagcgccugguggugagccugcuccugugccugcuggacuggaucauggcccucccgcugaagacccugcuccagcccuuccacgcgaccggggccgaguccgacaagaccgagaaguccguccugaacugcaucuacaaggugcugcacggcugcguguacggggcccagugcuucuccaacccccgguacuuccccaugagccucuccgaccuggccagcgucgacuacgacccguucaugcaccuggagucccucaaggagcccgagccccugcacagccccgacuccgagcgcagcagcaagcugcagccggugacggaggugaagacccagaugcagcacggccucaucuccaucgccgcgcggaccgucaucacccaccuggugaaccaccugggccacuaccccaugagcgggggccccgccaugcucacgucccaggugugcgagaaccacgacaaccacuacagcgaguccaccgagcugagccccgagcuguucgaguccccgaacauccaguucuucguccucaacaacaccacccuggugagcugcauccagauccgcuccgaggagaacaugcccgggggcgggcugagcgccggccucgccuccgccaacagcaacgugcgcaucaucguccgggaccuguccggcaaguacagcugggacuccgcgauccuguacgggcccccgcccgugagcggccucuccgagcccacgagcuucaugcugucccugagccaccaggagaagcccgaggagccgcccaccagcaacgagugccucgaggacaucaccgugaaggacgggcugucccugcaguucaagcgcuuccgggagaccguccccacgugggacaccauccgcgacgaggaggacgugcucgacgagcugcugcaguaccucggcgugaccagccccgagugccugcagcggaccggcaucucccugaacaucccggcgccccagcccgucugcaucagcgagaagcaggagaacgacgugaucaacgccauccucaagcagcacacggaggagaaggaguucguggagaagcacuucaacgaccugaacaugaaggccgucgagcaggacgagcccaucccgcagaagccccaguccgccuucuacuacugccgccugcuccugagcauccuggggaugaacuccugggacaagcggcgcagcuuccaccuccugaagaagaacgagaagcugcuccgggagcugcgcaaccuggacucccggcagugccgcgagacccacaagaucgcgguguucuacguggccgagggccaggaggacaagcacagcauccucaccaacaccgggggcucccaggccuacgaggacuucgucgccgggcugggcugggaggugaaccugacgaaccacugcggcuucaugggcggccuccagaagaacaagagcaccgggcugaccacccccuacuucgcgacguccaccguggaggucaucuuccacgugagcacccggaugcccuccgacagcgacgacucccugaccaagaagcuccgccaccugggcaacgacgaggugcacaucgucuggagcgagcacacgcgggacuaccgccgggggaucaucccgaccgaguucggcgacgugcugaucgugaucuaccccaugaagaaccacauguucagcauccagaucaugaagaagcccgagguccccuucuucggcccccucuucgacggggccaucgugaacggcaaggugcugcccaucaugguccgcgccaccgccaucaacgccucccgggcgcucaagagccucaucccccuguaccagaacuucuacgaggagcgcgcccgcuaccugcagaccaucgugcagcaccaccucgagcccacgaccuucgaggacuucgccgcccagguguucuccccggcccccuaccaccaccuccccagcgacgcggaccacuga

SEQ ID NO: 35449 - RNA, 5622 nt, Artificial Sequence
  derived and/or modified sequence opt1 from RALGAPA2__Homo_sapiens__NP_065076
auguucagccgccggagccacggcgacgugaagaaguccacccagaaggugcuggaccccaagaaggacgugcucacccgccugaagcaccuccgggcccugcuggacaacguggacgccaacgaccugaagcaguucuucgagaccaacuacucccagaucuacuucaucuucuacgagaacuucaucgcccucgagaacagccugaagcugaaggggaacaacaagucccagcgcgaggagcucgacagcauccuguuccuguucgagaagauccuccaguuccugcccgagcggaucuucuuccgcuggcacuaccaguccaucggcagcacccugaagaagcuccugcacaccgggaacuccaucaagauccggugcgagggcauccgccuguuccuccuguggcugcaggcccuccagaccaacugcgccgaggagcagguccugaucuucgccugccuggugcccggguuccccgccgugaugagcucccggggccccugcacgcucgagacccugaucaaccccagccccuccguggcggacgugaagaucuaccccgaggagaucacgccccugcucccggccaucagcggcgagaagaucgccgaggaccagaccugcuucuuccugcagauccugcucaaguacauggugauccaggccgcgucccuggaguggaagaacaaggagaaccaggacacgggguucaaguuccuguucacccucuuccgcaaguacuaccugccccaccuguuccccagcuucaccaagcucaccaacaucuacaagcccguccuggacaucccgcaccuccggcccaagcccguguacaucacgaccacccgcgacaacgagaacaucuacuccaccaagauccccuacauggccgcccggguggucuucaucaaguggaucgugacguucuuccucgagaagaaguaccugaccgccacccagaacaccaagaacggcguggacguccugccgaagaucauccagacggucgggggcggggccgugcaggagcgcgcgcccgagcucgacgggggcgggcccaccgagcaggacaagagccacuccaacagcagcacccuguccgaccggcgccugagcaacuccagccucugcuccaucgaggaggagcaccggauggucuacgagauggugcagcgcauccugcugagcacccggggcuacgugaacuucgucaacgagguguuccaccaggccuuccuccugcccuccugcgagaucgccgugacgcgcaaggucgugcaggucuaccggaaguggauccugcaggacaagccgguguucauggaggagcccgaccgcaaggacguggcccaggaggacgccgagaagcugggguucagcgagaccgacuccaaggaggcgagcuccgagagcuccggccacaagcgcagcuccagcuggggccggaccuacuccuucaccagcgccaugucccgcgggugcgucacggaggaggagaacaccaacgugaaggccggcgugcaggcccuccugcaggucuuccugaccaacagcgccaacaucuuccuccuggagcccugcgcggaggugcccgugcugcucaaggagcaggucgacgccugcaaggccgugcugaucaucuuccggcgcaugaucauggagcugaccaugaacaagaagacgugggagcagaugcuccagauccugcugcggaucaccgaggccgugaugcagaagccgaaggacaagcagaucaaggaccucuucgcccagagccuggcggggcuccuguuccgcacccugauggucgccuggauccgggccaaccugugcguguacaucucccgcgagcucugggacgacuuccugggcgugcugagcucccucaccgagugggaggagcugaucaacgagugggccaacaucauggacagccugacggcgguccucgcccggaccguguacgggguggagaugaccaaccugccccuggacaagcucuccgagcagaaggagaagaagcagcgcggcaagggcugcguccuggacccccagaaggggaccaccgugggccggagcuucucccugagcuggcgcucccaccccgacgugacggagccgaugcgguuccgcagcgccaccaccuccggggcccccggcgucgagaaggcccggaacaucgugcgccagaaggcgaccgagguggaggagugccagcagagcgagaacgcccccgccgccggguccggccaccucacggucggccagcagcagcagguccugcggagcuccagcaccuccgacaucccggagccccugugcagcgacagcucccaggggcagaaggccgagaacacccagaacagcuccagcuccgagccccagcccauccaggagaacaagggccacgugaagcgcgagcacgaggggaucaccauccucguccggcgcagcuccagcccggcggagcuggaccugaaggacgaccuccagcagacgcagggcaagugccgcgagcggcagaaguccgagagcaccaacuccgacaccacccuggggugcacgaacgaggccgagcugagcaugggccccuggcagaccugcgaggaggaccccgagcucaacacccccaccgacgugguggccgacgccgacgcccgccacuggcugcagcuguccccgacggacgcgagcaaccucaccgacuccagcgagugccugaccgacgacugcuccaucaucgccggcgggagccugaccggcuggcaccccgacuccgccgccguccucuggcggcgcgugcuggggauccugggcgacgugaacaacauccagagccccaagauccacgcgcgggucuucugcuaccucuacgagcugugguacaagcuggccaagauccgcgacaaccucgccaucagccuggacaaccaguccagccccuccccgcccgugcugaucccgccccugcggauguucgccagcuggcuguucaaggccgcgacgcugccgaacgaguacaaggagggcaagcuccaggccuaccgccugaucugcgccaugaugacccggcgccaggacgugcugcccaacuccgacuuccucguccacuucuaccuggugaugcaccuggggcucaccagcgaggaccaggacauccugaacaccaucauccggcacugcccgccccgcuucuucucccugggcuucccgggguucagcaugcucgugggcgacuucaucacggccgccgcgcggguccuguccaccgacauccugaccgcgccccgcagcgaggccgugaccgugcucgggucccuggucugcuuccccaacacguaccaggagaucccccugcuccagagcgugccggaggugaacgaggccaucaccggcaccgaggacgucaagcacuaccugaucaacauccugcucaagaacgccaccgaggagcccaacgaguacgcgcggugcaucgccgugugcucccugggcguguggaucugcgaggagcuggcccagugcacgagccacccccaggucaaggaggccaucaacgugaucggggugacccucaaguucccgaacaagaucgucgcccagguggccugcgacguccugcagcugcucguguccuacugggagaagcugcagauguucgagaccagccugccccgcaagauggccgagauccucguggccaccgucgccuuccugcugcccuccgcggaguacagcuccguggagacggacaagaaguucaucgugagccuccugcugugccuccuggacuggugcauggcccugcccgucagcgugcuccugcacccgguguccaccgccguccuggaggagcagcacagcgcccgggcgccccugcucgacuacaucuaccgcgugcugcacugcugcgugugcggcuccagcaccuacacccagcagucccacuacauccugacccucgcggaccugagcuccacggacuacgaccccuuccugccccucgccaacgucaagagcuccgagccggugcaguaccacagcuccgccgagcuggggaaccugcucaccguggaggaggagaagaagcggcgcagccuggagcugaucccccucaccgcccggauggucauggcccaccuggugaaccaccugggccacuacccccucuccgggggccccgcgauccugcacagccugguguccgagaaccacgacaacgcccacgucgagggcagcgagcucuccuucgagguguuccgcagcccgaaccugcagcuguucguguucaacgacuccacccucaucagcuaccugcagacgcccaccgaggggcccgucggcgggagccccgugggcucccugagcgacgugcgcgucaucgugcgggacaucuccgggaaguacagcugggacggcaaggugcucuacggcccgcuggaggggugccuggcccccaacggccgcaaccccuccuuccucaucagcuccuggcaccgggacaccuucgggccccagaaggacagcucccaggucgaggagggcgacgacgugcuggacaagcugcucgagaacaucgggcacaccagcccggagugccugcugcccucccagcucaaccugaacgagcccagccugacgcccugcggcaugaacuacgaccaggagaaggagaucaucgaggugauccuccgccagaacgcccaggaggacgaguacauccagucccacaacuucgacagcgccaugaaggucaccucccagggccagccgagccccguggagccccgggggcccuucuacuucugccgccugcugcucgacgaccugggcaugaacuccugggaccggcgcaagaacuuccaccuccugaagaagaacagcaagcugcugcgggagcucaagaaccuggacucccgccagugccgggagacccacaagaucgcgguguucuacaucgccgaggggcaggaggacaagugcagcauccugagcaacgagcgcggcucccaggccuacgaggacuucgucgccggccucgggugggagguggaccugagcacccacugcggcuucaugggcggccugcagcggaacggguccacgggccagaccgcgccguacuacgccaccagcaccguggaggucaucuuccacguguccacgcgcaugcccagcgacuccgacgacagccucaccaagaagcugcggcaccugggcaacgacgaggugcacaucgucugguccgagcacagccgcgacuaccggcgcgggaucauccccaccgccuucggcgacguguccaucaucaucuacccgaugaagaaccacauguucuucaucgccaucaccaagaagcccgaggugcccuucuucgggccccucuucgacggcgccaucgucagcgggaagcugcugccgucccucgugugcgcgacgugcaucaacgccagccgggccgugaagugccugaucccccuguaccaguccuucuacgaggagcgcgcccucuaccuggaggccaucauccagaaccaccgcgaggucaugaccuucgaggacuucgcggcccagguguucagccccucccccagcuacucccugagcggcaccgacuga

SEQ ID NO: 35450 - RNA, 4476 nt, Artificial Sequence
  derived and/or modified sequence opt1 from RALGAPB__Homo_sapiens__NP_001269847
auguacagcgaguggcgcucccugcaccucgugauccagaacgaccagggccacaccagcguccugcacuccuaccccgagagcguggggcgggagguggccaacgccgucgugcgcccgcugggccaggugcucgggacccccuccgucgcgggcagcgagaaccugcugaagacggacaaggaggugaaguggaccauggaggugaucugcuacgggcucacccugccccuggacggcgagaccgucaaguacugcguggacguguacacggacuggaucauggcccucguccugcccaaggacuccaucccgcugcccgugaucaaggagcccaaccaguacgugcagaccauccucaagcaccugcagaaccuguucgucccccggcaggagcagggcagcucccagauccgccucugccugcaggugcugcgggccauccagaagcucgcccgcgagagcucccugauggcccgggagaccugggaggugcugcuccuguuccugcuccagaucaacgacauccugcuggcgccgcccaccguccaggggggcaucgccgagaaccucgccgagaagcugaucggggugcuguucgagguguggcuccuggccugcacgcgcugcuuccccacccccccguacuggaagaccgcgaaggagauggucgccaacuggcggcaccaccccgccgugguggagcaguggagcaaggucaucugcgcccugaccucccgccuccugcgguucacguacggccccagcuuccccgccuucaaggugccggacgaggacgcgucccugaucccccccgagauggacaacgagugcgucgcccagaccugguuccgcuuccuccacaugcugagcaaccccguggaccuguccaacccggccaucaucagcuccacccccaaguuccaggagcaguuccucaacgugagcgggaugccccaggagcugaaccaguaccccugccugaagcaccucccgcagaucuucuuccgggccaugcgcggcaucagcugccuggucgacgccuuccugggcaucucccggccccgcagcgacuccgcgccccccaccccggugaaccggcucagcaugccccaguccgccgccgugagcacgacccccccgcacaaccgccggcaccgcgccgucaccgugaacaaggccaccaugaagacguccaccgugagcaccgcgcacgccuccaagguccagcaccagaccagcuccacgagcccccuguccagccccaaccagaccuccagcgagccccggccgcugcccgccccccgccgccccaaggugaacuccauccucaaccuguucgggagcuggcuguucgacgccgccuucgugcacugcaagcugcacaacggcaucaaccgggacuccagcaugaccgcgaucaccacgcaggccagcauggaguuccgccggaaggggucccagaugagcaccgacaccauggucuccaacccgauguucgacgccagcgaguuccccgacaacuacgaggccggccgcgcggaggccugcggcacccucugccggaucuucugcuccaagaagacgggggaggagauccugcccgccuaccugagccgcuucuacaugcuccugauccagggccugcagaucaacgacuacgugugccaccccgugcucgccuccgucauccugaacagcccgccccuguucugcugcgaccucaaggggaucgacguggugguccccuacuucaucuccgcccuggagaccauccugcccgaccgggagcucagcaaguucaaguccuacgugaacccgaccgagcugcgccggagcuccaucaacauccugcucagccugcugccccucccccaccacuucggcaccgugaaguccgaggucgugcuggaggggaaguucagcaacgacgacuccagcagcuacgacaagcccaucacguuccugucccucaagcugcgccuggugaacauccucaucggcgcgcugcagaccgagaccgacccgaacaacacccagaugauccugggcgccaugcucaacaucguccaggacagcgcccugcuggaggccaucgggugccagauggagaugggcgggggcgagaacaaccucaagucccacagccggaccaacuccgggaucagcuccgccagcggcggcuccacggagcccaccacccccgacagcgagcgccccgcgcaggcccugcugcgggacuacgacuccgccgccgggcuccugauccgcagcauccaccuggugacccagcggcucaacucccaguggcgccaggacaugagcaucucccuggccgcgcuggagcuccugagcggccuggccaaggugaaggucaugguggacuccggggaccggaagcgcgccaucagcuccgugugcacguacaucgucuaccagugcagccggccggccccccuccacagccgcgaccugcacuccaugaucguggcggccuuccagugccugugcguguggcucaccgagcaccccgacaugcuggacgagaaggacugccugaaggagguccucgagaucguggagcugggcaucagcggguccaagagcaagaacaacgagcaggaggugaaguacaagggcgacaaggagccgaaccccgccuccaugcgcgucaaggacgccgccgaggcgacccugaccugcaucaugcagcuccugggcgccuuccccagccccuccgggccggccagccccugcucccuggugaacgagacgacccucaucaaguacagccggcugcccaccaucaacaagcacuccuuccgcuacuucgugcuggacaacagcgucauccucgccaugcuggagcagccccugggcaacgagcagaacgacuucuucccguccgugaccgugcucguccgggggaugagcggccgccuggccugggcgcagcagcugugccuccugccccggggcgccaaggccaaccagaagcuguucgugcccgagccccgcccggugcccaagaacgacgucggguucaaguacuccgugaagcaccggcccuuccccgaggagguggacaagaucccguucgucaaggccgaccucagcauccccgaccugcacgagaucgugacggaggagcuggaggagcgccacgagaagcuccgguccggcauggcccagcagaucgcguacgagauccaccuggagcagcagagcgaggaggagcugcagaagcgcuccuuccccgaccccgugaccgacugcaagccgcccccccccgcccaggaguuccagaccgcccggcucuuccugagccacuucggguuccugagccucgaggcccugaaggagccggcgaacucccgccugcccccccaccucaucgcccuggacagcaccauccccggcuucuucgacgacaucggguaccuggaccuccugccgugccggcccuucgacacggucuucaucuucuacaugaagcccggccagaagaccaaccaggagauccugaagaacguggaguccagccgcaccguccagccgcacuuccucgaguuccugcugucccucggcuggagcguggacguggggcggcaccccggcuggaccgggcacgucuccacgagcugguccaucaacugcugcgacgacggcgaggggagccagcaggaggaggugaucuccagcgaggacaucggcgccuccaucuucaacggccagaagaaggugcuguacuacgccgacgcccugaccgagaucgcguucgucgugcccagccccguggagucccucaccgacagccuggaguccaacaucagcgaccaggacuccgacagcaacauggaccugaugccggggauccucaagcagcccagccugacccuggagcuguuccccaaccacacggacaaccucaacuccagccagcgccugucccccagcucccggaugcgcaagcugccgcagggccggcccguccccccccucgggccggagacccgcgugagcguggucuggguggagcgguacgacgacaucgagaacuucccccuguccgagcugaugaccgagaucagcaccggcguggagacgaccgccaacuccagcaccucccuccgcagcaccacgcuggagaaggagguccccgugaucuucauccacccccugaacaccgggcucuuccgcaucaagauccagggcgccaccggcaaguucaacauggugaucccgcuggucgacgggaugaucgugucccggcgcgcccugggcuuccucgugcggcagaccgucaucaacaucugccgccggaagcgccuggagagcgacuccuacagccccccccacgugcggcgcaagcagaagaucacggacaucgugaacaaguaccggaacaagcagcuggagcccgaguucuacaccucccucuuccaggaggucgggcugaagaacugcagcuccuga

SEQ ID NO: 35451 - RNA, 2580 nt, Artificial Sequence
  derived and/or modified sequence opt1 from RALGDS__Homo_sapiens__NP_001035827
augaugguggacugccagagcuccacccaggagaucggcgaggagcugaucaacggggucaucuacagcaucucccuccgcaaggugcagcugcaccacggcgggaacaagggccagcgguggcugggguacgagaacgagagcgcccucaaccuguacgagaccugcaaggugcgcacggucaaggccggcacccuggagaagcucguggagcaccuggugcccgcguuccagggcuccgaccugagcuacgucaccaucuuccucugcaccuaccgggccuucacgaccacccagcagguccuggaccugcuguucaagcgcuacgggcggugcgacgcccugaccgccuccagccgcuacggcugcauccugccguacuccgacgaggacgggggcccccaggaccagcucaagaacgccaucagcuccauccuggggacguggcuggaccaguacagcgaggacuucugccagccgcccgacuuccccugccucaagcagcugguggcguacgugcagcugaacaugcccggcuccgaccucgagcggcgcgcccaccuccugcucgcccagcuggagcacagcgagcccaucgaggccgagcccgaggcgcuguccccggugcccgcccucaagcccacccccgagcuggagcuggcccucaccccggcccgggcccccagccccgugcccgcgccggcccccgagcccgagcccgccccgacccccgcccccggcuccgagcuggaggucgcccccgcgccggcccccgagcugcagcaggcccccgagcccgccguggggcucgagagcgccccggcgcccgcccuggagcuggagcccgccccggagcaggaccccgcccccucccagacgcucgagcuggagcccgccccggcgcccgugcccagccugcagcccagcuggccgucccccgucguggccgagaacggccucagcgaggagaagccccaccuccugguguucccgcccgaccuggucgccgagcaguucacccugauggacgccgagcuguucaagaagguggugcccuaccacugccucggguccaucuggagccagcgcgacaagaagggcaaggagcaccuggcgcccaccauccgggccaccgucacgcaguucaacuccguggccaacugcgugaucacgaccugccugggcaaccgcagcaccaaggcccccgaccgggcccgcgucguggagcacuggaucgaggucgcgcgggagugccgcauccucaagaacuucuccagccuguacgccauccuguccgcccugcagagcaacuccauccaccggcucaagaagaccugggaggacgugagccgcgacuccuuccggaucuuccagaagcugagcgagaucuucuccgacgagaacaacuacagccugucccgcgagcuccugaucaaggaggggaccagcaaguucgccacccuggagaugaacccgaagcgggcccagaagcgccccaaggagaccggcaucauccaggggacggugcccuaccucggcaccuuccugaccgaccuggucaugcucgacaccgcgaugaaggacuaccuguacgggcgccugaucaacuucgagaagcggcgcaaggaguucgaggugaucgcccagaucaagcuccugcaguccgccugcaacaacuacagcaucgcccccgacgagcaguucggcgccugguuccgggcgguggagcgccugagcgagacggaguccuacaaccucagcugcgagcuggagccgcccuccgagagcgccuccaacacccugcggaccaagaagaacaccgccaucgucaagcgcuggagcgaccggcaggcccccuccacggagcucagcaccuccggcagcucccacagcaaguccugcgaccagcugcgcugcgggcccuaccugagcuccggcgacaucgcggacgcccucagcgugcacuccgccgggagcagcuccagcgacguggaggagaucaacaucuccuucgucccggagagccccgacggccaggagaagaaguucugggaguccgccagccaguccagccccgagaccuccgggaucagcuccgccagcuccagcaccuccagcuccagcgcguccacgaccccgguggccgccacccggacccacaagcgcagcgugagcggccugugcaacuccagcuccgcccugccccucuacaaccagcaggucggcgacugcugcaucauccgggugagccuggacguggacaacgggaacauguacaaguccauccuggucaccagccaggacaaggcccccgcggugauccgcaaggccauggacaagcacaaccucgaggaggaggagcccgaggacuacgagcugcugcagauccucuccgacgaccggaagcugaagaucccggagaacgccaacguguucuacgccaugaacagcacggccaacuacgacuucguccugaagaagcgcaccuucaccaagggcgugaaggugaagcacggggcguccagcacccucccccggaugaagcagaagggccugaagaucgccaaggggaucuucuga

SEQ ID NO: 35452 - RNA, 1590 nt, Artificial Sequence
  derived and/or modified sequence opt1 from RALGPS1__Homo_sapiens__NP_001177657
auguacaagcgcaacggccugauggccagcgugcucgucaccuccgccacgccccaggggagcuccagcuccgacagccuggagggccaguccugcgacuacgcgagcaaguccuacgacgccgugguguucgacguccugaaggugaccccggaggaguucgccagccagaucacccucauggacauccccguguucaaggccauccagcccgaggagcuggccuccugcggguggagcaagaaggagaagcacucccuggcgcccaacgucguggccuucacccggcgcuucaaccaggugagcuucugggucgugcgggagauccucaccgcccagacgcugaagauccgcgccgagauccugucccacuucgugaagaucgcgaagaagcuccuggagcugaacaaccuccacagccugauguccgucgugagcgcccugcaguccgccccgaucuuccggcucaccaagaccugggcccugcugaaccgcaaggacaagaccacguucgagaagcucgacuaccugaugagcaaggaggacaacuacaagcggacccgcgaguacauccggagccugaagauggugcccuccauccccuaccucggcaucuaccugcuggaccucaucuacaucgacagcgccuaccccgcguccgggagcaucauggagaacgagcagcgcuccaaccagaugaacaacauccugcggaucaucgccgaccugcaggucagcugcuccuacgaccaccucaccacccugccgcacgugcagaaguaccucaagagcgugcgcuacaucgaggagcugcagaaguucgucgaggacgacaacuacaagcugucccugcggaucgagcccggcagcuccagcccccgccucguguccagcaaggaggaccuggccggccccuccgccgggagcggcuccgcccgguucagccgccggccgacgugccccgacaccuccguggcggggagccugcccacgcccccggucccccgccaccgcaagagccacucccucggcaacaaccgggggcggcuguacgccacccugggccccaacuggcgcgugcccgugcgcaacagcccgcggacccgcuccugcgucuacagccccaccggccccugcaucugcucccucgggaacagcgccgccgugcccaccauggagggcccgcugcggcgcaagacccugcucaaggaggggcggaagcccgcccuguccagcuggacgcgcuacugggucauccuguccggcagcacccuccuguacuacggcgcgaagucccugcgggggaccgaccgcaagcacgugagcaucgugggcuggaugguccagcuccccgacgaccccgagcacccggacaucuuccagcugaacaaccccgacaaggggaacguguacaaguuccagaccggcucccgguuccacgccauccuguggcacaagcaccuggacgacgccugcaagagcaaccgcccccaggaggccggggccgcgccgggccccacgggcaccgacucccacgagguggaccaccucgagggcggggccgggaaggaggccggccccugcgccuga

SEQ ID NO: 35453 - RNA, 873 nt, Artificial Sequence
  derived and/or modified sequence opt1 from RALY__Homo_sapiens__NP_031393
augagccugaagcuccaggccuccaacgugaccaacaagaacgaccccaagagcaucaacucccgcgucuucaucggcaaccugaacaccgcccuggugaagaaguccgacguggagacgaucuucagcaaguacgggcgggucgcgggcugcagcgugcacaagggguacgccuucgugcaguacuccaacgagcgccacgcccgggccgccguccucggcgagaacgggcgcgugcuggcgggccagacccuggacaucaacauggccggcgagccgaagcccgaccggcccaaggggcucaagcgcgccgccagcgcgaucuaccggcuguucgacuaccgcggccggcugucccccgugccggucccccgcgccgugcccgugaagcggccccgcgucaccgugccgcucgugcggcgcgucaagaccaacgugcccgugaagcuguucgcccggagcacggccgucaccaccuccagcgccaagaucaagcugaaguccagcgagcuccaggcgaucaagaccgagcugacgcagaucaaguccaacaucgacgcccugcucagccgccuggagcagaucgccgccgagcagaaggccaaccccgacgggaagaagaagggcgacgggggcggcgccgggggcgggggcggcgggggcggguccggcgggggcggcagcgggggcgggggcgggggcggcuccagccggcccccggcgccccaggagaacaccaccagcgaggccgggcugccccagggcgaggcccgcacccgggacgacggggacgaggagggccuccugacgcacuccgaggaggagcuggagcacagccaggacaccgacgccgacgacggggcgcuccaguga

SEQ ID NO: 35454 - RNA, 915 nt, Artificial Sequence
  derived and/or modified sequence opt1 from RALYL__Homo_sapiens__NP_001093861
augagcaagcgccggcgccugaagcagggcgagcccaucaugaccgggaagacccagacguccaacgugaccaacaagaacgaccccaagagcaucaacucccgggucuucaucggcaaccucaacaccgccaucgugaagaagguggacaucgaggccaucuucagcaaguacgggaagaucgucggcugcuccgugcacaagggguacgcguucgugcaguacaugagcgagcgccacgcccgggccgccgucgccggcgagaacgcgcgcgugaucgccggccagccccuggacaucaacauggccggggagcccaagcccuaccggccgaagcccggcaacaagcgcccccuguccgcccucuaccggcuggagagcaaggagcccuuccuguccgucgggggcuacguguucgacuacgacuacuaccgcgacgacuucuacaaccggcuguucgacuaccacgggcgcgugccgcccccgccccgggcggugaucccgcugaagcgcccccgggucgccgugaccacgacccgccggggcaagggcguguucagcaugaagggcgggucccgcagcaccgccuccgggagcaccggcuccaagcucaagagcgacgagcuccagacgaucaagaaggagcugacccagaucaagaccaagaucgacucccugcucggccggcuggagaagaucgagaagcagcagaaggccgaggccgaggcgcagaagaagcagcuggaggagagccucguccugauccaggaggagugcguguccgagaucgccgaccacagcaccgaggagcccgccgagggcgggcccgacgccgacggggaggagaugacggacggcaucgaggaggacuucgacgaggacgggggccacgagcuguuccuccagaucaaguga

SEQ ID NO: 35455 - RNA, 447 nt, Artificial Sequence
  derived and/or modified sequence opt1 from RAMP1__Homo_sapiens__NP_005846
auggcccgcgcccugugccggcucccccgccggggccuguggcugcuccuggcgcaccaccuguucaugaccaccgccugccaggaggccaacuacggggcccuccugcgcgagcugugccucacgcaguuccagguggacauggaggccgucggcgagacccuguggugcgacugggggcggaccauccgcagcuaccgggagcuggcggacugcaccuggcacauggccgagaagcucggcugcuucuggccgaacgccgagguggaccgcuucuuccuggccgugcacgggcgguacuuccgcuccugccccaucagcggccgggcgguccgcgacccgcccggcuccauccuguaccccuucaucguggugcccaucacggucacccuccuggugaccgcccugguggucuggcagagcaagcggaccgaggggaucguguga

SEQ ID NO: 35456 - RNA, 528 nt, Artificial Sequence
  derived and/or modified sequence opt1 from RAMP2__Homo_sapiens__NP_005845
auggccagccugcgcguggagcgggccggcgggccccgccucccgcggacccgcgucggccggcccgcggcccugcgccugcuccugcugcucggggccgugcugaacccccacgaggcccuggcccagccccucccgaccacgggcacccccggguccgagggcggcaccgugaagaacuacgagaccgcgguccaguucugcuggaaccacuacaaggaccagauggaccccaucgagaaggacuggugcgacugggccaugaucagccggcccuacuccacgcugcgcgacugccuggagcacuucgccgagcuguucgaccucggguucccgaacccccuggccgagcggaucaucuucgagacccaccagauccacuucgcgaacugcagccucgugcagcccaccuucuccgacccgcccgaggacgugcugcuggccaugaucaucgcccccaucugccucauccccuuccugaucacccuggucguguggcgcagcaaggacuccgaggcccaggccuga

SEQ ID NO: 35457 - RNA, 447 nt, Artificial Sequence
  derived and/or modified sequence opt1 from RAMP3__Homo_sapiens__NP_005847
auggagaccggcgcccugcgccggccccagcuccugccgcugcuccugcugcucugcgggggcugcccccgcgccgggggcugcaacgagaccgggaugcuggagcggcugccccucugcggcaaggcguucgccgacaugaugggcaagguggacgucuggaaguggugcaaccugagcgaguucaucguguacuacgaguccuucacgaacugcaccgagauggaggccaacguggucgggugcuacuggcccaacccgcuggcccagggcuucaucaccgggauccaccgccaguucuucagcaacugcaccguggaccgggugcaccucgaggacccgcccgacgagguccugaucccccugaucgugauccccgugguccucacgguggccauggcgggccugguggucuggcgcuccaagcggaccgacacccugcucuga

SEQ ID NO: 35458 - RNA, 1863 nt, Artificial Sequence
  derived and/or modified sequence opt1 from RANBP10__Homo_sapiens__NP_065901
auggccgccgcgaccgccgaccccggcgccgggaacccccagcccggcgacagcuccgggggcggggccggcggcgggcugcccagccccggcgagcaggagcucucccgccggcugcagcgccuguacccggccgugaaccagcaggagacgccccucccccggagcuggucccccaaggacaaguacaacuacaucgggcugagccagggcaaccugcgcguccacuacaaggggcacggcaagaaccacaaggacgcggccuccgugcgggccacccacccgauccccgccgcgugcggcaucuacuacuucgaggugaagaucgucagcaaggggcgcgacggcuacauggggaucggccucuccgcccagggcgugaacaugaaccggcugcccgggugggacaagcacagcuacggcuaccacggggacgacggccacuccuucugcagcuccgggaccggccagcccuacggcccgaccuucaccacgggggacgugaucggcugcugcgucaaccugaucaacgggaccugcuucuacaccaagaacggccacagccucgggaucgccuucaccgaccugcccgccaaccuguaccccacggugggccuccagacccccggcgagaucguggacgccaacuucgggcagcagccguuccuguucgacaucgaggacuacaugcgcgaguggcgggcgaagguccagggcaccgugcacugcuuccccaucuccgcccgccugggggaguggcaggccgugcuccagaacauggucagcuccuaccuggugcaccacggcuacugcgccaccgccacggcguucgcccggaugaccgagacccccauccaggaggagcaggccagcaucaagaaccgccagaagauccagaagcuggugcucgaggggcgggucggcgaggccaucgagaccacgcagcgcuucuaccccggccugcuggagcacaacccgaaccuccuguucaugcugaagugccggcaguucguggagauggugaacgggaccgacuccgagguccgcagccucagcucccggagccccaagucccaggacagcuaccccggcucccccagccuguccccgcgccacgggcccagcuccagccacaugcacaacaccggcgccgacucccccagcugcuccaacggcguggcgagcaccaaguccaagcagaaccacagcaaguaccccgccccguccagcuccagcagcuccagcuccagcuccagcuccagcucccccagcuccgugaacuacagcgaguccaacagcacggacuccaccaagagccagcaccacuccagcaccagcaaccaggagaccuccgacagcgagauggagauggaggccgagcacuaccccaacgggguccugggcuccaugagcacgcggaucgugaacggggccuacaagcacgaggaccuccagaccgacgaguccagcauggacgaccgccacccgcggcgccagcugugcggcgggaaccaggccgcgaccgagcgcaucauccuguucggccgggagcuccaggcccuguccgagcagcugggccgcgaguacgggaagaaccucgcccacaccgagaugcugcaggacgccuucagccugcucgcguacuccgaccccuggagcugccccgugggccagcagcuggaccccauccagcgggagccggucugcgccgcccugaacuccgccauccucgagagccagaaccugcccaagcagccgccccugaugcucgcccuggggcaggcguccgagugccugcgccucauggcccgggccggccuggggagcugcuccuucgcccgcguggacgacuaccugcacuga

SEQ ID NO: 35459 - RNA, 3267 nt, Artificial Sequence
  derived and/or modified sequence opt1 from RANBP17__Homo_sapiens__NP_075048
auggcccugcacuuccagagccucgccgagcuggaggugcugugcacccaccucuacaucggcaccgaccugacgcagcgcaucgaggcggagaaggcccugcucgagcugaucgacucccccgagugccugagcaagugccagcuccugcuggagcaggggaccaccuccuacgcccagcuccuggccgcgaccugccugagcaagcucgucucccgggugagcccgcugcccguggagcagcgcauggacauccggaacuacauccugaacuacgucgccucccagcccaagcucgcccccuucgugauccaggcccugauccaggugaucgccaagaucacgaagcugggcugguucgagguccagaaggaccaguucguguuccgcgagaucaucgcggacgugaagaaguuccuccaggggaccgucgagcacugcaucaucggcgugaucauccugagcgagcugacccaggagaugaaccucguggacuacucccggccgagcgccaagcaccgcaagaucgccaccuccuuccgggacacgagccugaaggacguccuggugcucgccugcucccugcugaaggagguguucgccaagccccucaaccugcaggaccagugccagcagaaccuggucaugcagguccucaagcuggugcugaacugccucaacuucgacuucaucgggagcuccgcggacgagagcgccgacgaccugugcaccgugcagauccccaccaccuggcgcacgaucuuccuggagcccgagacccucgaccuguucuucaaccuguaccacucccucccgccccugcugagccagcucgcccuguccugccuggugcaguucgccagcacccggcgcagccucuucaacucccccgagcgggccaaguaccugggcaaccugaucaagggcgugaagcgcauccuggagaacccccaggggcucagcgacccgggcaacuaccacgaguucugccgguuccuggcgcgccugaagaccaacuaccagcucggggagcuggucauggugaaggaguaccccgaggugauccggcugaucgccaacuucacgaucaccucccuccagcacugggaguucgcccccaacagcguccacuaccugcugacccucuggcagcgcaugguggccuccguccccuucgucaagagcaccgagccgcaccuccuggacacguacgcccccgagaucaccaaggcguucaucaccucccggcucgacagcguggccaucguggugcgcgaccaccuggacgacccccuggacgacaccgccacgguguuccagcagcucgagcagcugugcaccgucucccggugcgaguacgagaagaccugcgcccugcucgugcagcuguucgaccagaacgcccagaacuaccagaagcugcuccaccccuacagcggcgugaccgucgacaucacgauccaggaggggcgccuggcguggcugguguaccucgugggcaccgucgugggcgggcggcugaccuacaccuccacggacgagcacgacgccauggacggcgagcugagcugccgcguguuccagcucaucucccugauggacaccgggcugccgcgcugcugcaacgagaagaucgagcucgccauccugugguuccuggaccaguuccggaagaccuacgucggcgaccagcuccagcgcaccagcaagguguacgcccggauguccgaggugcugggcaucacggacgacaaccacguccuggagaccuucaugaccaagaucgugaccaaccucaaguacugggggcgcuacgagcccgugaucagccggacccugcaguuccugaacgaccucuccgucggcuacauccugcugaagaagcucgugaagaucgacgcggugaaguucaugcugaagaaccacacgagcgagcacuuccccuuccuggggaucuccgacaaccacagccucagcgacuuccgcugccggaccaccuucuacaccgcccugacgcgccugcucauggucgaccugggcgaggacgaggacgaguucgagaacuucaugcugccccucaccguggccuucgagaccgugcugcagaucuucaacaacaacuucaagcaggaggacgucaagcggaugcugaucgggcucgcccgcgaccugcggggcaucgccuucgcgcugaacaccaagacguccuacaccaugcuguucgacuggauguacccgaccuaccugccccugcuccagaacgccguggagcgcugguacggcgagccgaccugcacgacccccauccugaagcugauggccgagcucaugcagaaccggagccagcgccugaacuucgacguguccagccccaacgggauccuccuguuccgggaggccuccaagauggucugcaccuacggcaaccagauccugagccuggggucccucagcaaggaccagaucuaccccaugaagcugaagggcaucuccaucugcuacagcgcccugaaguccgcgcucugcgggaacuacgugagcuucggcguguucaagcuguacggcgacaaccacuucgacaacguccugcaggccuucgugaagaugcuccuguccgugagccacuccgaccugcuccaguaccgcaagcugagccaguccuacuacccccugcucgagugccugacccaggaccacaugagcuucaucaucaaccuggagccgcccguccucauguacgugcugacgagcaucuccgaggggcugaccacccucgacaccguggucagcuccagcugcugcacgucccuggacuacaucgugaccuaccuguucaagcacaucgccaaggagggcaagaagccccuccggugccgcgaggccacccaggccgggcagcggcugcugcacuucaugcagcagaaccccgacgugcuccagcagaugaugagcguccugaugaacaccaucguguucgaggacugccgcaaccagugguccgugagccgcccgcugcugggccucauccugcugaacgagaaguacuucuccgagcuccgggcgagccugaucaacucccagccccugcccaagcaggagguccucgcccagugcuuccgcaaccugauggaggggguggagcagaaccugagcgugaagaaccgggaccgcuucacgcagaaccucuccgucuuccggcgcgacguggccgaggcccugcggagcgacggcaacaccgagcccugcucccuggacaugaugagcuga

SEQ ID NO: 35460 - RNA, 606 nt, Artificial Sequence
  derived and/or modified sequence opt1 from RANBP1__Homo_sapiens__NP_002873
auggccgccgcgaaggacacccacgaggaccacgacaccagcacggagaacaccgacgaguccaaccacgacccccaguucgagccgaucgugagccugcccgagcaggagaucaagacccucgaggaggacgaggaggagcuguucaagaugcgcgccaagcuguuccgguucgccuccgagaacgaccuccccgaguggaaggagcgcggcaccggggacgucaagcugcugaagcacaaggagaagggcgccauccggcuccugaugcgccgggacaagacgcugaagaucugcgccaaccacuacaucacccccaugauggagcucaagccgaacgcggggagcgaccgcgccuggguguggaacacccacgccgacuucgccgacgagugccccaagcccgagcugcuggcgauccgguuccucaacgccgagaacgcccagaaguucaagaccaaguucgaggagugccgcaaggagaucgaggagcgggagaagaaggccggcuccgggaagaacgaccacgccgagaagguggcggagaagcuggaggcccugagcgucaaggaggagacgaaggaggacgccgaggagaagcaguga

SEQ ID NO: 35461 - RNA, 9675 nt, Artificial Sequence
  derived and/or modified sequence opt1 from RANBP2__Homo_sapiens__NP_006258
augcgccggagcaaggccgacguggagcgcuacaucgccagcgugcagggcagcacccccagcccccggcagaaguccaugaagggguucuacuucgccaagcucuacuacgaggccaaggaguacgaccucgccaagaaguacaucugcaccuacaucaacgugcaggagcgcgaccccaaggcccaccgguuccugggccugcucuacgagcuggaggagaacacggacaaggccguggagugcuaccgccggagcguggagcucaaccccacccagaaggaccucgugcucaagaucgcggagcugcucugcaagaacgacgugaccgacgggcgcgccaaguacuggcuggagcgggccgccaagcuguuccccggcagccccgcgaucuacaagcucaaggagcagcugcuggacugcgagggggaggacggcuggaacaagcuguucgaccugauccaguccgagcuguacgugcgccccgacgacgugcacgugaacauccggcucguggagguguaccgcagcaccaagcggcugaaggacgccguggcccacugccacgaggccgagcgcaacaucgcccugcgguccagccucgaguggaacuccugcguggugcagacccugaaggaguaccuggagagccuccagugccuggaguccgacaagagcgacuggcgcgcgaccaacaccgaccugcuccuggccuacgccaaccugaugcuccugacccuguccacccgggacgugcaggagagccgcgagcuccugcaguccuucgacagcgcccugcaguccgucaagagccucggcgggaacgacgagcugagcgccaccuuccuggagaugaagggccacuucuacaugcacgcggggucccuccugcugaagaugggccagcacagcuccaacgugcaguggcgggcccucagcgagcuggccgcccugugcuaccucaucgccuuccaggugccccgccccaagaucaagcugaucaagggggaggcgggccagaaccugcucgagaugauggccugcgaccggcugucccagagcggccacaugcugcugaaccucucccgcgggaagcaggacuuccugaaggagaucgucgagaccuucgccaacaagagcggccaguccgcccuguacgacgcccucuucagcucccagagccccaaggacaccuccuuccuggggagcgacgacaucggcaacaucgacgugcgcgagcccgagcuggaggaccucacccgguacgacgugggcgcgauccgcgcccacaacgggucccugcagcaccugaccuggcucggccugcaguggaacagccugcccgcccuccccgggauccggaaguggcugaagcagcuguuccaccaccucccccacgagaccucccgccuggagaccaacgcccccgagagcaucugcauccuggaccucgaggucuuccugcugggcgugguguacacgucccaccuccagcugaaggagaagugcaacagccaccacagcuccuaccagccccugugccucccccugccggucugcaagcagcugugcaccgagcggcagaaguccuggugggacgcggugugcacccucauccaccgcaaggccguccccgggaacguggccaagcugcggcugcucgugcagcacgagaucaacacccugcgcgcccaggagaagcacggccugcagcccgcccuccugguccacugggcggagugccugcagaagacgggcuccgggcucaacagcuucuacgaccagcgggaguacaucggccgcuccgugcacuacuggaagaaggugcugccccugcucaagaucaucaagaagaagaacagcaucccggagcccaucgacccccuguucaagcacuuccacuccgucgacauccaggccagcgagaucguggaguacgaggaggacgcccacaucaccuucgccauccuggacgccgugaacgggaacaucgaggacgcggucaccgccuucgaguccaucaagagcgugguguccuacuggaaccucgcccugaucuuccaccggaaggccgaggacaucgagaacgacgcccugagccccgaggagcaggaggagugcaagaacuaccuccgcaagacccgggacuaccugaucaagaucaucgacgacuccgacagcaaccuguccgucgugaagaagcucccggugccccuggagagcgucaaggagaugcugaacuccgugaugcaggagcucgaggacuacagcgagggcgggccccuguacaagaacggcagccugcgcaacgcggacuccgagaucaagcacagcacgcccuccccgacccgguacagccucucccccagcaaguccuacaaguacagccccaagaccccgccccgcugggccgaggaccagaacucccugcugaagaugaucugccagcaggucgaggccaucaagaaggagaugcaggagcucaagcugaacagcuccaacagcgccagcccccaccgguggcccaccgagaacuacggcccggacagcguccccgacggguaccagggcucccagacguuccacggggcgccccugaccguggccaccaccggccccagcguguacuacucccagagcccggccuacaacucccaguaccuccugcgccccgccgccaacgucacgcccaccaaggggcccguguacggcaugaaccggcugccgccccagcagcacaucuacgcguacccccagcagaugcacacgccgcccgugcagagcagcuccgccugcauguucagccaggagauguacgggccgcccgcccuccgcuucgagucccccgccaccgggauccugagcccccgcggcgacgacuacuucaacuacaacguccagcagacguccaccaacccgccccuccccgagccgggguacuucaccaagccgcccaucgccgcgcacgccagccgguccgccgagagcaagaccaucgaguucggcaagaccaacuucgugcagccgaugcccggcgaggggcuccgccccucccugcccacgcaggcccacaccacccagccgacccccuucaaguucaacagcaacuucaaguccaacgacggcgacuucacguucagcagcccccagguggucacccagcccccgcccgccgcguacagcaacuccgagagccugcucgggcugcugaccuccgacaagccccuccagggcgacggguacagcggcgccaagcccaucccgggcgggcagaccaucggcccccggaacacguucaacuucggguccaagaacgugagcggcaucagcuucaccgagaacaugggguccagccagcagaagaacuccggcuuccgccggagcgacgacauguucaccuuccacggccccgggaaguccguguucggcacccccacgcuggagaccgccaacaagaaccacgagaccgacgggggcagcgcccacggggacgacgacgacgacggcccgcacuucgagcccgucgugccccugcccgacaagaucgaggugaagaccggcgaggaggacgaggaggaguucuucugcaaccgcgcgaagcuguuccgguucgacgucgaguccaaggaguggaaggagcgcgggaucggcaacgugaagauccugcggcacaagacgagcgggaagauccgccugcucaugcggcgcgagcagguccugaagaucugcgccaaccacuacaucuccccggacaugaagcugacccccaacgccggcagcgaccgguccuucgucuggcacgcccucgacuacgccgacgagcugcccaagcccgagcagcuggcgauccgcuucaagaccccggaggaggccgcccucuucaagugcaaguucgaggaggcccagagcauccugaaggcccccgggaccaacguggcgauggccuccaaccaggccgugcggaucgucaaggagcccacgagccacgacaacaaggacaucugcaaguccgacgccggcaaccugaacuucgaguuccagguggccaagaaggagggcagcugguggcacugcaacuccugcagccucaagaacgcguccaccgccaagaagugcgugagcugccagaaccugaaccccagcaacaaggagcuggucgggccgccccucgccgagaccguguucacccccaagacguccccggagaacgugcaggaccgcuucgcccuggucacccccaagaaggagggccacugggacugcagcaucugccuggugcggaacgagcccaccgugucccgcugcaucgccugccagaacaccaagagcgcgaacaaguccgggagcuccuucguccaccaggccagcuucaaguucggccagggcgaccuccccaagccgaucaacuccgacuuccggagcguguucuccacgaaggaggggcagugggacugcagcgccugccuggugcagaacgagggcuccagcaccaagugcgccgcgugccagaacccccgcaagcagucccugcccgccaccagcauccccaccccggccuccuucaaguucgggacgagcgagaccuccaagacccucaagagcggcuucgaggacauguucgccaagaaggaggggcagugggacugcagcuccugccucguccggaacgaggccaacgcgacccgcugcguggccugccagaaccccgacaagcccagccccuccacgagcgucccggcccccgccuccuucaaguucggcaccagcgagaccuccaaggcccccaagagcggcuucgaggggauguucaccaagaaggagggccagugggacugcuccgugugccuggugcgcaacgaggcgagcgccaccaagugcaucgccugccagaaccccgggaagcagaaccagacgaccuccgccgucagcaccccggccuccagcgagaccuccaaggcgcccaagagcggcuucgaggggauguucacgaagaaggagggccagugggacugcuccgugugccuggugcggaacgaggccagcgccaccaagugcaucgccugccagaaccccggcaagcagaaccagaccaccuccgcggucagcacgcccgccagcuccgagaccagcaaggccccgaaguccggguucgagggcauguucaccaagaaggaggggcagugggacugcagcgugugccucgugcgcaacgaggccuccgccaccaagugcaucgcgugccagugccccagcaagcagaaccagacgaccgccaucuccacccccgccagcuccgagaucagcaaggcccccaaguccggcuucgaggggauguucauccggaagggccagugggacugcagcgucugcugcgugcagaacgaguccagcucccugaagugcguggccugcgacgcgagcaagccgacccacaagcccaucgccgaggcccccuccgccuucacgcugggcagcgagaugaagcuccacgacagcuccgggagccaggucggcaccggguucaaguccaacuucagcgagaaggccuccaaguucggcaacaccgagcagggcuucaaguucgggcacguggaccaggagaacagccccuccuucauguuccagggcagcuccaacaccgaguucaagagcacgaaggagggguucuccaucccggugagcgcggacggcuucaaguucgggaucuccgagcccggcaaccaggagaagaaguccgagaagccccuggagaacggcaccggguuccaggcccaggacaucuccggccagaagaacgggcgcggcgucaucuucgggcagaccagcuccaccuucacguucgccgaccuggccaagagcaccuccggcgagggcuuccaguucgggaagaaggacccgaacuucaagggcuucagcggggcgggcgagaagcuguucagcucccaguacgggaagauggccaacaaggccaacaccagcggcgacuucgagaaggacgacgacgccuacaagaccgaggacuccgacgacauccacuucgagcccguggugcagaugcccgagaaggucgagcuggugacgggcgaggaggacgagaaggugcuguacagccagcgggucaagcuguuccgcuucgacgccgaggugucccaguggaaggagcgggggcugggcaaccugaagauccucaagaacgaggugaacgggaagcugcgcaugcugaugcggcgcgagcagguccucaaggugugcgcgaaccacuggaucaccaccaccaugaaccugaagccccugagcggcuccgaccgggccuggauguggcucgccagcgacuucuccgacggggacgccaagcuggagcagcuggccgcgaaguucaagacgccggagcucgccgaggaguucaagcagaaguucgaggagugccagcgccugcugcucgacaucccccugcagacgccccacaagcugguggacaccggccgggccgccaagcucauccagcgcgccgaggagaugaaguccggccugaaggacuucaagaccuuccugacgaacgaccagaccaaggucaccgaggaggagaacaagggguccggcaccggggcggccggcgccagcgacaccacgaucaagcccaacccggagaacaccggccccacccucgagugggacaacuacgaccugcgggaggacgcccuggacgacuccgugagcuccagcuccgugcacgccagcccccucgcguccagccccguccgcaagaaccuguuccgguucggggagagcaccacgggcuucaacuucuccuucaagagcgcccuguccccgagcaagucccccgccaagcucaaccagagcgggaccuccgugggcaccgacgaggagagcgacgugacccaggaggaggagcgcgacgggcaguacuucgagcccgucgugccccugccggaccugguggaggucuccagcggcgaggagaacgagcaggucguguucucccaccgggccaagcucuaccgcuacgacaaggacgucggccaguggaaggagcgcgggaucggcgacaucaagauccugcagaacuacgacaacaagcagguccggaucgugaugcgccgggaccagguccugaagcucugcgcgaaccaccgcaucacgcccgacaugacccugcagaacaugaaggggaccgagcggguguggcuguggaccgccugcgacuucgccgacggcgagcgcaagguggagcaccucgccguccgguucaagcugcaggacguggccgacagcuucaagaagaucuucgacgaggcgaagacggcccaggagaaggacucccugaucaccccgcacgugagccgcuccagcacgccccgggagucccccugcgggaagaucgccgucgccgugcucgaggagaccacgcgcgagcggaccgacgugauccagggcgacgacgucgccgacgcgaccagcgagguggaggucuccagcaccagcgagacgacccccaaggccgugguguccccgcccaaguucgucuucggcagcgaguccgucaagagcaucuucuccagcgagaaguccaagcccuucgccuucgggaacagcuccgccaccggcagccuguucggguucuccuucaacgcgccccucaagagcaacaacuccgagaccagcuccguggcgcagagcggcuccgagagcaaggucgagcccaagaagugcgagcucuccaagaacagcgacaucgagcagagcuccgacagcaaggugaagaaccuguucgccuccuucccgacggaggagagcuccaucaacuacaccuucaagacccccgagaaggccaaggagaagaagaagcccgaggacagccccuccgacgacgacgugcugaucgucuacgagcucaccccgacggccgagcagaaggcgcuggccaccaagcugaagcugccgcccaccuucuucugcuacaagaaccgccccgacuacgugagcgaggaggaggaggacgacgaggacuucgagaccgccgugaagaagcugaacgggaagcuguaccucgacggcuccgagaagugccggccgcuggaggagaacacggccgacaacgagaaggagugcaucaucgucugggagaagaagcccaccguggaggagaaggccaaggcggacacccugaagcugccgcccaccuucuucugcggcgugugcagcgacacggacgaggacaacgggaacggcgaggacuuccaguccgagcugcagaagguccaggaggcccagaagucccagaccgaggagaucaccagcaccacggacagcguguacaccgggggcaccgaggugauggucccguccuucugcaagagcgaggagcccgacuccaucaccaagagcaucuccagccccagcguguccagcgagaccauggacaagcccguggaccuguccacgcgcaaggagaucgacaccgacagcaccucccagggggagagcaagaucgucuccuucggcuucggcagcuccaccgggcucagcuucgccgaccuggccuccagcaacuccggcgacuucgccuucgggagcaaggacaagaacuuccagugggcgaacacgggcgccgccguguucggcacccaguccguggggacccagagcgccggcaaggucggggaggacgaggacggcuccgacgaggagguggugcacaacgaggacauccacuucgagccgaucgucagccugcccgagguggaggugaaguccggggaggaggacgaggagauccucuucaaggagcgggccaagcuguaccgcugggaccgggacgucucccaguggaaggagcgcggcgugggcgacaucaagauccuguggcacaccaugaagaacuacuaccggauccucaugcgccgggaccagguguucaaggucugcgcgaaccacgugaucacgaagaccauggagcugaagccccugaacgugagcaacaacgcccucgucuggaccgccuccgacuacgccgacggggaggcgaagguggagcagcuggccgugcgcuucaagaccaaggaggucgccgacugcuucaagaagacguucgaggagugccagcagaaccugaugaagcuccagaagggccacgugagccuggccgccgagcuguccaaggagaccaaccccguggucuucuucgacgugugcgcggacggggagccgcucggccgcaucaccauggagcuguucagcaacaucgugccccggaccgccgagaacuuccgcgcccugugcacgggggagaagggcuucggcuucaagaacuccaucuuccaccgggucauccccgacuucgugugccagggcggcgacaucaccaagcacgacgggaccggcgggcagagcaucuacggcgacaaguucgaggacgagaacuucgacgugaagcacaccggccccgggcuccuguccauggccaaccagggccagaacacgaacaacagccaguucgucaucacccugaagaaggccgagcaccucgacuucaagcacgugguguucggguucgucaaggacggcauggacaccgugaagaagaucgaguccuucggcagcccgaagggguccgucugccgccggaucaccaucacggagugcggccagaucuga

SEQ ID NO: 35462 - RNA, 1689 nt, Artificial Sequence
  derived and/or modified sequence opt1 from RANBP3__Homo_sapiens__NP_003615
auggccgaccuggccaacgaggagaagcccgcgaucgccccgcccguguucgucuuccagaaggacaagggccagaagucccccgccgagcagaagaaccucuccgacagcggggaggagccccgcggcgaggccgaggccccgcaccacgggaccggccaccccgaguccgcgggggagcacgcccuggagccgcccgcccccgccggcgcgagcgccuccacgcccccgccgcccgcccccgaggcccagcugccgcccuucccccgggagcucgccggccgcagcgccgggggcuccagccccgagggcggggaggacuccgaccgggaggacgggaacuacugcccgcccgugaagcgcgagcggaccagcucccugacccaguucccgcccagccaguccgaggagcgcagcuccggcuuccggcugaagccgcccacccucauccacggccaggcgcccagcgccgggcugcccucccagaagcccaaggagcagcagcgcagcgugcugcggcccgccguccuccaggcgccccagcccaaggcgcugucccagaccgugcccagcagcggcacgaacggggugagccugcccgccgacugcaccggcgccguccccgccgccagccccgacaccgccgccuggcgcucccccagcgaggccgccgacgaggagaaggagccgcagaagaacgaguccagcaacgccuccgaggaggaggcgugcgagaagaaggaccccgccacccagcaggccuucguguucggccagaaccuccgggaccgcgugaagcugaucaacgagagcgucgacgaggccgacauggagaacgcggggcaccccuccgccgacacgcccaccgccaccaacuacuuccugcaguacaucagcuccagccucgagaacuccaccaacagcgccgacgccuccagcaacaaguucguguucggccagaacauguccgagcgggugcugagcccgcccaagcugaacgaggucuccagcgacgcgaaccgcgagaacgccgccgccgagagcggguccgagagcuccagccaggaggccacgcccgagaaggagucccucgcggagagcgccgccgccuacaccaaggccaccgcgcggaagugccugcuggagaagguggaggugaucaccggcgaggaggccgaguccaacguccuccagaugcagugcaagcuguucguguucgacaagacgagccaguccuggguggagcgcgggcggggccugcuccgccugaacgacauggccagcaccgacgacggcacccugcagucccggcucgucaugcgcacccaggggagccugcggcugauccucaacacgaagcugugggcccagaugcagaucgacaaggcguccgagaaguccauccgcaucaccgccauggacaccgaggaccagggcgugaagguguuccugaucagcgccagcuccaaggacaccgggcagcucuacgccgcccugcaccaccgcauccuggcgcuccggagccgcgucgagcaggagcaggaggccaagaugcccgccccggagcccggcgccgcccccagcaacgaggaggacgacuccgacgacgacgacgugcuggcgcccagcggggccacggccgccggcgccggcgacgagggggacggccagaccaccggguccaccuga

SEQ ID NO: 35463 - RNA, 1473 nt, Artificial Sequence
  derived and/or modified sequence opt1 from RANBP3L__Homo_sapiens__NP_001154901
augaccaccaucccccgcaagggcagcucccaccucccggggagccugcacacgugcaagcugaagcugcaggaggaccggcgccagcaggagaaguccgugaucgcccagcccaucuucgucuucgagaagggcgagcagaccuucaagcggcccgccgaggacacccucuacgaggcggccgagcccgagugcaacggguucccgaccaagcgcgugcggagcuccagcuucacguuccacaucaccgacucccagagccagggcguguccacccugagccagaagcagaugcgcugcuccagcgucaccaaccugcccacguucccccacuccgggcccgugcggaagaacaacguguucaugaccagcgcccucguccaguccagcguggacaucaaguccgccgagcagggcccggugaagcacagcaagcacgucauccgccccgccauccugcagcugccccaggcgcgguccugcgccaaggugcgcaagaccuucggccacaaggcccucgagagcugcaagaccaaggagaagacgaacaacaagaucagcgaggggaacuccuaccugcugagcgagaaccucucccgggcccgcaucagcgugcagcuguccaccaaccaggacuuccugggcgcgaccagcgucgggugccagcccaacgaggacaagugcuccuucaagagcugcuccagcaacuucguguucggcgagaacaugguggagcggguccucgggacccagaagcugacgcagccgcagcuggagaacgacuccuacgccaaggagaagcccuucaagagcauccccaaguuccccgugaacuuccucuccagccgcaccgacuccaucaagaacaccagccugaucgaguccgccgccgccuucagcucccagccgagccggaagugccugcucgagaagaucgacgugaucaccggcgaggagacggagcacaacguccugaagaucaacugcaagcuguucaucuucaacaagaccacccagagcuggaucgagcgcggccgggggacccuccgccugaacgacacggcguccaccgacugcggcacccugcagagccggcucaucaugcgcaaccaggggucccugcggcugauccucaacagcaagcugugggcccagaugaagauccagcgcgccaaccacaagaacgugcgcaucaccgccacggaccuggaggacuacuccaucaagaucuuccucauccaggccagcgcgcaggacaccgccuaccuguacgccgccauccaccaccggcugguggcccuccaguccuucaacaagcagcgcgacgucaaccaggcggagagccuguccgagaccgcccagcagcugaacugcgagagcugcgacgagaacgaggacgacuucauccaggugaccaagaacggcuccgaccccagcuccuggacgcaccggcagagcguggccugcuccuga

SEQ ID NO: 35464 - RNA, 3318 nt, Artificial Sequence
  derived and/or modified sequence opt1 from RANBP6__Homo_sapiens__NP_036548
auggccgccaccgcgagcgccggcgugcccgccaccgucuccgagaagcaggaguucuaccagcugcucaagaaccugaucaacccgagcugcauggugcgccggcaggccgaggagaucuacgagaacauccccgggcugugcaagacgaccuuccuccuggacgccgugcgcaaccggcgcgcgggcuacgagguccggcagauggccgccgcccugcuccgccggcugcuguccagcggguucgaggagguguaccccaaccuccccgcggacgugcagcgcgacgucaagaucgagcugauccuggccgugaagcucgagacccacgccuccaugcggaagaagcugugcgacaucuucgccgugcuggcccgcaaccucaucgacgaggacggcaccaaccacuggccggaggggcugaaguuccugaucgacagcaucuacuccaagaacgucgugcucugggagguggcgcugcacgucuucuggcacuuccccggcaucuucggcacgcaggagcggcacgaccuggacaucaucaagcgccuccuggaccagugcauccaggaccaggagcaccccgccauccggacccugagcgcccgcgccgccgcggccuucgugcucgccaacgagaacaacaucgcccuguucaaggacuucgccgaccugcuccccgggauccugcaggcggugaacgacuccugcuaccaggacgacgacagcguccuggagucccucguggagaucgccgacaccgugccgaaguaccugggccccuaccuggaggacacccuccagcugagccugaagcucugcggggacucccggcugagcaaccugcagcgccagcucgcccuggaggucaucgugacgcuguccgagaccgccacccccaugcucaagaagcacaccaacaucaucgcccaggcggugccccacauccuggccaugauggucgaccugcaggacgacgaggacugggugaacgccgacgagauggaggaggacgacuucgacagcaacgccguggcggccgaguccgcccucgaccggcuggccugcggccucgggggcaaggucgugcugccgaugacgaaggagcacaucaugcagaugcugcagagccccgacuggaaguaccgccacgccggccugauggcgcuguccgccaucggggagggcugccaccagcagauggagagcauccucgacgagaccgucaacagcgugcugcuguuccuccaggacccccacccccgggugcgcgccgccgccugcaccacccuggggcagauggcgacggacuucgccccgaacuuccagaagaaguuccacgagaccgucaucgccgcccugcuccggaccauggagaaccagggcaaccagcgcgugcagucccacgccgcgagcgcccugaucaucuucaucgaggacugccccaagucccugcucgugcuguacgucgacagcauggugaagaaccugcacuccgugcucgucaucaagcugcaggagcugauccgcaacggcaccaagcucgcccuggagcagcuggugacgaccaucgccagcguggcggacaccaucgaggagaaguucguccccuacuacgacaucuucaugcccucccucaagcacaucguggagcuggccgugcagaaggagcugaagcuccugcgggggaagaccaucgagugcaucagccacaucggccuggccgucgggaaggagaaguucaugcaggacgccuccaacgugaugcagcuccugcugaagacgcagagcgaccucaacaacauggaggacgacgacccgcagaccuccuacauggugagcgccugggcgcgcaugugcaagauccugggcaaggacuuccagcaguaccugccccucgucaucgagccccugaucaagaccgccuccgccaagcccgacguggcccugcucgacacccaggacguggagaacaugagcgacgacgacggguggcaguucgucaaccugggcgaccagcaguccuucggcaucaagacgagcgggcuggaggccaaggcgaccgccugccagaugcucguguacuacgccaaggagcugcgggagggcuucguggaguacaccgagcaggucgugaagcugauggugccgcuccugaaguucuacuuccacgacaacguccgcguggccgccgcggaguccaugcccuuccugcucgagugcgcccggauccgcgggcccgaguaccuggcccagauguggcaguucaucugcgacccccugaucaaggccaucggcaccgagccggacacggacgugcucagcgagaucaugaacuccuucgccaagagcaucgaggucaugggggacggcugccugaacgacgagcaccuggaggagcucggcgggauccugaaggcgaagcuggagggccacuucaagaaccaggagcuccgccaggugaagcggcaggaggagaacuacgaccagcaggucgagaugagccugcaggacgaggacgagugcgacguguacauccugaccaagguguccgacauccuccacagccuguucuccaccuacaaggagaagauccugcccugguucgagcagcuccugccccugaucgugaaccucaucugcagcucccggccguggcccgaccgccagugggggcugugcaucuucgacgacaucaucgagcacugcagccccaccuccuucaaguacgucgaguacuuccgguggcccaugcugcucaacaugcgcgacaacaacccggaggugcggcaggccgccgccuacggccugggggugauggcgcaguucggcggcgacgacuaccgcagccugugcuccgaggccgucccccuccuggugaaggugaucaagugcgccaacagcaagacgaagaagaacgucaucgccaccgagaacugcaucuccgccaucgggaagauccugaaguucaagcccaacugcgugaacguggacgagguccucccccacuggcugagcuggcugccgcuccacgaggacaaggaggaggcgauccagacccuguccuuccugugcgaccucaucgagagcaaccaccccguggugaucggccccaacaacuccaaccugcccaagaucaucagcaucaucgccgaggggaagaucaacgagaccaucaacuacgaggacccgugcgccaagcggcuggccaacgucgugcgccaggugcagaccuccgaggaccucuggcuggagugcgucagccagcuggacgacgagcagcaggaggcccuccaggagcugcugaacuucgcguga

SEQ ID NO: 35465 - RNA, 2190 nt, Artificial Sequence
  derived and/or modified sequence opt1 from RANBP9__Homo_sapiens__NP_005484
augagcggccagcccccgcccccccccccgcagcagcagcagcagcagcagcagcugucccccccccccccggccgcccucgcgcccgugagcggggucgugcugcccgcccccccggccguguccgccggcagcucccccgccgggagccccggcgggggcgcgggcggggagggccugggggccgccgccgcggcccuccugcugcaccccccgcccccccccccgcccgccaccgccgccccccccccgcccccccccccgccccccccgcccgcguccgccgccgcccccgccagcggccccccggcgccccccgggcucgccgccggccccggcccggccgggggcgcccccacccccgcgcuggucgccggguccagcgccgccgcccccuucccgcacggcgacuccgcgcugaacgagcaggagaaggagcuccagcgccggcugaagcgccuguaccccgccguggacgagcaggagacgccccucccccggagcugguccccgaaggacaaguucagcuacaucggccugucccagaacaaccugcgcgugcacuacaaggggcacggcaagacccccaaggacgccgccagcguccgggcgacccaccccauccccgccgccugcgggaucuacuacuucgaggugaagaucguguccaagggccgcgacggguacaugggcaucggccucagcgcccagggggucaacaugaaccggcugccgggcugggacaagcacuccuacggguaccacggcgacgacgggcacagcuucugcagcuccggcaccggccagcccuacgggcccacguucaccaccggcgacgugaucgggugcugcgugaaccugaucaacaacaccugcuucuacacgaagaacggccacagccucgggaucgccuucaccgaccugcccccgaaccuguaccccaccgucggccuccagacccccggcgaggugguggacgcgaacuucgggcagcacccguucgucuucgacaucgaggacuacaugcgcgaguggcggacgaagauccaggcccagaucgaccgcuuccccaucggcgaccgggagggggaguggcagaccaugauccagaagaugguguccagcuaccuggugcaccacggcuacugcgccaccgccgaggccuucgcgcgcuccaccgaccagacgguccuggaggagcucgccagcaucaagaaccggcagcgcauccagaagcuggugcuggccggccggaugggggaggccaucgagaccacccagcagcucuaccccucccugcuggagcgcaaccccaaccuccuguucacccugaaggugcggcaguucaucgagauggucaacggcacggacagcgaggugcgcugccucgggggccgguccccgaagagccaggacuccuaccccgugagcccccgccccuucuccagcccguccaugagccccucccacgggaugaacauccacaaccuggccagcggcaagggcuccaccgcgcacuucagcggguucgagagcugcuccaacggcgucaucagcaacaaggcccaccaguccuacugccacagcaacaagcaccaguccagcaaccugaacgugcccgagcucaacuccaucaacaugagccggucccagcaggucaacaacuucaccagcaacgacguggacauggagaccgaccacuacuccaacggggugggcgagacgagcuccaacggguuccugaacggcagcuccaagcacgaccacgagauggaggacugcgacaccgagauggaggucgacagcucccagcugcgccgccagcucugcggcgggagccaggccgccaucgagcggaugauccacuucggccgcgagcugcaggcgaugagcgagcagcugcggcgcgacugcgggaagaacaccgccaacaagaagaugcucaaggacgccuucucccugcuggccuacagcgaccccuggaacuccccggugggcaaccagcucgaccccauccagcgggagcccgugugcagcgcccugaacuccgcgauccuggagacccacaaccuccccaagcagccgccccuggcccuggccauggggcaggccacgcagugccugggccucauggcccgcagcggcaucggguccugcgcguucgccaccgucgaggacuaccugcacuga

SEQ ID NO: 35466 - RNA, 1764 nt, Artificial Sequence
  derived and/or modified sequence opt1 from RANGAP1__Homo_sapiens__NP_001265580
auggccagcgaggacaucgccaagcuggcggagacccucgccaagacccagguggccggcgggcagcuguccuucaagggcaagagccugaagcucaacacggccgaggacgccaaggacgucaucaaggagaucgaggacuucgacucccuggaggcgcugcgccucgaggggaacaccgugggcguggaggccgcccgggucaucgccaaggcgcuggagaagaaguccgagcugaagcgcugccacuggagcgacauguucaccgggcggcuccgcaccgagaucccgcccgcccugaucagccugggcgagggccucaucacggccggggcccagcugguggagcuggaccucuccgacaacgccuucggccccgacggggugcagggcuucgaggcgcugcucaagagcuccgccugcuucacccugcaggagcugaagcugaacaacugcgggaugggcaucggcgggggcaagauccucgccgccgcccugaccgagugccaccgcaagagcuccgcgcaggggaagccccuggcccucaaggucuucguggccggccggaaccggcuggagaacgacggcgccaccgcccuggcggaggccuuccgcgugaucgggacgcucgaggagguccacaugccccagaacggcaucaaccacccggggaucaccgcccuggcccaggccuucgcggugaacccccugcuccgggugaucaaccugaacgacaacaccuucaccgagaagggcgccgucgccauggccgagacgcugaagacccuccgccagguggaggugaucaacuucggggacugccugguccggagcaagggcgcgguggccaucgccgacgccauccgcggcgggcugcccaagcucaaggagcugaaccuguccuucugcgagaucaagcgggacgccgcgcucgccguggccgaggccauggccgacaaggcggagcuggagaagcuggaccucaacggcaacacccugggggaggagggcugcgagcagcugcaggagguccucgagggguucaacauggccaaggugcuggccagccuguccgacgacgaggacgaggaggaggaggaggagggcgaggaggaggaggaggaggccgaggaggaggaggaggaggacgaggaggaggaggaggaggaggaggaggaggaggaggaggagccccagcagcgcggccagggggagaaguccgccaccccgagccggaagauccucgaccccaacacgggcgagcccgcgcccgugcugagcuccccgccgcccgccgacgucagcaccuuccuggccuuccccagccccgagaagcugcuccgccuggggcccaaguccagcgugcugaucgcccagcagaccgacaccuccgaccccgagaagguggucagcgcguuccucaagguguccagcgucuucaaggacgaggccacggugcggauggccgugcaggacgccgucgacgcccugaugcagaaggcguucaacuccagcuccuucaacagcaacaccuuccugacccgccuccuggugcacaugggccugcucaaguccgaggacaaggugaaggccaucgccaaccuguacgggccccugauggcccucaaccacaugguccagcaggacuacuucccgaaggcccuggcgccccugcuccuggccuucgugaccaagcccaacagcgcccuggaguccugcagcuucgcccggcacucccuccugcagacgcuguacaagguguga

SEQ ID NO: 35467 - RNA, 441 nt, Artificial Sequence
  derived and/or modified sequence opt1 from RANGRF__Homo_sapiens__NP_001171272
auggagcccacccgcgacugcccgcuguucggcggggccuucagcgccauccuccccaugggcgcgaucgacguguccgaccugcggcccguccccgacaaccaggagguguucugccacccggugaccgaccagagccugaucgucgagcuccuggagcugcaggcccacgugcgcggggaggccgccgcccgguaccacuucgaggacgugggcgggguccagggcgcgcgcgccgugcacguggaguccguccagccccucagccuggagaaccuggcccuccggggccgcugccaggaggccugggugcuguccgggaagcagcagaucgcgaaggagaaccagcaggucgccaaggacgugacgcugcaccaggcccuccugcggcugccccaguaccagaccgaccuccugcugaccuucaaccagcccccguga

SEQ ID NO: 35468 - RNA, 387 nt, Artificial Sequence
  derived and/or modified sequence opt1 from RAN__Homo_sapiens__NP_001287725
auguucgacgugaccagccgcgucaccuacaagaacgugcccaacuggcaccgggaccuggugcgcgucugcgagaacaucccgaucgugcucugcggcaacaagguggacaucaaggaccggaaggucaaggccaaguccaucguguuccaccgcaagaagaaccugcaguacuacgacaucagcgccaaguccaacuacaacuucgagaagcccuuccuguggcucgcgcggaagcugaucggggaccccaaccuggaguucguggccaugcccgcccucgccccgcccgaggucgugauggaccccgcccuggcggcccaguacgagcacgaccuggagguggcccagacgaccgcccuccccgacgaggacgacgaccuguga

SEQ ID NO: 35469 - RNA, 555 nt, Artificial Sequence
  derived and/or modified sequence opt1 from RAP1B__Homo_sapiens__NP_001010942
augcgcgaguacaagcuggugguccucggcagcgggggcguggggaaguccgcccugaccgugcaguucguccagggcaucuucguggagaaguacgaccccaccaucgaggacagcuaccggaagcaggucgagguggacgcccagcagugcaugcuggagauccucgacacggcggggaccgagcaguucaccgccaugcgcgaccuguacaugaagaacggccagggcuucgcccugguguacuccaucaccgcccagagcacguucaacgaccuccaggaccugcgggagcagauccugcgcgugaaggacaccgacgacgucccgaugauccucguggggaacaagugcgaccuggaggacgagcggguggucggcaaggagcaggggcagaaccuggcccgccaguggaacaacugcgcguuccucgaguccagcgccaaguccaagaucaacgugaacgagaucuucuacgaccuggugcggcagaucaaccgcaagacccccguccccggcaaggcccggaagaaguccagcugccagcugcucuga

SEQ ID NO: 35470 - RNA, 2148 nt, Artificial Sequence
  derived and/or modified sequence opt1 from RAP1GAP2__Homo_sapiens__NP_001093868
auguucggccgcaagcggagcguguccuucgggggcuucggguggaucgacaagaccaugcuggccagccucaaggucaagaagcaggagcuggccaacuccagcgacgcgacccugcccgaccgcccgcucuccccgccccugacggcgccgcccaccaugaaguccuccgaguucuucgagaugcuggagaagaugcaggacgacuacauccccuaccccagcaucgacgaggugguggagaagggcgggcccuacccccaggucauccucccccaguucggcggcuacuggaucgaggaccccgagaacguggggacccccaccucccugggcagcuccaucugcgaggaggaggaggaggacaaccugagcccgaacacguucggguacaagcucgagugcaagggcgaggcccgggccuaccgccggcacuuccuggggaaggaccaccugaacuucuacugcaccggcuccagccucggcaaccugauccuguccgugaagugcgaggaggccgaggggaucgaguaccuccgcgucauccugcggagcaagcugaagaccgugcacgagcgcaucccccucgccggccuguccaagcugcccagcgugccccagaucgccaaggccuucugcgacgacgccgucgggcuccgguucaacccggugcuguaccccaaggcgucccagaugaucgugagcuacgacgagcacgaggucaacaacaccuucaaguucggcgugaucuaccagaaggcccgccagacgcuggaggaggagcuguucggcaacaacgaggagagccccgccuucaaggaguuccucgaccugcucggggacaccaucacccugcaggacuucaagggcuuccgcgggggccuggacgugacccacgggcagacgggcgucgagagcguguacaccaccuuccgggaccgggagaucauguuccacgugagcaccaagcuccccuucacggacggcgacgcccagcagcugcagcgcaagcggcacaucgggaacgacaucgucgccaucaucuuccaggaggagaacaccccguucgugcccgacaugaucgcguccaacuuccugcacgccuacaucgugguccagguggagacccccggcaccgagacgcccagcuacaagguguccgucaccgcccgcgaggacgugccgaccuucgggccgccccuccccagcccgcccgucuuccagaagggccccgaguuccgggaguuccugcugaccaagcucacgaacgccgagaacgccugcugcaaguccgacaaguucgcgaagcuggaggaccgcacccgggccgcccugcucgacaaccugcacgacgagcugcacgcccacacccaggccaugcucgggcugggccccgaggaggacaaguucgagaacggcgggcacggcggguuccuggagagcuucaagcgcgcgauccgggugcgcucccacagcauggagaccauggugggcgggcagaagaagucccacagcggcggcauccccgggucccucagcggcgggaucucccacaacagcauggaggucacgaagaccaccuucuccccgcccgugguggccgccaccgucaagaaccagagccgcucccccaucaagcggcgcagcggccuguucccccggcugcacacgggcagcgaggggcagggcgacucccgcgcccggugcgacagcaccuccagcacccccaagacccccgacgggggccacuccagccaggagaucaaguccgagacgagcuccaacccgagcucccccgagaucugccccaacaaggagaagcccuucaugaagcucaaggagaacgggcgcgccaucagccgguccagcuccagcaccuccagcgugagcuccaccgcgggcgagggcgaggccauggaggagggggacagcggcgggucccagccgagcaccaccucccccuucaagcaggagguguucgucuacagccccucccccagcuccgagagcccgucccugggcgccgccgcgacgcccaucaucaugagccgcucccccaccgacgccaagagccggaacagcccccgcuccaaccugaaguuccgguucgacaagcugucccacgccagcuccggggccggccacuga

SEQ ID NO: 35471 - RNA, 1827 nt, Artificial Sequence
  derived and/or modified sequence opt1 from RAP1GDS1__Homo_sapiens__NP_001093896
auggccgacaaccugagcgacacccucaagaagcugaagaucaccgccguggacaagacggaggacucccuggagggcugccucgacugccugcugcaggcgcucgcccagaacaacaccgagaccagcgagaagauccaggccuccgggauccugcagcuguucgccagccuccugacgccccaguccagcugcaaggccaaggucgcgaacaucaucgccgagguggccaagaacgaguucaugcgcaucccgugcguggacgccggccugaucagcccccucguccagcugcugaacuccaaggaccaggaggugcuccugcagaccgggcgggcgcugggcaacaucugcuacgacucccacgaggggcgcagcgccguggaccaggccggcggcgcccagaucgucaucgaccaccuccggucccugugcagcaucaccgaccccgccaacgagaagcugcucaccguguucugcgggaugcugaugaacuacuccaacgagaacgacagccugcaggcgcagcucaucaacaugggcgugauccccacccuggucaagcugcucgggauccacugccagaacgccgcccugacggagaugugccugguggccuucggcaaccucgccgagcuggaguccagcaaggagcaguucgcguccaccaacaucgccgaggagcuggugaagcuguucaagaagcagaucgagcacgacaagcgcgagaugaucuucgagguccucgccccgcuggccgagaacgacgccaucaagcuccagcugguggaggcggggcugguggagugccuccuggagaucguccagcagaagguggacagcgacaaggaggacgacaucaccgagcugaagaccggcuccgaccucauggugcugcugcuccugggcgacgagagcaugcagaagcuguucgagggcgggaaggggagcgucuuccagcgggugcucuccuggauccccagcaacaaccaccagcugcagcuggccggcgcccuggccaucgccaacuucgcgcgcaacgacgccaacugcauccacaugguggacaacggcaucgucgagaagcucauggaccugcuggaccggcacguggaggacgggaacgugacgguccagcacgccgcccucuccgcgcugcgcaaccuggccauccccgugaucaacaaggccaagaugcucagcgccggcgucaccgaggccgugcugaaguuccugaaguccgagaugcccccggugcaguucaagcuccuggggacccugcggaugcucaucgacgcgcaggccgaggccgccgagcagcugggcaagaacgucaagcugguggagcgccucguggaguggugcgaggccaaggaccacgcgggggucaugggcgagagcaaccggcugcuguccgcccucauccgccacagcaaguccaaggacgugaucaagaccaucgugcagagcggcgggaucaagcaccuggucacgauggccaccuccgagcacgugaucaugcagaacgaggcccugguggcccucgcgcugaucgccgcccuggagcucggcaccgccgagaaggaccuggagagcgcgaagcugguccagauccuccaccggcugcuggccgacgagcgcuccgcccccgagaucaaguacaacagcauggugcucaucugcgcccugaugggguccgagugccugcacaaggaggugcaggaccucgccuuccuggacgucgugagcaagcugcggucccacgagaacaagagcguggcgcagcaggccucccucaccgagcagcgccugacggucgagagcuga

SEQ ID NO: 35472 - RNA, 552 nt, Artificial Sequence
  derived and/or modified sequence opt1 from RAP2A__Homo_sapiens__NP_066361
augcgcgaguacaagguggucgugcucggcagcgggggcguggggaaguccgcccucaccguccaguucgugaccggcacguucaucgagaaguacgaccccaccaucgaggacuucuaccggaaggagaucgagguggacagcuccccgagcguccuggagauccuggacaccgccgggaccgagcaguucgcguccaugcgcgaccucuacaucaagaacggccagggcuucauccugguguacagccuggugaaccagcaguccuuccaggacaucaagcccaugcgggaccagaucauccgcgucaagcgguacgagaaggugcccgugauccucgucgggaacaagguggaccuggagagcgagcgcgagguguccagcuccgagggccgggcccuggccgaggagugggggugccccuucauggagacgagcgccaaguccaagaccauggucgacgagcuguucgccgagaucgugcgccagaugaacuacgcggcccagccggacaaggacgaccccugcugcagcgccugcaacauccaguga

SEQ ID NO: 35473 - RNA, 552 nt, Artificial Sequence
  derived and/or modified sequence opt1 from RAP2B__Homo_sapiens__NP_002877
augcgcgaguacaagguggucgugcugggcagcgggggcguggggaaguccgcccucaccguccaguucgugaccggcagcuucaucgagaaguacgaccccacgaucgaggacuucuaccggaaggagaucgagguggacuccagcccguccguccuggagauccuggacaccgccgggaccgagcaguucgcgagcaugcgcgaccucuacaucaagaacggccagggcuucauccugguguacucccuggugaaccagcagagcuuccaggacaucaagcccaugcgggaccagaucauccgcgucaagcgguacgagcgcgugcccaugauccucguggggaacaaggucgaccuggagggcgagcgggagguguccuacggggagggcaaggcccuggccgaggaguggagcugccccuucauggagaccuccgccaagaacaaggccagcguggacgagcuguucgcggagaucguccgccagaugaacuacgccgcccagccgaacggggacgagggcugcugcuccgccugcgugauccucuga

SEQ ID NO: 35474 - RNA, 3285 nt, Artificial Sequence
  derived and/or modified sequence opt1 from RAPGEF1__Homo_sapiens__NP_001291204
augagcggcgggcugggccuccgccggucccccgagaugagcgggaagaucgagaaggccgacucccagcgcagccaccuguccagcuucaccaugaagcugauggacaaguuccacuccccgaagaucaagcggacccccagcaagaagggcaagcccgccgagguguccgucaagauccccgagaagccggugaacaaggaggcgacggaccgcuuccuccccgagggguacccccugccccuggaccucgagcagcaggccguggaguucaugagcaccuccgccgucgccagccggucccagcgccagaagaaccugagcuggcuggaggagaaggagaaggaggugguguccgcccuccgguacuucaagaccaucgucgacaagauggcgaucgacaagaaggugcuggagaugcugccgggcagcgccuccaaggugcucgaggccauccugccccugguccagaacgacccccgcauccagcacagcuccgcccucagcagcugcuacucccggguguaccagagccuggcgaaccugauccgcugguccgaccaggugaugcucgagggcgucaacagcgaggacaaggagauggugaccacggugaagggggucaucaaggccgugcuggacggcgugaaggagcugguccggcucaccaucgagaagcaggggcgccccuccccgaccagccccgugaagcccuccagccccgccuccaagccggacggccccgccgagcugccccugaccgaccgggagguggagauccucaacaagacgaccgggaugagccaguccaccgagcugcugcccgacgccaccgacgaggaggucgcgccgcccaagccgccccuccccggcauccgcgugguggacaacagcccgccgcccgcccugccgcccaagaagcggcaguccgcccccagccccacgcgcgucgccguggucgcccccaugucccgggcgaccagcggcuccagccugcccguggggaucaaccgccaggacuucgacguggacugcuacgcccagcggcgccucuccggcgggagccacagcuacggcggcgagagcccccggcugucccccugcuccagcaucgggaagcuguccaagagcgacgagcagcucuccagccuggaccgcgacuccggccagugcagccgcaacaccuccugcgagacccuggaccacuacgaccccgacuacgaguuccuccagcaggaccugagcaacgccgaccagaucccccagcagacggccuggaaccugagcccccucccggagucccugggggaguccggcagccccuuccuggggccgcccuuccagcucccccugggcggccacccccagcccgacgggccccuggccccgggccagcagaccgacaccccgcccgcgcuccccgagaagaagcggcgcuccgccgccagccagaccgccgacgggagcggcugccgggucuccuacgagcgccaccccagccaguacgacaacaucuccggggaggaccugcagagcacggcccccauccccuccgugcccuacgcgccguucgccgccauccugcccuuccagcacggcggcagcuccgcccccguggaguucgucggggacuucaccgcgccggagagcaccggcgaccccgagaagcccccgccccuccccgagaagaagaacaagcacaugcuggccuacaugcagcugcuggaggacuacuccgagccccagcccagcauguucuaccagaccccgcagaacgagcacaucuaccagcagaagaacaagcuccugauggagguguacggguucuccgacagcuucuccggcguggacagcguccaggagcuggcgcccccgcccgcccucccgcccaagcagcggcagcuggagccgcccgccgggaaggacggccacccccgcgaccccuccgccgugagcggcgugcccgggaaggacucccgggacggcagcgagcgcgcccccaagucccccgacgcccuggagagcgcccagagcgaggaggaggucgacgagcucucccugaucgaccacaacgagaucaugagccggcugacgcucaagcaggagggggacgacggccccgacgugcgcggcggguccggcgacauccugcuggugcacgccaccgagaccgaccggaaggaccucguccuguacugcgaggcguuccugaccacguaccgcaccuucaucagccccgaggagcucaucaagaagcugcaguaccgguacgagaaguucucccccuucgccgacaccuucaagaagcgcgugagcaagaacaccuucuucgugcugguccgggugguggacgagcucugccuggucgagcugacggaggagauccucaagcugcugauggagcucguguuccgccuggugugcaacggggagcugucccucgcccggguccugcgcaagaacauccuggacaagguggaccagaagaagcuccugcggugcgccaccagcucccagccgcuggccgcgcgcggcguggccgcccgccccgggacccuccacgacuuccacagccacgagaucgccgagcagcugacccugcucgacgcggagcuguucuacaagaucgagauccccgagguccugcucugggccaaggagcagaacgaggagaagucccccaaccugacgcaguucaccgagcacuucaacaacaugagcuacugggugcgguccaucaucaugcugcaggagaaggcccaggaccgcgagcggcuccugcugaaguucaucaagaucaugaagcaccuccgcaagcugaacaacuucaacagcuaccuggccauccucuccgcccuggacagcgcgccgauccggcgccuggaguggcagaagcagaccuccgagggccucgccgaguacugcacccugaucgacagcuccagcagcuuccgggccuaccgcgccgcccuguccgagguggagccgcccugcauccccuaccucggccugauccugcaggaccucaccuucguccaccuggggaaccccgacuacaucgacggcaaggugaacuucagcaagcgguggcagcaguucaacauccuggacuccaugcgcugcuuccagcaggcgcacuacgacaugcggcgcaacgacgacaucaucaacuucuucaacgacuucagcgaccaccucgccgaggaggcccugugggagcugucccucaagaucaagccccggaacaucacgcgccggaagaccgaccgcgaggagaagaccuga

SEQ ID NO: 35475 - RNA, 4500 nt, Artificial Sequence
  derived and/or modified sequence opt1 from RAPGEF2__Homo_sapiens__NP_055062
augaagccccuggccaucccggccaaccacggcgugauggggcagcaggagaagcacagccuccccgcggacuucaccaagcugcaccugaccgacucccuccacccccaggucacgcacgugagcuccagccacuccggcugcagcaucaccuccgacagcggguccagcucccugagcgacaucuaccaggccaccgaguccgaggccggcgacauggaccugagcgggcuccccgagaccgccguggacuccgaggacgacgacgacgaggaggacaucgagcgcgccagcgacccgcugaugucccgggacaucguccgcgacugccuggagaaggaccccaucgaccggacggacgacgacaucgagcagcuccuggaguucaugcaccagcugcccgcguucgccaacaugaccaugagcgugcgccgggagcucugcgccgugauggucuucgccgugguggagcgcgcgggcaccaucguccugaacgacggcgaggagcuggacuccuggagcgugauccucaacgggagcguggaggucaccuaccccgacggcaaggccgagauccugugcauggggaacuccuucggcgugagcccgacgauggacaaggaguacaugaagggggugaugcggaccaaggucgacgacugccaguucgugugcaucgcccagcaggacuacugccgcauccugaaccagguggagaagaacaugcagaaggucgaggaggagggcgagaucgugauggugaaggagcaccgggagcucgaccgcaccggcacccggaaggggcacaucgucaucaagggcacguccgagcgccugaccaugcaccugguggaggagcacagcguggucgaccccaccuucaucgaggacuuccuccugaccuaccggacguuccuguccagccccauggagguggggaagaagcuccuggagugguucaacgaccccucccugcgcgacaaggucacccggguggugcuccugugggucaacaaccacuucaacgacuucgagggcgacccggccaugacccgcuuccuggaggaguucgagaacaaccucgagcgggagaagaugggcgggcaccuccgccugcucaacaucgccugcgcggccaaggccaagcggcgccugaugacccugacgaagcccagccgggaggcgccccuccccuucauccugcugggcggguccgagaagggcuucgggaucuucguggacagcguggacuccggcagcaaggccaccgaggccggccucaagcgcggggaccagauccuggaggucaacggccagaacuucgagaacauccagcuguccaaggccauggagauccuccgcaacaacacccaccugagcaucaccgugaagacgaaccuguucguguucaaggagcuccugacccggcuguccgaggagaagcgcaacggggccccgcaccuccccaagaucggcgacaucaagaaggccagccgguacuccauccccgaccuggccguggacguggagcaggucaucgggcuggagaaggugaacaagaaguccaaggcgaacaccgugggcggccgcaacaagcugaagaagauccuggacaagacccggaucagcauccugccccagaagccguacaacgacaucgggaucggccagagccaggacgacagcaucguggggcugcgccagacgaagcacauccccaccgcccuccccgucuccggcacccugagcuccagcaaccccgaccugcuccagucccaccaccggauccuggacuucagcgccaccccggaccugcccgaccaggugcuccgcguguucaaggccgaccagcagucccgguacaucaugaucagcaaggacacgaccgccaaggaggucgugauccaggcgauccgcgaguucgccgugaccgccacccccgaccaguacucccugugcgaggucagcgugacgcccgagggggugaucaagcagcggcgccugccggaccagcucuccaagcuggccgaccggauccagcugagcggccgcuacuaccucaagaacaacauggagaccgagacccugugcuccgacgaggacgcgcaggagcugcuccgggagagccagaucucccugcugcagcucagcaccgucgagguggccacccagcuguccaugcgcaacuucgagcuguuccggaacaucgagcccacggaguacaucgacgaccucuucaagcugcgcagcaagaccagcugcgccaaccugaagcgguucgaggaggugaucaaccaggagaccuucugggucgccuccgagauccuccgcgagaccaaccagcugaagcgcaugaagaucaucaagcacuucaucaagaucgcccugcacugccgggagugcaagaacuucaacagcauguucgcgaucaucuccggccucaaccuggcccccguggcccgccugcggacgaccugggagaagcucccgaacaaguacgagaagcuguuccaggaccugcaggaccucuucgaccccagccgcaacauggccaaguaccggaacgugcugaacucccagaaccugcagccgcccaucaucccccucuuccccgucaucaagaaggaccugaccuuccugcacgaggggaacgacagcaagguggacggccucgugaacuucgagaagcugcgcaugaucgccaaggagauccggcacgucgggcgcauggcguccgugaacauggaccccgcccugauguuccggacccgcaagaagaaguggcggagccucggcucccugagccagggcuccacgaacgccaccgugcuggacgucgcccagaccgggggccacaagaagcgcgugcggcgcagcuccuuccucaacgccaagaagcuguacgaggacgcgcagauggcccggaaggugaagcaguaccugagcaaccucgagcuggagauggacgaggagucccugcagacccucagccugcagugcgagcccgccacgaacacccugccgaagaaccccggggacaagaagcccgucaaguccgagaccagccccguggccccgcgcgcgggcucccagcagaaggcccagagccucccccagccccagcagcagcccccgcccgcccacaagaucaaccaggggcuccaggugcccgccgucagccuguaccccucccggaagaaggugccggugaaggaccugccgcccuucggcaucaacagcccccaggcccugaagaagauccugucccucagcgaggagggcucccuggagcgccacaagaagcaggcggaggacaccaucagcaacgccuccagccagcuguccagcccgcccacgagcccccaguccagcccccggaagggguacacccucgcccccuccggcaccgucgacaacuucuccgacagcgggcacuccgagaucagcucccgcagcagcaucguguccaacagcuccuucgacagcgugcccgucucccugcacgacgagcggcgccagcgccacagcguguccaucguggagaccaaccugggcauggggcggauggagcgccggacgaugaucgagcccgaccaguacagccucggcuccuacgccccgaugagcgagggccgcgggcuguacgccaccgcgaccgucaucuccagccccuccaccgaggagcugagccaggaccagggcgaccgggccucccucgacgccgccgacagcgggcgcggcuccuggacgagcugcuccagcgggagccacgacaacauccagaccauccagcaccagcgguccugggagacccugcccuucggccacacccacuucgacuacagcggcgaccccgccgggcugugggcguccagcucccacauggaccagaucauguucagcgaccacuccacgaaguacaaccgccagaaccagagccgggagucccucgagcaggcccagagccgcgccuccugggccagcuccaccggcuacuggggcgaggacagcgagggggacaccgggaccaucaagcggcgcggcggcaaggacguguccaucgaggcggagagcuccagccugacguccgucaccaccgaggagaccaagccggugcccaugcccgcccacaucgccguggccagcagcacgaccaaggggcugaucgcccggaaggagggccgcuaccgggagcccccgcccaccccgcccggguacaucggcauccccaucaccgacuuccccgagggccacucccaccccgcgcgcaagcccccggacuacaacgucgcccuccagcggagccgcaugguggcccgguccagcgacaccgccgggcccuccagcgugcagcagccccacggccaccccacguccagccgcccggucaacaagccccaguggcacaagcccaacgaguccgacccccgccuggccccguaccagagccagggguucuccaccgaggaggacgaggacgagcaggucagcgcgguguga

SEQ ID NO: 35476 - RNA, 2772 nt, Artificial Sequence
  derived and/or modified sequence opt1 from RAPGEF3__Homo_sapiens__NP_001092001
augaaggugggcuggcccggggagagcugcuggcaggucggccuggccguggaggacuccccggcccucggggcgccccgcgugggcgcccugcccgacgucgugcccgaggggacccugcucaacauggugcugcggcgcaugcaccggccgcgcagcugcuccuaccagcugcuccuggagcaccagcggcccagcugcauccagggccugcgcuggacgccccucaccaacuccgaggagagccuggacuucuccgagagccuggagcaggccuccaccgagcggguccuccgcgccggccggcagcugcaccgccaccuccuggcgaccugccccaaccugauccgggaccgcaaguaccaccuccggcuguaccgccagugcugcagcgggcgggagcugguggacggcauccuggcccucgggcugggcgugcacucccgcagccaggucguggggaucugccaggugcugcucgacgagggcgcccugugccacgucaagcacgacugggccuuccaggaccgggacgcccaguucuaccgcuucccgggccccgagcccgagcccguggggacccacgagauggaggaggagcuggcggaggccguggcccuccugucccagcggggcccggacgcccugcucacggucgcccugcgcaagccgcccgggcagcggaccgacgaggagcuggaccucaucuucgaggagcugcugcacaucaaggcgguggcccaccucagcaacuccgugaagcgcgagcuggccgccguccuccuguucgagccccacagcaaggccggcaccgugcuguucucccagggcgacaaggggaccagcugguacaucaucuggaagggcuccgugaacgucgugacgcacgggaagggccuggugaccacccuccacgagggggacgacuucggccagcuggcgcuggucaacgacgcgccccgcgccgccaccaucauccuccgggaggacaacugccacuuccugcgcguggacaagcaggacuucaaccggaucaucaaggacgucgaggccaagacgaugcgccuggaggagcacggcaagguggugcucguccuggagcgggccagccagggggccggccccagccgcccgcccacccccgggcggaaccgcuacaccgugauguccggcacccccgagaagauccuggagcugcuccuggaggccauggggcccgacagcuccgcccacgaccccacggagaccuuccugagcgacuuccuccugacccaccggguguucaugccguccgcccagcugugcgcggcccuccugcaccacuuccacgucgagcccgccggcggcagcgagcaggagcgcuccaccuacgugugcaacaagcggcagcagauccugcgccucgugagccagugggucgcccuguacggguccaugcugcacacggaccccguggcgaccagcuuccuccagaagcuguccgaccuggugggccgggacacccgccucagcaaccugcugcgggagcaguggcccgagcgccggcgcugccaccggcucgagaacgggugcggcaacgccuccccgcagaugaaggcccgcaaccugcccgucuggcugcccaaccaggacgagccgcuccccgggagcuccugcgccauccaggugggcgacaaggugcccuacgacaucugccgccccgaccacagcguccugacccugcagcucccggugacggccuccgugcgggaggucauggcggcccuggcccaggaggacggcuggaccaagggccaggugcuggugaaggucaacagcgccggggacgccaucgggcuccagcccgacgcgcgcggcguggccaccucccugggccugaacgagcgccucuucguggucaacccccaggaggugcacgagcugaucccccacccggaccagcuggggcccaccgugggcagcgccgaggggcucgaccuggucagcgccaaggaccuggccggccagcucacggaccacgacuggucccuguucaacagcauccaccagguggagcugauccacuacgugcucgggccccagcaccuccgggacgucaccaccgcgaaccuggagcgguucaugcgccgguucaacgagcugcaguacuggguggccaccgagcugugccugugccccgugccgggcccccgcgcccagcuccugcggaaguucaucaagcuggccgcgcaccucaaggagcagaagaaccugaacuccuucuucgccgucauguucggccugagcaacuccgccaucagccgccucgcccacacgugggagcggcugccccacaaggugcgcaagcuguacuccgcccucgagcggcugcuggaccccagcuggaaccaccgcguguaccggcucgcgcuggccaagcuguccccgcccgucauccccuucaugccccuccugcugaaggacaugaccuucauccacgaggggaaccacacccucguggagaaccugaucaacuucgagaagaugcgcaugauggcccgggccgcccgcaugcugcaccacugccggagccacaacccggugccccucagcccccugcgcucccgggucucccaccuccacgaggacagccagguggcgcgcaucuccacgugcagcgagcagucccugagcacccgcagccccgccuccaccugggccuacgugcagcagcugaaggucaucgacaaccagcgggagcugagccgccucucccgggagcuggagccguga

SEQ ID NO: 35477 - RNA, 2604 nt, Artificial Sequence
  derived and/or modified sequence opt1 from RAPGEF4__Homo_sapiens__NP_001093867
augcuguacaagaaguaccgccaguacauggccggccuccuggcgcccccguacggggugauggagaccggcagcaacaacgaccggauccccgacaaggagaacacgccccugaucgagccccacgucccgcuccgccccgccaacaccaucaccaaggugcccuccgagaagauccugcgggccgggaagauccugcgcaacgccauccucagccgggccccgcacaugauccgcgaccggaaguaccaccugaagaccuaccgccagugcugcgugggcaccgagcuggucgacuggaugaugcagcagacgcccugcgugcacucccggacccaggccguggggauguggcagguccuccuggaggacggcgugcugaaccacguggaccaggagcaccacuuccaggacaaguaccucuucuaccgcuuccuggacgacgagcacgaggacgcgccccugcccaccgaggaggagaagaaggagugcgacgaggagcuccaggacaccaugcugcugcucagccagaugggccccgacgcccacaugcggaugauccugcgcaagccgcccgggcagcggacggucgacgaccuggagaucaucuacgaggagcuccugcacaucaaggcccugucccaccucagcaccaccgugaagcgcgagcuggccggcgugcugaucuucgagucccacgcgaagggcgggaccguccucuucaaccagggggaggagggcacgagcugguacaucauccugaagggcuccgugaacguggucaucuacgggaagggcguggugugcacccugcacgagggggacgacuucggcaagcucgcccuggucaacgacgcgccccgggccgccagcaucgugcugcgcgaggacaacugccacuuccuccggguggacaaggaggacuucaaccgcauccugcgggacgucgaggccaacaccgugcgccugaaggagcacgaccaggacgugcucguccuggagaaggugcccgccggcaaccgggccuccaaccaggggaacagccagccgcagcagaaguacaccgucauguccggcacgcccgagaagauccuggagcacuuccucgagaccauccgccuggaggccacccugaacgaggccaccgacagcgugcucaacgacuucaucaugaugcacugcguguucaugcccaacacgcagcugugccccgcgcuggucgcccacuaccacgcccagccgucccaggggaccgagcaggagaagauggacuacgcccucaacaacaagcgccgggugauccgccuggugcugcagugggccgcgauguacggcgaccuccugcaggaggacgacgucagcauggccuuccuggaggaguucuacguguccgugagcgacgacgcccggaugaucgccgcccugaaggagcagcuccccgagcuggagaagaucgucaagcagaucuccgaggacgcgaaggcgccccagaagaagcacaaggugcugcuccagcaguucaacaccggggacgagcgcgcccagaagcggcagcccauccgcggcagcgacgaggugcuguucaaggucuacugcauggaccacaccuacacgaccauccgggugccgguggccaccagcgucaaggaggugaucuccgccguggccgacaagcugggcagcggggagggccucaucaucgucaagauguccagcgggggcgagaagguggugcugaagcccaacgacgucuccguguucaccacgcugaccaucaacgggcgccucuucgccugcccccgggagcaguucgacagccugacgccccugccggagcaggagggccccaccgugggcaccgucgggaccuucgagcucauguccagcaaggaccuggccuaccagaugaccaucuacgacugggagcuguucaacugcgugcacgagcucgagcugaucuaccacaccuucggccgccacaacuucaagaagacgaccgccaaccuggaccucuuccugcggcgcuucaacgagauccaguucuggguggucaccgagaucugccugugcucccagcucagcaagcgggugcagcugcugaagaaguucaucaagaucgcggcccacugcaaggaguacaagaaccucaacuccuucuucgccaucgugauggggcugagcaacgucgccgugucccgccuggcccucaccugggagaagcugcccagcaaguucaagaaguucuacgcggaguucgagucccugauggacccgagccggaaccaccgcgccuaccggcucaccguggccaagcuggagccgccccugauccccuucaugccccuccugaucaaggacaugacguucacccacgagggcaacaagaccuucaucgacaaccuggucaacuucgagaagaugcgcaugaucgccaacaccgcccggacggugcgcuacuaccgcucccagcccuucaaccccgacgcggcccaggccaacaagaaccaccaggacgugcggagcuacguccgccagcucaacgugaucgacaaccagcggacccugucccagaugagccaccgccuggagccccggcgcccguga

SEQ ID NO: 35478 - RNA, 2193 nt, Artificial Sequence
  derived and/or modified sequence opt1 from RAPGEF5__Homo_sapiens__NP_036426
auggccaucggcguguggcagcugcuccuggacauggggaucaugcugagcgucgaccagcaccucuacuuccaggacaccuacguguucuaccaguucuccagcgacgagugcuccuaccuguacugcgaguucgagcgcgaggaggaguggcagaacggcgugaagcugcuccugcagcuggucccccucaucccggcccgcgggggcaucugcgagcugagccaccagaagaucgaggacuccgaggagagcuccgacgagauccuggugcggcucaccagcgcggugcagcgggagcuggccgccgucaucgcccugaaggcccgcaaguccgcgaucgagcaggacgaggagaacaacgacaagcacguggccgugacggaggccgagagcguccccgacucccaggccggggugaugugcaagcuccaggagcgggacgagaucggccgcaucgagcuggugcagaagcuggcgaaggagaacuaccaguuccuccagaccgacaagaaggagcaggagaaguccgagcaccaggacgacgaggucaccaccguccaggugaaggagcaggaccagagcgugcuggugcugaagaaggugcagugcugcggccccgcccccacggccgggagcgccgagucccacuggcgguacgucguggugagcggcaccccggagaagauccucgagcaccuccugaacgaccugcaccuggaggagguccaggacaaggagaccgagacccugcucgacgacuuccugcugacguacaccguguucaugaccaccgacgaccucugccaggcccugcugcgccacuacuccgcgaagaaguaccaggggaaggaggagaacagcgacgugccccggcgcaagcggaagguccuccaccuggugucccaguggaucgcccuguacaaggacuggcuccccgaggacgagcacagcaagauguuccugaagacgaucuaccgcaacguccuggacgacguguacgaguaccccauccucgagaaggagcugaaggaguuccagaagauccugggcaugcaccggcgccacaccguggacgaguacagcccgcagaagaagaacaaggcccucuuccaccaguucucccugaaggagaacuggcugcagcaccgggggaccgucaccgagacggaggagaucuucugccacguguacaucaccgagcacagcuacguguccgucaaggccaaggugagcuccaucgcccaggagauccucaagguggucgcggagaagauccaguacgccgaggaggaccuggcccugguggccaucaccuucagcggcgagaagcacgagcuccagcccaacgaccuggugaucuccaagagccuggaggccuccggccgcaucuacgucuaccggaaggaccuggcggacacccucaaccccuucgccgagaacgaggagagccagcagcgcuccaugcggauccuggggaugaacacgugggaccuggcccucgagcugaugaacuucgacuggagccuguucaacuccauccacgagcaggagcucaucuacuucaccuucagccgccagggcuccggggagcacaccgccaaccugagccugcuccugcagcggugcaacgaggugcagcuguggguggccaccgagauccuccugugcucccagcugggcaagcgcguccagcucgugaagaaguucaucaagaucgcggcccacugcaaggcccagcgcaaccugaacagcuucuucgccaucgugaugggccugaacacggcguccgucagccggcucagccagaccugggagaagauccccgggaaguucaagaagcuguucuccgagcuggagagccucaccgacccgucccugaaccacaaggccuaccgcgacgccuucaagaagaugaagccgcccaagauccccuucaugccccugcuccugaaggacgugaccuucauccacgagggcaacaagacguuccuggacaaccucgugaacuucgagaagcugcacaugaucgccgacaccguccggacccugcgccacugccggaccaaccaguucggggaccucagccccaaggagcaccaggagcugaaguccuacgugaaccaccuguacgugaucgacagccagcaggcccucuucgagcugucccaccgcaucgagccccgggucuga

SEQ ID NO: 35479 - RNA, 1935 nt, Artificial Sequence
  derived and/or modified sequence opt1 from RAPH1__Homo_sapiens__NP_976241
auggagcagcugagcgacgaggagaucgaccacggcgccgaggaggacuccgacaaggaggaccaggaccucgacaagauguucggggccuggcugggcgagcuggacaagcucacccagagccuggacuccgacaagcccauggagccggugaagcgcagcccccugcggcaggagaccaacauggcgaacuucuccuaccgcuucagcaucuacaaccucaacgaggcccugaaccagggggagacggucgaccuggacgcccucauggccgaccugugcuccaucgagcaggagcugagcuccaucggcagcgggaacuccaagcggcagaucaccgagaccaaggccacccagaagcuccccgugagccgccacacgcugaagcacggcacccugaagggccucuccagcuccagcaaccggaucgcgaagcccucccacgccagcuacucccuggacgacgugaccgcccagcuggagcaggccagccucagcauggacgaggcggcccagcaguccguccuggaggacaccaagccgcuggugacgaaccagcaccgccggaccgccagcgccgggaccguguccgacgccgagguccacagcaucuccaacagcucccacagcuccaucaccagcgcggccuccagcauggacucccucgacaucgacaaggugacgcgcccccaggagcuggaccugacccaccagggccagcccaucaccgagcacgccaucagccuccggugcuccagcaagcaggccaagcgccacaucgacuucaccgaggagcaggccgagcugacgccccacuccuaccuggaccgggagaccagccuccugcugcgcaacaucgcggggaagccgucccaccuccugaccaaggaggagcaggccgccaagcugaaggccgagaagauccggguggcccucgagaagaucaaggaggcgcaggucaagaagcuggugauccgcgugcacaugagcgacgacagcuccaagaccaugauggucgacgagcggcagacggugcgccaggugcuggacaaccucauggacaagagccacugcggcuacucccuggacuggagccuggucgagaccguguccgagcuccagauggagcggaucuucgaggaccacgagaaccugguggagaaccugcucaacuggacccgcgacagccagaacaagcugaucuucauggagcggaucgagaaguacgcccuguucaagaacccccagaacuaccuccuggggaagaaggagaccgccgagauggccgaccgcaacaaggagguccugcucgaggagugcuucugcggcuccagcgugacggugcccgagaucgagggcguccuguggcugaaggacgacgggaagaaguccuggaagaagcgguacuuccugcuccgcgccagcggcaucuacuacgugcccaaggggaaggcgaaggugucccgcgaccuggucugcuuccugcagcucgaccacgugaacgucuacuacggccaggacuaccggaacaaguacaaggccccgaccgacuacugccuggugcugaagcacccccagauccagaagaagucccaguacaucaaguaccucugcugcgacgacgugcgcacccugcaccagugggucaacggcauccggaucgccaaguacgggaagcagcuguacaugaacuaccaggaggcccucaagcgcaccgagagcgcguacgacuggacgagccuguccagcuccagcaucaagagcggcuccagcuccagcuccauccccgagagccaguccaaccacagcaaccaguccgacagcgggguguccgacacccagcccgccggccacgugcggagccaguccaucgucagcuccguguucagcgaggccuggaagcgcgggacccagcuggaggaguccagcaaguga

SEQ ID NO: 35480 - RNA, 1239 nt, Artificial Sequence
  derived and/or modified sequence opt1 from RAPSN__Homo_sapiens__NP_005046
augggccaggaccagaccaagcagcagaucgagaaggggcugcagcucuaccagagcaaccagaccgagaaggcccuccagguguggacgaagguccuggagaaguccagcgaccugaugggccgcuuccgggugcuggggugccuggugaccgcccacuccgagaugggccgcuacaaggagaugcucaaguucgcggucgugcagaucgacaccgcccgggagcuggaggacgccgacuuccugcucgagagcuaccugaaccuggcccgcuccaacgagaagcucugcgaguuccacaagaccaucagcuacugcaagacgugccuggggcugcccggcacccgggccggcgcgcagcucgggggccaggugucccugagcauggggaacgccuuccugggccucuccgucuuccagaaggcccuggagagcuucgagaaggcccugcgcuacgcgcacaacaacgacgacgccaugcucgagugccgggugugcugcucccuggggagcuucuacgcccaggugaaggacuacgagaaggcccuguucuucccgugcaaggccgcggagcucgucaacaacuacggcaagggcuggucccugaaguaccgcgccaugagccaguaccacauggccguggccuaccggcugcucgggcgccugggcuccgccauggagugcugcgaggagagcaugaagaucgcgcugcagcacggggaccggccccuccaggcccugugccugcucugcuucgccgacauccaccgcucccggggcgaccuggagaccgccuucccccgcuacgacagcgccauguccaucaugaccgagaucggcaaccggcugggccaggugcaggcgcuccugggggucgccaagugcuggguggcccgcaaggcccuggacaaggcccucgacgcgaucgagcgggcccaggaccuggccgaggagguggggaacaagcugagccagcucaagcugcacugccugagcgaguccaucuaccgcagcaagggccuccagcgggagcugcgcgcccacgucgugcgguuccacgagugcguggaggagacggagcuguacugcgggcucugcggcgaguccaucggcgagaagaacagccgccugcaggcgcugcccugcucccacaucuuccaccuccgcugccugcagaacaacgggacccggagcugcccgaacugccgccgguccagcaugaagcccggcuucgucuga

SEQ ID NO: 35481 - RNA, 1374 nt, Artificial Sequence
  derived and/or modified sequence opt1 from RARA__Homo_sapiens__NP_001019980
auguacgagagcguggaggucggcgggcccaccccgaaccccuuccuggugguggacuucuacaaccagaaccgcgccugccuccugcccgagaagggccugcccgccccggggcccuacuccaccccgcuccggacgccccuguggaacggcagcaaccacuccaucgagacccagagcuccagcuccgaggagaucguccccagcccgcccagcccgccgccccugccccgcaucuacaagcccugcuucgugugccaggacaaguccuccggguaccacuacggcgugagcgcgugcgagggcugcaagggguucuuccggcgcuccauccagaagaacauggucuacacgugccaccgggacaagaacugcaucaucaacaaggugacccgcaaccggugccaguacugccgccuccagaagugcuucgaggugggcaugagcaaggaguccguccggaacgaccgcaacaagaagaagaaggaggugcccaagcccgagugcagcgaguccuacacccugacccccgaggugggggagcugaucgagaagguccggaaggcccaccaggagaccuuccccgcccucugccagcugggcaaguacaccacgaacaacagcuccgagcagcgcgugagccuggacaucgaccucugggacaaguucagcgagcuguccaccaagugcaucaucaagaccguggaguucgccaagcagcugcccggguucaccacgcucaccaucgccgaccagaucacccugcugaaggcggccugccucgacauccugauccugcggaucugcacccgcuacacgcccgagcaggacaccaugaccuucagcgacggccucacccugaaccggacgcagaugcacaacgccggcuucgggccccugaccgaccucgucuucgccuucgcgaaccagcugcugccccucgagauggacgacgccgagaccggccugcuguccgccaucugccucaucugcggggaccgccaggaccuggagcagccggaccggguggacaugcugcaggagccccuccuggaggcccugaagguguacguccgcaagcggcgccccagccggccccacauguucccgaagaugcucaugaagaucaccgaccugcgcuccaucagcgccaagggcgcggagcgcgugaucacgcugaagauggagauccccggcuccaugcccccgcucauccaggagaugcuggagaacagcgaggggcuggacacccucuccggccagcccgggggcgggggccgggacggcgggggccuggccccgccgcccgggagcugcucccccagccugucccccagcuccaaccgcagcucccccgccacccacagccccuga

SEQ ID NO: 35482 - RNA, 1347 nt, Artificial Sequence
  derived and/or modified sequence opt1 from RARB__Homo_sapiens__NP_000956
auguucgacugcauggacgugcugagcgucucccccggccagauccucgacuucuacaccgccagcccguccagcugcaugcugcaggagaaggcccugaaggcgugcuucuccgggcucacccagacggaguggcagcaccgccacaccgcccagagcaucgagacccaguccaccagcuccgaggagcuggugcccuccccgcccagcccccugcccccgccccggguguacaagcccugcuucgucugccaggacaagagcuccggcuaccacuacggggugagcgccugcgagggcugcaagggguucuuccgccgguccauccagaagaacaugaucuacacgugccaccgcgacaagaacugcgugaucaacaaggucacccggaaccgcugccaguacugccggcuccagaagugcuucgaggugggcaugagcaaggaguccgugcgcaacgaccggaacaagaagaagaaggagaccagcaagcaggagugcaccgaguccuacgagaugacggccgagcuggacgaccugaccgagaagauccgcaaggcccaccaggagaccuuccccagccucugccagcugggcaaguacaccacgaacagcuccgcggaccaccggguccgccuggaccucgggcugugggacaaguucagcgagcuggccaccaagugcaucaucaagaucguggaguucgccaagcggcuccccggcuucaccgggcugaccaucgccgaccagaucacgcugcucaaggcggccugccuggacauccugauccuccgcaucugcacccgguacacccccgagcaggacaccaugacguucuccgacggccugacccugaaccgcacccagaugcacaacgccggguucggcccgcucaccgaccugguguucacguucgccaaccagcugcucccccuggagauggacgacaccgagaccggccugcucagcgccaucugccugaucugcggggaccggcaggaccuggaggagcccaccaaggucgacaagcuccaggagccccugcuggaggcgcucaagaucuacauccgcaagcggcgcccguccaagccccacauguuccccaagauccugaugaagaucacggaccugcggagcaucuccgccaagggcgccgagcgcgugaucacccucaagauggagauccccgggagcaugccgccccugauccaggagaugcuggagaacuccgagggccacgagccccucacccccagcuccagcggcaacaccgccgagcacuccccgagcaucucccccagcuccguggagaacagcggggucucccagagcccccuggugcaguga

SEQ ID NO: 35483 - RNA, 1332 nt, Artificial Sequence
  derived and/or modified sequence opt1 from RARG__Homo_sapiens__NP_001036193
auguacgacugcauggagaccuucgcccccggcccgcgccggcuguacggggccgcgggccccggggccggccuccugcgccgggccaccgggggcagcugcuucgccggccuggaguccuucgccuggccccagcccgcgagccuccaguccguggagacgcagagcaccuccagcgaggagauggucccguccagccccuccccgccgcccccgccccgcguguacaagcccugcuucgugugcaacgacaagagcuccggguaccacuacggcgucagcuccugcgaggggugcaagggcuucuuccggcgcagcauccagaagaacaugguguacacgugccaccgggacaagaacugcaucaucaacaaggugacccgcaaccggugccaguacugccgccugcagaagugcuucgaggucgggauguccaaggaggccgugcggaacgaccgcaacaagaagaagaaggaggugaaggaggagggcagccccgacuccuacgagcugagcccccagcucgaggagcugaucaccaaggucuccaaggcccaccaggagaccuuccccagccugugccagcucggcaaguacaccaccaacagcuccgccgaccaccgggugcagcuggaccuggggcucugggacaaguucagcgagcuggcgacgaagugcaucaucaagaucguggaguucgccaagcgccugcccggcuucaccgggcucuccaucgccgaccagaucacccugcugaaggccgccugccucgacauccugaugcugcggaucugcacccgcuacacgcccgagcaggacaccaugaccuucagcgacggccucacccugaaccggacgcagaugcacaacgcgggcuucgggccccugaccgaccucgucuucgccuucgccggccagcugcugccccucgagauggacgacaccgagaccgggcugcuguccgccaucugccucaucugcggcgaccgcauggaccuggaggagcccgagaagguggacaagcugcaggagccgcuccuggaggcccugcggcucuacgcgcgccggcgccgccccagccagcccuacauguucccccggaugcugaugaagaucacggaccugcgcgggaucuccaccaagggcgccgagcgggccaucacccucaagauggagaucccgggccccaugccgccccugauccgcgagaugcuggagaaccccgagauguucgaggacgacagcucccagcccgggccccacccgaacgccagcuccgaggacgaggugcccggcgggcagggcaagggcgggcucaagagccccgccuga

SEQ ID NO: 35484 - RNA, 687 nt, Artificial Sequence
  derived and/or modified sequence opt1 from RARRES1__Homo_sapiens__NP_002879
augcagccccgccggcagcgccugccggcccccuggagcggcccccgggggccccgcccgaccgcgccccuccuggcccugcuccugcugcucgcccccguggccgcccccgccggcuccggggacccggacgaccccggccagccccaggacgcgggggucccccggcgccugcugcagcaggccgcccgggccgcgcuccacuucuucaacuuccgcagcggcuccccgagcgcccugcgggugcuggccgaggugcaggagggccgcgccuggaucaaccccaaggaggggugcaagguccacgugguguucuccaccgagcgguacaaccccgagagccuccugcaggagggcgaggggcgccugggcaagugcuccgcccgggucuucuucaagaaccagaagccccgcccgacgaucaacgugaccugcacccggcucaucgagaagaagaagcgccagcaggaggacuaccugcuguacaagcagaugaagcagcucaagaacccccuggagaucgugagcauccccgacaaccacgggcacaucgaccccucccugcggcucaucugggaccuggcguuccugggcagcuccuacgucaugugggagaugaccacccaggugagccacuacuaccucgcccagcugacguccgugcgccaguggguccggaagaccuga

SEQ ID NO: 35485 - RNA, 492 nt, Artificial Sequence
  derived and/or modified sequence opt1 from RARRES2__Homo_sapiens__NP_002880
augcgccggcugcucaucccccuggcccuguggcucggcgccgugggggucggcguggcggagcugaccgaggcccagcgccgggggcuccagguggcccuggaggaguuccacaagcacccgcccguccagugggccuuccaggagaccagcguggaguccgccguggacacgcccuuccccgcgggcaucuucguccgccuggaguucaagcugcagcagaccagcugccggaagcgcgacuggaagaagccggagugcaaggugcggcccaacgggcgcaagcggaagugccucgccugcaucaagcugggcuccgaggacaaggugcugggccgccucguccacugccccaucgagacccaggugcugcgggaggccgaggagcaccaggagacccagugccugcgcgugcagcgggccggggaggacccccacagcuucuacuucccgggccaguucgcguucuccaaggcccucccccgcagcuga

SEQ ID NO: 35486 - RNA, 495 nt, Artificial Sequence
  derived and/or modified sequence opt1 from RARRES3__Homo_sapiens__NP_004576
auggccagcccccaccaggagccgaagcccggcgaccugaucgagaucuuccgccucggguacgagcacugggcccuguacaucggcgacggguacgugauccaccuggcgccgcccuccgaguaccccggcgccgggagcuccagcgucuucuccgugcucagcaacuccgccgaggugaagcgggagcgccuggaggacgucgugggcggcugcugcuaccgggugaacaacagccuggaccacgaguaccagccccgccccgucgaggugaucaucuccagcgccaaggagaugguggggcagaagaugaaguacuccaucgucagccggaacugcgagcacuucgugacccagcuccgcuacggcaagucccggugcaagcaggucgagaaggccaagguggagguggggguggcgaccgcccugggcauccuggucguggccgggugcagcuucgccauccgccgguaccagaagaaggcgacggccuga

SEQ ID NO: 35487 - RNA, 1737 nt, Artificial Sequence
  derived and/or modified sequence opt1 from RARS2__Homo_sapiens__NP_064716
auggccugcggcuuccgccgggccaucgcgugccagcugagccgcgugcucaaccugcccccggagaaccugaucaccuccaucagcgccguccccaucucccagaaggaggagguggccgacuuccagcucagcguggacucccugcuggagaaggacaacgaccacagccggcccgacauccagguccaggccaagcgccucgccgagaagcugcggugcgacaccgugguguccgagaucagcacggggcagcgcaccgucaacuucaagaucaaccgggagcugcucaccaagaccgugcugcagcaggucaucgaggacggcuccaaguacgggcucaagagcgagcuguucuccggccugccccagaagaagaucgugguggaguucagcuccccgaacguggcgaagaaguuccacgucgggcaccuccgcagcacgaucaucggcaacuucaucgccaaccugaaggaggcccugggccaccaggugauccggaucaacuaccugggggacuggggcaugcaguucgggcuccugggcaccggguuccagcuguucggcuacgaggagaagcuccaguccaacccccugcagcaccuguucgagguguacguccaggugaacaaggaggccgcggacgacaagagcguggccaaggccgcccaggaguucuuccagcgccucgagcugggcgacguccaggcccugucccucuggcagaaguuccgggaccugagcaucgaggaguacauccgcguguacaagcggcuggggguguacuucgacgaguacuccggcgagagcuucuaccgcgagaagucccaggagguccucaagcugcuggagagcaaggggcuccugcugaagaccaucaagggcaccgcggugguggaccucagcggcaacggggaccccuccagcaucugcacggucaugcgguccgacggcaccagccuguacgccacccgcgaccuggccgccgccaucgaccggauggacaaguacaacuucgacaccaugaucuacgugacggacaaggggcagaagaagcacuuccagcaggucuuccagaugcucaagaucaugggcuacgacugggcggagcgcugccagcacgugcccuucggggugguccagggcaugaagacccggcgcggcgacgugaccuuccuggaggacgugcugaacgagauccagcuccggaugcugcagaacauggccuccaucaagaccacgaaggagcugaagaacccgcaggagaccgccgagcgcgucgggcucgccgcccugaucauccaggacuucaagggccugcuccugagcgacuacaaguucuccugggaccgcguguuccagagccgcggggacaccggcguguuccugcaguacacccacgcgcggcugcacucccucgaggagacguucgggugcggcuaccugaacgacuucaacaccgccugccugcaggagccccagagcgucuccauccuccagcaccuccugcgguucgacgaggugcuguacaagagcucccaggacuuccagccccgccacaucgugagcuaccugcugacccucucccaccuggccgccgucgcccacaagacccugcagaucaaggacagcccgcccgagguggcgggcgcccggcuccaccuguucaaggccgugcgcuccguccuggccaacgggaugaagcuccugggcaucacgcccgugugccggauguga

SEQ ID NO: 35488 - RNA, 1983 nt, Artificial Sequence
  derived and/or modified sequence opt1 from RARS__Homo_sapiens__NP_002878
auggacgugcuggucagcgagugcuccgcccgccuccugcagcaggaggaggagaucaagagccugaccgccgagaucgaccggcucaagaacugcggcugccugggggcgucccccaaccuggagcagcuccaggaggagaaccugaagcugaaguaccgccucaacauccugcgcaagagccugcaggccgagcggaacaagccgaccaagaacaugaucaacaucaucucccggcuccaggagguguucggccacgccaucaaggccgccuaccccgaccuggagaacccgccccugcucgugacgcccagccagcaggcgaaguucggggacuaccagugcaacuccgccaugggcaucagccagaugcugaagaccaaggagcagaaggucaacccccgcgagaucgccgagaacaucaccaagcaccuccccgacaacgagugcaucgagaagguggagaucgccgggcccggcuucaucaacgugcaccuccggaaggacuucgucuccgagcagcugaccagccugcuggugaacggcgugcagcugccggcgcugggggagaacaagaaggucaucguggacuucuccagccccaacaucgccaaggagaugcacgugggccaccuccgcuccacgaucaucggggagagcaucucccggcuguucgaguucgccggcuacgacguccugcgccucaaccacgugggggacuggggcacccaguucggcaugcugaucgcccaccuccaggacaaguuccccgacuaccugaccgugagcccgcccaucggggaccugcaggucuucuacaaggaguccaagaagcgguucgacaccgaggaggaguucaagaagcgcgccuaccagugcguggugcugcuccagggcaagaaccccgacaucacgaaggcguggaagcugaucugcgacgucagccggcaggagcugaacaagaucuacgacgcccucgacgugucccugaucgagcgcggggagagcuucuaccaggaccggaugaacgacaucgugaaggaguucgaggaccgcggcuucguccagguggacgacggccggaagaucguguucguccccgggugcagcaucccccugaccaucgugaaguccgacggcggguacaccuacgacaccagcgaccucgccgccaucaagcagcgccuguucgaggagaaggccgacaugaucaucuacgucguggacaacggccaguccgugcacuuccagacgaucuucgcggccgcccagaugaucgggugguacgacccgaaggucacccggguguuccacgccggcuucggcgugguccugggggaggacaagaagaaguucaagacccgcagcggcgagaccgugcggcucauggaccugcugggggagggccucaagcgcuccauggacaagcugaaggagaaggagcgcgacaaggugcugacggccgaggagcucaacgcggcccagaccagcgucgccuacgggugcaucaaguacgccgaccugucccacaaccggcugaacgacuacaucuucagcuucgacaagaugcuggacgaccgcggcaacaccgccgcguaccuccuguacgccuucacccggauccgcuccaucgcccggcuggccaacaucgacgaggagaugcuccagaaggcggcccgcgagacgaagauccugcuggaccacgagaaggaguggaagcucggccggugcauccugcgcuuccccgagauccugcagaagauccucgacgaccuguuccugcacacccucugcgacuacaucuacgagcuggccaccgccuucaccgaguucuacgacagcugcuacugcguggagaaggaccggcagacggggaagauccugaaggugaacauguggcgcaugcuccugugcgaggccgucgcggccgugauggccaagggcuucgacauccuggggaucaagcccgugcagcggauguga

SEQ ID NO: 35489 - RNA, 3144 nt, Artificial Sequence
  derived and/or modified sequence opt1 from RASA1__Homo_sapiens__NP_002881
augauggccgccgaggcgggcagcgaggagggcgggcccgugaccgccggggccggcgggggcggcgccgccgcgggguccagcgccuacccggccgucugccgcgugaagauccccgccgcgcugcccguggccgccgcccccuacccgggccucgucgagaccgggguggccggcacgcucgggggcggcgcggcccugggguccgaguuccugggcgccgggagcguggccggcgcccugggcggggcgggccugaccgggggcgggaccgccgccggcgucgccggcgccgcggccgggguggccggcgccgccguggcggggcccuccggcgacauggcccucaccaagcugcccacgagccugcucgccgagacccuggggcccggcggcggguucccgccccugccgccgccgcccuaccucccgccccugggcgccgggcugggcaccgucgacgagggggacucccucgacggccccgaguacgaggaggaggagguggcgaucccccugaccgccccgcccacgaaccagugguaccacggcaagcuggaccggaccaucgccgaggagcgccuccggcaggccggcaagagcggcuccuaccugauccgcgagagcgaccggcgccccggguccuucgugcugagcuuccucucccagaugaacgucgugaaccacuuccggaucaucgccaugugcggcgacuacuacaucggcgggcgccgguucagcucccugagcgaccugaucggcuacuacucccacgugagcugccuccugaagggggagaagcugcucuaccccgucgcgccgcccgagcccguggaggaccgccggcgcgugcgggccauccugcccuacaccaagguccccgacaccgacgagaucuccuuccugaagggcgacauguucaucgugcacaacgagcucgaggacggguggaugugggugacgaaccugcgcaccgacgagcagggccugaucgucgaggaccucguggaggaggugggccgggaggaggacccccacgaggggaagaucugguuccacgggaagaucagcaagcaggaggccuacaaccugcugaugaccgucggccaggugugcagcuuccucguccgccccuccgacaacacccccggggacuacagccuguacuuccggacgaacgagaacauccagcgcuucaagaucugccccacccccaacaaccaguucaugaugggcgggcgguacuacaacuccaucggcgacaucaucgaccacuaccgcaaggagcagaucguggagggguacuaccugaaggagcccgugcccaugcaggaccaggagcagguccucaacgacaccguggacggcaaggagaucuacaacaccauccggcgcaagacgaaggacgccuucuacaagaacaucgugaagaagggguaccugcugaagaagggcaaggggaagcgcuggaagaaccucuacuucauccuggagggcagcgacgcccagcugaucuacuucgaguccgagaagcgggcgaccaagcccaagggccucaucgaccugagcgucugcuccguguacgugguccacgacagccuguucgggcgcccgaacugcuuccagaucguggugcagcacuucuccgaggagcacuacaucuucuacuucgccggcgagacccccgagcaggccgaggacuggaugaaggggcuccaggccuucugcaaccugcgcaagagcucccccggcaccagcaacaagcggcugcggcaggucuccagccuggugcuccacaucgaggaggcccacaagcugcccgugaagcacuucacgaacccguacugcaacaucuaccugaacuccguccagguggcgaagacccacgcccgcgaggggcagaaccccguguggagcgaggaguucgucuucgacgaccucccgcccgacaucaaccgguucgagaucacccuguccaacaagaccaagaaguccaaggaccccgacauccuguucaugcgcugccagcucagccggcugcagaagggccacgccacggacgagugguuccugcucagcagccacaucccccugaagggcaucgagcccgggucccugcgcgugcgggcccgcuacagcauggagaagaucaugcccgaggaggaguacuccgaguucaaggagcucauccugcagaaggagcugcacguggucuacgcgcucagccacgugugcggccaggaccggacccugcuggccuccauccuccugcgcaucuuccugcacgagaagcucgagagccugcugcucugcacccugaacgaccgggagaucuccauggaggacgaggccaccacgcuguuccgcgccaccacccucgccagcacccugauggagcaguacaugaaggcgacggccacccaguucgugcaccacgcccugaaggacuccauccucaagaucauggagagcaagcaguccugcgagcugagcccguccaagcuggagaagaacgaggacgucaacaccaaccucacccaccuccugaacauccugagcgagcugguggagaagaucuucauggccuccgagauccugccgcccacccuccgguacaucuacgggugccugcagaaguccgugcagcacaaguggcccacgaacaccaccaugcgcacccgggucgugagcggcuucguguuccugcgccucaucugccccgccauccugaacccccgcauguucaacaucaucagcgacagccccucccccaucgcggcccggacgcugauccucgucgccaagagcgugcagaaccuggccaaccugguggaguucggcgccaaggagccguacauggagggggucaaccccuucaucaaguccaacaagcaccgcaugaucauguuccucgacgagcugggcaacgugcccgagcugccggacaccaccgagcacagccggaccgaccucucccgcgaccuggcggcccugcacgagaucugcguggcccacagcgacgagcuccggacgcuguccaacgagcgcggggcccagcagcacguccugaagaagcuccuggcgaucaccgagcugcuccagcagaagcagaaccaguacaccaagaccaacgacgugcgguga

SEQ ID NO: 35490 - RNA, 2553 nt, Artificial Sequence
  derived and/or modified sequence opt1 from RASA2__Homo_sapiens__NP_001290174
auggccgccgcggcccccgccgccgccgcggccagcuccgaggccccggccgcgagcgccaccgccgagcccgaggccggcgaccaggacucccgcgaggugcggguccugcagagccuccgcgggaagaucugcgaggccaagaaccugcugcccuaccucggcccccacaagaugcgggacugcuucugcaccaucaaccuggaccaggaggagguguaccgcacccagguggucgagaagucccugagcccguucuucuccgaggaguucuacuucgagaucccccggacguuccaguaccucagcuucuacguguacgacaagaacgugcugcagcgcgaccugcggaucgggaaggucgcgaucaagaaggaggaccucugcaaccacuccggcaaggagaccugguucagccugcagcccguggacuccaacagcgaggugcaggggaagguccaccuggagcucaagcugaacgagcugaucaccgagaacggcacggugugccagcagcucgugguccacaucaaggccugccacggccugccccugaucaacgggcaguccugcgacccguacgccaccgugagccucgugggccccucccgcaacgaccagaagaagaccaaggucaagaagaagaccagcaacccccaguucaacgagaucuucuacuucgaggugacgcgguccagcuccuacacccgcaagagccaguuccagguggaggaggaggacaucgagaagcuggagauccggaucgaccuguggaacaacgggaaccucguccaggacguguuccugggcgagaucaaggugcccgucaacgugcugcgcaccgacagcucccaccaggccugguaccuccugcagccgcgggacaacgggaacaagagcuccaagaccgacgaccugggcagccuccgccugaacaucugcuacacggaggacuacgugcugcccuccgaguacuacggcccccucaagacccugcugcucaagagccccgacguccagccgaucuccgccagcgcggccuacauccuguccgagaucugccgggacaagaacgacgccgugcugccccucguccgccugcugcuccaccacgacaagcuggugcccuucgccaccgccguggcggagcuggaccucaaggacacccaggacgccaacacgaucuuccgggggaacagccuggccacccgcugccuggacgagaugaugaagaucgucggcgggcacuaccucaaggugacccugaagcccauccuggacgagaucugcgacuccagcaaguccugcgagaucgacccgaucaagcucaaggagggcgacaacguggagaacaacaaggagaaccugcgguacuacgucgacaagcuguucaacaccaucgucaagagcuccaugagcugccccacggugaugugcgacaucuucuacucccugcgccagauggccacccagcgguuccccaacgacccccacgugcaguacagcgccguguccagcuucguguuccuccgcuucuucgcggucgccguggugagcccgcacaccuuccaccuccgcccccaccaccccgacgcccagaccauccggacgcugacccugaucuccaagaccauccagacccugggcagcugggggucccugagcaaguccaagagcuccuucaaggagacguucaugugcgaguucuucaagauguuccaggaggagggcuacaucaucgccgucaagaaguuccucgacgagaucagcuccaccgagaccaaggagagcuccgggaccagcgagcccgugcaccugaaggagggcgagauguacaagcgcgcgcaggggcggacgcgcaucggcaagaagaacuucaagaagcggugguucugccugaccucccgcgagcucaccuaccacaagcagccgggcagcaaggacgccaucuacaccauccccgugaagaacauccuggccgucgagaagcuggaggaguccagcuucaacaagaagaacauguuccaggugauccacacggagaagccccucuacgugcaggccaacaacugcgucgaggccaacgaguggaucgacgugcugugccgggugucccgcugcaaccagaaccggcugagcuucuaccacccgagcgucuaccucaacgggaacuggcugugcugccaggagaccggcgagaacacccuggggugcaagcccugcaccgcgggcgugcccgccgacauccagaucgacaucgacgaggaccgcgagaccgagcggaucuacucccucuucacgcugagccugcucaagcugcagaagauggaggaggccugcgggaccaucgccguguaccagggcccccagaaggagccggacgacuacuccaacuucgucaucgaggacagcgugaccaccuucaagacgauccagcagaucaaguccaucaucgagaagcuggacgagccccacgagaaguaccgcaagaagcggagcuccagcgccaaguacggcuccaaggagaaccccaucguggggaaggcgagcuga

SEQ ID NO: 35491 - RNA, 2421 nt, Artificial Sequence
  derived and/or modified sequence opt1 from RASAL1__Homo_sapiens__NP_001180449
auggccaagagcuccagccugaacgugcgcgucguggagggccgggcccuccccgcgaaggacguguccgggagcuccgacccguacugccuggucaagguggacgacgagguggucgcccgcaccgccaccguguggcggagccugggccccuucuggggcgaggaguacacggugcaccucccccuggacuuccaccagcuggccuucuacguccucgacgaggacaccguggggcacgacgacaucaucgggaagaucucccugagccgcgaggccaucaccgcggacccccggggcaucgacuccuggaucaaccugagccgcguggacccggacgccgagguccagggcgagaucugccucuccgugcagaugcuggaggacgggcagggccggugccugcgcugccacgugcuccaggcccgggaccuggcgccccgcgacaucagcgggaccuccgaccccuucgcccgggucuucuggggcagccagucccuggagacgagcaccaucaagaagacccgcuucccccacugggacgaggugcucgagcugcgggagaugccgggggcccccagcccccugcgcguggagcucugggacugggacauggucggcaagaacgacuuccugggcaugguggaguucucccccaagacccugcagcagaagccgcccaaggggugguuccggcuccugcccuucccccgcgccgaggaggacuccggcgggaaccugggcgcccuccgggugaagguccgccugaucgaggaccgggugcugccgagccagugcuaccagccccucauggagcugcugauggagagcgugcagggccccgccgaggaggacacggcgagcccccucgcccugcuggaggagcucacccugggggacugccgccaggaccuggccaccaagcucgucaagcuguuccugggccgggggcucgccggccgcuuccuggacuaccugacccgccgggagguggcccgcacgauggacccgaacacccucuuccgguccaacucccuggcgagcaaguccauggagcaguucaugaagcuggucgggaugcccuaccuccacgaggugcugaagcccgugaucagccgcgucuucgaggagaagaaguacauggagcuggaccccugcaagauggaccucggccggacccgccggaucuccuucaagggcgcccugagcgaggagcagaugcgcgagaccucccuggggcugcucacgggcuaccuggggccgaucguggacgccaucgugggcagcgucgggcggugcccgcccgccaugcgccuggccuucaagcagcuccaccggcgcguggaggagcgguucccccaggcggagcaccagcaggacgugaaguaccuggccaucuccggcuuccuguuccuccgcuucuucgcccccgccauccugacccccaagcuguucgaccuccgggaccagcacgccgacccccagaccagccgcucccugcugcuccuggcgaaggccguccagagcaucggcaaccuggggcagcagcucggccaggggaaggagcuguggauggccccgcugcaccccuuccuccugcagugcgugucccgggugcgcgacuuccuggaccggcucgucgacguggacggcgacgaggaggccggggugcccgcgcgcgcccuguucccgcccagcgccaucguccgcgagggcuaccugcucaagcggaaggaggagcccgccggccuggccacccgcuucgcguucaagaagcgguacguguggcuguccggggagacgcucagcuucuccaagagccccgaguggcagaugugccacagcauccccgugucccacauccgcgccgucgagcggguggacgagggcgccuuccagcugccgcacgugaugcaggucgugacccaggacgggaccggcgcccugcacaccacguaccuccagugcaagaacgugaacgagcugaaccaguggcugagcgcccuccgcaaggcguccgcccccaaccccaacaagcuggccgccugccaccccggcgccuuccggagcgcgcgcuggaccugcugccugcaggccgagcgguccgccgccgggugcagccgcacccacuccgcggucacccucggcgacuggagcgacccgcuggaccccgacgccgaggcccagacgguguaccggcagcugcuccuggggcgcgaccagcugcggcucaagcugcuggaggacuccaacauggacaccacccucgaggccgacaccggcgccugccccgaggugcuggcgcgccagcgggccgccacggcccgccugcucgagguccuggccgaccuggaccgggcgcacgaggaguuccagcagcaggagcgcgggaaggccgcccucggcccccugggcccguga

SEQ ID NO: 35492 - RNA, 3420 nt, Artificial Sequence
  derived and/or modified sequence opt1 from RASAL2__Homo_sapiens__NP_004832
augcagacccccgaggugccggccgagcgcagcccccggcgccgguccaucagcggcaccuccacgagcgagaagcccaacuccauggacaccgccaacaccagccccuucaaggugccgggguucuucuccaagcgccugaagggcagcaucaagcggaccaagucccagagcaagcucgaccgcaacacguccuuccggcugcccagccugcgcuccaccgacgaccggagccgcgggcuccccaagcugaaggagucccggagccacgagucccugcucagccccugcuccaccguggagugccuggaccugggccgcggggagccggugagcgucaagccccuccacagcuccauccugggccaggacuucugcuucgaggugaccuaccugagcggcuccaagugcuucagcugcaacuccgcgagcgagcgggacaaguggauggagaaccuccgccggacggugcagcccaacaaggacaacugccgccgggccgagaacguccugcgccuguggaucaucgaggccaaggaccucgcccccaagaagaaguacuucugcgagcugugccuggacgacacccucuucgcccggaccaccuccaagacgaaggcggacaacaucuucuggggcgagcacuucgaguucuucagccugccgccccugcacuccaucaccgugcacaucuacaaggacguggagaagaagaagaagaaggacaagaacaacuacgucgggcucgugaacauccccaccgccagcgugaccgggcgccaguucgucgagaagugguaccccguguccacgccgacccccaacaagggcaagaccgggggccccagcauccggaucaagucccgcuuccagaccaucacgauccugcccauggagcaguacaaggaguucgccgaguucgugaccagcaacuacaccaugcugugcuccguccucgagccggugaucagcgugcgcaacaaggaggagcuggccugcgcgcugguccacauccuccaguccaccggccgggccaaggacuuccugacggaccuggugaugagcgagguggaccgcugcggggagcacgacguccucaucuuccgggagaacaccaucgccaccaaguccaucgaggaguaccugaagcuggugggccagcaguaccuccacgacgcccugggggaguucaucaaggcccuguacgagagcgacgagaacugcgagguggaccccagcaagugcuccagcuccgagcucaucgaccaccagagcaaccugaagaugugcugcgagcuggcguucugcaagaucaucaacuccuacugcgucuucccccgcgagcucaaggagguguucgccagcuggaagcagcagugccugaaccggggcaagcaggacaucuccgagcgccugaucagcgccucccucuuccugcgguuccugugccccgccaucaugagcccgucccucuucaaccugaugcaggaguaccccgacgaccgcaccagccggacgcugacccucaucgccaaggucauccagaaccuggcgaacuucgccaaguucggcaacaaggaggaguacauggccuucaugaacgacuuccuggagcacgaguggggcgggaugaagcgcuuccugcucgagaucuccaaccccgacaccaucagcaacacccccggguucgacggcuacaucgaccuggggcgggagcuguccgugcuccacagccugcugugggagguggucucccagcucgacaagggcgagaacagcuuccugcaggccacgguggccaagcugggcccgcucccccgcgugcuggcggacaucaccaagagccugaccaaccccaccccgauccagcagcagcuccggcgcuucacggagcacaacuccagccccaacgucuccgggagccuguccagcggccugcagaagaucuucgaggaccccaccgacuccgaccuccacaagcucaagagccccucccaggacaacaccgacagcuacuuccgggggaagacccugcugcuggugcagcaggccuccagccaguccaugaccuacagcgagaaggacgagcgcgaguccagccugccgaacggccgguccgugagccucauggaccugcaggacacgcacgccgcccaggucgagcacgccuccgugaugcuggacgugcccauccgccucaccgggagccagcugagcaucacccaggucgcguccaucaagcagcugcgggagacccagagcacgccccaguccgcgccccaggugcgccgcccgcuccaccccgcccugaaccagcccggcggccugcagccccucagcuuccagaacccgguguaccaccugaacaaccccauccccgccaugcccaaggccuccaucgacagcucccuggagaaccucagcaccgccuccagccggucccagagcaacuccgaggacuucaagcugagcgggccguccaacagcuccauggaggacuucaccaagcgcagcacccaguccgaggacuucagccggcgccacacgguccccgaccggcacaucccccuggcccucccccgccagaacagcaccggccaggcccagauccggaagguggaccagggcgggcugggggcccgcgcgaaggccccgcccucccugccccacagcgccucccuccggagcaccggcuccaugagcguggucuccgccgcccugguggcggagcccgugcagaacggcagccgcucccggcagcagagcuccagcucccgcgagagcccgguccccaaggugcgggccauccagcgccagcagacccagcagguccagucccccguggacagcgccacgauguccccgguggagcggaccgccgccugggugcugaacaacgggcaguacgaggaggacgucgaggagaccgagcagaaccucgacgaggcgaagcacgccgagaaguacgagcaggagaucaccaagcugaaggagcgccugcgggugagcucccgccggcucgaggaguacgagcgccggcugcuggugcaggagcagcagaugcagaagcuccugcuggaguacaaggcccgccucgaggacagcgaggagcgccugcggcgccagcaggaggagaaggacagccagaugaaguccaucaucagccggcugauggccgucgaggaggagcucaagaaggaccacgcggagaugcaggccgugaucgacgccaagcagaagaucaucgacgcccaggagaagcgcaucgugucccuggacagcgccaacacgcggcugauguccgcgcucacccaggucaaggagcgcuacagcaugcagguccggaacggcaucucccccaccaaccccaccaagcugagcaucacggagaacggggaguucaagaacuccagcugcuga

SEQ ID NO: 35493 - RNA, 369 nt, Artificial Sequence
  derived and/or modified sequence opt1 from RASD1__Homo_sapiens__NP_001186918
augaagcuggccgccaugaucaagaagaugugccccagcgacuccgagcugagcaucccggcgaagaacugcuaccgcauggugauccugggcuccagcaaggucgggaagaccgccaucgugucccgguuccugaccggccgcuucgaggacgccuacacgcccaccaucgaggacuuccaccggaaguucuacagcauccgcggggagguguaccagcucgacauccuggacaccuccggcaaccaccccuuccccgccaugcggcgccugagcauccucaccgacccgcggcaccagguccugccccaggagcagaaccagggggagcgcggccgggcccccggccaccuccgccagcagggguga

SEQ ID NO: 35494 - RNA, 801 nt, Artificial Sequence
  derived and/or modified sequence opt1 from RASD2__Homo_sapiens__NP_055125
augaugaagacccugagcuccggcaacugcacccucagcgugcccgccaagaacuccuaccgcauggucgugcugggggccagccgggugggcaaguccagcaucgucucccgcuuccugaacgggcgguucgaggaccaguacacgccgaccaucgaggacuuccaccgcaagguguacaacauccggggcgacauguaccagcucgacauccuggacaccagcgggaaccaccccuuccccgcgaugcgccggcuguccauccucaccggcgacguguucauccuggucuucagccuggacaaccgcgaguccuucgacgaggugaagcggcuccagaagcagauccuggaggucaagagcugccugaagaacaagacgaaggaggccgccgagcuccccauggugaucugcggcaacaagaacgaccacggggagcugugccgccaggugccgaccaccgaggccgagcugcucguguccggcgacgagaacugcgccuacuucgaggucagcgcgaagaagaacaccaacguggacgagauguucuacgugcuguucuccauggccaagcugccccacgagaugagccccgcccuccaccggaagaucuccguccaguacggggacgccuuccacccccgcccguucugcaugcggcgcgugaaggagauggacgcguacggcauggugagccccuucgcccggcgccccuccgucaacagcgaccugaaguacaucaaggccaaggugcugcgggaggggcaggcccgcgagcgggacaagugcacgauccaguga

SEQ ID NO: 35495 - RNA, 2223 nt, Artificial Sequence
  derived and/or modified sequence opt1 from RASEF__Homo_sapiens__NP_689786
auggaggccgacggcgacggggaggagcuggcccgccuccggagcguguucgcggccugcgacgccaaccgcuccggccggcuggagcgcgaggaguuccgggcccugugcaccgagcuccgcguccggcccgccgacgcggaggccguguuccagcgccuggacgccgaccgggacggggccaucaccuuccaggaguucgcgcgcggcuuccuggggagccuccggggcggccgccggcgcgacugggggccccuggaccccgcccccgccguguccgaggccggccccgagacgcacgacagcgaggaggacgagggggacgaggacgccgcggccgcccuggccaccuccugcggcccggccagccccgggcgggcguggcaggacuuccaggcccgccucggcgacgaggccaaguucaucccccgggaggagcaggucuccacccuguaccagaacaucaaccugguggagccccgccucauccagccguacgagcacgugaucaagaacuucauccgggagauccgccugcagagcaccgagauggagaaccuggccaucgccgucaagcgggcgcaggacaaggccgccaugcagcucuccgagcuggaggaggagauggaccagcgcauccaggccgccgagcacaagacgcgcaaggacgagaagcggaaggcggaggaggcccugagcgaccuccgccggcaguacgagaccgaggugggcgaccuccaggugaccaucaagaagcugcgcaagcuggaggagcaguccaagcgggucagccagaaggaggacguggccgcccugaagaagcagaucuacgaccuguccauggagaaccagaaggugaagaaggaccuccuggaggcgcagaccaacaucgccuuccugcagagcgagcucgacgcccugaaguccgacuacgccgaccagagccugaacacggagcgcgaccucgagaucauccgggccuacaccgaggaccgcaacucccuggagcggcagaucgagauccugcagaccgcgaaccgcaagcuccacgacagcaacgacgggcugcgguccgcccuggagaacagcuacagcaaguucaaccgcucccuccacaucaacaacaucagccccggcaacaccaucucccggagcucccccaaguucaucgggcacagcccccagccgcugggcuacgaccgcuccagccgguccagcuacgucgacgaggacugcgacucccuggcccucugcgacccccugcagcgcacgaacugcgagguggacagccugcccgaguccugcuucgacagcggccucuccacccugcgggaccccaacgaguacgacagcgagguggaguacaagcaccagcgcggguuccagcggucccacggcguccaggagagcuucgggggcgacgccuccgacaccgacgugccggacauccgcgacgaggagaccuucgggcuggaggacguggccagcguccucgacuggaagccccagggcagcguguccgagggcagcaucguguccagcucccgcaagcccaucagcgcgcugagcccccagacggaccuggucgacgacaacgccaagagcuucuccagccagaaggccuacaagaucgugcucgccggggacgccgcggugggcaaguccagcuuccugaugcggcugugcaagaacgaguuccgcgagaacaucuccgccacccugggggucgacuuccagaugaagacccucaucguggacggcgagcggaccguccugcagcugugggacacggccgggcaggagcgcuuccggagcaucgccaaguccuacuuccgcaaggcggacggcgugcuccugcuguacgacgugaccugcgagaaguccuuccucaacauccgggagugggucgacaugaucgaggacgccgcccacgagaccgugccgaucaugcuggugggcaacaaggccgacauccgcgacaccgccgcgacggaggggcagaagugcguccccggccacuucggggagaagcuggccaugaccuacggcgcccucuucugcgagaccuccgccaaggacgggagcaacaucguggaggccgugcugcaccuggcgcgggaggucaagaagcgcaccgacaaggacgacagccgguccaucacgaaccucaccggcaccaacagcaagaaguccccgcagaugaagaacugcugcaacggcuga

SEQ ID NO: 35496 - RNA, 1470 nt, Artificial Sequence
  derived and/or modified sequence opt1 from RASGEF1A__Homo_sapiens__NP_001269791
auguuccuggagccccaggagaccaugccgcagaccagcguggucuucuccagcauccucggccccuccugcagcggccaggugcagcccgggaugggggagcgcggcgggggcgccggcgggggcuccggggaccugaucuuccaggacggccaccugaucagcgggucccucgaggcccugauggagcaccuggugcccacggucgacuacuacccggaccggaccuacaucuucaccuuccuccugagcucccgcguguucaugccgccccacgaccugcucgcgcgggugggccagaucugcgucgagcagaagcagcagcuggaggccggccccgagaaggccaagcucaagagcuucuccgccaagaucgugcagcugcugaaggaguggaccgaggccuuccccuacgacuuccaggacgagaaggcgauggccgagcugaaggccaucacgcaccgcgugacccagugcgacgaggagaacgggaccgucaagaaggccaucgcgcagaugacccagagccuccugcugucccucgccgcccggagccagcugcaggagcugcgcgagaagcuccggccgcccgccguggacaagggccccauccugaagacgaagccgcccgccgcgcagaaggacauccugggggugugcugcgacccccucguccuggcccagcagcugacccacaucgagcucgaccgcguguccagcaucuaccccgaggaccugaugcagaucgugucccacauggacagccuggacaaccaccggugccgcggcgaccucaccaagaccuacucccuggaggccuacgacaacugguucaacugccugagcaugcucgucgccacggaggugugccggguggucaagaagaagcaccgcacccggaugcuggaguucuucaucgacguggcccgcgagugcuucaacaucggcaacuucaacagcaugauggcgaucaucuccgggaugaaccugagccccguggcccggcucaagaagaccugguccaaggucaagaccgccaaguucgacgugcuggagcaccacauggaccccagcuccaacuucugcaacuaccgcacggcccugcagggcgccacccagcggagccagauggcgaacuccagccgcgagaagaucgugauccccgucuucaaccucuucgugaaggacaucuacuuccugcacaagauccacaccaaccaccuccccaacgggcacaucaacuucaagaaguucugggagaucucccggcagauccacgaguucaugaccuggacgcaggucgagugcccguucgagaaggacaagaagauccagagcuaccugcugaccgcccccaucuacuccgaggaggcccuguucguggccagcuucgaguccgagggccccgagaaccacauggagaaggacagcuggaagacccuccgcaccacgcugcugaaccgggccuga

SEQ ID NO: 35497 - RNA, 1401 nt, Artificial Sequence
  derived and/or modified sequence opt1 from RASGEF1C__Homo_sapiens__NP_778232
augccccagacccugagcgccuccgacauggugaccccgggcagccucuccccgccgcccacggagcccaccgacggggagcaggccggccagccccugcuggacggggcgcccagcuccgccagccucgagacccugauccagcaccuggugcccaccgccgacuacuaccccgagaaggccuacaucuucacguuccuccuguccagccgccuguucaucgagccccgggagcuccuggcccgcgugugccaccugugcaucgagcagcagcagcucgacaagcccgugcuggacaaggcgcgggugcgcaaguucggccccaagcugcuccagcugcuggccgaguggaccgagaccuucccgcgggacuuccaggaggaguccaccaucgggcaccucaaggacguggugggccgcaucgcccccugcgacgaggccuaccggaagcgcaugcaccagcugcugcaggcgcuccaccagaagcuggccgcccugcggcagggccccgaggggcucgucggcgccgacaagcccaucagcuaccgcacgaagccgcccgccuccauccaccgggagcugcugggggugugcagcgaccccuacacccucgcgcagcagcugacccacguggagcuggagcgccuccggcacaucggccccgaggaguucguccaggccuucgugaacaaggacccgcuggccuccaccaagcccugcuucagcgacaagacguccaaccuggaggccuacgugaagugguucaaccgccucugcuaccuggucgccaccgagaucugcaugcccgcgaagaagaagcagcgggcccaggugaucgaguucuucaucgacguggcccgcgagugcuucaacaucgggaacuucaacagccugauggccaucaucuccggcaugaacaugagccccgucucccggcucaagaagaccugggccaaggugcgcaccgcgaaguucuucauccuggagcaccagauggacccgacgggcaacuucugcaacuaccggaccgcccugcgcggggccgcccaccggagccucaccgcccacagcucccgcgagaagaucgugauccccuucuucagccugcugaucaaggacaucuacuuccucaacgagggcugcgcgaaccgccugcccaacgggcacgucaacuucgagaaguuccuggagcucgccaagcaggucggcgaguucaucaccuggaagcaggucgagugccccuucgagcaggacgccuccaucacgcacuaccuguacaccgccccgaucuucagcgaggacggccuguaccucgcguccuacgagagcgagucccccgagaaccagaccgagaaggagcgguggaaggcccugcgcagcuccauccuggggaagaccuga

SEQ ID NO: 35498 - RNA, 3774 nt, Artificial Sequence
  derived and/or modified sequence opt1 from RASGRF1__Homo_sapiens__NP_001139120
augcagaagggcauccgccugaacgacgggcacguggccagccucggccugcuggcccggaaggacgggacccgcaagggcuaccucuccaagcggagcuccgacaacaccaaguggcagacgaagugguucgcgcugcugcagaaccuccuguucuacuucgagagcgacuccagcucccgccccagcgggcuguaccuccuggagggcugcgucugcgaccgggccccgucccccaagcccgcccugagcgccaaggagccccucgagaagcagcacuacuucaccgugaacuucucccacgagaaccagaaggcccuggagcugcgcaccgaggacgcgaaggacugcgacgaguggguggccgccaucgcccacgcgagcuaccggacccucgccacggagcacgaggcccugaugcagaaguaccugcaccuccugcagaucgucgagaccgagaagaccguggccaagcagcugcgccagcagaucgaggacggcgagaucgagaucgagcggcucaaggccgagaucaccucccugcugaaggacaacgagcgcauccagagcacgcagaccguggcgccgaacgacgaggacuccgacaucaagaagaucaagaagguccagagcuuccuccggggguggcugugccgccggaaguggaagaccaucauccaggacuacauccgcuccccccacgccgacagcaugcggaagcgcaaccaggugguguucuccaugcuggaggccgaggccgaguacguccagcagcuccacauccuggugaacaacuuccugcggccccuccgcauggccgcgagcagcaagaagcccccgaucacccacgacgacguguccagcaucuuccugaacuccgagacgaucauguuccugcaccagaucuucuaccagggccucaaggcccggaucagcuccuggcccacccugguccuggccgaccucuucgacauccugcugcccaugcucaacaucuaccaggaguucgugcgcaaccaccaguacagccugcagauccuggcccacugcaagcagaaccgggacuucgacaagcuccugaagcacuacgaggccaagcccgacugcgaggagcgcacccuggagaccuuccucacguacccgauguuccagaucccccgcuacauccugacccugcacgagcuccuggcgcacaccccccacgagcacguggagcggaacucccuggacuacgccaagagcaagcuggaggagcucucccgcaucaugcacgacgaggucagcgagaccgagaacauccggaagaaccuggccaucgagcgcaugaucaucgaggggugcgagauccugcucgacacgucccagaccuucgugcggcagggcagccugauccaggugcccauguccgagaaggggaagaucacccgcggccggcugggcagccucucccugaagaaggagggggagcgccagugcuuccuguucagcaagcaccucaucaucugcacccggggcuccgggggcaagcugcaccugacgaagaacggcgucaucagccucaucgacugcacccugcuggaggagccggaguccaccgaggaggaggccaaggggagcggccaggacaucgaccaccucgacuucaagaucgggguggagcccaaggacagcccccccuucaccgugauccuggucgccuccagccgccaggagaaggcggccuggacguccgacaucagccagugcguggacaacauccggugcaacggccugaugaugaacgccuucgaggagaacuccaaggugaccgucccgcagaugaucaagagcgacgccucccucuacugcgacgacguggacauccgcuucagcaagaccaugaacuccugcaagguccugcagauccgguacgcgagcguggagcgccugcucgagcggcugaccgaccugcgcuuccucuccaucgacuuccugaacacguuccugcacagcuaccggguguucaccaccgccaucgucgugcucgacaagcugaucaccaucuacaagaagcccaucuccgccauccccgcccgcagccuggagcuccuguucgccuccgggcagaacaacaagcugcucuacggcgagcccccgaagagcccccgggcgacgcgcaaguucuccagcccccccccgcugagcaucaccaagaccuccagccccucccgccggcgcaagcugagccucaacauccccaucaucaccggcgggaaggcccuggaccuggccgcccucuccugcaacagcaacggcuacaccuccauguacagcgccauguccccguucagcaaggcgacgcuggacaccuccaagcuguacgugagcuccagcuucaccaacaagauccccgacgagggggacaccacgcccgagaagcccgaggacccguccgcccucagcaagcaguccagcgaggucuccaugcgggaggagagcgacaucgaccagaaccagagcgacgacggcgacaccgagaccucccccaccaagagccccacgacccccaaguccgugaagaacaagaacagcuccgaguucccgcuguucagcuacaacaacgggguggucaugaccuccugccgcgagcuggacaacaaccggagcgcccucuccgccgccagcgcguucgccaucgccaccgccggcgcgaacgagggcacgcccaacaaggagaaguaccgccggaugucccuggccagcgccggguucccccccgaccagcgcaacggcgacaaggaguucgugauccggcgcgccgccaccaaccgggugcugaacguccuccgccacuggguguccaagcacagccaggacuucgagaccaacgacgagcugaagugcaaggugaucggguuccuggaggaggucaugcacgacccggagcuccugacccaggagcggaaggcggccgccaacaucauccgcacgcugacccaggaggaccccggcgacaaccagaucacccucgaggagaucacccagauggccgagggggugaaggccgagcccuucgagaaccacuccgcgcuggagaucgccgagcagcugacgcuccuggaccaccugguguucaagaagauccccuacgaggaguucuucggccagggcuggaugaagcucgagaagaacgagcggaccccguacaucaugaagaccaccaagcacuucaacgacaucagcaaccugaucgccuccgagaucauccgcaacgaggacaucaacgcccgggucagcgccaucgagaaguggguggcgguggccgacaucugccgcugccugcacaacuacaacgccguccucgagaucacguccagcaugaaccggagcgccaucuuccgccugaagaagaccuggcugaagguguccaagcagaccaaggcgcucaucgacaagcugcagaagcuggugagcuccgaggggcgguucaagaaccuccgcgaggcccugaagaacugcgacccccccugcguccccuaccugggcauguaccucaccgaccuggccuucaucgaggaggggacgccgaacuacaccgaggacggccuggugaacuucagcaagaugcgcaugaucucccacaucauccgggagauccgccaguuccagcagaccgccuacaagaucgagcaccaggccaaggugacccaguaccuccuggaccagagcuucgucauggacgaggagucccuguacgagagcucccuccggaucgagcccaagcugcccacguga

SEQ ID NO: 35499 - RNA, 3714 nt, Artificial Sequence
  derived and/or modified sequence opt1 from RASGRF2__Homo_sapiens__NP_008840
augcagaagagcgugcgcuacaacgagggccacgcccuguaccucgccuuccuggcgcggaaggaggggaccaagcgcggcuuccuguccaagaagaccgccgaggccagccgguggcacgagaagugguucgcccucuaccagaacguccuguucuacuucgagggggagcaguccugccgccccgccggcauguaccugcucgaggggugcagcugcgagcggacgccggcgcccccccgcgccggcgccggccaggggggcgugcgggacgcccuggacaagcaguacuacuucaccgugcuguucgggcacgagggccagaagccccucgagcugcgcugcgaggaggagcaggacgggaaggaguggauggaggcgauccaccaggccuccuacgccgacauccugaucgagcgggagguccucaugcagaaguacauccaccuggugcagaucguggagaccgagaagaucgccgccaaccagcugcgccaccagcucgaggaccaggacaccgagaucgagcggcugaagagcgagaucaucgcgcugaacaagacgaaggagcgcaugcggccguaccaguccaaccaggaggacgaggaccccgacaucaagaagaucaagaagguccagagcuucaugcgcggcuggcucugccggcgcaaguggaagaccaucgugcaggacuacaucugcuccccccacgccgagagcaugcggaagcgcaaccagaucguguucaccauggucgaggccgaguccgaguacgugcaccagcuguacauccuggugaacggcuuccuccggccccugcgcauggccgccagcuccaagaagccgcccaucagccacgacgacgucuccagcaucuuccugaacuccgagaccaucauguuccuccacgagaucuuccaccaggggcugaaggcgcggaucgccaacuggcccacgcugauccucgccgaccuguucgacauccugcuccccaugcugaacaucuaccaggaguucgugcgcaaccaccaguacagccugcaggugcucgccaacugcaagcagaaccgcgacuucgacaagcugcugaagcaguacgaggccaacccggcgugcgagggccggaugcucgagaccuuccugaccuaccccauguuccagaucccccgcuacaucaucacccugcacgagcuccuggcccacacgccccacgagcacgucgagcggaagucccuggaguucgccaagagcaagcucgaggagcugagccgcgugaugcacgacgagguguccgacaccgagaacauccggaagaaccuggccaucgagcgcaugaucgucgaggggugcgacauccuccuggacaccagccagaccuucauccggcagggcucccugauccaggugccgagcguggagcgcggcaagcucuccaagguccggcuggggagccugucccugaagaaggagggcgagcgccagugcuuccucuucacgaagcacuuccugaucugcacccggagcuccgggggcaagcugcaccuccugaagaccgggggcgugcugagccucaucgacugcacccugaucgaggagcccgacgccuccgacgacgacagcaagggcuccgggcagguguucggccaccuggacuucaagaucgucguggagccccccgacgcggccgccuucacggucgugcuccuggccccgagccgccaggagaaggcggccuggauguccgacaucagccagugcguggacaacauccggugcaacgggcugaugaccaucgucuucgaggagaacuccaaggugaccgugccccacaugaucaagagcgacgcccgccuccacaaggacgacaccgacaucugcuucuccaagacgcugaacagcugcaaggucccccagauccgguacgccagcguggagcgccugcucgagcggcugaccgaccugcgcuuccucuccaucgacuuccugaacaccuuccugcacaccuaccggaucuucacgaccgccgcggugguccucggcaagcugagcgacaucuacaagcgccccuucaccuccaucccggugcgcagccuggagcucuucuucgccaccucccagaacaaccggggggagcaccugguggacggcaagagcccccgccugugccggaaguucuccagcccccccccgcucgccgucucccgcacgagcucccccgugcgggcccgcaagcugagccugaccuccccccucaacagcaagaucggcgcccuggaccugaccaccuccagcuccccgacgaccaccacccagagccccgcggccagcccccccccgcacaccgggcagaucccccucgaccugucccggggccugagcucccccgagcagagccccgggacgguggaggagaacgucgacaacccgcgcguggaccucugcaacaagcugaagcgguccauccagaaggccgugcuggagagcgcccccgccgaccgcgcgggcgucgaguccagccccgccgccgacaccaccgagcucucccccugccggagcccguccaccccccgccaccugcgguaccgccagcccgggggccagacggccgacaacgcgcacugcagcgugucccccgccagcgccuucgccaucgccaccgcggccgccggccacggguccccgcccggcuucaacaacaccgagcggaccugcgacaaggaguucaucauccgccggacggccaccaaccgcgugcugaacguccuccggcacugggugagcaagcacgcccaggacuucgagcugaacaacgagcugaagaugaacgugcucaaccugcuggaggagguccuccgcgaccccgaccugcugccccaggagcggaaggcggccgccaacauccuccgcgcccugucccaggacgaccaggacgacauccaccugaagcucgaggacaucauccagaugaccgacugcaugaaggccgagugcuucgagagccuguccgcgauggagcuggccgagcagaucacccuccuggaccacgugaucuuccgcagcaucccguacgaggaguuccuggggcagggcuggaugaagcucgacaagaacgagcggacgcccuacaucaugaagaccagccagcacuucaacgacauguccaaccugguggccagccagaucaugaacuacgccgacgucuccagccgcgcgaacgccaucgagaaguggguggccguggccgacaucugccggugccugcacaacuacaacggcguccucgagaucaccuccgcccugaaccgcagcgcgaucuaccggcugaagaagaccugggccaagguguccaagcagacgaaggcccucauggacaagcugcagaagaccgugagcuccgaggggcgcuucaagaaccugcgggagacccucaagaacugcaacccccccgccgucccguaccugggcauguaccugaccgaccucgccuucaucgaggaggggacgcccaacuucaccgaggagggccuggugaacuucagcaagaugcgcaugaucucccacaucauccgggagauccgccaguuccagcagaccagcuaccggaucgaccaccagcccaagguggcgcaguaccugcucgacaaggaccugaucaucgacgaggacacccuguacgagcucucccugaagaucgagccgcgccugcccgccuga

SEQ ID NO: 35500 - RNA, 2289 nt, Artificial Sequence
  derived and/or modified sequence opt1 from RASGRP1__Homo_sapiens__NP_001122074
augggcacccuggggaaggcccgcgaggcgccccggaagccgagccacggcugccgcgccgccuccaaggcccggcucgaggccaagcccgccaacagccccuuccccucccacccgagccuggcgcacaucacccaguuccgcaugauggugucccuggggcaccucgccaagggcgccagccuggacgaccugaucgacuccugcauccagagcuucgacgccgacgggaaccucugccgguccaaccagcugcugcaggucaugcucacgaugcaccgcaucgugaucagcuccgcggagcugcugcagaaggugaucacccucuacaaggacgcccuggccaagaacagccccggccugugccucaagaucugcuacuucguccgguacuggaucaccgaguucugggugauguucaagauggacgccucccugaccgacacgauggaggaguuccaggagcuggugaaggccaagggcgaggagcuccacugccgccugaucgacaccacccagaucaacgcgcgggacuggagccgcaagcugacccagcggaucaaguccaacacgagcaagaagcgcaaggucucccuccuguucgaccaccuggagcccgaggagcucagcgagcaccugaccuaccuggaguucaaguccuuccggcgcaucagcuucagcgacuaccagaacuaccucgugaacuccugcgugaaggagaaccccaccauggagcggagcaucgcccugugcaacgggaucucccaguggguccagcugauggugcucagccgcccgacgccccagcugcgggccgagguguucaucaaguucauccaggucgcccagaagcugcaccagcuccagaacuucaacacccugauggccgugaucggcgggcugugccacuccagcaucucccgccucaaggagaccagcucccacgugccccacgagaucaacaagguccugggcgagaugaccgagcugcucagcuccagccggaacuacgacaacuaccgccgggcguacggggagugcaccgacuucaagauccccauccugggcgugcaccugaaggaccucaucucccuguacgaggccaugccggacuaccuggaggacggcaaggugaacguccacaagcuccuggcccuguacaaccacaucagcgagcucgugcagcugcaggagguggccccgccccuggaggccaacaaggaccugguccaccuccugacgcugucccucgaccuguacuacaccgaggacgagaucuacgagcugagcuacgcgcgcgagccccgcaaccaccgggcccccuccguguucaagaacuacgaccacgaccaggacggguacaucagccaggaggaguucgagaagaucgccgccuccuuccccuucagcuucugcgugauggacaaggaccgcgagggccucaucagccgggacgagaucaccgccuacuucaugcgcgcguccagcaucuacuccaagcuggggcugggcuucccccacaacuuccaggagaccacguaccucaagcccaccuucugcgacaacugcgccggcuuccuguggggcgucaucaagcagggguaccggugcaaggacugcgggaugaacugccacaagcagugcaaggaccugguggucuucgagugcaagaagcgcgccaagaacccgguggcccccaccgagaacaacaccagcgugggccccgucuccaaccucugcagccugggggcgaaggaccugcuccacgcccccgaggagggcccguucacguuccccaacggcgaggccguggagcacggggaggaguccaaggaccggaccaucaugcugaugggcgugagcucccagaagaucagccugcgccucaagcgggccgucgcccacaaggcgacccagaccgagucccagcccuggaucgggagcgagggccccuccgggccguucgugcugagcagcccccgcaagacggcccaggacacccuguacgugcuccccuccccgaccucccccugccccagccccguccuggugcggaagcgcgccuucgugaagugggagaacaaggacagccugaucaaguccaaggaggagcuccggcaccuccgccugccgaccuaccaggagcuggagcaggagaucaacacgcugaaggccgacaacgacgcccugaagauccagcucaaguacgcgcagaagaagaucgagagccugcagcuggagaaguccaaccacguccucgcccagauggagcagggcgacugcagcuga

SEQ ID NO: 35501 - RNA, 1830 nt, Artificial Sequence
  derived and/or modified sequence opt1 from RASGRP2__Homo_sapiens__NP_001092141
auggccggcacccuggaccucgacaaggggugcaccguggaggagcugcugcgcggcugcaucgaggccuucgacgacagcgggaagguccgggacccccagcucgugcgcauguuccugaugaugcaccccugguacauccccuccagccagcuggcggccaagcuccugcacaucuaccagcagucccggaaggacaacagcaacucccuccaggugaagacgugccaccugguccgcuacuggaucagcgccuuccccgccgaguucgaccugaaccccgagcuggccgagcagaucaaggagcucaaggcgcugcuggaccaggagggcaaccggcgccacuccagccucaucgacaucgacuccgugccgaccuacaaguggaagcgccaggugacccagcggaaccccgucgggcagaagaagcggaagaugagccugcuguucgaccaccucgagcccauggagcuggccgagcaccugaccuaccucgaguaccgcuccuucugcaagauccuguuccaggacuaccacagcuucgugacgcacggcugcaccguggacaaccccguccuggagcgguucaucucccucuucaacagcgugucccagugggugcagcugaugauccugagcaagccgaccgcgccccagcgcgcccucgucaucacccacuucgugcacguggccgagaagcugcugcagcuccagaacuucaacacgcugauggccgucgugggcgggcugucccacagcuccaucagccggcucaaggagacccacagccacgugucccccgagaccaucaagcugugggagggccugaccgagcucgucacggccaccgggaacuacggcaacuaccgccggcgccuggccgccugcgugggguuccgguuccccauccugggcgugcaccucaaggaccuggucgcgcugcagcucgcccugccggacuggcuggaccccgcccgcacccggcucaacggcgccaagaugaagcagcuguucagcauccuggaggagcucgccauggugaccucccugcgcccgcccgugcaggcgaaccccgaccugcugagccuccugacggucucccuggaccaguaccagaccgaggacgagcucuaccagcugagccugcagcgggagccccgcuccaagagcucccccaccagccccaccuccugcacgccgccgccccgcccgcccgugcucgaggaguggaccagcgccgccaagcccaagcuggaccaggcccuggucguggagcacaucgagaagaugguggaguccgucuuccggaacuucgacguggacggggacggccacaucagccaggaggaguuccagaucauccgcgggaacuuccccuaccucuccgccuucggcgaccuggaccagaaccaggacggcugcaucagccgggaggagaugguguccuacuuccugcgcagcuccagcguccucgggggccggaugggguucgugcacaacuuccaggagagcaacucccugcgccccguggcgugccggcacugcaaggcccugauccucggcaucuacaagcaggggcugaagugccgcgccugcggcgucaacugccacaagcagugcaaggaccggcugagcguggagugccgccggcgcgcccaguccgugagccucgagggcuccgcccccagccccucccccaugcacagccaccaccaccgggcguucuccuucagccugccgcgccccgggcggcgcggcucccggccgcccgagauccgcgaggaggagguccagaccguggaggacgggguguucgacauccaccuguga

SEQ ID NO: 35502 - RNA, 2070 nt, Artificial Sequence
  derived and/or modified sequence opt1 from RASGRP3__Homo_sapiens__NP_056191
augggcagcagcgggcugggcaaggccgccacccucgacgagcugcugugcacgugcaucgagauguucgacgacaacggggagcucgacaacagcuaccugccccgcaucgugcugcucaugcaccggugguaccuguccagcaccgagcuggcggagaagcuccugugcauguaccgcaacgccaccggcgaguccugcaacgaguuccggcugaagaucugcuacuucaugcgcuacuggauccucaaguucccggccgaguucaaccuggaccuggggcucauccggaugaccgaggaguuccgcgaggucgccagccagcugggcuacgagaagcacgugucccugaucgacaucagcuccauccccagcuacgacuggaugcggcgcgugacccagcggaagaaggucuccaagaagggcaaggccugccuccuguucgaccaccuggagcccaucgagcucgcggagcaccugacguuccuggagcacaagagcuuccgccggaucuccuucaccgacuaccagagcuacgugauccacgggugccucgagaacaaccccacccuggagcgcuccaucgcccuguucaacggcaucagcaagugggugcagcucaugguccuguccaagccgacgccccagcagcgggccgaggugaucaccaaguucaucaacguggccaagaagcugcuccagcugaagaacuucaacacccugauggcggucgucgggggccucagccacuccagcaucagccgccugaaggagacccacucccaccugagcuccgaggugaccaagaacuggaacgagaugacggagcucgugagcuccaacgggaacuacugcaacuaccggaaggccuucgccgacugcgacggcuucaagauccccauccugggcgugcaccugaaggaccucaucgccgugcacgucaucuuccccgacuggaccgaggagaacaaggugaacaucgugaagaugcaccagcugagcgucacccuguccgagcucgugagccugcagaacgccucccaccaccuggagccgaacauggaccucaucaaccugcugacccucagccuggaccuguaccacacggaggacgacaucuacaagcugucccucgugcuggagccccgcaacagcaagucccccaccagccccaccaccccgaacaagcccgucgugccccuggagugggcgcucggggugaugcccaagccggaccccacggucaucaacaagcacauccggaagcugguggaguccgucuuccgcaacuacgaccacgaccacgacggcuacaucagccaggaggacuucgaguccaucgccgccaacuuccccuuccuggacagcuucugcgugcucgacaaggaccaggacgggcugaucuccaaggacgagaugauggccuacuuccugcgggccaagagccagcuccacugcaagaugggccccggcuucauccacaacuuccaggagaugaccuaccugaagccgaccuucugcgagcacugcgcgggguuccuguggggcaucaucaagcagggguacaagugcaaggacugcggcgccaacugccacaagcagugcaaggaccuccuggugcuggccugccgccgguucgcccgcgcccccagccucuccagcgggcacggcucccugcccggcagccccucccugccgcccgcgcaggacgaggucuucgaguuccccggggugaccgccggccaccgcgaccucgacagccgggccaucacgcuggugaccggguccagccgcaagaucuccguccggcugcagcgcgccaccaccagccaggccacgcagaccgagcccgugugguccgaggcgggcuggggcgacagcgggucccacaccuucccgaagaugaaguccaaguuccacgacaaggccgccaaggacaagggcuucgccaagugggagaacgagaagccccgggugcacgcgggggucgacgugguggaccgcggcaccgaguucgagcucgaccaggacgagggggaggagacgcggcaggacggcgaggacggguga

SEQ ID NO: 35503 - RNA, 1980 nt, Artificial Sequence
  derived and/or modified sequence opt1 from RASGRP4__Homo_sapiens__NP_001139674
augaaccgcaaggacagcaagcggaagucccaccaggagugcaccggcaagaucgggggccgcgggcggccccgccaggugcggcgccacaagaccugccccagcccccgggagaucuccaaggucauggccagcaugaaccugggccuccuguccgagggcgggugcagcgaggacgagcugcucgagaagugcauccaguccuucgacagcgccggcucccugugccacgaggaccacaugcugaacauggugcucgccaugcacagcugggugcugcccuccgccgaccuggccgcccgccuccugacgagcuaccagaaggccaccggggacacccaggagcugcggcgccuccagaucugccaccugguccgguacuggcugaugcgccaccccgaggugaugcaccaggacccgcagcucgaggaggugaucggccgguucugggcgaccgucgcccgcgaggggaacuccgcccagcggcgccugggcgacagcuccgaccugcccgggcucggcaagaagcggaaggugagccugcuguucgaccaccucgagacgggcgagcuggcccagcaccugaccuaccucgaguuccgcuccuuccaggcgaucacgccccaggaccugcggagcuacgugcugcagggguccguccgcggcugccccgcccucgaggggagcgugggccugagcaacuccgugagccgguggguccaggugauggugcugucccgcccgggcccccuccagcgcgcccagguccuggacaaguucauccacguggcccagcggcugcaccagcuccagaacuucaacacccugauggccgugaccgggggccugugccacagcgcgaucucccgccucaaggacagccacgcccaccugucccccgacagcaccaaggcccugcucgagcugaccgagcugcucgccucccacaacaacuacgcccgguaccgccggaccugggcggggugcgccggcuuccgccugcccguccugggggugcaccucaaggaccuggugagccugcacgaggcccagccggaccggcuccccgacggccgccugcaccuccccaagcugaacaaccuguaccugcggcugcaggagcucgucgcccugcagggccagcacccgcccugcuccgccaacgaggaccugcuccaccuccugacgcugagccuggaccuguucuacaccgaggacgagaucuacgagcucuccuacgcgcgcgagccccggugccccaagagccugcccccgucccccuucaacgcgccccuggugguggagugggcccccggggucaccccgaagcccgaccgcgugacccucggccggcacgucgagcagcugguggagagcguguucaagaacuacgaccccgaggggcgcggcacgaucucccaggaggacuucgagcggcugagcgggaacuuccccuucgccugccacggccuccacccgccgccccgccagggccggggguccuucagccgcgaggagcugaccggcuaccugcuccgggccagcgccaucugcuccaagcuggggcuggccuuccuccacaccuuccacgaggucaccuuccgcaagcccacguucugcgacagcugcuccggcuuccuguggggcgugaccaagcagggguaccgcugccgggagugcggccugugcugccacaagcacugccgcgaccaggugaaggucgagugcaagaagcggcccggggccaagggcgacgccgggccgcccggcgcgcccgugcccagcacccccgcgccccacgccuccugcggcagcgaggagaaccacuccuacacccucagccuggagccggagacggggugccagcugcgccacgccuggacccagaccgagagcccccaccccuccugggagaccgacacggugcccugcccggucauggacccgcccuccaccgccagcuccaagcucgacagcuga

SEQ ID NO: 35504 - RNA, 2892 nt, Artificial Sequence
  derived and/or modified sequence opt1 from RASIP1__Homo_sapiens__NP_060275
augcugagcggcgagcgcaaggaggggggcuccccccgguucgggaagcuccaccugccggugggccuguggaucaacagcccccgcaagcagcucgccaagcuggggcggcgcuggcccuccgccgcgagcgucaaguccagcuccagcgacaccggcucccggagcuccgagccccugccgcccccccccccgcacguggagcuccgccgggugggcgccgucaaggccgccgggggcgccagcgggucccgcgcgaagcggaucagccagcuguuccgcggcuccgggaccggcacgaccggcagcuccggggccggcgggcccggcacccccggcggggcccagcggugggccagcgagaagaagcugcccgagcucgcggccggcguggccccggagcccccccuggccacccgcgccacggcgcccccgggggugcugaagaucuucggcgccgggcucgccuccggcgccaacuacaagagcguccuggccaccgcgcggagcaccgcccgcgagcugguggccgaggcccucgagcgguacggccuggccgggucccccggcgggggccccggggagagcuccugcguggacgcguucgcccugugcgacgcccucggccgccccgccgccgcgggcgucgggagcggcgaguggcgggccgagcaccugcgcgugcugggggacuccgagcggccgcuccuggugcaggagcuguggcgcgcccggcccggcugggcccgccgcuucgagcuccgggggcgcgaggaggcgcggcgccuggagcaggaggccuucggcgccgccgacagcgagggcaccggggcccccuccuggcggccccagaagaaccgcagccgggcggccuccggcggggccgcccuggccagcccgggccccggcacgggguccggcgcgcccgccgggagcggcgggaaggagcgcuccgagaaccucagccugcggcgcuccgucagcgagcugucccuccagggccggcgccggcgccagcaggagcggcgccagcaggcccugagcauggcccccggcgccgcggacgcccagaucgggaccgccgacccgggcgacuucgaccagcugacccagugccucauccaggcccccuccaaccggcccuacuuccugcugcuccagggguaccaggacgcgcaggacuucgugguguacgucaugacccgcgagcagcacguguucggccgggggggcaacagcagcggccgcgggggcuccccggcccccuacguggacacguuccugaacgcccccgacauccugccccgccacugcaccguccgggccgggccggagcaccccgccauggugcgccccagccggggcgcgcccgugacccacaacgggugccuccugcugcgcgaggccgagcuccacccgggcgaccugcugggccucggggagcacuuccuguucauguacaaggacccccggaccggcggguccggccccgcccgccccccguggcugcccgcccggcccggggccacgcccccgggccccggcugggcguucagcugccgccucugcgggcggggccugcaggagcgcggggaggcccuggccgccuaccuggacggccgggagcccguccuccgcuuccggccccgcgaggaggaggcccugcugggcgagaucgugcgggcggccgccgccggguccggcgaccucccgccccuggggcccgcgacccugcucgcccugugcgugcagcacagcgcccgcgagcuggagcucggccaccugccccggcugcucgggcgccuggcccggcugaucaaggaggccgucugggagaagaucaaggagaucggcgaccgccagccggagaaccaccccgagggcgugcccgaggucccgcucacccccgaggcgguguccguggagcugcggccccugaugcucuggauggccaacaccacggagcugcugagcuucguccaggagaaggugcucgagauggagaaggaggccgaccaggaggacccccagcugugcaacgaccuggagcucugcgacgaggccauggcccugcuggacgaggugaucaugugcaccuuccagcaguccgucuacuaccucaccaagacccuguacagcacgcugccggcgcuccuggacuccaaccccuucaccgccggggccgagcugcccggccccggggccgagcucggcgccaugccgcccgggcugcgccccacccugggcguguuccaggcggcccucgagcugaccagccagugcgagcugcaccccgaccucgugucccagacguucggcuaccuguucuucuucagcaacgccucccugcucaacagccugauggagcgcgggcagggccggccguucuaccaguggucccgcgccguccagauccggaccaaccuggaccucgugcuggacuggcugcagggggccggccucggggacaucgcgaccgaguucuuccgcaagcugagcauggccgugaaccugcucugcgucccccggaccagccugcugaaggccuccuggagcucccuccgcacggaccaccccacccugacccccgcccagcugcaccaccuccugagccacuaccagcugggcccgggccgggggccccccgcggccugggaccccccgcccgccgagcgcgaggccguggacaccggcgacaucuucgaguccuucagcucccaccccccccucauccugccgcuggggagcucccggcuccgccugacgggccccgugaccgacgacgcccugcaccgggagcuccgccggcugcgccggcugcucugggaccuggagcagcaggagcugcccgcgaacuaccgccacggccccccggucgccaccagccccuga

SEQ ID NO: 35505 - RNA, 612 nt, Artificial Sequence
  derived and/or modified sequence opt1 from RASL10A__Homo_sapiens__NP_006468
augggcgggagccugcgcguggccguccucggcgcccccggggugggcaagaccgcgaucauccggcaguuccuguucggggacuacccggagcgccaccggcccaccgacggcccccgccuguaccggcccgccgugcuccuggacggcgccgucuacgaccuguccauccgcgacggggacguggccggcccggggagcucccccggcgggcccgaggaguggcccgacgccaaggacuggagccuccaggacacggacgcguucgugcuggucuacgacaucugcuccccggacagcuucgacuacgugaaggcccugcggcagcgcaucgccgagacccggcccgccggcgcgcccgaggcccccauccucguggucggcaacaagcgcgaccggcagcgccugcgguucgggccgcgccgggcccuggccgcccucgugcgccggggcuggcgcugcggguaccuggagugcuccgcgaaguacaacuggcacgugcugcgccucuuccgggagcugcugcggugcgcccucguccgcgcccgccccgcccaccccgcccugcggcugcagggcgcgcuccaccccgcccgcugcagccugauguga

SEQ ID NO: 35506 - RNA, 612 nt, Artificial Sequence
  derived and/or modified sequence opt1 from RASL10B__Homo_sapiens__NP_201572
auggugagcaccuaccgcgucgccgugcugggcgcccgcggggugggcaaguccgcgaucguccggcaguuccucuacaacgaguucagcgaggugugcgugcccaccacggcccggcgccuguaccugccggccgucgugaugaacgggcacgugcacgaccuccagauccuggacuucccgcccaucuccgccuuccccgucaacacccugcaggagugggccgacacgugcugccggggccuccgcagcgugcacgcguacauccugguguacgacaucugcugcuucgacuccuucgaguacgucaagaccauccggcagcagauccuggagacccgcgugaucgggaccagcgagacccccaucaucaucgugggcaacaagcgggaccuccagcgcggccgggucaucccccgcuggaacgugucccaccuggugcggaagaccuggaagugcggguacgucgagugcagcgccaaguacaacuggcacauccugcuccuguucuccgagcugcucaagagcgugggcugcgcccgcugcaagcacgugcacgccgcgcugcgguuccagggggcccugcgccggaaccgcugcgccaucauguga

SEQ ID NO: 35507 - RNA, 729 nt, Artificial Sequence
  derived and/or modified sequence opt1 from RASL11A__Homo_sapiens__NP_996563
augcgcccccugagcauguccggccacuuccuccuggccccgauccccgagagcuccagcgacuaccugcuccccaaggacaucaagcuggccgugcugggggcgggccgggucgggaaguccgccaugaucgugcgcuuccucaccaagcgguucaucggcgacuacgagcccaacaccgggaagcuguacagccgccugguguacgucgagggcgaccagcucucccugcagauccaggacacgccgggcggggugcagauccaggacagccugccccagguggucgacucccucagcaagugcgugcagugggccgagggcuuccugcugguguacuccaucaccgacuacgacagcuaccucuccauccggccccuguaccagcacauccgcaagguccaccccgacagcaaggccccggugaucaucguggggaacaagggcgaccugcuccacgcccggcagguccagacccaggacgggauccagcuggcgaacgagcugggcucccucuuccuggagaucagcaccuccgagaacuacgaggacgugugcgacguguuccagcaccugugcaaggaggucagcaagaugcacggccucuccggggagcgccggcgcgccagcaucaucccccggccccgcagccccaacaugcaggaccugaagcggcgcuucaagcaggcccuguccccgaaggugaaggcccccagcgcgcucggcuga

SEQ ID NO: 35508 - RNA, 747 nt, Artificial Sequence
  derived and/or modified sequence opt1 from RASL11B__Homo_sapiens__NP_076429
augcgccugauccagaacaugugcaccaucgccgaguaccccgccccgggcaacgcggccgccagcgacugcugcgugggggccgccggccggcgccucgucaagaucgcgguggugggggccuccggcgucgggaagaccgcccugguggugcgguuccugacgaagcgcuucaucggcgacuacgagcggaacgccggcaaccucuacacccgccagguccagaucgagggggagacccuggcgcuccaggugcaggacacccccggcauccaggugcacgagaacagccuguccugcagcgagcagcugaaccggugcauccgcugggccgacgccgucgugaucguguucuccaucacggacuacaagagcuacgagcugaucucccagcuccaccagcacguccagcagcugcaccuggggacccggcuccccgugguggucguggccaacaaggccgaccugcugcacaucaagcaggucgacccccagcucggccugcagcuggcgagcaugcucgggugcuccuucuacgaggugagcguguccgagaacuacaacgacguguacagcgccuuccacguccugugcaaggaggugucccacaagcagcagccgagcuccacccccgagaagcgccggaccagccugaucccccgccccaaguccccgaacaugcaggaccucaagcggcgcuucaagcaggcccugagcgccaaggugcggacggucaccuccguguga

SEQ ID NO: 35509 - RNA, 801 nt, Artificial Sequence
  derived and/or modified sequence opt1 from RASL12__Homo_sapiens__NP_057647
augagcuccguguucggcaagccccgcgccgggagcggcccgcaguccgcgccccuggaggugaaccucgccauccuggggcggcgcggcgccggcaagagcgcccugaccgugaaguuccucaccaagcgguucaucuccgaguacgaccccaaccuggaggacacguacagcuccgaggagaccguggaccaccagcccguccaccuccgcgugauggacaccgccgaccuggacaccccgcggaacugcgagcgcuaccugaacugggcccacgcguuccugguggucuacagcguggacucccggcagagcuucgacuccagcuccagcuaccucgagcugcuggcccuccacgccaaggagacgcagcgcuccauccccgcccugcugcucgggaacaagcuggacauggcgcaguaccgccaggugaccaaggccgagggcgucgcccuggccgggcgguucggcugccucuucuucgaggugagcgccugccuggacuucgagcacgugcagcacgucuuccacgaggcggugcgggaggcccgccgggagcuggagaaguccccgcucacccgcccccuguucaucagcgaggagcgggcccugccccaccaggcgccccucaccgcccgccacgggcuggccuccugcacguucaacacccugagcaccaucaaccucaaggagaugcccaccguggcccaggccaagcuggucacggucaagagcucccgggcccagagcaagcgcaaggcccccacccugacccuccugaagggcuucaagaucuucuga

SEQ ID NO: 35510 - RNA, 570 nt, Artificial Sequence
  derived and/or modified sequence opt1 from RASSF1__Homo_sapiens__NP_001193886
augagccugaacaaggacggcuccuacaccggguucaucaaggugcagcucaagcugguccgccccgugagcgugccguccagcaagaagccgcccucccugcaggacgcccggcgcggccccgggcggggcaccagcguccgccggcgcacguccuucuaccuccccaaggacgccgugaagcaccuccacgugcugagccggacccgcgcgcgggaggucaucgaggcccugcugcgcaaguuccuggugguggacgacccccggaaguucgcccucuucgagcgcgccgagcggcacgggcaggucuaccugcgcaagcugcucgacgacgagcagccccugcggcugcgccuccuggccggccccuccgacaaggcgcugagcuucgugcucaaggagaacgacuccggcgaggugaacugggacgccuucagcaugccggagcugcacaacuuccugcggauccuccagcgcgaggaggaggagcaccuccggcagauccugcagaaguacuccuacugccgccagaagauccaggaggcccugcacgccugcccccugggguga

SEQ ID NO: 35511 - RNA, 981 nt, Artificial Sequence
  derived and/or modified sequence opt1 from RASSF2__Homo_sapiens__NP_055552
auggacuacagccaccagaccucccuggugcccugcggccaggacaaguacaucagcaagaacgagcuccugcugcaccucaagaccuacaaccuguacuacgaggggcagaaccugcagcuccgccaccgggaggaggaggacgaguucaucgucgagggccugcugaacaucuccugggggcuccgccggccgauccgccugcagaugcaggacgacaacgagcggauccgcccgccgcccagcuccagcuccuggcacagcggcugcaaccugggggcccagggcacgacccucaagccccugaccgugcccaaggugcagaucuccgaggucgacgccccgcccgagggcgaccagaugcccagcuccaccgacagccgggggcugaagccccuccaggaggacacgccccagcugaugcgcacccgguccgacgugggcgugcgccggcgcgggaacguccggacccccagcgaccagcgccggauccgccggcaccgcuucuccaucaacggccacuucuacaaccacaagaccagcguguucacgcccgcguacggguccgugaccaacguccggaucaacagcaccaugaccacgccccaggugcugaagcuccugcugaacaaguucaagaucgagaacuccgccgaggaguucgcccucuacgugguccacaccagcggcgagaagcagaagcugaaggccaccgacuacccccugaucgcccgcauccuccagggccccugcgagcagaucagcaagguguuccugauggagaaggaccagguggaggaggucaccuacgacguggcgcaguacaucaaguucgagaugccggugcugaaguccuucauccagaagcuccaggaggaggaggaccgggaggucaagaagcugaugcgcaaguacacggugcugcgccucaugauccggcagcgccuggaggagaucgccgagacccccgccaccaucuga

SEQ ID NO: 35512 - RNA, 717 nt, Artificial Sequence
  derived and/or modified sequence opt1 from RASSF3__Homo_sapiens__NP_835463
augagcuccggcuacagcucccuggaggaggacgccgaggacuucuucuucaccgcccgcaccagcuucuuccggcgcgcgccccaggggaagccgcgguccggccagcaggacguggagaaggagaaggagacgcacagcuaccucuccaaggaggagaucaaggagaagguccacaaguacaaccuggccgugaccgacaagcugaagaugacccucaacagcaacgggaucuacaccggcuucaucaaggugcagauggagcugugcaagccgccccagacgucccccaacagcgggaagcugucccccagcuccaacggcugcaugaacacccuccacaucagcuccaccaacaccgucggcgaggugaucgaggcccugcugaagaaguuccucgugacggagagccccgccaaguucgcccuguacaagcgcugccaccgggaggaccaggucuacgcgugcaagcuguccgaccgcgagcacccccucuaccugcggcugguggccgggccccgcaccgacacccucagcuucgugcugcgggagcacgagaucggcgagugggaggccuucucccugccggagcuccagaacuuccugcgcauccuggacaaggaggaggacgagcagcuccagaaccugaagcggcgcuacaccgccuaccggcagaagcuggaggaggcgcuccgcgaggucuggaagcccgacuga

SEQ ID NO: 35513 - RNA, 966 nt, Artificial Sequence
  derived and/or modified sequence opt1 from RASSF4__Homo_sapiens__NP_114412
augaaggaggacugccugcccagcucccacgugccgaucagcgacuccaagagcauccagaaguccgagcuccugggccugcucaagaccuacaacugcuaccacgagggcaagagcuuccagcugcgccaccgggaggaggaggggacccugaucaucgaggggcuccugaacaucgccuggggccugcgccggcccauccgccuccagaugcaggacgaccgggagcagguccaccuccccuccacgagcuggaugccccgccggccguccugcccccugaaggagcccagcccccagaacgggaacaucaccgcccagggcccguccauccagcccgugcacaaggcggagagcuccaccgacagcuccggcccccuggaggaggccgaggaggcgccccagcugaugcgcaccaagagcgacgccuccugcaugagccagcggcgcccgaagugccgggcccccggggaggcccagcgcauccggcgccaccgguucuccaucaacggccacuucuacaaccacaagacgagcguguucacccccgccuacgggagcgucaccaacgugcgcgugaacuccaccaugacgacccugcagguccucacccugcugcucaacaaguuccggguggaggacggccccagcgaguucgcccuguacaucgugcacgaguccggggagcgcaccaagcugaaggacugcgaguacccgcucaucagccggauccugcacggccccugcgagaagaucgcccgcaucuuccugauggaggcggaccucggcgucgaggugccccacgagguggcccaguacaucaaguucgagaugcccguccuggacuccuucguggagaagcugaaggaggaggaggagcgggagaucaucaagcucacgaugaaguuccaggcccugcgccugaccaugcuccagcgccuggagcagcugguggaggccaaguga

SEQ ID NO: 35514 - RNA, 1257 nt, Artificial Sequence
  derived and/or modified sequence opt1 from RASSF5__Homo_sapiens__NP_872604
auggccauggccagccccgcgaucggccagcgcccguacccccugcuccuggaccccgagcccccgcgguaccugcagucccucagcgggcccgagcugcccccgcccccgcccgaccgcuccagccggcugugcgugcccgccccgcucuccaccgcccccggcgcccgcgaggggcggagcgcccgccgggcggcccgcggcaaccuggagcccccgccccgggccucccgccccgcccggccccugcgccccgggcuccagcagcggcugcgccggcgccccggcgcgccccggccccgcgacgugcggagcaucuucgagcagccccaggacccgcgcgugcccgccgagcggggcgaggggcacugcuucgccgagcuggugcuccccggcgggcccggcuggugcgaccugugcgggcgcgagguccugcgccaggcccuccggugcaccaacugcaaguucacgugccacccggagugccgcucccugauccagcuggacugcagccagcaggagggccucucccgggaccgccccagccccgaguccacccugaccgugaccuucagccagaacgugugcaagccggucgaggagacgcagcggccgcccacccugcaggagaucaagcagaagaucgacuccuacaacacccgcgagaagaacugccucggcaugaagcugagcgaggacgggaccuacacgggcuucaucaaggugcaccugaagcuccggcgccccgugaccguccccgccgggauccggccccaguccaucuacgacgcgaucaaggaggugaaccuggccgccaccaccgacaagcgcacgagcuucuaccugccccucgacgccaucaagcagcugcacaucuccagcaccaccaccgugagcgaggucauccagggccugcucaagaaguucauggugguggacaacccccagaaguucgcccuguucaagcggauccacaaggacggccagguccuguuccagaagcucuccaucgcggaccgcccgcuguaccugcggcuccuggccgggcccgacacggaggugcugagcuucgugcucaaggagaacgagaccggcgaggucgagugggacgccuucuccauccccgagcugcagaacuuccugaccauccucgagaaggaggagcaggacaagauccagcagguccagaagaaguacgacaaguuccgccagaagcuggaggaggcccugcgggagagccaggggaagcccggcuga

SEQ ID NO: 35515 - RNA, 912 nt, Artificial Sequence
  derived and/or modified sequence opt1 from RASSF6__Homo_sapiens__NP_001257320
augaccaugauggcccaccaguaccccagcuggaucuucaucaacgagaagaccuucaucacgcgcgagcagcugaacucccuccugaagaccuacaacaucuucuacgagaaccagaagaaccugcacauccucuacggcgagaccgaggacgggaagcugaucguggagggcaugcuggacaucuucuggggcgucaagcggccgauccagcucaagauccaggacgagaagcccuucagcuccuucaccagcaugaaguccagcgacguguucuccagcaaggggaugacgcgcuggggcgaguucgacgaccuguaccggaucuccgagcuggaccgcacccagauccccaugagcgagaagcggaacucccaggaggacuaccucagcuaccacuccaacacccugaagccccacgccaaggacgagccggacagccccgugcuguaccgcaccauguccgaggcggcccucguccggaagcgcaugaagccccugaugauggaccggaaggagcgccagaagaaccgggccagcaucaacgggcacuucuacaaccacgagaucgagaacagcccccaggacuucgcccugcacaucaucuucgccacgggcgagcagcgccggcucaagaagaccgacaucccgcugcugcagcgccuccugcaggggcccuccgagaagaacgcgcggaucuuccugauggacaaggacgccgaggagaucuccagcgacguggcccaguacaucaacuuccacuucagccuccuggaguccauccugcagcgccucaacgaggaggagaagcgggagauccagcgcaucgugaccaaguucaacaaggagaaggccaucauccugaagugccugcagaacaagcucgucaucaagaccgagacgaccguguga

SEQ ID NO: 35516 - RNA, 1014 nt, Artificial Sequence
  derived and/or modified sequence opt1 from RASSF7__Homo_sapiens__NP_001137465
augcugcucggccuggccgccauggagcugaaggugugggucgacgggauccagcgcguggugugcggcgucagcgagcagacgaccugccaggagguggugaucgcgcucgcccaggccaucgggcagaccggccgguucguccuggugcagcgccugcgggagaaggagcgccagcuccugccccaggagugccccgugggggcccaggcgaccugcggccaguucgccuccgacguccaguucgugcugcggcgcaccggccccagccucgccgggcggcccuccagcgacuccugcccgccgcccgagcgcugccugauccgggccagccugcccgugaagccccgcgccgcgcucggcugcgagccccggaagacccugacgcccgagcccgcccccucccugagccgcccggggcccgccgcccccgucacccccaccccgggcugcugcaccgaccuccgggggcuggagcugcgcgugcagcggaacgccgaggagcucggccacgaggcguucugggagcaggagcugcgccgggagcaggcccgcgagcgggagggccaggcccgccugcaggcccucuccgccgcgacggccgagcacgccgcccggcugcaggcccuggacgcgcaggcccgcgcccucgaggccgagcugcagcuggccgcggaggcccccgggccgcccagccccauggccuccgccaccgagcgccuccaccaggaccuggcggugcaggagcggcagagcgccgagguccagggcucccuggcccucgugagccgcgcccuggaggccgcggagcgggcccugcaggcccaggcccaggagcucgaggagcugaaccgcgagcugcggcagugcaaccuccagcaguucauccagcagaccggggccgcgcugcccccgccgccccgccccgaccggggcccgcccggcacccaggugggggucgugcugggcgggggcugggaggugcgcacguggcccucccccacccccagcuga

SEQ ID NO: 35517 - RNA, 1260 nt, Artificial Sequence
  derived and/or modified sequence opt1 from RASSF8__Homo_sapiens__NP_001158219
auggagcugaaggugugggucgacggcgugcagcgcaucgugugcggggucaccgaggugaccacgugccaggagguggucaucgcccucgcccaggcgaucggccggaccgggcgcuacacccugaucgagaaguggcgggacaccgagcgccaccuggcgccccacgagaacccgaucaucagccucaacaaguggggccaguacgccuccgacgugcagcugauccugcggcgcacggggcccagccucuccgagcggcccaccagcgacuccguggcccgcauccccgagcggacccuguaccgccagagccugccgccccucgccaagcugcggccccagaucgacaaguccaucaagcgccgggagcccaagcgcaagagccugaccuucacgggcggcgcgaaggggcucauggacaucuucggcaaggggaaggagaccgaguucaagcagaagguccugaacaacugcaagaccaccgccgacgagcugaagaagcucauccggcugcagacggagaagcugcaguccaucgagaagcagcucgagagcaacgagaucgagauccgcuucugggagcagaaguacaacuccaaccuggaggaggagaucgugcggcuggagcagaagaucaagcgcaacgacguggagaucgaggaggaggaguucugggagaacgagcuccagaucgagcaggagaacgagaagcagcugaaggaccagcugcaggagauccggcagaagaucaccgagugcgagaacaagcucaaggacuaccuggcccagauccgcaccauggagagcggccuggaggccgagaagcuccagcgggagguccaggaggcccaggugaacgaggaggaggugaaggggaagaucggcaaggucaagggcgagaucgacauccaggggcagcagucccugcgccuggagaacggcaucaaggccguggagcgcagccucgggcaggccaccaagcggcugcaggacaaggagcaggagcuggagcagcucacgaaggagcugcgccaggugaaccugcagcaguucauccagcagaccggcaccaaggucaccgugcucccggccgagcccaucgagaucgaggccucccacgcggacaucgagcgggaggcccccuuccagagcggcucccugaagcgccccgggagcucccggcagcugccgagcaaccuccgcauccugcagaaccccaucagcuccggcuucaaccccgaggggaucuacguguga

SEQ ID NO: 35518 - RNA, 555 nt, Artificial Sequence
  derived and/or modified sequence opt1 from RAX2__Homo_sapiens__NP_116142
auguuccugagccccggcgaggggcccgccaccgagggcgggggccucgggcccggcgaggaggcccccaagaagaagcaccgccggaaccgcaccacguucaccaccuaccagcugcaccagcuggagcgggcguucgaggccucccacuaccccgacguguacagccgcgaggagcucgccgccaagguccaccucccggaggugcgggugcaggucugguuccagaaccgccgggccaaguggcgccggcaggagcgccuggaguccggcagcggggcgguggccgcgccccggcugcccgaggcccccgcccugccguucgcccgcccgcccgccaugucccugccccucgagcccuggcugggccccgggccgcccgccgugcccggccugccccggcuccuggggcccggccccggccugcaggccagcuucgggccgcacgcguucgcccccaccuucgccgacggcuucgcccucgaggaggccucccugcgccugcucgcgaaggagcacgcccaggcccuggaccgggccuggccgcccgccuga

SEQ ID NO: 35519 - RNA, 1041 nt, Artificial Sequence
  derived and/or modified sequence opt1 from RAX__Homo_sapiens__NP_038463
augcaccuccccggcugcgcccccgccauggcggacgggagcuucucccucgccggccaccuccugcgcagccccgggggcuccaccagccggcuccacuccaucgaggccauccugggguucaccaaggacgacggcauccugggcacguuccccgccgagcgcggggcccggggcgcgaaggagcgcgaccggcgccucggggcccggcccgccugccccaaggcccccgaggagggcagcgagcccagcccgccgcccgcgcccgcccccgccccggaguacgaggcgccccgccccuacugccccaaggagccgggggaggcccggcccucccccggccugcccgugggccccgccaccggggaggccaagcuguccgaggaggagcagcccaagaagaagcaccgccggaaccgcaccaccuucacgaccuaccagcugcacgagcuggagcgggccuucgagaagucccacuaccccgacgucuacagccgcgaggagcuggccggcaaggugaaccugcccgaggugcggguccaggugugguuccagaaccgccgggccaaguggcgccggcaggagaagcuggaggugagcuccaugaagcugcaggacagcccccuccuguccuucagccgcuccccgcccagcgcgacccugagcccccucggggccggccccggcuccgggggcgggcccgccggcggggcccugccccuggagagcuggcucggcccgccccugcccggcgggggcgccaccgcgcugcagucccuccccggguucggcccgcccgcccagagccugcccgccuccuacacgcccccgcccccgccgccgcccuuccugaacagcccgccccucgggcccggccugcagccccuggccccgccgccgcccuccuaccccugcggccccggguucggcgacaaguucccccucgacgaggccgacccccggaacagcuccaucgcggcccugcgccugaaggccaaggagcacauccaggccaucgggaagcccuggcaggcgcucuga

SEQ ID NO: 35520 - RNA, 4776 nt, Artificial Sequence
  derived and/or modified sequence opt1 from RB1CC1__Homo_sapiens__NP_001077086
augaagcuguacguguuccucgucaacaccggcaccacgcugaccuucgacaccgagcugaccgugcagacgguggccgaccucaagcacgccauccagagcaaguacaagaucgcgauccagcaccagguccugguggugaacgggggcgagugcauggccgccgaccgccgggucugcaccuacuccgccgggaccgacaccaaccccaucuuccuguucaacaaggagaugauccucugcgaccgcccgcccgccauccccaagacgaccuucagcaccgagaacgacauggagaucaagguggaggagucccugaugaugcccgcgguguuccacaccgucgccagccggacgcagcuggcccucgagauguacgagguggccaagaagcugugcuccuucugcgagggccuggugcacgacgagcaccuccagcaccaggggugggcggccaucauggccaaccuggaggacugcagcaacuccuaccagaagcuccucuucaaguucgagagcaucuacuccaacuaccugcagagcaucgaggacaucaagcugaagcucacccaccugggcaccgccgucuccgugauggccaagaucccgcugcucgagugccugacccgccacagcuaccgggagugccugggccgccucgacucccugcccgagcacgaggacagcgagaaggcggagaugaagcgguccacggagcuggugcucagccccgacaugccccgcaccaccaacgagucccugcugaccagcuucccgaaguccgucgagcacgugagccccgacacggccgacgccgagagcgggaaggagauccgggaguccugccagagcaccgugcaccagcaggacgagaccaccaucgacacgaaggacggcgaccuccccuucuucaacgucucccugcuggacuggaucaacgugcaggaccgccccaacgacguggagagccucguccggaagugcuucgacuccaugagccgccuggacccgcggaucauccgccccuucaucgccgagugccggcagaccaucgccaagcuggacaaccagaacaugaaggcgaucaaggggcucgaggaccgccuguacgcccuggaccagaugaucgccuccugcggccggcucgugaacgagcagaaggagcuggcccagggguuccuggccaaccagaagcgcgcggagaaccucaaggacgccagcgugcugcccgaccugugccucucccacgccaaccagcugaugaucaugcugcagaaccaccggaagcuccuggacaucaagcagaagugcaccaccgccaagcaggagcuggccaacaaccugcacguccgccucaaguggugcugcuucgugaugcugcacgcggaccaggacggcgagaagcugcaggcccuccugcggcuggucaucgagcuccuggagcgcgugaagaucguggaggcccugagcacggucccccagauguacugccucgccgugguggaggucgugcgccggaagauguucaucaagcacuaccgcgagugggcgggcgcccuggugaaggacgggaagcggcuguacgaggccgagaaguccaagcgcgagagcuucggcaagcuguuccggaaguccuuccugcgcaaccggcuguuccgcgggcucgacagcuggccgcccuccuucugcacccagaagccccggaaguucgacugcgagcugcccgacaucagccugaaggaccuccaguuccugcaguccuucugcccgagcgagguccagcccuuccugcgcgugccccuccugugcgacuucgagccccugcaccagcacgugcucgcccugcacaaccuggucaaggccgcgcagucccucgacgagaugagccagaccaucaccgaccugcugagcgagcagaaggccuccgugagccagacguccccgcagagcgccuccagcccccggauggaguccaccgccggcaucaccaccacgaccagcccccgcacgcccccgccccucaccgugcaggacccccugugcccggccgucugcccccuggaggagcucucccccgacagcaucgacgcgcacaccuucgacuucgagaccaucccccacccgaacaucgagcagaccauccaccaggugucccuggaccuggacagccucgccgagucccccgagagcgacuucauguccgccgugaacgaguucgucaucgaggagaaccugagcucccccaaccccaucagcgacccgcagagccccgagaugaugguggagucccuguacagcuccgugaucaacgccaucgacagccggcgcaugcaggacaccaacgucugcggcaaggaggacuucggggaccacaccucccucaacgugcagcuggagcggugccgcguggucgcccaggacagccacuucuccauccagacgaucaaggaggaccugugccacuuccggaccuucgugcagaaggagcagugcgacuucagcaacucccucaagugcaccgcgguggagauccgcaacaucaucgagaaggucaagugcagccuggagaucacccugaaggagaagcaccagaaggagcuccugucccugaagaacgaguacgagggcaagcucgacgggcugaucaaggagacggaggagaacgagaacaagaucaagaagcugaagggcgagcucgugugccuggaggaggugcugcagaacaaggacaacgaguucgcccucgucaagcacgagaaggaggccgugaucugccugcagaacgagaaggaccagaagcugcucgagauggagaacaucaugcacagccagaacugcgagaucaaggagcugaagcagucccgggagaucgugcuggaggaccucaagaagcugcacgucgagaacgacgagaagcugcagcuccugcgcgccgagcugcagagccucgagcagucccaccugaaggagcuggaggacacccuccaggugcgccacauccaggaguucgagaaggugaugaccgaccaccgggucagccuggaggagcugaagaaggagaaccagcagaucaucaaccagauccaggagucccacgcggagaucauccaggagaaggagaagcagcuccaggagcugaagcugaaggugagcgaccucuccgacacccgcugcaagcuggagguggagcuggcccucaaggaggccgagacggacgagaucaagauccugcuggaggagagccgggcccagcagaaggagacccucaagagccugcuggagcaggagaccgagaaccuccgcaccgagaucuccaagcugaaccagaagauccaggacaacaacgagaacuaccaggucgggcuggccgagcuccggacgcugaugaccaucgagaaggaccagugcaucagcgagcugaucucccgccacgaggaggagagcaacauccucaaggcggagcugaacaaggugaccucccugcacaaccaggccuucgagaucgagaagaaccucaaggagcagaucaucgagcugcagagcaagcuggacuccgagcugagcgcccucgagcggcagaaggacgagaagaucacccagcaggaggagaaguacgaggccaucauccagaaccuggagaaggaccgccagaagcugguguccagccaggagcaggaccgggagcagcucauccagaagcugaacugcgagaaggacgaggccauccagacggcgcugaaggaguucaagcucgagcgcgaggucguggagaaggagcugcuggagaaggugaagcaccucgagaaccagaucgccaagucccccgccaucgacagcacccggggcgacuccagcucccuggucgccgagcugcaggagaagcuccaggaggagaaggccaaguuccuggagcagcuggaggagcaggagaagcgcaagaacgaggagaugcagaacgugcggaccagccucaucgcggagcagcagaccaacuucaacacggugcugacccgcgagaagaugcggaaggagaacaucaucaacgaccuguccgacaagcucaagagcaccaugcagcagcaggagcgcgacaaggaccugaucgagucccugagcgaggaccgggcccgccuccuggaggagaagaagaagcuggaggaggaggucagcaagcuccgguccagcuccuucgugcccagcccguacguggccaccgcccccgagcuguacggcgcgugcgcccccgagcugcccggggaguccgaccgcagcgccgucgagacggccgacgagggccggguggacuccgccauggagaccagcaugauguccguccaggagaacauccacaugcucagcgaggagaagcagcgcaucaugcugcuggagcgcacccuccagcugaaggaggaggagaacaagcggcugaaccagcgccucaugucccagagcauguccagcguguccagccggcacuccgagaagaucgcgauccgcgacuuccaggugggggaccugguccugaucauccucgacgagcggcacgacaacuacgugcuguucaccgugagcccgacgcuguacuuccuccacuccgagagccugcccgcccuggaccucaagcccgccagcggcgccucccgccggcccuggguccuggggaaggugauggagaaggaguacugccaggccaagaaggcgcagaaccgcuucaaggugccgcugggcaccaaguucuaccgggucaaggccgugagcuggaacaagaagguguga

SEQ ID NO: 35521 - RNA, 2787 nt, Artificial Sequence
  derived and/or modified sequence opt1 from RB1__Homo_sapiens__NP_000312
augcccccgaagacgccccgcaagaccgccgccaccgcggccgccgccgccgcggagccgcccgccccgcccccgccgcccccgcccgaggaggaccccgagcaggacagcggccccgaggaccugccccucgugcggcuggaguucgaggagaccgaggagcccgacuucaccgcccugugccagaagcucaagauccccgaccacguccgcgagcgggccuggcugaccugggagaagguguccagcguggacgggguccugggcggguacauccagaagaagaaggagcucuggggcaucugcaucuucaucgcggccguggaccuggacgagauguccuucacguucaccgagcugcagaagaacaucgagaucagcgugcacaaguucuucaaccuccugaaggagaucgacaccuccaccaaggucgacaacgccaugagccgccugcucaagaaguacgacgugcuguucgcccuguucuccaagcucgagcggacgugcgagcugaucuaccugacccagcccagcuccagcaucuccaccgagaucaacagcgcccucgugcugaaggucuccuggaucaccuuccugcucgcgaagggggaggugcugcagauggaggacgaccuggugaucagcuuccagcucaugcugugcguccuggacuacuucaucaagcucuccccgcccaugcugcugaaggagcccuacaagacggccgugauccccaucaacggcagcccccgcacgccccggcgcggccagaaccgguccgcccgcaucgccaagcagcucgagaacgacacccggaucaucgaggugcugugcaaggagcacgagugcaacaucgacgaggucaagaacguguacuucaagaacuucauccccuucaugaacagccuggggcucgugaccuccaacggccugcccgaggucgagaaccugagcaagcgcuacgaggagaucuaccugaagaacaaggaccuggacgcccggcuguuccucgaccacgacaagacccugcagaccgacagcaucgacuccuucgagacccagcgcacgccccgcaagagcaaccuggacgaggaggugaacgugaucccgccccacacccccguccggaccgugaugaacaccauccagcagcucaugaugauccugaacuccgcgagcgaccagcccuccgagaaccugaucagcuacuucaacaacugcaccgugaaccccaaggaguccauccucaagcgggucaaggacaucggguacaucuucaaggagaaguucgccaaggccgugggccaggggugcgucgagaucggcagccagcgcuacaagcugggcgugcggcuguacuaccgcgugauggaguccaugcucaagagcgaggaggagcggcuguccauccagaacuucagcaagcugcugaacgacaacaucuuccacaugucccuccuggccugcgcccuggaggucgugauggcgacguacagccgcuccaccagccagaaccucgacuccgggaccgaccugagcuucccguggauccugaacgugcucaaccugaaggccuucgacuucuacaaggucaucgaguccuucaucaaggccgagggcaaccugacccgcgagaugaucaagcaccucgagcggugcgagcaccgcaucauggagagccuggccuggcugagcgacagcccccucuucgaccugaucaagcaguccaaggaccgggaggggcccacggaccaccuggaguccgccugcccccucaaccugccgcugcagaacaaccacaccgcggccgacauguaccucagccccgugcgcucccccaagaagaagggcagcaccacccgggugaacuccacggccaacgccgagacccaggcgaccagcgccuuccagacccagaagccccugaaguccacgagccugucccucuucuacaagaaggucuaccgccuggccuaccugcggcucaacacccugugcgagcgccugcucagcgagcacccggagcuggagcacaucaucuggacccuguuccagcacacccuccagaacgaguacgagcugaugcgggaccgccaccuggaccagaucaugaugugcuccauguacggcaucugcaaggugaagaacaucgaccucaaguucaagaucaucgugaccgccuacaaggaccugccccacgccguccaggagacguucaagcgggugcugaucaaggaggaggaguacgacagcaucaucguguucuacaacuccgucuucaugcagcgccucaagaccaacauccugcaguacgcgagcacccggccgcccacccugucccccaucccccacaucccccgcagccccuacaaguucccgagcagcccccuccggauccccgggggcaacaucuacaucagcccccugaaguccccguacaagaucuccgaggggcugcccacgcccaccaagaugacgccccgcucccggauccucgugagcaucggcgaguccuucgggaccagcgagaaguuccagaagaucaaccagauggugugcaacuccgaccgcguccugaagcggagcgccgagggcuccaacccgcccaagccccugaagaagcuccgcuucgacaucgagggcagcgacgaggccgacggguccaagcaccucccgggcgagagcaaguuccagcagaagcuggccgagaugaccuccacccgcacccggaugcagaagcagaagaugaacgacagcauggacaccuccaacaaggaggagaaguga

SEQ ID NO: 35522 - RNA, 2145 nt, Artificial Sequence
  derived and/or modified sequence opt1 from RBAK__Homo_sapiens__NP_066986
augaacacccugcagggccccgugagcuucaaggacgucgccguggacuucacccaggaggaguggcagcagcucgacccggacgagaagaucacguaccgcgacgugaugcuggagaacuacucccaccuggucagcgugggguacgacaccaccaagcccaacgugaucaucaagcucgagcagggcgaggagcccuggaucaugggcggggaguuccccugccagcacuccccggaggccuggcgggucgacgaccugaucgagcgcauccaggagaacgaggacaagcacagccggcaggcggccugcaucaacuccaagacccugacggaggagaaggagaacaccuucagccagaucuacauggagaccucccucgugcccagcuccaucaucgcccacaacugcgugagcugcgggaagaaccuggaguccaucagccagcugaucuccagcgacggcuccuacgcccgcaccaagcccgacgagugcaacgagugcggcaagacguaccacggggagaagaugugcgaguucaaccagaacggcgacaccuacagccacaacgaggagaacauccuccagaagaucuccauccuggagaagcccuucgaguacaacgagugcauggaggcccuggacaacgaggcggucuucaucgcccacaagcgggccuacaucggggagaagccguacgaguggaacgacagcggccccgacuucauccagauguccaacuucaacgccuaccagcgcagccagauggagaugaagcccuucgagugcagcgagugcgggaaguccuucugcaagaaguccaaguucaucauccaccagcgggcgcacaccggcgagaagcccuacgagugcaacgugugcggcaagagcuucagccagaaggggacccucacggugcaccgccggucccaccuggaggagaagccguacaagugcaacgagugcggcaagaccuucugccagaagcugcaccucacccagcaccuccgcacccacagcggggagaagcccuacgagugcuccgagugcggcaagacguucugccagaagacccaccugacccuccaccagcggaaccacagcggcgagcgccccuaccccugcaacgagugcgggaaguccuucagccggaaguccgcccugagcgaccaccagcgcacccacacgggcgagaagcuguacaagugcaacgagugcgggaaguccuacuaccgcaagagcacccucaucacccaccagcggacccacacgggcgagaagccguaccagugcuccgagugcgggaaguucuucagccgggucuccuaccugaccauccacuaccgcagccaccuggaggagaagcccuacgagugcaacgagugcggcaagaccuucaaccucaacuccgccuucauccggcaccgcaaggugcacaccgaggagaagucccacgagugcagcgagugcggcaaguucagccagcuguaccugacggaccaccacaccgcccaccucgaggagaagcccuacgagugcaacgagugcgggaagaccuuccuggugaacagcgccuucgacggccaccagccccugccgaagggggagaaguccuacgagugcaacgucugcggcaagcuguucaacgagcugagcuacuacaccgagcacuaccggucccacagcgaggagaagcccuacgggugcuccgagugcggcaagacguucagccacaacuccagccuguuccgccaccagcgcgugcacaccggcgagaagcccuacgagugcuacgagugcgggaaguucuucucccagaaguccuaccucaccauccaccaccggauccacagcggcgagaagcccuacgagugcagcaagugcgggaagguguucucccgcaugagcaaccugaccguccacuaccggucccacagcggcgagaagccguacgagugcaacgagugcgggaagguguucagccagaaguccuaccugacggugcacuaccgcacccacagcggcgagaagcccuacgagugcaacgagugcggcaagaaguuccaccaccgguccgcguucaacagccaccagcgcauccaccggcgcgggaacaugaacguccucgacguggagaaccuguga

SEQ ID NO: 35523 - RNA, 1503 nt, Artificial Sequence
  derived and/or modified sequence opt1 from RBBP5__Homo_sapiens__NP_001180201
augaaccuggagcuccuggagagcuucggccagaacuaccccgaggaggccgacgggacccuggacugcaucuccauggcccugaccugcacguucaaccgcuggggcacccuccuggcgguggggugcaacgacggccggaucgucaucugggacuuccucacccgcgggaucgccaagaucaucagcgcccacauccacccggugugcucccugugcuggagccgggacggccacaagcugguguccgccagcaccgacaacaucgucucccagugggacgugcucagcggcgacugcgaccagcgcuuccgguuccccucccccauccugaaggugcaguaccacccccgcgaccagaacaagguccuggugugcccgaugaaguccgcccccgugaugcucacgcugagcgacagcaagcacgucgugcugcccguggacgacgacuccgaccucaacgucguggcgagcuucgaccggcgcggggaguacaucuacaccggcaacgccaaggggaagauccuggugcugaagaccgacucccaggaccucgucgccagcuuccgggugaccacgggcaccuccaacaccaccgccaucaagagcaucgaguucgcgcgcaagggguccugcuuccugaucaacacggccgaccggaucauccgcguguacgacggccgggagauccugaccugcggccgcgacggggagcccgagccgaugcagaagcuccaggaccuggucaaccggacccccuggaagaagugcugcuucagcggcgacggggaguacaucguggccggcagcgcccgccagcacgcccuguacaucugggagaaguccaucggcaaccucgugaagauccugcacgggacccggggcgagcugcuccuggacgucgcguggcaccccgugcgccccaucaucgccagcaucuccagcgggguggucuccaucugggcccagaaccagguggagaacuggagcgccuucgccccggacuucaaggagcuggacgagaacgucgaguacgaggagcgggaguccgaguucgacaucgaggacgaggacaagagcgagcccgagcagacgggcgcggacgccgccgaggacgaggagguggacgugaccuccgucgaccccaucgccgccuucugcagcuccgacgaggagcucgaggacagcaaggcgcugcuguaccuccccaucgccccggagguggaggaccccgaggagaaccccuacgggcccccgcccgacgccgugcagaccucccugauggacgagggcgccagcuccgagaagaagcgccagagcuccgccgacggcagccagccgcccaagaagaagcccaagaccacgaacaucgagcugcaggggguccccaacgacgaggugcacccccuccugggcgugaagggggacggcaaguccaagaagaagcaggcggggcggcccaagggcagcaaggccggcggggccaucagcgagcugcucuga

SEQ ID NO: 35524 - RNA, 5379 nt, Artificial Sequence
  derived and/or modified sequence opt1 from RBBP6__Homo_sapiens__NP_008841
augagcugcgugcacuacaaguucuccagcaagcugaacuacgacaccgucaccuucgacggccuccacaucucccugugcgaccugaagaagcagaucauggggcgcgagaagcucaaggccgccgacugcgaccugcagaucacgaacgcgcagaccaaggaggaguacaccgacgacaacgcccugauccccaagaacagcuccgugaucgugcggcgcaucccgaucggcggggucaagagcaccuccaagacguacgugaucagccggaccgagcccgccauggccaccaccaaggccaucgacgacuccagcgcguccaucagccucgcccagcugacgaagaccgccaaccuggccgaggcgaacgccuccgaggaggacaagaucaaggccaugaugagccaguccggccacgaguacgaccccaucaacuacaugaagaagccccucgggccgcccccccccagcuacaccugcuuccgcugcggcaagccgggccacuacaucaagaacugccccaccaacggggacaagaacuucgaguccggcccccggaucaagaagagcacggggaucccccgcuccuucaugauggaggugaaggacccgaacaugaagggcgccaugcugaccaacaccgggaaguacgccauccccaccaucgacgcggaggccuacgccaucggcaagaaggagaagccccccuuccugccggaggagcccagcagcuccagcgaggaggacgaccccauccccgacgagcuccugugccugaucugcaaggacaucaugacggacgccgucgugaucccgugcugcggcaacuccuacugcgacgagugcauccggaccgcccuccuggagagcgacgagcacaccugccccaccugccaccagaacgacgugucccccgacgcgcugaucgccaacaaguuccuccgccaggccgucaacaacuucaagaacgagacgggguacaccaagcggcugcgcaagcagcugcccccgcccccccccccgaucccccccccgcggccccucauccagcgcaaccugcagccccugaugcggagccccaucucccgccagcaggacccgcucaugauccccgugaccagcuccagcacccaccccgcccccuccaucagcucccugacgagcaaccaguccagccuggccccgcccguguccggcaaccccagcuccgcgcccgccccgguccccgacaucaccgccaccgugagcaucagcgugcacuccgagaagagcgacgggcccuuccgggacuccgacaacaagauccuccccgccgccgcgcuggccagcgagcacuccaagggcaccagcuccaucgccaucacggcccugauggaggagaagggcuaccaggucccggugcucgggacccccagccugcugggccagucccuccugcacgggcagcugauccccaccaccggccccgugcgcaucaacacggcgcggccggggggcggccgccccgggugggagcacagcaacaagcucggcuaccuggucucccccccccagcagauccggcgcggggagcggagcugcuaccgcuccaucaaccgcggccggcaccacagcgagcgcucccagcggacccaggggccgagccugcccgccacccccguguucgugccgguccccccccccccgcucuaccccccccccccgcacacccugccccugccccccggcgugccgcccccccaguucuccccccaguucccgcccggccagccccccccggccggguacagcgugcccccccccggcuucccgcccgcccccgccaaccucagcacgcccugggucuccagcggggugcagaccgcgcacuccaacaccaucccgaccacccaggcccccccccugagccgcgaggaguucuaccgggagcagcgccggcugaaggaggaggagaagaagaaguccaagcucgacgaguucacgaacgacuucgccaaggagcugauggaguacaagaagauccagaaggagcgccggcgcagcuucucccggagcaaguccccguacagcggcuccagcuacucccgcagcuccuacaccuacagcaagucccggagcggguccacccgcagccggagcuacucccgcagcuucucccggagccacucccgcagcuacucccggagcccccccuacccccgccgcggccggggcaagucccgcaacuaccggagccgcucccggagccacggguaccaccgcucccggagccgcuccccgcccuaccggcgcuaccacagccggucccgcagcccccaggccuuccggggccagucccccaacaagcgcaacgucccgcagggggagaccgagcgggaguacuucaaccgcuaccgggaggugcccccccccuacgacaugaaggccuacuacggccgcagcguggacuuccgggacccguucgagaaggagcgcuaccgggagugggagcgcaaguaccgcgagugguacgagaaguacuacaagggcuacgcggccggggcccagccccggcccagcgccaaccgcgagaacuucucccccgagcgguuccugccgcucaacauccgcaacagccccuucacgcggggccgccgggaggacuacgucgggggccagucccaccgcagccggaacaucggguccaacuaccccgagaagcugagcgcccgcgacggccacaaccagaaggacaacaccaaguccaaggagaaggagagcgagaacgcgcccggcgacgggaagggcaacaagcacaagaagcaccggaagcgccggaagggggaggaguccgagggcuuccugaacccggagcugcucgagaccagccgcaagucccgggagcccaccgggguggaggagaacaagacggacagccuguucgugcugcccucccgcgacgacgccacccccguccgggacgagccgauggacgccgagagcaucaccuucaaguccgugagcgagaaggacaagcgcgagcgggacaagcccaaggccaagggcgacaagaccaagcgcaagaacgacggcuccgcggugagcaagaaggagaacaucgucaagcccgccaaggggccccaggagaagguggacggcgagcgcgagcgguccccgcgcagcgagccccccaucaagaaggccaaggaggagacgccgaagaccgacaacaccaagagcuccagcuccagccagaaggacgagaagaucaccgggacgccccggaaggcccacuccaagagcgccaaggagcaccaggagaccaagcccgugaaggaggagaaggucaagaaggacuacuccaaggacgugaagagcgagaagcucaccaccaaggaggagaaggcgaagaagcccaacgagaagaacaagccgcuggacaacaagggcgagaagcgcaagcggaagacggaggagaaggggguggacaaggacuucgaguccagcuccaugaagaucagcaagcuggaggucaccgagaucgugaagcccucccccaagcgcaagauggagcccgacaccgagaagauggaccggaccccggagaaggacaagaucagccucuccgcccccgccaagaagaucaagcugaaccgcgagacgggcaagaagaucggcagcaccgagaacaucuccaacaccaaggagcccagcgagaagcuggaguccaccagcagcaaggugaagcaggagaaggucaaggggaaggugcggcgcaaggugacgggcaccgagggguccagcuccacccucgucgacuacaccagcacguccagcaccggcgggucccccgugcggaagagcgaggagaagaccgacaccaagcgcacggugaucaagaccauggaggaguacaacaacgacaacaccgccccggccgaggacgucaucaucaugauccaggugccccaguccaagugggacaaggacgacuucgagagcgaggaggaggacgugaaguccacccagcccaucagcuccgucggcaagcccgcgagcgugaucaagaacguguccaccaagccgagcaacaucgucaaguaccccgagaaggaguccgagcccagcgagaagauccagaaguucacgaaggacgugucccacgagaucauccagcacgaggugaagagcagcaagaacuccgccagcuccgagaagggcaagaccaaggaccgggacuacagcguccuggagaaggagaaccccgagaagcgcaagaacuccacccagccggagaaggagagcaaccuggaccggcucaacgagcaggggaacuucaagucccugagccaguccagcaaggaggcccgcaccuccgacaagcacgacagcacgcgggccuccagcaacaaggacuucacccccaaccgcgacaagaagaccgacuacgacacccgggaguacuccagcuccaagcgccgggacgagaagaacgagcugacgcgccgcaaggacagccccagccggaacaaggacuccgccagcggccagaagaacaagccccgcgaggagcgggaccucccgaagaaggggaccggcgacuccaagaagagcaacuccagccccucccgcgaccggaagccccacgaccacaaggcgaccuacgacaccaagcgcccgaacgaggagacgaagagcguggacaagaaccccugcaaggaccgggagaagcacgugcuggaggcccgcaacaacaaggaguccagcggcaacaagcugcucuacauccugaacccccccgagacccaggucgagaaggagcagaucaccgggcagaucgacaaguccaccgugaagccgaagccccagcugagccacuccagccggcucuccagcgaccugacgcgcgagaccgacgaggccgccuucgagcccgacuacaacgaguccgacagcgaguccaacgugagcgucaaggaggaggagagcuccggcaacaucagcaaggaccugaaggacaagaucguggagaaggcgaaggagucccucgacaccgccgccgugguccagguggggaucagccggaaccagucccacagcucccccagcguguccccgagccgcucccacagccccuccggcagccagacccggucccacagcuccagcgccuccagcgccgagagccaggacuccaagaagaagaagaagaagaaggagaagaagaagcacaagaagcacaagaagcacaagaagcacaagaagcacgcggggacggaggucgagcuggagaagagccagaagcacaagcacaagaagaagaaguccaagaagaacaaggacaaggagaaggagaaggagaaggacgaccagaaggugaagagcgugaccgucuga

SEQ ID NO: 35525 - RNA, 1410 nt, Artificial Sequence
  derived and/or modified sequence opt1 from RBBP7__Homo_sapiens__NP_001185648
auggccgccgaggcgggcguggucggggccggcgccagccccgacggggacuggcgcgaccaggccugcggccugcuccugcacgugcaccuguccagccggcucgggcgcgccgcgccggugcggaccggccgccaccuccggaccgucuucgaggacacgguggaggagcgcgugaucaacgaggaguacaagaucuggaagaagaacacccccuuccuguacgaccuggucaugacccacgcccugcaguggcccucccugaccgugcaguggcuccccgaggugacgaagccggagggcaaggacuacgcccugcacuggcugguccucgggacccacaccagcgacgagcagaaccaccuggugguggcccggguccacauccccaacgacgacgcgcaguucgacgccucccacugcgacagcgacaagggcgaguucgggggcuucggguccgugaccggcaagaucgagugcgagaucaagaucaaccacgagggcgaggugaaccgcgcccgguacaugccccagaacccccacaucaucgccacgaagaccccgagcuccgacguccugguguucgacuacaccaagcaccccgccaagcccgaccccagcggggagugcaacccggaccuccgccugcggggccaccagaaggagggguacggccuguccuggaacagcaaccucuccggccaccuccugagcgcguccgacgaccacaccgugugccugugggacaucaacgccgggcccaaggagggcaagaucgucgacgccaaggccaucuucacggggcacagcgccgugguggaggacgucgcguggcaccuccugcacgagucccuguucggcagcguggccgacgaccagaagcugaugaucugggacacccgcuccaacaccaccagcaagcccagccaccugguggacgcccacacggccgaggucaacugccucuccuucaaccccuacagcgaguucauccuggccaccggguccgcggacaagaccguggcccugugggaccuccggaaccugaagcugaagcuccacaccuucgagagccacaaggacgagaucuuccagguccacugguccccgcacaacgagacgauccuggccagcuccggcaccgaccgccggcugaacgugugggaccucagcaagaucggcgaggagcaguccgccgaggacgccgaggacgggccgcccgagcugcuguucauccacggcgggcacaccgcgaagaucagcgacuucuccuggaaccccaacgagcccugggugaucugcagcgucuccgaggacaacaucaugcagaucuggcagauggccgagaacaucuacaacgacgaggagagcgacgugaccacguccgagcucgagggccaggggagcuga

SEQ ID NO: 35526 - RNA, 2604 nt, Artificial Sequence
  derived and/or modified sequence opt1 from RBBP8__Homo_sapiens__NP_976037
augaacaucagcggcuccagcugcgggucccccaacagcgccgacaccuccagcgacuucaaggaccuguggaccaagcucaaggagugccacgaccgcgaggugcagggccugcaggucaaggugacgaagcugaagcaggagcggauccucgacgcccagcgccuggaggaguucuucaccaagaaccagcagcugcgggagcagcagaaggugcuccacgagaccaucaagguccuggaggaccgccugcgggcggggcucugcgaccgcugcgccgugaccgaggagcacaugcggaagaagcagcaggaguucgagaacauccgccagcagaaccugaagcugaucacggagcucaugaacgagcggaacacccugcaggaggagaacaagaagcuguccgagcagcuccagcagaagaucgagaacgaccagcagcaccaggccgccgagcuggagugcgaggaggacgugaucccggacagccccaucaccgccuucuccuucagcggcgucaaccgccugcggcgcaaggagaacccccacgugcgguacaucgagcagacccacacgaagcucgagcacuccgugugcgcgaacgagaugcgcaaggucagcaaguccagcacccacccccagcacaacccgaacgagaacgagauccugguggccgacaccuacgaccagucccagagccccauggccaaggcccacgggaccuccagcuacacgcccgacaaguccagcuucaaccuggcgaccguggucgccgagacccucggccugggcgugcaggaggagagcgagacccaggggcccauguccccgcugggcgacgagcucuaccacugccuggaggggaaccacaagaagcagcccuucgaggagagcacgcggaacaccgaggacucccugcgcuucagcgacuccaccagcaagaccccgccccaggaggagcuccccacgcggguguccagccccgucuucggcgccaccuccagcaucaaguccgggcuggaccugaacaccagccucucccccagccugcugcagcccggcaagaagaagcaccucaagacccugccguucuccaacacgugcaucagccgccuggagaagacccgguccaagagcgaggacuccgcccucuucacccaccacagccugggcagcgaggugaacaagaucaucauccaguccagcaacaagcagauccugaucaacaagaacaucuccgagagccucggggagcagaaccgcaccgaguacggcaaggacuccaacacggacaagcaccuggagccccugaagucccucgggggccggaccagcaagcgcaagaagaccgaggaggagagcgagcacgagguguccugcccccaggccagcuucgacaaggagaacgcguuccccuucccgauggacaaccaguucuccaugaacggcgacugcgucauggacaagccccuggaccugagcgaccgcuucuccgccauccagcggcaggagaagucccaggggagcgagaccagcaagaacaaguuccgccaggugacgcucuacgaggcccugaagaccauccccaagggcuucuccagcagccggaaggccuccgacgggaacugcacccugcccaaggacagcccgggcgagcccugcucccaggagugcaucauccuccagccccugaacaagugcagccccgacaacaagccgucccugcagaucaaggaggagaacgccguguucaagaucccccugcgcccccgggagagccucgagaccgagaacguccuggacgacaucaaguccgcggggagccacgagccgaucaagauccagacgcgcuccgaccacggcggcugcgagcuggccagcgugcuccagcugaaccccugccggaccgggaagaucaagucccugcagaacaaccaggacgugagcuucgagaacauccagugguccaucgaccccggcgccgaccucagccaguacaagauggacgucaccgugaucgacaccaaggacgggucccagagcaagcugggcggggagaccgucgacauggacugcacgcugguguccgagaccgugcuccugaagaugaagaagcaggagcagaagggcgagaaguccagcaacgaggagcgcaagaugaacgacagccuggaggacauguucgaccggaccacccacgaggaguacgagagcugccucgccgacuccuucagccaggccgcggacgaggaggaggagcuguccacggccaccaagaagcugcacacccacggcgacaagcaggacaaggucaagcagaaggccuucguggagcccuacuucaagggggacgagagcaucaugcagaucugccagcagaagaaggagaagcgcaacuggcucccggcccaggacaccgacuccgccacguuccaccccacccaccagcggaucuucggcaagcugguguuccugccccuccgccuggucuggaaggaggugauccugcggaagauccucauccuggugcugguccagaaggacgugagccucaccacccaguacuuccugcagaaggcgcgcucccggcgccaccggcgcuga

SEQ ID NO: 35527 - RNA, 561 nt, Artificial Sequence
  derived and/or modified sequence opt1 from RBBP9__Homo_sapiens__NP_006597
auggccagccccuccaaggccgugaucgucccgggcaacgggggcggggacgugaccacccacggcugguacgggugggugaagaaggagcuggagaagauccccggcuuccagugccucgcgaagaacaugcccgaccccaucacggcccgcgagagcaucuggcugccguucauggagaccgagcugcacugcgacgagaagaccaucaucaucggccacuccagcggggccaucgccgccaugcgguacgcggagacccaccgcgucuacgccaucgugcucguguccgccuacacgagcgaccugggcgacgagaacgagcgggccuccggguacuucacccgccccuggcagugggagaagaucaaggcgaacugccccuacaucguccaguucggcagcaccgacgaccccuuccugccguggaaggagcagcaggagguggccgaccggcucgagaccaagcugcacaaguucacggacugcgggcacuuccagaacaccgaguuccacgagcugaucaccguggucaagucccuccugaaggugcccgccuga

SEQ ID NO: 35528 - RNA, 1407 nt, Artificial Sequence
  derived and/or modified sequence opt1 from RBCK1__Homo_sapiens__NP_006453
augggcaccgccacccccgacgggcgcgaggaccaggagcggcugugggugagcgucgaggacgcccagaugcacacggugaccaucuggcucaccgugcgcccggacaugaccgucgcgucccugaaggacaugguguuccuggacuacggcuucccgcccgugcuccagcagugggucaucgggcagcggcuggcccgcgaccaggagacgcugcacagccacggcgugcggcagaacggggacuccgccuaccucuaccugcugagcgcccgcaacaccucccucaacccccaggagcugcagcgggagcgccagcugcggaugcucgaggaccugggcuucaaggaccugacccuccagccccgcggcccccuggagcccgggcccccgaagcccggcgugccccaggagcccgggcggggccagccggacgccguccccgagcccccgcccgugggguggcagugccccggcugcaccuucaucaacaagcccacgcgccccggcugcgagaugugcugccgggcgcgcccggaggccuaccaggugcccgccagcuaccagcccgacgaggaggagcgggcccgccuggcgggggaggaggaggcccuccggcaguaccagcagcgcaagcagcagcagcaggagggcaacuaccugcagcacguccagcuggaccagcggucccucgugcugaacaccgagcccgccgagugcccggugugcuacagcguccuggcccccggggaggccguggugcuccgcgagugccugcacaccuucugccgggagugccugcagggcaccauccgcaacucccaggaggcggaggucagcugccccuucaucgacaacacguacuccugcagcggcaagcuccuggagcgcgagaucaaggcccugcucacccccgaggacuaccagcgguuccuggaccuggggaucuccaucgccgagaaccgcagcgccuucuccuaccacugcaagaccccggacugcaagggcuggugcuucuucgaggacgacgugaacgaguucacgugccccgugugcuuccacgucaacugccuccugugcaaggccauccacgagcagaugaacugcaaggaguaccaggaggaccuggcgcuccgggcccagaacgacguggccgcccgccagaccaccgagaugcugaaggugaugcugcagcagggggaggccaugcggugcccccagugccagaucgucgugcagaagaaggacggcugcgacuggauccgcugcaccgucugccacaccgagaucugcugggugacgaaggggccgcgguggggccccggcgggcccggcgacaccagcgggggcugccgcugccgggugaacgggauccccugccacccguccugccagaacugccacuga

SEQ ID NO: 35529 - RNA, 1113 nt, Artificial Sequence
  derived and/or modified sequence opt1 from RBFOX1__Homo_sapiens__NP_001135805
augaacugcgagcgcgagcagcugcggggcaaccaggaggccgccgcggcccccgacaccauggcccagccguacgccagcgcccaguucgcgccgccccagaacgggauccccgccgaguacaccgcgccccacccccaccccgcccccgaguacacgggccagaccaccgugccggagcacacccucaaccuguacccgcccgcccagacgcacuccgagcagagccccgccgacaccuccgcccagaccgucagcgggaccgccacgcagaccgacgacgccgcgcccaccgacggccagccccagacccagcccuccgagaacacggagaacaagagccagcccaagcgccugcacguguccaacaucccguuccgguuccgcgaccccgaccuccggcagauguucgggcaguucggcaagauccuggacguggagaucaucuucaacgagcgcggcagcaagggguucggcuucgucaccuucgagaacuccgccgacgccgaccgggcccgcgagaagcugcacgggaccgugguggagggccggaagaucgaggucaacaacgccaccgcgcgcgugaugacgaacaagaagaccgugaaccccuacaccaacggguggaagcucaaccccgucgugggcgccguguacagcccggaguucuacgccguccccggcuuccccuaccccgccgccaccgcggccgccgccuaccgcggggcccaccuccggggccgggggcgcacgguguacaacaccuuccgggcggccgccccgcccccgcccauccccgccuacggcggcguggucuaccaggacggguucuacggcgcggacaucuacgggggcuacgccgccuaccgcuacgcccagcccacccccgccaccgcggccgccuacuccgacagcuacgggcggguguacgccgccgacccguaccaccacgcgcuggcccccgcccccacguacggcgugggcgccaugaacgccuucgcgccccugaccgacgccaagacccgcucccacgccgacgacgucgggcuggugcugagcucccuccaggccagcaucuaccggggcggguacaaccgcuucgcgccguacuga

SEQ ID NO: 35530 - RNA, 1143 nt, Artificial Sequence
  derived and/or modified sequence opt1 from RBFOX2__Homo_sapiens__NP_001026865
auggagaagaagaagauggugacccagggcaaccaggagcccaccacgaccccggacgccaugguccagcccuucaccaccauccccuucccgcccccgccccagaacgggauccccacggaguacggcgugccccacacccaggacuacgccgggcagaccggcgagcacaaccugacccucuacgggagcacgcaggcgcacggcgagcaguccagcaacucccccagcacccagaacggcucccugaccaccgagggcggggcccagacggacgggcagcagagccagacccaguccagcgagaacuccgagagcaaguccacccccaagcgccugcacgugagcaacauccccuuccgguuccgcgacccggaccuccggcagauguucggccaguucgggaagauccuggacgucgagaucaucuucaacgagcgcggcuccaagggcuucggguucgugaccuucgagaacagcgccgacgccgaccgggcccgcgagaagcugcacggcacgguggucgaggggcggaagaucgaggugaacaacgcgaccgcccgcgugaugaccaacaagaagauggucacccccuacgccaacggcuggaagcucucccccguggugggcgccgucuacgggcccgagcuguacgcggccagcuccuuccaggccgacgugagccugggcaacgacgccgccgugccgcucuccgggcggggcgggaucaacacguacaucccccugaucagccugccccucguccccggcuucccguaccccaccgcggccaccaccgccgccgccuuccgcggcgcgcaccuccgggggcgcggccggacgguguacggggccgugcgcgccgucccgcccaccgccauccccgccuaccccggcgugguguaccaggacggguucuacggcgcggaccuguacggcggguacgccgccuaccgguacgcccagcccgccaccgcgaccgccgccacggccgcggccgccgccgccgcggccuacagcgacggcuacgggcgcgucuacaccgccgaccccuaccacgcccuggccccggcggccuccuacggcgugggggccguggccagccuguaccggggcggcuacucccgcuucgcccccuacuga

SEQ ID NO: 35531 - RNA, 939 nt, Artificial Sequence
  derived and/or modified sequence opt1 from RBFOX3__Homo_sapiens__NP_001076044
auggcccagcccuacccgcccgcccaguacccgcccccgccccagaacggcauccccgcggaguacgccccgcccccgccccaccccacccaggacuacagcgggcagacccccgugcccacggagcacggcaugacccuguacacccccgcccagacccaccccgagcagcccggguccgaggccagcacgcagcccaucgccggcacccagaccgucccccagaccgacgaggcggcccagacggacucccagccccuccacccgagcgaccccaccgagaagcagcagcccaagcgccugcacguguccaacauccccuuccgguuccgcgacccggaccugcggcagauguucgggcaguucggcaagauccucgacguggagaucaucuucaacgagcgcggcagcaagggguucggcuucgucaccuucgagaccuccagcgacgccgaccgggcccgcgagaagcugaacgggacgaucguggagggccggaagaucgaggugaacaacgcgaccgcccgcgucaugaccaacaagaagaccgggaaccccuacacgaacggcuggaagcugaaccccguggugggcgccgucuacgggcccgaguucuacgccgugaccggcuucccguaccccaccaccgggacggccguggcguaccggggcgcccaccuccgcggccgggggcgcgccgucuacaacaccuuccgggccgcgcccccgcccccgcccauccccaccuacggcgccgugguguaccaggacggguucuacggcgccgagaucuacgggggcuacgccgccuaccgcuacgcccagcccgcggccgccgccgccgcguacuccgacagcuacggccgggucuacgccgccgccgaccccuaccaccacaccaucgggcccgcggccacguacuccaucggcaccauguga

SEQ ID NO: 35532 - RNA, 3207 nt, Artificial Sequence
  derived and/or modified sequence opt1 from RBL1__Homo_sapiens__NP_002886
auguucgaggacaagccccacgccgagggcgccgcgguggucgccgccgccggggaggcccugcaggcgcucugccaggagcugaaccuggacgagggcagcgccgccgaggcccucgacgacuucaccgcgauccgcgggaacuacucccuggagggcgaggugacccacuggcuggccugcagccucuacguggccugccggaaguccaucaucccgaccgucgggaagggcaucauggagggcaacugcgugagccugacccgcauccugcgguccgccaagcucagccugauccaguucuucuccaagaugaagaaguggauggacaugagcaaccugccccaggaguuccgcgagcggaucgagcgccucgagcggaacuucgagguguccaccgucaucuucaagaaguacgagcccaucuuccuggacaucuuccagaaccccuacgaggagccgcccaagcugccccgcagccggaagcagcgccggauccccugcuccgugaaggaccucuucaacuucugcuggacccuguucguguacacgaaggggaacuuccgcaugaucggcgacgaccuggucaacagcuaccaccuccugcugugcugccucgaccugaucuucgccaacgcgaucaugugcccgaaccggcaggaccugcucaaccccuccuucaaggggcugcccagcgacuuccacaccgccgacuucaccgccuccgaggagcccccgugcaucaucgccgugcugugcgagcuccacgacggccugcugguggaggccaaggggaucaaggagcacuacuucaagcccuacaucagcaagcuguucgaccgcaagauccucaagggcgagugccugcucgaccuguccagcuucaccgacaacuccaaggcggucaacaaggaguacgaggaguacgugcugacggugggcgacuucgacgagcggaucuuccucggggccgacgccgaggaggagaucggcacgccccgcaaguucacccgggacacgccccuggggaagcugaccgcccaggccaacgucgaguacaaccuccagcagcacuucgagaagaagcgcagcuucgcgccgagcacgccccugaccggccggcgcuaccugcgggagaaggaggccgugaucacccccguggccuccgccacccagagcgucucccgccuccagagcaucguggccggccugaagaacgcgcccuccgaccagcugaucaacaucuucgagagcugcgugcgcaacccggucgagaacaucaugaagauccucaaggggaucggcgagaccuucugccagcacuacacccaguccaccgacgagcagcccgggagccacaucgacuucgccgugaaccggcugaagcuggccgagauccucuacuacaagauccuggagaccgugaugguccaggagacccgccggcugcacggcauggacauguccgugcugcucgagcaggacaucuuccaccgcagccugauggccugcugccuggagaucguccucuucgcguacuccagcccccggaccuuccccuggaucaucgaggugcugaaccugcagccguucuacuucuacaaggugaucgaggucgugauccgcuccgaggaggggcucagccgggacauggugaagcaccugaacuccaucgaggagcagauccuggagagccucgccuggucccacgacagcgcccugugggaggcccugcaggucuccgccaacaaggugccgaccugcgaggaggugaucuuccccaacaacuucgagacgggcaacggcgggaacguccagggccaccucccccugaugcccaugagcccccugaugcacccccgcgugaaggaggugcggaccgacagcgggucccuccgccgggacaugcagccgcugagccccaucuccguccacgagcgcuacagcucccccaccgcgggcagcgccaagcggcgccuguucggggaggacccgcccaaggagaugcucauggacaagaucaucaccgagggcacgaagcugaagaucgcccccuccagcuccaucaccgccgagaacgugagcauccugcccggccagacccuccugaccauggccacggcgcccgugaccgggaccaccggccacaaggucacgaucccgcugcacgggguggccaacgacgccggcgagaucacccucaucccccuguccaugaacaccaaccaggagagcaaggugaagucccccgucagccugaccgcccacucccucaucggggccagccccaagcagaccaaccugacgaaggcgcaggaggugcacuccaccggcaucaaccggccgaagcgcaccggcagccuggcccucuucuaccggaagguguaccaccuggccagcguccgccugcgggaccucugccugaagcuggacguguccaacgagcuccgccgcaagaucuggaccugcuucgaguucacgcuggugcacugccccgaccugaugaaggaccggcaccucgaccagcugcugcucugcgccuucuacaucauggcgaaggucaccaaggaggagcgcaccuuccaggagaucaugaaguccuaccggaaccagccccaggccaacagccacguguaccgcagcgugcugcugaaguccaucccccgggaggucguggccuacaacaagaacaucaacgacgacuucgagaugaucgacugcgaccucgaggacgccaccaagacgccggacugcagcuccgggcccgugaaggaggagcgcggcgaccugaucaaguucuacaacaccaucuacgucgggcgggucaagagcuucgcccugaaguacgaccucgcgaaccaggaccacaugauggacgccccgccccugucccccuucccccacaucaagcagcagcccggcagcccccgccggaucucccagcagcacagcaucuacaucuccccgcacaagaacggcagcgggcugacgccccgcuccgcccuccuguacaaguucaacggcagccccuccaagagccugaaggacaucaacaacaugauccggcagggggagcagcgcaccaagaagcgggugaucgccaucgacuccgacgccgagagcccggcgaagcgcgugugccaggagaacgacgacgugcuccugaagcggcugcaggacguggucagcgagcgcgccaaccacuga

SEQ ID NO: 35533 - RNA, 3198 nt, Artificial Sequence
  derived and/or modified sequence opt1 from RBL2__Homo_sapiens__XP_005256140
augcagagccugaccaagggcaacgaccuccacuggcuggccugcgcccuguacguggcgugccgcaaguccguccccaccgugagcaaggggacgguggagggcaacuacgucucccucacccggauccugaagugcagcgagcagucccugaucgaguucuucaacaagaugaagaagugggaggacauggccaaccucccgccccacuuccgcgagcggaccgagcgccuggagcggaacuucaccgugagcgccgugaucuucaagaaguacgagcccaucuuccaggacaucuucaaguacccccaggaggagcagccgcgccagcagcgggggcgcaagcagcggcgccagcccugcacggucuccgagaucuuccacuucugcugggugcuguucaucuacgccaagggcaacuuccccaugaucagcgacgaccucgugaacuccuaccaccuccugcugugcgcccuggaccuggucuacgggaacgcgcuccagugcagcaaccggaaggagcuggugaaccccaacuucaagggccuguccgaggacuuccacgccaaggacagcaagccguccagcgacccgcccugcaucaucgagaagcucugcucccugcacgacggccuggugcucgaggccaaggggaucaaggagcacuucuggaagcccuacauccgcaagcuguacgagaagaagcugcucaagggcaaggaggagaaccugaccggguuccuggagccgggcaacuucggggagagcuucaaggccaucaacaaggcguacgaggaguacguccucuccgugggcaaccuggacgagcggaucuuccugggcgaggacgccgaggaggagaucgggacccucagccgcugccugaacgccggcuccgggaccgagacggccgagcgggugcagaugaagaacauccugcagcagcacuucgacaagagcaaggcccuccgcaucagcacgccccugaccggcguccgguacaucaaggagaacucccccugcgugacccccgugagcaccgcgacccacucccugagccgccuccacaccaugcugaccggccugcggaacgccccguccgagaagcucgagcagauccugcgcacgugcagccgggaccccacccaggccaucgccaaccgccugaaggagauguucgagaucuacucccagcacuuccagcccgacgaggacuucagcaacugcgccaaggagaucgcguccaagcacuuccgcuucgccgagaugcucuacuacaagguccuggagagcgugaucgagcaggagcagaagcggcugggggacauggaccucuccggcauccuggagcaggacgccuuccaccgcagccugcucgccugcugccuggagguggucaccuucuccuacaagcccccggggaacuuccccuucaucaccgagaucuucgacgugccccuguaccacuucuacaaggugaucgaggucuucauccgggccgaggacggccugugccgcgagguggucaagcaccucaaccagaucgaggagcagauccuggaccaccuggcguggaagcccgagagcccgcucugggagaagauccgggacaacgagaaccgcgugcccacgugcgaggaggugaugccgccccagaaccuggagcgggccgacgagaucugcaucgccggguccccgcugacgccccgccgggucaccgaggugcgcgccgacaccggcggccucgggcggagcaucaccucccccaccacccuguacgaccgcuacagcuccccgcccgccagcaccacgcggcgccggcuguucguggagaacgacagccccuccgacggcgggacccccggccgcaugccgccccagccccucgucaacgcggugcccgugcagaacgucagcggggagaccguguccgugaccccgguccccggccagacgcuggugaccauggccaccgccaccgugacggccaacaacggccagaccgucaccauccccgugcaggggaucgcgaacgagaacggcgggaucaccuucuuccccgugcaggucaacgugggcgggcaggcccaggccgugaccggcagcauccagccgcuguccgcccaggcccucgcgggcagccuguccagccagcaggucacggggaccacccuccaggugcccggccagguggccauccagcagaucucccccgggggccagcagcagaagcagggccagagcgucaccuccagcuccaaccggccccgcaagacgagcucccugagccuguucuuccggaagguguaccaccuggccgccgugcgccuccgcgaccugugcgccaagcuggacaucuccgacgagcuccggaagaagaucuggaccugcuucgaguucagcaucauccagugcccggagcugaugauggaccgccaccuggaccagcuccugaugugcgcgaucuacgucauggccaaggugaccaaggaggacaagagcuuccagaacaucaugcggugcuaccgcacccagccccaggcccggucccagguguaccgcagcguccugaucaaggggaagcggaagcgccggaacuccggcagcuccgacagccgcucccaccagaacagccccacggagcucaacaaggaccggaccucccgcgacagcucccccgugaugcggagcuccagcacccugccggugccccagcccuccagcgccccgcccacccccacgcgccugaccggggccaacuccgacauggaggaggaggagcggggcgaccucauccaguucuacaacaacaucuacaucaagcagaucaagaccuucgcgaugaaguacagccaggccaacauggacgccccgccccugucccccuaccccuucguccgcaccgggagcccccggcgcauccagcugagccagaaccaccccguguacaucagcccccacaagaacgagacgaugcucagcccccgggagaagaucuucuacuacuucuccaacucccccuccaagcgccugcgggagaucaacagcaugauccgcaccggcgagacccccaccaagaagcgcggcauccugcucgaggacggguccgagagccccgccaagcggaucugccccgagaaccacuccgcgcugcugcgccggcuccaggacguggccaacgaccgcggcagccacuga

SEQ ID NO: 35534 - RNA, 2988 nt, Artificial Sequence
  derived and/or modified sequence opt1 from RBM10__Homo_sapiens__NP_001191397
augagcggcucccccagccugaccgcccgcgccgagaagguguccgucgacgcggggcggggcgggggcgagagccuccaggaggccuccccgcgccuggccgaccacgggagcuccagcggcggcgggugggaggugaagcggucccagcgccugcggcgcggccccagcagcccccggcgccccuaccaggacauggaguacgagcggcgcgggggccgcggggaccggaccggccgguacggcgccacggaccgcucccaggacgacgggggcgagaaccggucccgcgaccacgacuaccgggacauggacuaccgcagcuacccgcgggaguacgggucccaggagggcaagcacgacuacgacgacagcuccgaggagcagagcgccgaggacuccuacgaggcgagccccggcagcgagacccagcgccggcgccgccggcgccaccggcacucccccaccgggcccccgggcuucccccgcgacggggacuaccgggaccaggacuaccgcaccgagcagggcgaggaggaggaggaggaggaggacgaggaggaggaggagaaggccagcaacaucgugaugcuccggaugcugccccaggccgccacggaggacgacauccgcgggcagcugcagucccacggcguccaggcgcgggaggugcgccucaugcggaacaagagcuccggccagagccgcggguucgccuucguggaguucucccaccuccaggacgccacccgguggauggaggccaaccagcacagccugaacauccugggccagaaggucuccaugcacuacagcgaccccaagccgaagaucaacgaggacuggcugugcaacaagugcggggugcagaacuucaagcgccgggagaagugcuucaagugcggcgugcccaaguccgaggccgagcagaagcugccccucgggacccgccuggaccagcagacccugccccucggcggccgggagcugagccaggggcugcucccgcugccccagcccuaccaggcgcagggcguccuggccucccaggcccucagccagggguccgagcccagcuccgagaacgccaacgacacgaucauccugcgcaaccugaacccgcacagcaccauggacuccauccucggcgcccuggcgcccuacgccgugcugagcagcuccaacgugcgggucaucaaggacaagcagacccagcucaaccgcggguucgccuucauccagcugagcaccaucguggaggccgcccagcugcuccagauccugcaggcgcugcacccgccccucacgaucgacggcaagaccaucaacguggaguucgccaagggcuccaagcgcgacauggccagcaacgaggggucccggaucagcgccgccuccgucgcgagcaccgccaucgccgccgcgcagugggccaucucccaggccagccagggcggggagggcaccugggccacguccgaggagccgcccguggacuacagcuacuaccagcaggacgagggcuacgggaacucccagggcaccgagagcucccuguacgcccacggguaccugaagggcaccaaggggcccggcaucaccggcacgaagggggaccccaccggcgcggggcccgaggccagccucgagcccggcgccgacuccgugagcaugcaggccuucagccgcgcccagcccggggcggccccgggcaucuaccagcaguccgccgaggccagcuccagccagggcaccgccgcgaacucccagagcuacaccaucaugucccccgccguccucaagagcgagcugcagucccccacgcaccccagcuccgcccugccgcccgccaccagccccaccgcgcaggaguccuacagccaguaccccgugccggacguguccaccuaccaguacgacgagacgagcggguacuacuacgacccccagaccggccuguacuacgaccccaacucccaguacuacuacaacgcccagagccagcaguaccuguacugggacggggagcggcgcaccuacguccccgcccucgagcaguccgccgacggccacaaggagaccggggccccgagcaaggagggcaaggagaagaaggagaagcacaagacgaagaccgcgcagcagaucgccaaggacauggagcggugggcccgcagccugaacaagcagaaggagaacuucaagaacuccuuccagcccaucagcucccugcgggacgacgagcgccgggagagcgccaccgccgacgcgggcuacgccauccucgagaagaagggggcccuggccgagcgccagcacaccuccauggaccugcccaagcucgccagcgacgaccggcccuccccgccccgcggccugguggcggccuacagcggggaguccgacagcgaggaggagcaggagcggggcgggcccgagcgcgaggagaagcugacggacuggcagaagcuggccugccuccugugccggcgccaguuccccuccaaggaggcccugauccggcaccagcagcucagcggccugcacaagcagaaccuggagauccaccgccgggcgcaccucuccgagaacgagcuggaggcccuggagaagaacgacauggagcagaugaaguaccgcgaccgggccgccgagcgccgcgagaaguacggcaucccggagccgcccgagcccaagcggcgcaaguacgggggcaucagcaccgccuccguggacuucgagcagcccacccgggacgggcucggcagcgacaacaucggcucccgcaugcugcaggcgaugggguggaaggagggcagcgggcugggccggaagaagcaggggaucgucacccccaucgaggcccagacccgcgugcggggcuccggccucggggcccgcggcagcagcuacggggucacguccaccgagagcuacaaggagacccugcacaagaccauggugacgcgguucaacgaggcccaguga

SEQ ID NO: 35535 - RNA, 2799 nt, Artificial Sequence
  derived and/or modified sequence opt1 from RBM12__Homo_sapiens__NP_001185769
auggccguggucauccgccugcagggccuccccaucguggccgggaccauggacauccggcacuucuucagcggccugaccaucccggacgggggcgugcacaucgucgggggcgagcugggcgaggcguucaucguguucgccacggacgaggacgcccgccucgggaugaugcggaccggcgggaccaucaagggcuccaaggugacccugcugcucagcuccaagacggagaugcagaacaugaucgagcugagccgccggcgcuucgagaccgccaaccuggacaucccccccgccaacgcgucccggagcgggcccccgcccuccagcggcauguccagccgcgucaaccuccccaccaccguguccaacuucaacaaccccagcccguccguggucacggccaccaccagcgugcacgaguccaacaagaacauccagaccuucagcacggccuccgugggcaccgccccccccaacaugggggcgagcuucggcucccccaccuucagcagcaccgucccguccacggccagccccaugaacaccgugccccccccgcccaucccccccaucccggccaugcccucccugccccccaugccgagcaucccccccauccccgugccgccccccgucccgacccugccccccgugcccccggugccccccauccccccgguccccuccgugccccccaugaccccgcucccccccaugagcgggaugcccccgcugaaccccccccccguggccccgcugcccgccggcaugaacggcuccggggcgcccaugaaccucaacaacaaccugaaccccauguuccugggcccgcucaaccccgucaaccccauccagaugaacagccaguccagcgugaagccgcugcccaucaaccccgacgaccuguacguguccguccacgggaugcccuucagcgccauggagaacgacgugcgggacuucuuccacggccuccgcgucgacgccgugcaccugcugaaggaccacguggggcggaacaacggcaacggccucgucaaguuccuguccccgcaggacacguucgaggcccugaagcgcaaccggaugcucaugauccagcgcuacguggaggugagccccgccaccgagcggcagugggucgcggccgggggccacaucaccuucaagcagaacauggggcccuccggccagacccaccccccgccccagacgcugccccgcagcaagucccccagcgggcagaagcggucccgcagccggagcccgcacgaggccggcuucugcguguaccugaagggccuccccuucgaggccgagaacaagcacgugaucgacuucuucaagaagcuggacaucgucgaggacuccaucuacaucgccuacgggcccaacggcaaggcgaccggggagggcuucguggaguuccgcaacgaggccgacuacaaggccgcccugugccggcacaagcaguacauggggaaccgcuucauccaggugcaccccaucaccaagaagggcaugcucgagaagaucgacaugauccgcaagcggcugcagaacuucagcuacgaccagcgcgagaugauccugaacccggagggcgacgucaacuccgccaaggugugcgcgcacaucaccaacauccccuucagcaucacgaagauggacgugcuccaguuccuggaggggauccccgucgacgagaacgccgugcacgugcuggucgacaacaacggccaggggcucggccaggcccuggugcaguucaagaacgaggacgacgcccggaaguccgagcgccugcaccggaagaagcucaacggccgcgaggcguucgugcacgucgugacccuggaggacaugcgggagaucgagaagaaccccccggcccaggggaagaagggccugaagaugcccgugcccgggaaccccgccgucccgggcaugcccaacgccgggcuccccggcgugggccugcccagcgccgggcugccgggcgcggggcuccccuccaccggccugcccgggagcgccaucaccuccgccggccugccgggcgccgggaugcccagcgccggcauccccuccgcggggggcgaggagcacgccuuccugacgguggggagcaaggaggccaacaacggccccccguucaacuuccccggcaacuucgggggcuccaacgccuucgggccccccaucccgccccccggccucgggggcggcgccuucggggacgcgcgccccggcaugccgagcgucgggaacuccggccugcccggccuggggcucgacgugcccggcuucgggggcgggcccaacaaccugagcggcccguccggcuucgggggcgggccccagaacuucggcaacgggcccggcagccugggcgggcccccgggcuucgggagcggcccccccgggcucggcuccgcccccggccaccuggggggcccgcccgccuucgggcccggccccggcccggggcccggccccgggccgauccacaucggcgggccccccggcuucgccagcuccagcggcaagcccgggccgaccgugaucaagguccagaacaugcccuucaccguguccaucgacgagauccuggacuucuucuacggcuaccaggugauccccgggagcgucugccucaaguacaacgagaagggcaugcccaccggggaggcgaugguggccuucgagucccgggacgaggccacggccgccgugaucgaccugaacgaccgcccgaucggcagccggaaggucaagcuggugcucggcuga

SEQ ID NO: 35536 - RNA, 471 nt, Artificial Sequence
  derived and/or modified sequence opt1 from RBM14__Homo_sapiens__NP_001185765
augaagaucuucgugggcaacgucgacggggccgacaccacccccgaggagcuggccgcccucuucgcgccguacggcacggugaugagcugcgccgugaugaagcaguucgccuucguccacaugcgcgagaacgccggggcgcugcgggccaucgaggcccugcacggccacgagcuccgccccgggcgggcccuggugguggagaugucccgcccccggccccugaacaccuggaagaucuucgucggcaacgugagcgcggccugcaccucccaggagcuccgcagccuguucgagcggcgcggccgggugaucgagugcgacgucgugaaggacuacgccuucgugcacauggagaaggaggccgacgccaaggcggccaucgcccagcugaacgggaaggaggucaagggcaagcgcaucaacguggagcucuccaccaaggggauggugccgacgggcgucuga

SEQ ID NO: 35537 - RNA, 1020 nt, Artificial Sequence
  derived and/or modified sequence opt1 from RBM14-RBM4__Homo_sapiens__NP_001185774
augaagaucuucgugggcaacgucgacggggccgacaccacccccgaggagcuggccgcgcuguucgccccguacggcacggugaugagcugcgccgugaugaagcaguucgccuucguccacaugcgcgagaacgccggggcgcugcgggccaucgaggcccugcacggccacgagcuccgccccgggcgggcccuggugguggagaugucccgcccccggccccugaacaccuggaagaucuucgucggcaacgugagcgcggccugcaccucccaggagcuccgcagccuguucgagcggcgcggccgggugaucgagugcgacgucgugaaggggaagcgcaugcacgugcagcuguccaccagccggcuccgcacggccccgggcaugggggaccaguccggcugcuaccggugcgggaaggagggccacuggagcaaggagugccccaucgaccgcuccggccgggucgccgaccugaccgagcaguacaacgagcaguacggggccgugcgcacccccuacaccaugagcuacggcgacucccuguacuacaacaacgcguacggggcccucgacgccuacuacaagcggugccgcgccgcccggagcuacgaggcgguggccgccgccgccgcguccgucuacaacuacgccgagcagacgcugagccagcugccccaggugcagaacaccgccauggccucccaccucaccagcaccucccuggacccguacgaccgccaccuccuccccacgagcggcgccgcggccaccgccgccgcggccgccgccgccgcggccgccgugaccgccgccuccaccagcuacuacggccgggaccgcagcccccugcgccgggcgacggcccccgucccgaccgugggggagggcuacggguacggccacgaguccgagcugagccaggccuccgccgccgcgcgcaacagccucuacgacauggcccgguacgagcgcgagcaguacgccgaccgggcccgcuacuccgcguucuga

SEQ ID NO: 35538 - RNA, 2934 nt, Artificial Sequence
  derived and/or modified sequence opt1 from RBM15__Homo_sapiens__XP_011540270
augcgcaccgccggccgggaccccgugccccgccggagcccccgcuggcggcgcgccgucccccugugcgagaccuccgcggggcggcgcgugacgcagcuccggggcgacgaccugcgccggcccgccaccaugaaggggaaggagcgcagcccggugaaggccaagcggucccgcggcggggaggacagcaccucccggggcgagcgcagcaagaagcugggcggguccggcgggagcaacggcuccagcuccgggaagaccgacagcggcggcgggucccggcgcagccuccaccuggacaaguccagcucccggggcgggagccgcgaguacgacacgggcggcggguccagcagcucccggcugcacagcuacuccagccccuccaccaagaacagcuccggcgggggcgagagccgcuccagcucccgcgggggcggcggggagagccgguccagcggcgccgccuccagcgcgcccgggggcggggacggcgccgaguacaagacccucaagaucuccgagcugggcagccagcuguccgacgaggccgucgaggacggccucuuccacgaguucaagcgcuucggggacgugagcgugaagaucagccaccuguccgggagcggcuccggggacgagcgggucgccuucgugaacuuccgccggcccgaggacgcgcgcgccgccaagcacgcccggggccgccuggugcucuacgaccggccgcugaagaucgaggccgucuacgugagccgccggcgcucccggagcccccuggacaaggacaccuacccgcccuccgcgagcguggucggcgccuccgucgggggccaccgccacccgcccgggggcggcgggggccagcggagccucucccccgggggcgccgcccugggguaccgcgacuaccggcugcagcagcucgcccugggccgccugcccccgcccccgccgccgccccucccccgggaccuggagcgcgagcgcgacuaccccuucuacgagcgggugcgccccgcguacagccuggagccccgggucggcgccggggccggcgccgcccccuuccgcgagguggacgagaucucccccgaggacgaccagcgggcgaaccgcacccucuuccuggggaaccuggacaucacggugaccgagagcgaccuccggcgcgccuucgaccgguucggcgucaucaccgagguggacaucaagcgccccucccgggggcagacgagcaccuacggcuuccugaaguucgagaaccuggacaugucccaccgcgccaagcucgccaugagcggcaagaucaucauccggaaccccaucaagaucggguacggcaaggccacccccaccacgcgccugugggucgggggccuggggcccugggugccccucgcggcccuggcccgggaguucgaccgcuucggcaccauccggaccaucgacuaccgcaagggcgacagcugggccuacauccaguacgagucccuggacgcggcccacgccgccuggacccacaugcggggguucccccucggcgggcccgaccgccggcugcgcguggacuucgccgacacggagcaccgcuaccagcagcaguaccugcagccgcucccccugacccacuacgagcuggugaccgacgcguucggccaccgggcccccgacccccuccgcggggcccgggaccgcaccccgccccugcuguaccgggaccgcgaccgggaccucuaccccgacagcgacugggugcccccgcccccgcccgugcgcgagcgguccacgcgcaccgccgccaccagcguccccgcguacgagccccuggacucccuggaccggcgccgggacggcuggagccucgaccgcgaccggggcgaccgcgaccugcccuccagccgggaccagccccgcaagcggcgccugccggaggaguccgggggccgccaccuggaccggagccccgaguccgaccgcccccggaagcgccacugcgcccccagcccggaccggucccccgagcucagcuccagccgcgaccgguacaacuccgacaacgaccgcagcucccggcugcugcucgagcgccccagcccgauccgggaccgccgggggagccuggagaagucccagggcgacaagcgcgaccggaagaacagcgccuccgccgagcgcgaccggaagcaccgcaccacggcccccaccgagggcaagagcccccugaagaaggaggaccgguccgacgggagcgcgcccuccaccagcaccgccuccagcaagcucaaguccccgagccagaagcaggacggcgggacggcccccguggccuccgcgagccccaagcugugccuggccuggcagggcaugcuccugcugaagaacuccaacuuccccagcaacaugcaccuccugcagggggaccuccagguggccuccagccugcuggucgagggcuccaccggcgggaagguggcccagcugaagaucacccagcgccuccggcuggaccagccgaagcuggacgaggugacccgccgcaucaaggucgccggccccaacggguacgcgauccuccuggccgugcccggcagcagcgacucccggagcuccagcuccagcgccgccuccgacacggccaccagcacccagcgcccccugcggaaccucguguccuaccugaagcagaagcaggcggccggggucaucagccugccggugggcggcaacaaggacaaggagaacaccggggugcuccacgccuucccgcccugcgaguucucccagcaguuccuggacagccccgccaaggcccuggcgaaguccgaggaggacuaccucgucaugaucaucgugcgcggcuucggguuccagaucggcgugcgguacgagaacaagaagcgcgagaaccuggcccugacccuccuguga

SEQ ID NO: 35539 - RNA, 1206 nt, Artificial Sequence
  derived and/or modified sequence opt1 from RBM17__Homo_sapiens__NP_001139019
augagccuguacgacgaccucggcguggagaccuccgacagcaagaccgaggggugguccaagaacuucaagcugcugcagagccagcuccaggugaagaaggccgcccugacgcaggcgaagucccagcgcaccaagcagagcaccgugcuggcccccgugaucgaccucaagcggggcggguccagcgacgaccgccagaucgucgacaccccgccccacguggccgccggccugaaggaccccgugcccuccggguucagcgccggcgagguccugaucccgcucgcggacgaguacgaccccauguuccccaacgacuacgagaagguggugaagcggcagcgcgaggagcggcagcgccagcgggagcuggagcgccagaaggagaucgaggagcgggagaagcgccggaaggaccgccacgaggccuccggcuucgcccggcgccccgacccggacagcgacgaggacgaggacuacgagcgggagcgccggaagcgcuccaugggcggggccgcgaucgccccgcccacgagccuggucgagaaggacaaggagcucccccgggacuuccccuacgaggaggacucccgcccccggagccaguccagcaaggccgccaucccgccgcccguguacgaggagcaggaccgcccccgcucccccaccgggcccagcaacagcuuccuggccaacaugggcgggaccguggcgcacaagaucaugcagaaguacggcuuccgggagggccaggggcugggcaagcacgagcaggggcucuccaccgcccugagcgucgagaagacguccaagcgcggcggcaagaucaucgugggggacgccaccgagaaggacgccagcaagaaguccgacagcaacccccugaccgagauccucaagugccccaccaaggugguccugcugcggaacauggugggcgccggggagguggacgaggaccucgaggucgagacgaaggaggagugcgagaaguacggcaagguggggaagugcgugaucuucgagauccccggcgcgcccgacgacgaggccguccgcaucuuccuggaguucgagcggguggaguccgccaucaaggccguggucgaccugaacggccgcuacuucgggggccggguggucaaggccugcuucuacaaccucgacaaguuccgcgugcuggaccuggcggagcaggucuga

SEQ ID NO: 35540 - RNA, 3684 nt, Artificial Sequence
  derived and/or modified sequence opt1 from RBM20__Homo_sapiens__NP_001127835
auggugcuggccgccgcgaugagccaggacgccgaccccuccggcccggagcagcccgaccgcgucgccugcagcgugcccggggcccgggccucccccgcgccgagcggcccccgcgggaugcagcagccccccccgcccccccagcccccgccccccccccaggccggccucccgcagaucauccagaacgccgccaagcugcuggacaagaaccccuucuccgugagcaaccccaacccccuccugccgucccccgcgagccugcagcucgcccagcugcaggcccagcugacccuccaccggcugaagcuggcccagaccgccgucacgaacaacaccgcggccgccaccgugcucaaccaggugcuguccaaggucgccaugagccagccccuguucaaccagcuccgccaccccuccgugaucaccgggccgcacggccacgccggcgugccccagcacgcggccgccauccccagcacgcgguuccccuccaacgccaucgccuucagcccgcccucccagacccgcgggcccggcccgagcaugaaccugcccaaccagccccccuccgcgauggucaugcacccguucaccggggugaugccccagacccccggccagcccgccgugauccuggggaucggcaagacgggcccggcccccgccaccgccggguucuacgaguacggcaaggcgagcuccgggcagaccuacggccccgagaccgacggccagcccggguuccucccgagcagcgccuccacgagcggcuccgucaccuacgaggggcacuacagccacaccggccaggacgggcaggccgccuucuccaaggacuucuacggccccaacagccagggcucccacguggcgagcggguuccccgccgagcaggccggcgggcugaaguccgaggugggcccccugcuccaggggaccaacagccagugggaguccccgcacggcuucagcggccaguccaagcccgaccugacggccgggcccauguggcccccgccccacaaccagcccuacgagcuguacgaccccgaggagccgaccagcgaccggaccccccccuccuucggcgggcgccucaacaacagcaagcagggcuucaucggggccggccggcgcgcgaaggaggaccaggcccugcuguccguccggccgcuccaggcccacgagcugaacgacuuccacggcguggccccccugcaccucccccacaucugcagcaucugcgacaagaagguguucgaccugaaggacugggagcugcacgucaaggggaagcuccacgcccagaagugccugguguucuccgagaacgcgggcauccgcugcauccuggggagcgccgagggcacccucugcgccagccccaacuccacggccguguacaacccggccggcaacgaggacuacgcgagcaaccuggggaccuccuacguccccauccccgcccggagcuucacccaguccagccccaccuucccgcuggccuccgugggcacgaccuucgcccagcgcaagggggcgggccgggugguccacaucugcaaccuccccgaggggagcugcaccgagaacgacgugaucaaccugggccugcccuucggcaaggucaccaacuacauccucaugaaguccacgaaccaggccuuccuggagauggccuacaccgaggccgcccaggcgauggugcaguacuaccaggagaagagcgccgugaucaacggggagaagcugcucauccgcauguccaagcgguacaaggagcugcagcugaagaagcccggcaaggccgucgccgccaucauccaggacauccacagccagcgcgagcgggacauguuccgcgaggcggaccgguacgggccggagcgcccccgcucccggagccccgugucccgcagccucuccccccggagccacaccccgagcuucaccuccugcagcuccagccacuccccccccggccccagccgcgccgacugggggaacggccgggacuccugggagcacagcccguacgcccgccgggaggaggagcgcgaccccgcccccuggcgggacaacggcgacgacaagcgcgaccggauggaccccugggcccacgaccgcaagcaccacccgcggcagcuggacaaggcggagcuggacgagcgccccgaggggggccggccccaccgcgagaaguacccccgguccgggagcccgaaccugccccacuccgugagcuccuacaagagccgcgaggacggcuacuaccggaaggagcccaaggccaaguccgacaaguaccucaagcagcagcaggacgccccggggcgcagccgccggaaggacgaggcccgccugcgggagucccgccacccccaccccgacgacagcggcaaggaggacggccuggggcccaaggucacgcgggcgccggagggcgccaaggccaagcagaacgagaagaacaagaccaagcgcaccgaccgggaccaggagggggccgacgaccgcaaggagaacaccauggccgagaacgaggcgggcaaggaggagcaggaggggauggaggaguccccccagagcgugggccggcaggagaaggaggccgaguucagcgaccccgagaacacgcgcaccaagaaggagcaggacugggaguccgagagcgaggccgagggcgaguccugguaccccaccaacauggaggagcucgugaccgucgacgaggugggggaggaggaggacuucaucguggagccggacauccccgagcuggaggagaucguccccaucgaccagaaggacaagaucugccccgagaccugccugugcgugacgaccacccucgaccuggaccuggcccaggacuucccgaaggagggcgugaaggccgucgggaacggcgcggccgagaucagccucaaguccccccgggagcugcccagcgccuccaccagcugccccuccgacauggacguggagaugccgggccugaaccucgacgccgagcgcaagcccgccgagagcgagacggggcugucccuggaggacagcgacugcuacgagaaggaggcgaagggcguggaguccagcgacguccaccccgcccccaccgugcagcagauguccagcccgaagcccgccgaggagcgggcccgccagcccucccccuucguggacgacugcaagacccgggggaccccggaggacggcgccugcgaggggagcccccucgaggagaaggcguccccccccaucgagacggaccugcagaaccaggccugccaggagguccugaccccggagaacagccgcuacguggagaugaagagccucgaggugcggucccccgaguacaccgaggucgagcugaagcagccccugagccucccguccugggagcccgaggacguguucagcgagcuguccaucccccugggcguggaguucgucgugccccgcaccggcuucuacugcaagcucugcgggcuguucuacacgagcgaggagaccgccaagaugucccacugccggagcgccgugcacuaccgcaaccugcagaaguaccucucccagcuggcggaggagggccugaaggagaccgagggggccgacagcccgcggcccgaggacuccggcaucgucccccgcuucgagcgcaagaagcucuga

SEQ ID NO: 35541 - RNA, 2532 nt, Artificial Sequence
  derived and/or modified sequence opt1 from RBM25__Homo_sapiens__XP_011535346
augagcuucccgccgcaccugaaccgcccgcccaugggcauccccgcccucccgcccgggaucccgccgccccaguuccccggcuucccgccgcccgugccgcccgggacccccaugauccccguccccauguccaucauggcccccgcgcccaccgugcuggugcccacggucagcauggugggcaagcaccugggggcccggaaggaccaccccggccucaaggccaaggagaacgacgagaacugcggccccaccaccaccguguucgucgggaacaucuccgagaaggccagcgacaugcugauccgccagcugcucgccaagugcggccuggugcuguccuggaagcgggugcagggggcgagcggcaagcuccaggccuucggguucugcgaguacaaggagcccgaguccacgcugcgcgcccugcggcuccugcacgaccugcagaucggcgagaagaagcuccuggucaagguggacgccaagaccaaggcgcagcuggacgaguggaaggccaagaagaaggccagcaacggcaacgcccgccccgagaccgugaccaacgacgacgaggaggcccucgacgaggagacgaagcggcgcgaccagaugaucaagggggcgaucgagguccugauccgggaguacuccagcgagcugaacgcccccucccaggagagcgacucccacccccgcaagaagaagaaggagaagaaggaggacaucuuccggcgcuuccccguggcgccccucauccccuacccccugaucaccaaggaggacaucaacgccaucgagauggaggaggacaagcgggaccugaucagccgcgagaucuccaaguuccgggacacccacaagaagcucgaggaggagaagggcaagaaggagaaggagcgccaggagaucgagaaggagcggcgcgagcgggagcgcgagcgggagcgcgagcgcgagcggcgcgagcgggagcgcgagcgggagcgcgagcgggagcgcgagaaggagaaggagcgggagcgcgagcgggagcgcgaccgggaccgcgaccggaccaaggagcgcgaccgggaccgcgaccgggagcgcgaccgcgaccgggaccgcgagcggagcuccgaccgcaacaaggaccggagccgcucccgggagaagucccgcgaccgggagcgcgagcgggagcgcgagcgggagcgcgagcgggagcgcgagcgggagcgcgagcgggagcgcgagcgggagcgcgagcgcgagcgggagcgcgagcgggagaaggacaagaagcgcgaccgggaggaggacgaggaggacgccuacgagcgccggaagcuggagcgcaagcugcgggagaaggaggccgccuaccaggagcgccucaagaacugggagauccgggagcgcaagaagacgcgggaguacgagaaggaggccgagcgcgaggaggagcggcgccgggagauggccaaggaggccaagcgccugaaggaguuccuggaggacuacgacgacgaccgggacgaccccaaguacuaccgcgggagcgcgcuccagaagcgccugcgggaccgcgagaaggagauggaggccgacgagcgggaccgcaagcgggagaaggaggagcuggaggagauccgccagcggcuccuggccgagggccaccccgaccccgacgccgagcugcagcgcauggagcaggaggccgagcggcgccggcagccccagaucaagcaggagccggagagcgaggaggaggaggaggagaagcaggagaaggaggagaagcgcgaggagcccauggaggaggaggaggagcccgagcagaagcccugccucaagccgacccugcggcccaucagcuccgcgcccagcguguccagcgccuccggcaacgccacccccaacaccccgggggacgagagccccugcggcaucaucaucccccacgagaacucccccgaccagcagcagccggaggagcaccgccccaagaucgggcugagccucaagcugggcgccuccaacagccccgggcagcccaacuccgucaagcggaagaagcugccgguggacagcguguucaacaaguucgaggacgaggacuccgacgacgucccccgcaagcggaagcucgugccccuggacuacggcgaggacgacaagaacgcgacgaagggcaccgugaacaccgaggagaagcgcaagcacaucaagagccugaucgagaagauccccaccgccaagccggagcuguucgccuacccccucgacugguccaucgucgacagcauccugauggagcggcgcauccggcccuggaucaacaagaagaucaucgaguacaucggggaggaggaggccacgcucguggacuucgugugcuccaaggucauggcccacagcagcccgcaguccauccuggacgacguggcgaugguccuggacgaggaggccgagguguucaucgugaagauguggcgccugcucaucuacgagaccgaggccaagaagaucggccuggucaaguga

SEQ ID NO: 35542 - RNA, 2952 nt, Artificial Sequence
  derived and/or modified sequence opt1 from RBM26__Homo_sapiens__NP_001273561
auggugagcaagaugaucaucgagaacuucgaggcccucaagagcuggcucagcaagacccucgagcccaucugcgacgccgaccccagcgcgcuggccaaguacguccucgcccuggugaagaaggacaagagcgagaaggagcugaaggcccucugcaucgaccagcuggacguguuccugcagaaggagacccagaucuucgucgagaagcuguucgacgccgugaacacgaaguccuaccugccgccgcccgagcagcccagcuccggcagccugaagguggaguucuucccccaccaggagaaggacaucaagaaggaggagaucaccaaggaggaggagcgcgagaagaaguucucccggcgccucaaccacuccccgccccaguccagcucccgguaccgcgagaaccggagccgcgacgagcggaagaaggacgaccgcucccggaagcgcgacuacgaccggaacccgccccgccgggacagcuaccgcgaccgguacaaccgccggcgcgggcggucccgcagcuacucccggagccgcagccgcuccuggagcaaggagcggcugcgcgagcgggaccgcgaccggucccgcacccggagccgcucccggacccgcagccgggagcgcgaccuggucaagcccaaguacgaccucgaccggacggacccccuggagaacaacuacacccccguguccagcgugcccuccaucagcuccggccacuaccccguccccacccugagcuccaccaucacggugaucgcccccacccaccacgggaacaacaccaccgagagcugguccgaguuccacgaggaccagguggaccacaacagcuacguccggccgcccaugcccaagaagcggugccgcgacuacgacgagaagggcuucugcaugcgcggggacaugugccccuucgaccacggcuccgaccccgugguggucgaggacgugaaccuccccggcaugcugcccuuccccgcccagccgcccguggucgaggggcccccgccgcccggccugcccccgcccccgcccauccucacgcccccgcccgugaaccugcgcccgcccgugcccccgcccgggccccugccgcccagccucccgcccgucaccgggcccccgccgccccugccgccccugcagcccuccggcauggacgcgccgcccaacagcgccaccagcuccgugcccaccguggucacgaccggcauccaccaccagcccccgcccgcgccgcccagccucuucaccgccgacaccuacgacacggacggcuacaaccccgaggcccccuccaucaccaacaccagccggcccauguaccgccaccgcgugcacgcccagcggcccaaccugaucgggcugaccuccggcgacauggaccugccgccccgcgagaagccgcccaacaagagcuccaugcggaucgucguggacagcgagucccgcaagcggacgaucgggagcggcgagcccggcgugcccaccaagaagaccugguucgacaagcccaacuucaaccgcaccaacucccccggguuccagaagaagguccaguucggcaacgagaacacgaagcuggagcugcggaaggugccgcccgagcucaacaacaucagcaagcugaacgagcacuucucccgcuucgggacccuggugaaccuccaggucgccuacaacggcgaccccgagggggcgcugauccaguucgccaccuacgaggaggccaagaaggccaucagcuccaccgaggccgugcugaacaaccgguucaucaagguguacuggcaccgcgagggcagcacgcagcagcuccagaccaccucccccaaggucaugcagccccuggugcagcagcccauccugcccguggucaagcagagcgugaaggagcggcucggccccgugcccagcuccaccaucgagcccgcggaggcccagagcgccuccagcgaccugccccagguccuguccacgagcaccgggcucaccaagaccguguacaaccccgccgcccugaaggcggcccagaagacccugcucguguccacgagcgccgucgacaacaacgaggcccagaagaagaagcaggaggcccugaagcugcagcaggacgugcgcaagcggaagcaggagauccuggagaagcacaucgagacccagaagaugcucaucuccaagcuggagaagaacaagaccaugaaguccgaggacaaggcggagaucaugaagacccuggaggugcucacgaagaacaucaccaagcugaaggacgaggucaaggccgccucccccggccgcugccugcccaagagcaucaagaccaagacccagaugcagaaggagcuccuggacacggagcuggaccucuacaagaagaugcaggccggggaggaggugaccgagcugcggcgcaaguacaccgagcugcagcucgaggcggccaagcggggcauccuguccagcgggcgcggccggggcauccacucccgcgggcggggcgccgugcacgggcgcggccgcgggcggggccgcggccgcgggguccccggccacgccgugguggaccaccggccccgggcccuggagaucagcgcguucaccgaguccgaccgcgaggaccuccugccccacuucgcccaguacggggagaucgaggacugccagaucgacgacagcucccugcacgccgucaucacguucaagacccgggccgaggccgaggcggccgccgugcacggcgcccgcuucaagggccaggaccucaagcuggccuggaacaagccggugaccaacaucagcgcggucgagaccgaggagguggagcccgacgaggaggaguuccaggaggagagccugguggacgacucccuccugcaggacgacgacgaggaggaggaggacaacgagagccgguccuggcgccgguga

SEQ ID NO: 35543 - RNA, 3183 nt, Artificial Sequence
  derived and/or modified sequence opt1 from RBM27__Homo_sapiens__NP_061862
augcugaucgaggacguggacgcccucaagagcuggcuggccaagcugcucgagcccaucugcgacgcggacccguccgcccuggccaacuacgucguggcccuggugaagaaggacaagcccgagaaggagcucaaggccuucugcgcggaccagcuggacgucuuccugcagaaggagaccagcggcuucguggacaagcucuucgagucccuguacaccaagaacuaccugccccuccuggagcccgugaagccggagcccaagccccugguccaggagaaggaggagaucaaggaggagguguuccaggagcccgccgaggaggagcgcgacgggcggaagaagaaguacccgagcccccagaagacgcgcuccgagagcuccgagcggcgcacccgggagaagaagcgcgaggacggcaaguggcgggacuacgaccgcuacuacgagcggaacgagcucuaccgcgagaaguacgacuggcggcgcgggcggagcaagucccgcagcaagucccggggccugagccgcucccggagccgcucccgggggcgcagcaaggaccgggaccccaaccgcaacguggagcaccgcgagcgguccaaguucaagagcgagcgcaacgaccuggaguccagcuacguccccgugagcgccccgccccccaacuccagcgagcaguacuccagcggcgcccaguccauccccagcaccgugaccgucaucgcgccggcccaccacuccgagaacacgaccgagagcugguccaacuacuacaacaaccacagcuccagcaacuccuucggccggaaccucccccccaagcgccggugccgcgacuacgacgagcggggguucugcgugcugggcgaccugugccaguucgaccacgggaacgacccccucguggucgacgagguggcccugccgagcaugauccccuucccccccccgccccccggccugcccccgccccccccgcccgggaugcucaugccccccaugccgggccccggccccgggcccggcccggggcccggccccggccccgggccgggccccgggcccggccacuccaugcgccugcccgugccgcaggggcacggccagcccccccccagcgucgugcugccgaucccccggccccccaucacccaguccagccucaucaacucccgcgaccagccgggcaccagcgccgugcccaaccuggccagcgucgggacgcggcugcccccgccccucccccagaaccugcuguacaccguguccgagcgccagcccauguacagccgggagcacggcgcggccgccuccgagcgccuccagcuggggaccccgcccccccugcucgccgcccggcuggugcccccgcgcaaccugaugggcagcuccaucggguaccacaccagcgucuccagccccacgccccucgugcccgacaccuacgagccggacggcuacaaccccgaggcgcccuccaucaccagcuccggccggagccaguaccgccaguucuucucccggacccagacgcagcgccccaaccugaucgggcugaccagcggcgacauggacgucaacccgcgcgccgccaacaucgugauccagaccgagccccccgugcccgucuccaucaacagcaacaucacccggguggugcucgagccggacucccgcaagcgggccaugagcgggcuggagggcccccugacgaagaagcccuggcucgggaagcagggcaacaacaaccagaacaagcccggcuuccugcgcaagaaccaguacaccaacaccaagcuggaggucaagaagaucccgcaggagcucaacaacaucaccaagcugaacgagcacuucagcaaguucgggacgaucgugaacauccagguggccuucaagggcgaccccgaggcggcccugauccaguaccugaccaacgaggaggcccggaaggccaucuccagcaccgaggccguccucaacaaccgcuucauccgggugcuguggcaccgcgagaacaacgagcagcccacccugcaguccagcgcgcagcuccugcugcagcagcagcagacgcucucccaccugagccagcagcaccaccaccugccccagcaccuccaccagcagcaggugcuggucgcccaguccgccccgagcaccgugcacgggggcauccagaagaugauguccaagccccagaccagcggcgccuacgugcugaacaagguccccgugaagcaccggcucgggcacgcgggcgggaaccaguccgacgccagccaccugcugaaccaguccggcggggccggcgaggacugccagaucuucagcaccccgggccaccccaagaugaucuacuccagcuccaaccucaagacgcccagcaagcugugcuccgggagcaagagccacgacgugcaggagguccugaagaagaagcaggaggccaugaagcuccagcaggacaugcgcaagaagcggcaggaggugcuggagaagcagaucgagugccagaagaugcugaucuccaagcucgagaagaacaagaacaugaagcccgaggagcgcgccaacaucaugaagacccugaaggagcugggcgagaagaucagccagcucaaggacgagcugaagaccuccagcgcgguguccaccccgagcaaggucaagacgaagaccgaggcccagaaggagcugcucgacaccgagcuggaccugcacaagcggcucuccagcggggaggacaccaccgagcugcgcaagaagcugucccagcuccagguggaggccgcccggcugggcauccugcccguggggcgcggcaagacgaugagcucccagggccgggggcgcggccgggggcgcggcgggcggggccgcggcagccucaaccacauggucguggaccaccgccccaaggcccugaccguggggggcuucaucgaggaggagaaggaggaccugcuccagcacuucuccaccgcgaaccaggggcccaaguucaaggaccggcgccugcagaucagcuggcacaagccgaagguccccuccaucagcaccgagacggaggaggaggaggugaaggaggaggagaccgagaccuccgaccuguuccuccccgacgacgacgacgaggacgaggacgaguacgagagccgguccuggcgccgguga

SEQ ID NO: 35544 - RNA, 1857 nt, Artificial Sequence
  derived and/or modified sequence opt1 from RBM28__Homo_sapiens__NP_001159607
auggccggccugacccucuucguggggcgccugcccccgagcgcccgguccgagcagcuggaggagcuguucagccaggucggccccgugaagcagugcuucguggucaccgagaaggggcgcacgguggccguggacugggccgucgccaaggacaaguacaaggacacccaguccgugagcgccaucggcgaggagaagucccacgagagcaagcaccaggaguccgugaagaagaaggggcgggaggaggaggacauggaggaggaggagaacgacgacgacgacgacgacgacgacgaggaggacggcgucuucgacgacgaggacgaggaggaggagaacaucgagagcaaggugaccaagcccgugcagauccagaagcgcgccgucaagcggcccgcgccggccaaguccagcgaccacuccgaggaggacagcgaccucgaggaguccgacagcaucgacgacggcgaggagcuggcccaguccgacaccagcacggaggagcaggaggacaaggccguccagguguccaacaagaagaagcgcaagcuccccagcgacgugaacgaggggaagaccguguucauccggaaccuguccuucgacagcgaggaggaggagcugggcgagcuccugcagcaguucggggagcugaaguacgugcgcaucguccuccaccccgacaccgagcacagcaagggcugcgcguucgcccaguucaugacccaggaggccgcccagaagugccugcuggccgcgucccccgagaacgaggccgggggccucaagcuggacggccggcagcugaagguggaccucgccgugacgcgcgacgaggccgccaagcugcagaccaccaaggucaagaagccgaccgggacgcggaaccuguaccucgcgcgcgagggccugauccgggccgggaccaaggccgccgagggcgugagcgccgcggacauggccaagcgcgagcgguucgagcugcucaagcaccagaagcugaaggaccagaacaucuucgugucccgcacccggcugugccuccacaaccugcccaaggccgucgacgacaagcagcugcgcaagcuccugcugagcgccaccuccggcgagaagggggugcggaucaaggagugccgcgucaugcgggaccucaagggcgugcacgggaacaugaagggccagagccugggguacgccuucgcggaguuccaggagcacgagcacgcccugaaggcccuccgccugaucaacaacaaccccgagaucuucggcccccugaagcgcccgaucguggaguucucccucgaggaccggcgcaagcugaagaugaaggagcugcggauccagcgcagccuccagaagaugcgguccaagcccgccacgggcgagccccagaaggggcagcccgagccggcgaaggaccagcagcagaaggccgcccagcaccacaccgaggagcagagcaaggucccgcccgagcagaagcgcaaggccggcuccaccagcuggaccggguuccagacgaaggccgagguggagcaggucgagcugcccgacggcaagaagcggcgcaaggugcuggcgcuccccucccaccgggggcccaagauccgccugcgggacaagggcaaggugaagcccgugcaccccaagaagccgaagccccagaucaaccaguggaagcaggagaagcagcagcugagcuccgagcaggucagccgcaagaaggccaagggcaacaagaccgagacccgguucaaccagcucguggagcaguacaagcagaagcugcuggggcccuccaagggcgcgccccuggccaagcgcagcaagugguucgacuccuga

SEQ ID NO: 35545 - RNA, 816 nt, Artificial Sequence
  derived and/or modified sequence opt1 from RBM38__Homo_sapiens__NP_001278709
augcugcuccagcccgccccgugcgcccccagcgccggcuucccccgcccccuggccgccccgggggccaugcacggcucccagaaggacaccaccuucacgaagaucuucgucgggggccugcccuaccacaccaccgacgccagccuccggaaguacuucgagggguucggcgacaucgaggaggcgguggugaucaccgaccgccagacgggcaagucccggggguacggcuucgggaucaucuucgugcuggagggccacaucagccaggcccugaacuucgacgggcgcuccuggaaccccggcggcaucuucgucggggagccccaggugaccauggccgaccgggccgcggccgagcgcgccugcaaggacccgaaccccaucaucgacggccggaaggccaacgugaaccucgccuaccugggggcgaagccccgcagccugcagaccggcuucgccaucggcguccagcagcuccaccccacccugauccagcggacguacgggcugaccccgcacuacaucuacccgcccgccaucgugcagcccuccguggucauccccgccgcccccgugcccagccucuccagccccuacaucgaguacaccccggcgucccccgccuacgcccaguacccgcccgccaccuacgaccaguaccccuacgccgcgagccccgccacggccgccuccuucgugggcuacagcuaccccgccgcggucccccaggcccuguccgccgccgcgccggccgggaccaccuucgugcaguaccaggcgccccagcugcagcccgaccgcaugcaguga

SEQ ID NO: 35546 - RNA, 1527 nt, Artificial Sequence
  derived and/or modified sequence opt1 from RBM39__Homo_sapiens__NP_001229528
auggccgacgacaucgacaucgaggccaugcuggaggcgcccuacaagaaggacgagaacaagcucagcuccgccaacggccacgaggagcgcagcaagaagcggaagaaguccaagagccgcucccggagccacgagcgcaagcgguccaagagcaaggagcgcaagcggucccgcgaccgggagcgcaagaaguccaagagccgggagcgcaagcggagccgcuccaaggagcggcgccggagccgcucccggagccgcgaccggcgcuuccgcgggcgguaccgcuccccguaccggcgccggagccgcuccaagagccccuuccggaaggacaagagccccgugcgcgagcccaucgacaaccugaccccggaggagcgggacgcccgcaccgucuucugcaugcagcuggccgcccggauccgcccccgggaccucgaggaguucuucuccacggugggcaaggugcgcgacguccggaugaucagcgaccgcaacucccggcgcagcaaggggaucgcguacguggaguucguggacgucuccagcgugccccuggccaucggccugaccgggcagcgggugcucggcguccccaucaucgugcaggccucccaggccgagaagaaccgcgcggccgccauggccaacaaccugcagaagggcagcgccgggccgaugcgccuguacgugggcucccuccacuucaacaucaccgaggacaugcugcgggggaucuucgagcccuucggccgcaucgagagcauccagcugaugauggacuccgagaccgggcggagcaagggcuacggcuucaucacguucuccgacagcgagugcgcgaagaaggcccucgagcagcugaacggguucgagcuggccggccgccccaugaaggucgggcacgugaccgagcggaccgacgccuccagcgccuccagcuuccucgacuccgacgagcuggagcgcaccggcaucgaccugggcacgaccgggcggcuccagcugauggcgcgccuggccgagggcaccgggcuccagaucccgcccgccgcccagcaggcccugcagaugagcggcagccuggcguucggggccguggccgaguucuccuucgucaucgaccuccagacccggcugagccagcagacggaggccuccgcccuggcggccgccgccagcgugcagccccucgcgacccagugcuuccagcuguccaacauguucaacccccagaccgaggaggaggugggcugggacaccgagaucaaggacgacgucaucgaggagugcaacaagcacggcggggugauccacaucuacguggacaagaacagcgcccagggcaacgucuacgugaagugccccuccaucgccgccgccaucgcggccgugaacgcccugcacgggcgcugguucgccggcaagaugaucacggccgcguacgucccgcuccccaccuaccacaaccuguuccccgacagcaugaccgccacccagcugcucgugcccucccggcgcuga

SEQ ID NO: 35547 - RNA, 474 nt, Artificial Sequence
  derived and/or modified sequence opt1 from RBM3__Homo_sapiens__NP_006734
augagcuccgaggagggcaagcuguucgucgggggccucaacuucaacaccgacgagcaggcccuggaggaccacuucagcuccuucgggcccaucagcgagguggugguggucaaggaccgcgagacccagcggucccgcggcuucggguucaucacguucaccaacccggagcacgccagcguggcgaugcgggccaugaacggcgagucccuggacggccgccagauccggguggaccacgccggcaagagcgcccgcgggacccgcgggggcggguucggcgcccacggccgggggcgguccuacagccgcggcgggggcgaccagggcuacggguccggccgguacuacgacagccgccccgggggcuacggguacggcuacggccggucccgcgacuacaacgggcggaaccagggcggguacgaccgcuacagcggcgggaacuaccgggacaacuacgacaacuga

SEQ ID NO: 35548 - RNA, 1425 nt, Artificial Sequence
  derived and/or modified sequence opt1 from RBM45__Homo_sapiens__NP_694453
auggacgaggccggcagcuccgccagcgggggcggguuccgccccggcguggacucccuggacgagccgcccaacagccggaucuuccucgucaucuccaaguacacccccgagagcgugcugcgcgagcgguucucccccuucggggacauccaggacaucugggugguccgcgacaagcacaccaaggagagcaagggcaucgcguucgugaaguucgcccgguccagccaggccugccgcgccauggaggagaugcacggccagugccuggggccgaacgacacgaagcccaucaagguguucaucgcccagucccggagcuccggcagccaccgcgacgucgaggacgaggagcucacccggaucuucgugaugauccccaaguccuacaccgaggaggaccugcgcgagaaguucaagguguacggggacaucgaguacugcagcaucaucaagaacaaggucaccggcgaguccaaggggcugggcuacgugcgguaccucaagcccagccaggcggcccaggccaucgagaacugcgaccgcuccuuccgggccauccuggcggagccgaagaacaaggccagcgagagcuccgagcaggacuacuacagcaacaugcgccaggaggcccugggccacgagccccgggugaacauguuccccuucgagcagcaguccgaguucagcuccuucgacaagaacgacagccgcgggcaggaggccaucuccaagcggcucagcgucgugucccgcgugcccuucacggaggagcagcuguucagcaucuucgacaucgucccgggccuggaguacugcgaggugcagcgggaccccuacuccaacuacgggcacggcgugguccaguacuucaacguggccagcgcgaucuacgccaaguacaagcuccacggcuuccaguacccgcccgggaaccgcaucggcguguccuucaucgacgacgggagcaacgccaccgaccugcugcggaagauggccacccagauggucgccgcgcagcucgccuccaugguguggaacaaccccagccagcagcaguucaugcaguucggcggguccagcggcucccagcugccccagauccagaccgacgugguccugcccagcugcaagaagaaggcccccgccgagacgccggugaaggagcgccucuucaucgucuucaacccccacccccugccccuggacgugcucgaggacaucuucugccgcuucggcaaccugaucgagguguaccuggucagcgggaagaacgugggcuacgccaaguacgcggaccggaucuccgccaacgacgccaucgccacccuccacgggaagauccugaacggcgugcgccugaaggucaugcucgccgacagcccgcgggaggaguccaacaagcgccagcggaccuacuga

SEQ ID NO: 35549 - RNA, 1602 nt, Artificial Sequence
  derived and/or modified sequence opt1 from RBM46__Homo_sapiens__NP_659416
augaacgaggagaacaucgacggcaccaacgggugcagcaaggugcgcaccggcauccagaacgaggccgcccugcucgcgcugauggagaagacgggguacaacaugguccaggagaacggccagcggaaguucgggggcccgccgcccggcugggaggggccgccgccgccccgcggcugcgagguguucguggggaagaucccccgggacauguacgaggacgagcugguccccguguucgagcgcgccggcaagaucuacgaguuccggcucaugauggaguucuccggggagaaccgcggcuacgccuucgugauguacaccaccaaggaggaggcccagcuggccauccggauccugaacaacuacgagauccgccccggcaaguucaucggggucugcgugagccucgacaacugccggcuguucaucggcgcgauccccaaggagaagaagaaggaggagauccuggacgagaugaagaaggugaccgagggggucguggacgugaucgucuaccccuccgccacggacaagaccaagaaccgcggcuucgccuucguggaguacgagagccaccgggccgcggccauggcccgccggaagcucauccccggcaccuuccagcugugggggcacaccauccagguggacugggccgaccccgagaaggaggucgacgaggagacgaugcagcgcgugaaggugcuguacguccggaaccucaugaucuccaccaccgaggagaccaucaaggccgaguucaacaaguucaagcccggcgcgguggagcgcgugaagaagcugcgggacuacgccuucguccacuucuucaaccgcgaggacgccguggccgccaugagcgugaugaacgggaagugcaucgacggcgcguccaucgaggucacgcuggccaagcccgugaacaaggagaacaccuggcggcagcaccucaacgggcagaucagccccaacuccgagaaccugaucgucuucgccaacaaggaggagagccaccccaagacccugggcaagcuccccacccugcccgcccgccugaacggccagcacucccccagcccgcccgagguggagcggugcacguaccccuucuaccccgggaccaagcucaccccgaucuccauguacagccugaaguccaaccacuucaacagcgccgugaugcaccuggacuacuacugcaacaagaacaacugggcgccgcccgaguacuaccucuacuccaccacgagccaggacggcaagguccugcugguguacaagaucgugauccccgccaucgccaacgggucccagagcuacuucaugcccgacaagcucugcaccacccuggaggacgccaaggagcuggccgcgcaguucacccuccugcaccuggacuacaacuuccaccgcagcuccaucaacagccucucccccgucagcgccacgcuguccagcggcacccccuccgugcugccguacaccagccgccccuacuccuaccccggguacccccucagcccgaccaucucccuggccaacggcagccacgugggccagcggcugugcaucuccaaccaggccagcuucuucuga

SEQ ID NO: 35550 - RNA, 1782 nt, Artificial Sequence
  derived and/or modified sequence opt1 from RBM47__Homo_sapiens__NP_001092104
augaccgccgaggacagcaccgccgcgauguccagcgacuccgccgccggcagcuccgccaaggugcccgagggggucgccggcgcgccgaacgaggccgcccugcucgcccugauggagcgcacgggguacagcauggugcaggagaacggccagcggaaguacgggggcccgccgcccggcugggaggggccccacccccagcgcggcugcgagguguucgucgggaagaucccccgggacguguacgaggacgagcuggugcccgucuucgaggcggugggccgcaucuacgagcuccggcugaugauggacuucgacgggaagaaccgcggcuacgccuucgugauguacugccacaagcacgaggccaagcgggccguccgcgagcugaacaacuacgagauccggcccggccgccuccugggggugugcugcuccguggacaacugccggcuguucaucggcgggauccccaagaugaagaagcgcgaggagauccucgaggagaucgccaaggucaccgagggcgugcuggacgugaucgucuacgcgagcgccgccgacaagaugaagaaccggggcuucgccuucguggaguacgagucccaccgcgccgcggccauggcccggcgcaagcugaugcccgggcggauccagcucuggggccaccagaucgccguggacugggccgagcccgagaucgacgucgacgaggacgugauggagaccgugaagauccuguacguccgcaaccugaugaucgagaccacggaggacaccaucaagaaguccuucgggcaguucaacccgggcugcguggagcgggugaagaagauccgcgacuacgcguucguccacuucaccagccgggaggacgccgugcacgccaugaacaaccucaacgggaccgagcuggagggcagcugccuggaggucacgcucgccaagcccguggacaaggagcaguacucccgcuaccagaaggccgcgcgcggcgggggcgccgccgaggccgcgcagcagcccagcuacguguacuccugcgaccccuacacccuggccuacuacggguacccguacaacgcccugaucggccccaaccgggacuacuucgucaaggccgggagcauccgcggccggggccgcggggccgcgggcaaccgggcccccgggccccgcggcuccuaccucgggggcuacagcgccggccgggggaucuacucccgcuaccacgagggcaaggggaagcagcaggagaagggcuacgagcuggugccgaaccuggagauccccaccgugaaccccgucgccaucaagcccggcaccguggccaucccggcgaucggggcccaguacagcauguuccccgccgcccccgcccccaagaugaucgaggacggcaagauccacacgguggagcacaugaucagcccgaucgcgguccagcccgaccccgccuccgccgccgcggccgccgccgccgcggccgccgccgccgcggccgugaucccgaccgugagcaccccgccgcccuuccaggggcggcccaucacccccgucuacacgguggcccccaacgugcagcgcauccccaccgccggcaucuacggggccuccuacguccccuucgcggcccccgccaccgccaccaucgcgacgcuccagaagaacgccgccgccgccgcggccauguacggcggcuacgccggguacaucccccaggccuuccccgccgcggccauccaggugccgauccccgacguguaccagaccuacuga

SEQ ID NO: 35551 - RNA, 432 nt, Artificial Sequence
  derived and/or modified sequence opt1 from RBM4__Homo_sapiens__NP_001185772
auggugaagcuguucaucggcaaccucccccgcgaggccaccgagcaggagauccggagccuguucgagcaguacgggaagguccuggagugcgacaucaucaagaacuacggcuucgugcacaucgaggacaagaccgccgcggaggacgccauccgcaaccuccaccacuacaagcugcacggggugaacaucaacgucgaggccuccaagaacaagagcaagacguccaccaagcugcacgugggcaacaucagcccgaccugcaccaacaaggagcuccgggccaaguucgaggaguacgggcccgugaucgagugcgacaucgucaaggacuacgccuucgugcacauggagcgcgcggaggacgccguggaggccauccggggccuggacaacacggaguuccagggcgggaugugcgucggcuga

SEQ ID NO: 35552 - RNA, 2448 nt, Artificial Sequence
  derived and/or modified sequence opt1 from RBM5__Homo_sapiens__NP_005769
augggcagcgacaagcgcgugucccggaccgagcgcagcgggcgguacggcuccaucaucgaccgcgacgaccgggacgagcgcgagagccggucccgccggcgcgacagcgacuacaagcgguccagcgacgaccgccgcggggaccgguacgacgacuaccgggacuacgacucccccgagcgcgagcgggagcgccggaacagcgaccgcuccgaggacggcuaccacagcgacggggacuacggcgagcacgacuaccggcacgacaucuccgacgagcgcgagagcaagaccaucaugcugcgcggccucccgaucacgaucaccgaguccgacauccgggagaugauggagagcuucgaggggccccagcccgccgacguccgccugaugaagcggaagaccggcgugucccgcggguucgccuucguggaguucuaccaccuccaggacgcgaccagcuggauggaggccaaccagaagaagcuggucauccagggcaagcacaucgccaugcacuacuccaacccccggccgaaguucgaggacuggcugugcaacaagugcugccugaacaacuuccgcaagcggcucaagugcuuccgcugcggggccgacaaguucgacagcgagcaggaggugccgcccggcacgaccgagagcgugcaguccgucgacuacuacugcgacaccaucauccugcggaacaucgcgccccacaccgugguggacagcaucaugacggcccugucccccuacgccagccucgccgucaacaacauccgccugaucaaggacaagcagacccagcagaaccggggcuucgccuucgugcagcuguccagcgcgauggacgccucccagcuccugcagauccugcagagccuccacccgccccugaagaucgacgggaagaccaucggcguggacuucgccaaguccgcccgcaaggaccugguccucagcgacgggaaccggguguccgccuucagcguggcguccaccgccaucgccgccgcccaguggagcuccacgcagagccaguccggcgagggcgggagcgucgacuacuccuaccugcagcccggccaggacggguacgcgcaguacgcccaguacagccaggacuaccagcaguucuaccagcagcaggccggcgggcuggagagcgacgccuccagcgccuccggcaccgcggugaccaccacgagcgccgccguggucucccagagcccccagcucuacaaccagaccuccaacccgcccggcagccccaccgaggaggcccagcccuccaccagcacguccacccaggcccccgcggccagccccaccgggguggugcccggcaccaaguacgccgucccggacacguccaccuaccaguacgacgagagcuccggguacuacuacgaccccaccaccggccuguacuacgaccccaacagccaguacuacuacaacucccugacgcagcaguaccucuacugggacggggagaaggagaccuacgugcccgccgcggagagcagcucccaccagcagagcggccugccgcccgccaaggagggcaaggagaagaaggagaagcccaaguccaagaccgcccagcagaucgccaaggacauggagcgcugggccaagagccugaacaagcagaaggagaacuucaagaacuccuuccagcccgugaacagccuccgggaggaggagcgccgggaguccgcggccgccgacgccggguucgcccuguucgagaagaagggcgcgcuggccgagcgccagcagcucaucccggagcugguccggaacggggacgaggagaacccccugaagcgcggccucguggccgccuacagcggggacuccgacaacgaggaggagcuggucgagcgccuggagagcgaggaggagaagcucgccgacuggaagaagauggcgugccugcugugccggcgccaguuccccaacaaggacgcccucgugcggcaccagcagcuguccgaccugcacaagcagaacauggacaucuaccgccggagccgccucuccgagcaggagcuggaggcccuggagcuccgggagcgcgagaugaaguaccgggaccgcgccgcggagcggcgcgagaaguacggcaucccggagccgcccgagcccaagcggaagaagcaguucgacgccggcaccgugaacuacgagcagcccacgaaggacgggaucgaccacagcaacaucggcaacaagaugcugcaggccaugggguggcgcgagggcuccggccuggggcggaagugccagggcaucaccgcccccaucgaggcccagguccgccucaagggggcgggccugggggccaagggcagcgccuacggccuguccggggccgacagcuacaaggacgccgugcggaaggcgauguucgcccgcuucaccgagauggaguga

SEQ ID NO: 35553 - RNA, 3372 nt, Artificial Sequence
  derived and/or modified sequence opt1 from RBM6__Homo_sapiens__NP_005768
auguggggcgacagccgccccgccaaccggaccgggccguuccgcggcucccaggaggagcgguucgcccccggguggaaccgcgacuacccccccccgccccugaagagccacgcgcaggagcggcacuccggcaacuuccccgggcgcgacagccuccccuucgacuuccagggccacuccggcccgcccuucgccaacguggaggagcacagcuucuccuacggggcccgggacggcccccacggggacuaccgcggcggggagggccccggccacgacuuccgggggggcgacuucagcuccagcgacuuccagucccgcgacagcucccagcuggacuuccgggggcgcgacauccacagcggcgacuuccgggaccgcgagggcccgcccauggacuaccgggggggcgacgggaccuccauggacuaccgcggccgggaggccccccacaugaacuaccgcgaccgggacgcccacgcggucgacuuccgcgggcgggacgcccccccgagcgacuuccgcggccgcggcacguacgaccuggacuuccgggggcgcgacggcucccacgccgacuuccgggggcgcgaccucagcgaccuggacuuccgggcccgcgagcagucccggagcgacuuccgcaaccgggacgugagcgaccuggacuuccgcgacaaggacggcacccagguggacuuccgggggcgcggcuccggcaccaccgaccucgacuuccgggaccgcgacacgccccacagcgacuuccgggggcgccaccggucccgcaccgaccaggacuuccggggccgcgagauggggagcugcauggaguucaaggaccgcgagaugccccccgucgacccgaacauccuggacuacauccagcccuccacccaggaccgggagcacagcggcaugaacgugaaccgccgggaggaguccacccacgaccacacgaucgagcgccccgcguucgggauccagaagggcgaguucgagcacagcgagacccgggagggcgagacccaggggguggccuucgagcacgagucccccgccgacuuccagaacagccaguccccgguccaggaccaggacaagagccagcuguccggccgcgaggagcagagcuccgacgccgggcucuucaaggaggagggcggccuggacuuccuggggcggcaggacaccgacuaccgcagcauggaguaccgggacguggaccaccgccuccccggcucccagauguucggguacggccagagcaaguccuuccccgaggggaagacggcccgggacgcgcagcgcgaccugcaggaccaggacuaccggaccggccccagcgaggagaagccgagccgccugauccggcucuccggcgugcccgaggacgccaccaaggaggagauccugaacgccuuccgcacccccgacgggaugccggucaagaaccugcagcucaaggaguacaacacgggcuacgacuacggguacgugugcguggaguucagccugcuggaggacgccaucggcugcauggaggccaaccaggggacccucaugauccaggacaaggaggucacccuggaguacguguccagccuggacuucugguacugcaagcggugcaaggcgaacaucggcggccaccgcuccagcugcuccuucugcaagaacccccgggaggugaccgaggccaagcaggagcucaucacguacccccagccccagaagaccagcaucccggccccccuggagaagcagcccaaccagccccugcgcccggccgacaaggagcccgagccccggaagcgcgaggaggggcaggagucccgccucggccaccagaagcgggaggccgagcgcuaccugcccccgagccggcgcgaggggcccaccuuccggcgcgaccgggagcgcgaguccuggagcggcgagacccggcaggacggggaguccaagacgaucaugcugaagcgcaucuaccggagcaccccccccgaggucaucguggaggugcucgagccguacguccgccugaccaccgcgaacgugcggaucaucaagaaccgcacgggccccaugggccacaccuacggguucaucgaccuggacucccacgccgaggcccuccggguggucaagauccugcagaaccuggacccccccuucagcaucgacggcaagaugguggccgugaaccucgccaccgggaagcgccggaacgacuccggcgaccacagcgaccacaugcacuacuaccaggggaagaaguacuuccgcgaccggcgcggcggcgggcgcaacagcgacugguccagcgacaccaaccggcagggccagcaguccagcuccgacugcuacaucuacgacagcgcgacgggguacuacuacgacccgcuggccggcaccuacuacgaccccaacacccagcaggaggucuacgugccccaggaccccggccugccggaggaggaggagaucaaggagaagaagcccaccucccaggggaagagcuccagcaagaaggagauguccaagcgcgacggcaaggagaagaaggaccggggggucacgcgcuuccaggagaacgccagcgagggcaaggcccccgcggaggacguguucaagaagccgcucccccccaccgugaagaaggaggagucccccccgccccccaaggucgugaacccccugaucgggcugcucggcgaguacggcggggacagcgacuacgaggaggaggaggaggaggagcagaccccgcccccccagccccggaccgcccagccgcagaagcgcgaggagcagaccaagaaggagaacgaggaggacaagcugacggacuggaacaagcuggccugccuccugugccggcgccaguuccccaacaaggaggugcugaucaagcaccagcagcucuccgaccugcacaagcagaaccuggagauccaccggaagaucaagcagagcgagcaggagcuggccuaccucgagcgccgggagcgcgagggcaaguucaaggggcggggcaacgaccgccgggagaagcugcaguccuucgacagccccgagcgcaagcggaucaaguacucccgcgagaccgacagcgaccggaagcuggucgacaaggaggacaucgacaccagcuccaaggggggcugcgugcagcaggccaccggcuggcgcaaggggacgggccucggguacggccaccccgggcuggcgagcuccgaggaggccgagggccggaugcgcggcccgagcgugggggccuccggccgcaccagcaagcggcaguccaacgagaccuaccgcgacgccguccggcgcgugauguucgcccgguacaaggagcuggacuga

SEQ ID NO: 35554 - RNA, 801 nt, Artificial Sequence
  derived and/or modified sequence opt1 from RBM7__Homo_sapiens__NP_057174
augggcgccgccgcggccgaggccgaccgcacccuguucguggggaaccucgagaccaaggucacggaggagcugcuguucgagcuguuccaccaggccggccccgugaucaaggugaagaucccgaaggacaaggacgggaagcccaagcaguucgccuucgucaacuucaagcacgaggugagcgugcccuacgcgaugaaccuccugaacggcaucaagcucuacgggcggcccaucaagauccaguuccgcuccggcagcucccacgccccgcaggacgucagccuguccuacccccagcaccacgugggcaacagcucccccaccagcaccucccccagccgguacgagcgcaccauggacaacaugacguccagcgcccagaucauccagcgguccuucagcuccccggagaacuuccagcgccaggccgugaugaacagcgcgcugcggcagauguccuacgggggcaaguucgggagcagcccccucgaccaguccggcuucagccccuccguccagagccacucccacagcuucaaccaguccagcuccagccaguggcgccaggggacccccuccagccagcggaaggugcgcaugaacuccuacccguaccuggccgaccggcacuacagccgcgagcagcgguacaccgaccacggcuccgaccaccacuaccgcggcaagcgggacgacuucuucuacgaggaccgcaaccacgacgacuggagccacgacuacgacaaccggcgcgacuccagccgggacgggaaguggcgcuccagccggcacuga

SEQ ID NO: 35555 - RNA, 1212 nt, Artificial Sequence
  derived and/or modified sequence opt1 from RBMS1__Homo_sapiens__NP_002888
augggcaagguguggaagcagcagauguacccccaguacgccaccuacuacuacccgcaguaccugcaggccaagcagagccucguccccgcgcaccccauggcgcccccgucccccagcaccacguccagcaacaacaacuccagcuccagcuccaacagcgggugggaccagcuguccaagaccaaccuguacauccgcggccucccgccccacaccaccgaccaggaccuggugaagcugugccagcccuacgggaagaucgugagcacgaaggccauccucgacaagaccaccaacaagugcaagggcuacggguucgucgacuucgacucccccgccgccgcccagaaggccgugagcgcccugaaggccuccggcgugcaggcgcagauggccaagcagcaggagcaggaccccaccaaccuguacaucagcaaccucccccuguccauggacgagcaggagcuggagaacaugcucaagccguucggccaggucaucagcacgcggauccugcgcgacuccagcgggaccagccggggcgugggguucgcccgcauggaguccaccgagaagugcgaggccgugaucggccacuucaacgggaaguucaucaagaccccgcccggcgucagcgcccccacggagccccugcucugcaaguucgcggacggcgggcagaagaagcggcagaaccccaacaaguacauccccaacggccgccccuggcaccgggagggggaggccggcaugacccugaccuacgacccgaccacggccgccauccagaacggcuucuaccccucccccuacagcaucgccaccaaccgcaugaucacccagaccuccaucacgcccuacaucgcgagcccgguguccgccuaccaggugcagagccccuccuggaugcagccccagcccuacauccugcagcacccgggggccguccucacccccagcauggagcacaccaugucccugcagcccgccagcaugaucuccccgcuggcccagcagaugagccaccucucccugggcagcaccgggacguacaugcccgcgaccuccgccaugcagggcgccuaccugccccaguacgcccacaugcagaccaccgccgugcccguggaggaggcgagcgggcagcagcaggucgccguggagacguccaacgaccacagcccguacaccuuccagcccaacaaguga

SEQ ID NO: 35556 - RNA, 1224 nt, Artificial Sequence
  derived and/or modified sequence opt1 from RBMS2__Homo_sapiens__NP_002889
augcugcucagcgugaccucccgccccggcaucagcaccuucggguacaaccggaacaacaagaagccguacgucucccuggcccagcagauggccccgcccagccccuccaacagcacgcccaacuccagcuccggcagcaacgggaacgaccagcuguccaagaccaaccucuacauccgcggccugcagcccgggaccaccgaccaggaccuggugaagcucugccagcccuacggcaagaucgugagcacgaaggcgauccuggacaagaccaccaacaagugcaagggcuacggguucgucgacuucgacucccccagcgccgcccagaaggccgugaccgcccugaaggcguccggcgugcaggcccagauggccaagcagcaggagcaggacccgacgaaccucuacaucagcaaccugccccuguccauggacgagcaggagcucgaggggaugcugaagcccuucggccaggucaucagcacccggauccugcgcgacaccuccgggaccagccggggcgugggcuucgcccgcauggagagcacggagaagugcgaggcgaucaucacccacuucaacgggaaguacaucaagacgcccccgggcgugcccgcccccuccgacccccuccugugcaaguucgccgacgggggcccgaagaagcggcagaaccagggcaaguucguccagaacgggcgcgccuggccccggaacgccgacaugggcgugauggcgcugaccuacgaccccaccaccgcccuccagaacggguucuaccccgccccguacaacaucacccccaaccgcaugcuggcccagagcgcccugucccccuaccucagcucccccgugagcuccuaccagcgggucacccagacgagcccgcuccaggugcccaaccccuccuggaugcaccaccacagcuaccugaugcagcccuccggcagcgugcugaccccggggauggaccaccccaucucccugcagcccgcgagcaugaugggcccgcugacccagcagcucggccaccugucccugagcuccaccgggacguacaugcccaccgccgccgccaugcagggcgccuacaucagccaguacacccccguccccuccagcagcguguccguggaggagagcuccgggcagcagaaccaggucgcgguggacgccccgagcgagcacggcguguacuccuuccaguucaacaaguga

SEQ ID NO: 35557 - RNA, 1260 nt, Artificial Sequence
  derived and/or modified sequence opt1 from RBMS3__Homo_sapiens__NP_001003792
augggcaagcgccuggaccagccccagauguacccgcaguacaccuacuacuacccccacuaccuccagaccaagagcuacgcccccgcgccccacccgauggccccgcccucccccagcacgaacuccagcuccaacaacagcuccaacaacagcuccggggagcagcugagcaagaccaaccuguacauccggggccucccgcccgggaccaccgaccaggaccugaucaagcugugccagcccuacggcaagaucguguccacgaaggccauccucgacaagaacaccaaccagugcaagggguacggcuucgucgacuucgacagccccgccgccgcccagaaggcgguggccucccugaaggccaacggcgugcaggcccagauggcgaagcagcaggagcaggacccgaccaaccuguacaucagcaaccuccccaucuccauggacgagcaggagcuggagaacaugcugaagcccuucgggcacgucaucagcacccgcauccuccgggacgccaacggcgugucccgcggggugggcuucgcccggauggagagcacggagaagugcgaggucgugauccagcacuucaacgggaaguaccugaagaccccgcccggcauccccgcccccuccgagccccugcucugcaaguucgccgacggcgggcagaagaagcgccagaaccagagcaaguacacccagaacggccggcccuggccccgcgagggggaggcgggcauggcccugaccuacgaccccacggccgccauccagaacggcuucuacagcucccccuacagcaucgccaccaaccggaugaucccgcagaccuccaucacccccuucaucgcggccagccccguguccacguaccagggggccgucaucacccccaccauggaccacccgaugagcaugcagcccgccaacaugaugggcccccugacccagcagaugaaccaccucucccuggggacgaccggcaccauccagagccaggaccgcaucaugauccugcaccagcuccugugccaguacaugaccgccgcggccccgaugcaggggacguacaucccccaguacacccccgugcccccgaccgccguguccaucgagggcgucguggccgacaccagcccccagacgguggcccccuccagccaggacaccuccggccagcagcagcagaucgcggucgacaccagcaacgagcacgcccccgccuacuccuaccagcagagcaagccguga

SEQ ID NO: 35558 - RNA, 969 nt, Artificial Sequence
  derived and/or modified sequence opt1 from RBMX2__Homo_sapiens__NP_057108
augaacccccugaccaaggugaagcucaucaacgagcugaacgagcgcgagguccagcugggcguggccgacaaggugagcuggcacuccgaguacaaggacagcgccuggaucuuccucgggggccugccguacgagcugaccgagggggacaucaucugcgucuucucccaguacggcgagaucgugaacaucaaccucgugcgggacaagaagacgggcaagagcaagggguucugcuuccugugcuacgaggaccagcgcuccaccauccuggcggucgacaacuucaacggcaucaagaucaaggggcggaccauccgcguggaccacgugagcaacuaccgggcccccaaggacuccgaggagaucgacgacgucacccgccagcuccaggagaagggcugcggggcccggacgcccagccccucccugagcgaguccagcgaggacgagaagccgaccaagaagcacaagaaggacaagaaggagaagaagaagaagaagaaggagaaggagaaggccgaccgcgaggugcaggccgagcagcccuccagcuccagcccccggcgcaagaccgugaaggagaaggacgacaccggccccaagaagcacuccagcaagaacuccgagcgggcgcagaaguccgagccgcgcgaggggcagaagcugcccaagagccggacggccuacagcggcggcgccgaggaccucgagcgcgagcugaagaaggagaagcccaagcacgagcacaagagcuccagccggcgcgaggcccgggaggagaagacccgcauccgggaccgcgggcgguccagcgacgcgcacuccagcugguacaacggccgcuccgaggggcgcagcuaccggucccgcagccggucccgcgacaagagccaccggcacaagcgcgcccggcgcucccgggagcgcgagagcuccaaccccagcgaccgguggcgccacuga

SEQ ID NO: 35559 - RNA, 591 nt, Artificial Sequence
  derived and/or modified sequence opt1 from RBMX__Homo_sapiens__NP_001158275
augguggaggccgaccgccccggcaagcuguucaucgggggccucaacaccgagaccaacgagaaggcccuggaggcggucuucgggaaguacggccggaucguggaggugcugcucaugaaggaccgcgagacgaacaagagccggggguucgccuucgucaccuucgaguccccggccgacgccaaggacgccgcgcgcgacaugaacggcaagcugcuguaccacguggaggagaucgugauggagguccaccucgagggcaaccggugcccccugguggagauguucaucugcccccaggagaugauggggauccugcucaagaccgccauccaggccgagaucacccaggugcuggucauccuggagaucaugcaccaccaccacgagaucauccucacggugaucauggugauccccguccacgugaugaccauccaccaggaggacaucgccaucgagauggacaugguggucaucgugaccauccagaucauccagguggaggucccgaccgagauccacaugcgcgugauggugggcgacuucgcgcacuacgggcggggcguccugaucgacagccaguga

SEQ ID NO: 35560 - RNA, 1179 nt, Artificial Sequence
  derived and/or modified sequence opt1 from RBMXL2__Homo_sapiens__NP_055284
augguggaggccgaccgccccggcaagcuguucaucgggggccugaaccuggagaccgacgagaaggcccuggaggcggaguucgggaaguacggccggaucgucgaggugcuccugaugaaggaccgcgagaccaacaagagccggggguucgccuucgugacguucgagucccccgccgacgccaaggccgcggcccgcgacaugaacggcaagagccuggacggcaaggccaucaaggucgcccaggcgaccaagcccgccuucgaguccagccggcgcgggccgcccccgccccggucccgcggccggccccgcuuccuccgggggacccgcggcgggggcggcgggccccggcgcagcccgucccggggcgggcccgacgacgacggcggcuacaccgccgacuucgaccugcgccccagccgggcccccaugccgaugaagcgcgggcccccgccccggcgcguggggcccccgcccaagcgggccgcgcccuccggccccgcccgcagcuccggcgggggcaugcgcggccgggcccuggccgugcgcgggcgggacggcuacagcgggccgccccgccgggagccccucccgccccgccgggaccccuaccugggcccccgcgacgagggguacuccagccgggacggcuacuccagccgcgacuaccgggagccccgcggcuucgcccccucccccggggaguacacgcaccgggacuacggccacagcuccguccgcgacgacugcccgcugcggggguacagcgaccgcgacggcuacgggggccgggaccgcgacuacggcgaccaccucagccgggggucccaccgcgagcccuucgagagcuacggcgagcugcgcggggcggcccccggccggggcaccccgcccuccuacgggggcgggggccgcuacgaggaguaccggggguacagccccgacgccuacuccggcggccgcgacagcuacuccagcuccuacgggcggagcgaccgcuacucccggggccgccaccggguggggcgccccgaccggggccugagccucuccauggagcgcgggugcccgccccagcgggacagcuacucccgcagcggcugccgggugccccgcggcgggggccggcucgggggccgccuggagcgcgggggcggccggucccgguacuga

SEQ ID NO: 35561 - RNA, 1491 nt, Artificial Sequence
  derived and/or modified sequence opt1 from RBMY1A1__Homo_sapiens__XP_011529738
augguggaggccgaccaccccggcaagcuguucaucgggggccucaaccgcgagaccaacgagaagaugcugaaggccgucuucgggaagcacggcccgaucagcgaggugcugcucaucaaggaccggaccuccaagagccgcggguucgcguucaucacguucgagaaccccgccgacgccaagaacgccgccaaggacaugaacggcaagucccugcacggcaaggcgaucaagguggagcaggccaagaagcccagcuuccaguccgggggccggcgccggcccccggccagcucccgcaaccggagccccuccgggagccugcgcuccgcccggggcagccgcgggggcacccggggcuggcuccccucccacgaggggcaccuggacgacggcggguacacccccgaccugaagaugagcuacucccgcggccucaucccggucaagcggggccccagcucccgcagcgggggcccccccccgaagaaguccgcgcccagcgccguggcccggagcaacuccuggauggggagccagggccccaugucccagcgccgggagaacuacggggugcccccgcgccgggccaccaucagcuccuggcgcaacgaccggaugagcacgcgccacgacggcuacgccaccaacgacggcaaccaccccuccugccaggagacccgcgacuacgcgccccccagccggggguacgccuaccgcgacaacggccacuccaaccgggacgagcacagcucccgcggguaccggaaccaccgcagcucccgggagacccgcgacuacgccccgcccagccggggccacgccuaccgcgacuacgggcacucccggcgcgacgagagcuacucccggggcuaccgcaaccggcgcagcucccgggagacgcgcgaguacgccccccccagccggggccacggguaccgcgacuacggccacagccgccggcacgaguccuacagccgcggguaccggaaccacccguccagccgcgagacccgggacuacgcgcccccccaccgcgacuacgccuaccgggacuacggccacuccagcugggacgagcacuccagccgcggguacuccuaccacgacggcuacggcgaggcccuggggcgggaccacagcgagcaccuguccggcagcuccuaccgcgacgcccuccagcgguacgggaccagccacggcgcccccccggcgcgcggcccccggauguccuacgggggcagcaccugccacgccuacuccaacacgcgcgaccgguacgggcgcagcugggagagcuacuccagcugcggcgacuuccacuacugcgaccgggagcacgucugccgcaaggaccagcggaaccccccgucccuggggcgcgugcugcccgacccccgggaggccugcggcagcuccagcuacguggccuccaucgucgacggcggggagagccgcuccgagaagggcgacagcucccgcuacuga

SEQ ID NO: 35562 - RNA, 474 nt, Artificial Sequence
  derived and/or modified sequence opt1 from RBP1__Homo_sapiens__NP_001124464
auggacccgcccgccggcuucgugcgcgccgggaaccccgcggucgccgcgccccagagcccccuguccccggagggcgcccacuuccgggccgcccaccacccccgcagcaccgggucccggugccccggcagccuccagcccucccgcccgcugguggccaacuggcugcagagccuccccgagaugcccguggacuucaccggguacuggaagaugcuggucaacgagaacuucgaggaguaccugcgggcccucgacgugaacguggcccugcgcaagaucgcgaaccugcucaagcccgacaaggagaucguccaggacggcgaccacaugaucauccggacgcuguccaccuuccgcaacuacaucauggacuuccaggugggcaaggaguucgaggaggaccugaccgggaucgacgaccggaagugcauggccggcgugcagagccgcgaccucuccagccuguga

SEQ ID NO: 35563 - RNA, 405 nt, Artificial Sequence
  derived and/or modified sequence opt1 from RBP2__Homo_sapiens__NP_004155
augacccgcgaccagaacggcaccugggagauggagagcaacgagaacuucgagggguacaugaaggcccuggacaucgacuucgccacgcggaagaucgcggugcgccucacccagaccaaggucaucgaccaggacggcgacaacuucaagaccaagacgaccuccaccuuccggaacuacgacguggacuucaccgugggggucgaguucgacgaguacaccaagagccuggacaaccgccacgugaaggcccuggugaccugggagggcgacguccucgugugcgugcagaagggggagaaggagaaccggggcuggaagcaguggaucgagggcgacaagcuguaccuggagcucacgugcggggaccaggucugccgccagguguucaagaagaaguga

SEQ ID NO: 35564 - RNA, 3744 nt, Artificial Sequence
  derived and/or modified sequence opt1 from RBP3__Homo_sapiens__NP_002891
augaugcgcgagugggugcugcucaugagcguccugcugugcggccucgccgggcccacccaccuguuccagccgucccuggugcucgacauggccaaggugcugcuggacaacuacugcuuccccgagaaccuccugggcaugcaggaggcgauccagcaggccaucaagagccacgagauccuguccaucagcgacccccagacccucgccuccguccugaccgccggggugcagagcucccugaacgacccccggcucgugaucagcuacgagccguccacccccgagccgccgccccagguccccgcccugaccagccuguccgaggaggagcuccuggcguggcugcagcgcggccuccggcacgaggugcuggaggggaacgugggcuaccugcgcgucgacagcgugcccggccaggaggugcucuccaugaugggggaguuccuggucgcccacguguggggcaaccugauggggaccagcgcccucgugcuggaccugcggcacugcacgggcgggcaggucuccggcauccccuacaucaucagcuaccuccaccccggcaacaccauccugcacguggacaccaucuacaaccgccccuccaacaccacgaccgagaucuggacccugccccaggugcucggggagcgguacggcgccgacaaggacgucguggugcugaccagcucccagacgcgcggggucgcggaggacaucgcccacauccugaagcagaugcggcgcgccaucguggugggcgagcggaccggcgggggcgcccucgaccugcgcaagcugcggaucggggagagcgacuucuucuucaccguccccgugagccgcucccucggcccgcucgggggcggcagccagaccugggagggguccggcguccugcccugcguggggacgcccgccgagcaggcgcuggagaaggcccuggccauccugacccuccggagcgcccugcccggcgugguccacugccugcaggaggugcucaaggacuacuacacccugguggaccgcgucccgacccugcugcagcaccucgccuccauggacuucagcacggugguguccgaggaggaccuggucaccaagcugaacgcggggcuccaggccgccagcgaggacccccggcugcuggugcgcgccaucggccccaccgagacccccuccuggccggcccccgacgcggccgccgaggacagccccggcguggcccccgagcucccggaggacgaggccauccggcaggcgcuggucgacuccguguuccaggugagcguccugcccgggaacgugggcuaccuccgcuucgacuccuucgccgacgccagcgugcuggggguccuggcccccuacgugcuccgccaggugugggagccgcugcaggacacggagcaccugaucauggaccuccggcacaaccccggcgggcccuccagcgcggucccccugcugcucuccuacuuccagggcccggaggccggccccgugcaccuguucaccaccuacgaccgccggaccaacaucacgcaggagcacuucagccacauggagcugcccgggccccgcuacuccacccagcggggcguguaccuccugaccagccaccgcaccgccacggccgccgaggaguucgcguuccugaugcagagccucgggugggccacccuggucggcgagaucaccgccggcaaccugcuccacacccggacggugccgcugcuggacacccccgaggggucccucgcccugaccgugcccguccugaccuucaucgacaaccacggcgaggccuggcucgggggcgggguggugcccgacgcgaucguccuggccgaggaggcccuggacaaggcccaggaggugcucgaguuccaccagagccugggcgcccugguggagggcaccgggcaccuccuggaggcgcacuacgcccgcccggaggucgugggccagacguccgcccugcuccgggccaagcuggcgcagggggccuaccgcaccgccguggaccuggagagccucgccucccagcugaccgccgaccugcaggaggucagcggcgaccaccggcuccugguguuccacucccccggggagcugguggucgaggaggcgccgccgcccccgcccgccgugcccagccccgaggagcucaccuaccugaucgaggcccuguucaagacggaggugcuccccggccagcugggcuaccugcgcuucgacgccauggccgagcucgagaccgucaaggcgguggggccccagcuggugcggcuggucuggcagcagcucguggacaccgccgcccuggugaucgaccugcgcuacaaccccggcuccuacagcaccgccaucccccuccugugcuccuacuucuucgaggccgagccccggcagcaccuguacagcgucuucgaccgcgcgacguccaaggugaccgagguguggacccucccccaggucgccgggcagcgguacggcagccacaaggaccuguacauccugaugucccacaccagcggguccgccgccgaggcguucgcccacacgaugcaggaccuccagcgcgccaccgugaucggcgagccgaccgccggcggggcccugagcgucggcaucuaccagguggggagcagcccccuguacgcguccaugcccacccagauggccauguccgccacgaccggcaaggccugggaccucgccgggguggagcccgacaucaccgucccgaugagcgaggcgcuguccaucgcccaggacaucguggcccugcgggccaaggugcccaccguccuccagacggccggcaagcugguggcggacaacuacgccagcgccgagcugggcgccaagauggccaccaagcucuccgggcugcagagccgcuacucccgggugaccagcgaggucgcgcuggccgagauccucggcgccgaccugcagaugcuguccggggacccccaccucaaggccgcgcacauccccgagaacgccaaggaccgcaucccgggcaucgugcccaugcagauccccagccccgagguguucgaggagcugaucaaguucuccuuccacaccaacguccuggaggacaacaucggcuaccuccgcuucgacauguucggggacggcgagcugcugacccaggugagccggcuccugguggagcacaucuggaagaagaucaugcacacggacgccaugaucaucgacaugcgcuucaacaucgggggcccgaccuccagcauccccauccugugcuccuacuucuucgacgaggggccgcccguccuccuggacaagaucuacagccggcccgacgacuccgugagcgagcuguggacccacgcccagguggucggcgagcgcuacggcagcaagaaguccauggugauccugacgagcuccgugaccgccgggaccgcggaggaguucaccuacaucaugaagcggcucggccgcgcccuggucaucggggaggugacgagcggcgggugccagccgccccagaccuaccacguggacgacaccaaccuguaccucaccauccccacggcccgguccgucggcgccagcgacggcuccagcugggagggggugggcgugacgccccacgucguggugcccgccgaggaggcgcuggcccgcgccaaggagaugcugcagcacaaccagcuccgggucaagcgcucccccgggcugcaggaccaccuguga

SEQ ID NO: 35565 - RNA, 606 nt, Artificial Sequence
  derived and/or modified sequence opt1 from RBP4__Homo_sapiens__NP_006735
augaagugggugugggcccugcuccugcuggccgcgcucggcagcgggcgcgccgagcgggacugccgcgucuccagcuuccgggugaaggagaacuucgacaaggcccgcuucuccggcaccugguacgccauggccaagaaggaccccgaggggcuguuccugcaggacaacaucguggcggaguucagcgucgacgagaccggccagauguccgccacggccaaggggcgggugcgccuccugaacaacugggacgugugcgccgacauggucggcaccuucaccgacaccgaggaccccgcgaaguucaagaugaaguacuggggcguggccagcuuccugcagaaggggaacgacgaccacuggaucguggacacggacuacgacaccuacgccguccaguacuccugccggcuccugaaccuggacgggaccugcgccgacagcuacuccuucguguucagccgcgaccccaacggccucccgcccgaggcccagaagaucgugcggcagcgccaggaggagcugugccuggcgcggcaguaccgccucaucguccacaacggcuacugcgacgggcgguccgagcgcaaccugcuguga

SEQ ID NO: 35566 - RNA, 1503 nt, Artificial Sequence
  derived and/or modified sequence opt1 from RBPJ__Homo_sapiens__NP_005340
auggaccacaccgagggcagccccgccgaggagccgcccgcccacgcgcccucccccgggaaguucggcgagcggcccccgcccaagcgccugacccgcgaggccaugcggaacuaccucaaggagcgcggggaccagacggugcugauccugcacgccaaggucgcccagaaguccuacggcaacgagaagcgguucuucugcccgccgcccugcguguaccucauggggagcggcuggaagaagaagaaggagcagauggagcgcgacggcugcagcgagcaggagucccagcccugcgccuucaucgggaucggcaacagcgaccaggagaugcagcagcugaaccuggaggggaagaacuacugcaccgcgaagacccucuacaucuccgacagcgacaagcggaagcacuucaugcuguccgugaagauguucuacggcaacagcgacgacaucggggucuuccuguccaagcgcaucaaggugaucagcaagcccuccaagaagaagcagagccucaagaacgccgaccugugcaucgccuccggcaccaagguggcccuguucaaccggcuccgcagccagacggucuccacccgguaccugcacguggagggcgggaacuuccacgcgagcucccagcaguggggcgccuucuucauccaccuccuggacgacgacgagagcgagggggaggaguucaccgugcgcgacggcuacauccacuacggccagaccgucaagcuggugugcagcgugacggggauggcccugccccggcucaucauccgcaaggucgacaagcagaccgcccugcuggacgccgacgaccccgugucccagcuccacaagugcgcguucuaccugaaggacaccgagcggauguaccugugccucagccaggagcgcaucauccaguuccaggccacccccugccccaaggagcccaacaaggagaugaucaacgacggcgccuccuggacgaucaucagcaccgacaaggccgaguacaccuucuacgaggggaugggccccgugcuggcccccgucacccccgugccgguggucgagucccugcagcucaacgggggcggcgacguggcgaugcuggagcugacggggcagaacuucacccccaaccuccgggugugguucggcgacgucgaggccgagaccauguaccgcugcggggagagcaugcugugcguggugcccgacaucuccgccuuccgggagggcuggcgcuggguccggcagcccgugcaggucccggugacccuggugcgcaacgacgggaucaucuacagcacgucccucaccuucaccuacacccccgagcccggcccccgcccgcacugcagcgccgccggcgcgauccugcgggccaacuccagccaggucccgcccaacgaguccaacacgaacagcgagggguccuacaccaacgccagcaccaacuccaccagcgugacguccagcaccgccaccguggucagcuga

SEQ ID NO: 35567 - RNA, 630 nt, Artificial Sequence
  derived and/or modified sequence opt1 from RBPMS2__Homo_sapiens__NP_919248
augagcaaccugaagcccgacggcgagcacgggggcuccaccgggaccggcagcggggccggcuccggcggggcccucgaggaggaggugcgcacgcuguucgucagcggccugccgguggacaucaagccccgggagcucuaccugcuguuccgccccuucaagggguacgagggcucccucaucaagcugaccgcgcggcagcccgugggguucgucaucuucgacagccgcgccggcgccgaggccgccaagaacgcgcugaacggcauccgguucgacccggagaacccccagacccuccgccuggaguucgccaaggccaacaccaagauggccaaguccaagcugauggcgacgcccaaccccagcaacgugcacccggcccucggggcccacuucaucgcccgggaccccuacgaccugaugggcgccgcgcugauccccgccucccccgaggccugggccccguacccccucuacaccaccgagcugacccccgccaucagccacgcggccuucacguaccccaccgccaccgccgccgcggccgcccugcacgcccaggugcgcugguacccguccagcgacaccacgcagcagggguggaaguaccggcaguucugcuga

SEQ ID NO: 35568 - RNA, 2355 nt, Artificial Sequence
  derived and/or modified sequence opt1 from RBSN__Homo_sapiens__NP_001289307
auggccagccuggacgaccccggcgaggugcgcgagggguuccucugcccgcugugccugaaggaccuccaguccuucuaccagcugcacagccacuacgaggaggagcacuccggcgaggaccgggacgucaaggggcagaucaagagccuggugcagaaggccaagaaggcgaaggaccgccuccugaagcgggagggcgacgaccgcgccgaguccgggacccagggcuacgagagcuucuccuacggcgggguggaccccuacaugugggagccccaggagcugggcgccguccggagccaccucuccgacuucaagaagcaccgcgccgcccggaucgaccacuacgugguggaggucaacaagcugaucauccgccuggagaagcucaccgcguucgaccggacgaacaccgagagcgccaagauccgcgccaucgagaaguccguggugcccugggucaacgaccaggacgugccguucugccccgacugcgggaacaaguucagcauccggaaccgccggcaccacugccgccugugcggcuccaucaugugcaagaagugcauggagcugaucagccucccccuggccaacaagcugaccuccgcgagcaaggagucccucagcacccacacgucccccagccagagcccgaacuccgugcacgggagccggcgcggcuccaucagcuccaugagcuccgucagcuccgugcuggacgagaaggacgacgaccggauccgcugcugcacccacugcaaggacacccugcucaagcgggagcagcagaucgacgagaaggagcacacccccgacaucgugaagcuguacgagaagcugcgccucugcauggagaaggucgaccagaaggcccccgaguacauccggauggccgccagccugaacgccggcgagacgaccuacucccuggagcacgcgagcgaccuccgcguggaggugcagaaggucuacgagcugaucgacgcccuguccaagaagauccucacccuggggcugaaccaggacccgccgccccaccccagcaaccuccgccugcagcggaugauccgcuacuccgccacccuguucgugcaggagaagcuccugggccugaugagccuccccacgaaggagcaguucgaggagcugaagaagaagcggaaggaggagauggagcgcaagcgggccguggagcgccaggccgcgcuggagucccagcggcgccucgaggagcggcagagcgggcuggccucccgcgccgccaacggcgaggucgccagccugcggcgcggccccgcgccccuccggaaggccgagggguggcugccccugagcggcgggcagggccaguccgaggacagcgacccccuccugcagcagauccacaacaucaccuccuucauccgccaggccaaggccgccgggcggauggacgaggugcgcacccugcaggagaaccugcggcagcuccaggacgaguacgaccagcagcagaccgagaaggcgaucgagcugagccgccggcaggccgaggaggaggaccugcagcgcgagcagcuccagaugcugcgcgagcgggagcuggagcgcgagcgggagcaguuccgcguggccucccuccacacgcggacccgcagccuggacuuccgggagaucggcccguuccagcuggagcccucccgcgagccccggacccaccucgccuacgcgcuggaccugggcagcucccccgucccgagcuccaccgcccccaagacgcccagccucuccagcacccagcccacccgcgugugguccgggccgcccgccgucggccaggagcggcugccccagagcuccaugccgcagcagcacgaggggcccagccugaaccccuucgacgaggaggaccucagcucccccauggaggaggccaccacgggcccgcccgccgcgggggugagccuggaccccuccgcccgcauccugaaggaguacaaccccuucgaggaggaggacgaggaggaggaggccguggccggcaacccguucauccagcccgacagccccgcccccaacccguucuccgaggaggacgagcacccccagcagcggcucagcagcccccugguccccggcaacccguucgaggagccgaccugcaucaaccccuucgagauggacuccgacuccgggcccgaggcggaggagcccaucgaggaggagcugcuccugcagcagaucgacaacaucaaggccuacaucuucgacgccaagcagugcggccgccuggacgagguggaggugcucaccgagaaccugcgggagcugaagcacacccucgccaagcagaagggcgggacggacuga

SEQ ID NO: 35569 - RNA, 327 nt, Artificial Sequence
  derived and/or modified sequence opt1 from RBX1__Homo_sapiens__NP_055063
auggccgccgcgauggacguggacacccccagcggcaccaacuccggggccggcaagaagcgcuucgaggucaagaaguggaacgccguggcccugugggccugggacaucguggucgacaacugcgcgaucugccggaaccacaucauggaccucugcaucgagugccaggccaaccaggccagcgccacguccgaggagugcaccguggcguggggcgugugcaaccacgccuuccacuuccacugcaucagccgcuggcugaagacccggcaggucugcccgcuggacaaccgcgagugggaguuccagaaguacgggcacuga

SEQ ID NO: 35570 - RNA, 3378 nt, Artificial Sequence
  derived and/or modified sequence opt1 from RC3H1__Homo_sapiens__NP_001287780
augcccgugcaggcgccccaguggaccgacuuccucagcugccccaucugcacccagaccuucgacgagaccauccggaagcccaucucccucggcugcgggcacaccgucugcaagaugugccugaacaagcugcaccggaaggccugccccuucgaccagaccacgaucaacaccgacaucgagcuccugcccgugaacagcgcccugcuccagcuggugggcgcccagguccccgagcagcagcccaucacccugugcuccgggguggaggacaccaagcacuacgaggaggccaagaagugcguggaggagcucgcccuguaccugaagccccucagcuccgcccgcggcgucgggcugaacagcacgacccaguccgugcugagccggcccaugcagcgcaagcucgugacccugguccacugccagcugguggaggaggagggccggauccgcgccaugcgggccgcccgcucccucggcgagcggaccgugacggagcugauccugcagcaccagaacccccagcagcucagcuccaaccugugggccgccguccgcgcccgggggugccaguuccugggccccgccaugcaggaggaggcccucaagcuggugcugcucgcccuggaggacgggagcgcccugucccgcaaggugcucguccuguucguggugcagcggcuggagccccgcuucccccaggccagcaagaccuccaucggccacgucgugcagcuccuguaccgggccagcugcuucaaggugaccaagcgcgacgaggacuccagccugaugcagcucaaggaggaguuccggaccuacgaggcccugcgccgggagcacgacucccagaucguccagaucgccauggaggcggggcugcgcaucgcccccgaccaguggagcagccuccuguacggcgaccagucccacaagagccacaugcaguccaucaucgacaagcugcagacgcccgccagcuucgcccaguccgugcaggagcucaccaucgcccugcagcggaccggcgaccccgcgaaccugaaccgccuccgcccccaccuggagcugcucgccaacaucgaccccagccccgacgcgcccccgcccaccugggagcagcuggagaacgggcugguggccguccggacggugguccacggccugguggacuacauccagaaccacuccaagaagggggccgaccagcagcagccgccccagcacagcaaguacaagaccuacaugugccgcgacaugaagcagcggggcggcugcccccgcggggcguccugcaccuucgcccacagccaggaggagcucgagaaguuccggaagaugaacaagcgccuggugccccggcgcccccuguccgccagccucggccagcugaacgaggucgggcugcccuccgccgcgauccuccccgacgagggcgccguggaccugcccagccggaagccgcccgcccugcccaacgggaucguguccaccggcaacacggucacccagcucaucccccgcggcaccgaccccagcuacgacuccagccugaagcccgggaagaucgaccaccuguccagcagcgcccccggcagcccgcccgaccuccuggagagcgugccgaaguccaucagcgcccugcccgugaacccccacuccaucccgccccgggggcccgcggaccugccgcccaugcccgucaccaagccccugcagauggugccccgcggcagccagcuguaccccgcccagcagacggacguguacuaccaggacccgcgcggggccgcgccgcccuucgagcccgccccguaccagcagggcauguacuacacgccgccgccccagugcgucucccgcuucgugcggcccccgcccagcgcgccggagcccgcgccgcccuaccucgaccacuacccgcccuaccugcaggagcgcguggucaacucccaguacggcacccagccccagcaguacccgcccaucuaccccagccacuacgacgggcggcgcguguaccccgcccccuccuacacccgggaggagaucuuccgcgagagccccauccccaucgagaucccgcccgccgccgugccguccuacguccccgagagccgcgagcgguaccagcagaucgaguccuacuaccccguggcgccccacccgacgcagauccgccccagcuaccugcgggagccgcccuacucccgccucccgccgccgccccagccccaccccagccuggacgagcugcaccggcgccggaaggagaucauggcccagcucgaggagcgcaaggugaucagcccgccgcccuucgcccccucccccacccugccgcccaccuuccaccccgaggaguuccuggacgaggaccucaaggucgccggcaaguacaaggggaacgacuacagccaguacucccccuggagcugcgacaccaucggcuccuacaucgggacgaaggacgcgaagcccaaggacgugguggccgccggcagcgucgagaugaugaacguggaguccaagggcaugcgggaccagcgccuggaccugcagcggcgcgccgccgagaccagcgacgacgaccucauccccuucggggaccggcccaccgugucccgcuucggcgcgaucagccggaccuccaagaccaucuaccagggggccggccccaugcaggccauggcgccccagggcgcccccacgaaguccaucaacaucuccgacuacagccccuacgggacccacggcggguggggcgccucccccuacagcccccaccagaacauccccucccaggggcacuucagcgagcgcgagcggaucuccaugagcgaggucgccagccacggcaagccccugcccuccgccgagcgcgagcagcugcggcucgagcugcagcagcugaaccaccagaucagccagcagacccagcuccgcggccuggagcgggaggccaacacccuggccgggcagucccagccgccgccgccgcccccgcccaaguggcccggcaugaucagcuccgagcagcucagccuggagcugcaccagguggagcgcgagaucgggaagcgcacgcgggagcucuccauggagaaccagugcagccuggacaugaaguccaagcugaacaccagcaagcaggcggagaacggccagcccgagccccagaacaaggugcccgccgaggaccucacccugaccuucuccagcgacgucccgaacggguccgcccugacgcaggagaacaucagccuccuguccaacaagaccagcucccugaaccucagcgaggaccccgagggcggcggggacaacaacgacucccagcgcagcggcgugacccccagcuccgcccccuga

SEQ ID NO: 35571 - RNA, 516 nt, Artificial Sequence
  derived and/or modified sequence opt1 from RCAN1__Homo_sapiens__NP_001272318
augguguacgccaaguucgagagccuguuccgcaccuacgacaaggacaucaccuuccaguacuucaaguccuucaagcggguccgcaucaacuucagcaaccccuucuccgccgcggacgcccggcuccagcugcacaagacggaguuccugggcaaggagaugaagcucuacuucgcccagacccugcacaucgggagcucccaccuggccccgcccaaccccgacaagcaguuccucaucagcccgcccgccuccccgcccgugggcuggaagcaggucgaggacgcgacccccgugaucaacuacgaccugcuguacgccaucagcaagcucgggcccggcgagaaguacgagcugcacgccgccaccgacacgacccccuccguggugguccacgugugcgagagcgaccaggagaaggaggaggaggaggagauggagcgcaugcggcgccccaagcccaagaucauccagacccggcgcccggaguacacccccauccaccuguccuga

SEQ ID NO: 35572 - RNA, 594 nt, Artificial Sequence
  derived and/or modified sequence opt1 from RCAN2__Homo_sapiens__NP_005813
augcccgcccccagcauggacugcgacguguccacccuggucgccugcgugguggacgucgagguguucaccaaccaggaggugaaggagaaguucgagggccucuuccgcacguacgacgacugcgucaccuuccagcuguucaagagcuuccggcgcgugcggaucaacuucuccaaccccaagagcgcggcccgcgcccggaucgagcugcacgagacccaguuccgcgggaagaagcucaagcuguacuucgcccaggugcagacccccgagacggacggcgacaagcugcaccucgcgccgccccagcccgccaagcaguuccugaucuccccgcccagcuccccgcccgucggguggcagcccaucaacgacgccacccccgugcugaacuacgaccuccuguacgccguggccaagcugggccccggggagaaguacgagcuccacgcgggcaccgagagcacccccuccgucguggugcacgucugcgacagcgacaucgaggaggaggaggaccccaagacgucccccaagccgaagaucauccagacccggcgccccggccugccgcccagcguguccaacuga

SEQ ID NO: 35573 - RNA, 1596 nt, Artificial Sequence
  derived and/or modified sequence opt1 from RCBTB1__Homo_sapiens__XP_005266498
augguggacgucggcaaguggcccaucuucacccugcucagcccgcaggagaucgccuccauccgcaaggccugcguguucgggaccagcgcguccgaggcccuguacgugacggacaacgacgaggucuucguguucggccugaacuacagcaacugccucgggaccggcgacaaccaguccacccuggugcccaagaagcuggaggggcucugcggcaagaagaucaagagccuguccuacggcagcgggccccacguccugcucuccaccgaggacggcgugguguacgccugggggcacaacggcuacagccagcuggggaacggcacgaccaaccagggcaucgcccccguccaggugugcaccaaccugcucaucaagcaggucguggagguggccugcgggucccaccacagcauggcgcuggccgccgacggcgagguguucgccuggggguacaacaacugcggccaggucggcuccgggagcaccgcgaaccagccgacgccccggaaggugaccaacugccugcacaucaagcgcguggucggcaucgccugcgggcagaccuccagcauggccgugcucgacaacggcgagguguacggguggggcuacaacggcaacgggcagcugggccuggggaacaacggcaaccagcucacccccguccggguggccgcccugcacuccgugugcgucaaccagaucgugugcggguacgcgcacacgcuggcccucaccgacgagggccugcuguacgccuggggcgccaacaccuacgggcagcucggcaccgggaacaagaacaaccugcugagccccgcccacaucauggucgagaaggagcgcgugguggagaucgcggccugccacuccgcccacacgagcgccgccaagacccagggcgggcacgucuacauguggggccagugccggggccagagcgugauccucccgcaccugacccacuucuccugcaccgacgacguguucgcgugcuucgccacgcccgccgucagcuggcgccugcucuccguggagcacgaggacuuccugaccguggccgagagccugaagaaggaguucgacucccccgagaccgccgaccucaaguuccggaucgacgggaaguacauccacguccacaaggcggugcugaagauccgcugcgagcacuuccggagcauguuccaguccuacuggaacgaggacaugaaggaggugaucgagaucgaccaguucagcuaccccgucuaccgcgccuuccugcaguaccucuacaccgacacgguggaccugccgcccgaggacgccaucggccugcucgaccuggccaccuccuacugcgagaaccggcugaagaagcucugccagcacaucaucaagcgcgggaucaccguggagaacgcguucagccuguucuccgccgccguccgguacgacgccgaggaccuggaggaguucugcuucaaguucugcaucaaccaccucaccgaggugacgcagaccgccgcguucuggcagauggacggcccccugcugaaggaguucaucgccaaggccagcaagugcggcgccuucaagaacuga

SEQ ID NO: 35574 - RNA, 1671 nt, Artificial Sequence
  derived and/or modified sequence opt1 from RCBTB2__Homo_sapiens__NP_001273759
augagcgcccugccccgcgaccucgagcuguccaacccgcgggagaagcugaccaagcccgugcaggccacccucagcucccugaagaugcuggacgucggcaaguggcccaucuucagccucugcuccgaggaggagcugcagcugauccgccaggcgugcguguucgggagcgccggcaacgaggugcucuacacgaccgucaacgacgagaucuucgugcuggggaccaacugcugcggcugccuggggcucggcgacgugcaguccaccaucgagccccggcgccuggacagccugaacggcaagaagaucgccugccucuccuacgggagcggcccgcacaucguccuggccacgaccgagggggagguguucaccuggggccacaacgccuacucccagcuggggaacggcaccacgaaccacggccucgugcccugccacaucagcaccaaccuguccaacaagcaggucaucgagguggcgugcgggagcuaccacucccuggugcucaccagcgacggcgaggucuucgccuggggguacaacaacuccggccaggugggcagcggguccaccgugaaccagcccaucccccggcgcgucacgggcugccugcagaacaaggugguggucaccaucgccugcgggcagaugugcugcauggccgugguggacaccggcgaggucuacguguggggguacaacggcaacggccagcuggggcucggcaacagcgggaaccagccgacccccugccggguggcggcccugcagggcauccgcguccagcggguggccugcggguacgcccacacgcugguccucaccgacgagggccagguguacgccuggggcgcgaacagcuacgggcagcugggcaccgggaacaaguccaaccagagcuaccccacccccgugacggucgagaaggaccgcaucaucgagaucgccgccugccacuccacccacaccagcgccgccaagacccagggcgggcacguguacauguggggccagugccggggccaguccgugauccugccgcaccucacgcacuucagcugcaccgacgacgucuucgcgugcuucgccacccccgccgugaccuggcgccugcuguccguggagcccgacgaccaccucacggucgccgagagccugaagcgggaguucgacaaccccgacaccgccgaccugaaguuccucguggacgggaaguacaucuacgcgcacaaggugcugcugaagauccgcugcgagcacuuccgguccagccucgaggacaacgaggacgacaucgucgagauguccgaguucagcuacccgguguaccgcgccuuccuggaguaccuguacaccgacuccaucagccucucccccgaggaggccgugggccugcuggaccucgccaccuucuaccgggagaaccgccugaagaagcugugccagcagacgaucaagcaggggaucugcgaggagaacgccaucgcgcuccugagcgccgccgucaaguacgacgcccaggaccuggaggaguucugcuuccgguucugcaucaaccaccugaccguggugacccagaccuccggcuucgcggagauggaccacgaccuccugaagaacuucaucagcaaggccucccgcgucggcgccuucaagaacuga

SEQ ID NO: 35575 - RNA, 759 nt, Artificial Sequence
  derived and/or modified sequence opt1 from RCHY1__Homo_sapiens__NP_001009922
auggccgccaccgcgcgcgaggacggcgccagcgggcaggagcggggccagcgcgggugcgagcacuacgaccggggcugccugcucaaggcccccugcugcgacaagcuguacacgugccgccugugccacgacaacaacgaggaccaccagcucgaccgguucaaggugaaggagguccagugcaucaacugcgagaagauccagcacgcccagcagaccugcgaggagugcuccacccuguucggggaguacuacugcgacaucugccaccuguucgacaaggacaagaagcaguaccacugcgagaacugcggcaucugccgcaucggcccgaaggaggacuucuuccacugccucaagugcaaccugugccuggccaugaaccuccaggggcggcacaagugcaucgagaacgugagccgccagaacugccccaucugccuggaggacauccacaccucccggguggucgcgcacgugcugcccugcggccaccuccugcaccgcggguaccggugcccccugugcaugcacagcgcccucgacaugacccgcuacuggcggcagcuggacgacgagguggcccagacgccgaugcccuccgaguaccagaacaugaccgucgacauccugugcaacgacugcaacggccgcagcaccgugcaguuccacauccucgggaugaagugcaagaucugcgaguccuacaacaccgcccaggcgggcggccggcgcaucagccuggaccagcaguga

SEQ ID NO: 35576 - RNA, 648 nt, Artificial Sequence
  derived and/or modified sequence opt1 from RCL1__Homo_sapiens__NP_001273629
augcccccgggcgggggcggggagguggucuucagcugccccgugcgcaaggugcugaagcccauccagcucaccgaccccggcaagaucaagcggauccgcgggauggccuacuccguccgggugagcccgcagauggccaaccgcaucguggacuccgcgcggagcauccugaacaaguucauccccgacaucuacaucuacaccgaccacaugaagggcgucaacuccggcaagagccccggguucggccugucccucguggccgagacgaccagcgggaccuuccuguccgccgagcuggccagcaacccccagggccagggggccgcggugcucccggaggaccugggccgcaacugcgcccggcugcuccuggaggagaucuaccgcggcgggugcgucgacuccaccaaccagagccuggcccuccugcugaugacgcucggccagcaggacguguccaaggugcugcuggggccccucagccccuacaccaucgaguuccugcggcaccugaaguccuucuuccagaucauguucaagaucgagaccaagcccugcggcgaggagcucaagggcggggacaagguccugaugaccugcgugggcaucggguucagcaaccuguccaagacgcucaaguga

SEQ ID NO: 35577 - RNA, 996 nt, Artificial Sequence
  derived and/or modified sequence opt1 from RCN1__Homo_sapiens__NP_002892
auggcccgcggcgggcggggccgccggcuggggcucgcccugggccugcuccuggcgcuggugcucgcgccccgcguccugcgggccaagccgaccgugcgcaaggagcgggugguccgccccgacagcgagcugggggagcggccgcccgaggacaaccaguccuuccaguacgaccacgaggccuuccucggcaaggaggacagcaagaccuucgaccagcugacgcccgacgaguccaaggagcgccugggcaagaucguggaccggaucgacaacgacggggacggcuucgugaccaccgaggagcucaagaccuggaucaagcgcguccagaagcgguacaucuucgacaacguggccaagguguggaaggacuacgaccgcgacaaggacgacaagaucagcugggaggaguacaagcaggccacguacggguacuaccugggcaaccccgccgaguuccacgacuccagcgaccaccacaccuucaagaagaugcugccccgggacgagcgccgguucaaggccgccgaccucaacggggaccugaccgcgacccgcgaggaguucacggccuuccugcaccccgaggaguucgagcacaugaaggagaucgucgugcucgagacccuggaggacaucgacaagaacggcgacggcuucguggaccaggacgaguacaucgccgacauguucucccacgaggagaacgggccggagcccgacuggguccugagcgagcgggagcaguucaacgaguuccgcgaccucaacaaggacggcaagcuggacaaggacgagauccggcacuggauccugccccaggacuacgaccacgcccaggccgaggcgcgccaccucguguacgaguccgacaagaacaaggacgagaagcugaccaaggaggagauccuggagaacuggaacauguucguggggagccaggccaccaacuacggcgaggaccucacgaagaaccacgacgagcuguga

SEQ ID NO: 35578 - RNA, 954 nt, Artificial Sequence
  derived and/or modified sequence opt1 from RCN2__Homo_sapiens__NP_002893
augcgccugggcccccggaccgccgcccucgggcugcugcuccugugcgcggccgccgccggcgccgggaaggcggaggagcugcacuacccgcucggcgagcgccggagcgacuacgaccgcgaggcccugcugggggugcaggaggacgucgacgaguacgugaagcucggccacgaggagcagcagaagcggcugcaggccaucaucaagaagaucgaccuggacuccgacggcuuccucaccgagagcgagcuguccagcuggauccagauguccuucaagcacuacgccaugcaggaggcgaagcagcaguucguggaguacgacaagaacagcgacgacacggucaccugggacgaguacaacauccagauguacgaccgcgugaucgacuucgacgagaacaccgcccuggacgacgccgaggaggaguccuuccggaagcuccaccugaaggacaagaagcgcuucgagaaggccaaccaggacagcgggcccggccugucccucgaggaguucaucgccuucgagcaccccgaggagguggacuacaugaccgaguucgucauccaggaggcgcuggaggagcacgacaagaacggggacggcuucgugagccuggaggaguuccucggggacuaccggugggaccccacggccaacgaggacccggaguggauccugguggagaaggaccgcuucgucaacgacuacgacaaggacaacgacggccggcuggacccccaggagcuccugcccuggguggugcccaacaaccagggcaucgcccaggaggaggcccugcaccucaucgacgagauggaccugaacggggacaagaagcuguccgaggaggagauccucgagaacccggaccuguuccugaccagcgaggccaccgacuacggccgccagcuccacgacgacuacuucuaccacgacgagcuguga

SEQ ID NO: 35579 - RNA, 1458 nt, Artificial Sequence
  derived and/or modified sequence opt1 from RCOR1__Homo_sapiens__NP_055971
augcccgccaugguggagaagggcccggaggucagcgggaagcgccggggccgcaacaacgccgcggccuccgccagcgccgccgcggccuccgccgccgcgagcgccgccugcgccucccccgccgcgaccgccgccagcggggccgccgcguccagcgccuccgccgccgccgcgagcgccgccgccgcccccaacaacggccagaacaagucccuggcggccgccgcccccaacgggaacagcuccagcaacuccugggaggagggcagcuccggcagcuccagcgacgaggagcacgggggcgggggcaugcggguggggccgcaguaccaggcggugguccccgacuucgaccccgccaagcucgcccgccggagccaggagcgcgacaaccugggcaugcugguguggucccccaaccagaaccucagcgaggccaagcuggacgaguacaucgccaucgcgaaggagaagcacggcuacaacauggagcaggcccuggggaugcuguucuggcacaagcacaacaucgagaagucccucgccgaccugccgaacuucacccccuuccccgacgaguggacgguggaggacaagguccucuucgagcaggccuucagcuuccacggcaagaccuuccaccggauccagcagaugcugcccgacaaguccaucgccagccuggugaaguucuacuacuccuggaagaagacccgcaccaagacgagcgugauggaccggcacgcgcgcaagcagaagcgggagcgcgaggaguccgaggacgagcucgaggaggccaacgggaacaacccgaucgacaucgaggucgaccagaacaaggagagcaagaaggaggugccgcccaccgagaccgugccccaggucaagaaggagaagcacuccacccaggccaagaaccgggccaagcgcaagccgcccaagggcauguuccugagccaggaggacguggaggccguguccgcgaacgccacggccgccaccaccguccugcggcagcucgacauggagcuggugagcgugaagcgccagauccagaacaucaagcagaccaacuccgcgcugaaggagaagcucgacggcgggaucgagcccuaccggcugcccgaggucauccagaagugcaacgcccgcuggacgaccgaggagcagcugcucgccgugcaggccauccggaaguacggccgcgacuuccaggccaucagcgacgugaucgggaacaaguccgucguccaggugaagaacuucuucgugaacuaccggcgccgcuucaacaucgacgaggugcugcaggagugggaggcggagcacggcaaggaggagaccaacgggcccagcaaccagaagcccgucaagucccccgacaacagcaucaagaugcccgaggaggaggacgaggccccggugcuggacgugcgguacgccagcgccuccuga

SEQ ID NO: 35580 - RNA, 1251 nt, Artificial Sequence
  derived and/or modified sequence opt1 from RCSD1__Homo_sapiens__NP_443094
auggaggagcgccccgccgagaccaacgccaacguggacaacagcgcguccccgagcgucgcccagcuggccggccgguuccgcgagcaggccgccgcggccaaggagacccccgccuccaagcccacgcggcgcaagcccccgugcagccucccccuguucccgcccaagguggaccuggggcagaacggcgaggagaaguccccgcccaacgccagccacccgcccaaguucaaggugaaguccagcccccucaucgagaagcugcaggcgaaccugaccuucgaccccgccgcccuccugcccggggccucccccaagagcccgggccugaaggccauggucucccccuuccacagcccgcccuccacccccagcucccccggggugcggagccgccccuccgaggcggaggaggugcccgucagcuucgaccagccgcccgagggcucccaccuccccugcuacaacaaggugcggacccgcggcagcaucaagcggcgcccgcccagccggcgcuuccggcgcucccagagcgacugcggggagcugggcgacuuccgggccguggaguccagccagcagaacggggccaaggaggaggacggcgacgagguccugcccuccaagagcaaggcccccgggagcccccucuccuccgagggcgccgcgggcgagggggugcgcacgcugggccccgccgagaagccgccccugcggcgcagccccucccggaccgagaagcaggaggaggaccgcgccaccgaggaggccaagaacggggagaaggcccggcgcagcuccgaggagguggacggccagcaccccgcgcaggaggagguccccgagagcccccagaccuccggcccggaggccgagaaccgcugcgggagcccccgggaggagaagcccgccggcgaggaggccgagauggagaaggccacggaggugaagggggagcgcgugcagaacgaggaggucggccccgagcacgacucccaggagaccaagaagcucgaggagggggcggccgugaaggagaccccgcacagcccgcccggcggcgugaagggcggggacguccccaagcaggagaaggggaaggagaagcagcaggagggcgccgugcuggagcccgggugcagcccccagaccggccccgcccagcuggagacguccagcgaggugcaguccgagcccgcggucccgaagcccgaggacgacacccccgugcaggacaccaagauguga

SEQ ID NO: 35581 - RNA, 603 nt, Artificial Sequence
  derived and/or modified sequence opt1 from RCVRN__Homo_sapiens__NP_002894
augggcaacagcaaguccggggcccugagcaaggagauccucgaggagcugcagcugaacaccaaguucuccgaggaggagcucugcagcugguaccaguccuuccugaaggacugccccaccggccgcaucacgcagcagcaguuccagagcaucuacgccaaguucuucccggacaccgaccccaaggcguacgcccagcacguguuccgguccuucgacagcaaccuggacgggacccucgacuucaaggaguacgucaucgcccugcacaugaccacggccggcaagaccaaccagaagcuggagugggccuucucccucuacgacguggacgggaacggcaccaucagcaagaacgaggugcuggagaucgucauggcgaucuucaagaugaucacccccgaggacgugaagcugcuccccgacgacgagaacacgccggagaagcgcgccgagaagaucuggaaguacuucggcaagaacgacgacgacaagcugaccgagaaggaguucaucgaggggacccuggccaacaaggagauccuccggcugauccaguucgagccccagaaggugaaggagaagaugaagaacgccuga

SEQ ID NO: 35582 - RNA, 588 nt, Artificial Sequence
  derived and/or modified sequence opt1 from RD3__Homo_sapiens__NP_001158160
augagccugaucuccuggcuccgcuggaacgaggcccccagccggcuguccacccgcagcccggccgagauggugcuggagacccucaugauggagcugacgggccagaugcgggaggcggagcgccagcagcgggagcgcuccaacgccguccggaaggugugcaccgggguggacuacagcuggcuggccuccacgccccgcagcaccuacgaccucucccccaucgagcggcugcagcuggaggacgucugcgugaagauccaccccagcuacugcggcccggccauccuccgcuuccggcagcugcuggccgagcaggagcccgaggugcaggaggucucccagcuguuccgcagcgugcuccaggaggugcuggagcggaugaagcaggaggaggaggcgcacaagcucacccgccaguggucccugcggccccgcgggagccuggccaccuucaagacccgggcccgcaucucccccuucgccagcgacauccggaccaucuccgaggacgucgagcgcgacacgccgccgccccuccggagcugguccaugcccgaguuccgcgcgcccaaggccgacuga

SEQ ID NO: 35583 - RNA, 1026 nt, Artificial Sequence
  derived and/or modified sequence opt1 from RDH10__Homo_sapiens__NP_742034
augaacaucguggucgaguucuucguggugaccuucaagguccugugggccuucgugcucgccgcggcccgcuggcuggugcggcccaaggagaaguccgucgccggccaggugugccugaucaccggggccggcagcgggcucggccgccuguucgcccuggaguucgcgcggcgccgggcccuccuggugcugugggacaucaacacgcagagcaacgaggagaccgccgggaugguccgccacaucuaccgggaccucgaggccgcggacgccgccgcccugcaggccggcaacggcgaggaggagauccugccgcacugcaaccuccagguguucaccuacacgugcgacguggggaagcgcgagaacgucuaccugaccgcggagcgggugcgcaaggaggugggcgaggucuccgugcuggugaacaacgccggggucgugagcggccaccaccuccuggagugccccgacgagcugaucgagcggaccaugauggugaacugccacgcccacuucuggaccaccaaggccuuccuccccacgaugcuggagaucaaccacgggcacaucgucaccguggccuccagccugggccucuucuccaccgcgggcguggaggacuacugcgccagcaaguucggggucgugggcuuccacgagucccugagccacgagcugaaggccgccgagaaggacgggaucaagaccacgcucgucugccccuaccugguggacaccggcauguuccgcggcugccggauccgcaaggagaucgagccguuccugccgccccucaagcccgacuacugcgugaagcaggccaugaaggcgauccugaccgaccagcccaugaucugcacgccccggcugauguacaucgucaccuucaugaaguccauccuccccuucgaggccguggugugcauguaccgcuuccugggggccgacaagugcauguaccccuucaucgcccagcggaagcaggccaccaacaacaacgaggcgaagaacggcaucuga

SEQ ID NO: 35584 - RNA, 957 nt, Artificial Sequence
  derived and/or modified sequence opt1 from RDH11__Homo_sapiens__NP_057110
augguggagcugauguucccccuccugcugcuccugcugccguuccuccuguacauggccgcgccccagauccgcaagaugcugagcuccggcgucugcaccagcaccgugcagcuccccgggaagguggucguggugacgggcgccaacaccgggaucggcaaggagaccgccaaggagcuggcccagcgcggggcccgggucuaccuggccugccgggacguggagaagggcgagcucguggcgaaggagauccagaccacgaccggcaaccagcagguccuggugcgcaagcuggaccucuccgacaccaagagcauccgggccuucgccaagggguuccuggccgaggagaagcaccuccacgugcugaucaacaacgcgggcgucaugaugugccccuacuccaagaccgccgacggguucgagaugcacaucggcgugaaccaccuggggcacuuccugcucacgcaccuccugcuggagaagcugaaggagagcgccccgucccgcaucgugaacgucagcucccuggcccaccaccucggccggauccacuuccacaaccugcagggcgagaaguucuacaacgccgggcuggcguacugccacagcaagcucgccaacauccuguucacccaggagcuggcccgccggcucaagggcuccggggugaccaccuacagcgugcaccccggcacgguccaguccgagcuggugcgccacagcuccuucaugcgguggaugugguggcuguucagcuucuucaucaagacgccccagcagggcgcccagaccucccuccacugcgcccugaccgaggggcuggagauccucagcggcaaccacuucuccgacugccacguggcgugggucagcgcccaggcccgcaacgagaccaucgcccggcgccugugggacgugagcugcgaccugcucgggcugcccaucgacuga

SEQ ID NO: 35585 - RNA, 951 nt, Artificial Sequence
  derived and/or modified sequence opt1 from RDH12__Homo_sapiens__NP_689656
augcuggugacccucggccugcugaccagcuucuucuccuuccucuacauggucgcccccagcauccgcaaguucuucgccgggggcgugugccggacgaacgugcagcugccggggaaggucguggugaucaccggcgcgaacaccgggaucggcaaggagaccgcccgcgagcuggccucccggggcgcccgcgucuacaucgccugccgggacgugcucaagggggagagcgcggccuccgagauccgcguggacacgaagaacagccagguccuggugcggaagcuggaccucuccgacaccaagagcauccgcgccuucgccgagggcuuccuggcggaggagaagcagcugcacauccucaucaacaacgccggggugaugaugugccccuacuccaagaccgccgacggcuucgagacccaccugggggucaaccaccugggccacuuccuccugacguaccugcuccuggagcggcugaaggugagcgcccccgcccgcguggucaacguguccagcguggcgcaccacaucggcaagauccccuuccacgaccuccaguccgagaagcgguacagccgcggguucgccuacugccacuccaagcuggccaacguccuguucacccgggagcucgccaagcgccugcagggcaccggggugaccacguacgccgugcacccgggcgucgugcggagcgagcuggugcgccacuccagccuccugugccugcucuggcggcuguucucccccuucgucaagaccgcgcgcgagggcgcccagaccagccugcacugcgcccucgccgaggggcuggagccccugagcggcaaguacuucuccgacugcaagcggaccugggugagcccccgcgcccggaacaacaagacggcggagcgccucuggaacgucuccugcgagcugcuggggauccgcugggaguga

SEQ ID NO: 35586 - RNA, 1011 nt, Artificial Sequence
  derived and/or modified sequence opt1 from RDH14__Homo_sapiens__NP_065956
auggccguggccaccgcggccgccguccuggccgcccucggcggggcgcuguggcuggccgcccgccgguucgugggcccccgcgugcagcggcuccgccgcgggggcgacccggggcugaugcacggcaagaccguccugaucacgggcgccaacagcgggcucggccgggcgaccgccgccgagcugcugcggcucggggcccgcgugaucaugggcugccgggaccgcgcccgggcggaggaggccgccgggcagcugcgccgggagcugcgccaggccgccgagugcggccccgagcccggcguguccggggucggcgagcucaucgugcgggagcuggaccuggcgagccuccgcuccgugcgggccuucugccaggagaugcugcaggaggagccccgccuggacguccucaucaacaacgccgggaucuuccagugcccguacaugaagaccgaggacggcuucgagaugcaguucggcgugaaccaccuggggcacuuccugcucaccaaccugcugcucggccugcucaagagcuccgcccccagccggaucguggucguguccagcaagcuguacaaguacggggacaucaacuucgacgaccugaacuccgagcagagcuacaacaaguccuucugcuacagccgcuccaagcuggccaacauccucuucacgcgggagcuggcgcgccgccuggagggcaccaacgugaccgucaacgugcuccaccccgggaucgugcggaccaaccugggccgccacauccacaucccccugcucgucaagccgcuguucaaccuggugagcugggccuucuucaagacgcccguggagggcgcccagaccuccaucuaccucgccagcucccccgaggucgagggggugagcggccgguacuucggggacugcaaggaggaggagcugcugcccaaggccauggacgaguccguggcgcgcaagcucugggacaucagcgaggucauggugggccugcugaaguga

SEQ ID NO: 35587 - RNA, 954 nt, Artificial Sequence
  derived and/or modified sequence opt1 from RDH16__Homo_sapiens__NP_003699
auguggcuguaccucgccguguucgucggccuguacuaccugcuccacugguaccgcgagcgccaggugcugagccaccuccgggacaaguacguguucaucaccgggugcgacuccggcuucgggaagcugcuggcccggcagcuggacgcgcgcggccuccggguccuggccgccugccugaccgagaagggggccgagcagcuccgcggccagacgagcgaccggcuggagaccgugacccuggacgugaccaagacggaguccgucgccgcggccgcccagugggugaaggagugcgugcgcgacaagggccucugggggcuggucaacaacgccggcaucagccugcccaccgcgccgaacgagcuccugaccaagcaggacuucgugaccauccuggacgugaaccuccugggggucaucgacgugacgcugucccuccugccccuggugcggcgcgcccggggccgcgucgugaacgugagcuccgucauggggcgggugagccucuucggcggcggguacugcaucuccaaguacggcguggaggccuucagcgacucccugcgccgggagcugagcuacuucggggucaagguggccaugaucgagcccggcuacuucaagaccgccgugaccuccaaggagcgcuuccucaagagcuuccuggagaucugggaccgguccagccccgaggucaaggaggcguacggcgagaaguucguggccgacuacaagaaguccgccgagcagauggagcagaagugcacccaggaccugagccucgucacgaacugcauggagcacgcccugaucgccugccacccgcgcacccgguacuccgcggggugggacgccaagcugcucuaccugcccaugagcuacaugcccaccuuccugguggacgccaucauguacugggugagccccuccccggccaaggcccucuga

SEQ ID NO: 35588 - RNA, 957 nt, Artificial Sequence
  derived and/or modified sequence opt1 from RDH5__Homo_sapiens__NP_002896
auguggcugccccuccugcugggcgcccuccugugggccgugcuguggcuccugcgcgaccggcagagccugccggcguccaacgccuucgucuucaucaccgggugcgacagcggcuucgggcgccuccuggcccugcagcucgaccagcggggcuuccgcgugcuggccuccugccugacccccagcggggccgaggaccuccagcggguggcguccagccgccugcacacgacccugcucgacaucaccgacccccaguccguccagcaggccgccaaguggguggagaugcacgugaaggaggccggccuguucggccuggucaacaacgcggggguggccggcaucaucgggcccaccccguggcucacgcgggacgacuuccagcgcgugcugaacgucaacaccaugggccccaucggggugacccuggcccuccugccccugcuccagcaggcccggggccgcgugaucaacaucaccagcguccugggccggcuggccgcgaacgggggcggguacugcguguccaaguucggccucgaggccuucagcgacucccugcgccgggacguggcccacuucggcauccgcgucagcaucguggagcccggguucuuccggacgccggugaccaaccuggagucccucgagaagacccugcaggccugcugggcccgccugccgcccgcgacccaggcccacuacggcggggccuuccucacgaaguaccugaagaugcagcagcggaucaugaaccugaucugcgaccccgaccucaccaaggucagccgcugccuggagcacgcccugaccgcccggcacccccgcacccgguacucccccggcugggacgcgaagcuccuguggcugcccgccagcuaccuccccgccucccugguggacgccgugcugacguggguccucccgaagcccgcccaggcgguguacuga

SEQ ID NO: 35589 - RNA, 996 nt, Artificial Sequence
  derived and/or modified sequence opt1 from RDH8__Homo_sapiens__NP_056540
augaacggccagagccaggugcugcccgggggcgggcacgagucccgcgagggcaucaacauggccgccgcgccgcggaccguccucaucagcgggugcuccagcggcaucggccuggagcuggccgugcagcucgcccacgaccccaagaagcgcuaccagguggucgccaccaugcgggaccuggggaagaaggagacgcuggaggccgcggccggcgaggcccucgggcagacccugaccguggcccagcuggacgugugcuccgacgagagcgucgcgcagugccucuccugcauccagggcgagguggacgugcuggucaacaacgccgggaugggccuggugggcccccucgaggggcugagccuggccgccaugcagaacguguucgacaccaacuucuucggcgccguccgccucgugaaggcggugcugcccgggaugaagcggcgccggcagggccacaucgucgugaucuccagcgugaugggccugcagggggucaucuucaacgacguguacgccgccuccaaguucgcccucgagggcuucuucgagagccuggccauccagcugcuccaguucaacaucuucaucucccugguggagccggggcccgucgugacggaguucgagggcaagcugcucgcccaggugagcauggcggaguuccccgggaccgaccccgagacccugcacuacuuccgcgaccuguaccucccggccucccggaagcuguucugcagcgucggccagaacccccaggacgugguccaggccaucgugaacgugaucuccagcacccgcccgccccugcggcgccagacgaacauccgguacagcccccucaccacccugaagaccgucgacuccagcggcucccuguacgugcgcacgacccaccggcuccuguuccgcugcccccggcugcucaaccuggggcugcagugccucagcugcggcugccugcccacccgcgugcggccccgcuga

SEQ ID NO: 35590 - RNA, 711 nt, Artificial Sequence
  derived and/or modified sequence opt1 from RDM1__Homo_sapiens__NP_001030008
auggccgagcuggugcccuucgccgucccgaucgagagcgacaagacccuccuggugugggagcuguccagcggccccaccgcggaggcccuccaccacucccuguucacggccuucagccaguucgggcugcucuacuccgugcgcgucuuccccaacgccgccguggcgcaccccggcuucuacgccgugaucaaguucuacagcgcccgggccgcgcaccgcgcccagaaggccugcgaccggaagcagcuguuccagaaguccccggucaaggugcgccuggggacccggcacaaggccgugcagcaccaggcccucgcgcugaacagcuccaagugccaggagcuggccaacuacuacuucggcuucaacgggugcagcaagcgcaucaucaagcuccaggagcuguccgaccuggaggagcgggagaacgaggacagcauggucccccuccccaagcagucccugaaguucuucugcgcccuggagguggugcuccccagcugcgacugccgcuccccgggcaucggccuggucgaggagcccauggacaagguggaggaggggccccugagcuuccucaugaagcggaagaccgcccagaagcuggccauccagaaggcgcuguccgacgccuuccagaagcuccugaucgugguccugggcaagaccgugcucaucauccuggaggugcugcaguuccaguga

SEQ ID NO: 35591 - RNA, 1815 nt, Artificial Sequence
  derived and/or modified sequence opt1 from RDX__Homo_sapiens__NP_001247421
augcccaagcccaucaacgugcgcgucaccaccauggacgccgagcuggaguucgccauccagcccaacacgaccggcaagcagcuguucgaccagguggugaagaccgucgggcuccgggaggugugguucuucggccugcaguacguggacagcaagggguacuccaccuggcucaagcugaacaagaaggucacgcagcaggacgugaagaaggagaacccccugcaguucaaguuccgcgcgaaguucuuccccgaggacgugagcgaggagcucauccaggagaucacccagcggcuguucuuccugcaggucaaggaggccauccucaacgacgagaucuacugcccgcccgagaccgccgugcugcuggccuccuacgccgugcaggcgaaguacggcgacuacaacaaggagauccacaagcccggguaccucgccaacgaccgccugcugccccagcggguccucgagcagcacaagcugaccaaggagcagugggaggagcgcauccagaacuggcacgaggagcaccggggcaugcugcgcgaggacagcaugauggaguaccucaagaucgcccaggaccuggagauguacggcgugaacuacuucgagaucaagaacaagaaggggacggagcuguggcucggcguggacgcccuggggcugaacaucuacgagcacgacgacaagcucacccccaagaucggcuuccccugguccgagauccggaacaucagcuucaacgacaagaaguucgucaucaagcccaucgacaagaaggcgcccgacuucguguucuacgccccgcgccugcggaucaacaagcgcauccuggcccucugcauggggaaccacgagcuguacaugcggcgccggaagcccgacaccaucgaggugcagcagaugaaggcccaggcccgcgaggagaagcaccagaagcagcuggagcgggcgcagcucgagaacgagaagaagaagcgcgagaucgccgagaaggagaaggagcggaucgagcgcgagaaggaggagcugauggagcggcugaagcagaucgaggagcagaccaucaaggcccagaaggagcucgaggagcagacgcgcaaggcccuggagcuggaccaggagcgcaagcgggccaaggaggaggcggagcgccucgagaaggagcggcgcgccgccgaggaggccaaguccgccaucgcgaagcaggccgccgaccagaugaagaaccaggagcagcuggccgccgagcuggcggaguucaccgccaagaucgcccuccuggaggaggccaagaagaagaaggaggaggaggcgaccgaguggcagcacaaggccuucgccgcccaggaggaccuggagaagaccaaggaggagcucaagacggucaugagcgcgcccccgcccccgcccccgccgcccgugaucccgcccaccgagaacgagcacgacgagcacgacgagaacaacgccgaggccuccgccgagcugagcaacgagggcgugaugaaccaccgguccgaggaggagcgcgucaccgagacccagaagaacgagcgggugaagaagcagcugcaggcccucagcuccgagcuggcccaggcgcgcgacgagacgaagaagacccagaacgacgugcugcacgccgagaacgucaaggccggccgggacaaguacaagacccuccgccagauccggcaggggaacaccaagcagcgcaucgacgaguucgaggccauguggggccccaagcuguacgcccuguuccagaugcggagcugccaguccagcaucaagcagauguga

SEQ ID NO: 35592 - RNA, 1644 nt, Artificial Sequence
  derived and/or modified sequence opt1 from REC8__Homo_sapiens__NP_001041670
auguucuacuaccccaacgugcugcagcgccacaccggcugcuucgccaccaucuggcucgccgcgacgcgggggagccgccuggucaagcgggaguaccugcgcgugaacguggucaagaccugcgaggagauccucaacuacgugcuggugcggguccagccgccccagcccggccugccccgcccgcgguucucccucuaccugagcgcccagcugcagaucggggugauccgcguguacucccagcagugccaguaccucgucgaggacauccagcacauccuggagcggcugcaccgcgcccagcuccagauccggaucgacauggagaccgagcugcccagccugcuccugcccaaccaccuggccaugauggagacccucgaggacgcccccgacccguucuucggcaugauguccguggacccccgccugcccagccccuucgacaucccgcagauccggcaccuccuggaggcggccauccccgagcgcguggaggagaucccgcccgagguccccacggagccccgggagcccgagcgcauccccgugaccgugcugccgcccgaggccaucaccauccuggaggccgagcccauccggaugcucgagaucgagggggagcgcgagcugcccgaggucucccggcgcgagcuggaccuccugaucgcggaggaggaggaggccauccugcucgagaucccgcggcugcccccgcccgcccccgccgagguggagggcaucggcgaggcccuggggcccgaggagcuccgccugaccggcugggagcccggggcgcugcucauggaggugacgccgcccgaggagcugcgccugcccgcgcccccgagccccgagcggcgcccgcccgugcccccgccgccccggcgccggcgccggcgccggcuccuguucugggacaaggagacccagaucucccccgagaaguuccaggagcagcugcagacccgcgcccacugcugggagugccccaugguccagccgcccgagcggaccauccgcggccccgccgagcuguuccggacgcccacccucagcggguggcugccgcccgagcuccugggccuguggacccacugcgcccagcccccgcccaaggcccuccgccgggagcugcccgaggaggccgccgccgaggaggagcgccggaagaucgaggugcccuccgagaucgaggucccccgcgaggcccuggagcccagcgugccccugauggugucccucgagaucagccuggaggcggccgaggaggagaagucccggaucagccugaucccgcccgaggagcgcugggccuggcccgaggucgaggcccccgaggcccccgcgcuccccgugguccccgagcugccggaggugcccauggagaugccccuggugcugcccccggagcucgagcugcucucccuggaggccguccaccgcgccguggcccuggagcuccaggcgaaccgggagcccgacuucagcucccuggugagcccccugagcccccgccggauggccgcccgcgucuucuaccuccugcuggugcucuccgcccagcagauccugcacgugaagcaggagaagccguacggccggcugcucauccagcccgggccccgcuuccacuga

SEQ ID NO: 35593 - RNA, 2916 nt, Artificial Sequence
  derived and/or modified sequence opt1 from RECK__Homo_sapiens__NP_066934
auggccaccgugcgcgccagccugcggggcgcgcugcugcugcuccuggccgucgccgggguggccgagguggccggcgggcuggcgcccggcuccgccggggcccucugcugcaaccacagcaaggacaaccagaugugccgcgacgucugcgagcagaucuucuccagcaaguccgagagccggcugaagcaccuccuccagcgcgccccggacuacugccccgagaccaugguggagaucuggaacugcaugaacuccagccugcccggcguguucaagaaguccgacggcugggucgggcugggcugcugcgagcucgcgaucgcccuggagugccggcaggccugcaagcaggccagcuccaagaacgacaucagcaaggugugccgcaaggaguacgagaacgcccuguucuccugcaucagccggaacgagaugggguccgugugcugcagcuacgcgggccaccacacgaacugccgcgaguacugccaggccaucuuccggaccgacuccagccccgggccgucccagaucaaggccgucgagaacuacugcgccagcaucagcccccagcucauccacugcgugaacaacuacacccaguccuaccccaugcgcaaccccaccgacagccuguacugcugcgaccgggccgaggaccacgcgugccagaacgccugcaagcgcauccugauguccaagaagacggagauggagaucguggacggccucaucgagggcugcaagacccagccgcugccccaggacccccuguggcagugcuuccucgagagcucccagagcguccaccccggggugaccgugcacccgccgcccuccaccggccuggacggggccaagcugcacugcugcagcaaggccaacacguccacgugccgggagcucugcaccaagcuguacagcauguccuggggcaacacccagagcuggcaggaguucgaccgcuucugcgaguacaaccccgucgagguguccaugcugaccugccucgccgacgugcgggagcccugccagcugggcugccgcaaccugaccuacugcaccaacuucaacaaccggcccaccgagcuguuccgcagcugcaacgcgcaguccgaccagggggccaugaacgacaugaagcugugggagaagggcagcaucaagaugcccuucaucaacauccccguccuggacaucaagaagugccagccggagauguggaaggccaucgccugcucccuccagaucaagcccugccacagcaagucccgggggagcaucaucugcaagagcgacugcguggagauccugaagaagugcggcgaccagaacaaguuccccgaggaccacacggccgaguccaucugcgagcugcucagccccaccgacgaccugaagaacugcaucccgcuggacaccuaccuccgccccuccacccuggggaacaucguggaggaggucacgcaccccugcaaccccaacccgugccccgcgaacgagcugugcgaggugaaccggaagggcugccccagcggcgacccgugccuccccuacuucugcgugcaggggugcaagcugggcgaggccuccgacuucaucguccgccaggggacccugauccaggugcccagcuccgccggcgaggucgggugcuacaagaucugcagcugcggccaguccggccuccuggagaacugcauggagaugcacugcaucgaccugcagaaguccugcaucgucgggggcaagcgcaagagccacgggaccagcuucuccaucgacugcaacgugugcagcugcuucgccggcaaccucgugugcuccacccggcugugccugagcgagcacuccagcgaggacgaccgccggacguucaccgggcugcccugcaacugcgcggaccaguucgugccggugugcggccagaacggccgcaccuaccccagcgccugcaucgcccggugcgucgggcuccaggaccaccaguucgaguucggcuccugcaugagcaaggaccccugcaaccccaacccgugccagaagaaccagcgcugcauccccaagccccaggugugccugaccacguucgacaaguucgggugcucccaguacgagugcgugccccggcagcuggccugcgaccagguccaggacccggugugcgacaccgaccacauggagcacaacaaccucugcacccuguaccagcgcggcaagagccuguccuacaagggccccugccagcccuucugccgggccaccgagcccgugugcgggcacaacggcgagacguacagcuccgucugcgcggccuacagcgaccgcguggccguggacuacuacggggacugccaggccgucggcgugcucuccgagcacagcuccguggccgagugcgcgagcgucaagugcccgucccugcuggccgccgggugcaagcccaucaucccgcccggcgccugcugcccccucugcgccggcaugcugcgggugcuguucgacaaggagaagcucgacaccaucgcgaaggugaccaacaagaagcccaucaccguccuggagauccugcagaagauccgcaugcacgugagcgugccccagugcgacgucuucggguacuucuccaucgagagcgagaucgugauccucaucauccccguggaccacuacccgaaggcccugcagaucgaggccugcaacaaggaggccgagaagaucgagucccugaucaacagcgacucccccacgcucgcgagccacgucccccugagcgcccugaucaucucccagguccaggugagcuccagcgugccguccgccggcgugcgggcccgccccagcugccacucccuccugcugccccucagccuggggcuggcccuccaccuccuguggaccuacaacuga

SEQ ID NO: 35594 - RNA, 1308 nt, Artificial Sequence
  derived and/or modified sequence opt1 from RECQL5__Homo_sapiens__NP_001003715
augagcucccaccacaccaccuuccccuucgacccggagcgccgggugcgcagcacgcugaagaaggucuucggcuucgacuccuucaagacgccccuccaggagagcgccaccauggccguggugaaggggaacaaggacgucuucgugugcaugcccaccggcgcggggaagucccugugcuaccagcugcccgcccuccuggccaagggcaucaccaucguggucagcccgcugaucgcccucauccaggaccagguggaccaccuccugacccugaaggugcgggucuccagccugaacuccaagcugagcgcccaggagcgcaaggagcuccuggcggaccuggagcgggagaagccccagaccaagauccucuacaucacccccgagauggccgccuccagcuccuuccagcccacgcugaacagccuggugucccgccaccuccugagcuaccugguggucgacgaggcccacugcgugucccagugggggcacgacuuccggccggacuaccuccgccugggcgcgcugcggagccgccucggccacgcccccugcguggcccugaccgccaccgccacgccccagguccaggaggacguguucgcggcccugcaccucaagaagcccguggccaucuucaagaccccgugcuuccgggccaaccuguucuacgacguccaguucaaggagcugaucuccgaccccuacgggaaccucaaggacuucugccugaaggcccugggccaggaggcggacaaggggcucagcggcugcgggaucguguacugccgcacccgggaggccugcgagcagcuggccaucgagcugagcugccgcggcgugaacgccaaggccuaccacgcgggccucaaggccuccgagcggacccugguccagaacgacuggauggaggagaaggugcccgugaucgucgccaccaucagcuucgggaugggcguggacaaggccaacguccgcuucguggcccacuggaacaucgcgaaguccauggccggguacuaccaggagagcggccgggccggccgcgacgggaagcccuccuggugccggcuguacuacagccgcaacgaccgggaccagguguccuuccucauccgcaaggaggucgccaagcugcaggagaagcgcggcaacaaggcgagcgacaaggccacgaucauggccuucgacgcccuggugaccuucugcgaggagcucgggcgguggggccgcgggcacggcaagucccugcgggccgcguggugcagccagguggucucccgccacgccgagcuguga

SEQ ID NO: 35595 - RNA, 1950 nt, Artificial Sequence
  derived and/or modified sequence opt1 from RECQL__Homo_sapiens__XP_006719196
auggccagcguguccgcccugaccgaggagcucgacagcaucaccuccgagcugcacgcgguggagauccagauccaggagcugacggagcgccagcaggagcucauccagaagaagaaggugcugaccaagaagaucaagcagugccuggaggacagcgacgccggcgccuccaacgaguacgacagcucccccgccgccuggaacaaggaggacuucccguggagcgggaaggugaaggacauccuccagaacgucuucaagcuggagaaguuccggccccugcagcucgagaccaucaacgugaccauggcgggcaaggagguguuccuggucaugcccaccgggggcgggaagucccugugcuaccagcuccccgcccugugcagcgacggcuucacgcuggugaucugcccgcucaucucccugauggaggaccagcugauggugcucaagcagcugggcaucagcgccaccaugcugaacgccuccagcuccaaggagcacgucaagugggugcacgcggagauggugaacaagaacagcgagcucaagcugaucuacgucacccccgagaagaucgccaaguccaagauguucaugagccgccuggagaaggccuacgaggcccggcgcuucacgcggaucgccguggacgaggugcacugcugcucccagugggggcacgacuuccgccccgacuacaaggcgcucggcauccugaagcggcaguuccccaacgccagccugaucgggcucaccgccaccgccaccaaccacguccugacggacgcccagaagauccugugcaucgagaagugcuucaccuucaccgcgagcuucaaccgcccgaaccucuacuacgaggugcggcagaagcccuccaacaccgaggacuucaucgaggacaucgugaagcugaucaacggccgcuacaaggggcagagcggcaucaucuacugcuucucccagaaggacagcgagcaggucacggugucccugcagaaccucggcauccacgccggggccuaccacgccaaccuggagcccgaggacaagaccaccgugcaccggaaguggagcgccaacgagauccaggucgugguggcgaccgucgccuucggcauggggaucgacaagcccgacgugcgcuucgucauccaccacuccaugagcaaguccauggagaacuacuaccaggagagcggccgggccggccgcgacgacaugaaggccgacugcauccuguacuacggguucggcgacaucuuccggaucuccagcaugguggugauggagaacgucgggcagcagaagcucuacgagaugguguccuacugccagaacaucagcaagugccgccgggugcugauggcccagcacuucgacgaggucuggaacuccgaggcgugcaacaagaugugcgacaacugcugcaaggacagcgccuucgagcgcaagaacaucacggaguacugccgggaccugaucaagauccucaagcaggccgaggagcugaacgagaagcugaccccgcucaagcugaucgacuccuggaugggcaagggggccgcgaagcugcgcguggccggcguggucgcccccacccucccccgggaggaccuggagaagaucaucgcccacuuccugauccagcaguaccucaaggaggacuacagcuucaccgccuacgcgacgaucuccuaccugaagaucggccccaaggccaaccugcugaacaacgaggcccacgccaucaccaugcaggucaccaagagcacccagaacagcuuccgcgccgaguccagccagacgugccacuccgagcagggggacaagaagauggaggagaagaacagcggcaacuuccagaagaaggcggccaacaugcuccagcaguccgggagcaagaacaccggcgccaagaagcgcaagaucgacgacgccuga

SEQ ID NO: 35596 - RNA, 627 nt, Artificial Sequence
  derived and/or modified sequence opt1 from REEP1__Homo_sapiens__NP_001158202
augcagaaggugcugagcaacggccagaccgaggagguccgcuccgggagccggcucaucuucggcacccuguaccccgccuacuacuccuacaaggccgucaagagcaaggacaucaaggaguacgugaaguggaugauguacuggaucaucuucgcgcuguucacgaccgccgagaccuucaccgacaucuuccucugcugguuccccuucuacuacgagcugaagaucgccuucguggccuggcugcucucccccuacacgaaggggagcucccugcuguaccgcaaguucgugcaccccacccucagcuccaaggagaaggagaucgacgacugccuggugcaggccaaggaccggagcuacgacgcgcugguccacuucggcaagcgcgggcucaacguggccgccaccgccgcggugauggccgccuccaagggccagggcgcccugagcgagcggcugcgcuccuucagcaugcaggaccucaccacgauccgcggggacggcgcccccgcgccguccgggcccccgccgcccggcagcgggcgggccuccggcaagcacggccagcccaagaugagccgguccgccagcgagagcgccuccagcuccgggaccgccuga

SEQ ID NO: 35597 - RNA, 765 nt, Artificial Sequence
  derived and/or modified sequence opt1 from REEP2__Homo_sapiens__NP_001258732
auggugagcuggaucaucucccgccuggucgugcucaucuucggcacccuguaccccgccuacagcuccuacaaggccgugaagaccaagaacgucaaggaguacgugaaguggaugauguacuggaucguguucgcguucuucacgaccgccgagacccugaccgacaucguccucagcugguucccguucuacuucgagcugaagaucgccuucgugaucuggcugcucucccccuacacgaaggggagcuccgugcuguaccggaaguucguccaccccacccugagcaacaaggagaaggagaucgacgaguacaucacccaggcccgcgacaaguccuacgagaccaugaugcgggugggcaagcgcgggcucaaccuggccgcgaacgccgccgugacggccgcggccaagggccaggggguccugagcgagaagcuccgguccuucagcaugcaggaccugacccugauccgcgacgaggacgcccucccccugcagcggccggacggccgccugcggcccucccccggcagccuccuggacaccaucgaggaccugggggacgaccccgcccucucccugcgcagcuccaccaacccggccgacagccggacggaggcguccgaggacgacaugggcgacaaggcccccaagcgcgccaagcccaucaagaaggcccccaaggccgagccgcuggcgagcaagacccucaagacccggcccaagaagaagaccagcgggggcggggacuccgccuga

SEQ ID NO: 35598 - RNA, 768 nt, Artificial Sequence
  derived and/or modified sequence opt1 from REEP3__Homo_sapiens__NP_001001330
auggugagcuggaugaucucccgcgccgucgugcugguguucggcaugcucuaccccgccuacuacagcuacaaggcggucaagaccaagaacgugaaggaguacgugcgguggaugauguacuggaucgucuucgcccuguacaccgugaucgagacgguggccgaccagaccgucgccugguucccgcuguacuacgagcucaagaucgccuucgugaucuggcugcugucccccuacaccaagggggcgagccucaucuaccgcaaguuccugcacccccugcucuccagcaaggagcgggagaucgacgacuacaucgugcaggccaaggagcgcggcuacgagaccauggucaacuucgggcggcagggccugaaccuggccgccacggcggccgugaccgccgccgugaagucccagggggccaucaccgagcgccuccggagcuucuccaugcacgaccugaccacgauccagggcgacgagcccgucggccagcgcccguaccagccccugcccgaggcgaagaagaaguccaagcccgccccgagcgagagcgccggguacggcaucccccucaaggacggggacgagaagaccgacgaggaggccgagggccccuacuccgacaacgagaugcugacccacaaggggcugcggcgcagccaguccaugaaguccgugaagaccacgaagggccggaaggaggugcgcuacggcagccucaaguacaaggucaagaagcggccccagguguacuucuga

SEQ ID NO: 35599 - RNA, 570 nt, Artificial Sequence
  derived and/or modified sequence opt1 from REEP5__Homo_sapiens__NP_005660
augagcgccgccaugcgcgagcgguucgaccgcuuccugcacgagaagaacugcaugaccgaccuccuggcgaagcuggaggccaagaccggcgugaaccggagcuucaucgcccucggggucaucggccugguggcccuguaccucguguucggguacggcgccagccugcugugcaaccucaucggguucggcuaccccgcguacaucuccaucaaggccaucgagagcccgaacaaggaggacgacacgcaguggcugaccuacugggucguguacggcguguucuccaucgccgaguucuucagcgacaucuuccuguccugguuccccuucuacuacaugcucaagugcggguuccugcuguggugcauggcccccagccccuccaacggcgcggagcuccuguacaagcgcaucauccggccguucuuccugaagcacgagagccagauggacuccgucgugaaggaccucaaggacaaggccaaggagaccgccgacgccaucaccaaggaggccaagaaggcgacggugaaccugcugggggaggagaagaaguccaccuga

SEQ ID NO: 35600 - RNA, 555 nt, Artificial Sequence
  derived and/or modified sequence opt1 from REEP6__Homo_sapiens__NP_612402
auggacggccugcgccagcggguggagcacuuccucgagcagcgcaaccuggucaccgaggugcugggggcccucgaggccaagaccggcguggagaagcgguaccuggcggccggggccgucacgcugcucagccuguaccuccuguucggcuacggggccucccugcugugcaaccucaucggcuucguguaccccgccuacgcgagcaucaaggccaucgaguccccgagcaaggacgacgacaccguguggcugaccuacugggucguguacgcccuguucggccucgccgaguucuucuccgaccugcugcucagcugguuccccuucuacuacguggggaagugcgcguuccugcuguucugcauggcgccccgccccuggaacggcgcccucaugcuguaccagcgggucgugcgcccgcuguuccuccggcaccacggggccguggaccgcaucaugaacgaccuguccggccgggcccuggacgccgccgccgggaucacccgcaacgucaagcccagccagacgccccagcccaaggacaaguga

SEQ ID NO: 35601 - RNA, 501 nt, Artificial Sequence
  derived and/or modified sequence opt1 from REG1A__Homo_sapiens__NP_002900
auggcccagaccagcuccuacuucaugcugaucagcugccucauguuccugucccagagccagggccaggaggcccagaccgagcugccccaggcgcgcaucuccugcccggaggggacgaacgccuaccggagcuacugcuacuacuucaacgaggaccgcgagaccuggguggacgccgaccucuacugccagaacaugaacuccggcaaccuggucagcgugcugacccaggccgagggggccuucguggcgucccucaucaaggagagcggcaccgacgacuucaacgucuggaucgggcugcacgaccccaagaagaaccggcgcuggcacugguccagcggcucccuggugagcuacaaguccuggggcaucggggcccccagcuccgugaaccccggcuacugcgucagccucacguccagcaccggguuccagaaguggaaggacgugccgugcgaggacaaguucagcuucgugugcaaguucaagaacuga

SEQ ID NO: 35602 - RNA, 501 nt, Artificial Sequence
  derived and/or modified sequence opt1 from REG1B__Homo_sapiens__NP_006498
auggcccagaccaacagcuucuucaugcugaucuccagccucauguuccugucccugagccagggccaggagucccagaccgagcuccccaacccgcgcaucagcugccccgaggggacgaacgccuaccgguccuacugcuacuacuucaacgaggaccccgagaccuggguggacgcggaccuguacugccagaacaugaacagcggcaaccuggucuccgugcucacccaggccgagggggccuucguggccagccugaucaaggaguccagcaccgacgacuccaacgucuggaucggccugcacgaccccaagaagaaccgccgguggcacuggagcuccgggagccucguguccuacaagagcugggacacgggcuccccgagcagcgccaacgcgggcuacugcgccucccugaccagcugcuccggguucaagaaguggaaggacgagagcugcgagaagaaguucuccuucgugugcaaguucaagaacuga

SEQ ID NO: 35603 - RNA, 528 nt, Artificial Sequence
  derived and/or modified sequence opt1 from REG3A__Homo_sapiens__NP_620355
augcugcccccgauggcccuccccagcguguccuggaugcugcugagcugccucaugcugcugucccagguccagggcgaggagccccagcgcgagcuccccagcgcccggauccgcugcccgaagggguccaaggcguacggcagccacugcuacgcccuguuccugucccccaagagcuggaccgacgccgaccucgccugccagaagcggcccuccgggaaccuggugagcgugcuguccggcgccgaggggagcuucgucuccagccucgugaaguccaucggcaacagcuacuccuacguguggaucggccugcacgaccccacccaggggacggagccgaacggcgaggggugggaguggagcuccagcgacgucaugaacuacuucgcgugggagcgcaaccccagcaccaucuccagccccggccacugcgccucccugagccgguccaccgccuuccuccgcuggaaggacuacaacugcaacgugcggcugcccuacgugugcaaguucaccgacuga

SEQ ID NO: 35604 - RNA, 1647 nt, Artificial Sequence
  derived and/or modified sequence opt1 from RELA__Homo_sapiens__NP_001138610
auggacgagcuguucccccucaucuucccggccgagcccgcccaggcgagcggccccuacguggagaucaucgagcagcccaagcagcgcgggaugcgguuccgcuacaagugcgagggccgguccgccgggagcaucccgggcgagcgcuccaccgacaccacgaagacccaccccaccaucaagaucaacggguacaccggccccggcacgguccggaucagccuggugaccaaggacccgccgcaccgcccccacccccacgagcugguggggaaggacugccgggacggcuucuacgaggccgagcucugccccgaccgcugcauccacuccuuccagaaccuggggauccagugcgucaagaagcgggaccuggagcaggccaucagccagcgcauccagaccaacaacaacccguuccaggaggagcagcggggcgacuacgaccucaacgccgugcgccugugcuuccaggugaccguccgggaccccuccgggcgcccccugcggcugcccccggugcucagccaccccaucuucgacaaccgcgcgcccaacacggccgagcugaagaucugccgggugaaccgcaacuccggcagcugccucggcggggacgagaucuuccugcugugcgacaagguccagaaggaggacaucgagguguacuucaccggccccgggugggaggcccggggcuccuucagccaggccgacgugcaccgccaggucgcgaucguguuccggaccccgcccuacgccgaccccucccuccaggcccccgugcgcgucagcaugcagcugcgccggccguccgaccgcgagcugagcgagcccauggaguuccaguaccuccccgacaccgacgaccggcaccgcaucgaggagaagcggaagcgcacguacgagaccuucaaguccaucaugaagaagucccccuucagcggcccgaccgacccccggcccccgccccgccggaucgccgugcccagccgcagcuccgccagcgugcccaagccggcgccccagcccuaccccuucaccuccagccuguccacgaucaacuacgacgaguucccgaccauggucuuccccagcgggcagaucucccaggccagcgcccuggcccccgccccgccccaggugcucccccaggcgcccgcccccgcccccgcccccgccaugguguccgcgcuggcccaggcccccgcccccgucccggugcuggcccccggcccgccccaggcgguggccccgcccgcccccaagcccacccaggccggggagggcacccucagcgaggcgcugcugcagcuccaguucgacgacgaggaccugggggcccugcucggcaacuccacggaccccgccgucuucaccgaccuggccagcguggacaacuccgaguuccagcagcugcucaaccagggcauccccgucgcgccccacaccaccgagccgaugcugauggaguaccccgaggccaucacgcggcuggugaccggggcccagcgcccgcccgaccccgcccccgcgccccucggcgcccccgggcugccgaacggccugcucagcggggacgaggacuucuccagcaucgccgacauggacuucuccgcccugcugagccagaucuccagcuga

SEQ ID NO: 35605 - RNA, 1740 nt, Artificial Sequence
  derived and/or modified sequence opt1 from RELB__Homo_sapiens__NP_006500
augcugcgcagcggccccgccuccgggccgagcgugcccaccggccgggccaugcccucccgccgggucgcgcggcccccggccgcccccgagcucggggcccugggcagccccgaccuguccagccucucccuggccgugagccgguccaccgacgagcuggagaucaucgacgaguacaucaaggagaacggguucggccucgacggcgggcagcccggcccgggggagggccugccccgccuggugagccgcggggcggccucccucagcacggucacccugggccccguggcgcccccggccaccccgccgcccuggggcugcccccuggggcgccucgugucccccgcccccggccccgggccccagccccaccuggucaucaccgagcagcccaagcagcggggcaugcgcuuccgguacgagugcgagggccgcagcgccggguccauccugggcgagagcuccacggaggccagcaagacccuccccgccaucgagcugcgggacugcgggggccugcgcgagguggaggugaccgccugccucgucuggaaggacuggccgcaccgggugcacccccacucccugguggggaaggacugcaccgacggcaucugccgcguccggcugcgcccccacgugagcccccggcacagcuucaacaaccucggcauccagugcgugcgcaagaaggagaucgaggcggccaucgagcggaagauccagcuggggaucgacccguacaacgccggcucccugaagaaccaccaggaggucgacaugaacguggugcgcaucugcuuccaggccagcuaccgcgaccagcaggggcagaugcggcgcauggaccccguccucuccgagcccguguacgacaagaaguccacgaacaccagcgagcugcggaucugccgcaucaacaaggagagcggcccgugcaccgggggcgaggagcuguaccuccugugcgacaaggugcagaaggaggacaucuccgucguguucagccgggccuccugggagggccgcgcggacuucagccaggccgacgugcaccggcagaucgccaucgucuucaagaccccgcccuacgaggaccuggagaucguggagcccgucacggugaacguguuccuccagcgccugaccgacggggucugcuccgagccccugcccuucaccuaccucccccgggaccacgacagcuacggcguggacaagaagcgcaagcgggggaugcccgacgugcugggcgagcugaacuccagcgacccgcacgggaucgaguccaagcgccggaagaagaagcccgccauccucgaccacuuccugcccaaccacggcagcggccccuuccugccgcccuccgcccuccugcccgaccccgacuucuucagcgggaccgucucccugccgggccucgagccgcccgggggccccgaccugcuggacgacggcuucgcguacgaccccacggcccccacccucuucaccaugcuggaccugcucccgcccgccccgccccacgccagcgccguggugugcagcgggggcgcgggggccgucgugggcgagacccccgggcccgagccccugacgcuggacuccuaccaggcccccggccccggcgacgggggcaccgccagccuggugggguccaacauguucccgaaccacuaccgcgaggcggccuucggcgggggccuccugagccccggccccgaggccaccuga

SEQ ID NO: 35606 - RNA, 1764 nt, Artificial Sequence
  derived and/or modified sequence opt1 from REL__Homo_sapiens__NP_001278675
auggccagcggcgccuacaaccccuacaucgagaucaucgagcagccgcgccagcgggggaugcgcuuccgguacaagugcgagggccgcuccgcggggagcauccccggcgagcacuccaccgacaacaaccggaccuaccccagcauccagaucaugaacuacuacgggaagggcaaggugcgcaucacgcuggucaccaagaacgaccccuacaagccgcacccccacgaccucgugggcaaggacugccgggacggguacuacgaggccgaguucggccaggagcgccggccccuguucuuccagaaccuggggauccgcugcgugaagaagaaggaggucaaggaggccaucaucacccggaucaaggccggcaucaaccccuucaacgugccggagaagcagcucaacgacaucgaggacugcgaccugaacgugguccgccugugcuuccagguguuccuccccgacgagcacgggaaccugaccacggcccugccgcccguggucuccaaccccaucuacgacaaccgggcgcccaacaccgccgagcuccgcaucugccgggugaacaagaacugcggcagcgugcgcggcggggacgagaucuuccugcugugcgacaagguccagaaggacgacaucgaggugcgguucgugcucaacgacugggaggccaagggcaucuucucccaggccgacguccaccgccagguggcgaucguguucaagaccccgcccuacugcaaggccaucaccgagcccgucacggugaagaugcagcugcggcgccccagcgaccaggagguguccgagagcauggacuuccgguaccugcccgacgagaaggacaccuacgggaacaaggccaagaagcagaagaccacccuccuguuccagaagcugugccaggaccacgucaacuuccccgagcgcccgcgccccggccuccugggcuccaucggggagggccgguacuucaagaaggagcccaaccuguucagccacgacgccguggugcgcgagaugcccacgggggucuccagccaggccgaguccuacuacccgagccccggccccaucuccagcgggcucucccaccacgcgagcauggcgccccugccgagcuccagcugguccagcguggcccaccccacgccccgguccggcaacaccaacccgcugagcuccuucagcacccgcacccuccccuccaacagccagggcaucccgcccuuccugcggauccccgucgggaacgaccugaacgccuccaacgccugcaucuacaacaacgccgacgacaucgugggcauggaggccagcuccaugcccagcgccgaccucuacgggaucuccgaccccaacaugcugagcaacugcuccgugaacaugaugaccaccagcuccgacagcaugggcgagaccgacaacccccgccugcucagcaugaaccuggagaacccguccugcaacagcguccuggacccccgggaccuccgccagcugcaccagauguccagcuccagcauguccgccggggccaacagcaacacgaccguguucgugucccagagcgacgcguucgagggcuccgacuucagcugcgccgacaacuccaugaucaacgagagcggccccuccaacagcaccaaccccaacucccacggguucguccaggacagccaguacagcggcaucggguccaugcagaacgagcagcugagcgacuccuucccguacgaguucuuccagguguga

SEQ ID NO: 35607 - RNA, 10383 nt, Artificial Sequence
  derived and/or modified sequence opt1 from RELN__Homo_sapiens__NP_005036
auggagcgcuccggcugggcccggcagaccuuccugcuggcccugcugcugggggcgacccugcgcgcccgggccgccgccggcuacuacccccgcuucucccccuucuucuuccugugcacccaccacggggagcucgagggcgacggggagcagggcgaggugcugaucucccugcacaucgcgggcaaccccaccuacuacguccccgggcaggaguaccacgugaccaucuccaccuccaccuucuucgacggccuccuggugaccgggcuguacaccuccaccagcguccaggccucccagagcaucggcggguccagcgccuucggcuucggcaucauguccgaccaccaguucgggaaccaguucaugugcagcgugguggccucccacgucagccaccuccccacgaccaaccuguccuucaucuggaucgcgccgcccgccggcaccgggugcgugaacuucauggccaccgccacgcaccggggccaggugaucuucaaggacgcccuggcgcagcagcucugcgagcagggcgcccccaccgacgucaccgugcacccccaccuggccgagauccacagcgacuccaucauccugcgcgacgacuucgacagcuaccaccagcuccagcugaaccccaacaucuggguggagugcaacaacugcgagaccggggagcagugcggcgccaucaugcacgggaacgccgucacguucugcgagcccuacggcccccgggagcugaucaccaccgggcucaacaccacgaccgcguccgugcugcaguucagcaucggcagcggcuccugccgcuucagcuacuccgaccccagcaucaucgugcuguacgccaagaacaacuccgccgacuggauccagcucgagaagauccgggccccgagcaacgucuccaccaucauccacauccuguaccugcccgaggacgccaagggggagaacgugcaguuccaguggaagcaggagaaccuccgcgugggcgaggucuacgaggcgugcugggcccuggacaacauccugaucaucaacagcgcccaccggcaggucgugcucgaggacucccuggaccccgucgacaccgggaacuggcuguucuuccccggcgccacggugaagcacagcugccaguccgacgggaacagcaucuacuuccacggcaacgagggcuccgaguucaacuucgccaccacccgcgacguggaccucagcaccgaggacauccaggagcagugguccgaggaguucgagagccagccgacggggugggacguccugggcgcggugaucgggaccgagugcggcaccaucgaguccgggcugagcauggucuuccucaaggacggcgagcggaagcugugcacccccuccauggacacgaccggcuacgggaaccugcgcuucuacuucgugaugggcgggaucugcgaccccggcaacagccacgagaacgacaucauccucuacgccaagaucgagggccggaaggagcacaucacccuggacacccugagcuacuccagcuacaaggugcccucccucgucagcguggugaucaacccggagcugcagacgcccgccaccaaguucugccugcgccagaagaaccaccaggggcacaaccggaacgucugggccguggacuucuuccacgugcuccccguccugcccuccaccaugagccacaugauccaguucuccaucaaccugggcugcgggacccaccagccgggcaacagcgugucccucgaguucagcaccaaccacgggcgcuccuggagccugcugcacacggagugccugcccgagaucugcgcgggcccccaccucccccacuccaccguguacagcuccgagaacuacagcggcuggaaccggaucaccaucccgcugcccaacgccgcccugacccgcaacacgcggauccgcuggcgccagaccgggcccauccucggcaacaugugggccaucgacaacgucuacaucgggccguccugccugaaguucugcagcggccgggggcagugcacccgccacggcugcaagugcgaccccggcuucagcgggcccgccugcgagauggcgucccagaccuuccccauguucaucagcgaguccuucggcagcucccggcugagcuccuaccacaacuucuacagcauccgcggggccgagguguccuucggcugcggggugcucgccagcggcaaggcccuggucuucaacaaggacggccggcgccagcugaucacguccuuccucgacagcucccagagccgguuccugcaguucacccugcgccucggguccaagagcgugcugagcacgugccgggccccggaccagcccggcgagggggugcugcuccacuacagcuacgacaacggcaucaccuggaagcugcuggagcacuacuccuaccucagcuaccacgagccccgcaucaucagcgucgagcugcccggggacgcgaagcaguucggcauccaguuccggugguggcagccguaccacuccagccagcgcgaggacgugugggccaucgacgagaucaucaugaccuccgugcuguucaacagcaucucccucgacuucaccaaccuggucgaggugacccagagccugggcuucuaccucgggaacgugcagcccuacugcggccacgacuggacccugugcuucacgggggacuccaagcuggccagcuccaugcgguacgucgagacccagagcaugcagaucggcgccuccuacaugauccaguucagccucgugaugggcugcgggcagaaguacacgccccacauggacaaccaggugaagcuggaguacuccaccaaccacggccugacguggcaccucguccaggaggagugccugcccagcaugccguccugccaggaguucaccagcgccuccaucuaccacgcgagcgaguucacccaguggcgccgggugaucgugcugcucccccagaagaccugguccagcgccacgcgcuuccgguggagccaguccuacuacaccgcccaggacgagugggcccuggacagcaucuacaucgggcagcagugccccaacaugugcuccggccacgggagcugcgaccacggcaucugccgcugcgaccagggcuaccaggggaccgagugccaccccgaggcggcccugccguccaccaucaugagcgacuucgagaaccagaacggcugggaguccgacuggcaggaggucaucgggggcgagaucgugaagcccgagcaggggugcggcgugaucagcuccggcagcucccucuacuucagcaaggccgggaagcggcagcuggucuccugggaccuggacacgagcuggguggacuucgugcaguucuacauccagaucggcggggaguccgccagcugcaacaagcccgacucccgcgaggagggcguccuccugcaguacagcaacaacgggggcauccaguggcaccuccuggccgagauguacuucuccgacuucagcaagccccgcuucguguaccuggagcugccggcggccgccaagacccccugcacccgguuccgcugguggcagcccguguucagcggcgaggacuacgaccagugggccgucgacgacaucaucauccucuccgagaagcagaagcagaucauccccgugaucaacccgacccugccccagaacuucuacgagaagcccgccuucgacuacccgaugaaccagaugagcguguggcugaugcucgcgaacgaggggauggucaagaacgagacguucugcgccgccacccccuccgccaugaucuucggcaagagcgacggggaccgguucgccgugacccgcgaccugacccugaagcccggcuacgugcuccaguucaagcugaacaucggcugcgcgaaccaguucuccagcacggcccccguccugcuccaguacucccacgacgccgggaugagcugguuccuggugaaggagggcugcuacccggccuccgcggggaagggcugcgaggggaacagccgggagcuguccgagcccaccauguaccacaccggcgacuucgaggaguggacccgcaucaccaucgugaucccccggagccucgccuccagcaagacgcgcuuccgguggauccaggaguccagcucccagaagaacgugccgcccuucggccuggacgggguguacaucagcgagcccugccccuccuacugcagcggccacggggacugcaucagcggcgugugcuucugcgaccugggguacaccgccgcccaggggaccugcgucuccaacgugcccaaccacaacgagauguucgaccgcuucgagggcaagcucagcccccugugguacaagaucaccggcgcccaggucggcacggggugcggcacccugaacgacgggaagucccucuacuucaacggccccggcaagcgggaggcgcgcaccgugccccuggacacccggaacauccgccuggugcaguucuacauccagaucgggagcaagacguccggcaucacgugcaucaagccccggacccgcaacgaggggcucaucguccaguacagcaacgacaacggcauccuguggcaccuccugcgggagcuggacuucauguccuuccuggagccgcagaucaucagcaucgaccucccccaggacgccaagacccccgccacggccuuccgcugguggcagccccagcacgggaagcacuccgcccagugggcgcuggacgacgugcugaucggcaugaacgacagcucccagaccggcuuccaggacaaguucgacgggagcaucgaccuccaggccaacugguaccggauccagggcgggcaggucgacaucgacugccuguccauggacaccgcccugaucuucaccgagaacaucggcaagccgcgcuacgccgagacgugggacuuccacgucagcgccuccaccuuccuccaguucgagaugagcaugggcugcuccaagcccuucagcaacucccacagcgugcagcugcaguacagccugaacaacgggaaggacuggcaccucgugaccgaggagugcgugccgcccaccaucggcugccugcacuacacggaguccagcaucuacaccuccgagcgguuccagaacuggaagcgcaucaccguguaccugccgcucagcaccaucagcccccgcacgcgguuccgcuggauccaggcgaacuacaccgugggggccgacagcugggccaucgacaacgucgugcuggccuccggcugccccuggaugugcagcgggcggggcaucugcgacgccggccgcugcgugugcgaccggggguucggcgggcccuacugcgucccgguggugccccugcccuccauccucaaggacgacuucaacggcaaccugcacccggaccuguggcccgaggucuacggggcggagcgcggcaaccucaacggcgagaccaucaagagcgggaccucccugaucuucaagggcgaggggcugcggaugcucaucagccgcgaccuggacugcacgaacaccauguacgugcaguucucccugcgguucaucgccaagagcacccccgagcgcucccacagcauccugcuccaguucuccaucagcggcgggaucaccuggcaccugauggacgaguucuacuucccccagacgaccaacauccuguucaucaacgugccgcuccccuacaccgcccagaccaacgccacgcgguuccgccuguggcagcccuacaacaacggcaagaaggaggagaucuggaucgucgacgacuucaucaucgacggcaacaacgugaacaaccccgugaugcugcucgacaccuucgacuucgggccgcgggaggacaacugguucuucuaccccggcgggaacaucggccuguacugccccuacagcuccaagggggcgcccgaggaggacagcgccauggucuucguguccaacgaggugggcgagcacagcaucaccacccgcgaccugaacgucaacgagaacaccaucauccaguucgagaucaacgugggcugcuccacggacagcuccagcgccgacccggugcggcucgaguucucccgcgacuucggggccaccuggcaccuccugcucccccugugcuaccacagcuccagccacgucuccagccugugcuccaccgagcaccaccccagcuccaccuacuacgccggcacgaugcagggguggcggcgcgagguggugcacuucggcaagcuccaccugugcggcagcguccgguuccgcugguaccagggguucuaccccgcgggcucccagccggugaccugggccaucgacaacguguacaucgggccccagugcgaggagaugugcaacggccaggggagcugcaucaacggcaccaagugcaucugcgaccccggcuacagcgggccgaccugcaagaucuccacgaagaacccggacuuccugaaggacgacuucgagggccagcucgagagcgaccgcuuccugcugauguccgggggcaagcccagccggaagugcgggauccucuccagcggcaacaaccuguucuucaacgaggacggccugcgcaugcucaugacccgggaccuggaccugucccacgcccgcuucguccaguucuucaugcggcucgggugcggcaagggggugcccgacccccgcagccagccggugcugcugcaguacucccucaacggcgggcugagcuggucccugcuccaggaguuccuguucagcaacuccagcaacgucggccgguacaucgcccuggagaucccccucaaggcccgcuccggcagcacccggcugcgcugguggcagcccuccgagaacgggcacuucuacagccccugggugaucgaccagauccugaucggcgggaacaucuccggcaacaccgugcucgaggacgacuucacgacccuggacagccggaaguggcugcuccacccgggcgggaccaagaugcccgucugcggcagcaccggggacgcgcugguguucaucgagaaggccuccacgcgcuacguggucagcaccgacguggccgugaacgaggacuccuuccugcagaucgacuucgccgccagcugcuccgucaccgacagcugcuacgcgaucgagcucgaguacuccguggaccugggccugagcuggcacccccucgugcgggacugccugccgaccaacgucgagugcucccgcuaccaccuccagcggauccucgugagcgacacguucaacaaguggacccgcaucacccugccccugccgcccuacacccggucccaggccacgcgcuuccgguggcaccagccggcccccuucgacaagcagcagaccugggccaucgacaacgucuacaucggggacggcugcaucgacaugugcagcggccacgggcgcugcauccagggcaacugcgugugcgacgagcaguggggcgggcucuacugcgacgaccccgagaccucccugcccacccagcugaaggacaacuucaaccgggcgccgagcucccagaacuggcucacggugaacgggggcaagcugagcaccgucugcggcgccguggccuccgggauggcccugcacuucagcggcgggugcucccgccuccuggugaccgucgaccugaaccucaccaacgccgaguucauccaguucuacuucauguacggcugccugaucacgcccaacaaccgcaaccagggggugcugcucgaguacagcgugaacggcggcaucaccuggaaccugcugauggagaucuucuacgaccaguacagcaagcccggguucgucaacauccuccugcccccggacgcgaaggagaucgccacccgguuccgcugguggcagccccggcacgacggccuggaccagaacgacugggccaucgacaacgugcucaucuccgggagcgccgaccagcgcaccgugaugcuggacacguucuccagcgcccccgucccccagcacgagcgguccccggcggacgccggccccguggggcgcaucgccuucgacauguucauggaggacaagaccagcgugaacgagcacuggcuguuccacgacgacugcaccgucgagcgguucugcgacucccccgacggcgugaugcucugcggcagccacgacgggcgcgagguguacgccgucacccacgaccugacgcccaccgagggcuggaucaugcaguucaagaucuccguggggugcaaggugagcgagaagaucgcccagaaccagauccacguccaguacuccaccgacuucggcgugagcuggaacuaccuggugccgcagugccuccccgcggaccccaagugcuccggcagcgucucccagcccagcguguucuucccgaccaagggguggaagcggaucaccuacccccugcccgagucccuggugggcaacccgguccgcuuccgguucuaccagaaguacagcgacaugcagugggccaucgacaacuucuaccucgggcccggcugccuggacaacugccgcgggcacggcgacugccugcgggagcagugcaucugcgaccccggcuacuccgggcccaacugcuaccucacgcacacccugaagaccuuccugaaggagcgcuucgacagcgaggagaucaagccggaccucuggaugagccuggagggcgggagcacgugcaccgagugcggcauccuggccgaggacaccgcccucuacuucgggggcagcaccgugcggcaggcggugacccaggaccuggaccugcgcggcgccaaguuccuccaguacugggggcggaucggcuccgagaacaacaugacgagcugccaccgccccaucugccggaaggaggggguccugcuggacuacuccaccgacggcgggaucaccuggacccuccugcacgagauggacuaccagaaguacaucagcgugcgccacgacuacauccugcuccccgaggacgcccugacgaacaccacccgccugcggugguggcagcccuucgugaucuccaacggcaucgucgugagcggcguggagcgcgcccagugggcccuggacaacauccucaucgggggcgcggagaucaacccgucccagcuggucgacaccuucgacgacgaggggacgagccacgaggagaacugguccuucuaccccaacgccgugcggaccgccggcuucugcggcaaccccagcuuccaccuguacuggcccaacaagaagaaggacaagacccacaacgcccucuccagccgcgagcugaucauccagccgggguacaugaugcaguucaagaucguggucggcugcgaggccaccuccugcggggaccugcacagcgugaugcucgaguacacgaaggacgcgcgguccgacagcuggcagcuggugcagacccagugccugcccuccagcagcaacuccaucggcugcagccccuuccaguuccacgaggccaccaucuacaacuccgucaacagcuccagcuggaagcgcaucaccauccagcuccccgaccacguguccagcuccgccacgcaguuccgguggauccagaagggggaggagaccgagaagcagagcugggccaucgaccacguguacaucggcgaggccugcccgaagcugugcuccggccacggguacugcaccaccggcgcgaucugcaucugcgacgagagcuuccagggggacgacugcuccgucuucagccacgaccugcccuccuacaucaaggacaacuucgagagcgcccgcgugacggaggccaacugggagaccauccagggcggggugaucggcuccggcugcgggcagcucgcccccuacgcccacggcgacagccuguacuucaacgggugccagauccggcaggcggccaccaagccccuggaccucacccgcgccagcaagaucauguucguccugcagaucggcuccaugagccagacggacuccugcaacagcgaccuguccgggccgcacgccguggacaaggcggugcuccugcaguacagcgucaacaacggcaucaccuggcacgugaucgcccagcaccagcccaaggacuucacccaggcccagcgggucuccuacaacgugccccuggaggcccgcaugaagggcgugcuccugcggugguggcagccccgccacaacgggaccggccacgaccagugggcccuggaccacgucgagguggugcucgucagcacgcggaagcagaacuacaugaugaacuucucccgccagcacgggcugcggcacuucuacaaccgccggcgccggagccugcgccgcuacccguga

SEQ ID NO: 35608 - RNA, 897 nt, Artificial Sequence
  derived and/or modified sequence opt1 from REM1__Homo_sapiens__NP_054731
augacccugaacaccgagcaggaggccaagacgccccuccaccgccgggccagcaccccgcugccccugagcccccgcggccaccagcccgggcggcucuccaccgugccguccacccagagccagcacccccgccugggccaguccgcgagccugaacccgcccacgcagaagcccucccccgcccccgacgacuggagcuccgagagcuccgacagcgagggguccugggaggcccucuaccgggucgugcugcugggcgaccccggggugggcaagaccagccucgccucccuguucgccggcaagcaggagcgcgaccugcacgagcagcucggggaggacgucuacgagcggacccugaccguggacggcgaggacacgacccugguggucguggacaccugggaggcggagaagcucgacaagagcuggucccaggagagcugccugcagggcggguccgccuacgugaucgucuacagcaucgccgaccgcgggagcuucgaguccgccagcgagcugcggauccagcuccgccggacccaccaggcggaccacgugccgaucauccuggugggcaacaaggccgaccuggcccgcugccgggaggucuccguggaggagggccgcgccugcgccguggucuucgacugcaaguucaucgagacgagcgcgacccuccagcacaacguggccgagcuguucgagggggugguccggcagcugcgccuccggcgccgggacuccgccgccaaggagccgcccgcgccccgccggcccgccagccuggcccagcgcgcccgccgguuccuggcccgccucaccgcccgguccgcgcgccggcgcgcccugaaggcccggagcaaguccugccacaaccuggccgugcucuga

SEQ ID NO: 35609 - RNA, 1284 nt, Artificial Sequence
  derived and/or modified sequence opt1 from RENBP__Homo_sapiens__NP_002901
augagcaagggccugcccgcccggcaggacauggagaaggagcgggagacccuccaggccuggaaggagcgcguggggcaggagcuggaccgggucguggcguucuggauggagcacucccacgaccaggagcacggcggguucuucacgugccugggccgcgaggggcggguguacgacgaccucaaguacgucuggcugcagggccgccagguguggauguacugccggcuguaccgcaccuucgagcgguuccgccacgcccagcuccuggacgccgccaaggccggcggggaguuccugcuccgguacgcgcgcguggccccgcccggcaagaagugcgccuucguccugacccgggacgggcgccccgugaaggugcagcggaccaucuucagcgagugcuucuacaccauggccaugaacgagcuguggcgcgcgacgggcgagguccgguaccagaccgaggccguggagaugauggaccagaucgugcacuggguccaggaggacgccuccgggcucggccgcccccagcugcagggcgccccggccgcggagcccauggccgugcccaugaugcugcucaaccugguggagcagcugggggaggccgacgaggagcucgccggcaaguacgccgagcugggggacuggugcgcgcggcgcauccugcagcacguccagcgggacggccaggccgugcucgagaacgugagcgagggcgggaaggagcugcccggcugccuggggcgccagcagaacccgggccacacccucgaggccgggugguuccugcugcgccacugcauccggaagggcgaccccgagcuccgcgcccacgucaucgacaaguuccugcugcuccccuuccacuccggcugggaccccgaccacgggggccuguucuacuuccaggacgccgacaacuucugcccgacccagcuggagugggcgaugaagcucugguggccccacagcgaggccaugaucgccuuccugaugggguacuccgacagcggcgaccccgugcugcuccggcuguucuaccagguggccgaguacacguuccgccaguuccgggaccccgaguacggggagugguucggcuaccugucccgcgagggcaaggucgcccucagcaucaagggcgggccguucaaggggugcuuccacgugccccggugccuggcgaugugcgaggagaugcugggcgcccuccugucccgccccgcccccgccccgagccccgcgcccacccccgccugccgcggggccgaguga

SEQ ID NO: 35610 - RNA, 1221 nt, Artificial Sequence
  derived and/or modified sequence opt1 from REN__Homo_sapiens__NP_000528
auggacggcuggcgccggaugccccgcugggggcugcuccugcugcucuggggcagcugcaccuucgggcugcccaccgacacgaccaccuucaagcggaucuuccugaagcgcaugcccuccauccgggagagccucaaggagcgcggcguggacauggcccggcuggggcccgaguggucccagcccaugaagcgccugacccucggcaacacgaccagcuccgucauccugaccaacuacauggacacccaguacuacggcgagaucgggaucggcacgccgccccagaccuucaaggugguguucgacaccgggagcuccaacgucugggugcccagcuccaagugcagccggcuguacaccgccugcguguaccacaagcuguucgacgcguccgacagcuccagcuacaagcacaacggcacggagcugacccugcgcuacuccaccgggaccgucagcggcuuccucucccaggacaucaucacggugggcgggaucaccgugacccagauguucggcgaggucaccgagaugcccgcccugccguucaugcuggccgaguucgacgggguggugggcaugggcuucaucgagcaggccaucgggcgggucacgcccaucuucgacaacaucaucagccagggcgugcucaaggaggacguguucuccuucuacuacaaccgcgacagcgagaacagccagucccucgggggccagaucguccucgggggcagcgacccccagcacuacgagggcaacuuccacuacaucaaccugaucaagaccgggguguggcagauccagaugaagggcguguccgucgggagcuccacccugcugugcgaggacggcugccucgcccugguggacaccggggcgagcuacaucuccggcagcacguccagcaucgagaagcugauggaggcccucggcgccaagaagcggcuguucgacuacguggucaagugcaacgaggggcccacccugccggacaucuccuuccaccucggcgggaaggaguacacccugaccagcgccgacuacguguuccaggaguccuacagcuccaagaagcugugcacgcucgcgauccacgccauggacaucccgccgcccaccggccccaccugggcccugggggccaccuucauccgcaaguucuacacggaguucgaccggcgcaacaaccggaucggcuucgcccuggcgcgcuga

SEQ ID NO: 35611 - RNA, 2310 nt, Artificial Sequence
  derived and/or modified sequence opt1 from REPS1__Homo_sapiens__NP_001122089
auggagggccugacccucagcgacgccgagcagaaguacuacuccgaccuguucagcuacugcgacaucgaguccaccaagaagguggucgugaacgggcgcgugcuggagcuguuccgggccgcgcagcugcccaacgacgucgugcugcagaucauggagcucugcggcgccacgcgccugggguacuucggccggagccaguucuacaucgcccugaagcucguggccgucgcccaguccggguucccgcugcgcguggagagcaucaacaccgugaaggaccugccccucccccgguucgucgcguccaagaacgagcaggagagccgccacgccgccuccuacagcuccgacagcgagaaccagggcuccuacagcggcgugaucccgcccccgcccgggcggggccaggugaagaagggguccgucagccacgacaccgugcagccccgcaccuccgccgacgcgcaggagcccgccagccccguggucagcccccagcaguccccgcccacgagcccccacaccuggcggaagcacucccgccaccccagcggcgggaacuccgagcggccccuggccggcccgggccccuucuggagccccuucggggaggcccaguccggcagcuccgccggggacgcgguguggagcggccacagcccgcccccgccccaggagaacuggguguccuucgccgacacgccgcccaccuccacccugcucaccaugcaccccgccagcguccaggaccagaccaccgugcgcacgguggccuccgccaccaccgcgaucgagauccggcgccagagcuccagcuacgacgaccccuggaagaucaccgacgagcagcggcaguacuacgucaaccaguucaagacgauccagcccgaccucaacggcuucauccccggguccgccgccaaggaguucuucaccaagagcaagcugcccauccucgagcugucccacaucugggagcugagcgacuucgacaaggacggcgcccucacccuggacgaguucugcgccgcguuccaccuggugguggcccgcaagaacggguacgaccuccccgagaagcugccggagagccugaugcccaagcucaucgaccuggaggacuccgccgacgucggcgaccagcccggggaggugggcuacagcggcucccccgccgaggccccgcccagcaagucccccagcaugcccucccugaaccagaccuggccggagcucaaccagagcuccgaggacacggcgaucguccaccccgugcccauccggaugacccccagcaagauccacaugcaggagauggagcugaagcgcaccggguccgaccacaccaacccgacgagcccccugcucgugaagcccuccgaccugcuggaggagaacaagaucaacagcuccgucaaguucgccagcggcaacaccguggccgacggguacuccagcagcgacuccuucaccagcgaccccgagcagaucggcuccaacgugacccggcagcgcagccacuccgggacgagcccggacaacaccgccccgccgccgcccccgccccggccccagcccucccacagccgcuccagcucccucgacaugaaccgcaccuucaccgucacgaccggccagcagcaggcgggcgugguggcccacccgcccgccgucccgccccggccccagcccagccaggcccccgggcccgccgugcaccgccccguggacgcggacggccugaucacccacaccuccacgagcccccagcagauccccgagcagcccaacuucgccgacuucucccaguucgaggucuucgccgccagcaacgugaacgacgagcaggacgacgaggccgagaagcaccccgaggugcugcccgcggagaaggccuccgaccccgccagcucccuccgggucgccaagaccgacagcaagaccgaggagaagaccgccgcgagcgcccccgccaacguguccaaggggaccacgccccuggcgcccccgcccaagcccgugcgccggcgccugaaguccgaggacgagcuccggcccgaggucgacgagcacacccagaagaccggcgugcuggccgccgugcuggccagccagccgagcaucccccgcuccgucgggaaggacaagaaggccauccaggccagcauccggcgcaacaaggagaccaacacggugcucgcgcggcugaacuccgagcugcagcagcagcucaaggacgugcuggaggagcgcaucagccuggagguccagcuggagcagcuccggcccuucucccaccuguga

SEQ ID NO: 35612 - RNA, 1980 nt, Artificial Sequence
  derived and/or modified sequence opt1 from REPS2__Homo_sapiens__NP_001074444
auggaggccgccgcggccgccgccgccgcggccgccgccgcggccgccgccggcgggggcugcgggagcgggcccccgccccugcuccuguccgagggcgagcagcagugcuacagcgagcuguucgcccgcugcgcgggcgccgccggcgggggccccggguccgggcccccggaggccgcccggguggcgcccggcaccgccaccgccgccgccggccccgucgcggaccucuuccgcgccagccagcugcccgccgagacgcugcaccagaucaccgagcucugcggcgccaagcgggugggguacuucggcccgacccaguucuacaucgcccugaagcugaucgcggccgcccaguccgggcuccccgugcgcaucgagagcaucaagugcgagcugccccugccccgguucaugauguccaagaacgacggcgagauccgcuucggcaacccggccgagcuccacgggaccaagguccagauccccuaccugacgaccgagaagaacagcuucaagcggauggacgacgaggacaagcaggagacccagucccccaccaugagcccccuggcguccccgcccagcuccccgccccacuaccagcgcgugccccucagccacggcuacuccaagcugcggagcuccgccgagcagaugcaccccgcccccuacgaggcccgccagccccuggugcagccggaggggagcuccagcggcgggcccggcacgaagccccuccggcaccaggccagccugauccgcuccuucagcgucgagcgggagcugcaggacaacuccagcuaccccgacgagccguggcgcaucaccgaggagcagcgggaguacuacgugaaccaguuccgcucccuccagcccgaccccagcuccuucaucagcggcuccguggcgaagaacuucuucaccaagagcaagcuguccaucccggagcugagcuacaucugggagcucuccgacgccgacugcgacggggcccugacccugcccgaguucugcgccgccuuccaccucaucgucgcgcggaagaacggcuacccccugcccgaggggcugccgcccacgcuccagcccgaguaccugcaggccgccuuccccaagccgaagugggacugccagcuguucgacagcuacuccgagagccuccccgccaaccagcagccccgcgaccugaaccggauggagaagaccuccgugaaggacauggccgaccugcccgugccgaaccaggacgucaccagcgacgacaagcaggcgcucaaguccaccaucaacgaggcccugcccaaggacgugagcgaggaccccgccacgcccaaggacagcaacucccugaaggcccgcccgcggagccgcuccuacagcuccaccagcaucgaggaggcgaugaagcgcggcgaggacccgcccacgccgccgccccggccccagaagacccacucccgcgccagcucccucgaccugaacaagguguuccagcccagcguccccgccaccaaguccgggcugcugcccccgccgcccgcccucccgccccggcccugccccagccaguccgagcaggucagcgaggccgagcugcucccccagcugucccgcgcgcccagccaggccgccgaguccagccccgccaagaaggacgugcuguacagccagccgcccuccaagcccauccggcgcaaguuccggcccgagaaccaggccaccgagaaccaggagcccagcaccgcggccuccggccccgccagcgccgccaccaugaagccccaccccacggugcagaagcaguccagcaagcagaagaaggcgauccagaccgccauccgcaagaacaaggaggccaacgccgugcucgcgcggcugaacuccgagcugcagcagcagcugaaggaggugcaccaggagcgcaucgcccucgagaaccagcuggagcagcugcggcccgucaccgugcucuga

SEQ ID NO: 35613 - RNA, 543 nt, Artificial Sequence
  derived and/or modified sequence opt1 from RERG__Homo_sapiens__NP_001177655
auggccaagagcgccgaggugaagcuggcgaucuucggccgcgccggggucggcaaguccgagagcaccuaccggcaccaggccaccaucgacgacgaggugguguccauggagauccucgacacggccgggcaggaggacaccauccagcgcgagggccacaugcgguggggcgagggguucguccugguguacgacaucaccgaccgcggcagcuucgaggaggugcugccccucaagaacauccuggacgagaucaagaagccgaagaacgucacccugauccucguggggaacaaggccgaccuggaccacucccgccaggugagcacggaggagggcgagaagcuggcgaccgagcucgccugcgccuucuacgagugcuccgccugcaccggggagggcaacaucaccgagaucuucuacgagcugugccgggagguccggcgccggcgcauggugcaggggaagacgcggcgccggagcuccaccacccacgugaagcaggcgaucaacaagaugcugaccaagaucagcuccuga

SEQ ID NO: 35614 - RNA, 618 nt, Artificial Sequence
  derived and/or modified sequence opt1 from RERGL__Homo_sapiens__NP_079006
augagcaacuuccugcaccucaaguacaacgagaaguccgugagcgucaccaaggcccugaccgugcgcuuccugacgaagcgguucaucggcgaguacgccuccaacuucgagagcaucuacaagaagcaccucugccuggagcgcaagcagcugaaccucgagaucuacgaccccugcucccagacccagaaggcgaaguucagccugaccuccgagcugcacugggccgacggguucgugaucgucuacgacaucagcgaccgguccagcuucgccuucgccaaggcccucaucuaccgcauccgggagccgcagaccucccacugcaagcgcgcgguggagagcgccguguuccuggucggcaacaagcgggaccugugccacgugcgcgagguggggugggaggagggccagaagcucgcccuggagaaccggugccaguucugcgagcuguccgccgcggagcagagccucgaggucgagaugauguucauccgcaucaucaaggacauccugaucaacuucaagcugaaggagaagcggcgccccuccgggagcaaguccauggccaagcucaucaacaacguguucggcaagcggcgcaagagcguguga

SEQ ID NO: 35615 - RNA, 3294 nt, Artificial Sequence
  derived and/or modified sequence opt1 from REST__Homo_sapiens__NP_001180437
auggccacccaggugaugggccagagcuccgggggcgggggccuguucaccagcuccgggaacaucggcauggcccuccccaacgacauguacgaccugcacgaccugagcaaggcggagcucgccgcgccccagcugaucaugcuggccaacgucgcccucacgggcgaggugaacggguccugcugcgacuaccuggugggcgaggagcgccagauggccgagcugaugcccgucggggacaacaacuucagcgacuccgaggagggcgaggggcucgaggagagcgccgacaucaagggcgagccccacggccuggagaacauggagcugcggucccucgagcugagcgugguggagccccagcccgucuucgaggccuccggggcccccgacaucuacagcuccaacaaggaccugccgcccgagacccccggcgcggaggacaagggcaagagcuccaagaccaagcccuuccgcugcaagcccugccaguacgaggccgagagcgaggagcaguucgugcaccacauccgggugcacuccgccaagaaguucuucgucgaggagagcgccgagaagcaggccaaggcgcgcgaguccggcagcagcaccgccgaggagggcgacuucuccaaggggcccauccggugcgaccgcugcggcuacaacacgaaccgguacgaccacuacaccgcccaccucaagcaccacacccgcgccggggacaacgagcggguguacaagugcaucaucugcaccuacacgaccgugagcgaguaccacuggcgcaagcaccuccggaaccacuucccgcgcaaggucuacacgugcggcaagugcaacuacuucuccgaccggaagaacaacuacgugcagcacgugcgcacccacacgggggagcggcccuacaagugcgagcugugccccuacagcuccagccagaagacccaccucacccgccacaugcggacccacuccggcgagaagcccuucaagugcgaccagugcagcuacgucgccuccaaccagcacgaggugacgcgccacgcgcgccaggugcacaacggcccgaagccccugaacugcccccacugcgacuacaagaccgccgaccggagcaacuucaagaagcacgucgagcugcacgugaacccccggcaguucaacugcccggugugcgacuacgccgccuccaagaagugcaaccugcaguaccacuucaagagcaagcacccgaccugccccaacaagaccauggacgucuccaaggugaagcugaagaagaccaagaagcgcgaggccgaccugcccgacaacaucaccaacgagaagaccgagaucgagcagaccaagaucaagggggacguggcggggaagaagaacgagaaguccgucaaggccgagaagcgcgacgugagcaaggagaagaagcccagcaacaacgucuccgugauccaggugacgacccggacccgcaagagcgucaccgaggugaaggagauggacgugcacacgggguccaacagcgagaaguucagcaagaccaagaaguccaagcggaagcucgaggucgacagccacucccugcacggccccgugaacgacgaggagagcuccaccaagaagaagaagaagguggagagcaaguccaagaacaacagccaggagguccccaagggggacuccaagguggaggagaacaagaagcagaacacgugcaugaagaaguccaccaagaagaagacccugaagaacaagagcagcaagaaguccagcaagcccccgcagaaggagcccguggagaagggcuccgcccagauggacccgccccagaugggccccgcccccaccgaggccguccagaaggggcccguccagguggagccgcccccgcccauggagcacgcgcagauggagggcgcccagauccgccccgcccccgacgagcccgugcagauggagguggugcaggaggggcccgcccagaaggagcuccugccgcccgucgagcccgcgcagauggugggcgcccagaucgugcuggcccacauggagcugcccccgcccauggagaccgcccagacggaggucgcccagauggggcccgcgcccauggagccggcccagauggagguggcccagguggagagcgcccccaugcaggucgugcagaaggagcccgugcagauggagcucagcccgcccauggaggucgugcagaaggagcccgugcagaucgagcugagcccgcccauggaggucgugcagaaggagcccgugaagaucgagcucagcccgcccaucgaggucgugcagaaggagcccgugcagauggagcuguccccgcccaugggcgucgugcagaaggagcccgcccagcgggagcccccgccgccccgcgagccgccccugcacauggagcccaucagcaagaagccgccccuccggaaggacaagaaggagaaguccaacaugcagagcgagcgcgcgcggaaggagcagguccugaucgaggugggccuggugcccgugaaggacuccuggcuccugaaggagagcgucuccaccgaggaccuguccccgcccagcccgccccuccccaaggagaaccugcgcgaggaggccagcggggaccagaagcugcucaacaccggcgaggggaacaaggaggcgccccugcagaaggugggcgccgaggaggccgacgagucccugcccggccucgccgccaacaucaacgagagcacccacaucuccagcuccgggcagaaccugaacacccccgagggcgagacgcugaacgggaagcaccagaccgacagcaucgugugcgagaugaagauggacaccgaccagaacacccgggagaaccugacgggcaucaacuccaccgucgaggagcccgugagccccaugcucccgcccuccgccguggaggagcgcgaggccgucagcaagaccgcgcuggccuccccgcccgccaccauggccgccaacgagucccaggagaucgacgaggacgaggggauccacagccacgagggcuccgaccugagcgacaacauguccgagggcagcgacgacuccgggcuccacggcgcgcggcccgugccccaggagagcucccgcaagaacgccaaggaggcccuggccgugaaggccgcgaagggggacuucgucugcaucuucugcgaccggagcuuccgcaagggcaaggacuacuccaagcaccugaaccggcaccucgugaacgucuacuaccuggaggaggccgcccaggggcaggaguga

SEQ ID NO: 35616 - RNA, 3219 nt, Artificial Sequence
  derived and/or modified sequence opt1 from RET__Homo_sapiens__NP_065681
auggccaaggccaccagcggcgcggccgggcugcgccuccugcugcuccugcugcucccccugcugggcaagguggcccucgggcuguacuucucccgggacgccuacugggagaagcuguacgucgaccaggccgcgggcaccccgcuccuguacgugcacgcccugcgcgacgcccccgaggaggugcccagcuuccggcucgggcagcaccuguacggcacguaccgcacccggcugcacgagaacaacuggaucugcauccaggaggacaccggccuccuguaccugaaccgcucccucgaccacagcuccugggagaagcugagcguccggaaccgcggguucccccugcucaccguguaccugaagguguuccuguccccgacgagccuccgggagggcgagugccaguggcccgggugcgcccgcgucuacuucuccuucuucaacaccagcuuccccgcgugcuccagccugaagccccgggagcugugcuucccggagacccgccccuccuuccggauccgcgagaaccggccgcccggcaccuuccaccaguuccgccuccugcccgugcaguuccugugccccaacaucagcguggccuaccggcuccuggagggggagggccugcccuuccgcugcgcccccgacucccucgaggucagcacgcggugggcccuggaccgcgagcagcgggagaaguacgagcugguggccgugugcaccguccacgcgggcgcccgcgaggagguggugauggucccguuccccgugaccguguacgacgaggacgacuccgcccccaccuuccccgccggggucgacacggccagcgcggugguggaguucaagcgcaaggaggacaccgucguggccacccuccggguguucgacgccgacgucgugccggccuccggcgagcugguccgccgguacaccagcacgcugcuccccggggacaccugggcccagcagaccuuccgcguggagcacuggcccaacgagaccagcgugcaggcgaacggcuccuucguccgggccacggugcacgacuaccgccuggugcugaaccggaaccucagcaucuccgagaaccgcaccaugcagcuggccguccuggugaacgacagcgacuuccagggccccggggccggcgugcuccugcugcacuucaacgucuccgugcugccggugagccuccaccuccccuccaccuacagccuguccgucagccggcgcgcccggcgcuucgcgcagaucgggaaggugugcguggagaacugccaggccuucuccggcaucaacguccaguacaagcugcacagcuccggggccaacugcagcacccugggcguggugacguccgccgaggacaccagcggcauccuguucgucaacgacaccaaggcgcuccggcgccccaagugcgccgagcugcacuacauggugguggccaccgaccagcagacgucccggcaggcccaggcccagcugcucgucaccguggaggggagcuacguggcggaggaggccggcugcccccuguccugcgccgucagcaagcgccggcuggagugcgaggagugcgggggccucgggagcccgaccggccgcugcgaguggcggcagggcgacgggaagggcaucacccgcaacuucuccacgugcagccccuccaccaagaccugccccgacgggcacugcgacgugguggagacccaggacaucaacaucugcccgcaggacugccugcgcggcagcaucgucgggggccacgagcccggcgagccccgggggaucaaggccggcuacgggacgugcaacugcuuccccgaggaggagaagugcuucugcgagccggaggacauccaggacccccugugcgacgagcucugccgcaccgugaucgccgcggccgugcuguucuccuucaucgucagcgugcugcucuccgccuucugcauccacugcuaccacaaguucgcccacaagccgcccaucagcuccgccgagaugaccuuccggcgccccgcgcaggccuuccccgugagcuacuccagcuccggcgcccggcgccccagccuggacuccauggagaaccaggucagcguggacgccuucaagauccuggaggaccccaagugggaguucccgcggaagaaccucgugcugggcaagacccugggggagggcgaguucgggaaggucgugaaggcgaccgccuuccaccucaagggccgcgccggguacacgaccguggccgucaagaugcugaaggagaacgccucccccagcgagcugcgggaccuccugagcgaguucaacgugcugaagcaggucaaccacccccacgugaucaagcucuacggcgcgugcucccaggacggcccccugcugcucaucguggaguacgccaaguacgggagccugcgcggcuuccugcgggagucccgcaagguggggccgggcuaccucgggagcggcggcucccggaacagcuccagccuggaccaccccgacgagcgcgcccugaccaugggggaccucaucuccuucgccuggcagaucagccagggcaugcaguaccuggccgagaugaagcugguccaccgggaccucgcggcccgcaacauccugguggccgaggggcggaagaugaagaucuccgacuucggccugagccgcgacguguacgaggaggacuccuacgucaagcggagccaggggcgcauccccgugaaguggauggccaucgagucccucuucgaccacaucuacaccacgcagagcgacgugugguccuucggcguccugcugugggagaucgugacccucggcgggaaccccuacccgggcaucccgcccgagcggcuguucaaccugcucaagaccgggcaccgcauggagcgccccgacaacugcagcgaggagauguaccggcugaugcugcagugcuggaagcaggagcccgacaagcgccccgucuucgccgacaucuccaaggaccucgagaagaugauggugaagcggcgcgacuaccuggaccuggcggccagcacccccagcgacucccucaucuacgacgacggccugagcgaggaggagacgccgcugguggacugcaacaacgcgccccucccccgggcccugcccuccaccuggaucgagaacaagcuguacgggcgcaucagccacgccuucacccgguucuga

SEQ ID NO: 35617 - RNA, 327 nt, Artificial Sequence
  derived and/or modified sequence opt1 from RETN__Homo_sapiens__NP_001180303
augaaggcccugugccuccugcugcuccccgugcugggccugcucgucagcuccaagacccugugcagcauggaggaggccaucaacgagcgcauccaggagguggcggggucccugaucuuccgggccaucagcuccaucggccucgagugccagagcgugaccucccgcggggaccuggcgaccugcccgcggggcuucgccgucaccgggugcacgugcggcagcgccugcggcuccugggacgugcgcgccgagacgaccugccacugccagugcgccgggauggacuggaccggcgcccggugcugccgcgugcagcccuga

SEQ ID NO: 35618 - RNA, 336 nt, Artificial Sequence
  derived and/or modified sequence opt1 from RETNLB__Homo_sapiens__NP_115968
augggccccagcuccugccugcuccugauccugaucccgcuccugcagcugaucaaccccgggagcacccagugcucccucgacagcgugauggacaagaagaucaaggacguccugaacucccuggaguacagccccucccccaucagcaagaagcucuccugcgccagcgugaagucccagggccgcccgagcuccugccccgccgggauggcggugaccggcugcgccugcggguacggcugcggcagcugggacguccagcuggagacgaccugccacugccagugcuccgugguggacuggaccaccgcccggugcugccaccugacguga

SEQ ID NO: 35619 - RNA, 1833 nt, Artificial Sequence
  derived and/or modified sequence opt1 from RETSAT__Homo_sapiens__NP_060220
auguggcugccccucgugcugcugcucgccguccugcugcucgccgugcugugcaagguguaccugggccucuucagcggguccagcccgaaccccuucuccgaggacgucaagcgcccgcccgcgccccuggugaccgacaaggaggcccggaagaaggugcugaagcaggccuucagcgccaaccagguccccgagaagcucgacgugguggucaucggcuccggguucggcgggcuggccgcggccgccauccuggccaaggcgggcaagcgcgugcucgugcuggagcagcacaccaaggccggcgggugcugccacaccuucggcaagaacgggcuggaguucgacaccggcauccacuacaucgggcggauggaggagggcagcaucggccgcuucauccucgaccagaucaccgaggggcagcuggacugggccccgcuguccagccccuucgacaucaugguccucgagggccccaacgggcggaaggaguaccccauguacuccggcgagaaggccuacauccagggccugaaggagaaguucccccaggaggaggccaucaucgacaaguacaucaagcuggugaagguggucagcuccggggcgccccacgccauccuccugaaguuccugccgcuccccguggugcagcugcuggaccgcugcggccuccugacccgguucagccccuuccugcaggccuccacgcagagccucgccgagguccugcagcagcugggggccuccagcgagcuccaggcggugcuguccuacaucuuccccaccuacggcgugaccccgaaccacagcgccuucuccaugcacgcccugcucgucaaccacuacaugaagggcggguucuacccccgcggcgggagcagcgagaucgccuuccacaccauccccgugauccagcgggccggcggggcggugcugacgaaggccaccguccaguccgugcugcucgacagcgccggcaaggccugcggggucuccgugaagaagggccacgagcuggugaacaucuacugccccaucgucgugagcaacgccggccuguucaacaccuacgagcaccuccugccggggaacgcgcgcugccugcccggcgugaagcagcagcucgggaccguccggcccggccuggggaugacguccguguucaucugccugcgcggcaccaaggaggaccugcaccuccccagcaccaacuacuacguguacuacgacaccgacauggaccaggccauggagcgguacgucuccaugccgcgcgaggaggccgccgagcacaucccccugcuguucuucgcguuccccagcgccaaggaccccacgugggaggaccgguucccgggccgcuccaccaugaucaugcucauccccaccgccuacgagugguucgaggaguggcaggccgagcugaaggggaagcggggcagcgacuacgagaccuucaagaacuccuucguggaggccagcauguccgugguccugaagcuguucccccagcucgaggggaagguggagagcgugacggcgggcuccccgcugaccaaccaguucuaccucgccgcgccccgcggcgccugcuacggggccgaccacgaccugggccggcugcaccccugcgucauggccagccuccgcgcccagucccccaucccgaaccuguaccugaccgggcaggacaucuucacgugcggccucgugggggcccugcagggcgcccugcucugcagcuccgccauccugaagcggaaccuguacagcgaccucaagaaccuggacagccgcauccgcgcgcagaagaagaagaacuga

SEQ ID NO: 35620 - RNA, 3753 nt, Artificial Sequence
  derived and/or modified sequence opt1 from REV1__Homo_sapiens__NP_001032961
augcgccggggcggguggcgcaagcgggccgagaacgacggcugggagaccuggggcggguacauggccgcgaaggugcagaagcuggaggagcaguuccgcagcgacgccgccaugcagaaggacgggaccuccagcacgaucuucuccggcgucgccaucuacgugaacggcuacaccgaccccagcgccgaggagcuccggaagcugaugaugcugcacgggggccaguaccacguguacuacucccgcagcaagaccacccacaucaucgcgacgaaccucccgaacgccaagaucaaggagcugaagggggagaaggucauccggcccgaguggaucguggaguccaucaaggccggccgccugcucagcuacauccccuaccagcuguacaccaagcaguccagcgugcagaaggggcuguccuucaaccccgucugccggccggaggacccccuccccggccccagcaacaucgccaagcagcugaacaaccgcgugaaccacaucgugaagaagaucgagaccgagaacgaggucaaggugaacggcaugaacuccuggaacgaggaggacgagaacaacgacuucagcuucguggaccuggagcagaccuccccggggcggaagcagaacggcaucccccacccccgcgggagcacggcgaucuucaacggccacacccccuccagcaacggcgcccucaagacccaggacugccuggucccgauggugaacuccguggccagccggcugagccccgccuucucccaggaggaggacaaggccgagaaguccuccaccgacuuccgcgacugcacgcuccagcagcugcagcagagcacccggaacaccgacgcgcugcgcaacccccaccggaccaacuccuucagccucagcccccugcacagcaacacgaagaucaacggggcccaccacuccaccguccagggcccgagcuccaccaagagcaccuccagcguguccacguucagcaaggccgcccccuccgugcccagcaagcccuccgacugcaacuucaucagcaacuucuacagccacucccgccugcaccacaucagcauguggaagugcgagcucaccgaguucgucaacacccugcagcggcaguccaacgggaucuucccgggccgcgagaagcugaagaagaugaagaccgggcggagcgcccucguggugacggacaccggcgacauguccguccugaacagcccccgccaccaguccugcaucaugcacguggacauggacugcuucuucgugagcgucggcauccgcaaccggcccgaccugaaggggaagcccguggcggucaccuccaaccgcggcaccgggcgggccccgcuccgccccggcgccaacccccagcuggaguggcaguacuaccagaacaagauccugaaggggaaggccgacauccccgacagcucccucugggagaacccggacagcgcccaggcgaacggcaucgacuccgugcugagccgggccgagaucgccuccugcagcuacgaggcccgccagcugggcaucaagaacgggauguucuucggccacgccaagcagcucugccccaaccugcaggcggugcccuacgacuuccacgccuacaaggaggucgcccagacgcuguacgagacccucgccuccuacacccacaacaucgaggcggugagcugcgacgaggcccugguggacaucaccgagauccuggccgagacgaagcucaccccggacgaguucgccaacgccguccggauggagaucaaggaccagaccaagugcgcggccagcguggggaucggcuccaacauccugcuggcccgcauggccacccggaaggccaagcccgacgggcaguaccaccucaagcccgaggagguggacgacuucauccgcggccagcuggucacgaaccugcccggcguggggcacagcauggaguccaagcucgcgagccugggcaucaagaccugcggggaccugcaguacaugaccauggccaagcuccagaaggaguucggcccgaagaccggccagaugcuguaccgguucugccgcgggcuggacgaccggcccgugcgcaccgagaaggagcggaaguccgucagcgccgagaucaacuacggcauccgcuucacgcagcccaaggaggccgaggccuuccugcucucccugagcgaggagauccagcggcgccuggaggcgaccgggaugaagggcaagcggcucacccugaagaucauggugcgcaagcccggggccccgguggagaccgccaaguucggcggccacgggaucugcgacaacaucgcccgcacggucacccuggaccaggcgaccgacaacgccaagaucaucggcaaggccaugcucaacauguuccacaccaugaagcugaacaucuccgacaugcgcggggugggcauccacgugaaccagcugguccccacgaaccucaaccccagcacgugccccucccggccgagcgugcaguccagccacuuccccuccgggagcuacuccgugcgggacgucuuccaggugcagaaggccaagaaguccaccgaggaggagcacaaggagguguuccgcgccgcggucgaccuggagaucagcagcgccagccggaccugcaccuuccugccgcccuuccccgcccaccuccccaccucccccgacaccaacaaggccgagagcuccggcaaguggaacggccugcacacccccgugagcgugcagucccgccugaaccucagcaucgaggucccgucccccagccagcuggaccaguccgugcuggaggcccucccgcccgaccugcgggagcaggucgagcaggucugcgcggugcagcaggccgagagccacggggacaagaagaaggagcccgugaacggcugcaacacggggauccugccccagcccgugggcaccgugcuccugcagaucccggagccccaggaguccaacagcgacgccgggaucaaccugaucgcccuccccgccuucucccagguggaccccgaggucuucgcggcccugccggccgagcugcagcgcgagcucaaggccgcguacgaccagcggcagcgccagggcgagaacagcacccaccagcaguccgccagcgccuccgugcccaagaacccccugcugcaccucaaggccgccgugaaggagaagaagcggaacaagaagaagaagaccaucggcagccccaagcgcauccaguccccgcugaacaacaagcugcucaacagccccgcgaagacgcugcccggggccugcggcagcccccagaagcugaucgacggguuccucaagcacgagggcccgcccgccgagaagccccuggaggagcuguccgccagcaccuccgggguccccggccucagcucccugcagagcgacccggccggcugcgugcggccgcccgcgcccaaccuggccggggccguggaguucaacgacgucaagacccuccugcgcgaguggaucaccacgaucuccgaccccauggaggaggacauccuccagguggugaaguacugcaccgaccugaucgaggagaaggaccuggagaagcuggaccucgucaucaaguacaugaagcggcugaugcagcagagcguggaguccguguggaacauggccuucgacuucauccuggacaacguccagguggugcuccagcagaccuacggcagcacccugaaggucacguga

SEQ ID NO: 35621 - RNA, 9159 nt, Artificial Sequence
  derived and/or modified sequence opt1 from REV3L__Homo_sapiens__NP_001273361
auggccuucagcaucgaccgcgcccugaacguggcccucgggaaccccagcagcaccgcccagcacgucuucaaggugagccuggugagcgggaugcccuucuacggcuaccacgagaaggagcggcacuucaugaagaucuaccuguacaaccccaccauggucaagcgcaucugcgagcuccugcagagcggggccaucaugaacaaguucuaccagccccacgaggcccacauccccuaccugcuccagcuguucaucgacuacaaccuguacggcaugaaccucaucaaccuggccgcggugaaguuccggaaggcccgccggaaguccaacacccugcacgccaccgggagcugcaagaaccaccucagcggcaacucccuggccgacacccuguuccgcugggagcaggacgagaucccgagcucccucauccuggagggcguggagccccaguccacgugcgagcuggaggucgacgcgguggccgccgacauccucaaccggcuggacaucgaggcccagaucgggggcaaccccgggcugcaggccaucugggaggacgagaagcagcgccggcgcaaccggaacgagaccucccagaugagccagcccgagucccaggaccaccgcuucgugccggcgaccgagagcgagaagaaguuccagaagcggcuccaggagauccugaagcagaacgacuucuccgucacccugagcggcuccguggacuacagcgacgggagccaggaguucuccgccgagcucacccugcacagcgaggugcugucccccgagaugcuccagugcacgcccgccaacauggucgaggugcacaaggacaaggagagcuccaagggccacacccgccacaagguggaggaggcccugaucaacgaggaggccauccugaaccucauggagaacagccagaccuuccagccccugacccagcggcuguccgagagcccggucuucauggacuccagccccgacgaggcgcucgugcaccuccuggccggccucgaguccgacggguaccgcggcgagcggaaccgcaugcccagccccugccgguccuucgggaacaacaaguacccgcagaacagcgacgacgaggagaacgagccccagaucgagaaggaggagauggagcugucccuggugaugagccagcgcugggacuccaacaucgaggagcacugcgccaagaagcggagccucugccgcaacacgcaccgcuccagcaccgaggacgacgacagcuccagcggcgaggagauggagugguccgacaacagccugcugcucgccucccugagcaucccccagcuggacggcaccgccgacgagaacuccgacaacccccucaacaacgagaacagccggacccacuccagcgucaucgcgacguccaagcugagcgugaagccguccaucuuccacaaggacgccgccacccuggagcccagcuccagcgccaagaucaccuuccagugcaagcacaccuccgcccucagcagccacgugcugaacaaggaggaccugaucgaggaccugucccagacgaacaagaacaccgagaaggggcucgacaacagcgucaccuccuucaccaacgagagcacguacuccaugaaguaccccggcagccuguccagcaccgugcacuccgagaacagccacaaggagaacuccaagaaggagauccugcccgugagcuccugcgagagcuccaucuucgacuacgaggaggacaucccgagcgucacccgccaggugcccucccggaaguacaccaacauccgcaagaucgagaaggacagccccuucauccacaugcaccggcaccccaacgagaacacgcucgggaagaacuccuucaacuucagcgaccugaaccacagcaagaacaaggucuccagcgagggcaacgagaaggggaacuccaccgcgcugagcucccucuucccgagcuccuucaccgagaacugcgagcugcugagcugcuccggcgagaaccgcaccauggugcacagccucaacuccacggccgacgagagcggccugaacaagcugaagauccgguacgaggaguuccaggagcacaagaccgagaagcccucccucagccagcaggccgcccacuacauguucuuccccuccgugguccugagcaacugccugacccgcccgcagaagcucucccccgugaccuacaagcugcagcccgggaacaagcccagccggcugaagcucaacaagcgcaagcuggcgggccaccaggagacguccaccaagagcagcgagaccggguccaccaaggacaacuucauccagaacaacccgugcaacagcaaccccgagaaggacaacgcccuggccuccgaccucaccaagacgacccggggcgccuucgagaacaagacccccaccgacggguucaucgacugccacuucggcgacggcacgcuggagaccgagcagagcuucgggcuguacggcaacaaguacacccuccgcgccaagcggaaggugaacuacgagaccgaggacuccgagagcuccuucgucacgcacaacagcaagaucucccugccccacccgauggagaucggggagagccuggacggcacccucaagucccgcaagcggcgcaagaugagcaagaagcugccgcccgugaucaucaaguacaucaucaucaaccgguuccgcgggcggaagaacaugcuggugaagcucggcaagaucgacuccaaggagaagcaggucauccugaccgaggagaagauggagcuguacaagaagcucgcgccccugaaggacuucuggccgaaggugcccgacagccccgccaccaaguaccccaucuacccgcugacgcccaagaagucccaccgccgcaagagcaagcacaaguccgccaagaagaagaccggcaagcagcagcggaccaacaacgagaacaucaagcgcacccucagcuuccggaagaagcgcucccacgccauccugagcccgcccagccccuccuacaacgccgagacggaggacugcgaccugaacuacagcgacgugauguccaagcucggguuccugagcgagcgguccaccagccccaucaacuccuccccgccccgcugcugguccccgaccgacccccgggcggaggagaucauggccgccgccgagaaggaggccaugcuguucaagggccccaacgucuacaagaagaccgugaacagccgcaucgggaagacgucccgggcgcgcgcccagaucaagaaguccaaggccaagcucgccaacccguccaucgugaccaagaagcggaacaagcgcaaccagaccaacaagcuggucgacgacggcaagaagaagccccgggcgaagcagaagaccaacgagaagggcacgagccgcaagcacaccacccugaaggacgagaagaucaagucccagagcggggccgaggugaaguucgugcucaagcaccagaacgucuccgaguucgccagcuccagcggcgggagccagcugcuguucaagcagaaggacaugccccucaugggcuccgccguggaccacccccugagcgccucccugccgaccgggaucaacgcgcagcagaagcucagcggcugcuucuccagcuuccuggaguccaagaaguccguggaccugcagacguuccccuccagccgggacgaccuccaccccuccgucgugugcaacagcaucggccccgggguguccaagaucaacguccagcgcccgcacaaccagagcgccauguucacccugaaggaguccacccugauccagaagaacaucuucgaccucagcaaccaccugucccagguggcccagaacacccagaucagcuccggcaugagcagcaagaucgaggacaacgccaacaacauccagcggaacuaccuguccagcaucgggaagcucuccgaguaccgcaacagccuggaguccaagcuggaccaggccuacacgcccaacuuccuccacugcaaggacagccagcagcagaucgugugcaucgcggagcaguccaagcacagcgagaccugcucccccggcaacaccgccagcgaggagucccagaugcccaacaacugcuucgucaccagccugcgguccccgaucaagcagaucgccugggagcagaagcagcgcggguucauccuggacaugagcaacuucaagcccgagcgggugaagccccgcucccucagcgaggccaucucccagacgaaggcccugagccagugcaagaaccgcaacgugagcacccccuccgcguucggcgagggccagagcgggcuggccguccucaaggagcugcugcagaagcggcagcagaaggcccagaacgccaacaccacccaggacccgcucuccaacaagcaccagcccaacaagaacaucagcggcucccuggagcacaacaaggcgaacaagcgcacccggagcgugacgagcccccgcaagccccggaccccgcgcagcaccaagcagaaggagaagauccccaagcugcucaagguggacucccugaaccugcagaacagcucccagcucgacaacagcgucuccgacgacagccccaucuucuucuccgaccccggguucgagagcugcuacucccuggaggacagccuguccccggagcacaacuacaacuucgacaucaacaccaucggccagacgggguucugcagcuucuacagcggcucccaguucgugcccgccgaccagaaccucccccagaaguuccugagcgacgccgugcaggaccuguuccccggccaggccaucgagaagaacgaguuccucucccacgacaaccagaagugcgacgaggacaagcaccacaccaccgacagcgccuccuggauccggagcgggacccuguccccggagaucuucgagaaguccacgaucgacuccaacgagaaccgccggcacaaccaguggaagaacagcuuccacccccugaccacccgcuccaacagcaucauggacuccuucugcguccagcaggcggaggacugccucagcgagaagucccggcugaaccgcagcuccgugagcaaggagguguuccugucccucccccagccgaacaacagcgacuggauccagggccacacccggaaggagauggggcagagccuggacuccgccaacacgagcuucaccgccauccuguccagccccgacggcgagcucgucgacguggccugcgaggaccuggagcuguacgugucccgcaacaacgacaugcugacccccacccccgacagcuccccgcggagcacguccagccccucccagagcaagaacggguccuucacgccccgcaccgccaacauccucaagccccugaugagcccgcccucccgggaggagaucauggcgacccugcucgaccacgaccugagcgagacgaucuaccaggagcccuucugcuccaaccccagcgacgucccggagaagccccgcgagaucggcggccggcugcucaugguggagacccgccuggccaacgaccuggccgaguucgagggggacuucucccucgagggccugcgccuguggaagaccgccuucagcgccaugacccagaacccccggcccgggagcccgcuccgcuccggccagggcguggucaacaaggggagcuccaacagccccaagaugguggaggacaagaagaucgugaucaugcccugcaagugcgcgcccucccggcagcugguccagguguggcugcaggccaaggaggaguacgagcgcagcaagaagcucccgaagacgaagcccaccggcguggucaaguccgccgagaacuucagcuccagcgugaaccccgacgacaagcccgucgugccgcccaagauggacgugucccccugcauccugcccaccaccgcccacacgaaggaggacgucgacaacagccagaucgcccugcaggcgccgaccaccgggugcucccagaccgccagcgagucccagaugcugccgcccguggccagcgccuccgacccggagaaggacgaggacgacgacgacaacuacuacaucagcuacuccagccccgacagccccgugaucccgcccuggcagcagcccaucucccccgacagcaaggcgcugaacggcgacgaccggcccuccagccccgucgaggagcugcccucccucgccuucgagaacuuccugaagcccaucaaggacgggauccagaagucccccugcuccgagccgcaggagccccuggugaucagccccaucaacacgcgcgcccggaccggcaagugcgagucccucugcuuccacagcacccccaucauccagcgcaagcugcuggagcggcucccggaggcccccggccugagcccccugagcaccgagcccaagacgcagaagcucuccaacaagaaggggagcaacaccgacacccugcgccgggugcugcucacccaggccaagaaccaguucgcggccgucaacaccccgcagaaggagacgucccagaucgacggccccagccugaacaacaccuacggguucaagguguccauccagaaccugcaggaggccaaggcccuccacgagauccagaaccugacccugaucagcguggagcuccacgcccgcacccggcgcgaccuggagcccgaccccgaguucgacccgaucugcgcgcuguucuacugcaucuccagcgacacgccccuccccgacaccgagaagaccgagcugaccggcgucaucgugaucgacaaggacaagacgguguucagccaggacauccgguaccagaccccgcugcucauccgcuccgggaucaccggccuggaggucaccuacgccgccgacgagaaggcccuguuccacgagaucgccaacaucaucaagcgguacgaccccgacauccuccugggcuacgagauccagaugcacagcuggggguaccugcuccagcgcgcggccgcccuguccaucgaccugugccggaugaucagccgcgugcccgacgacaagaucgagaaccgguucgccgcggagcgcgacgaguacggcuccuacacgaugagcgagaucaacaucguggggcgcaucacccucaaccuguggcggaucaugcgcaacgaggucgcccugaccaacuacaccuucgagaacguguccuuccacgugcuccaccagcgguucccccuguucacguuccgcguccugagcgacugguucgacaacaagaccgaccucuaccgguggaagaugguggaccacuacgugucccgcguccggggcaaccugcagaugcuggagcagcucgaccugaucgggaagaccagcgagauggcccgccuguucggcauccaguuccuccacgugcugacccggggcucccaguaccgcguggagagcaugaugcugcggaucgccaagccgaugaacuacauccccgucacgcccuccgugcagcagcgcagccagaugcgggcgccccagugcgugccgcucaucauggagcccgagucccgcuucuacagcaacuccguccuggugcuggacuuccagagccucuaccccagcaucgugaucgcguacaacuacugcuucagcacgugccuggggcacgucgagaaccugggcaaguacgacgaguucaaguucgggugcaccagccuccgggugcccccggaccugcuguaccaggugcgccacgacaucaccgucucccccaacggcguggccuucgugaagcccagcguccggaagggcgugcucccccgcaugcuggaggagauccugaagacccgguucauggugaagcaguccaugaaggccuacaagcaggaccgcgcccucagccgcaugcuggacgcccggcagcuggggcucaagcugaucgcgaacgucaccuucggcuacaccuccgccaacuucagcgggcgcaugccgugcaucgaggugggcgacuccaucgugcacaaggcccgggagacccuggagcgcgccaucaagcucgucaacgacacgaagaaguggggcgcccgggugguguacggcgacaccgacagcauguucguccugcugaagggcgcgaccaaggagcaguccuucaagaucgggcaggagaucgccgaggccgugaccgccacgaaccccaagcccgugaagcucaaguucgagaaggucuaccugcccugcgugcugcagaccaagaagcgcuacgucggcuacauguacgagacccucgaccagaaggacccgguguucgacgcgaaggggaucgagaccgugcggcgcgacagcugccccgccgucuccaagauccuggagcggagccugaagcuccuguucgagacgcgcgacaucucccugaucaagcaguacgugcagcggcagugcaugaagcuccuggagggcaaggccagcauccaggacuucaucuucgccaaggaguaccgcggguccuucagcuacaagcccggcgccugcgugcccgcgcuggagcugacccggaagaugcucaccuacgaccgccgguccgagccgcaggucggcgagcgcgugcccuacgugaucaucuacgggacccccggcgucccccugauccagcuggugcggcgcccgguggagguccuccaggaccccacgcugcggcugaacgccaccuacuacaucaccaagcagauccucccgccccuggcccgcaucuucagccugaucgggaucgacguguucagcugguaccacgagcucccccggauccacaaggccaccuccagcucccgcagcgagcccgagggccgcaaggggaccaucucccaguacuucacgacccugcacugccccgugugcgacgaccugacccagcacggcaucugcagcaagugccggucccagccccagcacgucgccgugauccucaaccaggagauccgcgagcuggagcggcagcaggagcagcuggugaagaucugcaagaacugcaccggcugcuucgaccgccacauccccugcgucagccucaacugccccgugcuguucaagcugucccgggugaaccgcgagcucagcaaggcgcccuaccugcggcagcugcucgaccaguucuga

SEQ ID NO: 35622 - RNA, 3666 nt, Artificial Sequence
  derived and/or modified sequence opt1 from REXO1__Homo_sapiens__NP_065746
augcugcgcagcaccggcuucuuccgggccaucgacugccccuacugguccggggccccgggcgggcccugccgccggcccuacugccacuuccgccaccggggcgcgcgcgggagcggcgcccccggcgacgggggcgaggccccgcccgccgccgggcucggcuacgaccccuacaaccccgagcugccgaagccccccgcgcagcgggagaacgggacccugggccucggcgaggagccccgcccggacgugcuggagcuggagcucgucaaccaggccaucgaggccgugcgguccgagguggagcuggagcagcgccgguaccgcgagcugcucgagacgacccgggagcaccgcagcgccgaggcgcccgcccuggccccccgggggcccaacgccuccccgaccgucggccccgacgaggacgccuucccccuggcguucgacuacagccccgggucccacggccuccugagcccggacgccggcuaccagcccaccccccuggccgcccccgccgagccgggguccaaguacagccucgcgucccuggaccgcggccaggggcggggcgggggcggcgggggcgcccuggaguacgugcccaaggccgugagccagccccgccggcacucccgccccgucccgagcgggaaguacgugguggacaacucccggccccccacggaccucgaguacgacccgcugagcaacuacuccgcccgccaccugagccgcgccuccagccgggacgagcgcgcggccaagcggccccgcggcagccggggguccgagcccuacacccccgccccgaagaagcucugcgaccccuucggcagcugcgacgcccgcuucuccgacagcgaggacgaggccgcgaccguccccggcaacgagcccaccacggccuccaccccgaaggcccgggccgaccccgagaucaaggcgaccgggcagccccccagcaaggagggccuggaggccgaggggggcgggcugcgcgagaccaaggagacggccgugcagugcgacgugggcgaccuccagccgccccccgccaagcccgccuccccggcgcagguccagagcucccaggacggcgggugccccaaggagggcaagcccaagaagaagaagaccggggcccccccggcccccagcugcaaggacggcgcccagggcaaggacaagaccaaggacaaggggcggggccgccccguggagaagccccgggccgacaagaaggggccgcaggcguccagcccccgccggaaggccgagcgccccgagggcaccaagaagaagccguccagcgccacgcccguggccaccuccgggaagggccggcccgaccgccccgcccggcgcccgagccccaccuccggcgacagccggcccgcggccgggcgcggccccccgcgcccccugcagcugcccgaccggaaguccaccaaggcccccagcgggaagcucgucgagcgcaaggcccggagccuggacgagggcgcgucccaggacgccccgaagcugaagaagcgcgcccucagccacgccgaccuguucggggacgaguccgaggacgaggccgcgggccccggcgugcccagcguguggcccuccgcccugccgagccucuccagcgacuccgacagcgacuccgacagcucccugggguuccccgaggcccagggcccccccaagcggcugaaggccagcccgccccccucccccgccccgagcuccagcagcuccagcuccagcuccacgagcuccgcgggggccgacgucgacuacagcgcccucgagaaggagguggacuucgacuccgaccccauggaggagugccugcgcaucuucaacgagagcaccuccgugaagaccgaggaccggggccgccuggcccggcagccccccaaggaggagaagagcgaggagaaggggcucuccggccugaccacgcuguucccgggccagaagcgccggaucagccaccucuccaagcaggggcaggaggucgagcccccccgccggggcccggccgugccccccgcgcgccccccgaccgcccaggaggugugcuaccugcgggcccagcaggcccagcgcgcgagcgccucccugcuccaggcccccgcccggcuggccgagaagagccccuccguccacaucagcgcgcccggggagaagcgccggaucgcccacaucccgaacccccgccuggccgccgcccccaccggcgcgaagcggacccucgccgccagcgggucccagagcuccaacggccccgagccgggcgggcagcagcugaagacgcgcacccugagcggcauggccuccaagaccaccacgaccaucauccccaagcgcaucgcccacagccccucccugcagagccucaagaagcccaucaucccgaaggaguucgggggcaaggugcccaccgucauccggcagcgcuaccugaaccuguucaucgaggagugccucaaguucugcaccuccaaccaggaggcgaucgagaaggcccugaacgaggagaagguggccuacgaccggagccccuccaagaacaucuaccugaacguggccgucaacacgcucaagaagcugcgcggccuggcccccagcgcggugccggggcucuccaagaccagcggccggcgcguggucucccacgagguggugcuggggggccggcuggccgccaagaccagcuucucccucagccgccccuccagcccccgggucgaggaccugaagggggccgcgcuguacagccgccuccgggaguaccugcugacccaggaccagcucaaggagaacggcuaccccuucccgcaccccgagcgccccggcggggccaucaucuucaccgccgaggagaagcggcccaaggacuccagcugccgcacgugcugccggugcggcaccgaguaccugguguccagcuccgggcgcugcauccgggacgaggagugcuacuaccacuggggccgccugcggcgcaaccgcguggccgggggcugggagacccaguacaugugcugcagcgccgcggccggcuccgucgggugccagguggccaagcagcacgugcaggacggccggaaggagcgccucgagggguucgucaagaccuucgagaaggagcugagcggcgacacgcacccggggaucuacgcccuggacugcgagauguccuacaccaccuacggccucgagcugacccgggugacgguggucgacaccgacgugcacguggucuacgacaccuucgugaagcccgacaacgagaucguggacuacaacacccgcuucagcggcgucacggaggccgaccuggcggacaccuccgugacccuccgggacgugcaggccguccugcugagcauguucuccgccgacaccauccucaucgggcacagccuggaguccgaccugcucgcccugaaggugauccacagcacgguggucgacaccuccgugcuguucccccaccgccucggccugccguacaagcggagccugcgcaaccucauggccgacuaccugcggcagaucauccaggacaacguggacgggcacuccagcagcgaggacgcgggcgccugcaugcaccuggucaucuggaaggugcgcgaggacgccaagaccaagcgguga

SEQ ID NO: 35623 - RNA, 714 nt, Artificial Sequence
  derived and/or modified sequence opt1 from REXO2__Homo_sapiens__NP_056338
augcugggcgggagccucggcucccgccugcugcgcggggugggcgggagccacggccgguucggcgcccgcgggguccgggagggcggggccgcgauggccgccggcgaguccauggcccagcggaugguguggguggaccucgagaugaccgggcuggacaucgagaaggaccagaucaucgagauggccugccugaucaccgacagcgaccucaacauccuggcggagggccccaaccugaucaucaagcagccggacgagcuccuggacuccaugagcgacuggugcaaggagcaccacggcaaguccgggcugacgaaggccgucaaggagagcaccaucacccuccagcaggccgaguacgaguuccuguccuucgugcgccagcagaccccgcccggccugugcccccucgccgggaacagcgugcacgaggacaagaaguuccuggacaaguacaugccccaguucaugaagcaccuccacuaccggaucaucgacgucuccacggugaaggagcugugccgccggugguaccccgaggaguacgaguucgcgcccaagaaggccgccagccaccgcgcccuggacgacaucuccgagagcaucaaggagcugcaguucuaccggaacaacaucuucaagaagaagaucgacgagaagaagcgcaagaucaucgagaacggcgagaacgagaagaccguguccuga

SEQ ID NO: 35624 - RNA, 753 nt, Artificial Sequence
  derived and/or modified sequence opt1 from REXO4__Homo_sapiens__NP_001266278
augggcaaggccaaggugcccgccagcaagcgcgcgccguccagccccgucgccaagcccgggcccgugaagacccugacccggaagaagaacaagaagaagaagcgcuucuggaaguccaaggcccgggaggugagcaagaagccggccuccggccccggggccgucgugcgcccgcccaaggcgcccgaggacuucagccagaacuggaaggcccuccaggaggugccccgguggacgggcgggcgccaguaccuggcgccccggcccgucgagcaguccaccauccgcaaggagccgcggaagggccagauggugauccuguuccagaacgagggcaccagcuccauccgcagcgggaagcuccggcgccagccccagccccacccgccccgggaggagcuggaggugguccagaaggagguggccgagaugcugaagggccgcauccucguggggcacgcccugcacaacgaccugaagguccucuuccuggaccaccccaagaagaagauccgggacacccagaaguacaagcccuucaagucccaggucaagagcggccgccccucccugcggcuccugagcgagaagauccuggggcuccaggugcagcaggccgagcacugcuccauccaggacgcccaggccgccaugcgccuguacgugauggugaagaaggagugggagagcauggcgcgggaccgccggccgcugcucacggcccccgaccacugcuccgacgacgccuga

SEQ ID NO: 35625 - RNA, 3447 nt, Artificial Sequence
  derived and/or modified sequence opt1 from RFC1__Homo_sapiens__NP_001191676
auggacauccgcaaguucuucggggugauccccagcgggaagaagcuggucuccgagaccgugaagaagaacgagaagaccaagagcgacgaggagacgcucaaggccaagaagggcaucaaggagaucaaggugaacuccagccggaaggaggacgacuucaagcagaagcagccguccaagaagaagcgcaucaucuacgacagcgacuccgagagcgaggagacccugcaggucaagaacgccaagaagccgcccgagaagcugcccguguccagcaagcccgggaagaucucccggcaggaccccgugaccuacaucagcgagaccgacgaggaggacgacuucaugugcaagaaggcggccuccaagagcaaggagaacggccgcuccacgaacagccaccucgggaccuccaacaugaagaagaacgaggagaacaccaagaccaagaacaagccccugagccccaucaagcugacgccgaccuccguccucgacuacuucggcaccggcagcgugcagcggagcaacaagaagaugguggccuccaagcgcaaggagcugagccagaacaccgacgaguccgggcugaacgacgaggccaucgccaagcagcuccagcuggacgaggacgcggagcuggagcggcagcuccacgaggacgaggaguucgcccgcacgcuggccaugcuggacgaggagcccaagaccaagaaggcccggaaggacaccgaggcgggcgagaccuucagcuccguccaggccaaccucagcaaggccgagaagcacaaguacccccacaaggugaagacggcccagguguccgacgagcgcaagagcuacagcccccggaagcagagcaaguacgaguccagcaaggagucccagcagcacagcaaguccagcgccgacaagaucggggaggucuccagcccgaaggcguccagcaagcuggccaucaugaagcgcaaggaggagagcuccuacaaggagaucgagcccguggccagcaagcggaaggagaacgccaucaagcugaagggcgagaccaagacccccaagaagaccaaguccagccccgccaagaaggaguccgugagcccggaggacuccgagaagaagcgcacgaacuaccaggcguaccggagcuaccucaaccgcgaggggcccaaggcccugggcuccaaggagauccccaagggcgccgagaacugccuggaggggcucaucuucgucaucaccggcgugcuggagagcaucgagcgggacgaggccaagucccugaucgagcgcuacgggggcaaggugaccggcaacgucagcaagaagaccaacuaccucgugauggggcgggacuccggccagagcaaguccgacaaggccgcggcccuggggacgaagaucaucgacgaggacggccugcucaaccugauccgcaccaugcccgggaagaaguccaaguacgagaucgccguggagaccgagaugaagaaggaguccaagcuggagcggaccccgcagaagaacguccagggcaagcgcaagaucagccccagcaagaaggaguccgagagcaagaagucccgccccacgagcaagcgggacucccucgccaagaccaucaagaaggagaccgacguguucuggaagucccuggacuucaaggagcaggucgccgaggagaccagcggcgacagcaaggcgcgcaaccuggccgacgacuccagcgagaacaagguggagaaccuccuguggguggacaaguacaagcccacgucccugaagaccaucaucgggcagcagggcgaccagagcugcgccaacaagcuccugcgguggcugcgcaacuggcagaaguccagcuccgaggacaagaagcacgccgcgaaguucgggaaguucagcggcaaggacgacggguccagcuucaaggccgcccuccuguccggcccgcccggcgucgggaagaccaccacggccagccuggugugccaggagcucggcuacagcuacguggagcugaacgccuccgacacccggagcaaguccagccugaaggcgaucgucgccgagucccucaacaacaccagcaucaagggguucuacuccaacggcgccgccagcuccgugagcaccaagcacgcccugaucauggacgagguggacgggauggcgggcaacgaggaccgcggcgggauccaggagcugaucggccucaucaagcacaccaagauccccaucaucugcaugugcaacgaccggaaccaccccaagauccgcucccugguccacuacugcuucgaccugcgguuccagcgcccgcggguggagcagaucaagggggccaugaugagcaucgccuucaaggagggccugaagaucccgccgcccgccaugaacgagaucauccucggcgccaaccaggacauccgccaggugcugcacaaccuguccauguggugcgcgcggagcaaggcccucacguacgaccaggccaaggccgacucccaccgcgcgaagaaggacaucaagauggggcccuucgacgucgcccggaagguguucgccgccggcgaggagaccgcccacaugagccugguggacaaguccgaccuguucuuccacgacuacagcaucgcgccccucuucguccaggagaacuacauccacgugaagcccguggccgccgggggcgacaugaagaagcaccugaugcugcucucccgcgccgccgacagcaucugcgacggggaccuggucgacagccagauccgguccaagcagaacuggagccugcuccccgcgcaggccaucuacgccuccgugcugcccggcgagcugaugcgcggcuacaugacccaguuccccaccuuccccagcuggcucgggaagcacuccagcacgggcaagcacgaccggaucgugcaggaccuggcccugcacaugucccuccgcaccuacagcuccaagcgcaccgucaacauggacuaccugagccugcuccgggacgcccuggugcagccgcugaccucccaggggguggacggcguccaggacgugguggcgcucauggacacguacuaccugaugaaggaggacuucgagaacaucauggagaucagcuccuggggcgggaagcccagccccuucuccaagcuggaccccaaggucaaggccgccuucacccgcgccuacaacaaggaggcgcaccucaccccguacagccugcaggccaucaaggccucccggcacagcaccucccccagccuggacagcgaguacaacgaggagcucaacgaggacgacucccagagcgacgagaaggaccaggacgccaucgagacggacgccaugaucaagaagaagaccaaguccagcaagcccuccaagcccgagaaggacaaggagccgcgcaagggcaagggcaagagcuccaagaaguga

SEQ ID NO: 35626 - RNA, 963 nt, Artificial Sequence
  derived and/or modified sequence opt1 from RFC2__Homo_sapiens__NP_002905
auggagguggaggccgucugcggcggggccggcgagguggaggcgcaggacagcgaccccgccccggccuucuccaaggcccccgggagcgccggccacuacgagcugcccuggguggagaaguaccgccccgucaagcucaacgagaucguggggaacgaggacaccgugucccggcuggaggucuucgcgcgcgagggcaacgugccgaacaucaucaucgccggcccgcccgggaccggcaagacgaccagcauccugugccucgcccgggcccugcuggggcccgcgcucaaggacgccaugcuggagcugaacgccuccaacgacagcaugaccgacggcgcccagcaggcccuccgccggaccauggagaucuacuccaagacgacccgcuucgcgcuggccugcaacgccagcgacaagaucaucgagcccauccagucccggugcgccgugcugcgcuacaccaagcucaccgacgcccagauccugacgcggcugaugaacgucaucgagaaggagcgcgugcccuacaccgacgacgggcucgaggcgaucaucuucaccgcccagggcgacaugcggcaggcccugaacaaccugcagagcaccuucuccggcuucggguucaucaacagcgagaacguguucaaggucugcgacgagccccacccccuccuggugaaggagaugauccagcacugcgugaacgccaacaucgacgaggccuacaagauccuggcgcaccucuggcaccugggcuacuccccggaggacaucaucgggaacaucuuccgcgucugcaagacguuccagauggccgaguaccugaagcucgaguucaucaaggagaucggcuacacccacaugaagaucgccgagggcgugaacagccugcugcagauggccgggcuccuggcccggcugugccagaagaccauggcgcccguggccuccuga

SEQ ID NO: 35627 - RNA, 1071 nt, Artificial Sequence
  derived and/or modified sequence opt1 from RFC3__Homo_sapiens__NP_002906
augagccuguggguggacaaguaccgccccugcucccucggccggcuggacuaccacaaggagcaggccgcccagcugcgcaaccucguccagugcggggacuucccgcaccuccugguguacggccccagcggggcgggcaagaagacccggaucaugugcauccugcgcgagcuguacggggugggcgucgagaagcugcggaucgagcaccagaccaucaccacccccuccaagaagaagaucgagaucagcaccaucgccuccaacuaccaccucgaggugaaccccagcgacgccggcaacuccgaccgcguggucauccaggagaugcugaagaccguggcccagagccagcagcuggagacgaacucccagcgggacuucaaggugguccuccugaccgagguggacaagcugaccaaggacgcccagcacgcgcuccgccggaccauggagaaguacaugagcacgugccgccugauccugugcugcaacuccaccagcaaggugaucccgcccauccggucccgcugccucgccguccgggugcccgcccccagcaucgaggacaucugccacgugcuguccaccgucugcaagaaggaggggcugaaccucccgagccagcuggcccaccgccuggcggagaaguccugccggaaccuccgcaaggcccugcugaugugcgaggccugccgggugcagcaguaccccuucaccgccgaccaggagauccccgagacggacugggagguguaccuccgcgagaccgccaacgcgaucgucagccagcagacgccccagcggcugcuggaggugcgcggccggcucuacgagcugcugacccacugcaucccgcccgagaucaucaugaaggggcuccuguccgagcugcuccacaacugcgacggccagcugaagggggagguggcccagauggccgccuacuacgagcaccgccugcagcucggcagcaaggccaucuaccaccuggaggcguucgucgccaaguucauggcccuguacaagaaguucauggaggacggccucgaggggaugauguucuga

SEQ ID NO: 35628 - RNA, 1092 nt, Artificial Sequence
  derived and/or modified sequence opt1 from RFC4__Homo_sapiens__NP_853551
augcaggccuuccugaagggcaccagcaucuccaccaagcccccgcucacgaaggaccgcgggguggccgcgagcgccggcuccagcggggagaacaagaaggccaagcccguccccuggguggagaaguaccggcccaagugcguggacgaggucgccuuccaggaggaggugguggccguccugaagaagucccuggagggcgcggaccucccgaaccugcuguucuacgggccgcccggcaccggcaagaccagcaccauccucgccgccgcccgcgagcuguucgggcccgagcuguuccggcuccgcgugcuggagcugaacgcguccgacgagcggggcauccaggugguccgcgagaaggugaagaacuucgcccagcucacggugagcgggucccggagcgacggcaagcccugcccgcccuucaagaucgucauccuggacgaggccgacuccaugaccagcgccgcccaggcggcccugcgccggaccauggagaaggaguccaagaccacgcgcuucugccucaucugcaacuacgugagccggaucaucgagccccugaccucccgcugcagcaaguuccgguucaagccccuguccgacaagauccagcagcagcgccuccuggacaucgccaagaaggagaacgugaagaucagcgacgaggggaucgccuaccuggucaagguguccgagggcgaccuccggaaggccaucaccuuccugcagagcgcgacccgccugacgggcgggaaggagaucaccgagaaggugaucaccgacaucgccggcgucauccccgccgagaagaucgacgggguguucgccgccugccagagcggcuccuucgacaagcucgaggcgguggucaaggaccugaucgacgagggccacgccgccacccagcuggugaaccagcuccacgacguggucguggagaacaaccugagcgacaagcagaaguccaucaucacggagaagcuggccgaggucgacaagugccucgccgacggggcggacgagcaccuccagcugaucagccugugcgccaccgugaugcagcagcugucccagaacugcuga

SEQ ID NO: 35629 - RNA, 768 nt, Artificial Sequence
  derived and/or modified sequence opt1 from RFC5__Homo_sapiens__NP_001123584
auggugcuggagcucaacgccagcgacgaccgcggcaucgacaucauccgggggcccauccuguccuucgccagcacccgcaccaucuucaagaagggcuucaagcuggucauccucgacgaggcggacgccaugacgcaggacgcccagaacgcccugcggcgcgugaucgagaaguucaccgagaacacccgguucugccugaucugcaacuaccucuccaagaucaucccggcccugcagagccgcugcacccgguuccgcuucgggccccugacgcccgagcucauggugccccggcuggagcacgucguggaggaggagaagguggacaucuccgaggacggcaugaaggcgcuggucacccucagcuccggggacaugcgccgggcccugaacauccugcagagcaccaacauggccuucggcaaggugaccgaggagacgguguacacgugcaccggccacccgcucaaguccgacaucgccaacauccuggacuggaugcugaaccaggacuucaccaccgcguaccgcaacaucaccgagcucaagacccugaaggggcuggcccuccacgacauccugaccgagauccaccuguucguccaccggguggacuuccccagcuccgugcgcauccaccuccugacgaagauggccgacaucgaguaccggcugagcgucggcaccaacgagaagauccagcucuccagccugaucgccgccuuccaggugacccgcgaccugaucguggcggaggccuga

SEQ ID NO: 35630 - RNA, 1092 nt, Artificial Sequence
  derived and/or modified sequence opt1 from RFFL__Homo_sapiens__NP_001017368
augugggcgaccugcugcaacugguucugccuggacggccagcccgaggaggugccgccgccccagggggcccgcaugcaggccuacagcaaccccggcuacuccagcuuccccucccccaccgggcucgagcccagcugcaaguccugcggcgcccacuucgccaacacggcccggaagcagaccugccuggacugcaagaagaacuucugcaugaccugcagcucccaggucgggaacggcccccgccugugccuccugugccagcgguuccgcgccaccgcguuccagcgggaggagcugaugaagaugaaggugaaggaccuccgcgacuaccugagccugcacgacaucuccacggagaugugccgggagaaggaggagcucgugcugcugguccucggccagcagccggugaucagccaggaggaccgcacccgggccuccacccugagccccgacuuccccgagcagcaggccuuccugacccagccccacuccagcauggugccgcccacgucccccaaccuccccagcuccagcgcccaggcgaccuccgucccgcccgcccaggugcaggagaaccagcaggccaacgggcacgugagccaggaccaggaggagcccgucuaccuggagagcguggcccgcgugcccgccgaggacgagacccaguccaucgacagcgaggacuccuucgucccgggccggcgcgcgagccuguccgaccucaccgaccuggaggacaucgaggggcugacggugcggcagcucaaggagauccuggcccgcaacuucgugaacuacaagggcugcugcgagaagugggagcugauggagcgggucacccgccucuacaaggaccagaaggggcugcagcaccuggugagcggcgccgaggaccagaacggcggggccgugcccuccggccucgaggagaaccugugcaagaucugcauggacagccccaucgacugcguccugcucgagugcgggcacauggugaccugcaccaagugcggcaagcggaugaacgagugccccaucugccgccaguacgugauccgggccguccacguguuccgcuccuga

SEQ ID NO: 35631 - RNA, 468 nt, Artificial Sequence
  derived and/or modified sequence opt1 from RFK__Homo_sapiens__NP_060809
augcgccaccuccccuacuucugccggggccaggugguccgcggguucggccgggggagcaagcagcugggcaucccgaccgccaacuuccccgagcaggucguggacaaccugcccgccgacaucuccaccgggaucuacuacggcugggcgagcgugggcuccggggacgugcacaagaugguggucagcaucggcuggaaccccuacuacaagaacacgaagaaguccauggagacccacaucaugcacaccuucaaggaggacuucuacggggagauccugaacguggccaucgugggcuaccuccgcccggagaagaacuucgacagccuggagucccugaucagcgccauccagggggacaucgaggaggccaagaagcggcucgagcugcccgagcaccugaagaucaaggaggacaacuucuuccaggucuccaagagcaagaucaugaacggccacuga

SEQ ID NO: 35632 - RNA, 954 nt, Artificial Sequence
  derived and/or modified sequence opt1 from RFPL1__Homo_sapiens__NP_066306
augaagcgccugagccucgugaccaccaaccggcugagcccccacggcaacuuccugccgcucugcacguucccccuggccgucgacauggccgcccuguuccaggaggccuccuccugccccgugugcagcgacuaccucgagaagcccaugucccuggagugcgggugcgccgugugcuucaagugcaucaacagccugcagaaggagccgcacggcgaggaccuccugugcugcugcugcuccauggucagccagaagaacaagauccgccccuccuggcagcuggagcggcucgccagccacaucaaggagcuggagcccaagcugaagaagauccuccagaugaacccccgcaugcggaaguuccagguggacaugacccuggacgccgacaccgcgaacaacuuccugcucaucuccgacgaccugcgcagcgugcgguccgggugcaucacccagaaccgccaggaccuggccgagcgguucgacgucagcaucugcauccucggcuccccgcgcuucacgugcgggcggcacuacugggagguggacgugggcaccagcaccgagugggaccugggcgucugccgcgaguccgugcaccggaaggggcgcauccaccugaccacggagcggggcuucuggaccgugagccuccgcgacgggucccggcugagcgccagcaccgucccccugaccuuccucuucguggaccgcaagcugcagcgggugggcaucuuccuggacauggggaugcagaacgucuccuucuucgacgccgagggcggcagccacguguacacguuccgcuccgugagcgcggaggagccccuccaccuguucuucgcgcccccguccccgcccaacggggacaagagcguccuguccaucugccccgugaucaaccccggcaccaccgacgcccccgugcaccccggggaggccaaguga

SEQ ID NO: 35633 - RNA, 1626 nt, Artificial Sequence
  derived and/or modified sequence opt1 from RFT1__Homo_sapiens__NP_443091
augggcagccaggaggugcuggggcacgccgcccgccucgcguccagcggccugcugcuccagguccuguuccggcugaucaccuucgugcucaacgccuucauccugcgcuuccuguccaaggagaucgugggggucgugaacgugcggcucacccugcuguacagcacgacccucuuccuggcccgcgaggccuuccggcgcgccugccuguccggcgggacccagcgggacuggagccagacccucaaccugcuguggcucacggucccccugggcguguucuggucccuguuccucggcuggaucuggcugcagcugcucgaggugccggaccccaacgucgugccccacuacgcgaccggggugguccuguucggccugagcgccgugguggagcuccugggggagcccuucuggguccuggcccaggcccacauguucgugaagcucaaggugaucgcggagucccugagcgucauccugaaguccgugcucaccgccuuccuggugcuguggcucccgcacuggggccuguacaucuucagccuggcccagcuguucuacaccacgguccucgugcugugcuacgugaucuacuucaccaagcuccuggggucccccgagagcaccaagcugcagacccuccccgucucccgcaucacggaccugcugcccaacaucacccggaacggcgccuucaucaacuggaaggaggccaagcucaccuggagcuucuucaagcaguccuuccugaagcagauccugaccgagggcgagcgcuacgugaugacguuccugaacguccucaacuucggggaccagggcguguacgacaucgugaacaaccuggggagccuggucgcgcggcucaucuuccagccgaucgaggaguccuucuacaucuucuucgccaaggugcuggagcgcggcaaggacgccacccugcagaagcaggaggacguggccgucgccgcggccgugcucgagagccugcugaagcucgcccugcuggccggccucaccaucaccguguucggguucgccuacagccagcuggcgcuggacaucuacggcgggacgaugcucuccagcggcuccgggcccguccugcugcggagcuacugccucuacgugcugcugcucgccaucaacggcgugaccgagugcuucaccuucgccgccauguccaaggaggaggucgaccgcuacaacuucgugaugcuggcccugagcuccagcuuccucgugcuguccuaccugcucacccgguggugcggcagcgucggguucauccuggcgaacugcuucaacaugggcauccgcaucacgcagucccugugcuucauccaccgguacuaccgccggagcccccaccgcccccucgccgggcugcaccuguccccggugcuccugggcaccuucgcccugagcgggggcgugaccgccgucuccgagguguuccucugcugcgagcagggcuggcccgcgcggcuggcccacaucgccgugggggccuucugccugggcgccacccucgggacggcguuccugaccgagaccaagcugauccacuuccuccgcacccagcugggcgucccccgccggacggacaagaugaccuga

SEQ ID NO: 35634 - RNA, 1737 nt, Artificial Sequence
  derived and/or modified sequence opt1 from RFTN1__Homo_sapiens__NP_055965
augggcugcgggcugaacaagcucgagaagcgcgacgagaagcggcccggcaacaucuacagcacccugaagcgcccccagguggagaccaagaucgacgucuccuacgaguaccgguuccuggaguucacgacccucagcgccgccgagcugcccggguccagcgcggugcgccuggccucccuccgggaccugcccgcccagcugcucgagcuguaccagcagggcuucagccuggccgcccuccaccccuucgugcagccgacccacgagcgcgagaagaccccgcuggagcacaucuuccgggcgauccugaucaagaagacggaccgcucccagaagaccgaccuccacaacgagggguacauccuggagcuggacugcugcagcucccucgaccaccccaccgaccagaagcugauccccgaguucaucaagaagauccaggaggccgccagccagggccugaaguucgucggcgugaucccgcaguaccacuccagcgugaacuccgccgggagcuccgcgcccgucagcaccgccaacuccacggaggacgcccgggacgccaagaacgcccgcggcgaccacgcgagccucgagaacgagaagcccgggaccggcgacgugugcuccgcccccgccgggcggaaccagagcccggagcccagcuccggcccccgcggcgaggugccccuggccaagcagccgagcucccccagcggggagggcgacgggggcgagcuguccccgcagggcgucagcaagacccucgacgggcccgaguccaacccgcuggaggugcacgaggagccccugagcggcaagauggagaucuucacccucuucaacaagcccaagucccaccagaagugccggcaguacuaccccgugacgaucccgcugcacgucagcaagaacgggcagaccguguccggccuggacgccaacuggcucgagcacaugagcgaccacuuccgcaagggcgggaugcuggugaacgcggucuucuaccugggcaucgugaacgacucccuccacgggcugaccgacggcguguucaucuucgaggccgucagcaccgaggacuccaagacgauccagggguacgacgccaucgugguggagcaguggaccguccuggagggcguggaggugcagaccgacuacgucccccuccugaacagccuggccgccuacggguggcagcugaccugcgugcuccccacgcccgucgugaagaccaccuccgagggcagcguguccaccaagcagaucgucuuccugcagcggccgugccucccccagaagaucaagaagaaggagagcaaguuccaguggcgcuucagccgggaggagaugcacaaccgccagaugcggaaguccaagggcaagcugagcgcgcgcgacaagcagcaggccgaggagaacgagaagaaccuggaggaccaguccagcaaggccggggacaugggcaacugcguguccgggcagcagcaggagggcggggugagcgaggagaugaagggccccguccaggaggacaagggcgagcagcucucccccgggggccugcugugcggggugggcguggagggcgaggccguccagaacgggcccgccagccacucccgggcgcucgugggcaucugcacggggcacagcaaccccggcgaggacgcccgcgacggggacgccgaggaggugcgcgagcugggcaccgucgaggagaacuga

SEQ ID NO: 35635 - RNA, 1506 nt, Artificial Sequence
  derived and/or modified sequence opt1 from RFTN2__Homo_sapiens__NP_653230
augggcugcgggcugcgcaagcucgaggaccccgacgacagcuccccgggcaagaucuucagcacccugaagcggccccagguggagaccaagacggaguucgccuacgaguacguccugcucgacuucacccugcaggccuccagcaaccccgaggugaucaagaucaacuccauccuggacaucgugaccaaggucgagaacuacuaccucaagggguacaucgugggcgcgauccaccccgugauccagccggucgggcagcgcaagcaccuccccgccagcuaccuguaccggguggugcugcugcgccugaagcucucccccaagaacagcgccgcccccuccggccagcggcgcccgcggcuggucaucgaggagugcccccugaccagcgaggcccagacgaacgacgcggccaaggagcucaucgagaagaucaacguggccgccaagcgcggcaugaaguucgugggguucaucucccagcacuacagccccuccaaguucugcaacggcaccaaccacgacggggacaucgagagcaugcugcacguccggcacggcuccgacgagaacugccgcagcuggaacgaggggacccuguccggccagagcuccgagagcggcaucgaggaggagcuccaccacgagagcgggcaguaccagauggagcagaacggcucccccaccagcuccaagagccggaagggggaggcguccgacaacaagcuguacacgguguucaacgccuucgacgacgacagcaccuccugggccuaccaggagggcauccugagcaugaaggugacccgcaagggcuccgucaucagcacccucgacgccgacuggcuggagcugacgaccuucuacuacaagcaggggcucucccugaucgacagcuucguguucugggagaccuccaagggcgagcaccuccccaagagccuggagggguucuucaucuacgaggaggagggcuccggggugccgggcagcucccggaagggcaacgacgccaucgucguggagcaguggaccgugaucgaggggugcgagaucaagacggacuacggcccccugcugcacacccucgcggaguucggguggcugcugaccagcguccuccccaccccggugcugcgccacgacuccgagggcaaccuggccacgaagcagaucguguuccuccagcggcccgucauguggaacagcgccgcccagacccccgacaagaaggccagccgccacaucaagggggaggacaagaacaaggcgaccucccggagcaucggccuggacaccacguccagccagcccgccgagucccgccaccucccggaggagugccggcugagccccucccgcgagugcuggaccaaggagggccggcuggcccagcacaacagcuucuccggguucagcuccagcgacaacgugcugcgcgagcucgacgacggccaguucgaccaggaggacggggucacccaggugaccugcauguga

SEQ ID NO: 35636 - RNA, 2124 nt, Artificial Sequence
  derived and/or modified sequence opt1 from RFWD2__Homo_sapiens__NP_001001740
augagcggcucccgccaggccgggagcggcuccgccgggaccagccccggcuccagcgcggccuccagcgugaccuccgccagcuccagccuguccagcuccccgagcccgcccuccgucgccgugagcgccgcggcccucguguccgggggcgucgcccaggccgcgggcagcgggggccucgggggccccgugcggcccgugcuggucgcccccgccgugagcggguccggcggcggggccgugagcacgggccugucccgccacagcugcgccgcgcggcccuccgccggggucggcggcagcuccagcucccuggggagcggcucccgcaagcggccccugcucgccccgcugugcaacgggcugaucaacagcuacgaggacaaguccaacgacuucgugugccccaucugcuucgacaugaucgaggaggccuacaugaccaagugcggccacagcuucugcuacaagugcauccaccagucccucgaggacaacaaccgcugccccaagugcaacuacguggucgacaacaucgaccaccuguaccccaacuuccuggugaacgagcucauccugaagcagaagcagcgguucgaggagaagcgcuucaagcuggaccacagcaacgggcaccgguggcagaucuuccaggacuggcucggcaccgaccaggacaaccuggaccuggccaacgugaaccucaugcuggagcugcucguccagaagaagaagcagcuggaggcggagucccacgccgcccagcugcagauccucauggaguuccugaagguggcccgccggaacaagcgcgaggagaugagcggccuguacuccccggugagcgaggacagcaccgucccccaguucgaggcccccucccccagccacuccagcaucaucgacuccacggaguacagccagccgcccggguucuccggcagcucccagaccaagaagcagcccugguacaacagcacccucgcgucccggcgcaagcggcugaccgcccacuucgaggaccuggagcagugcuacuucagcacgcgcaugucccggaucagcgacgacucccgcaccgccagccagcucgacgaguuccaggagugccuguccaaguucacccgguacaacagcgugcgcccccuggccacccucagcuacgccuccgaccuguacaacgggagcuccaucgugagcuccaucgaguucgaccgggacugcgacuacuucgcgaucgccggcgucacgaagaagaucaagguguacgaguacgacaccgugauccaggacgccgucgacauccacuacccggagaacgagaugaccugcaacagcaagaucuccugcaucagcugguccagcuaccacaagaaccugcucgccuccagcgacuacgaggggaccgugauccugugggacggcuucacgggccagcgcuccaaggucuaccaggagcacgagaagcgcugcuggagcguggacuucaaccugauggaccccaagcuccuggcguccgggagcgacgacgccaaggugaagcugugguccaccaaccucgacaacagcgucgccuccaucgaggccaaggccaacgugugcugcgugaaguucagccccagcucccgguaccaccuggcguucggcugcgccgaccacugcguccacuacuacgaccugcgcaacaccaagcagcccaucaugguguucaaggggcaccggaaggccgugagcuacgccaaguucgucuccggcgaggagaucgugagcgccuccaccgacagccagcucaagcuguggaacguggggaagccguacugccugcgcuccuucaagggccacaucaacgagaagaacuucgucggccucgcgagcaacggggacuacaucgccugcggcuccgagaacaacagccuguaccuguacuacaaggggcuguccaagacgcuccugaccuucaaguucgacaccgucaagagcgugcuggacaaggaccggaaggaggacgacaccaacgaguucguguccgccgugugcuggcgcgcccuccccgacggcgagagcaacgugcugaucgccgcgaacucccagggcacgaucaagguccuggagcucguguga

SEQ ID NO: 35637 - RNA, 2325 nt, Artificial Sequence
  derived and/or modified sequence opt1 from RFWD3__Homo_sapiens__NP_060594
auggcccacgaggccauggaguacgacgugcagguccagcugaaccacgcggagcagcagcccgccccggccggcauggccagcucccagggcgggcccgcccuccugcagcccgugcccgcggacguggucagcucccagggggugccgagcauccugcagcccgcccccgccgaggugaucuccagccaggccacgcccccgcuccugcagcccgcgccccagcuguccgucgaccucaccgagguggaggugcugggcgaggacaccgucgagaacaucaacccccgcaccagcgagcagcaccggcagggguccgacggcaaccacaccaucccggccagcucccugcacagcaugaccaacuucaucuccggccuccagcgccugcacgggaugcuggaguuccuccggcccagcuccagcaaccacuccgugggccccaugcgcacgcggcgccgggugagcgccucccgccgggcccgcgccgggggcagccagcggaccgacagcgcgcgccugcgggcgccccuggacgccuacuuccaggucucccgcacccagccggaccuccccgccaccacguacgacagcgagacccggaaccccguguccgaggagcuccaggugagcuccagcuccgacagcgacuccgacagcuccgccgaguacgggggcgucguggaccaggccgaggagagcggcgccgugauccuggaggagcagcuggccggggucuccgccgagcaggaggugaccugcaucgacggcgggaagacccugcccaagcagccgagcccccagaaguccgagccccugcuccccagcgccuccauggacgaggaggagggcgacacgugcaccaucugccuggagcaguggaccaacgcgggcgaccaccgccugagcgcccuccggugcgggcaccuguucggcuaccgcugcaucuccaccuggcugaagggccaggugcggaagugcccgcagugcaacaagaaggcccgccacagcgacaucgucgugcucuacgcccggacgcugcgcgcccuggacaccagcgagcaggagcgcaugaaguccagccuccugaaggagcagaugcugcggaagcaggcggagcucgaguccgcccagugccgccugcagcuccaggugcugaccgacaagugcacccggcugcagcgccggguccaggaccugcagaagcucacgagccaccagucccagaaccugcagcagccccgcgggagccaggccugggugcuguccugcagccccuccagccaggggcagcacaagcacaaguaccacuuccagaagaccuucaccgucucccaggccggcaacugccggaucauggcguacugcgacgcccucagcugccuggugaucucccagcccagcccgcaggccuccuuccugcccggcuucggggugaagaugcucagcaccgccaacaugaaguccagccaguacauccccaugcacggcaagcagauccgcgggcuggccuucagcuccuaccugcggggccuccugcugagcgcgucccuggacaacacgaucaagcucaccagccuggagaccaacaccgucgugcagacguacaacgccgggcgcccggugugguccugcugcuggugccuggacgaggccaacuacaucuacgccggccucgccaacggcagcauccuggucuacgacgugcggaacaccuccagccacgugcaggagcuggucgcgcagaaggcccgcugcccccucgugucccugagcuacaugccccgggccgccuccgccgcguuccccuacgggggcgugcuggccgggacccucgaggacgccagcuucugggagcagaagauggacuucucccacuggccgcacguccugccccuggagcccggcgggugcaucgacuuccagaccgagaacagcucccgccacugccucgugacguaccggcccgacaagaaccacaccaccauccgcagcgugcugauggagauguccuaccggcuggacgacaccggcaacccgaucugcagcugccagcccguccacacguucuucggcgggccgaccugcaagcuccugaccaagaacgccaucuuccagucccccgagaacgacggcaacauccuggugugcaccggggacgaggcggccaacagcgcccuccugugggacgccgccagcggcucccugcuccaggaccugcagaccgaccagcccgugcuggacaucugccccuucgaggucaaccgcaacagcuaccucgcgacgcugaccgagaagauggugcacaucuacaagugggaguga

SEQ ID NO: 35638 - RNA, 2940 nt, Artificial Sequence
  derived and/or modified sequence opt1 from RFX1__Homo_sapiens__NP_002909
auggccacccaggccuacaccgagcugcaggcggcccccccgcccagccagcccccccaggccccgccccaggcccagccccagcccccgcccccccccccgcccgccgcgccccagcccccgcagccccccacggccgccgccaccccccagccgcaguacgugaccgagcuccaguccccccagccccaggcgcagcccccgggcgggcagaagcaguacgucaccgagcugcccgccgugcccgcccccagccagccgacgggcgcccccacccccuccccggccccccagcaguacaucguggucaccgugagcgagggggcgaugcgcgccuccgagaccgugagcgaggccucccccggcagcacggccucccagaccgggguccccacccagguggugcagcagguccagggcacccagcagcggcugcucgugcagacgagcgugcaggccaagccgggccacgucuccccccugcagcugaccaacauccaggugccccagcaggcgcuccccacccagcgccuggugguccagagcgccgccccgggguccaagggcgggcaggugagccugaccgugcacggcacgcagcagguccacuccccccccgagcagagccccgugcaggccaacuccagcuccagcaagaccgccggggcgccgaccggcaccgugccccagcagcuccagguccacggcgugcagcagagcgugcccgucacgcaggagcgguccgugguccaggccaccccccaggccccgaagcccgggcccgugcagccccugaccgugcagggccugcagccgguccacguggcccaggaggugcagcagcuccagcagguccccgugccccacguguacagcucccagguccaguacguggaggggggcgacgccagcuacaccgcguccgccauccgcagcuccacguacagcuaccccgagaccccgcuguacacccagaccgccuccacgagcuacuacgaggccgcgggcaccgccacccagguguccacccccgccacgagccaggccgucgccuccagcggguccaugcccauguacgugagcggcucccagguggucgcgagcuccaccagcaccggggccggcgccagcaacuccagcgggggcggcggguccggcgggggcgggggcggcgggggcgggggcgggggcggcgggagcggcuccaccgggggcggcgggagcggcgccgggacguacgugauccagggcggguacaugcugggcuccgccagccaguccuacagccacaccacccgggcguccccggccaccgugcaguggcuccuggacaacuacgagaccgccgagggcgucagccugccccgcuccacgcucuacugccacuaccugcugcacugccaggagcagaagcucgagcccgugaacgccgccagcuucgggaagcugauccgguccguguucaugggccugcgcacccggcgccucgggacccggggcaacagcaaguaccacuacuacgggcugcgcaucaaggcguccagcccccugcuccggcugauggaggaccagcagcacauggccaugcgcggccagccguucagccagaagcagcggcugaagcccauccagaagauggagggcaugaccaacggggucgccgugggccagcagcccuccacggggcucagcgacaucuccgcccaggugcagcaguaccagcaguuccuggacgcgagccgcucccugcccgacuucaccgagcucgaccugcagggcaagguccugccggagggggugggccccggcgacaucaaggccuuccaggugcucuaccgggagcacugcgaggccaucgucgacgugauggugaaccugcaguucacccuggucgagacccucuggaagacguucuggcgcuacaaccugagccagcccuccgaggcccccccgcuggccgugcacgacgaggcggagaagcggcuccccaaggccauccuggugcugcucagcaaguucgagcccguccugcaguggaccaagcacugcgacaacgugcuguaccaggggcucguggagauccugauccccgacguccugcgcccgauccccuccgcccugacccaggccauccggaacuucgccaagagccucgaguccuggcugacccacgcgauggugaacauccccgaggagaugcugcgcgugaaggucgccgccgccggcgccuucgcgcagacgcuccgccgguacaccagccugaaccaccuggcccaggccgcccgcgcggugcuccagaacaccgcccagaucaaccagaugcuguccgaccugaaccggguggacuucgccaacguccaggagcaggccagcugggugugccgcugcgaggaccgggugguccagcgccucgagcaggacuucaaggugacccugcagcagcagaacucccuggagcagugggccgcguggcucgacgggguggucagccaggugcugaagcccuaccagggcuccgccggguucccgaaggccgccaagcuguuccuccugaaguggagcuucuacuccagcauggugauccgggaccugacgcuccgcagcgccgcguccuucggcagcuuccaccugauccggcugcucuacgacgaguacauguacuaccugaucgagcaccgcgucgcccaggccaagggcgagacccccaucgccgugaugggggaguucgccaaccuggcgaccucccucaacccccuggaccccgacaaggacgaggaggaggaggaggaggaggagagcgaggacgagcugccgcaggacaucucccucgccgccggcggggagagccccgcccugggccccgagacccuggagcccccggccaagcucgcgcggacggacgcccgcggccuguucguccaggcccugcccuccagcuga

SEQ ID NO: 35639 - RNA, 2172 nt, Artificial Sequence
  derived and/or modified sequence opt1 from RFX2__Homo_sapiens__NP_000626
augcagaacagcgagggcggggccgacucccccgccagcguggcgcugcgcccguccgccgccgccccgcccguccccgccagcccccagcgggugcucgugcaggcggccuccagcaaccccaagggcgcccagaugcagcccaucucccugccccgcguccagcaggucccgcagcagguccagcccgugcagcacguguaccccgcccaggugcaguacguggagggcggggacgcgguguacaccaacggggccauccggaccgccuacacguacaaccccgagccgcagauguacgcccccagcuccaccgccagcuacuucgaggcgcccggcggcgcccaggugaccgucgccgccuccagcccgcccgccgugcccucccacagcaugguggggaucaccauggacgucggcgggucccccaucgugagcuccgcgggcgccuaccugauccacgggggcauggacagcacgcgccacucccucgcccacaccagccggagcucccccgccacccuggagauggccaucgagaaccugcagaaguccgagggcaucaccagccacaagagcgggcuccugaacucccaccuccaguggcugcuggacaacuacgagacggcggagggcgugagccugccgcgcuccagccucuacaaccacuaccugcggcacugccaggagcacaagcuggaccccgucaacgccgccuccuucgggaagcucauccgcagcguguucaugggccugcggacccgccggcugggcacccgcgggaacuccaaguaccacuacuacggcauccggcucaagcccgacagcccccugaaccgccugcaggaggacacccaguacauggccaugcggcagcagccgaugcaccagaagccccgcuaccggcccgcccagaagacggacucccucggggacagcggcucccacagcgggcugcacuccacccccgagcagaccauggcggugcagagccagcaccaccagcaguacaucgacgucucccacguguucccggaguuccccgcccccgaccugggcagcuuccuccugcaggacggcgugacccugcacgacgucaaggcccuccagcugguguaccgccggcacugcgaggccacggucgacguggugaugaaccugcaguuccacuacaucgagaagcucuggcugagcuucuggaacuccaaggcgagcuccagcgacgggccgaccucccugcccgccagcgacgaggaccccgagggcgccguccuccccaaggacaagcugaucucccugugccagugcgacccgauccuccgcuggaugcggagcugcgaccacauccuguaccaggcccugguggagauccucauccccgacgugcugcgccccguccccuccacccugacccaggccauccgcaacuucgccaagagccucgagggguggcugacgaacgcgauguccgacuucccgcagcaggucauccagaccaaggugggcguggugagcgccuucgcccagacccugcggcgcuacaccucccucaaccaccuggcccaggcggcccgggccgugcugcagaacacgagccagaucaaccagaugcucuccgaccugaaccgcgucgacuucgccaacgugcaggagcaggccagcugggugugccagugcgaggaguccgucgugcagcggcuggagcaggacuucaagcugacccuccagcagcagagcagccuggaccagugggcguccuggcuggacagcguggucacccaggugcucaagcagcacgccgggucccccagcuuccccaaggccgcccgccaguuccugcugaagugguccuucuacagcuccauggugauccgggaccucacccugcgcagcgcggccuccuucggcagcuuccaccugauccggcuccuguacgacgaguacauguucuaccuggucgagcaccgcguggccgaggccacgggcgagacccccaucgccgugaugggggaguucaacgaccucgcgucccugagccugacccuccuggacaaggacgacaugggcgacgagcagcggggguccgaggccggcccggacgcccgcagccugggggagccccucgucaagcgggagcgcuccgaccccaaccacagccugcagggcaucuga

SEQ ID NO: 35640 - RNA, 1242 nt, Artificial Sequence
  derived and/or modified sequence opt1 from RFX3__Homo_sapiens__NP_001269046
augcagaccagcgagaccggcuccgacacggggagcaccgugacccugcagaccuccgucgccagccaggccgcggugcccacccaggugguccagcaggucccggugcagcagcagguccagcagguccagacggugcagcagguccagcacguguaccccgcccaggugcaguacguggagggcuccgacaccguguacaccaacggggccauccgcacgaccaccuaccccuacaccgagacgcagauguacagccagaacaccggcgggaacuacuucgacacccagggcuccagcgcccaggugaccacggugguguccagccacuccauggugggcaccgggggcauccagaugggggucaccggcgggcagcucaucagcuccagcggcggcaccuaccugaucgggaacuccauggagaacagcggccacuccgugacgcacaccacccgggccagccccgcgaccaucgagauggccaucgagacgcugcagaaguccgacgggcucagcacccaccgcagcucccugcugaacagccaccuccaguggcugcuggacaacuacgagaccgccgagggcgugucccucccgcggagcacccuguacaaccacuaccugcgccacugccaggagcacaagcucgaccccgucaacgccgcguccuucggcaagcugauccggagcaucuucauggggcugcgcacgcggcgccucggcacccgggggaacuccaaguaccacuacuacggcauccgcgugaagcccgacagcccccugaaccggcugcaggaggacaugcaguacauggccaugcgccagcagccgaugcagcagaagcagcgguacaagcccaugcagaagguggacggggucgccgacggcuucaccggcuccgggcagcagaccggcacgagcguggagcagaccgucaucgcccagucccagcaccaccagcaguuccucgacgccagccgcgcgcugcccgaguucggggagguggagaucuccagccugcccgacggcaccaccuucgaggacaucaagucccuccagagccuguaccgggagcacugcgaggccauccuggacguggucgugaaccuccaguucucccugaucgagaagcuguggcagacguucuggcgcuacagcccguccacccccaccgacgggaccaccaucacggagagccggagcgaguccaccagcuuccccauccacuuccacggcuga

SEQ ID NO: 35641 - RNA, 2235 nt, Artificial Sequence
  derived and/or modified sequence opt1 from RFX4__Homo_sapiens__NP_001193620
augaucaagcgccgggcccaccccggcgccgggggcgaccgcacccggccgcgccggcgccggagcaccgaguccuggaucgagcgcugccugaacgagagcgagaacaagcgguacuccagccacacgucccucgggaacgugagcaacgacgagaacgaggagaaggagaacaaccgcgcguccaagccccacagcacccccgccacccugcaguggcuggaggagaacuacgagaucgccgagggcgucugcaucccccgguccgcccucuacaugcacuaccuggacuucugcgagaagaacgacacccagccggugaacgccgcgagcuucgggaagaucauccgccagcaguucccccagcugacgacccggcgccucggcacccggggccaguccaaguaccacuacuacgggaucgccgugaaggagagcucccaguacuacgacgucauguacagcaagaagggcgccgccuggguguccgagaccgggaagaaggaggugagcaagcagacggucgcguacagcccccgcuccaagcugggcacccugcuccccgaguucccgaacgugaaggaccugaaccugcccgccucccuccccgaggagaaggugagcaccuucaucaugauguaccggacccacugccagcgcauccuggacacggucauccgggccaacuucgacgaggugcagagcuuccugcuccacuucuggcaggggaugcccccgcacaugcugcccgugcugggcuccagcaccgucgugaacaucgugggcgucugcgacuccauccucuacaaggccaucagcggggugcugaugcccaccgugcugcaggcccuccccgacucccugacccaggucauccgcaaguucgcgaagcagcuggacgaguggcucaagguggcccugcacgaccugccggagaaccuccggaacaucaaguucgagcugagccgccgcuucucccagauccugcggcgccagacgagccucaaccaccugugccaggccucccggaccgugauccacagcgccgacaucaccuuccagaugcuggaggacuggcgcaacgucgaccucaacuccaucaccaagcagacgcuguacaccauggaggacagccgggacgagcaccgcaagcugaucacccagcucuaccaggaguucgaccaccuccuggaggagcagucccccaucgagagcuacaucgaguggcuggacaccaugguggaccggugcguggucaagguggccgcgaagcgccagggcucccugaagaaggucgcccagcaguuccugcucauguggagcugcuucgggacgcgggugauccgcgacaugacccugcacuccgcccccagcuucggcuccuuccaccugauccaccucauguucgacgacuacgugcuguaccugcucgagagccugcacugccaggagcgggccaacgagcugaugcgcgccaugaagggcgaggggagcaccgcggagguccgggaggagaucauccugaccgaggccgccgcccccacgccgucccccgugcccagcuucucccccgccaagagcgcgaccuccguggaggucccgccgcccagcucccccgugagcaaccccucccccgaguacaccggccucagcaccacgggggccaugcaguccuacaccuggagccugaccuacaccgugacgaccgccgccggcucccccgcggagaacagccagcagcugccgugcaugcgcaacacccacguccccuccagcuccgugacccaccggauccccguguacccccaccgcgaggagcacggguacaccggcagcuacaacuacggcagcuacgggaaccagcacccgcaccccaugcagucccaguaccccgcccucccccacgacacggccaucagcggcccgcugcacuacgcccccuaccaccgguccagcgcccaguaccccuucaacucccccaccagccgcauggagccgugccugauguccagcacgccccggcuccaccccacccccgucaccccgcgcuggcccgaggugcccuccgcgaacacgugcuacaccagccccuccgugcacagcgcccgcuacgggaacuccagcgacauguacaccccgcugaccacccggcgcaacuccgaguacgagcacaugcagcacuuccccggcuucgccuacaucaacggggaggccagcaccggcugggccaaguga

SEQ ID NO: 35642 - RNA, 1851 nt, Artificial Sequence
  derived and/or modified sequence opt1 from RFX5__Homo_sapiens__NP_001020774
auggccgaggacgagcccgacgccaagagcccgaagaccggcgggcgcgccccgcccggcggggccgaggccggcgagcccaccacgcugcuccagcggcugcgcgggaccaucuccaaggccgugcagaacaaggucgagggcauccugcaggacgugcagaaguucagcgacaacgacaagcucuaccuguaccugcagcuccccuccggccccaccaccggggacaagagcuccgagcccagcacgcuguccaacgaggaguacauguacgccuaccgguggauccgcaaccaccuggaggagcacaccgacacgugccuccccaagcagagcguguacgacgcguaccggaaguacugcgagucccuggccugcugccgcccgcugagcaccgccaacuucggcaagaucauccgggagaucuuccccgacaucaaggcccgccggcucgggggccgcgggcaguccaaguacugcuacagcggcauccggcgcaagacgcuggucuccaugccgccccugcccggccucgaccugaaggggagcgagucccccgagaugggccccgaggugacccccgcgccgcgggacgagcugguggaggccgccugcgcccugaccugcgacugggccgagcgcauccugaagcggagcuucuccagcaucgucgagguggcgcgcuuccugcuccagcagcaccugaucuccgcccggagcgcccacgcccacgugcugaaggccauggggcucgcggaggaggacgagcacgcgccccgcgagcggagcuccaagcccaagaacggccuggagaaccccgagggcggggcccacaagaagccggagcgccuggcccagccgcccaaggaccucgaggcccggaccggcgcggggccccuggcccgcggcgagcgcaagaaguccgucguggagagcagcgcccccggggccaacaaccuccaggugaacgcccucgucgcgcggcugccccugcuccugccccgcgcgccccggucccugaucccgcccauccccgugagcccgcccauccucgcgccccgccuguccagcggcgcccugaagguggccacccucccccuguccagccgggccggcgccccgcccgccgccguccccaucaucaacaugauccugcccaccgugccggcccuccccgggcccggccccgggccgggccgcgccccgcccgggggccugacccagccccggggcaccgagaaccgcgagguggggaucggcggggaccagggcccccacgacaagggggucaagcggacggccgaggugcccguguccgaggccagcggccaggccccgcccgcgaaggccgccaagcaggacaucgaggacaccgccuccgacgccaagcgcaagcggggccgcccccggaagaaguccgggggcagcggggagcgcaacagcacgccccugaaguccgcggccgccauggagagcgcccaguccagccggcuccccugggagaccuggggcagcggcggggagggcaacuccgccgggggcgccgagcgccccgggccgaugggcgaggccgagaagggcgccguccuggcccaggggcagggcgacgggaccgugagcaagggcgggcggggccccggcucccagcacaccaaggaggcggaggacaagaucccccuggugccgagcaaggucuccgugaucaaggggagccgcucccagaaggaggccuucccccucgccaagggcgaggucgacaccgcgccccaggggaacaaggaccugaaggagcacgugcugcagagcucccugagccaggagcacaaggaccccaaggccaccccgcccuga

SEQ ID NO: 35643 - RNA, 2787 nt, Artificial Sequence
  derived and/or modified sequence opt1 from RFX6__Homo_sapiens__NP_775831
auggccaaggugcccgagcuggaggacaccuuccuccaggcccagccggcgccccagcugagccccggcauccaggaggacugcugcguccagcugcucgggaagggccugcugguguaccccgaggagaccguguaccucgccgccgaggggcagccgggcggggagcagggcggcggggagaagggcgaggaccccgagcugcccggggccgucaaguccgagaugcaccugaacaacggcaacuucagcuccgaggaggaggacgccgacaaccacgacagcaagacgaaggcggccgaccaguaccucucccagaagaagaccaucacccagaucgugaaggacaagaagaagcagacccagcugacgcugcaguggcucgaggagaacuacaucgugugcgagggggucugccugccccgcugcauccuguacgcccacuaccucgacuucugccggaaggagaagcuggagccggccugcgcggccaccuucggcaagaccauccgccagaaguucccccugcucaccacgcggcgccugggcacccgggggcacagcaaguaccacuacuacggcaucgggaucaaggaguccagcgccuacuaccacuccguguacagcggcaagggccugacccgcuucuccgggagcaagcucaagaacgagggcggguucacccggaaguacucccugagcuccaagacgggcacccugcuccccgaguuccccagcgcccagcaccugguguaccaggggugcaucuccaaggacaaggucgacacccugaucaugauguacaagacccacugccagugcauccucgacaacgccaucaacggcaacuucgaggagauccagcacuuccugcugcacuucuggcagggcaugccggaccaccuccugccccugcucgagaaccccgugaucaucgacaucuucugcgugugcgacagcauccuguacaagguccugacggacgugcucauccccgcgaccaugcaggagaugccggagucccugcuggccgacauccgcaacuucgccaagaacugggagcaguggguggucagcagccucgagaaccugcccgaggcccugaccgacaagaagauccccaucgugcggcgcuucguguccagccucaagcggcagaccuccuuccugcaccuggcccagaucgcgcgccccgcccucuucgaccagcacgucgugaacagcaugguguccgacaucgagcgggucgaccugaacagcaucgggucccaggcccugcucacgaucagcggcuccaccgacaccgagagcgggaucuacaccgagcacgacuccaucacgguguuccaggagcugaaggaccugcugaagaagaacgccaccguggaggccuucaucgaguggcucgacaccgucguggagcagcgcgucaucaagaccagcaagcagaacggccggucccugaagaagcgcgcgcaggacuuccugcucaaguggagcuucuucggggcccgggugaugcacaaccugacgcugaacaacgccuccagcuucggcuccuuccaccucauccgcaugcugcuggacgaguacauccuccuggccauggagacccaguucaacaacgacaaggagcaggagcugcagaaccuccuggacaaguacaugaagaacagcgacgccuccaaggcggccuucaccgccagcccgagcuccugcuuccuggccaaccggaacaagggcagcaugguguccagcgacgcggucaagaacgagucccacguggagaccacguaccucccccugcccagcucccagcccgggggccuggggccggcccuccaccaguuccccgccggcaacaccgacaacaugccccugaccgggcagauggagcugagccagaucgccggccaccucaugacgcccccgaucucccccgccauggcgagccgcggcuccgugaucaaccaggggcccauggccggccggccgcccagcgucgggcccgugcuguccgcccccagccacugcuccaccuacccggagcccaucuaccccacccugccccaggccaaccacgacuucuacagcaccuccagcaacuaccagaccguguuccgcgcccagccgcacagcaccuccggccucuacccccaccacacggagcacggccgcugcauggcguggaccgagcagcagcugagccgggacuucuucuccgggagcugcgccggcucccccuacaacagccggcccccguccagcuacgggcccucccugcaggcccaggacagccacaacaugcaguuccucaacaccggcuccuucaacuuccugagcaacaccggggccgccuccugccagggcgcgacgcugccgcccaacagccccaacggcuacuacggguccaacaucaacuaccccgagagccaccgccucggcuccauggucaaccagcacgugagcgugaucuccagcauccgcagccugccgcccuacuccgacauccacgacccccugaacauccucgacgacagcgggcggaagcagaccuccagcuucuacaccgacaccuccagccccgucgccugccgcacgcccgugcuggccuccagccugcagacccccaucccguccagcuccagccagugcauguacggcaccuccaaccaguaccccgcccaggagacccucgacagccacgggacguccagccgggagaugguguccagccugcccccgaucaacaccgucuucaugggcaccgcggccggcgggaccuga

SEQ ID NO: 35644 - RNA, 1422 nt, Artificial Sequence
  derived and/or modified sequence opt1 from RFX8__Homo_sapiens__NP_001139136
auguacgagaucuacguggagaccugcggccagaacaccgagaaccaggucaaccccgccacguucgggaagugcgaggaccacagcccgaugaagaccgaccccgugggcagcccccugagcgaguuccgccggugccccuuccucgagcaggagcuggccaagaaguacuccugcaacaugauggcguuccuggccgacgaguacugcaacuacugccgcgacauccuccggaacguggaggaccugcugaccagcuucuggaagucccuccagcaggacaccgucaugcugaugagccugccggacgugugccagcuguucaagugcuacgacgugcagcuguacaaggggaucgaggacguccugcuccacgacuuccuggaggacguguccauccaguaccugaaguccgugcagcuguucuccaagaaguucaagcuguggcugcucaacgcccuggagggcguccccgcccugcuccagaucagcaagcugaaggaggugacgcuguucgugaagcgccuccggcgcaagaccuaccuguccaacauggccaagaccaugcggaugguccucaagagcaagcgccggguguccgugcucaagagcgaccugcaggcgaucaucaaccaggggacccuggccacguccaagaaggcccucgccagcgaccgcuccggcgcggacgagcuggagaacaaccccgagaugaagugccugcggaaccucaucagccugcugggcaccuccaccgaccuccgcgucuuccugagcugccugagcucccaccuccaggccuucguguuccagaccagccgguccaaggaggaguucacgaagcuggccgccagcuuccagcugcgcuggaaccuccugcugaccgccguguccaaggcgaugacccucugccaccgggacagcuucggguccuggcaccuguuccaccuccuccugcuggaguacaugauccacauccugcagagcugccucgaggaggaggaggaggaggaggacaugggcaccgucaaggagaugcugcccgacgacccgacgcuggggcagcccgaccaggcccucuuccacucccugaacagcucccugagccaggccugcgccucccccagcauggagccccucggcgugaugccgacccacauggggcagggccgcuaccccgugggcgucuccaacauggugcugcggauccugggguuccucguggacaccgccaugggcaacaagcugauccagguccugcucgaggacgagaccacggagagcgcggugaagcugucccugcccauggggcaggaggcccucaucacccugaaggacggccagcaguucgucauccagaucagcgacgugccccaguccagcgaggacaucuacuuccgcgagaacaacgccaacguguga

SEQ ID NO: 35645 - RNA, 717 nt, Artificial Sequence
  derived and/or modified sequence opt1 from RFXANK__Homo_sapiens__NP_001265656
auggagcugacccagcccgccgaggaccucauccagacccagcagacgccggccagcgagcugggcgaccccgaggaccccggggaggaggcggccgacggcuccgacaccguggugcugagccucuuccccugcaccccggagcccgugaaccccgagcccgacgccuccgugagcuccccgcaggccgggagcucccugaagcacagcaccacgcugaccaaccgccagcggggcaacgaggucuccgcccuccccgcgacccuggacugcgacaaccuggugaacaagcccgacgagcgcggguucacgccccucaucugggccagcgccuucggcgagaucgagaccgugcgguuccugcuggaguggggcgccgacccgcacauccucgcgaaggagcgcgaguccgcccugagccuggccuccaccgggggcuacaccgacaucgucgggcuccugcuggagcgggacguggacaucaacaucuacgacuggaacggcgggacgccccuccuguacgccgugcgcggcaaccacgucaagugcguggaggcccugcucgcgcggggcgccgaccugaccaccgaggccgacagcggguacacccccauggaccuggccguggcccucggcuaccgcaagguccagcaggucaucgagaaccacauccugaagcuguuccaguccaaccucgugcccgcggacccggaguga

SEQ ID NO: 35646 - RNA, 819 nt, Artificial Sequence
  derived and/or modified sequence opt1 from RFXAP__Homo_sapiens__NP_000529
auggaggcccagggcguggccgagggggcgggccccggggccgccagcggcgugccgcaccccgccgcccuggcgcccgccgccgcccccacccucgcgccggccuccguggccgccgccgcgagccaguucacccugcuggugaugcagcccugcgccgggcaggacgaggccgccgcccccggcggcuccgucggggcgggcaagcccgugcgcuaccucugcgagggggccggcgacggggaggaggaggccggcgaggacgaggccgaccugcuggacacgagcgacccgcccggcgggggcgaguccgccgcgagccucgaggaccuggaggacgaggagacccacuccgggggcgagggcagcuccgggggcgcccggcgccgggggagcggcgggggcuccaugagcaagaccugcaccuacgagggcugcuccgagacgaccagccagguggccaagcagcgcaagcccuggaugugcaagaagcaccggaacaagauguacaaggacaaguacaagaagaagaaguccgaccaggcccugaacugcgggggcaccgccagcaccggguccgcgggcaacgucaagcucgaggagagcgccgacaacauccuguccaucgugaagcagcgcacggggagcuucggcgaccggcccgcccgcccgacccugcucgagcagguccugaaccagaagcggcugagccuccugcgcucccccgagguggugcaguuccugcagaagcagcagcagcuccugaaccagcagguccuggagcagcggcagcagcaguuccccggcaccagcauguga

SEQ ID NO: 35647 - RNA, 414 nt, Artificial Sequence
  derived and/or modified sequence opt1 from RGCC__Homo_sapiens__NP_054778
augaagcccccggccgcccagggcagccccgcggccgccgccgccgcggcccccgcccuggacuccgccgcggccgaggaccucagcgacgcccugugcgaguucgacgccgugcuggccgacuucgcgucccccuuccacgagcgccacuuccacuacgaggagcaccucgagcggaugaagcgccggagcuccgccagcgucuccgacagcuccggguucagcgacuccgagagcgccgacucccuguaccgcaacagcuucuccuucagcgacgagaagcugaacuccccgaccgacagcacccccgcccuccuguccgccaccgugacgccccagaaggcgaagcugggcgacaccaaggagcucgaggccuucaucgccgaccuggacaagacccuggccagcauguga

SEQ ID NO: 35648 - RNA, 2301 nt, Artificial Sequence
  derived and/or modified sequence opt1 from RGL1__Homo_sapiens__NP_001284598
auggaggugaagcccgugggcgagccgacccaggaggugagcaaguucaagcuguccaccaagguggagagcacggggcacuggcucgucgaggaccacgugcgcaucugggaggugcugaagaccgaggaggucgagggcgaccagcugccgcccgggcacaccgugucccaguacgagaccugcaagauccggacgaucaaggccggcacccucgagaagcugguggagaaccugcucaccgccuucggggacaacgacuucaccuacaucagcaucuuccuguccacguaccgcggcuucgcgagcaccaaggagguccuggagcuccugcuggaccgguacggcaaccucaccucccccaacugcgaggaggacgggagccaguccagcuccgagagcaagauggugauccgcaacgccaucgccuccauccugcgggccuggcuggaccagugcgccgaggacuuccgcgagccgccccacuuccccugccuccagaagcugcuggacuaccucacccggaugaugcccggcagcgaccccgagcgccgggcgcagaaccugcuggagcaguuccagaagcaggagguggagacggacaacgggcuccccaacaccaucuccuucagccuggaggaggaggaggagcuggagggcggggaguccgccgaguucacgugcuucagcgaggaccucgucgccgagcagcugaccuacauggacgcccagcuguucaagaagguggugccccaccacugccucggcugcaucuggucccgccgggacaagaaggagaacaagcaccuggcgcccaccauccgcgccaccaucagccaguucaacacccugaccaagugcgucgugagcacgauccucggcgggaaggagcugaagacccagcagcgggccaagaucaucgagaaguggaucaacaucgcccacgagugccgccugcucaagaacuucuccagccugcgggccaucguguccgcgcugcagagcaacuccaucuaccgccucaagaagaccugggccgccgucccgcgggaccgcaugcugauguucgaggagcugagcgacaucuucuccgaccacaacaaccaccucaccagccgggagcugcugaugaaggagggcacguccaaguucgccaaccucgacagcuccgugaaggagaaccagaagcgcacccagcggcgccugcagcugcagaaggacaugggggugaugcagggcaccguccccuaccucggcaccuuccugacggaccugaccaugcucgacaccgcccugcaggacuacaucgagggcgggcugaucaacuucgagaagcgccggcgcgaguucgaggugaucgcgcagaucaagcugcuccagagcgccugcaacuccuacugcaugacccccgaccagaaguucauccagugguuccagcggcagcagcugcugacggaggaggagagcuacgcccucuccugcgagaucgaggccgccgcggacgccagcaccaccucccccaagccgcgcaagagcauggugaagcggcugucccuccuguuccuggggagcgacaugaucaccagccccacgcccaccaaggagcagcccaaguccaccgccagcggcuccagcggggaguccauggacagcgucuccgugagcuccugcgagagcaaccacuccgaggccgaggagggcagcaucaccccgauggacacccccgacgagccccagaagaagcuguccgagagcuccagcuccugcagcagcauccacuccauggacacgaacagcuccggcaugagcucccucaucaacccccugagcuccccgcccagcugcaacaacaaccccaagauccacaagcgcuccgucagcgugaccuccaucaccagcaccgugcugcccccggucuacaaccagcagaacgaggacacgugcaucauccggaucuccguggaggacaacaacgggaacauguacaagagcaucaugcucaccucccaggacaagacccccgccgugauccagcgcgcgaugcugaagcacaaccuggacagcgaccccgccgaggaguacgagcucguccaggugaucuccgaggacaaggagcuggugaucccggacagcgccaacgucuucuacgccaugaacucccaggugaacuucgacuucauccugcggaagaagaacagcauggaggagcaggucaagcuccgcagccggaccucccugacgcugccccgcaccgcgaagcggggcugcuggagcaaccgccacuccaagaucacccucuga

SEQ ID NO: 35649 - RNA, 2334 nt, Artificial Sequence
  derived and/or modified sequence opt1 from RGL2__Homo_sapiens__NP_004752
augcugccccgcccgcuccggcugcugcucgacaccuccccgcccggcggggugguccuguccagcuuccgcucccgggaccccgaggagggcgggggccccgggggccugguggugggcgggggccaggaggaggaggaggaggaggaggaggaggcccccgucagcgugugggacgaggaggaggacggggccguguucaccgucacgucccgccaguaccggccccucgacccccuggugccgaugcccccgccccgcagcucccggcgccugcgggcgggcacccucgaggcccuggugcgccaccuccucgacacccggaccagcgggacggacgucuccuucaugagcgccuuccuggccacccaccgcgccuucaccuccacccccgcgcugcucggccugauggccgaccggcuggaggcccucgagagccaccccacggacgagcuggagcgcaccaccgagguggccaucuccgugcugagcaccuggcucgcgucccaccccgaggacuucggcagcgaggccaaggggcagcuggaccggcuggaguccuuccuccugcagacgggcuacgccgccgggaagggcgucggcgggggcagcgccgaccugauccgcaaccuccggucccgcguggacccccaggcgccggaccugcccaagccccuggcccuccccggggacccgcccgccgaccccaccgacgugcuggucuuccuggccgaccaccucgccgagcagcugacccugcucgacgcggagcuguuccugaaccugauccccagccagugccugggcgggcuguggggccaccgggaccgcccgggccacagccaccucugccccuccgugcgggccaccgugacgcaguucaacaaggucgccggggccguggugagcuccguccugggcgccaccagcaccggggagggccccggggaggugaccauccgcccccugcgcccgccccagcgggcgcgccuccuggagaaguggauccggguggccgaggagugccgccugcuccggaacuucuccagcgucuacgccguggucuccgcccugcagagcucccccauccaccgccugcgggccgcguggggcgaggccacgcgcgacagccugcggguguucuccagccucugccagaucuucuccgaggaggacaacuacagccagucccgcgagcugcuggugcaggaggucaagcuccagagcccgcuggagccccacuccaagaaggcgccccggagcggcucccgcgggggcgggguggugcccuaccugggcaccuuccucaaggaccuggucaugcuggacgccgccagcaaggacgagcucgagaacggguacaucaacuucgacaagcggcgcaaggaguucgccgugcugagcgagcugcggcgccuccagaacgagugccggggcuacaaccugcagccggaccacgacauccagcgcuggcugcagggccuccggccccugaccgaggcccagucccaccgcgugagcugcgaggucgagccgcccggguccagcgacccgcccgccccgcgcgugcugcggcccacccucgugaucucccaguggacggagguccugggcagcgugggggugcccacgccccuggucuccugcgaccgccccagcaccggcggcgacgaggcccccaccacccccgcgccccuccugacccggcuggcccagcacaugaaguggcccuccgugagcucccucgacagcgcccuggaguccagccccucccugcacagcccggccgaccccucccaccucuccccgcccgccagcagcccccgccccagccgggggcaccgccgguccgcgagcugcggcagcccccugagcgggggcgccgaggaggccuccgggggcaccggcuacgggggcgaggggagcggcccgggggccuccgacugccgcaucauccgggugcagauggagcugggcgaggacggcagcgucuacaaguccauccucgugaccagccaggacaaggcccccuccgugaucagccgcguccugaagaagaacaaccgggacuccgcgguggccagcgaguacgagcuggugcagcuccugcccggggagcgcgagcugacgauccccgccuccgccaacgucuucuacgcgauggacggcgccagccacgacuuccuccugcggcagcgccggcgcuccagcaccgccaccccgggggugaccagcggccccuccgccagcgggacgccgcccuccgagggcggcgggggcagcuucccccggaucaaggccaccgggcgcaagaucgcgcgggcccuguucuga

SEQ ID NO: 35650 - RNA, 1422 nt, Artificial Sequence
  derived and/or modified sequence opt1 from RGL4__Homo_sapiens__NP_705843
augcgcaagcugcucaccaaccugcccgccgccgcggugcugagcgcccaggucuacuccgccgugcuccagggccugugggaggagaacgugugcgggaccccgggccggacgcgcgucugcaccgcccugcucuacggccaggugugccccuuccaggacagcaccgacggccugcggaccaucacguccauccuguucaacuggccgcccgagaacaccagcguguacuaccagccgccccagcgcuccagcuuccggaucaagcucgccuuccgcaaccuguccuggcccgggcugggccucgaggaccaccaggagaucguccugggccagcuggugcuccccgagccgaacgaggcgaagcccgacgaccccgccccgcggcccgggcagcacgcccugaccaugcccgcccuggagcccgcgcccccgcuccuggccgaccugggccccgcccucgagcccgagagccccgccgcccuggggccgcccggcuaccugcacuccgcgcccgggcccgccccggcccccggcgaggggcccccgcccgggaccgugcucgagccccagagcgcccccgaguccagcugccccugccgcggcuccgucaagaaccagcccagcgaggagcugcccgacaugacgaccuucccgccccggcugcucgccgagcagcugacccugauggacgcggagcuguucaagaagguggugcuccacgagugccuggggugcaucuggggccagggccaccucaaggggaacgagcacauggcccccaccguccgcgccacgaucgcccacuucaaccggcugaccaacugcaucaccaccuccugccugggcgaccacagcaugcgcgcccgggaccgcgcgcgggugguggagcacuggaucaaggucgcccgcgagugccucucccugaacaacuucagcuccgugcacgugaucgucagcgcccugugcagcaaccccaucgggcagcuccacaagacgugggccggcguguccagcaaguccaugaaggagcugaaggagcugugcaagaaggacaccgccgugaagcgggaccuccugaucaaggcggggagcuucaaggucgccacccaggagcgcaacccccagcgggugcagaugcgccugcggcgccagaagaagggcguggucccguuccucggcgacuuccugaccgagcugcagcgccucgacuccgccauccccgacgaccuggacgggaacacgaacaagcggagcaaggaggugcgcguccugcaggagaugcagcugcuccagguggccgcgaugaacuaccggcugcgcccccuggagaaguucgugaccuacuucacccggauggagcagcucuccgacaaggagagcuacaagcuguccugccagcuggagcccgagaacccguga

SEQ ID NO: 35651 - RNA, 1377 nt, Artificial Sequence
  derived and/or modified sequence opt1 from RGMA__Homo_sapiens__NP_001159755
augggcgggcugggcccccgccgggccgggaccagccgcgagcggcucguggucaccggccgcgccggguggaugggcaugggccgcggggccggccgcuccgcccugggguucuggccgacgcuggccuuccuccugugcagcuuccccgccgccaccucccccugcaagauccugaagugcaacagcgaguucugguccgcgaccagcggcucccacgcccccgccagcgacgacaccccggaguucugcgccgcgcuccgguccuacgcccugugcacgcgccggaccgcccggaccugccgcggggaccuggccuaccacagcgccgugcacggcaucgaggaccucaugucccagcacaacugcagcaaggacggccccaccucccagccccggcugcggacgcugcccccggcgggggacagccaggagcgcuccgacagccccgagaucugccacuacgagaaguccuuccacaagcacagcgccacccccaacuacacccacugcggccucuucggggacccccaccuccggaccuucacggaccgcuuccagaccugcaaggugcagggcgccuggccgcugaucgacaacaacuaccugaacguccaggugaccaacacccccgugcugcccggcuccgccgccacggcgaccagcaagcugaccaucaucuucaagaacuuccaggagugcgucgaccagaagguguaccaggccgagauggacgagcuccccgccgccuucguggacgggagcaagaacggcggggacaagcacggcgccaacucccugaagaucaccgagaaggucagcgggcagcacguggagauccaggcgaaguacaucggcacgaccaucgugguccgccaggugggccgguaccugaccuucgccgugcggaugccggaggaggucgugaacgccguggaggacugggacucccaggggcucuaccugugccugcgcggcugcccccucaaccagcagaucgacuuccaggccuuccacaccaacgccgaggggacgggcgcgcggcgccuggccgccgccagccccgcgcccaccgccccggagaccuuccccuacgagaccgccgucgccaagugcaaggagaagcugcccguggaggaccucuacuaccaggccugcguguucgaccugcugacgaccggggacgucaacuucacccucgcggccuacuacgcccuggaggacgugaagaugcugcacuccaacaaggacaagcuccaccuguacgagcgcacccgggaccugcccggccgcgccgccgcgggccucccgcuggcgccccggccccugcucggggcccuggugccccugcucgcccugcugccggucuucugcuga

SEQ ID NO: 35652 - RNA, 1437 nt, Artificial Sequence
  derived and/or modified sequence opt1 from RGMB__Homo_sapiens__NP_001012779
augauccgcaagaagcggaagcgcagcgcgcccccgggccccugccggucccacgggccccgccccgccaccgccccggccccgccgcccagccccgagcccacccggcccgccuggaccggcauggggcugcgcgccgcccccuccagcgcggccgccgccgcggccgagguggagcagcggcgcucccccggccucugcccgccgccccuggagcugcuccugcugcuccuguucagccuggggcuccugcacgccggcgacugccagcagcccgcccagugccggauccagaagugcaccaccgacuucgucucccugaccagccaccucaacuccgccguggacggcuucgacagcgaguucugcaaggcgcugcgcgccuacgccgggugcacgcagcggaccuccaaggccugccgcggcaaccugguguaccacagcgccguccucgggaucuccgaccugaugagccagcggaacugcuccaaggacggccccaccagcuccaccaaccccgaggugacgcacgaccccugcaacuaccacagccacgcgggggcccgcgagcaccggcgcggcgaccagaacccgcccuccuaccuguucugcggccucuucggggacccccaccuccggaccuucaaggacaacuuccagaccugcaagguggagggcgccuggccccugaucgacaacaacuaccugagcguccaggugaccaacgugcccgucgugcccgggagcuccgccacggccaccaacaagaucaccaucaucuucaaggcgcaccacgagugcaccgaccagaagguguaccaggccgucacggacgaccugcccgccgccuucguggacggcaccaccagcggcggggacuccgacgccaagagccugcgcaucguggagcgggaguccggccacuacgucgagaugcacgcgcgcuacaucgggaccacgguguucgugcggcaggucggccgcuaccucacccuggccauccgcaugcccgaggaccuggccaugagcuacgaggagucccaggaccuccagcugugcgugaacgggugcccgcugagcgagcggaucgacgacggccagggccagguguccgccauccucgggcacagccugccccgcaccucccugguccaggcguggcccggcuacacccucgagacggccaacacccagugccacgagaagaugccggugaaggacaucuacuuccagagcugcguguucgaccugcugaccaccggggacgccaacuucacggccgccgcgcacuccgcccucgaggacgucgaggcccugcacccccggaaggagcgcuggcacaucuuccccagcuccggcaacgggacgccccggggcggcagcgaccuguccgugagccucgggcugaccugccugauccucaucgucuuccuguga

SEQ ID NO: 35653 - RNA, 900 nt, Artificial Sequence
  derived and/or modified sequence opt1 from RGN__Homo_sapiens__NP_004674
augagcuccaucaagaucgagugcgugcugcccgagaacugccgcugcggcgagagcccggucugggaggagguguccaacagccuccuguucguggacauccccgccaagaaggucugccggugggacuccuucaccaagcagguccagcgcgugaccauggacgcccccgugagcuccguggcgcugcggcagagcgggggcuacguggccacgaucgggaccaaguucugcgcccucaacuggaaggagcaguccgccgucgugcuggccaccguggacaacgacaagaagaacaaccgcuucaacgacggcaaggucgaccccgcggggcgguacuucgccggcaccauggccgaggagacggccccggcggugcuggagcgccaccagggcgcccucuacagccuguuccccgaccaccacgugaagaaguacuucgaccaggucgacaucuccaacgggcuggacuggagccucgaccacaagaucuucuacuacaucgacucccugagcuacuccguggacgccuucgacuacgaccugcagaccggccagaucagcaaccggcgcuccguguacaagcucgagaaggaggagcagauccccgacgggaugugcaucgacgccgagggcaagcugugggucgccugcuacaacgggggccgggugauccgccuggaccccgugaccggcaagcggcuccagaccgucaagcugccgguggacaagacgaccagcugcugcuucgggggcaagaacuacuccgagauguacgugaccugcgcgcgcgacgggauggaccccgagggccugcuccggcagcccgaggccggcgggaucuucaagaucaccggccugggggucaagggcaucgcccccuacagcuacgccggguga

SEQ ID NO: 35654 - RNA, 5271 nt, Artificial Sequence
  derived and/or modified sequence opt1 from RGPD2__Homo_sapiens__NP_001071638
augcgccggagcaaggccuacggcgagcgcuaccuggccuccgugcaggggagcgcccccucccccggcaagaagcuccggggguucuacuucgccaagcuguacuacgaggccaaggaguacgaccuggccaagaaguacgugugcaccuaccucagcgugcaggagcgcgacccccgggcccaccgcuuccugggccugcucuacgagcuggaggagaacaccgagaaggccguggagugcuaccggcgcucccuggagcucaacccgccccagaaggaccugguccugaagaucgccgagcuccugugcaagaacgacgugaccgacgggcgggccaaguacuggguggagcgcgccgcgaagcuguucccgggcagccccgccaucuacaagcucaaggagcaccuccuggacugcgagggcgaggacggguggaacaagcuguucgacuggauccaguccgagcuguacguccggcccgacgacgugcacaugaacauccgccugguggagcucuaccggagcaacaagcgccugaaggacgccgucgcccggugccacgaggccgagcgcaacaucgcgcugcgguccagccucgaguggaacuccugcguggugcagacccugaaggaguaccuggagagccuccagugccuggaguccgacaagagcgacuggcgcgccaccaacaccgaccugcuccuggccuacgccaaccugaugcuccugacccuguccacccgggacguccaggagagccgcgagcuccuggaguccuucgacagcgcccugcaguccgccaagagcagccucggcgggaacgacgagcuguccgcgaccuuccuggagaugaagggccacuucuacaugcacgccgggagccuccugcugaagaugggccagcacggcaacaacgugcaguggcaggcccucuccgagcuggccgcgcugugcuacgugaucgccuuccaggucccccggcccaagaucaagcucaucaagggggaggccggccagaaccugcuggagaugauggccugcgaccgccugagccaguccgggcacaugcuccugaaccugagccgcggcaagcaggacuuccucaaggaggugguggagaccuucgccaacaaguccggccagagcguccuguacaacgcgcuguucuccagccaguccagcaaggacacguccuuccucgggagcgacgacaucggcaacaucgacgugcaggagcccgagcuggaggaccuggcccgguacgacgugggggccauccaggcccacaacggcucccuccagcaccugaccuggcuggggcuccaguggaacagccugcccgcgcugcccggcauccgcaaguggcucaagcagcuguuccaccaccucccccaggagaccucccggcuggagaccaacgcccccgagagcaucugcauccuggaccuggaggucuuccuccugggcgugguguacacgucccaccuccagcucaaggagaagugcaacagccaccacagcuccuaccagccccugugccugccccucccggucugcaagcgccugugcaccgagcggcagaaguccuggugggacgccgugugcacccugauccaccgcaaggccguccccgggaacagcgccgagcuccggcugguggugcagcacgagaucaacacccugcgcgcgcaggagaagcacggccuccagcccgcccugcugguccacugggccaagugccuccagaagauggggcggggccugaacagcuccuacgaccagcaggaguacaucgggcgcagcgugcacuacuggaagaaggugcugccccuccugaagaucaucaagaagaacuccaucccggagcccaucgacccccuguucaagcacuuccacagcgucgacauccaggccuccgagaucguggaguacgaggaggacgcccacaucacguucgcgauccucgacgccgugcacggcaacaucgaggacgccgucaccgccuucgagagcaucaaguccguggugagcuacuggaaccuggcccugaucuuccaccggaaggcggaggacaucgagaacgacgccgucuuccccgaggagcaggaggagugcaagaacuaccuccgcaagacccgggacuaccugaucaagaucaucgacgacuccgacagcaaccuguccguggugaagaagcucccggucccccuggagagcgugaaggagaugcugaaguccgugaugcaggagcucgaggacuacagcgagggcgggccccuguacaagaacggcagccugcgcaacgccgacuccgagaucaagcacagcacccccuccccgacgaaguacagccucucccccagcaaguccuacaaguacagccccaagaccccgccccggugggccgaggaccagaacucccugcgcaagaugaucugccaggaggucaaggcgaucaccaagcugaacagcuccaagagcgccucccggcaccgcuggcccaccgagaacuacgggcccgacagcgugccggacggcuaccaggggucccagacguuccacggcgcgccccugaccguggccaccaccggccccagcgucuacuacucccagagccccgccuacaacucccaguaccugcugcggccggcggccaacgugacgcccaccaaggggagcagcaacaccgaguucaaguccaccaaggagggcuucagcaucgccguguccgccgacggguucaaguucggcaucagcgagcccggcaaccaggagaagaaguccgagaagccccucgagaacgacacgggguuccaggcccaggacaucagcggccagaagaacgggcgcggcgucaucuucgggcagaccuccagcaccuucaccuucgcggacguggccaaguccacgagcggcgagggcuuccaguucgggaagaaggacccgaacuucaagggcuucuccggggccggcgagaagcuguucagcucccagugcgggaagauggccaacaaggccaacaccagcggcgacuucgagaaggacgacgacgcgugcaagaccgaggacuccgacgacauccacuucgagcccgugguccagaugcccgagaagguggagcuggugaccggcgaggagggggagaagguccucuacagccagggcgugaagcuguuccgcuucgacgccgagaucucccaguggaaggagcgggggcugggcaaccucaagauccugaagaacgaggugaacgggaagccccgcaugcugaugcggcgcgaccagguccucaaggugugcgccaaccacuggaucaccacgaccaugaaccugaagccgcugagcggcuccgaccgggccuggauguggcucgcgagcgacuucagcgacggcgacgccaagcuggagcgccuggccgcccaguucaagacccccgagcucgccgaggaguucaagcagaaguucgaggagugccagcggcugcugcucgacaucccccugcagacgccccacaagcugguggacacggggcgcgcggccaagcucauccagcgggccgaggagaugaaguccggccugaaggacuucaagaccuuccugaccaacgaccagaccaaggucacggaggaggagaacaaggggagcggcaccggggccgccggcgcguccgacaccaccaucaagccgaaccccgagaacacgggccccacccucgagugggacaacuacgaccugcgcgaggacgcccuggacgacaacgugagcuccagcuccgugcacgacagcccccucgccuccagcccgguccggaagaacaucuuccgcuucgacgaguccaccaccggguucaacuucagcuucaaguccgcccugagccuguccaagagccccgccaagcucaaccaguccggcacgagcguggggaccgacgaggaguccgacgugacccaggaggaggagcgggacggccaguacuucgagcccgucgugccgcugcccgaccugguggaggucagcagcggcgaggagaacgagcaggucguguucucccacauggcggagcucuaccgcuacgacaaggacgucgggcaguggaaggagcggggcaucggggacaucaagauccugcagaacuacgacaacaagcagguccgcaucgugaugcggcgcgaccaggugcugaagcugugcgccaaccaccggaucacccccgacaugagccuccagaacaugaagggcacggagcgcgugugggucuggaccgccugcgacuucgccgacggggagcggaagguggagcaccuggccgugcgcuucaagcugcaggacgucgcggacuccuucaagaagaucuucgacgaggccaagaccgcccaggagaaggacagccucaucacgccccacgugucccgcagcuccacgccgcgggagagccccugcggcaagaucgccguggcgguccuggaggagaccacccgcgagcggaccgacgugauccagggcgacgacguggccgacgccgccuccgaggucgaggugagcuccacgagcgagaccaccaccaaggccguggucagcccgcccaaguucguguucgggagcgaguccgugaagcgcaucuucagcuccgagaaguccaacccguucgcguucggcaacuccagcgccacggggagccuguucggcuucuccuucaacgcgccccucaagagcaacgacuccgagaccagcuccgucgcccagagcggguccgagagcaagguggagcccaagaagugcgagcuguccaagaacagcgacaucgagcaguccagcgacuccaaggugaagaaccugagcgccuccuuccccauggaggagagcuccaucaacuacaccuucaagaccccggagaaggagccgccccucuggcacgcggaguucacgaaggaggagcugguccagaagcugagcuccaccaccaagagcgccgaccagcucaacggccugcugcgggagaccgaggccaccagcgccgugcucauggagcagaucaagcugcugaaguccgagauccgccggcucgagcgcaaccaggaggagagcgccgcgaacguggagcaccugaagaacguccugcuccaguucaucuuccugaagcccggcuccgagcgggagagccugcucccggugaucaacacgaugcugcagcugucccccgaggagaaggggaagcucgccgccguggcccagggccugcaggagaccagcauccccaagaagaaguga

SEQ ID NO: 35655 - RNA, 876 nt, Artificial Sequence
  derived and/or modified sequence opt1 from RGR__Homo_sapiens__NP_001012738
auggccgagaccuccgcccugcccaccggcuucggggagcucgaggugcuggcggucggcauggugcugcucguggaggcccuguccgggcugagccucaacacgcugaccaucuucuccuucugcaagaccccggagcugcgcacccccugccaccuccugguccugagccucgcccuggccgacuccggcaucagccugaacgcccucguggcggccacguccagccugcugcggcgcuggcccuacggguccgacggcugccaggcccacggcuuccagggguucgugaccgcccucgcgagcaucugcuccagcgccgccaucgccuggggccgguaccaccacuacugcacccgcucccagcuggccuggaacagcgcggucucccuggugcuguucguguggcugagcuccgccuucugggccgcccugccccuccugggguggggccacuacgacuacgagccgcuggggaccugcugcacgcucgacuacagcaagggcgaccggaacuucaccuccuuccuguucaccaugagcuucuucaacuucgccaugccccuguucaucaccaucacgagcuacucccucauggagcagaagcugggcaagagcgggcaccuccaggucaacaccacccuccccgcgcgcacccugcugcucggcugggggcccuacgccauccuguaccuguacgccgugaucgccgacgugacguccaucagcccgaagcuccagaugguccccgcccugaucgcgaagauggugcccaccaucaacgccaucaacuacgcccugggcaacgagauggugugccggggcaucuggcagugccucagcccccagaagcgcgagaaggaccggaccaaguga

SEQ ID NO: 35656 - RNA, 546 nt, Artificial Sequence
  derived and/or modified sequence opt1 from RGS10__Homo_sapiens__NP_001005339
auguucaaccgcgccgugagccggcugucccgcaagcggcccccgagcgacauccacgacuccgacggcagcuccagcuccagccaccagucccucaagagcaccgccaagugggcggccucccuggagaaccugcucgaggaccccgagggggucaagcgcuuccgggaguuccugaagaaggaguucagcgaggagaacgugcuguucuggcucgccugcgaggacuucaagaagaugcaggacaagacccagaugcaggagaaggccaaggagaucuacaugacguuccuguccagcaaggccuccagccaggugaacgucgagggccagucccgccugaacgagaagauccucgaggagccccacccccugauguuccagaagcugcaggaccagaucuucaaccucaugaaguacgacagcuacucccgguuccucaagagcgaccuguuccugaagcacaagcgcaccgaggaggaggaggaggaccugccggacgcgcagaccgccgccaagcgggccagccgcaucuacaacaccuga

SEQ ID NO: 35657 - RNA, 1341 nt, Artificial Sequence
  derived and/or modified sequence opt1 from RGS11__Homo_sapiens__NP_003825
auggagcgcguggucgugagcaugcaggaccccgaccagggcgugaagaugcggucccagcgccugcucgucaccgugaucccgcacgccgugaccgggagcgacgucgugcaguggcuggcccagaaguucugcguguccgaggaggaggcgcugcaccucggcgccguccuggugcagcacggguacaucuacccccugcgggacccccgcagccucaugcugcggcccgacgagacgccguaccgcuuccagacccccuacuucuggaccuccacccugcggcccgccgccgagcucgacuacgccaucuaccuggcgaagaagaacauccgcaagcggggcacgcugguggacuacgagaaggacugcuacgaccgccuccacaagaagaucaaccacgccugggaccugguccugaugcaggcccgggagcagcuccgcgccgcgaagcagcggagcaagggggaccgccuggugaucgccugccaggagcagaccuacuggcuggugaaccggcccccgcccggcgcccccgacguccucgagcagggccccgggcgcggcuccugcgccgccagccgggugcugaugaccaaguccgcggacuuccacaagcgcgagaucgaguacuuccggaaggcccuggggcgcacccgggucaagagcuccgugugccucgaggccuaccugagcuucugcggccagcgcgggccgcacgacccccugguguccggcugccuccccagcaaccccuggaucuccgacaacgacgccuacugggugaugaacgccccgacggucgcggcccccaccaagcugcgcguggagcgguggggcuucagcuuccgcgagcugcucgaggaccccguggggcgggcccacuucauggacuuccugggcaaggaguucuccggggagaaccugagcuucugggaggccugcgaggagcuccgcuacggcgcccaggcgcagguccccacccugguggacgccgucuacgagcaguuccuggccccgggcgccgcccacugggugaacaucgacucccggaccauggagcagacgcucgaggggcugcgccagccccaccgguacgugcuggacgacgcgcagcuccacaucuacaugcugaugaagaaggacagcuacccccgcuuccucaagagcgacauguacaaggcccugcuggccgaggccggcaucccccuggagaugaagcggcgcgucuucccguucaccuggcggccccgccacuccagccccucccccgcgcuccugccgacccccguggagcccaccgccgccugcgggccgggcgggggcgacggcguggccuga

SEQ ID NO: 35658 - RNA, 2400 nt, Artificial Sequence
  derived and/or modified sequence opt1 from RGS12__Homo_sapiens__NP_937870
augaaccugggcaaggagcucagcaacgagacccacguguccaacgaccagcagagcgccaccgucuccgacggggagcugacgggcgccgaccugaaggacugcgugagcaacaacucccucagcuccaacgcgagccugcccuccgugcagagcugccgccggcugcgcgagcggcgcgucgccuccugggccgugagcuucgagcggcuccugcaggacccgguggggguccgcuacuucuccgacuuccugcggaaggaguucagcgaggagaacauccucuucuggcaggccugcgaguacuucaaccacgugcccgcccacgacaagaaggagcuguccuaccgcgcgcgggagaucuucagcaaguuccugugcuccaaggccaccacccccgugaacaucgacagccaggcccagcucgccgacgacguccugcgcgcgccccacccggacauguucaaggagcagcagcugcagaucuucaaccucaugaaguucgacuccuacacccgguuccucaagagcccccuguaccaggagugcauccuggccgagguggagggccgcgcccugcccgacagccagcagguccccuccagcccggccuccaagcacagccugggguccgaccacagcuccgugagcacgcccaagaagcucuccggcaagagcaaguccggccggagccugaacgaggagcugggggacgaggacuccgagaagaagcgcaagggcgccuucuucagcuggucccggacccgcagcaccgggcggucccagaagaagcgcgagcacggcgaccacgcggacgacgcccuccacgccaacgggggccugugccggcgcgagagccagggcuccgugagcagcgccgggucccuggaccucagcgaggccugccggacccuggcgcccgagaaggacaaggccacgaagcacugcugcauccaccuccccgacggcaccuccugcguggucgccgugaaggccggguucagcaucaaggacauccuguccggccugugcgagcgccacggcaucaacggggccgcggccgaccuguuccucgugggcggggacaagccgcugguccugcaccaggacagcuccauccucgagagccgcgaccugcggcuggagaagcgcacccucuuccggcuggaccuggugcccaucaaccgcuccgugggccucaaggccaagcccaccaagcccgucacggaggugcugcggccgguggucgcccgcuacgggcuggaccucagcggccugcuggugcggcucuccggcgagaaggagccccuggaccugggggcccccaucagcucccuggacggccagcgcgucgugcucgaggagaaggaccccagccgggggaaggcguccgccgacaagcagaagggcgugccggucaagcagaacaccgccgugaacagcuccagccgcaaccacagcgccaccggggaggagcggacccugggcaaguccaacagcaucaagaucaagggcgagaacgggaagaacgcgcgcgacccccggcuguccaagcgcgaggagagcaucgccaagaucggcaagaagaaguaccagaagaucaaccucgacgaggccgaggaguucuucgagcugaucuccaaggcccagagcaaccgggccgacgaccagcgcgggcugcuccggaaggaggaccuggugcugcccgaguuccuccgccugcccccgggcuccacggagcugacccuccccacccccgcggccgucgccaagggguucagcaagcgguccgccaccggcaacggccgcgagagcgccucccagcccggggagcagugggagccggugcaggagagcuccgacagccccuccacgagccccggcuccgcgagcuccccgcccgggccgcccggcaccaccccgcccggccagaagucccccagcgggcccuucugcacgccccagagccccgugagccuggcccaggagggcaccgcccagaucuggaagcgccagucccaggaggucgaggccgggggcauccagaccguggaggacgagcacguggccgagcugacccucaugggggagggcgacaucagcucccccaacagcacccugcugcccccgcccuccacgccccaggagguccccggcccgagccggcccggguccggcacccacgggagccgcgaccuccccgugaaccggaucaucgacguggaccuggucaccggcuccgcgcccgggcgcgacggcggcaucgccggggcccaggccggcccggggcggagccaggcguccggcgggccgcccaccagcgaccugcccggccucggccccgugcccggggagcccgccaagccgaagacguccgcccaccacgccaccuucguguga

SEQ ID NO: 35659 - RNA, 480 nt, Artificial Sequence
  derived and/or modified sequence opt1 from RGS13__Homo_sapiens__NP_002918
augagccgccggaacugcuggaucugcaagaugugccgcgacgaguccaagcggcccccgagcaaccugacccucgaggaggugcugcagugggcccaguccuucgagaaccugauggccaccaaguacggccccgucguguacgcggccuaccucaagauggagcacagcgacgagaacauccaguucuggauggccugcgagacguacaagaagaucgccucccgcuggagccggaucucccgcgccaagaagcuguacaagaucuacauccagccccagagcccccgggagaucaacaucgacuccagcacccgcgagaccaucauccggaacauccaggagccgaccgagacgugcuucgaggaggcgcagaagaucguguacaugcacauggagcgcgacuccuacccccgguuccucaagagcgagauguaccagaagcugcugaagaccaugcaguccaacaacagcuucuga

SEQ ID NO: 35660 - RNA, 1701 nt, Artificial Sequence
  derived and/or modified sequence opt1 from RGS14__Homo_sapiens__NP_006471
augcccggcaagccgaagcaccugggggugcccaacggccgcaugguccucgccgugagcgacggggagcuguccagcaccaccggcccccaggggcagggcgagggccggggguccagccuguccauccacagccuccccuccggcccgagcucccccuuccccacggaggagcagcccguggccagcugggcgcuguccuucgagcgccugcuccaggacccgcuggggcuggccuacuucaccgaguuccucaagaaggaguucagcgccgagaacgucaccuucuggaaggccugcgagcgguuccagcagauccccgccuccgacacccagcagcuggcgcaggaggcccgcaacaucuaccaggaguuccugagcucccaggcccucagccccgugaacaucgaccggcaggccuggcugggcgaggaggugcuggcggagccccgcccggacauguuccgggcccagcagcuccagaucuucaaccugaugaaguucgacuccuacgcccgcuucgucaagagcccccuguaccgggagugccuccuggccgaggccgaggggcgcccccugcgggagcccggcuccagccgccucggcagcccggacgcgacgcggaagaagcccaagcugaagcccgggaagucccugccccucggcguggaggagcuggggcagcugccgcccguggagggccccggcgggcgcccccuccggaaguccuuccgccgggagcugggcgggaccgccaacgccgcccugcgccgggagucccagggcagccucaacuccagcgccucccuggaccugggguuccucgcguucgucagcuccaagagcgagucccaccgcaagagccugggcuccaccgagggcgagagcgagucccggccggggaaguacugcugcguguaccugcccgacggcaccgccagccucgcccuggcccgccccgggcugacgauccgcgacaugcucgccggcaucugcgagaagcgggggcugucccugcccgacaucaagguguaccucgucggcaacgagcaggcgcuggugcuggaccaggacugcaccgugcucgccgaccaggagguccgccuggagaaccggaucaccuucgagcuggagcucaccgcccuggagcgcguggugcggaucagcgccaagccgacgaagcgccugcaggaggcccugcagcccauccucgagaagcacggccugagcccccuggaggucgugcuccaccggccgggggagaagcagccccuggaccugggcaagcucgugagcagcgucgcggcccagcgccuggugcuggacacccuccccggggugaagaucuccaaggcccgggacaagagccccugccgcucccagggcugcccgccccggacccaggacaaggccacccacccgccgcccgcgagccccuccagccuggucaaggugcccuccagcgccacggggaagcgccagaccugcgacaucgagggccuggucgagcuccugaaccgggugcaguccagcggcgcccacgaccagcgcgggcugcuccggaaggaggaccuggugcugcccgaguuccuccagcugcccgcccagggccccuccagcgaggagaccccgccccagaccaaguccgccgcgcagcccaucgggggcagccugaacuccacgaccgacagcgcccucuga

SEQ ID NO: 35661 - RNA, 609 nt, Artificial Sequence
  derived and/or modified sequence opt1 from RGS16__Homo_sapiens__NP_002919
augugccgcacccuggccgccuuccccaccacgugccucgagcgggcgaaggaguucaagacccgccugggcaucuuccugcacaagagcgagcucgggugcgacaccggcuccaccgggaaguucgaguggggcagcaagcacuccaaggagaaccggaacuucagcgaggacgugcugggguggcgcgaguccuucgaccugcuccugagcuccaagaacggcgucgccgccuuccacgccuuccugaagacggaguucagcgaggagaaccucgaguucuggcuggccugcgaggaguucaagaagauccgguccgcgaccaagcuggccagccgcgcccaccagaucuucgaggaguucaucugcuccgaggccccgaaggaggugaacaucgaccacgagacccacgagcucacccggaugaaccugcagacggcgaccgcgaccugcuucgacgccgcccagggcaagacccgcacgcugauggagaaggacagcuacccccgguuccucaagucccccgccuaccgcgaccuggccgcccaggccagcgccgccuccgcgacccugagcuccugcagccucgacgagcccucccacaccuga

SEQ ID NO: 35662 - RNA, 666 nt, Artificial Sequence
  derived and/or modified sequence opt1 from RGS17__Homo_sapiens__XP_011534055
augagcucccagcugggccccgagguggccgagaugcgcaagcggcagcagagccagaacgaggggaccccggccgucucccaggcgcccggcaaccagcgccccaacaacacgugcugcuucugcuggugcugcugcugcagcugcuccugccucaccgugcggaacgaggagcgcggggagaacgccggccggcccacccacaccaccaagauggagagcauccaggugcuggaggagugccagaacccgacggccgaggagguccuguccuggagccagaacuucgacaagaugaugaaggcccccgccgggcgcaaccucuuccgggaguuccugcgcaccgaguacuccgaggagaaccuccuguucuggcuggcgugcgaggaccugaagaaggagcagaacaagaaggugaucgaggagaaggcccggaugaucuacgaggacuacaucagcauccucucccccaaggaggugagccuggacucccgcguccgggaggugaucaaccgcaaccugcucgaccccaacccgcacauguacgaggacgcccagcugcagaucuacacccugaugcaccgggacagcuucccccgcuuccucaacucccagaucuacaagagcuucguggaguccaccgccggcagcuccagcgagagcuga

SEQ ID NO: 35663 - RNA, 708 nt, Artificial Sequence
  derived and/or modified sequence opt1 from RGS18__Homo_sapiens__NP_570138
auggagaccacccuccuguucuucagccagaucaacaugugcgaguccaaggagaagaccuucuucaagcugauccacggcagcgggaaggaggagaccuccaaggaggccaagauccgcgccaaggagaagcggaaccgccugagccuccuggugcagaagcccgaguuccacgaggacacccgguccagccgcuccggccaccuggcgaaggagacccgggucagcccggaggaggccgugaaguggggcgaguccuucgacaagcuccugagccaccgcgacgggcuggaggccuucacgcgguuccucaagaccgaguucuccgaggagaacaucgaguucuggaucgccugcgaggacuucaagaaguccaaggggccccagcagauccaccugaaggccaaggcgaucuacgagaaguucauccagaccgacgcccccaaggaggugaaccuggacuuccacaccaaggaggucaucacgaacagcaucacccagcccacccuccacagcuucgacgccgcccagucccgcguguaccagcugauggagcaggacagcuacacccgguuccugaaguccgacaucuaccucgaccugauggagggccgcccgcagcggcccacgaaccugcgccggcgcagccgguccuucacgugcaacgaguuccaggacgugcagagcgacgucgcgaucuggcucuga

SEQ ID NO: 35664 - RNA, 654 nt, Artificial Sequence
  derived and/or modified sequence opt1 from RGS19__Homo_sapiens__XP_011526788
augcccaccccgcacgaggccgagaagcagaucaccggccccgaggaggccgaccgcccgcccagcauguccagccacgacacggcgucccccgccgcccccagccggaaccccugcugccugugcuggugcugcugcugcuccugcagcuggaaccaggagcgccggcgcgccuggcaggccucccgggagagcaagcuccagccccugccguccugcgaggugugcgcgacccccagccccgaggagguccaguccugggcccagagcuucgacaagcugaugcacucccccgccgggcgcagcguguuccgggccuuccuccgcaccgaguacuccgaggagaacaugcuguucuggcuggcgugcgaggagcucaaggccgaggccaaccagcacguggucgacgagaaggcccggcugaucuacgaggacuacgugagcauccuguccccgaaggaggugagccucgacucccgcguccgggagggcaucaacaagaagaugcaggagcccagcgcccacaccuucgacgacgcgcagcugcagaucuacacgcugaugcaccgcgacagcuacccccgguuccucuccagccccaccuaccgcgcccugcugcuccaggggccgucccagagcuccagcgaggccuga

SEQ ID NO: 35665 - RNA, 630 nt, Artificial Sequence
  derived and/or modified sequence opt1 from RGS1__Homo_sapiens__NP_002913
augcgcgccgccgcgaucagcacccccaagcuggacaagaugcccggcauguucuucuccgccaaccccaaggagcucaaggggaccacgcacagccugcuggacgacaagaugcagaagcggcgccccaagaccuucggcauggacaugaaggccuaccuccgguccaugaucccccaccuggagagcgggaugaaguccagcaaguccaaggacgugcugagcgccgccgaggucaugcaguggucccagagccucgagaagcugcuggcgaaccagaccggccagaacguguucggguccuuccucaagagcgaguucuccgaggagaacaucgaguucuggcuggccugcgaggacuacaagaagaccgagagcgaccugcucccgugcaaggccgaggagaucuacaaggccuucgugcacuccgacgcggccaagcagaucaacaucgacuuccgcacgcgggagagcaccgccaagaagaucaaggcccccaccccgaccugcuucgacgaggcccagaaggucaucuacacgcugauggagaaggacuccuacccccgcuuccucaagagcgacaucuaccugaaccugcugaacgaccuccaggcgaacucccugaaguga

SEQ ID NO: 35666 - RNA, 726 nt, Artificial Sequence
  derived and/or modified sequence opt1 from RGS20__Homo_sapiens__NP_003693
augcgcaccgccgacggcggggagcccgccggcgcgagcagcccggccgggcggguggacggcgggcugcagaugggcagcgagcgcauggagaugcggaagcgccagaugcccgccgcccaggacacccccggcgccgcgcccgggcagccgggcgccgggucccggggcagcaacgccugcugcuucugcuggugcugcugcugcuccugcagcugccucacgguccgcaaccaggaggaccagcggcccaccaucgccucccacgagcugcgcgcggaccugcccaccugggaggagagccccgccccgacccucgaggaggugaacgccugggcccaguccuucgacaagcugauggugacgcccgccgggcggaacgcguuccgcgaguuccugcggaccgaguucagcgaggagaacaugcuguucuggauggccugcgaggagcucaagaaggaggccaacaagaacaucaucgaggagaaggcccgcaucaucuacgaggacuacaucuccauccugagccccaaggaggucucccucgacagccgggugcgcgaggugaucaaccggaacauggucgagcccucccagcacaucuucgacgacgcccagcugcagaucuacacccugaugcaccgcgacagcuacccgcgguucaugaacuccgcgguguacaaggaccuccugcagagccuguccgagaaguccaucgaggccuga

SEQ ID NO: 35667 - RNA, 459 nt, Artificial Sequence
  derived and/or modified sequence opt1 from RGS21__Homo_sapiens__NP_001034241
augcccgugaagugcugcuucuaccgcagcccgaccgccgagaccaugacgugguccgagaacauggacacccugcucgccaaccaggcgggccuggacgccuuccggaucuuccucaagagcgaguucuccgaggagaacguggaguucuggcuggccugcgaggacuucaagaagaccaagaacgccgacaagaucgccagcaaggcgaagaugaucuacuccgaguucaucgaggccgacgcccccaaggagaucaacaucgacuucgggacccgcgaccugaucagcaagaacaucgccgagcccacgcugaagugcuucgacgaggcgcagaagcucaucuacugccugauggccaaggacuccuucccccgguuccucaagagcgagaucuacaagaagcuggugaacucccagcaggucccgaaccacaagaaguggcugcccuuccuguga

SEQ ID NO: 35668 - RNA, 3759 nt, Artificial Sequence
  derived and/or modified sequence opt1 from RGS22__Homo_sapiens__NP_001273621
augcccgagaagcgccugaccgccgagccgcccaccaucacggaggaggaguucgaggacagccucgccaccgacgacuuccugguggacuacuucaacgaguuccugucccuccccaccuucagcgaggcgauccgguucaacgccgacuacggcgucuucgagguggccaacgacgcgccccaguuccuggagaagcagcugaagaagauccuccagaaccagcagccgcgcaaccccaucuacgacgugguccggaaggggaagaacgaggugaagcccgugcagaugaacgcccccgacgaggacgagaccaucaacgucaacuacaacaucaugugccugucccgcgaggagggcaucaaguggaucaagaaggagcggcugccggccuuccucgagagcgacugcuacuucgaguaccgccuggccaagcuggugucccaggugcgguggagcaaguccgggaugaacuucacggucggcagcaacuucucccccuggaucgugaagaagccgcccagccucccgccgcccgccaccgaggaggacaaccuggccuccuacacccagaccaaggacugguucgcgcuggccaagcagagccagcagacgguguccaccuucagccuccccugcugcguccccuacaacaagcugaagucccccgccaucagcuccgugagcgagaacuucaucuucgacgacggggugcacccccgcaccaagaaggaccccuccaagaccaacaagcugaucagcgaguucgaggaggaggagggcgaggaggaggaggucagcgugucccuccaggacacgccgagccaggcccugcugcggguguaccucgagaagaagcaggacgucgacgagucccugaccaugcacuucagcacgugcgaggaguuccuguccagcuacaucuacuucauccuccgcggcgccauccagcagaucguggggaagcccgugggcgagacccccgacuacaucaacuucaacaacaucaccaaggucuccuucgacgacugcuucgagagcauccacgggaagaacuuccuguccgagcuggugcagaccaccaaggagcggagcgaggagaucgagcagaccucccucagcuccaagaacgagagcgcgggccccgagucccgcgccgacuggugcaucagccaccggacguacgacaucgggaaccgcaaggaguucgagcgguucaagaaguucaucaagggcacccugggcgagcgcuacugguggcuguggauggacaucgagcggcucaaggugcugaaggacccggggcgccaccagcggcaccuggagaagaugaagaagugcuaccucgucuccaacggcgacuacuaccugagcgccgagauccuguccaaguucaagcuccuggacgggagccaguggaacgaggagcaccuccgcaacauccagagcgaggugcucaagccccugcugcucuacugggcgccccgguucugcgucacccacuccgccagcaccaaguacgccuccgccgagcugaaguucuggcaccuccgccaggccaagccccgcaaggacaucgacccguucccccagauggccacgcugcugccccugcggcccaagagcugcaucccccagauccccgagauccagaaggaggaguucucccucagccagcccccgaagucccccaacaagagccccgaggugaagaccgccacccagaagcccuggaagcgcgagcugcuguacccgggcuccagcaaggacgacgugaucgagaagggcuccaaguacaugagcgaguccagcaaggucauccaccugaccuccuucacggacaucagcgagugccucaagccccagcuggaccggcgcuacgcguacaccgaggagccccgggugaagaccguguccgacgucggggcccugggcgggagcgacauggagaaccuccugcagagccuguacguggagaaccgcgccggcuucuucuucaccaaguucugcgagcacuccgggaacaagcucuggaagaacagcguguacuucugguucgaccugcaggccuaccaccagcuguucuaccaggagacgcuccagcccuucaaggucugcaagcaggcccaguaccuguucgcgaccuacguggccccguccgccacccuggacaucggccuccagcaggagaagaagaaggagaucuacaugaagauccagccgcccuucgaggaccuguucgacaccgccgaggaguacauccugcuccugcugcucgagcccuggacgaagauggucaagagcgaccagaucgcguacaagaagguggagcugguggaggagacccggcagcuggacuccaccuacuuccgcaagcuccaggcccugcacaaggagaccuucagcaagaaggccgaggacaccacgugcgagaucggcaccgggauccugucccucagcaacguguccaagcggaccgaguacugggacaacguccccgccgaguacaagcacuucaaguucagcgaccugcugaacaacaagcucgaguucgagcacuuccgccaguuccuggagacccacuccagcuccauggaccugaugugcuggacggacaucgagcaguuccggcgcaucaccuaccgggaccgcaaccagcggaaggccaagagcaucuacaucaagaacaaguaccucaacaagaaguacuucuucggccccaacucccccgcgagccuguaccagcagaaccaggugaugcaccuguccgggggcugggggaagauccuccacgagcagcuggacgcccccgugcuggucgagauccagaagcacgugcagaaccgccucgagaacguguggcugccgcuguuccucgccagcgagcaguucgccgcccggcagaagaucaagguccagaugaaggacaucgcggaggagcugcugcuccagaaggccgagaagaagaucggcguguggaagcccguggaguccaaguggaucagcagcuccugcaagaucaucgccuuccgcaaggcccugcugaaccccgucaccagccggcaguuccagcgcuucguggcccucaagggcgaccugcuggagaacgggcuccuguucuggcaggaggugcagaaguacaaggaccugugccacucccacugcgacgagagcgucauccagaagaagaucaccacgaucaucaacugcuucaucaacuccagcaucccgcccgcgcuccagaucgacauccccguggagcaggcccagaagaucaucgagcaccgcaaggagcugggccccuacguguuccgggaggcccagaugaccaucuucgggguccuguucaaguucuggccgcaguucugcgaguuccgcaagaaccucaccgacgagaacaucauguccgugcuggagcggcgccaggaguacaacaagcagaagaagaagcuggccgugcucgaggacgagaaguccggcaaggacgggaucaagcaguacgcgaacaccagcguccccgccaucaagacggcccugcugagcgacuccuuccucggccugcagcccuacggccggcagcccaccuggugcuacagcaaguacaucgaggcccuggagcaggagcgcauccuccugaagauccaggaggagcuggagaagaagcuguucgccgggcugcagccgcugaccaacuucaaggcguccagcuccaccaugagccucaagaagaacauguccgcccacagcucccagaaguga

SEQ ID NO: 35669 - RNA, 636 nt, Artificial Sequence
  derived and/or modified sequence opt1 from RGS2__Homo_sapiens__NP_002914
augcagagcgccauguuccuggccgugcagcacgacugccgccccauggacaaguccgcgggcagcgggcacaaguccgaggagaagcgggagaagaugaagcgcacccuccugaaggacuggaagacccggcugagcuacuuccuccagaacuccagcacgccgggcaagcccaagaccgggaagaaguccaagcagcaggccuucaucaagcccagccccgaggaggcccagcugugguccgaggccuucgacgagcugcucgccagcaaguacggccuggcggccuuccgcgccuuccugaaguccgaguucugcgaggagaacaucgaguucuggcucgccugcgaggacuucaagaagaccaagagcccgcagaagcuguccagcaaggcgcggaagaucuacaccgacuucaucgagaaggaggcccccaaggagaucaacaucgacuuccagacgaagacccugaucgcccagaacauccaggaggccaccuccgggugcuucaccacggcccagaagcgcgucuacagccucauggagaacaacuccuacccccgguuccuggagagcgaguucuaccaggaccugugcaagaagccccagaucaccaccgagccgcacgcgaccuga

SEQ ID NO: 35670 - RNA, 1776 nt, Artificial Sequence
  derived and/or modified sequence opt1 from RGS3__Homo_sapiens__NP_001263190
augaaccgcuucaacggccugugcaaggugugcagcgagcggcgcuaccggcagaucaccaucccccgcgggaaggacggcuucggguucaccaucugcugcgacucccccguccgggugcaggccguggacagcggcgggcccgccgagcgcgcgggccuccagcagcuggacacgguccugcagcucaacgagcggcccguggagcacuggaagugcguggagcuggcccacgagauccgcuccugccccagcgagaucauccugcucgucuggcggauggugccccaggugaagcccggccccgacgggggcguccugcgccgggccuccugcaagagcacccacgaccugcagagcccgccgaacaagcgcgagaagaacugcacccacggggugcaggcccggcccgagcagcgccacagcugccaccucgugugcgacuccagcgacggccugcugcucgggggcugggagcgguacaccgaggucgccaagcgcggcgggcagcacacgcugcccgcgcugucccgggccaccgcccccaccgacccgaacuacaucauccucgcgccccugaaccccggcagccagcugcuccgccccguguaccaggaggacaccaucccggaggaguccgggagccccuccaagggcaagagcuacacgggccuggggaagaagucccggcugaugaagaccgugcagaccaugaagggccacgggaacuaccagaacugccccgucgugcgcccccacgccacccacagcuccuacggcacguacgugacccucgccccgaagguccugguguuccccguguucguccagccccuggaccucugcaaccccgcccggacccugcugcucagcgaggagcugcugcucuacgaggggcgcaacaaggccgccgaggugacccuguucgcguacagcgaccugcuccuguucacgaaggaggacgagccgggccgcugcgacgugcugcggaacccccucuaccugcaguccgucaagcugcaggagggcagcuccgaggaccucaaguucugcgugcuguaccuggccgagaaggccgagugccucuucacccuggaggcccacagccaggagcagaagaagcgcgucugcuggugccuguccgagaacaucgccaagcagcagcagcucgcggccagcccgcccgacuccaagaugagcggggccgacaccgugggcgacgacgacgaggccucccggaagcgcaagagcaagaaccuggccaaggacaugaagaacaagcuggggaucuuccggcgccggaacgagucccccggcgcgccgcccgccgggaaggccgacaagaugaugaaguccuucaagcccaccuccgaggaggcccucaaguggggcgagagccuggagaagcugcuggugcacaaguacggccucgccgucuuccaggcguuccugcgcacggaguucuccgaggagaaccuggaguucuggcucgccugcgaggacuucaagaaggucaagagccaguccaagauggccagcaaggccaagaagaucuucgcggaguacaucgccauccaggccugcaaggaggugaaccuggacuccuacacccgggagcacaccaaggacaaccugcagagcgugacccgcgggugcuucgaccucgcccagaagcggaucuucggccugauggagaaggacagcuacccccgcuuccugcgguccgaccucuaccuggaccugaucaaccagaagaagaugagcccgccccucuga

SEQ ID NO: 35671 - RNA, 909 nt, Artificial Sequence
  derived and/or modified sequence opt1 from RGS4__Homo_sapiens__NP_001095915
auguacaacaugaugcugcucauccagaagcgcaagggcaucgggagccagcugcugcgggccggcgaggccgagggggaccgcggcgcggggaccgccgagcgguccagcgacuggcucgacggccgcuccugggccaucaaggagacccccaccggccuggccgggcggcgcagcgaggacuccgacaacaucuucaccggcgaggaggccaaguacgcgcagagccggucccacagcuccagcugccgcaucuccuuccugcucgccaacagcaagcugcugaacaagaugugcaaggggcucgccggccugccggccuccugccugcggagcgcgaaggacaugaagcaccgccucggguuccugcugcagaaguccgacagcugcgagcacaacuccagccacaacaagaaggacaagguggucaucugccagcgggugucccaggaggaggugaagaagugggccgagagccucgagaaccugaucagccacgagugcggccuggccgccuucaaggccuuccucaaguccgaguacagcgaggagaacaucgacuucuggaucuccugcgaggaguacaagaagaucaagagccccuccaagcugagccccaaggcgaagaagaucuacaacgaguucaucuccguccaggccaccaaggaggugaaccuggacagcugcacccgcgaggagacgucccggaacaugcucgagcccaccaucacgugcuucgacgaggcccagaagaagaucuucaaccugauggagaaggacagcuaccgccgguuccugaagucccgcuucuaccucgaccuggugaacccgagcuccugcggcgccgagaagcagaagggggccaagagcuccgcggacugcgccagccuggucccccagugcgccuga

SEQ ID NO: 35672 - RNA, 222 nt, Artificial Sequence
  derived and/or modified sequence opt1 from RGS5__Homo_sapiens__NP_001241677
auggccgagaaggccaagcagaucuacgaggaguucauccagaccgaggcgcccaaggaggugaacaucgaccacuucaccaaggacaucacgaugaagaaccuggucgagccgagccucuccagcuucgacauggcccagaagcgcauccacgcccugauggagaaggacucccugccccgguucgugcgcagcgaguucuaccaggagcucaucaaguga

SEQ ID NO: 35673 - RNA, 1458 nt, Artificial Sequence
  derived and/or modified sequence opt1 from RGS6__Homo_sapiens__NP_001191346
auggcccagggcagcggggaccagcgcgccgugggcgucgcggaccccgaggaguccagcccgaacaugaucguguacugcaagaucgaggacaucaucaccaagaugcaggacgacaagaccgggggcgugcccauccggacggucaaguccuuccugagcaagauccccuccguggugaccgggaccgacaucguccaguggcucaugaagaaccugagcaucgaggaccccguggaggccauccaccugggcucccucaucgccgcccagggcuacaucuucccgaucagcgaccacgugcugaccaugaaggacgacgggacguucuaccgcuuccaggcccccuacuucuggcccuccaacugcugggagcccgagaacaccgacuacgcgaucuaccugugcaagcggaccaugcagaacaaggcccgccucgagcuggccgacuacgaggccgagaaccuggcgcggcuccagcgcgccuucgcccggaagugggaguucaucuucaugcaggccgaggcccaggucaagaucgaccgcaagaaggacaagaccgagcggaagauccuggacagccaggagcgcgcguucugggacgugcaccggccggugcccggcugcgucaacacgaccgagauggacauccgcaagugccggcgccugaagaacccccagaaggugaagaaguccguguacggggucaccgaggagagccaggcccagucccccgugcacgugcucagccagccgauccggaagaccacgaaggaggacauccgcaagcagaucaccuuccugaacgcccagaucgaccggcacugccugaagauguccaaggucgccgagagccucaucgccuacaccgagcaguacguggaguacgacccccugaucacccccgcggagcccuccaacccguggaucagcgacgacguggcccugugggacaucgagauguccaaggagcccagccagcagcgcgucaagcgguggggcuucagcuucgacgagauccucaaggaccagguggggcgcgaccaguuccugcgguuccuggaguccgaguucagcuccgagaaccuccgcuucuggcuggccgugcaggaccugaagaagcagccccuccaggacgucgccaagcgcguggaggagaucuggcaggaguuccuggcccccggcgcgccgagcgccaucaaccuggacucccacagcuacgagaucacgucccagaacgucaaggacggcgggcgguacaccuucgaggacgcccaggagcacaucuacaagcucaugaaguccgacagcuacgcccgcuuccugcggagcaacgccuaccaggaccugcuccuggcgaagaagaagcccgaguccgagcagggccgccggaccagccuggagaaguucacccgcuccgugcucuacagcaacacgccccuggccaagcggcccuga

SEQ ID NO: 35674 - RNA, 774 nt, Artificial Sequence
  derived and/or modified sequence opt1 from RGS7BP__Homo_sapiens__NP_001025046
augagcuccgcccccaacggccgcaagaagcggccgagccgcuccacccggagcuccaucuuccagaucagcaagccgccccugcaguccggggacugggagcgccggggcagcggguccgagagcgcccacaagacccagcgcgcgcucgacgacugcaagaugcuggugcaggaguucaacacgcaggucgcccuguaccgggagcucgugaucuccaucggcgacgugagcgucuccugccccagccugcgcgccgagaugcacaagacccggaccaaggggugcgagauggcccgccaggcccaccagaagcuggcggccaucuccggccccgaggacggcgagauccaccccgagaucugccggcucuacauccagcugcagugcugccuggagauguacaccacggagaugcucaagagcaucugccugcuggggucccuccaguuccaccgcaagggcaaggagcccgggggcgggaccaagagccuggacugcaagaucgaggaguccgccgagacccccgcccuggaggacagcagcuccagcccgguggacucccagcagcacagcuggcaggucuccaccgacaucgagaacacggagcgggacaugcgcgagaugaagaaccuccugagcaagcugcgggagaccaugccccucccccugaagaaccaggacgacuccagccugcucaaccugacccccuacccgcuggugcgccggcgcaagcggcgcuucuucggccucugcugccugaucuccagcuga

SEQ ID NO: 35675 - RNA, 1275 nt, Artificial Sequence
  derived and/or modified sequence opt1 from RGS7__Homo_sapiens__NP_001269702
auggcccagggcaacaacuacgggcagaccagcaacggcguggccgacgagucccccaacaugcuggucuaccgcaagauggaggacgugaucgcgcggaugcaggacgagaagaacgggaucccgauccgcaccgucaagagcuuccucuccaagauccccagcguguucuccggcagcgacaucgugcaguggcugaucaagaaccugacgaucgaggaccccgccguguaccucugcaagcggaccaugcagaacaaggcccgccuggagcuggccgacuacgaggccgagucccucgcgcggcugcagcgcgccuucgcccggaagugggaguucaucuucaugcaggccgaggcgcaggccaaggucgacaagaagcgcgacaagaucgagcggaagauccuggacagccaggagcgcgccuucugggacgugcaccggcccgugccggggugcgucaacaccaccgagguggacaucaagaaguccagccgcaugcggaacccccacaagacgcgcaaguccguguacggccuccagaacgacauccggagccacucccccacccacacccccaccccggagacgaagccgcccaccgaggacgagcugcagcagcagaucaaguacuggcagauccagcuggaccgccaccggcucaagaugagcaaggucgccgacucccugcugagcuacaccgagcaguaccucgaguacgaccccuuccugcugccgcccgaccccuccaaccccuggcucagcgacgacaccacguucugggagcuggaggccuccaaggagcccagccagcagcgcgugaagcgguggggcuucgggauggacgaggcgcugaaggaccccgugggccgcgagcaguuccucaaguuccuggagagcgaguucuccagcgagaaccugcgguucuggcucgccgucgaggaccugaagaagcgccccaucaaggaggugcccucccgcgugcaggagaucuggcaggaguuccuggccccgggggcccccagcgccaucaaccucgacuccaagagcuacgacaagaccacccagaacgucaaggagcccggccgguacaccuucgaggacgcgcaggagcacaucuacaagcugaugaaguccgacagcuacccccgcuucauccgguccagcgccuaccaggagcugcuccaggccaagaagaaggggcgcaacaucccgaucuuccccugccacaagaacugcacgcccacccugcgggccuccaccaaccugcucuga

SEQ ID NO: 35676 - RNA, 543 nt, Artificial Sequence
  derived and/or modified sequence opt1 from RGS8__Homo_sapiens__XP_005245612
auggccgcccugcucaugccccgccggaacaagggcaugcgcacccggcuggggugccugagccacaaguccgacagcugcuccgacuucaccgccauccucccggacaagcccaaccgcgcccugaagcggcugagcacggaggaggccacccgcugggccgacuccuucgacgugcuccugagccacaaguacggcgucgccgcguuccgggccuuccugaagaccgaguucuccgaggagaaccucgaguucuggcuggccugcgaggaguucaagaagacccgcagcacggccaagcugguguccaaggcgcaccggaucuucgaggaguucguggacguccaggcgccccgcgaggugaacaucgacuuccagacccgggaggccacccgcaagaaccuccaggagcccagccugaccugcuucgaccaggcccaggggaaggugcacucccugauggagaaggacagcuacccgcgguuccuccgcuccaagauguaccuggaccugcucagccagucccagcggcgccugagcuga

SEQ ID NO: 35677 - RNA, 708 nt, Artificial Sequence
  derived and/or modified sequence opt1 from RGS9BP__Homo_sapiens__NP_997274
auggcccgcgaggagugcaaggcccugcucgacggccugaacaagaccaccgcgugcuaccaccaccuggugcucacggucgggggcagcgccgacucccagaaccugcggcaggagcugcagaagacccgccagaaggcccaggagcucgccgugagcacgugcgcccggcugaccgcggugcugcgcgaccgggggcucgccgccgacgagcgcgccgaguucgagcggcugugggucgcguucuccggcugccuggaccuccuggaggccgacaugcgccgggcccuggagcucggggccgccuucccccugcacgcgccgcgccggccccuggugcgcaccggcguggccggcgccagcuccggggucgccgcccgggcgcucagcacccgcucccugcggcuggaggccgagggcgacuucgacguggccgaccuccgcgagcuggagcgggaggugcugcaggucggggagaugaucgacaacauggagaugaaggugaacgugccccgcuggaccguccaggcccggcaggccgcgggcgccgagcuccugagcaccguguccgccgggcccagcuccguggucagccugcaggagcgcggcggcgggugcgacccgcggaaggcccucgccgcgauccuguucggcgccgugcugcucgccgccguggcgcuggccgucugcguggccaagcuguccuga

SEQ ID NO: 35678 - RNA, 2016 nt, Artificial Sequence
  derived and/or modified sequence opt1 from RGS9__Homo_sapiens__NP_001075424
augaccauccgccaccagggccagcaguaccggccccgcauggccuuccugcagaagaucgaggcccucgugaaggacaugcagaacccggagaccgggguccggaugcagaaccagcgcgugcuggugacgagcgucccccacgcgaugaccggcuccgacgugcugcaguggaucgugcagcggcucuggaucagcucccuggaggcccagaaccuggggaacuucaucguccgcuacggcuacaucuacccccuccaggaccccaagaaccugauccugaagccggacgggagccucuaccgguuccagacccccuacuucuggcccacccagcaguggcccgccgaggacacggacuacgccaucuaccuggccaagcgcaacaucaagaagaagggcauccuggaggaguacgagaaggagaacuacaacuuccucaaccagaagaugaacuacaagugggacuucgugaucaugcaggcgaaggagcaguaccgggccggcaaggagcgcaacaaggccgaccgguacgcccuggacugccaggagaaggcguacuggcuggugcaccgcugcccgcccgggauggacaacguccucgacuacggccuggaccgggugaccaaccccaacgaggugaagaagcagaccgucguggccgugaagaaggagaucauguacuaccagcaggcccugaugcgcuccaccgucaagagcuccgugagccucgggggcaucgugaaguacuccgagcaguucagcuccaacgacgccaucaugagcgggugccugcccuccaacccguggaucacggacgacacccaguucugggaccugaacgccaagcucgucgagauccccaccaagaugcggguggagcgcugggcguucaacuucagcgagcugauccgggaccccaagggccgccaguccuuccaguacuuccugaagaaggaguucagcggcgagaaccucggguucugggaggccugcgaggaccugaaguacggcgaccaguccaaggugaaggagaaggccgaggagaucuacaagcuguuccucgcccccggggcccggcgcuggaucaacaucgacggcaagaccauggacaucacggucaagggccugaagcacccgcaccgguacgugcuggacgcggcccagacccacaucuacaugcucaugaagaaggacagcuacgcccgcuaccugaagucccccaucuacaaggacaugcuggccaaggccaucgagccccaggagaccaccaagaaguccagcacgcuccccuucaugcgccggcaccuccgcuccagcccgucccccgugauccugcggcagcuggaggaggaggcgaaggcccgcgaggccgccaacaccgucgacaucacccagcccgggcagcacauggcccccagcccgcaccugaccguguacacggggaccugcaugccgcccucccccagcucccccuucagcuccagcugccggagcccccgcaagcccuucgcgagcccgucccgguucauccgccggcccagcaccaccaucugccccucccccauccgcgucgcccuggagagcuccagcggccucgagcagaagggcgagugcuccgggagcauggccccgcggggccccagcgugacggaguccagcgaggccucccuggacaccagcuggccccgcucccggccccgcgcgccgcccaaggcccggauggcccugagcuucucccgcuuccuccggcgcggcugccuggccagccccguguucgcccggcugucccccaagugcccggcggucagccacgggcgcgugcagccccucggcgacguggggcagcagcugccccgccugaaguccaagcgggucgccaacuucuuccagaucaagauggacgugcccaccggcagcgggaccugccucauggacuccgaggacgccggcacgggcgagagcggggaccgcgccaccgagaaggaggugaucugcccgugggagucccuguga

SEQ ID NO: 35679 - RNA, 3231 nt, Artificial Sequence
  derived and/or modified sequence opt1 from RGSL1__Homo_sapiens__NP_001131141
augagcuccgccgagaucaucggcagcaccaaccugaucauccuccuggaggacgagguguucgccgacuucuucaacaccuuccugucccuccccgucuucgggcagacgccguucuacaccguggagaacagccaguggucccuguggcccgagauccccugcaaccugaucgcgaaguacaagggccuccugaccuggcuggagaagugccgccuccccuucuucugcaagaccaaccugugcuuccacuacauccugugccaggaguucaucagcuucaucaaguccccggagggcggggaggagcucguggacuucuggauccuggccgagaacauccugagcaucgacgagauggaccucgagguccgggacuacuaccugucccugcuccugaugcugcgcgccacgcaccuccaggaggggagccggguggugacccugugcaacaugaacaucaagucccugcucaaccugagcaucuggcaccccaaccaguccaccacccgccgggagauccugagccacaugcagaaggucgcccucuucaagcugcaguccuacuggcugcccaacuucuacacgcacaccaagaugaccauggccaaggaggaggcgugccacggccucaugcaggaguacgagacccgccuguacagcgugugcuacacgcacaucggcgggcugccccucaacauguccaucaagaagugccaccacuuccagaagcgguacagcucccgcaaggccaagcggaagauguggcagcugguggacccggacagcuggagccuggagauggaccucaagcccgacgccaucggcaugccccugcaggagaccugcccccaggagaaggucgugauccagaugccgucccugaagauggccagcuccaaggagacccgcaucagcucccucgagaaggacaugcacuacgcgaagaucagcuccauggagaacaaggccaagagccaccuccacauggaggcccccuucgagaccaagguguccacgcaccuccggaccgucauccccaucgugaaccacagcuccaagaugaccauccagaaggccaucaagcagagcuucucccucggguacauccaccuggcccugugcgcggacgccugcgccggcaaccccuuccgcgaccaccucaagaagcugaaccugaagguggagauccagcuccuggaccuguggcaggaccugcagcacuuccucagcguccugcugaacaacaagaagaacgggaacgccaucuuccggcaccuccugggcgaccgcaucugcgagcuguaccucaacgagcagaucggcccgugccugccccugaagucccagaccauccaggggcucaaggagcugcugcccagcggcgacgugauccccuggaucccgaaggcccagaaggagaucugcaagaugcucucccccugguacgacgaguuccuggacgaggaggacuacugguuccugcuguucacgacccagaaccgguucaucagcucccgccagcacaagcgggaguucaucgggaaggaggagaacauccugcuguacaagcgcauccagcagagccucgagcugagccaggcgcuggccgacaugaaggagauggacuaccggcaguggcgcaagaucgccaccgaggaccucaagcagggcggcucccuccagguggagcugaccagccccgucuuccugacggacaucaccaagauguccuucgaggagcugugcuacaagaaccccaagauggccauccagaagaucagcgacgacuacaagaucuacugcgagaaggccccgaagaucgacuucaagauggagaucaucaaggagaccaagaccgugucccggagcaaccgcaagaugucccugcucaagcgcacgcuggugcggaagcccagcaugcgcccccggaaccugaccgagguccuccugaacacccagcaccuggaguucuuccgcgaguuccucaaggagcggaaggcgaagaucccccugcaguuccugaccgccgugcagaagaucuccaucgagacgaacgagaagaucugcaagagccucaucgagaacgugaucaagaccuucuuccaggggcagcuguccccggaggagaugcugcagugcgacgcccccaucaucaaggagaucgccagcaugcgccacgucaccaccuccacgcuccugacccugcagggccacgugaugaaguccaucgaggagaagugguucaaggacuaccaggaccucuucccgccccaccaccaggaggucgaggugcagagcgaggugcagaucagcucccggaagcccagcaagaucgucagcaccuaccugcaggagucccagaagaagggguggaugcgcaugaucagcuucauccgguccuucugcaaguaccgccgguucaugcugaaccccagcaagcgccaggaguucgaggacuaccuccaccaggagaugcagaacuccaaggagaacuucaccaccgcccacaacacgagcggccgguccgcgcccccgagcaccaacgugcgcuccgccgaccaggagaacggggagaucacccuggugaagcggcgcaucuucggccaccggaucaucaccgucaacuucgccaucaacgaccuguacuucuucagcgagauggagaaguucaacgaccucguguccagcgcccacaugcuccaggugaaccgcgcguacaacgagaacgacgucauccugaugcgguccaagaugaacaucauccagaagcuguuccugaacagcgacaucccgcccaagcugcgcgugaacgugcccgaguuccagaaggacgccauccuggccgccaucacggagggcuaccuggaccgcuccgucuuccacggggccaucaugagcguguuccccguggucauguacuucuggaagcgguucugcuucuggaaggcgacccgcuccuaccugcaguaccggggcaagaaguucaaggaccgcaagagcccgcccaaguccaccgacaaguaccccuucagcagcgggggcgacaacgccauccuccgguucacccugcugcgcgggaucgaguggcuccagccccagcgggaggccaucuccagcgugcagaacuccagcuccagcaagcugacgcagccccgccugguggucuccgccaugcagcuccaccccgugcagggccagaagcugagcuacaucaagaaggagaaguga

SEQ ID NO: 35680 - RNA, 1230 nt, Artificial Sequence
  derived and/or modified sequence opt1 from RHAG__Homo_sapiens__NP_000315
augcgcuucaccuucccccugauggccaucgugcucgagaucgccaugaucguccuguucggccuguucguggaguacgagaccgaccagacggugcucgagcagcugaacaucaccaagccgaccgacauggggaucuucuucgagcuguacccccucuuccaggacguccacgugaugaucuucgugggcuucggguuccugaugaccuuccugaagaaguacggcuucagcuccgucgggaucaaccuccugguggcggcccugggccuccaguggggcacgaucgugcaggggauccugcagagccagggccagaaguucaacaucgggaucaagaacaugaucaacgccgacuucuccgccgccaccguccugaucagcuucggcgcggugcucgggaagaccucccccacccagaugcugaucaugacgauccuggagaucguguucuucgcccacaacgaguaccucgucagcgagaucuucaaggccuccgacaucggcgccagcaugaccauccacgcguucggcgccuacuucgggcuggccguggccggcauccuguaccgguccgggcuccgcaagggccacgagaacgaggagagcgccuacuacuccgaccuguucgcgaugaucggcacccuguuccucuggauguucuggcccagcuucaacuccgccaucgccgagccgggggacaagcagugccgggccaucgugaacaccuacuucagccuggccgcgugcguccugacggccuucgccuucuccagccucguggagcaccgcggcaagcugaacauggugcacauccagaacgccacccuggccgggggcgucgcgguggggaccugcgccgacauggccauccaccccuucggcuccaugaucaucggcagcaucgccgggaugguguccguccucggcuacaaguuccugacgccccuguucaccaccaagcuccggauccacgacacgugcggggugcacaaccugcacggccugcccgggguggucggcggccucgccgggaucguggcggucgccaugggcgccagcaacaccagcauggccaugcaggcggccgcccugggguccagcaucggcaccgccguggucgggggccugaugaccggccucauccugaagcugccgcucugggggcagcccuccgaccagaacugcuacgacgacagcguguacuggaaggugcccaagacccgcuga

SEQ ID NO: 35681 - RNA, 1095 nt, Artificial Sequence
  derived and/or modified sequence opt1 from RHBDD2__Homo_sapiens__NP_001035546
auggccgccagcggccccgggugccgcuccuggugccugugcccggaggugcccagcgcgaccuucuucaccgcccuccugucccugcucgucagcggcccccggcuguuccugcuccagcagccccuggccccguccgggcugacgcucaagagcgaggcccugcgcaacuggcaggucuaccggcuggugaccuacaucuucguguacgagaaccccaucucccuccugugcggcgccaucaucaucuggcgcuucgcggggaacuucgagcggaccgugggcaccgugcgccacugcuucuucacggucaucuucgccaucuucagcgccaucaucuuccuguccuucgaggccgugagcucccucagcaagcugggcgagguggaggacgcgcggggguucacccccgucgccuucgccaugcugggcgugaccaccgugcgcucccggaugcgccgggcccucgucuucgggaugguggugcccagcguccuggugccguggcugcuccugggcgccuccuggcugaucccccagacgagcuuccucuccaacgugugcgggcugagcaucggccuggcguacggccucaccuacugcuacuccaucgaccugagcgagcgcgucgcccugaagcucgaccagaccuuccccuucagccugaugcggcgcaucuccguguucaaguacgugagcggguccagcgccgagcggcgcgccgcccagucccggaagcugaaccccgucccgggcagcuaccccacccaguccugccacccccaccucagccccucccacccggugagccagacgcagcacgcguccgggcagaagcuggccagcuggcccuccugcacccccggccacaugcccacccugccgcccuaccagcccgccagcggccucugcuacgugcagaaccacuucgggcccaacccgaccuccagcuccgucuaccccgccagcgccggcacgucccuggggauccagccgcccacccccgugaacagccccggcaccgucuacagcggggcgcugggcacccccggcgccgccggguccaaggagagcucccgcgugccgaugcccuga

SEQ ID NO: 35682 - RNA, 1161 nt, Artificial Sequence
  derived and/or modified sequence opt1 from RHBDD3__Homo_sapiens__NP_036397
augcacgcccgcggcccccacgggcagcugagccccgcccucccccuggcguccagcgugcugaugcuccugauguccacccuguggcucgucggcgccgggcccggccuggugcuggcccccgagcuccugcuggacccguggcagguccaccggcuccugacccacgcccuggggcacacggcccuccccggccugcugcucagccugcugcuccugcccaccgugggcuggcagcaggagugccaccuggggacccuccgcuuccugcacgcguccgcccugcucgcccuggccagcggccugcucgcggugcugcuggccgggcucggccuguccagcgccgccggguccugcggcuacaugcccgugcaccuggccaugcucgcgggcgaggggcaccggccgcgccggccccgcggcgcccugccgcccuggcugagccccuggcuccugcuggcccucacgccccugcuguccagcgagccgcccuuccuccagcugcugugcgggcuccuggccggccuggccuacgcggccggcgccuuccgguggcuggagcccuccgagcgccggcuccagguccugcaggagggggugcugugccgcacccucgccggcugcuggccccugcggcugcucgccacccccgggagccuggcggagcugcccgugacccacccggccggcguccgcccgcccauccccgggccgcccuacguggccucccccgaccucuggagccacugggaggacuccgcccugcccccgcccagccugcggcccgugcagcccaccugggagggcuccagcgaggccggccucgacugggcgggggccagcuucucccccggcacgcccaugugggccgcccuggacgagcagaugcugcaggaggggauccaggcgagccuccuggacggccccgcccaggagccgcaguccgcccccuggcugagcaaguccagcgucuccagccuccgccugcagcagcuggagcggaugggguuccccaccgagcaggccgugguggcccucgcggccaccggccgcgucgagggcgccgugucccugcuggucgggggccagguggggaccgagacgcucgugacccacggcaagggcgggcccgcccacagcgagggcccggggccgcccuga

SEQ ID NO: 35683 - RNA, 2568 nt, Artificial Sequence
  derived and/or modified sequence opt1 from RHBDF1__Homo_sapiens__NP_071895
augagcgaggcccgccgggacuccaccagcucccugcagcgcaagaagcccccguggcucaagcuggacauccccagcgccgugccccugaccgcggaggagcccuccuuccuccagccgcugcggcgccaggccuuccugcggagcgucuccaugcccgccgagacggcccacaucagcagcccccaccacgagcuccgccggcccgugcugcagcgccagaccagcaucacccagaccauccggcgcggcacggccgacugguucgggguguccaaggacagcgacuccacccagaaguggcagcggaaguccauccgccacugcucccagcgguacggcaagcugaagccgcagguccuccgcgagcuggaccugcccagccaggacaacgugucccucaccagcaccgagacgcccccgccccuguacguggggcccugccagcugggcaugcagaagaucaucgacccccucgcgcgggggcgcgccuuccgggucgccgacgacaccgccgagggccuguccgcgccccacaccccggugacccccggcgccgccagccugugcagcuucuccagcucccgcagcggguuccaccggcucccccgccggcgcaagcgcgaguccguggccaagaugagcuuccgggccgcggccgcccugaugaagggccgcuccguccgggacgggacguuccgccgggcccagcgccggagcuucacccccgccuccuuccuggaggaggacaccaccgacuucccggacgagcucgacacgagcuucuucgcgcgcgagggcauccugcacgaggagcuguccaccuaccccgacgagguguucgagagccccuccgaggccgcccucaaggacugggagaaggcccccgagcaggccgaccugaccgggggcgcgcuggaccggagcgagcucgagcgcucccaccugaugcugccgcucgagcggggcuggcgcaagcagaaggagggggccgccgcgccccagcccaaggugcggcugcgccaggaggucgugagcaccgccggcccccggcgcgggcagcggaucgccgugccgguccgcaagcuguucgcccgggagaagcgccccuacggccucggcaugguggggcgccugacgaaccggaccuaccgcaagcggaucgacuccuucgugaagcgccagaucgaggacauggacgaccaccggcccuucuucaccuacuggcugaccuucguccacagccucgugacgauccuggccgugugcaucuacggcaucgccccggucggguucucccagcacgagaccguggacagcgugcugcgcaaccggggcgucuacgagaacgugaaguacguccagcaggagaacuucuggaucgggcccagcuccgaggcgcucauccaccugggcgccaaguucagccccugcaugcgccaggacccccaggugcacuccuucauccggagcgcccgcgagcgggagaagcacuccgccugcugcgugcgcaacgaccggagcggcugcguccagaccuccgaggaggagugcagcuccacccuggccgugugggugaaguggccgauccaccccagcgcgcccgagcucgccgggcacaagcgccaguucggcuccgucugccaccaggacccccgggugugcgacgagccgagcuccgaggacccccacgaguggcccgaggacaucacgaaguggcccaucugcaccaagaacagcgccgggaaccacaccaaccacccgcacauggacugcgugaucaccggccgccccugcugcaucgggacgaagggccggugcgagaucaccucccgcgaguacugcgacuucaugcggggcuacuuccacgaggaggccacccugugcagccagguccacugcauggacgacgugugcgggcugcuccccuuccugaaccccgaggugccggaccaguucuaccgccuguggcucucccuguuccugcacgccggcauccugcacugccucgucagcaucugcuuccagaugaccgugcugcgggaccuggagaagcucgcgggguggcaccgcaucgccaucaucuaccugcugagcggcgugacggggaaccucgccuccgccaucuuccugcccuaccgcgccgaggucggccccgcgggcagccaguucgggauccuggccugccucuucguggagcuguuccaguccuggcagauccuggcccggcccuggcgcgccuucuucaagcuccuggcggugguccuguuccucuucaccuucggccugcugccguggaucgacaacuucgcccacaucagcggguucaucuccggccucuuccugagcuucgccuuccugcccuacaucuccuucggcaaguucgaccucuaccggaagcgcugccagaucaucaucuuccaggugguguuccuggggcugcucgccggccuggucgugcuguucuacguguaccccguccggugcgaguggugcgaguuccugaccugcauccccuucaccgacaaguucugcgagaaguacgagcucgacgcccagcugcacuga

SEQ ID NO: 35684 - RNA, 2484 nt, Artificial Sequence
  derived and/or modified sequence opt1 from RHBDF2__Homo_sapiens__NP_001005498
auggccagcgccgacaagaacggcggguccgugagcuccgucagcuccagccgccugcagucccggaagcccccgaaccucagcaucaccaucccgccgcccgagaaggagacccaggcgcccggcgagcaggacuccaugcugcccgagcgcaagaaccccgccuaccucaagagcgugucccuccaggagccccggagccgcuggcaggaguccagcgagaagcggcccggguuccgccggcaggccucccugagccaguccauccgcaagggcgccgcccagugguucggggugagcggcgacugggagggccagcggcagcaguggcagcgccggucccugcaccacugcagcaugcgcuacgggcggcucaaggcgagcugccagcgcgaccuggagcugcccucccaggaggcccccagcuuccagggcacggagucccccaagccgugcaagaugcccaagaucgucgacccccucgcccgggggcgcgccuuccggcaccccgaggagauggaccgcccgcacgcgccccacccgccccugacccccggcgugcugagccucaccuccuucaccagcgugcgguccggguacagccaccucccccgccggaagcgcauguccgucgcccacaugagccugcaggccgccgccgcgcugcugaagggccgcuccgugcuggacgccacgggccagcggugccgcguggucaagcggagcuucgccuuccccuccuuccucgaggaggacgugguggacggggccgacaccuucgacagcuccuucuucagcaaggaggagauguccagcaugcccgacgacgucuucgaguccccgccccugagcgccagcuacuuccgcggcaucccccacuccgcgagccccguguccccggacggggugcagaucccccugaaggaguacggccgggcccccgucccgggcccccgccgggggaagcgcaucgccagcaaggugaagcacuucgccuucgaccggaagaagcgccacuacggccucgggguggucggcaacuggcugaaccgguccuaccgccggagcaucuccagcaccgugcagcgccagcuggaguccuucgacagccaccggcccuacuucaccuacuggcucacguucgugcacgucaucaucacccugcuggugaucugcaccuacgggaucgcccccgugggcuucgcgcagcacgucaccacgcagcucgugcugcgcaacaagggcgucuacgaguccgugaaguacauccagcaggagaacuucuggguggggccgagcuccaucgaccugauccaccucggcgccaaguucagccccugcauccggaaggacgggcagaucgagcagcugguccugcgcgagcgggaccucgagcgcgacuccggcugcugcgugcagaacgaccacagcgggugcauccagacccagcgcaaggacugcuccgagacccuggccaccuucgugaaguggcaggacgacacgggcccgcccauggacaagagcgaccugggccagaagcggaccagcggggccgucugccaccaggacccccggaccugcgaggagcccgccuccagcggcgcgcacaucuggcccgacgacaucaccaaguggcccaucugcacggagcaggcccgcuccaaccacaccggguuccuccacauggacugcgagaucaagggccgcccgugcugcaucgggaccaagggcagcugcgagaucaccacgcgggaguacugcgaguucaugcacggcuacuuccacgaggaggccacccugugcucccaggugcacugccuggacaaggugugcgggcuccugcccuuccugaaccccgagguccccgaccaguucuaccgccucuggcugagccuguuccuccacgccggcguggugcacugccuggucuccgugguguuccagaugaccauccugcgggaccucgagaagcuggcgggguggcaccgcaucgccaucaucuucauccugagcggcaucaccggcaaccuggccuccgccaucuuccucccguaccgggccgaggucgggcccgcgggcagccaguucgggcugcuggccugccucuucguggagcuguuccaguccuggccccugcucgagcgccccuggaaggccuuccugaaccugagcgccaucgugcuguuccuguucaucugcggccugcucccguggaucgacaacaucgcccacaucuucggguuccuguccggccugcuccuggcguucgccuuccugcccuacaucacguucggcaccagcgacaaguaccggaagcgcgcccucauccuggucucccugcucgccuucgccgggcuguucgcggcccuggugcucuggcuguacaucuaccccaucaacuggcccuggaucgagcaccugaccugcuucccguucaccagccgguucugcgagaaguacgagcucgaccaggugcugcacuga

SEQ ID NO: 35685 - RNA, 1122 nt, Artificial Sequence
  derived and/or modified sequence opt1 from RHBDL1__Homo_sapiens__NP_001265649
auggaccgcagcucccugcuccagcugauccaggagcagcagcuggaccccgagaacaccggcuucaucggggccgacaccuucacgggccucgugcacagccacgagcugccgcuggaccccgccaagcucgacaugcuggucgcgcuggcccaguccaacgagcaggggcaggugugcuaccaggagcucguggaccugaucagcuccaagcggagcuccagcuucaagcgcgccaucgccaacggccagcgggcccugccccgcgacgggccccucgacgagccgggccugggcgucuacaagcgguucgugcgcuacguggcguacgagauccugcccugcgaggucgaccggcgcugguacuucuaccggcaccgcuccugcccccccccgguguucauggccagcgugacccucgcccagaucaucgucuuccugugcuacggggcccggcugaacaagugggugcuccagaccuaccaccccgaguacaugaaguccccccugguguaccaccccggccaccgcgcgcgggccuggcgcuuccugaccuacauguucaugcacgucgggcucgagcagcugggcuucaacgcccugcuccagcugaugaucggggugccgcuggagauggugcacggccuccugcggaucagccugcucuaccuggccggcguccuggccgggucccucacggugagcaucaccgacaugcgcgcgcccguggucggcggguccggcggcguguacgcccugugcagcgcccaccuggccaacguggucaugaacugggccgggaugcggugccccuacaagcuccugcgcauggugcuggcgcucgugugcauguccagcgaggucggccgggccguguggcugcgcuucucccccccgcugcccgccagcgggccccagcccagcuucauggcccaccucgccggcgcggucguggggguguccaugggccugaccauccugcggagcuacgaggagcgccuccgcgaccagugcggcuggugggucgugcugcuggccuacgggaccuuccuccuguucgccguguucuggaacgucuucgccuacgaccugcugggcgcccacaucccgcccccccccuga

SEQ ID NO: 35686 - RNA, 1152 nt, Artificial Sequence
  derived and/or modified sequence opt1 from RHBDL2__Homo_sapiens__NP_001291675
augcagcugggcaagcgccacaagcucaccaccaagagcgugugccacgggaagggcgucgugauccgggugcuggcccugcccgggccguccuggguccgccggcgccgggagggcaaggcccucgagagcucccgcugcgcgcggcagccccgcgaggagcggcagcccgaggaccuggggcccccggccgugcccugggacagcugccccuccggcgaggagggcgggccccgcacgauggccgccgugcacgaccuggagauggagagcaugaaccucaacaugggccgggagaugaaggaggagcuggaggaggaggagaagaugcgcgaggacgggggcgggaaggaccgggccaaguccaagaagguccaccgcaucgugagcaaguggaugcugccggagaagucccggggcaccuaccucgagcgcgcgaacugcuucccgccgcccguguucaucaucagcaucucccuggccgagcuggccgucuucaucuacuacgccguguggaagccccagaagcaguggaucacccucgacaccggcauccuggagagccccuucaucuacucccccgagaagcgggaggaggcguggcgcuucaucagcuacaugcuggugcacgccgggguccagcacauccucggcaaccugugcaugcagcuggugcucgggaucccccuggagauggugcacaagggccugcgggucggccucguguaccuggccggggugaucgccggcucccuggccagcuccaucuucgacccccuccgcuaccuggucggggcgagcggcgggguguacgcccugaugggcggcuacuucaugaacgugcucgucaacuuccaggagaugauccccgccuucgggaucuuccggcugcugaucaucauccucaucaucgugcuggacaugggcuucgcccuguaccgccgcuucuucgugcccgaggacgggucccccgucagcuucgccgcgcacaucgccggcggguucgccggcaugagcaucggcuacacgguguucuccugcuucgacaaggcccuccugaaggacccgcgguucuggaucgccaucgcggccuaccuggccugcguccucuucgccguguucuucaacaucuuccugagccccgccaacuga

SEQ ID NO: 35687 - RNA, 1125 nt, Artificial Sequence
  derived and/or modified sequence opt1 from RHCE__Homo_sapiens__XP_011540191
augcccggcaccgugcuggucgggcaggaccucaccgugauggccgcccugggccugggguuccucacgagcaacuuccgccggcacuccuggagcuccguggcguucaaccuguucaugcuggcccucggcguccagugggccauccugcuggacggguuccucagccaguucccgcccggcaagguggugaucacccuguucuccauccgccuggccaccaugagcgccauguccguccucaucagcgcgggcgccgugcuggggaaggugaaccuggcccagcucgucgugauggugcuggucgaggugaccgcccugggcacgcuccggauggugaucuccaacaucuucaacaccgacuaccacaugaaccugcgccacuucuacgucuucgcggccuacuucgggcugaccguggccuggugccuccccaagccccugccgaagggcaccgaggacaacgaccagcgggccacgauccccagccuguccgccaugcucggggcgcuguuccuguggauguucuggcccagcgugaacuccgcccuccugcgcagccccauccagcggaagaacgccauguucaacaccuacuacgcccuggccgucuccguggugaccgcgaucagcggcuccagccucgcccacccgcagcgcaagaucuccaugaccuacguccacagcgccgugcuggccggcgggguggccgucggcacgagcugccaccugauccccucccccuggcucgcgauggugcuggggcuggucgccggccucaucagcaucggcggggccaagugccugcccgugugcugcaaccgggugcugggcauccaccacaucuccgucaugcacagcaucuucucccuccuggggcugcucggcgagaucaccuacaucgugcugcuggugcuccacaccgucuggaacgggaacggcaugaucggcuuccaggugcugcugagcaucggggagcucucccuggccaucgugaucgcccugaccagcggccugcucacggggcugcugcucaaccugaagaucuggaaggcgccgcacgucgccaaguacuucgacgaccagguguucuggaaguucccccaccuggccgugggcuucuga

SEQ ID NO: 35688 - RNA, 1440 nt, Artificial Sequence
  derived and/or modified sequence opt1 from RHCG__Homo_sapiens__XP_011519965
auggccuggaacaccaaccugcgcuggcggcucccccugaccugccugcuccuccaggugaucauggucauccuguucggcguguucgugcgcuacgacuucgaggccgacgcgcacugguggagcgagcggacgcacaagaaccuguccgacauggagaacgaguucuacuaccgcuacccgagcuuccaggacguccacgugaugguguucgucggguucggcuuccugaugaccuuccugcagcgguacggguucuccgccgugggcuucaacuuccuccuggccgccuucgggauccagugggcccugcucaugcagggcugguuccacuuccugcaggaccgcuacaucguggucggcguggagaaccugaucaacgcggacuucugcguggccagcgucugcguggccuucggggccgugcucggcaaggucucccccauccagcugcugaucaugaccuucuuccaggugacccucuucgcggugaacgaguucauccugcugaaccuccugaaggucaaggacgccgggggcagcaugacgauccacaccuucggggccuacuucggccugaccgugacccggauccucuaccgccggaaccuggagcaguccaaggagcgccagaacagcguguaccaguccgaccuguucgccaugaucggcacccucuuccuguggauguacuggcccagcuucaacuccgccaucagcuaccacggggacucccagcaccgggcggccaucaacaccuacugcagccuggccgccugcguccucaccuccguggccaucagcuccgcgcugcacaagaagggcaagcuggacauggugcacauccagaacgccacccucgccgggggcgucgccgugggcacggccgcggagaugaugcugaugcccuacggggcccugaucaucggcuucgucugcgggaucaucagcacccucggcuucguguaccugaccccguuccuggagucccgccuccacauccaggacacgugcgggaucaacaaccugcacggcauccccggcaucaucgggggcaucgugggggccgucacggccgccagcgcgagccuggagguguacggcaaggaggggcucgugcacuccuucgacuuccagggcuucaacggcgacuggaccgcccggacccaggggaaguuccagaucuacggccugcuggucacccucgccauggcccugaugggcgggaucaucguggggcugauccuccgccugcccuucuggggccagcccagcgacgagaacugcuucgaggacgcgguguacugggagaugccggagggcaacuccacggucuacauccccgaggaccccaccuucaagcccagcgggccguccgugcccagcgugcccauggucagcccccugccgauggccuccuccgugccccuggugcccuga

SEQ ID NO: 35689 - RNA, 555 nt, Artificial Sequence
  derived and/or modified sequence opt1 from RHEB__Homo_sapiens__NP_005605
augccccagagcaagucccgcaagaucgccauccugggcuaccggagcguggggaaguccagccucaccauccaguucgucgagggccaguucguggacuccuacgacccgaccaucgagaacacguucaccaagcugaucaccgugaacgggcaggaguaccaccuccagcuggucgacaccgccggccaggacgaguacagcaucuucccccagacguacuccaucgacaucaacggguacauccugguguacagcgugaccuccaucaagagcuucgaggucaucaaggugauccacggcaagcugcucgacauggugggcaagguccagauccccaucaugcugguggggaacaagaaggaccugcacauggagcgcgugaucuccuacgaggagggcaaggcgcucgccgagagcuggaacgccgccuuccuggaguccagcgccaaggagaaccagaccgcggucgacguguuccggcgcaucauccuggaggccgagaagauggacggggccgccucccagggcaagagcuccugcagcgugauguga

SEQ ID NO: 35690 - RNA, 552 nt, Artificial Sequence
  derived and/or modified sequence opt1 from RHEBL1__Homo_sapiens__NP_653194
augccccuggugcgcuaccggaaggucgugauccucggcuaccgcugcguggggaagaccagccuggcccaccaguucgucgagggcgaguucuccgagggguacgacccgaccguggagaacacguacagcaagaucgugacccugggcaaggacgaguuccaccuccaccuggucgacaccgccgggcaggacgaguacuccauccugcccuacagcuucaucaucggcgugcacggcuacgugcucgucuacuccgugaccagccugcacuccuuccaggugaucgagagccuguaccagaagcuccacgaggggcacggcaagacgcggguccccguggugcuggucgggaacaaggcggaccugucccccgagcgcgaggugcaggccguggagggcaagaagcucgccgagagcuggggcgccaccuucauggaguccagcgcccgggagaaccagcugacccaggggaucuucaccaaggucauccaggagaucgcgcgcguggagaacuccuacggccaggagcggcgcugccaccugauguga

SEQ ID NO: 35691 - RNA, 717 nt, Artificial Sequence
  derived and/or modified sequence opt1 from RHNO1__Homo_sapiens__NP_001239428
augcccccgcgcaagaagcggcgccagcccagccagaaggcgccccugcuguuccaccagcagccccuggagggcccgaagcacuccugcgccagcacccagcugcccaucacccacacgcgccaggugcccuccaagcccaucgaccacagcaccaucaccuccugggucagcccggacuucgacaccgccgccgggucccucuuccccgccuaccagaagcaccagaaccgggcccggcacagcucccgcaagcccacgaccagcaaguucccccaccugaccuucgaguccccgcagagcuccagcuccgagacccugggcaucccccucauccgggagugccccagcgaguccgagaaggacgugagccgccggccccuggugccgguccugagcccccagagcugcgggaacaugagcgugcaggcccuccagucccugcccuacguguucaucccgcccgacauccagacgcccgagagcuccagcgucaaggaggagcugaucccccaggaccagaaggagaacucccuccugagcugcacccugcacaccggcacccccaacuccccggagcccgggcccgugcucgugaaggacacgcccgaggacaaguacggcaucaaggucaccuggcgccggcgccagcaccuccuggcguaccuccgggagcgcggcaagcugagccggucccaguuccuggugaaguccuga

SEQ ID NO: 35692 - RNA, 591 nt, Artificial Sequence
  derived and/or modified sequence opt1 from RHOB__Homo_sapiens__NP_004031
auggccgccauccgcaagaagcugguggucgugggcgacggggcgugcggcaagaccugccuccugaucguguucagcaaggacgaguuccccgaggucuacgugccgaccguguucgagaacuacgucgccgacaucgagguggacgggaagcaggucgagcuggcccucugggacacggccggccaggaggacuacgaccggcugcgcccccuguccuaccccgacaccgacgugauccucaugugcuucagcguggacucccccgacagccuggagaacaucccggagaagugggugcccgaggucaagcacuucugccccaacgugcccaucauccugguggccaacaagaaggaccuccgguccgacgagcacguccgcaccgagcuggcgcggaugaagcaggagccggugcgcaccgacgacgggcgggccauggccgugcgcauccaggccuacgacuaccuggagugcagcgcgaagacgaaggagggcguccgggagguguucgagaccgccacccgcgccgcccuccagaagcgguacggcucccagaacgggugcaucaacugcugcaaggugcuguga

SEQ ID NO: 35693 - RNA, 2091 nt, Artificial Sequence
  derived and/or modified sequence opt1 from RHOBTB1__Homo_sapiens__XP_011538726
auggacgccgacauggacuacgagcgccccaacguggagaccaucaagugcgucguggugggcgacaacgccgucgggaagacccggcugaucugcgcgcgcgccugcaacacgacccucacccaguaccagcugcuggccacccacgugccgacggugugggccaucgaccaguaccgggucugccaggaggugcucgagcgcagccgggacguggucgacgagguguccgugagccugcgccugugggacaccuucggcgaccaccacaaggaccggcgcuucgccuacgggcgguccgacgucguggugcucugcuucagcaucgcgaaccccaacucccugaaccacgucaagagcaugugguaccccgagaucaagcacuucugcccccgcaccccggugauccuggugggcugccagcucgaccugcgguacgccgaccuggaggccgucaaccgcgcccggcgcccccucgcgcggcccaucaagcgcggggacauccugcccccggagaagggccgggagguggccaaggagcugggccuccccuacuacgagaccuccguguucgaccaguucgggaucaaggacgucuucgacaacgccauccgcgccgcccugaucagccggcgccaccuccaguucuggaagucccaccugaagaaggugcagaagccccugcugcaggcgcccuuccucccgcccaaggccccgccgcccgugaucaagauccccgagugccccagcaugggcacgaacgaggccgccugccugcuggacaacccccucugcgccgacguccuguucauccugcaggaccaggagcacaucuucgcgcaccggaucuaccucgccaccuccagcuccaaguucuacgaccuguuccugauggagugcgaggagagccccaacggguccgagggcgccugcgagaaggagaagcagagccgcgacuuccaggggcgcauccucuccguggaccccgaggaggagcgggaggagggcccgccccgcaucccccaggccgaccaguggaaguccagcaacaagagccuggucgaggcccugggccucgaggcggagggggccgugcccgagacccagacccugacgggcuggagcaagggguucaucggcaugcaccgggagaugcaggucaaccccaucuccaagcgcaugggccccaugaccguggugcggauggacgccagcgugcagccggggcccuuccgcacccugcuccaguuccuguacaccggccagcuggacgagaaggagaaggaccucgucgggcuggcccagaucgccgaggugcuggagauguucgaccuccggaugaugguggagaacaucaugaacaaggaggcguucaugaaccaggagaucacgaaggccuuccacguccgcaaggccaaccggaucaaggagugccuguccaagggcaccuucagcgacgugaccuucaagcuggacgacggggccaucuccgcgcacaagccccuccugaucugcagcugcgaguggauggccgccauguucggcggcuccuucguggagagcgccaacuccgaggucuaccugccgaacaucaacaagaucagcaugcaggccgugcucgacuaccuguacaccaagcagcugucccccaaccuggaccucgacccccuggagcugaucgcgcucgccaaccgcuucugccugccccaccugguggcccucgccgagcagcacgccguccaggagcugacgaaggcggccaccagcggggugggcaucgacggggaggugcuguccuaccucgagcuggcccaguuccacaacgcccaccagcuggccgcguggugccuccaccacaucugcaccaacuacaacagcgucugcuccaaguuccggaaggagaucaagagcaaguccgccgacaaccaggaguacuucgagcgccaccgguggccgcccgugugguaccugaaggaggaggaccacuaccagcgcgugaagcgggagcgcgagaaggaggacaucgcccugaacaagcaccggagccgccggaaguggugcuucuggaacuccagccccgccgucgcguga

SEQ ID NO: 35694 - RNA, 2250 nt, Artificial Sequence
  derived and/or modified sequence opt1 from RHOBTB2__Homo_sapiens__NP_001153508
augcaggccuggcgcaagggccccgacgggccgcagaagaccagcuccgacagcaugucccggcugauggacagcgacauggacuacgagcgccccaacguggagaccaucaagugcgucguggugggcgacaacgccgucgggaagacgcggcucaucugcgcgcgcgccugcaacgccacccugacccaguaccagcugcucgccacccacgugcccacggugugggccaucgaccaguaccgggucugccaggaggugcuggagcgcucccgggacguggucgacgacgugagcgugucccugcgccucugggacaccuucggcgaccaccacaaggaccggcgcuucgcguacgggcggagcgacgucguggugcugugcuucuccaucgccaaccccaacagccugcaccacgucaagaccaugugguacccggagaucaagcacuucugcccccgcgcccccgugauccucgugggcugccagcuggaccugcgguacgccgaccucgaggcggucaaccgcgcccggcgcccccuggcccggccgaucaagcccaacgagauccugccgcccgagaagggccgcgagguggccaaggagcucgggauccccuacuacgagaccuccguggucgcccaguucggcaucaaggacguguucgacaacgcgauccgggccgcccugaucagccgccggcaccuccaguucuggaagucccaccuccgcaacgugcagcgcccccugcugcaggcccccuuccugcccccgaagcccccgccgcccaucaucgucgugcccgacccgcccagcuccagcgaggagugccccgcccaccuccuggaggacccccucugcgcggacgucauccuggugcugcaggagcgggugcgcaucuucgcccacaagaucuaccucuccacgagcuccagcaaguucuacgaccuguuccugauggaccucagcgagggggagcugggcgggcccuccgagcccggcggcacccaccccgaggaccaccaggggcacagcgaccagcaccaccaccaccaccaccaccaccacggccgggacuuccugcuccgcgccgccuccuucgacgucugcgagagcguggacgaggccgggggcuccggccccgcggggcugcgggccagcaccuccgacggcauccugcgcgggaacggcaccggguaccuccccggccggggccgcgugcugagcuccuggagccgggccuucgucuccauccaggaggagauggccgaggacccgcugacguacaagagccgccucauggugguggucaagauggacuccagcauccagcccgggcccuuccgggccgugcugaaguaccuguacaccggcgagcucgacgagaacgagcgcgaccugaugcacaucgcgcacaucgccgagcugcucgagguguucgaccugcggaugauggucgccaacauccugaacaacgaggccuucaugaaccaggagaucaccaaggcguuccacgugcgccggaccaaccgcgugaaggagugccucgccaaggggacguucuccgacgucaccuucauccuggacgacggcaccaucagcgcccacaagccccugcugaucuccagcugcgacuggauggccgccauguucgggggcccguucguggaguccagcacccgggagguggucuuccccuacacgagcaaguccugcaugcgcgcggugcucgaguaccuguacaccggcauguucaccagcucccccgaccuggacgacaugaagcucaucauccuggccaaccggcugugccucccccaccugguggcccugaccgagcaguacacggucaccgggcucauggaggccacccagaugaugguggacaucgacggcgacgugcuggucuuccuggagcucgcccaguuccacugcgcguaccagcuggccgacuggugccugcaccacaucugcaccaacuacaacaacgugugccgcaaguucccgcgcgacaugaaggccaugagccccgagaaccaggaguacuucgagaagcaccgguggccgcccgugugguaccucaaggaggaggaccacuaccagcgcgcccggaaggagcgcgagaaggaggacuaccugcaccugaagcggcagcccaagcgccgguggcuguucuggaacucccccagcucccccagcuccagcgccgcguccagcuccagccccuccagcuccagcgccgucguguga

SEQ ID NO: 35695 - RNA, 1836 nt, Artificial Sequence
  derived and/or modified sequence opt1 from RHOBTB3__Homo_sapiens__NP_055714
augagcauccacaucguggcccugggcaacgagggggacaccuuccaccaggacaaccgccccuccggccucauccggaccuaccuggggcgcagcccgcuggucuccggcgacgagagcucccuccugcugaacgccgcgagcacgguggcccggcccguguucaccgaguaccaggccuccgccuucgggaacgucaagcucguggugcacgacugccccgucugggacaucuucgacagcgacugguacaccucccgcaaccugaucggcggcgccgacaucaucgugaucaaguacaacgugaacgacaaguucagcuuccacgaggucaaggacaacuacauccccgugaucaagcgggcgcugaacuccgugccggucaucaucgccgccguggggacccgccagaacgaggagcuccccugcacgugcccccugugcaccagcgaccggggcuccugcgugagcaccaccgaggggauccagcuggccaaggagcucggcgcgacguaccuggagcugcacucccucgacgacuucuacaucgggaaguacuucggcggcguccuggaguacuucaugauccaggcccugaaccagaagaccagcgagaagaugaagaagcgcaagauguccaacagcuuccacgggauccggcccccgcagcucgagcagcccgagaagaugcccgugcugaaggccgaggccucccacuacaacagcgaccugaacaaccuccuguucugcugccagugcguggacgucguguucuacaaccccaaccugaagaagguggucgaggcccacaagaucgugcucugcgcggugagccacgucuucaugcugcuguucaacgugaaguccccgaccgacauccaggacagcuccaucauccgcaccacgcaggaccucuucgccaucaaccgggacaccgccuuccccggcgccagccacgaguccagcgggaacccgccccugcgcgucaucgugaaggacgcccuguucugcuccugccucagcgacauccugcgguucaucuacuccggcgcguuccagugggaggagcuggaggaggacauccgcaagaagcucaaggacagcggcgacguguccaacgucaucgagaaggugaagugcauccugaagacccccgggaagaucaacugccugcggaacugcaagaccuaccaggcccgcaagccccucugguucuacaacacgagccugaaguucuuccugaacaagcccaugcucgccgacguggucuucgagauccagggcaccaccgugcccgcccaccgggccauccugguggcgcgcugcgaggucauggccgccauguucaacgggaacuacauggaggccaaguccgugcugaucccgguguacggcgucagcaaggagaccuuccucuccuuccuggaguaccuguacacggacagcugcugccccgccgggaucuuccaggcgaugugccuccugaucugcgccgagauguaccaggugucccggcugcagcacaucugcgagcuguucaucaucacccagcuccagagcaugcccucccgcgagcuggccagcaugaaccuggacaucguggaccuccugaagaaggccaaguuccaccacagcgacugccuguccaccuggcuccugcacuucaucgcgaccaacuaccugaucuucagccagaagcccgaguuccaggaccucuccgucgaggagcggagcuucguggagaagcaccgcuggccguccaacauguaccugaagcagcuggccgaguaccgcaaguacauccacagccggaagugccgcugccucgugauguga

SEQ ID NO: 35696 - RNA, 633 nt, Artificial Sequence
  derived and/or modified sequence opt1 from RHOD__Homo_sapiens__NP_055393
augaccgccgcccaggcggccggcgaggaggcgcccccgggggugcgcagcgucaagguggugcuggucggcgacgggggcugcgggaagaccucccuccugaugguguucgccgacggcgccuuccccgagagcuacacgcccaccguguucgagcgguacauggucaaccugcaggucaagggcaagcccgugcaccuccacaucugggacaccgccgggcaggacgacuacgaccgccugcggccgcuguucuaccccgacgccuccgugcuccugcugugcuucgacgugaccagccccaacuccuucgacaacaucuucaaccgcugguaccccgaggugaaccacuucugcaagaaggucccgaucaucguggugggcugcaagacggaccuccggaaggacaagagccuggucaacaagcugcgccggaacgggcucgagcccgugaccuaccaccgcggccaggagauggcccgguccgugggggccgucgcguaccuggagugcagcgcccgccugcacgacaacgugcacgccguguuccaggaggccgccgaggucgcgcucuccagccggggccgcaacuucuggcggcgcaucacccagggcuucugcguggugaccuga

SEQ ID NO: 35697 - RNA, 636 nt, Artificial Sequence
  derived and/or modified sequence opt1 from RHOF__Homo_sapiens__NP_061907
auggacgcccccggcgcccuggcgcagaccgccgccccggggcccggccgcaaggagcucaagaucgugaucgucggggacggcgggugcggcaagaccagccugcugaugguguacucccagggcagcuuccccgagcacuacgcccccuccguguucgagaaguacacggccagcgucaccgugggguccaaggaggugacccucaaccuguacgacaccgcgggccaggaggacuacgaccggcugcgcccgcucagcuaccagaacacgcaccugguccugaucugcuacgacgugaugaaccccaccuccuacgacaacgugcucaucaagugguuccccgaggucacccacuucugccgggggauccccauggugcugaucggcugcaagaccgaccugcgcaaggacaaggagcagcuccggaagcugcgcgccgcccagcuggagccgaucacguacaugcaggggcucagcgccugcgagcagauccgggcggcccuguaccuggagugcuccgccaaguuccgcgagaacguggaggacgucuuccgggaggccgccaagguggcgcucagcgcccugaagaaggcccagcgccagaagaagcggcgccugugccuccugcuguga

SEQ ID NO: 35698 - RNA, 576 nt, Artificial Sequence
  derived and/or modified sequence opt1 from RHOG__Homo_sapiens__XP_005252973
augcagagcaucaagugcguggucgugggcgacggggccgugggcaagaccugccugcucaucugcuacaccacgaacgccuuccccaaggaguacaucccgaccgucuucgacaacuacuccgcgcagagcgccguggacgggcgcaccgugaaccugaaccugugggacaccgccggccaggaggaguacgaccggcuccgcacgcuguccuacccccagaccaacgucuucgugaucugcuucagcaucgccuccccgcccagcuacgagaacgugcggcacaaguggcaccccgaggucugccaccacugccccgacgugcccauccugcucguggggaccaagaaggaccugcgcgcccagcccgacacccugcggcgccucaaggagcagggccaggcgccgaucacgccccagcagggccaggcccuggccaagcagauccacgccguccgguaccuggagugcuccgcgcuccagcaggacggggugaaggagguguucgccgaggccguccgcgccgugcugaaccccacccccaucaagcggggccgcagcugcauccugcucuga

SEQ ID NO: 35699 - RNA, 576 nt, Artificial Sequence
  derived and/or modified sequence opt1 from RHOH__Homo_sapiens__NP_001265298
augcugagcuccaucaagugcgugcucgucggcgacagcgccguggggaagaccucccugcuggugcgcuucaccagcgagacguuccccgaggccuacaagccgaccgucuacgagaacaccggcguggacguguucauggacgggauccagaucucccucggccugugggacaccgcggggaacgacgccuuccggagcauccgcccccuguccuaccagcaggccgacgucgugcucaugugcuacagcguggccaaccacaacuccuuccugaaccugaagaacaaguggaucggcgagauccggagcaaccuccccugcacgcccguccuggugguggccacccagaccgaccagcgcgagaugggcccgcaccgggcguccugcgucaacgccauggaggggaagaagcuggcccaggacgugcgcgccaagggcuaccucgagugcagcgcgcuguccaaccgcggggugcagcaggucuucgagugcgccgugcggaccgccgugaaccaggcccggcgccggaaccgccggcgccuguucagcaucaacgagugcaagaucuucuga

SEQ ID NO: 35700 - RNA, 1047 nt, Artificial Sequence
  derived and/or modified sequence opt1 from RHO__Homo_sapiens__NP_000530
augaacggcaccgaggggcccaacuucuacgugccguucagcaacgccaccggcgucgugcgcucccccuucgaguacccccaguacuaccuggccgagcccuggcaguucagcaugcucgcggccuacauguuccugcugaucgugcucggguucccgaucaacuuccugacgcuguacgucaccgugcagcacaagaagcuccggacgccccugaacuacauccugcucaaccuggccguggccgaccuguucaugguccucggcggguucaccuccacccuguacaccagccugcacggcuacuucguguucggccccaccgggugcaaccucgagggcuucuucgccacccucgggggcgagaucgcgcuguggucccuggugguccuggccaucgagcgcuacgugguggucugcaagcccaugagcaacuuccgguucggggagaaccacgccaucaugggcguggccuucacgugggugauggcgcuggccugcgccgccccgccccucgccggcuggucccgcuacauccccgaggggcugcagugcagcugcggcaucgacuacuacacccugaagcccgaggucaacaacgaguccuucgugaucuacauguucgugguccacuucaccaucccgaugaucaucaucuucuucugcuacgggcagcucguguucaccgugaaggaggcggccgcccagcagcaggagagcgccacgacccagaaggccgagaaggaggucacccggauggugaucaucauggugaucgcguuccugaucugcuggguccccuacgccuccguggccuucuacaucuucacccaccagggcagcaacuucggccccaucuucaugacgauccccgccuucuucgccaaguccgcggccaucuacaacccggucaucuacaucaugaugaacaagcaguuccgcaacugcaugcugaccaccaucugcugcgggaagaacccccucggcgacgacgaggccagcgccaccguguccaagacggagaccagccagguggcccccgcguga

SEQ ID NO: 35701 - RNA, 645 nt, Artificial Sequence
  derived and/or modified sequence opt1 from RHOJ__Homo_sapiens__NP_065714
augaacugcaaggagggcaccgacagcuccugcgggugccgcggcaacgacgagaagaagaugcugaagugcguggucgugggggacggcgccguggggaagaccugccuccugaugagcuacgccaacgacgcguuccccgaggaguacgucccgacgguguucgaccacuacgccgugaccgucaccgugggcggcaagcagcaccuccuggggcuguacgacaccgccggccaggaggacuacaaccagcugcggccccucuccuaccccaacacggacguguuccugaucugcuucagcgucgugaaccccgccuccuaccacaacgugcaggaggagugggucccggagcugaaggacugcaugccccacgugcccuacgugcucaucgggacccagaucgaccugcgcgacgaccccaagacccuggcccggcuccuguacaugaaggagaagccgcugaccuacgagcacggcgucaagcucgcgaaggccaucggggcccagugcuaccuggagugcagcgcccugacgcagaagggccucaaggcgguguucgacgaggccauccugaccaucuuccaccccaagaagaagaagaagcgcugcuccgagggccacagcugcugcuccaucaucuga

SEQ ID NO: 35702 - RNA, 618 nt, Artificial Sequence
  derived and/or modified sequence opt1 from RHOQ__Homo_sapiens__NP_036381
auggcccacggccccggggcccugaugcucaagugcguggucgugggcgacggggcggugggcaagaccugccugcugaugagcuacgccaacgacgccuucccggaggaguacguccccaccguguucgaccacuacgccguguccgucacggucgggggcaagcaguaccuccugggccuguacgacaccgccgggcaggaggacuacgaccgccuccggccccugagcuaccccaugaccgacguguuccugaucugcuucuccguggugaacccggcgagcuuccagaacgugaaggaggaguggguccccgagcucaaggaguacgcccccaacgugcccuuccugcugaucggcacccagaucgaccuccgcgacgacccgaagacgcuggcccggcugaacgacaugaaggagaagcccaucugcguggagcaggggcagaagcucgccaaggagaucggcgcgugcugcuacgucgagugcuccgcccugacccagaaggggcugaagaccguguucgacgaggccaucaucgccauccucacccccaagaagcacacggugaagaagcgcaucggcagccggugcaucaacugcugccugaucaccuga

SEQ ID NO: 35703 - RNA, 1980 nt, Artificial Sequence
  derived and/or modified sequence opt1 from RHOT1__Homo_sapiens__NP_001028738
augaagaaggacgugcgcauccugcucgucggcgagccccggguggggaagaccagccugaucaugucccuggugagcgaggaguucccggaggaggucccgccccgcgccgaggagaucaccauccccgccgacgugacgcccgagcgggugcccacccacaucgucgacuacuccgaggcggagcagagcgacgagcagcuccaccaggagaucucccaggccaacgugaucugcaucguguacgccgucaacaacaagcacagcaucgacaaggugaccucccgcuggaucccccugaucaacgagcggaccgacaaggacagccgccugccccucauccuggugggcaacaaguccgaccuggucgaguacagcuccauggagacgauccucccgaucaugaaccaguacaccgagaucgagaccugcguggagugcagcgccaagaaccugaagaacaucuccgagcuguucuacuacgcccagaaggcggugcuccaccccaccgggccccuguacugccccgaggagaaggagaugaagccggccugcaucaaggcccugacgcggaucuucaagaucagcgaccaggacaacgacggcacccucaacgacgccgagcugaacuucuuccagcgcaucugcuucaacacgccccuggcgccccaggcccucgaggacgucaagaacguggugcggaagcacaucuccgacggggucgccgacagcggccugacccugaagggcuuccucuuccugcacacccuguucauccagcgcgggcggcacgagaccaccuggaccgugcuccgccgguucggcuacgacgacgaccuggaccugacgcccgaguaccucuucccgcugcugaagaucccgcccgacugcaccaccgagcucaaccaccacgccuaccuguuccugcaguccaccuucgacaagcacgaccucgaccgcgacugcgcccugagccccgacgagcugaaggaccucuucaagguguuccccuacauccccugggggcccgacgucaacaacacggugugcaccaacgagcggggcuggaucaccuaccagggguuccugucccaguggacccugacgaccuaccucgacgugcagcgcugccuggaguaccugggcuaccucggcuacagcauccugaccgagcaggagagccaggcguccgccgucaccgugacgcgggacaagaagaucgaccugcagaagaagcagacccagcgcaacgucuuccggugcaacgugaucggggugaagaacugcggcaagagcgggguccuccaggcccugcugggccgcaaccucaugcggcagaagaagauccgcgaggaccacaaguccuacuacgccaucaacaccguguacguguacggccaggagaaguaccugcugcugcacgacaucagcgaguccgaguuccucaccgaggccgagaucaucugcgacgucgugugccugguguacgacgucagcaaccccaaguccuucgaguacugcgcgcgcaucuucaagcagcacuucauggacagccggaucccgugccugaucguggccgccaaguccgaccuccacgaggugaagcaggaguacagcaucucccccacggacuucugccgcaagcacaagaugcccccgccccaggccuucacgugcaacaccgccgacgcgcccagcaaggacaucuucgucaagcugaccaccauggccauguacccccacgcccggcugcgcugcaugugcacgugcaaccggugcaccuucugcaucugccagaacuuccucaacuccgaccugcugcagagcgugaagaacaagaucuucaccgccgugcucaaccgccacgucacccaggccgaccugaaguccagcaccuucuggcugcgggcguccuucggggccaccguguucgccgugcucggcuucgccauguacaaggcgcugcugaagcagcgcuga

SEQ ID NO: 35704 - RNA, 777 nt, Artificial Sequence
  derived and/or modified sequence opt1 from RHOU__Homo_sapiens__NP_067028
augcccccgcagcagggcgaccccgccuuccccgaccgcugcgaggcgcccccggugccgccccggcgcgagcggggcgggcgcgggggccgggggcccggcgagcccggcgggcgcggccgggccgggggcgccgaggggcgcggcgucaagugcgugcuggugggcgacggggccgucggcaagaccagccucgugguguccuacaccacgaacggguaccccaccgaguacauccccaccgccuucgacaacuucagcgccgucguguccguggacggccggcccguccgccugcagcugugcgacaccgcgggccaggacgaguucgacaagcuccggccgcugugcuacacgaacaccgacaucuuccugcucugcuucagcguggugucccccagcuccuuccagaacgucagcgagaagugggugcccgagauccgcugccacugccccaaggccccgaucauccugguggggacccaguccgaccugcgggaggacgucaaggugcucaucgagcuggacaagugcaaggagaagcccgugcccgaggaggccgccaagcugugcgcggaggagaucaaggccgccagcuacaucgagugcuccgcccucacccagaagaaccugaaggaggucuucgacgccgcgaucguggccggcauccaguacagcgacacgcagcagcagcccaagaaguccaagagccgcaccccggacaagaugaagaaccuguccaagagcugguggaagaaguacugcugcuucguguga

SEQ ID NO: 35705 - RNA, 711 nt, Artificial Sequence
  derived and/or modified sequence opt1 from RHOV__Homo_sapiens__NP_598378
augcccccgcgcgagcugagcgaggccgagcccccgccccuccgggcccccaccccgccgccccgccggcgcuccgcgccgcccgagcugggcaucaagugcgugcuggucggggacggcgccgugggcaagagcucccucaucgugagcuacacgugcaacggguaccccgcccgguaccgccccaccgcccuggacaccuucuccguccaggugcugguggacggggcccccguccggaucgagcucugggacaccgcgggccaggaggacuucgaccgccugcggagccugugcuaccccgacaccgacguguuccucgccugcuucuccgugguccagcccagcuccuuccagaacaucacggagaaguggcugcccgagauccgcacccacaacccccaggcccccgugcugcucgugggcacccaggccgaccugcgggacgacgucaacgugcugauccagcucgaccagggcgggcgcgaggggcccgugccccagccgcaggcgcagggccuggccgagaagauccgggccugcugcuaccuggagugcagcgcccucacccagaagaaccugaaggaggucuucgacuccgccauccugagcgcgaucgagcacaaggcccgccucgagaagaagcugaacgccaagggggugcggacgcugucccgcugccgguggaagaaguucuucugcuucguguga

SEQ ID NO: 35706 - RNA, 555 nt, Artificial Sequence
  derived and/or modified sequence opt1 from RHOXF1__Homo_sapiens__NP_644811
auggcccgcagccuggugcacgacaccgucuucuacugccucuccguguaccaggugaagaucagccccaccccgcagcugggcgccgcguccagcgccgaggggcacgucggccagggggcccccggccugauggggaacaugaaccccgagggcggcgugaaccacgagaacgggaugaaccgggacggcgggaugauccccgagggcgggggcggcaaccaggagccgcgccagcagccccagcccccgcccgaggagcccgcccaggccgcgauggaggggccccagcccgagaacaugcagccgcggacgcgccggaccaaguucacccuccuccagguggaggagcuggaguccgucuuccgccacacccaguaccccgacgugcccacgcggcgcgagcuggccgagaaccugggcgugaccgaggacaagguccgggugugguucaagaacaagcgcgcccggugccgccggcaccagcgcgagcugaugcucgccaacgagcugcgggcggaccccgacgacugcguguacaucgucguggacuga

SEQ ID NO: 35707 - RNA, 867 nt, Artificial Sequence
  derived and/or modified sequence opt1 from RHOXF2__Homo_sapiens__NP_115887
auggagcccccggaccagugcagccaguacaugaccucccugcucagccccgccguggacgacgagaaggagcugcaggacaugaacgccaugguccugucccucaccgaggaggugaaggaggaggaggaggacgcgcagcccgagcccgagcagggcacggccgccggggagaagcucaagagcgccggcgcccagggcggggaggagaaggacgggggcggcgaggagaaggacgggggcggggcgggcgugccggggcaccugugggagggcgaccuggagggcaccuccgggagcgacggcaacgucgaggacuccgaccagagcgagaaggagcccgggcagcaguacucccgcccccagggcgccgugggcgggcuggagcccggcaacgcccagcagcccaacgugcacgccuucacgccccugcagcuccaggagcuggagcggaucuuccagcgcgagcaguuccccagcgaguuccugcggcgccggcucgcgcgcuccaugaacgucaccgagcuggccgugcagaucugguucgagaaccggcgcgccaaguggcggcgccaccagcgggcccugauggcccgcaacaugcuccccuucauggcgguggggcagccggucauggugaccgccgccgaggccaucaccgcgccccuguucaucagcggcaugcgggacgacuacuucugggaccacucccacagcuccagccugugcuuccccaugcccccguucccgccgcccucccucccccugccccugaugcuccugccgcccaugccgcccgccgggcaggccgaguucggccccuuccccuucgugaucguccccagcuucaccuuccccaacguguga

SEQ ID NO: 35708 - RNA, 2013 nt, Artificial Sequence
  derived and/or modified sequence opt1 from RHPN1__Homo_sapiens__NP_443156
augauccuggaggagcgccccgacggcgccggggccggcgaggagagcccgcggcuccaggggugcgacucccugacccagauccagugcggccagcugcagagccgccgggcgcagauccaccagcagaucgacaaggagcuccagaugcgcaccggggccgagaaccuguaccgggccacguccaacaaccgcgugcgggagaccgucgcccuggagcucagcuacgugaacuccaaccugcagcugcucaaggaggagcuggaggagcugagcggcggcguggaccccgggcgccacggcuccgaggccgucaccgugcccaugaucccccucgggcugaaggagaccaaggagcuggacuggagcacgccgcucaaggagcugaucuccgugcacuucggcgaggacggggcgagcuacgaggccgagauccgggagcuggaggcccuccgccaggccaugcggacccccucccgcaacgagagcggccuggagcugcucaccgcguacuacaaccagcugugcuuccuggacgcccgguuccucacccccgcccgcucccugggccuguucuuccacugguacgacagccucacggggguccccgcccagcagcgggcccuggcguucgagaagggcuccgugcuguucaacaucggggcccuccacacccagaucggcgcccgccaggaccggagcugcaccgagggcgcccgccgggccauggaggcguuccagcgcgccgccggggccuucucccugcugcgggagaacuucagccacgccccgucccccgacaugagcgcggccagccucugcgcccuggagcagcugaugauggcccaggcccaggagugcguguucgagggccucuccccgcccgcgagcauggcgccccaggacugccuggcccagcugcgccucgcccaggaggccgcccaggucgccgccgaguaccgccuggugcaccggaccauggcccagccgcccgugcacgacuacguccccguguccuggacggcgcuggugcacgucaaggccgaguacuuccgcagccucgcccacuaccacguggccauggcccugugcgacgggucccccgcgaccgagggcgagcugcccacccacgagcaggucuuccuccagccgcccaccagcuccaagccccgggggcccgugcugccccaggagcuggaggagcgccggcagcucggcaaggcccaccugaagcgcgccauccugggccaggaggaggcccugcggcuccacgcccugugccgcgugcugcgggagguggaccuccugcgcgcggucaucagccagacgcugcagcggucccucgccaaguacgccgagcuggaccgcgaggacgacuucugcgaggccgcggaggcccccgacauccagccgaagacccaccagaagcccgaggcccggaugccccgccugagccaggggaagggccccgacaucuuccaccggcucgggccgcuguccguguucagcgccaagaaccgcuggcggcuggugggccccguccaccucacccgcggggagggcggcuucgggcugacccugcggggcgacucccccgugcucaucgccgcggucaucccggggagccaggccgccgccgccggccugaaggagggggacuacaucguguccgugaacggccagcccugccgcugguggcgccacgcggaggucgugacggagcugaaggccgccggcgaggccggggccagccuccagguggucucccugcugcccagcucccggcuccccagccugggcgaccgccggccggugcugcucgggccccgcggccugcugcggagccagcgcgagcacggcugcaagacccccgcguccaccugggccagcccccggccgcuccugaacuggucccgcaaggcccagcaggggaagaccggcgggugcccccagcccugcgcccccgugaagccggcgccgcccagcucccugaagcaccccggcuggcccuga

SEQ ID NO: 35709 - RNA, 2061 nt, Artificial Sequence
  derived and/or modified sequence opt1 from RHPN2__Homo_sapiens__NP_149094
augaccgacgcccugcuccccgccgcgccgcagccccuggagaaggagaacgacggcuacuuccgcaaggggugcaacccccuggcccagaccggccggagcaagcuccagaaccagcgcgccgcccugaaccagcagauccugaaggccgugcggaugcgcacgggggcggagaaccuccugaaggucgccaccaacuccaaggugcgggagcagguccgccuggagcucagcuucgugaacuccgaccugcagaugcugaaggaggagcucgagggccugaacaucagcguggggguguaccagaacaccgaggaggccuucaccaucccccugaucccgcucggccugaaggagacgaaggacgucgacuucgccguggugcugaaggacuucauccucgagcacuacuccgaggacggcuaccuguacgaggacgagaucgcggaccugauggaccuccggcaggccugccgcacccccagccgggacgaggccggggucgagcugcugaugaccuacuucauccagcucggcuucguggagucccgcuucuucccgcccacccggcagauggggcugcuguucacgugguacgacagccucaccggcgugcccgucucccagcagaaccugcugcucgagaaggccagcgugcuguucaacaccggggcccuguacacccagaucggcacgcgcugcgaccggcagacccaggcgggccucgaguccgccaucgacgccuuccagcgcgccgccggggugcugaacuaccugaaggacaccuucacccacacgcccagcuacgacaugucccccgcgaugcucagcguccuggugaagaugaugcuggcccaggcccaggaguccguguucgagaagaucagccuccccggcauccggaacgaguucuucaugcuggucaagguggcccaggaggccgcgaaggugggggaggucuaccagcagcugcacgccgccaugucccaggccccggugaaggagaacauccccuacagcugggccucccucgcgugcgugaaggcccaccacuacgccgcccuggcgcacuacuucaccgccauccugcucaucgaccaccaggucaagcccggcaccgaccuggaccaccaggagaagugccugagccagcucuacgaccacaugcccgagggccugaccccgcuggccacgcugaagaacgaccagcagcgccggcagcucggcaagagccaccuccgccgggccauggcccaccacgaggaguccgugcgcgaggcgagccugugcaagaagcugcgguccaucgagguccugcagaaggugcugugcgccgcccaggagcgcagccgccucaccuacgcccagcaccaggaggaggacgaccugcugaaccucaucgacgcccccuccguggucgcgaagaccgagcaggagguggacaucauccugccccaguucagcaagcugaccgugacggacuucuuccagaagcucgggccccuguccgucuucagcgccaacaagcgguggaccccgccccgcuccauccgguucaccgccgaggagggggaccugggcuucacccuccgcgggaacgcccccguccaggugcacuuccuggaccccuacugcagcgccuccguggcgggcgcccgggagggcgacuacaucgugagcauccagcugguggacugcaaguggcucacgcuguccgaggucaugaagcugcucaagagcuucggggaggacgagaucgagaugaagguggugucccugcuggacagcaccuccagcaugcacaacaaguccgccaccuacagcgucggcaugcagaagaccuacagcaugaucugccucgccaucgacgacgacgacaagacggacaagaccaagaagaucuccaagaagcugagcuuccuguccugggggaccaacaagaaccgccagaaguccgcgagcacccucugccugccgagcgugggcgccgcccggccccaggugaagaagaagcugcccucccccuucagccuccugaacuccgacagcuccugguacuga

SEQ ID NO: 35710 - RNA, 1149 nt, Artificial Sequence
  derived and/or modified sequence opt1 from RIBC2__Homo_sapiens__NP_056468
augggcagccagaccauggccguggcccugccccgcgaccugcggcaggacgcgaaccuggccaagcgccggcacgccgagcugugccgccagaagcgggucuucaacgcccgcaaccggaucaucgggggcgacaccgaggccugggacguccaggugcacgaccagaagaucaaggaggcgacggagaaggcccgccacgagaccuucgccgccgagaugcggcagaacgacaagaucaugugcauccucgagaaccgcaagaagcgggaccgcaagaaccugugccgggcgaucaacgacuuccagcaguccuuccagaagccggagacccgccgggaguucgaccugagcgacccccucgcccugaagaaggaccugcccgcccgccaguccgacaacgacgugcggaacaccaucagcgggaugcagaaguucaugggcgaggaccucaacuuccacgagcgcaagaaguuccaggaggagcagaaccgggaguggucccugcagcagcagcgcgaguggaagaacgcccgggccgagcagaagugcgcggaggcccuguacacggagacccgccuccaguucgacgagaccgccaagcaccuccagaagcuggagagcaccacgcgcaaggccgugugcgccuccgugaaggacuucaacaagagccaggcgaucgaguccgucgagcggaagaagcaggagaagaagcaggagcaggaggacaaccuggccgagaucaccaaccugcugcgcggggaccuccugagcgagaacccccagcaggccgccuccagcuucggcccgcaccggguggugcccgaccgcuggaagggcaugacccaggagcagcuggagcagauccggcucguccagaagcagcagauccaggagaagcugcgccugcaggaggagaagcggcagcgcgaccucgacugggaccggcgccggauccagggggcccgcgcgacccugcuguucgagcggcagcaguggcgccggcagcgcgaccuccggcgcgcccuggacuccagcaaccugucccucgccaaggagcagcaccuccagaagaaguacaugaacgagguguacacgaaccagcccaccggcgacuacuucacccaguucaacaccgggagccgguga

SEQ ID NO: 35711 - RNA, 3498 nt, Artificial Sequence
  derived and/or modified sequence opt1 from RIC1__Homo_sapiens__NP_001129392
auguacuuccugagcggcuggcccaagcgccuccugugcccgcuggggucccccgccgaggcccccuuccacgugcagagcgacccccagcgggcguucuucgccguccucgccgccgcccgccuguccaucugguacagccggccguccgugcugaucgugaccuacaaggagcccgccaagagcuccacccaguucggcagcuacaagcaggccgaguggcgccccgacuccacgaugaucgccgucagcaccgccaacggguacauccucuucuuccacaucaccuccacccggggcgacaaguaccuguacgagcccguguacccgaaggggagcccccagaugaagggcacgccccacuucaaggaggagcagugcgcgcccgcccugaaccucgagaugcgcaagauccuggaccugcaggccccgaucaugucccuccagagcgugcuggaggaccugcucgucgccaccuccgacggccugcugcaccucauccacugggaggggaugaccaacggccggaaggccaucaaccugugcaccgugcccuucagcguggaccugcaguccagccgcgucggguccuuccucggcuucacggacgugcacauccgggacauggaguacugcgcgacccuggacggguucgccguggucuucaacgacggcaaggugggcuucaucacccccgugagcagccgcuucaccgccgagcagcugcacggggucuggccccaggacgugguggacggcacgugcgucgccgugaacaacaaguaccggcucauggccuucgggugcguguccggcagcguccagguguacaccaucgacaacuccaccggcgcgaugcugcugagccacaagcucgagcugaccgccaagcaguacccggacaucuggaacaagacgggggccgugaagcugaugcgcuggucccccgacaacagcgucgugaucgucaccugggaguacggcgggcucucccuguggagcguguucggcgcccagcugaucugcacccucgggggcgacuucgccuaccgguccgacggcaccaagaaggacccccugaagaucaacagcauguccuggggcgcggagggguaccaccugugggugaucagcggguucggcucccagaacacggagaucgagagcgaccuccgcuccgucgugaagcagcccagcauccugcuguuccaguucaucaaguccgugcucaccgucaacccgugcaugagcaaccaggagcagguccugcugcagggggaggaccggcucuaccugaacugcggcgaggcgucccagacccagaacccccgcagcagcuccacccacagcgagcacaagcccucccgggagaagucccccuucgccgacggcgggcuggagagccagggccucagcacgcugcuggggcaccgccacuggcacguggugcagaucuccagcaccuaccucgaguccaacuggccgauccgguucagcgccaucgacaagcugggccagaacaucgccgugguggggaaguucggcuucgcgcacuacucccugcugaccaagaaguggaagcuguucggcaacaucacccaggagcagaacaugaucgucaccgggggccuggccugguggaacgacuucauggugcuggccugcuacaacaucaacgaccgccaggaggagcuccggguguaccugcgcacgagcaaccuggacaacgccuucgcgcacgucaccaaggcccaggccgagacccuccugcuguccguguuccaggacauggugaucgucuuccgcgccgacugcagcaucugccucuacuccaucgagcgcaagagcgacgggcccaacacgaccgccggcauccaggugcugcaggagguguccaugagccgguacaucccccaccccuuccuggucgugagcgugacccucaccuccgucagcacggagaacggcaucacccugaagaugccgcagcaggcgcgcggggccgaguccaucaugcugaaccucgccggccagcugaucaugaugcagcgggaccggagcgggccccagauccgcgagaaggacuccaaccccaacaaccagcggaagcugcucccguucugcccgcccguggugcuggcccagagcgucgagaacguguggacgaccugccgcgccaacaagcagaagcggcaccuccucgaggcgcuguggcuguccugcggcggggccggcaugaagguguggcucccccuguucccccgcgaccaccggaagccccacagcuuccugucccagcgcaucaugcuccccuuccacaucaacaucuacccccuggccguccuguucgaggacgcccucgugcugggcgccgugaacgacacccugcucuacgacagccuguacacccggaacaacgcgcgcgagcagcuggagguccucuucccguucugcgugguggagcggaccucccagaucuaccugcaccacauccugcgccagcuccugguccggaaccugggggagcaggcccuccugcuggcccagagcugcgccacccuccccuacuucccccacgugcuggagcugaugcuccacgaggugcuggaggaggaggcgaccucccgcgagcccaucccggacccccugcuccccacggucgccaaguucaucaccgaguucccccuguuccugcagaccguggugcacugcgcccggaagaccgaguacgcccucuggaacuaccuguucgccgcggucggcaacccgaaggaccuguucgaggagugccucauggcccaggaccuggacacggccgccagcuaccugaucauccuccagaacauggaggugcccgccgugucccgccagcacgcgacccugcuguucaacaccgcccucgagcaggggaagugggaccugugccgccacaugauccgguuccugaaggccaucggcagcggggaguccgagaccccgcccagcacgcccaccgcccaggagcccuccagcagcggcggcuucgaguucuuccgcaaccgguccaucagccucucccagagcgccgagaacguccccgcguccaaguucagccugcagaagacccuguccaugcccagcgggccguccggcaagcgcuggagcaaggacuccgacugcgccgagaacauguacaucgacaugaugcucuggcggcacgcccgccggcugcuggaggacgugcgccucaaggaccuggggugcuucgccgcgcagcugggcuucgagcucaucagcuggcugugcaaggagcggacccgcgccgcccggguggacaacuucgucaucgcccugaagcgccuccacaaggacuuccuguggccccugcccaucaucccggccuccagcaucuccagccccuucaagaacgggaaguaccggacgggcaacguggacuucaugucccucgugcagggcgagcuguacuucacccccugcaucuacaccuucugcuacuga

SEQ ID NO: 35712 - RNA, 564 nt, Artificial Sequence
  derived and/or modified sequence opt1 from RIC3__Homo_sapiens__NP_001128581
auggccuacagcaccgugcagcgcgucgcccuggcguccggccucgugcuggcccugagccuccugcugcccaaggccuuccucucccgggggaagcgccaggagccgccgcccacccccgagggcuaccccgaggagacguaccccaucuacgaccugagcgacugcaucaagcggcgccaggagaccauccugguggacuaccccgaccccaaggagcucuccgccgaggagaucgccgagcggauggggaugaucgaggaggaggagagcgaccaccugggcugggagucccugccgaccgacccccgcgcgcaggaggacaacagcgucaccuccugcgaccccaagcccgagacgugcagcugcugcuuccacgaggacgaggacccggccgugcucgccgagaacgccggguucuccgcggacagcuaccccgagcaggaggagaccaccaaggaggaguggucccaggacuucaaggacgagggccugggcaucagcaccgacaaggccuacacgggguccaugcugcggaagcgcaacccccagggccucgaguga

SEQ ID NO: 35713 - RNA, 5199 nt, Artificial Sequence
  derived and/or modified sequence opt1 from RICTOR__Homo_sapiens__NP_001272368
auggccgccaucggccgcgggcggagccugaagaaccugcgcgugcggggccgcaacgacuccggggaggagaacgugccccuggaccugacccgggagccgagcgacaaccugcgcgagauccugcagaacguggcgcggcugcagggcguguccaacaugcgcaagcucgggcaccugaacaacuucaccaagcugcucugcgacaucggccacagcgaggagaagcugggcuuccacuacgaggacaucaucaucugccugcggcucgcccugcugaacgaggccaaggaggugcgcgccgccgggcuccgggcgcugcgcuaccugauccaggacuccagcauccuccagaaggugcugaagcugaagguggacuaccucaucgcccggugcaucgacauccagcaguccaacgaggucgagcgcacgcaggcccugcggcuggugcgcaagaugaucaccgugaacgccagccucuuccccuccagcgucaccaacucccugaucgcggugggcaacgacgggcugcaggagcgggaccgcauggugcgggccugcaucgccaucaucugcgagcucgcccugcagaaccccgaggucguggcccugcgcggcgggcucaacaccauccugaagaacgugaucgacugccagcugagccggaucaacgaggcgcucaucacgaccauccugcaccuccugaaccaccccaagacccgccaguacguccgcgccgacguggagcuggagcggauccuggccccguacaccgacuuccacuaccgccacucccccgacacggccgagggccagcucaaggaggaccgggaggcccgcuuccuggcgagcaagaugggcaucaucgccaccuuccgguccugggccgggaucaucaaccugugcaagcccggcaacagcgggauccagucccucaucggcgugcugugcauccccaacauggagauccgccggggccugcucgagguccuguacgacaucuuccgccugccgcuccccguggugaccgaggaguucaucgaggcccugcugagcgucgaccccgggcgguuccaggacuccuggcgccugagcgacggcuucguggccgcggaggccaagaccauccucccccaccgggcccgcagccggccggaccugauggacaacuaccuggcccucauccuguccgccuucauccgcaacgggcugcucgagggccugguggaggucaucacgaacagcgacgaccacaucuccgugcgggcgaccauccugcucggggagcugcugcacauggccaacaccauccucccccacagccacucccaccaccuccacugccugcccacccucaugaacauggccgccagcuucgacauccccaaggagaagcgccugcgggcguccgccgcccugaacugccucaagcgcuuccacgagaugaagaagcggggcccgaagcccuacagccugcaccuggaccacaucauccagaaggccaucgccacgcaccagaagcgcgaccaguaccuccgcguccagaaggacaucuucauccugaaggacaccgaggaggcgcugcucaucaaccugcgggacucccaggugcugcagcacaaggagaaccucgaguggaacuggaaccugaucggcaccauccugaaguggcccaacgugaaccuccgcaacuacaaggacgagcagcugcaccgguucguccgccggcugcucuacuucuacaagcccagcuccaagcuguacgccaaccuggaccucgacuucgccaaggccaagcagcugaccgugguggggugccaguucacggaguuccugcucgagagcgaggaggacggccagggguaccuggaggaccuggucaaggacaucgugcaguggcucaacgccuccagcggcaugaagccggagcgcucccugcagaacaacgggcugcucaccacccugagccagcacuacuuccuguucaucggcacccucuccugccacccccacggcgugaagaugcuggagaagugcagcgucuuccagugccugcucaaccugugcucccugaagaaccaggaccaccuccugaagcugacggugagcagccucgacuacucccgggacgggcuggcgcgcgugauccugagcaagauccucaccgccgccaccgacgccugccggcuguacgccaccaagcaccuccgcguccuccugcgggcgaacguggaguucuucaacaacuggggcaucgagcugcucgugacgcagcugcacgacaagaacaagaccaucuccagcgaggcccuggacauccucgacgaggccugcgaggacaaggccaaccugcacgcgcugauccagaugaagcccgcccucucccaccugggggacaagggccugcuccugcugcuccgcuuccugagcauccccaagggguucuccuaccugaacgagcggggcuacgucgccaagcagcucgagaaguggcaccgcgaguacaacagcaaguacguggaccugaucgaggagcagcugaacgaggcccucaccaccuaccggaagccgguggacggcgacaacuacguccgccgguccaaccagcgccugcagcggccccacguguaccugcccauccaccucuacgggcagcuggugcaccacaagacgggcugccaccuccuggagguccagaacaucaucaccgagcugugccgcaacgugcggacccccgaccuggacaagugggaggagaucaagaagcugaaggccagccugugggcgcuggggaacaucggcuccagcaacuggggccugaaccuccugcaggaggagaacgugaucccggacauccugaagcucgccaagcagugcgagguccuguccauccgcgggaccugcguguacgugcugggccucaucgccaagacgaagcaggggugcgacauccugaagugccacaacugggacgccguccgccacagccggaagcaccuguggcccguggugcccgacgacgucgagcagcucugcaacgagcuguccagcaucccguccacccugagccucaacagcgaguccaccagcucccgccacaacagcgaguccgagagcgugcccuccagcauguucauccuggaggacgaccgguucggcuccagcuccaccagcaccuucuuccuggacaucaacgaggacacggagcccaccuucuacgaccgcuccgggcccaucaaggacaagaacagcuucccguucuucgccuccagcaagcucgugaagaaccggauccugaacucccugacccuccccaacaagaagcaccgcagcuccagcgaccccaagggcggcaagcugagcuccgagagcaagaccuccaaccggcgcauccggacgcugaccgagcccagcgucgacuucaaccacuccgacgacuucaccccgaucagcaccgugcagaagacgcuccagcuggagaccuccuucauggggaacaagcacaucgaggacaccggcagcacccccuccaucggggagaacgaccugaaguucacgaagaacuucggcaccgagaaccaccgcgagaacaccagccgggagcgccucguggucgaguccagcaccuccagccacaugaagauccggucccagagcuucaacacggacaccaccaccuccgggaucagcuccaugagcagcucccccagccgcgagacggugggcguggacgcgaccaccauggacaccgacugcggcuccaugagcacggucguguccaccaagaccaucaagaccagccacuaccugacgccccaguccaaccaccugagccucuccaagagcaacuccgugagccuggucccgcccggguccagccacacccugccccggcgcgcccagucccucaaggcccccagcaucgccaccaucaagucccuggccgacugcaacuucagcuacaccuccagccgggacgcguucggcuacgccacgcugaagcgccuccagcagcagcggaugcacccgagccugucccacagcgaggcccuggccucccccgcgaaggacguccuguucaccgacaccaucaccaugaaggccaacagcuucgagucccgccugacgcccagccgcaucgacuucaagaagaagcacgucgggggcauccggucccugcgccccaccaucaccaacaaccucuuccgguucaugaaggcccugagcuacgccucccuggacaaggaggaccuccugagcccgaucaaccagaacacccugcagcgcuccagcuccguccggagcaugguguccagcgccaccuacgggggcuccgacgacuacaucggccucgcgcugcccguggacaucaacgacaucuuccaggucaaggacauccccuacuuccagacgaagaacaucccgccccacgacgaccgcggggcccgggccuucgcccacgacgccggcgggcugcccagcggcaccgggggccucgugaagaacuccuuccaccuccugcgccagcagaugagccucaccgagaucaugaacagcauccacuccgacgcgagccuguuccuggaguccaccgaggacacgggccuccaggagcacaccgacgacaacugccuguacugcgugugcaucgagauccugggguuccagcccagcaaccagcucuccgccaucugcagccacuccgacuuccaggacaucccguacagcgacuggugcgagcagaccauccacaacccccuggaggucgugcccuccaaguucagcggcaucuccgggugcagcgacggcgucucccaggagggcagcgccuccagcaccaaguccacggagcugcuccugggggugaagaccauccccgacgacaccccgaugugccggauccugcuccgcaaggaggugcugcggcuggucaucaaccucagcuccagcgugagcaccaagugccacgagacgggccugcugaccaucaaggagaaguacccccagaccuucgacgacaucugccucuacuccgaggugagccaccuccugucccacugcaccuuccgccuccccugccggcgcuucauccaggagcuguuccaggacguccaguuccugcagaugcacgaggaggccgaggccgugcucgcgacgcccccgaagcagcccaucguggacaccagcgccgaguccuga

SEQ ID NO: 35714 - RNA, 7341 nt, Artificial Sequence
  derived and/or modified sequence opt1 from RIF1__Homo_sapiens__NP_001171134
augaccgcccgcggccagagcccccuggcgccccuccuggagacccuggaggaccccagcgccagccacgggggccagacggacgccuaccucacccugaccagccggaugaccggggaggagggcaaggaggugaucaccgagaucgagaagaagcugccccgccucuacaaggugcugaagacccacaucagcagccagaacagcgagcuguccagcgccgcccuccaggcccugggguucugccuguacaaccccaagaucaccuccgagcucagcgaggcgaacgcccuggagcugcucuccaagcugaacgacaccaucaagaacagcgacaagaacgugcggacccgcgcccugugggugaucuccaagcagaccuuccccagcgaggucgugggcaagaugguguccagcaucaucgacucccucgagauccuguucaacaagggcgagacccacagcgccgucguggacuucgaggcgcugaacgugaucguccggcucaucgagcaggcccccauccagaugggggaggaggccgugcgcugggccaagcuggugaucccccuggucgugcacuccgcccagaaggugcaccuccggggcgcgaccgcccuggagauggggaugccccugcuccugcagaagcagcaggagaucgccagcaucacggagcagcugaugaccaccaagcucaucagcgagcugcagaagcuguucauguccaagaacgagaccuacguccucaagcuguggccgcuguucgugaagcuccugggccgcacgcugcaccggagcggguccuucaucaacagccuccugcagcuggaggagcucggcuuccgcuccggcgcccccaugaucaagaagaucgccuucaucgcguggaagucccugaucgacaacuucgcccugaaccccgacauccucugcuccgccaagcggcugaagcugcucaugcagccccugagcuccauccacgugcgcaccgagacccuggcccugaccaagcucgaggucuggugguaccugcugaugcggcucgggccgcaccuccccgccaacuucgagcaggucugcgugccccugauccagagcacgaucuccaucgacagcaacgcgagcccccagggcaacagcugccacgucgccaccuccccggggcucaaccccaugacccccgugcacaagggcgccagcucccccuacggcgccccggggacgccccgcaugaaccugagcuccaaccugggcgggauggccacgauccccagcauccagcuccugggccuggagaugcuccugcacuuccugcucgggcccgaggcgcugagcuucgccaagcagaacaagcuggugcucucccuggagccgcuggagcacccccucaucagcucccccagcuucuucuccaagcacgccaacacccugaucaccgccguccacgacagcuucguggcggucggcaaggacgcccccgacgugguggucuccgccaucuggaaggagcugaucagccucgugaaguccgugaccgagagcggcaacaagaaggagaagccgggguccgagguccugacgcugcuccugaagucccuggaguccaucgugaaguccgagguguuccccgucuccaagacccucgugcugauggagaucaccaucaagggccugccccagaaggugcucgggagcccggccuaccaggucgccaacauggacauccugaacggcacccccgcgcuguuccucauccagcugaucuucaacaacuuccuggagugcgggguguccgacgagcgguucuuccucagccuggagagccuggugggcugcguccucuccggccccacgagcccccuggccuucuccgacagcgugcugaacgugaucaaccagaacgccaagcagcucgagaacaaggagcaccuguggaagaugugguccgucaucgugaccccgcugaccgagcucaucaaccagaccaacgaggugaaccagggggacgcccuggagcacaacuucagcgccaucuacggcgcgcugacgcuccccgucaaccacaucuucuccgagcagcgcuuccccguggccaccaugaagacccugcugcggaccuggagcgagcucuaccgcgccuucgcccggugcgccgcgcugguggccaccgccgaggagaaccugugcugcgaggagcucuccagcaagaucauguccagccuggaggacgagggguucuccaaccuccuguucgucgaccgcaucaucuacaucaucacggugaugguggacugcaucgacuucagccccuacaacaucaaguaccagccgaaggucaagagcccccagcggcccagcgacugguccaagaagaagaacgagccccugggcaagcugaccagccucuucaagcugaucgugaaggugaucuacuccuuccacacccugagcuucaaggaggcccacagcgacacccucuucacgaucgggaacuccaucaccggcaucaucagcuccguccugggccacaucagccugccguccaugauccgcaagaucuucgcgacccucacccgcccccuggcccuguucuacgagaacagcaagcucgacgaggugcccaagguguacuccugccugaacaacaagcuggagaagcuccugggggagaucaucgccugccugcaguucagcuacacgggcaccuacgacuccgagcuccuggagcagcugagcccccuccugugcaucaucuuccugcacaagaacaagcagauccggaagcaguccgcccaguucuggaacgccaccuucgcgaaggucaugaugcucguguacccggaggagcugaagcccgugcugacccaggccaagcagaaguuccuccugcugcuccccgggcuggagacggucgagaugauggaggagagcuccggccccuacagcgacggcaccgagaacucccagcugaacgugaagaucagcgggauggagcgcaaguccaacggcaagcgggacagcuuccucgcccagaccaagaacaagaaggagaacaugaagccggccgccaagcugaagcuggaguccagcagccugaaggugaagggggagauccuccuggaggaggagaaguccaccgacuucgucuucaucccgcccgagggcaaggacgcgaaggagcgcauccugacggaccaccagaaggaggugcucaagaccaagcggugcgacauccccgccauguacaacaaccuggacgugagccaggacacccuguucacccaguacucccaggaggagcccauggagauccccacgcucacccgcaagcccaaggaggacagcaagaugaugaucaccgaggagcagauggacuccgacaucgucaucccgcaggacgugaccgaggacugcgggauggccgagcaccuggagaaguccucccugagcaacaacgagugcggcucccucgacaagacgagccccgagauguccaacagcaacaacgacgagcggaagaaggcccugaucuccagccgcaagaccuccaccgagugcgccagcuccaccgagaacagcuucguggucuccagcagcuccgugagcaacacgaccguggcgggcacgccgcccuacccgaccucccggcgccagacguucaucacccuggagaaguucgacgggagcgagaaccggcccuucucccccagcccccucaacaacaucuccagcaccgucaccgugaagaacaaccaggagacgaugaucaagaccgacuuccugccgaaggccaagcagcgcgagggcaccuucuccaagagcgacuccgagaagaucgugaacgggaccaagcggagcucccgccgggccggcaaggccgagcagaccgggaacaagcgcagcaagccccugaugcgguccgagcccgagaagaacacggaggagagcgucgagggcaucgugguccucgagaacaacccgcccggccugcugaaccagaccgagugcguguccgacaaccaggugcaccucagcgaguccaccauggagcacgacaacaccaagcugaaggcggccacggucgagaacgccgugcugcucgagaccaacaccguggaggagaagaacgucgagaucaaccuggagagcaaggagaacacgccgcccguggugaucagcgccgaccagauggucaacgaggacucccaggugcagaucacgcccaaccagaagacccugcgccggagcucccgccgccggagcgagguggucgaguccaccaccgagagccaggacaaggagaacucccaccagaagaaggagcgccggaaggaggaggagaagccccuccagaaguccccgcugcacaucaaggacgacgugcugcccaagcagaagcucaucgccgagcagacgcugcaggagaaccugaucgagaagggguccaaccuccacgagaagacccugggcgagaccagcgcgaacgccgagaccgagcagaacaagaagaaggccgaccccgagaacaucaaguccgagggggacggcacgcaggacaucguggacaagagcuccgagaagcugguccgcgggcggacccgcuaccagacccggcgcgccagccagggccuccuguccagcaucgagaacuccgagagcgacuccagcgaggccaaggaggagggcagccggaagaagcgcuccgggaaguggaagaacaagagcaacgaguccguggacauccaggaccaggaggagaagguggucaagcaggagugcaucaaggcggagaaccagagccacgacuacaaggccaccuccgaggaggacgugagcaucaagucccccaucugcgagaagcaggacgagagcaacacggugaucugccaggacuccaccgucaccagcgaccugcuccaggugcccgacgaccugcccaacgugugcgaggagaagaacgagaccuccaaguacgccgaguacagcuucacgucccugcccgucccggagagcaaccuccggacccgcaacgccaucaagcggcugcacaagcgcgacuccuucgacaacugcagccugggcgaguccagcaagaucgggaucagcgacaucuccagccucuccgagaagaccuuccagacccuggagugccagcacaagcggagccgccgggugcgccgguccaagggcugcgacugcugcggggagaagucccagccccaggagaagucccugaucggccucaagaacacggagaacaacgacguggagaucagcgagaccaagaaggccgacguccaggcgcccgugucccccagcgagaccucccaggccaacccguacagcgagggccaguuccuggacgagcaccacuccgugaacuuccaccuggggcucaaggaggacaacgacaccaucaacgacagccugaucgucuccgagaccaagagcaaggagaacaccaugcaggagucccugcccagcggcaucgugaacuuccgcgaggagaucugcgacauggacuccagcgaggccaugagccucgagucccaggagagccccaacgagaacuucaagaccguggggccgugccugggcgacuccaagaacgucagccaggagucccuggagaccaaggaggagaagcccgaggagacgcccaagauggagcucagccuggagaacgugaccguggagggcaacgccugcaaggucaccgaguccaaccuggagaaggccaagaccauggagcucaacguggggaacgaggcgagcuuccacggccaggagcggaccaagacggggaucuccgaggaggccgccaucgaggagaacaagcgcaacgacgacagcgaggccgacaccgcgaagcugaacgccaaggagguggccaccgaggaguucaacuccgacaucagccuguccgacaacaccacgcccgucaagcucaacgcccagaccgagaucagcgagcagaccgccgcgggcgagcuggacgggggcaacgacguguccgaccugcacagcuccgaggagaccaacacgaagaugaagaacaacgaggagaugaugaucggcgaggccauggccgagaccgggcacgacggcgagaccgagaacgaggggaucaccacgaagaccagcaagccggacgaggccgagaccaacaugcucaccgccgagauggacaacuucgugugcgacacggucgagauguccaccgaggagggcaucaucgacgcgaacaagaccgagaccaacacggaguacagcaagagcgaggagaagcuggacaacaaccagauggugauggaguccgacauccugcaggaggaccaccacaccagccagaagguggaggagcccucccagugccucgccagcgggaccgccaucuccgagcugaucaucgaggacaacaacgccagcccccagaagcugcgcgagcucgaccccucccuggucagcgccaacgacuccccgagcggcaugcagacccggugcguguggagcccccuggcgagccccuccacgagcauccucaagcgcggccugaagcggucccaggaggacgagaucagcucccccgugaacaagguccgccgggugagcuucgccgacccgaucuaccaggccgggcuggccgacgacaucgaccgccggugcuccaucgugcgcagccacagcuccaacagcucccccaucggcaagagcgucaagaccucccccaccacccagagcaagaucuccgagauggcgaaggagagcauccccugcccgacggaguccguguacccgccccuggucaacugcguggcccccguggacaucauccugccgcagaucaccagcaacaugugggcccgggggcugggccagcucauccgcgccaagaacaucaagaccaucggggaccuguccacccugacggccagcgagaucaagacccuccccauccggucccccaaggucagcaacgugaagaaggcgcugcgcaucuaccacgagcagcaggucaagacccggggccuggaggagauccccguguucgacaucuccgagaagaccgugaacggcaucgagaacaagagccucuccccggacgaggagcgccuggugagcgacaucaucgaccccgucgcccuggagaucccccucuccaagaaccugcuggcccagaucagcgcccucgcccugcagcuggacagcgaggaccuccacaacuacuccgggagccagcuguucgagaugcacgagaagcuguccugcauggcgaacagcgugaucaagaaccuccagucccgguggcgcagccccucccacgagaacagcaucuga

SEQ ID NO: 35715 - RNA, 1206 nt, Artificial Sequence
  derived and/or modified sequence opt1 from RILP__Homo_sapiens__NP_113618
auggagccccgccgggccgccccgggcgugcccggguggggcagccgcgaggcggccggguccgccagcgccgccgagcuggucuaccaccucgcgggcgcccuggggaccgagcugcaggaccucgcccggcgcuucggccccgaggccgcggccggccuggugccccuggugguccgggcccucgagcugcuggagcaggccgccguggggccggcgcccgacucccuccaggugagcgcccagcccgccgagcaggagcugcgccggcugcgcgaggagaacgagcggcuccgccgggagcugcgcgccggcccccaggaggagcgggcccugcuccgccagcugaaggaggucaccgaccggcagcgcgacgagcugcgggcgcacaaccgcgaccuccggcagcgcgggcaggagacggaggcccugcaggagcagcugcagcggcuccugcuggugaacgccgagcuccgccacaagcuggccgccaugcagacccagcugcgcgcggcccaggaccgggagcgcgagcggcagcagccgggcgaggccgccacgccccaggccaaggagcgcgcgcgggggcaggccggccgccccggccaccagcacgggcaggagcccgagugggccaccgccggcgcgggggccccgggcaaccccgaggaccccgccgaggccgcccagcagcucggccggcccuccgaggcggggcagugccgcuucagccgggaggaguucgagcagauccugcaggagcgcaacgagcugaaggccaagguguuccuccugaaggaggagcuggccuacuuccagcgggagcuccugaccgaccaccgcgucccgggccugcuccuggaggccaugaagguggccgugcggaagcagcgcaagaagaucaaggcgaagaugcuggggacccccgaggaggccgaguccagcgaggacgaggccggccccuggauccuccuguccgacgacaagggggaccacccgcccccgcccgagagcaagauccaguccuucuucggccugugguaccggggcaaggccgagagcuccgaggacgagaccagcucccccgcccccagcaagcucgggggcgaggaggaggcgcagccccagucccccgcccccgacccgcccugcagcgcccugcacgagcaccugugccucggggccuccgcggcccccgaggccuga

SEQ ID NO: 35716 - RNA, 1212 nt, Artificial Sequence
  derived and/or modified sequence opt1 from RILPL1__Homo_sapiens__NP_847884
auggaggaggagcgcggcagcgcccuggccgcggaguccgcccucgagaagaacguggccgagcugaccgucauggacguguacgacaucgccagccugguggggcacgaguucgagcgggucaucgaccagcacggcugcgaggccaucgcgcgccucaugcccaagguggugcggguccuggagauccuggaggugcucgugucccgccaccacgucgccccggagcuggacgagcugcggcucgagcuggaccgccugcggcucgagcgcauggaccggaucgagaaggagcgcaagcaccagaaggagcuggagcugguggaggacguguggcgcggggaggcccaggaccuccugagccagaucgcccagcugcaggaggagaacaagcagcucaugaccaaccugucccacaaggacgucaacuucagcgaggaggaguuccagaagcacgagggcauguccgagcgggagcgccaggugaugaagaagcugaaggagguggucgacaagcagcgggacgagauccgggcgaaggaccgcgagcucgggcugaagaacgaggacguggaggcccugcagcagcagcagacgcggcucaugaagaucaaccacgaccugcgccaccgggugaccgucguggaggcccagggcaaggcccugaucgagcagaagguggagcucgaggccgaccugcagaccaaggagcaggagaugggcagccugcgcgcggagcucgggaagcugcgggagcgccugcagggcgagcacucccagaacggggaggaggagcccgagaccgagcccgucggcgaggagagcaucuccgacgccgagaagguggccauggaccucaaggaccccaaccgcccgcgguucacgcugcaggagcugcgcgacgugcuccacgagcggaacgagcucaagagcaaggucuuccugcugcaggaggagcuggccuacuacaaguccgaggagauggaggaggagaaccgcaucccccagcccccgcccaucgcccacccccggaccagcccccagcccgaguccgggaucaagcgccuguucagcuucuucucccgggacaagaagcgccucgcgaacacccagcggaacgugcacauccaggagagcuucggccagugggccaacacccaccgcgacgacggcuacacggagcaggggcaggaggcccugcagcaccuguga

SEQ ID NO: 35717 - RNA, 3159 nt, Artificial Sequence
  derived and/or modified sequence opt1 from RIMBP2__Homo_sapiens__NP_056162
augcgcgaggccgccgagcggcgccagcagcugcagcucgagcacgaccaggcgcuggccgugcugagcgccaagcagcaggagaucgaccuccugcagaaguccaagguccgggagcuggaggagaagugccgcacccagagcgagcaguucaaccuccugucccgggaccuggagaaguuccgccagcacgccggcaagaucgaccuccucgggggcagcgccguggcgccccuggacaucuccaccgccccgagcaagcccuucccccaguucaugaacgggcuggccacgucccugggcaaggggcaggagagcgccaucggcggcuccagcgcgaucggggaguacauccggccccugccgcagcccggcgaccgccccgagccccucuccgccaagccgaccuuccugagccgguccgggagcgcccgcugccgguccgagagcgacauggagaacgagcgcaacuccaacaccagcaagcagcgguacuccggcaaggugcaccugugcgucgcccgcuacagcuacaaccccuucgacgggcccaacgagaaccccgaggccgagcucccgcugaccgcgggcaaguaccuguacguguacggcgacauggacgaggacggguucuacgagggcgagcuccuggacgggcagcggggccuggugcccagcaacuucgucgacuucgugcaggacaacgagucccgccucgccagcacgcugggcaacgagcaggaccagaacuucaucaaccacuccgggaucggccuggagggggagcacauccucgaccugcacagccccacccacaucgacgccggcaucaccgacaacuccgccgggacccuggacgugaacaucgacgacaucggcgaggacaucguccccuacccgcggaagaucacgcucaucaagcagcuggccaagagcgugaucgugggcugggagccgcccgcggucccgcccggguggggcaccguguccagcuacaacgugcuggucgacaaggagacccgcaugaaccucacccuggggucccggacgaaggcccugaucgagaagcucaacauggccgccugcaccuaccgcaucagcgugcagugcgugaccucccggggcagcuccgacgagcugcagugcacccugcucgucgggaaggacgugguggucgcccccagccaccuccgcguggacaacaucacgcagaucuccgcgcagcugagcuggcugcccaccaacuccaacuacagccacgugaucuuccugaacgaggaggaguucgacaucgucaaggccgcccgcuacaaguaccaguucuucaaccugcggcccaacauggccuacaaggugaagguccucgccaagccccaccagaugcccuggcagcugccccuggagcagcgcgagaagaaggaggcguucguggaguucuccacccuccccgccggcccgcccgcgcccccgcaggacgugaccguccaggccggcgugacgcccgccaccauccgggugagcuggcgcccgcccguccugacccccaccgggcugagcaacggcgccaacgugacgggguacggcguguacgccaaggggcagcgggucgccgaggugaucuuccccaccgccgacuccaccgcgguggagcugguccgccuccggagccuggaggccaagggcgugaccgugcgcacgcuguccgcccagggcgagagcgucgacuccgccguggccgcggugccgcccgagcuccuggucccgcccacgccccacccccggcccgcgccccagagcaagccccuggccuccagcggggugcccgagaccaaggacgagcaccucggcccgcacgcccgcauggacgaggccugggagcagucccgggcccccgggcccgugcacggccacaugcuggagcccccggucggccccgggcgccggagccccucccccagccgcauccugccgcagccccagggcacccccguguccaccaccguggccaaggccauggcccgggaggcggcccagcgcgucgccgagagcucccggcucgagaagcgcagcguguuccuggagcgguccagcgccgggcaguacgccgcgagcgacgaggaggacgccuacgacuccccggacuucaagcgccgcggcgccagcguggacgacuuccugaagggguccgagcucggcaagcagccccacugcugccacggcgacgaguaccacaccgagagcucccgggggagcgaccuguccgacaucauggaggaggacgaggaggagcuguacagcgagaugcagcucgaggacggcgggcgccggcgccccuccggcaccagccacaacgcccugaagauccuggggaaccccgccuccgcgggccgggucgaccacaugggccgccgguucccgcgcgggagcgccggcccccagcggucccgccccgugacggugcccagcaucgacgacuacgggcgggaccgccucuccccggacuucuacgaggagagcgagaccgaccccggcgccgaggagcugcccgcccggaucuucgucgcccuguucgacuacgacccccucaccauguccccgaaccccgacgcggccgaggaggagcugcccuucaaggaggggcagaucaucaagguguacggcgacaaggacgccgacggcuucuaccgcggggagaccugcgcccggcugggccucauccccugcaacauggugagcgagauccaggcggacgacgaggagaugauggaccagcugcugcgccagggguuccucccgcugaacacccccgucgagaagaucgagcggucccgccggagcggccgccggcacagcguguccacgcgccgcaugguggcccuguacgacuacgacccccgggagagcucccccaacgucgacguggaggccgagcucaccuucugcaccggggacaucaucaccguguucggcgagaucgacgaggacggcuucuacuacggggagcugaacggccagaaggggcuggucccgagcaacuuccucgaggaggugcccgacgacguggaggucuaccuguccgacgcccccagccacuacucccaggacacgcccaugcgcagcaaggccaagcggaagaaguccgugcacuucaccccguga

SEQ ID NO: 35718 - RNA, 4920 nt, Artificial Sequence
  derived and/or modified sequence opt1 from RIMBP3C__Homo_sapiens__NP_001122105
auggccaaggacagccccuccccgcugggcgccagccccaagaagcccgggugcuccagccccgcggccgccgugcucgagaaccagcgccgggagcuggagaagcugcgcgccgagcucgaggccgagcgggcgggcuggcgcgccgagcggcgccgguucgccgcccgcgagcggcagcugcgcgaggaggcggagcgggagcgccggcagcuggccgaccgccuccgguccaagugggaggcccagcgcagccgggagcugcgccagcugcaggaggagaugcagcgggagcgcgaggccgagauccggcagcuccugcgcuggaaggaggccgagcagcgccagcugcagcagcuccugcaccgggagcgcgacggggucgugcggcaggcgcgcgagcugcagcggcagcucgccgaggagcuggugaaccgcggccacugcucccggccgggggccagcgaggucuccgccgcccagugccgcugccggcugcaggaggugcucgcgcagcugcgcuggcagaccgacggcgagcaggccgcccggauccgcuaccugcaggccgcccucgagguggagcggcagcuguuccugaaguacauccucgcgcacuuccgcggccaccccgcccugagcgggucccccgacccccaggccguccacagccuggaggagccgcucccccagaccuccagcggcuccugccacgcccccaagcccgccugccagcuggggagccuggacucccucagcgcggaggugggcgugcggucccgcagccuggggcuggucagcuccgccugcagcuccagcccggacggccuccuguccacgcacgccagcucccuggacugcuucgcccccgcgugcagccggucccucgacagcacccgcucccugcccaaggccagcaaguccgaggagcggcccagcuccccggacaccagcacccccggcucccgccgccuguccccgccgcccagcccccugccgccgcccccgccgcccagcgcccaccggaagcucagcaacccccgcgggggcgagggguccgagagccagcccugcgaggugcugacgcccuccccgcccggccucggccaccacgagcugaucaagcugaacuggcuccuggccaaggcccugugggugcucgcgcggcgcugcuacacccugcaggaggagaacaagcagcugcggcgcgccgggugccccuaccaggccgacgagaaggucaagcggcugaaggugaagcgcgccgagcucaccggccuggcccggcgccuggcggaccgggcccgcgagcuccaggagaccaaccugcgggccgugagcgcccccauccccggggaguccugcgccggccuggagcucugccaggucuucgcgcgccagcgggcccgcgaccugagcgagcaggccuccgcgccccuggccaaggacaagcagaucgaggagcuccggcaggagugccaccuccugcaggcccgcguggccagcgggcccugcuccgaccuccacacgggccggggcgggcccugcacccaguggcugaacgugcgcgaccuggaccggcuccagcgcgagagccagcgcgagguccugcggcugcagcgccagcucaugcugcagcagggcaacgggggcgccuggcccgaggccgggggccaguccgcgaccugcgaggaggugcggcgccagaugcuggcccuggagcgggagcuggaccagcgccggcgcgagugccaggagcugggcacccaggccgcccccgcccggcgccgcggggaggaggcggagacgcagcuccaggccgcccugcugaagaacgccuggcucgccgaggagaacggccggcugcaggcgaagaccgacugggugcggaaggucgaggccgagaacagcgaggugcgcgggcaccugggccgggccugccaggagcgcgacgccuccgggcucaucgcggagcagcugcugcagcaggccgcccggggccaggaccgccagcagcagcuccagcgggacccccagaaggcccugugcgaccugcaccccagcuggaaggagauccaggcccuccagugccgccccggccacccgcccgagcagcccugggagaccucccagaugcccgagagccaggugaaggggucccgccggcccaaguuccacgcgcgccccgaggacuacgccgucagccagcccaaccgggacauccaggagaagcgcgaggccagccuggaggaguccccgguggcccugggcgagagcgccuccgucccccaggugagcgagaccgugcccgcgucccagccccucagcaagaagacguccagccaguccaacagcuccagcgagggguccaugugggccaccgucccgagcucccccacccuggaccgggacaccgccagcgagguggacgaccuggagcccgacuccgugagccucgcccuggagaugggcggcuccgccgcgccggccgcccccaagcugaagaucuucauggcccaguacaacuacaaccccuucgaggggcccaacgaccacccggagggcgagcucccccugacggccggggacuacaucuacaucuucggcgacauggacgaggacggguucuacgagggcgagcuggacgacggccgccgggggcucguccccagcaacuucguggagcagauccccgacagcuacaucccgggcugccugcccgcgaagucccccgaccuggggcccagccagcucccggccggccaggacgaggcccuggaggaggacucccugcucagcgggaaggcccagggcaugguggaccgcggccugugccagaugguccgggugggguccaagaccgagguggcgaccgagauccuggacaccaagacggaggccugccagcucggccugcugcagagcauggggaagcagggccucucccgcccccugcuggggaccaagggcguccuccggauggcccccaugcagcugcaccuccagaacgugaccgccaccagcgccaacaucacguggguguacuccagccaccgccacccccacgucguguaccuggacgaccgggagcacgcgcugaccccggccggcguguccugcuacaccuuccaggggcugugccccggcacccacuaccgcguccggguggaggugcgccuccccugggaccugcugcaggucuacugggggacgaugagcuccaccgugaccuucgacacccuccuggccgggcccccguacccgccccuggacgugcucgucgagcggcacgccagccccggcgugcugguggucuccuggcugcccgugacgaucgacagcgccggcuccagcaacggcgugcaggucaccggguacgcgguguacgccgacggccucaaggugugcgaggucgccgacgccaccgccggguccaccgugcuggaguucagccagcuccaggugccccugaccuggcagaaggucagcgugcgcacgaugucccugugcggcgagagccuggacuccgugcccgcgcagauccccgaggacuucuucaugugccaccgguggccggagaccccgcccuucagcuacacgugcggcgaccccuccaccuaccgcgucaccuuccccgugugcccccagaagcucagccuggcgcccccguccgccaaggccagcccccacaaccccggguccugcggcgagccccaggccaaguuccuggaggccuucuucgaggagccgccccggcgccagagccccguguccaaccucgggagcgagggcgagugccccuccagcggggccggcucccaggcccaggagcuggccgaggcgugggagggcugccgcaaggaccuccuguuccagaaguccccgcagaaccaccggccgcccagcgucagcgaccagcccggggagaaggagaacugcuaccagcacaugggcaccuccaagagccccgcccccggguucauccaccuccgcaccgagugcggcccccggaaggagcccugccaggagaaggccgcccuggagcgcgugcugcggcagaagcaggacgcccagggguucaccccgccccagcugggcgcgagccagcaguacgccuccgacuuccacaacgugcugaaggaggagcaggaggcccugugccucgaccugcgcggcacggagcggcgcgaggagcggcgcgagcccgagccccacagccggcaggggcaggcccugggcgucaagcgcgggugccagcuccacgagccguccagcgcccugugccccgcgcccuccgccaaggugaucaagaugccccggggcgggccgcagcagcugggcaccggcgccaacacccccgcccgcguguucgucgcgcucagcgacuacaacccccuggugauguccgccaaccugaaggccgccgaggaggagcucguguuccagaagcggcagcugcugcgcgucugggggagccaggacacccacgacuucuaccucuccgagugcaaccgccaggugggcaacaucccggggcggcuggucgccgagauggaggugggcacggagcagaccgaccggcgcuggcgcagccccgcgcagggccaccuccccuccguggcccaccuggaggacuuccaggggcugaucaucccccagggcagcucccugguccuccaggggaacagcaagcggcugccgcuguggacccccaagaucaugaucgccgcccucgacuacgaccccggcgacgggcagaugggcggccaggggaagggccgccuggcccugcgggcgggggacguggugauggucuacggccccauggacgaccagggguucuacuacggcgagcucggcgggcaccgcggccuggugccggcccaccuccuggaccacaugucccugcacgggcacuga

SEQ ID NO: 35719 - RNA, 3039 nt, Artificial Sequence
  derived and/or modified sequence opt1 from RIMS1__Homo_sapiens__NP_001161879
augugcgcccccggcauccacgugagcuccgaggggugggaggagguccgcagcguggacuccgaggagggcaccaucgaggcccggcgcgcgguggccggggaccuggacuacuacuggcucgaccccgccaccuggcacagccgggagacgucccccaucagcucccaccccgucaccuggcagcccagcaaggagggcgaccgccugaucgggcgggugauccugaacaagcgcaccaccaugccgaaggacuccggcgcccuccugggccugaagguggucgggggcaagaugacggaccucgggcggcugggcgccuucaucaccaaggugaagaaggggagccuggcggacguggucggccaccuccgcgccggcgacgaggugcuggaguggaacgggaagccccugcccggcgccaccaacgaggagguguacaacaucauccucgaguccaagagcgagccccaggucgagaucaucgugucccggccgaucggggacaucccccgcauccccgagagcucccacccgccccuggagagcuccagcuccagcuucgagagccagaagauggagcggcccuccaucagcgugaucucccccaccagccccggcgcccugaaggacgcgccgcagguccuccccggccagcuguccgugaagcugugguacgacaagguggggcaccagcucaucgucaacgugcugcaggccacggaccugcccgcccgcguggacggccggccccgcaacccguacgucaagauguacuuccuccccgaccggagcgacaaguccaagcgccggaccaagaccgugaagaagauccuggagcccaaguggaaccagaccuucguguacagccacguccaccgccgggacuuccgcgagcggaugcuggagaucacggugugggaccagccccgcguccaggaggaggaguccgaguuccucggggagauccugaucgagcuggagaccgcccuccuggacgacgagccgcacugguacaagcugcagacccacgacgagagcucccucccccugccccagcccagcccguucaugccccgccggcacauccacggcgaguccagcuccaagaagcugcagcgcagccagcggaucuccgacagcgacaucuccgacuacgagguggacgacgggaucggcguggugcccccgggcuaccgcagcagcgcccgggaguccaagagcaccacgcucaccguccccgagcagcagcgcaccacccaccaccggucccgcagcgugagcccccaccgggggaacgaccagggcaagccccgcagccggcugccgaacgucccccugcagcgcucccucgacgagauccaccccacgcggcgcagccggucccccacccgccaccacgacgcgagccgguccccgguggaccaccgcacccgggacguggacagccaguaccuguccgagcaggacagcgagcugcucaugcugccccgcgccaagcgcgggcgguccgccgagugccugcacaccacgagcgagcuccagcccuuccuggaccgcgcccgguccgccagcaccaacugccugcgccccgacaccagccuccacuccccggagcgggagcgccacagccggaaguccgagcgcagcuccauccagaagcagacccggaagggcacggcgagcgacgccgagcgcaugcaccggcagcgcucccccacccagagcccgcccgccgacaccuccuucagcucccggcgcgggcggcagcugccccagguccccgugcgcagcggcuccaucgagcaggccagccugguggucgaggagcggacccgccagaugaagaugaaggugcaccgguucaagcagacgaccggcuccgggagcucccaggagcucgaccgcgagcaguacagcaaguacaacauccacaaggaccaguaccgguccugcgacaacgugagcgccaagagcuccgacagcgacgucuccgacgugagcgcgaucucccgcaccagcuccgccagccgccuguccagcaccuccuucaugagcgagcaguccgagcggccccgcggccggaucagcuccuucacgcccaagaugcaggggcgccggaugggcaccagcgggcgcuccaucaugaaguccaccuccgugagcggcgagauguacacccuggagcacaacgacggcagccaguccgacaccgccgucgggacggugggcgccgggggcaagaagcggcgcagcucccugagcgccaagguggucgcgaucgugucccggcgcagccgguccaccagccagcucucccagaccgagagcggccacaagaagcugaaguccaccauccagcgcagcacggagaccgggauggccgccgagaugcggaagauggugcgccagccgucccgggagagcaccgacggcuccaucaacagcuacuccagcgaggggaaccugaucuuccccggcguccgccucggggccgacucccaguucagcgacuuccuggacggccugggccccgcgcagcucguggggcggcagacccuggccacgcccgccaugggcgacauccagaucgggauggaggacaagaagggccagcuggagguggaggucauccgcgcccggagccucacccagaagccgggguccaagagcacccccgcccccuacgugaagguguaccugcuggagaacggcgcgugcaucgccaagaagaagacccgcaucgcccgcaagacgcucgacccgcuguaccagcagucccuggucuucgacgagagcccccagggcaaggugcuccaggugaucgucuggggcgacuacgggcggauggaccacaagugcuucauggggguggcccagauccugcuggaggagcucgaccuguccagcauggugaucggcugguacaagcuguucccgcccuccagccucgucgaccccacccugacgccccugacccgccgggccucccagagcucccucgagagcuccaccgggccgcccugcauccgcagcuga

SEQ ID NO: 35720 - RNA, 4050 nt, Artificial Sequence
  derived and/or modified sequence opt1 from RIMS2__Homo_sapiens__NP_001093587
augagcgcccccgugggcccgcgcgggcggcuggcccccauccccgcggccucccagcccccgcuccagcccgagaugcccgaccugagccaccugaccgaggaggagcgcaagaucauccucgccgucauggaccggcagaagaaggaggaggagaaggagcaguccgugcugaagaagcugcaccagcaguucgagauguacaaggagcaggucaagaagaugggcgaggagagccagcagcagcaggagcagaagggggacgcccccacgugcggcaucugccacaagacgaaguucgccgacgggugcggccacaacugcuccuacugccagaccaaguucugcgcgcgcugcggcgggcgggucagccuccgcuccaacaaggugaugugggugugcaaccugugccggaagcagcaggagauccugaccaagagcggcgccugguucuacaacuccgggagcaacaccccgcagcagcccgaccagaagguccuccgcggccugcggaacgaggaggcgccccaggagaagaagcccaagcugcacgagcagacgcaguuccaggggccguccggcgaccucagcgugcccgccguggagaagucccgcagccacggccugacccggcagcacuccaucaagaacgggagcggcgucaagcaccacaucgccuccgacaucgccagcgaccgcaagcggucccccagcgugagccgcgaccagaaccggcgcuacgaccagcgggaggagcgcgaggaguacucccaguacgccaccagcgacaccgccaugccccgguccccgagcgacuacgccgaccgccggucccagcacgagccccaguucuacgaggacagcgaccaccuguccuaccgcgacagcaaccgccggucccaccgccacagcaaggaguacaucguggacgacgaggacgucgagucccgggacgaguacgagcgccagcggcgcgaggaggaguaccagagccgguaccgcuccgaccccaaccucgcgcgguaccccgugaagccgcagcccuacgaggagcagaugcgcauccacgccgaggugagccgggcccgccacgagcggcgccacuccgacgucagccuggccaacgccgaccuggaggacucccggaucagcaugcuccgcauggaccggcccucccgccagcggagcaucagcgagcgccgcgcggccauggagaaccagcgguccuacagcauggagcgcacgcgggaggcccaggggcccuccagcuacgcccagcgcaccaccaaccacuccccgcccacgccccggcgcagcccccugccgaucgaccggcccgaccugcgccggaccgacucccuccgcaagcagcaccaccuggaccccagcuccgccgugcggaagaccaagcgcgagaagauggagaccaugcugcggaacgacagccucuccagcgaccaguccgagagcgugcgcccgcccccgcccaagccccacaaguccaagaagggcggcaagaugcggcagaucagccuguccagcagcgaggaggagcuggcguccacccccgaguacaccagcugcgacgacguggagaucgaguccgagagcguguccgagaagggggacauggacuacaacuggcucgaccacaccagcuggcacuccagcgaggccucccccaugagccugcaccccgugaccuggcagccguccaaggacggcgaccgccugaucgggcggauccuccugaacaagcgccugaaggacggcagcgucccccgggacuccggggccaugcucggccugaagguggugggcgggaagaugaccgagagcggccgccugugcgccuucaucacgaaggucaagaaggggucccucgccgacaccgugggccaccuccggcccggggacgagguccuggaguggaacggccgccugcugcagggcgcgaccuucgaggagguguacaacaucauccuggagagcaagcccgagccccagguggagcucgucgugucccgcccgaucggggacaucccccggauccccgacagcacccacgcccagcuggaguccagcagcuccagcuucgagucccagaagauggaccgcccgagcaucuccgugacgagccccaugucccccggcaugcugcgggacgucccccaguuccucagcgggcagcuguccagccagucccugagccgccggaccaccccguucgugccccgcgugcagaucaagcucugguucgacaaggucggccaccagcugaucgugaccauccugggggccaaggaccugcccucccgggaggacggccgcccccggaacccguacgugaagaucuacuuccuccccgaccgcagcgacaagaacaagcggcgcacgaagaccgucaagaagacccuggagcccaaguggaaccagaccuucaucuacuccccggugcaccggcgcgaguuccgggagcgcaugcuggagaucacgcucugggaccaggcccgggugcgcgaggaggagagcgaguuccugggcgagauccugaucgagcucgagaccgcgcugcuggacgacgagccccacugguacaagcuccagacccacgacgucuccagccugccccugccccacccgucccccuacaugccccggcgccagcuccacggggagagccccacccgccggcugcagcgcagcaagcggaucuccgacagcgagguguccgacuacgacugcgacgacggcaucgggguggucagcgacuaccgccacgacggccgggaccugcaguccagcacgcucuccgugccggagcaggucaugagcuccaaccacugcagccccuccggcagcccccaccgcguggacgugaucgggcggacccgcuccuggagccccuccgugccgccgccccagagccggaacgucgagcagggccugcgcgggacccggaccaugaccggccacuacaacacgaucucccgcauggaccggcaccgcgugauggacgaccacuacagccccgaccgggaccgcgacugcgaggccgccgaccggcagcccuaccaccgcucccggagcaccgagcagcgcccccugcucgagcggaccaccacgcgcagccgcuccaccgagcggcccgacaccaaccugaugcgcagcaugcccucccugaugaccgggcggagcgccccgcccucccccgcccucagccgcucccacccccggacgggcagcgugcagaccuccccgagcuccacccccgucgcgggccgccgggggcgccagcugccccagcugcccccgaagggcacccucgaccggaaggccgggggcaagaagcugcgcagcacggugcagcgguccaccgagaccgggcuggccguggagaugcgcaacuggaugacccggcaggccagccgcgaguccacggacggcagcaugaacuccuacagcuccgagggcaaccucaucuuccccgggguccggcuggccagcgacagccaguucuccgacuuccuggacggccucgggcccgcgcagcuggugggccgccagacccuggccaccccggccaugggggacauccaggugggcaugauggacaagaagggccagcucgaggucgagaucauccgggcccgcgggcugguggugaagcccggcagcaagacccugcccgcccccuacgucaagguguaccuccuggacaacggggugugcaucgcgaagaagaagacgaaggucgcccggaagacccuggagccgcucuaccagcagcugcuguccuucgaggagagcccccagggcaaggugcuccagaucaucguguggggcgacuacgggcgcauggaccacaaguccuucaugggcgucgcccagauccugcuggacgagcucgagcugagcaacauggugaucgggugguucaagcuguucccgcccuccagccucguggaccccacccuggcgccccugacccgccgggccucccagagcucccucgagagcuccacgggccccagcuacucccgcagcuga

SEQ ID NO: 35721 - RNA, 813 nt, Artificial Sequence
  derived and/or modified sequence opt1 from RIMS4__Homo_sapiens__NP_001192246
auggagcgcagccagucccggcugagccucuccgccagcuucgaggcccuggcgaucuacuuccccugcaugaacuccuucgacgacgaggacgccgagggcgacagccgccggcugaagggggccauccagcgcuccaccgagaccggccucgccguggagaugccgagccggacgcugcgccaggccucccacgagagcaucgaggacuccaugaacagcuacggguccgagggcaaccugaacuacgggggcgucugccucgcgagcgacgcccaguucuccgacuuccugggcagcauggggcccgcccaguucgugggccggcagacccuggccaccacccccaugggggacguggagaucggccuccaggagcgcaacgggcagcuggaggucgacaucauccaggcgcggggccugacggccaagcccggcuccaagacccucccggccgccuacaucaaggccuaccugcuggagaacgggaucugcaucgcgaagaagaagaccaagguggcccgcaagagccucgacccccuguacaaccaggugcugcuguuccccgagagcccccagggcaagguccuccaggugaucgugugggggaacuacggccggauggagcgcaagcaguucaugggcgucgcccgggugcugcucgaggagcuggaccugaccacgcucgccguggggugguacaagcuguucccgaccuccagcauggucgaccccgccaccggcccccugcuccgccaggcgucccagcugagccuggaguccaccguggggcccugcggcgagcggagcuga

SEQ ID NO: 35722 - RNA, 2352 nt, Artificial Sequence
  derived and/or modified sequence opt1 from RIN1__Homo_sapiens__NP_004283
auggagagccccggcgaguccggggccggcagcccgggggcccccucccccagcuccuucaccaccggccaccuggcgcgcgagaagcccgcccaggacccgcucuacgacgugcccaacgccagcgggggccaggccggcgggccccagcggcccggccgcgucgugucccugcgggagcgccugcuccugacgcggccgguguggcugcagcuccaggccaacgcggccgccgcccugcacaugcugcgcaccgagccgcccgggaccuuccucguccgcaagagcaacacccggcagugccaggcgcugugcaugcggcugcccgaggccuccggccccagcuucguguccagccacuacauccucgagucccccgggggcgugagccuggagggcuccgagcugauguuccccgaccucguccagcugaucugcgccuacugccacacgcgcgacauccugcuccugccccugcagcucccgcgggccauccaccacgccgcgacccacaaggagcuggaggccaucagccaccuggggaucgaguucugguccagcucccucaacaucaaggcccagcgcggccccgccgggggccccgugcugccccagcugaaggcccggagcccgcaggagcucgaccagggcaccggggcggcccugugcuucuucaacccccuguuccccggcgaccucgggcccaccaagcgcgagaaguucaagcggagcuucaaggugcgcgucuccacggagaccagcuccccgcugagcccgcccgccgugcccccgccgcccgugcccguccugcccggcgccgugcccucccagaccgagcggcugccgcccugccagcugcugcgccgggagagcuccgugggguaccgcguccccgccggcagcggccccucccugccgcccaugcccagccuccaggagguggacugcgggucccccagcuccagcgaggaggagggcgugcccgggucccggggcagccccgcgaccagcccccaccuggggcgccgccggccccuccugcgcuccauguccgccgccuucugcagccugcucgcccccgagcggcaggucggccgcgccgcggccgcccugaugcaggaccggcacacggccgcgggccagcuggugcaggaccuccugacccaggugcgcgccgggccggagccccaggagcugcagggcauccggcaggcccucagccgcgcccgggccaugcuguccgcggagcuggggcccgagaagcugcucagccccaagcgccuggagcacguccuggagaagucccuccacugcagcgugcugaagccgcugcggcccauccucgccgcccgccugcggcgccggcuggccgccgacggcucccucgggcgccuggcggagggccugcggcucgcccgcgcccagggccccggggccuucggcagccaccugucccugcccagcccgguggagcucgagcagguccggcagaagcugcugcagcuccugcgcaccuacucccccagcgcccaggugaagcgccugcuccaggcgugcaagcugcuguacauggcccuccggacccaggagggggagggcgccggcgccgacgaguuccugccccugcucucccugguccuggcgcacugcgaccucccggagcugcugcucgaggccgaguacaugagcgagcugcuggagcccucccuccugacgggggagggcggguacuaccugaccagccucuccgccagccuggcccugcucuccggccuggggcaggcccacacccugccccucagccccgugcaggagcugcgccggagccugucccucugggagcagcgccggcugccggcgacccacugcuuccagcaccuccuccgcguggccuaccaggaccccagcuccggcugcacgagcaagacccuggccgucccgcccgaggccuccaucgccacccugaaccagcucugcgcgaccaaguuccgggugacgcagcccaacaccuucggccuguuccuguacaaggagcagggguaccaccgccucccgcccggcgcccuggcccaccggcugcccaccaccggguaccucguguaccgccgggccgaguggcccgagacgcagggcgccgucaccgaggaggaggggagcggccaguccgaggcgcgcagccggggcgaggagcaggggugccagggcgacggggacgccggcgugaaggccagcccccgcgacauccgggagcaguccgagaccaccgccgagggcgggcagggccaggcgcaggaggggcccgcccagcccggcgagccggaggccgaggggucccgcgccgccgaggaguga

SEQ ID NO: 35723 - RNA, 2835 nt, Artificial Sequence
  derived and/or modified sequence opt1 from RIN2__Homo_sapiens__NP_001229510
augcuggacagcuucucccaggagagcacccuccccuuccgcgaggcccggaagcgcaccuccuuccagccggugcaggucuggcggaacuucacggccagccagaccaccgagucccccgcgugcagcggcgccucccugggggagaugaccgccuggacgaugggcgcccgcgggcuggacaagcggggcagcuucuucaagcucaucgacaccaucgccuccgagaucggggagcugaagcaggagauggugcgcaccgacgugaaccuggagaacggccucgagcccgcggagacccacagcaugguccggcacaaggacggcggguacuccgaggaggaggacgugaagacgugcgcccgcgacagcggcuacgacucccugagcaaccggcuguccauccucgaccgccugcugcacacccaccccaucuggcuccagcugagccuguccgaggaggaggccgccgaggugcuccaggcgcagccgcccgggaucuuccugguccacaagagcaccaagaugcagaagaaggugcugucccuccggcugcccugcgaguucggcgccccccugaaggaguucgccaucaaggagagcaccuacacguucagccucgagggguccggcaucagcuucgccgaccuguuccgccugaucgccuucuacugcaucucccgggacgugcucccguucacccugaagcugcccuacgcgaucagcaccgccaaguccgaggcccagcucgaggagcuggcccagaugggccugaacuucuggagcucccccgccgacagcaagcccccgaaccucccccccccccaccgcccgcuguccagcgacggggucugccccgcgucccugcggcagcucugccugaucaacggcgugcacagcaucaagacccgcacgcccuccgagcuggagugcagccagaccaacggggcccucugcuucaucaacccccuguuccugaaggugcacucccaggaccucagcggcggccugaagcggccguccacccgcacccccaacgccaacgggacggagcggacccgcagcccccccccgcggcccccccccccggccaucaacucccugcacaccagcccccgccucgcccgcaccgagacgcagaccagcaugcccgagaccgucaaccacaacaagcacggcaacguggcgcugccggggaccaagcccacgcccauccccccgccccggcugaagaagcaggccuccuuccucgaggccgagggcggggccaagacccugagcggcggccgccccggggccggccccgagcuggagcucgggaccgcgggcuccccggggggcgccccccccgaggccgcccccggcgacugcacccgggcgccgccccccagcuccgagagccgccccccgugccacgggggccggcagcgccuguccgacaugagcaucuccacgagcuccagcgacucccuggaguucgaccggagcaugccccuguucggguacgaggccgacaccaacuccagccucgaggacuacgagggcgaguccgaccaggagaccauggccccccccaucaagagcaagaagaagcgcagcuccagcuucgugcugccgaagcuggucaagucccagcuccagaaggugagcgggguguucuccagcuucaugacccccgagaagcggaugguccgccggaucgccgagcugucccgcgacaagugcacguacuucggcugccuggugcaggacuacgugagcuuccuccaggagaacaaggagugccacgucuccagcaccgacaugcugcagaccauccggcaguucaugacccaggugaagaacuaccugucccagagcuccgagcucgacccccccaucgagagccugaucccggaggaccagaucgacgugguccuggagaaggccaugcacaagugcauccucaagccccugaagggccacguggaggcgaugcugaaggacuuccacauggccgacggguccuggaagcagcucaaggagaaccugcagcugguccgccagcggaacccccaggagcucggcguguucgccccgacccccgacuucguggacgucgagaagaucaaggugaaguucaugacgaugcagaagauguacagccccgagaagaaggugaugcugcugcuccgcgucugcaagcugaucuacaccgugauggagaacaacuccgggcggauguacggcgccgacgacuuccugcccgugcucaccuacgucaucgcccagugcgacaugcuggagcuggacaccgagaucgaguacaugauggagcuccuggacccgagccugcuccacggcgaggggggcuacuaccugacguccgcguacggggcccugagccucaucaagaacuuccaggaggagcaggccgcccgccugcugagcuccgagacccgggacacccuccgccaguggcacaagcgccggaccacgaaccgcaccauccccagcguggacgacuuccagaacuaccugcggguggccuuccaggaggucaacuccggcugcaccgggaagacccugcucgugcgccccuacaucacgaccgaggacgugugccagaucugcgcggagaaguucaaggucggcgaccccgaggaguacagccuguuccuguucguggacgagaccuggcagcagcucgccgaggacaccuacccgcagaagaucaaggccgagcugcacucccggccccagccccacaucuuccacuucguguacaagcgcaucaagaacgaccccuacggcaucaucuuccagaacggggaggaggaccugacgaccagcuga

SEQ ID NO: 35724 - RNA, 2958 nt, Artificial Sequence
  derived and/or modified sequence opt1 from RIN3__Homo_sapiens__NP_079108
augauccgccacgccggcgcccccgcgcgcggggaccccaccggccccgugcccgucguggggaagggcgaggaggaggaggaggaggacgggaugcggcugugccuccccgccaacccgaagaacugccugccccaccggcgcggcaucagcauccuggagaagcucaucaagaccugccccguguggcugcagcugucccucggccaggccgaggucgcccggauccugcaccgcgugguggccgggauguuccugguccggcgcgacagcuccagcaagcagcucgugcugugcgugcacuuccccucccugaacgagagcuccgcggagguccucgaguacacgaucaaggaggagaaguccauccuguaccuggagggcuccgcccucguguucgaggacaucuuccggcugaucgccuucuacugcgugagccgcgaccugcucccguucacccugcggcugccccaggccauccucgaggcguccagcuucaccgaccuggagaccaucgccaaccuggggcucggcuucugggacuccagccugaacccgccccaggagcgcgggaagcccgccgagccgccccgggaccgcgcccccggcuucccccuggucuccagccuccggcccacggcccacgacgcgaacugcgccugcgagaucgagcuguccgugggcaacgaccgccugugguucgugaaccccaucuucaucgaggacugcagcuccgcccuccccaccgaccagccgccccuggggaacugccccgcccggccccugccgcccaccagcgacgccaccagccccacgucccgcugggcgccccggcgcccgccgccgcccccgcccguccucccccugcagcccugcagccccgcccagccgcccgugcugcccgcccucgcccccgcccccgcgugcccccugcccaccuccccgcccgugcccgcgccccacgucacgccccacgcccccgggcccccggaccaccccaaccagccgcccaugaugaccugcgagcggcugcccugccccaccgccggccucggcccccugcgcgaggaggccaugaagccgggcgccgccagcagcccccugcagcagguccccgcgcccccgcuccccgccaagaagaaccugcccaccgcgcccccgcgccggcgcgugagcgagcgggugucccuggaggaccagagccccgggauggccgccgagggcgaccagcucucccugccgccccaggggaccagcgacggccccgaggacacgccccgcgaguccaccgagcaggggcaggacaccgaggugaaggccagcgacccccacuccaugcccgagcugccgcggaccgccaagcagccgcccgugcccccgccccgcaagaagcggaucagccgccagcucgccuccacccugcccgcgccccuggagaacgccgagcugugcacgcaggccauggcccucgagacccccacccccggcccgccccgggagggccagagccccgccucccaggccgggacccagcacccgcccgcccaggccacggcccacagccaguccagccccgaguucaagggcagccuggcgucccugagcgacucccucggggucagcgugauggccaccgaccaggacuccuacagcaccuccagcaccgaggaggagcuggagcaguucuccagccccuccgucaagaagaagcccagcaugauccugggcaaggcccgccaccggcucuccuucgccagcuucuccagcauguuccacgcguuccuguccaacaaccgcaagcuguacaagaaggugguggagcucgcccaggacaaggggagcuacuucggcagccugguccaggacuacaagguguacucccuggagaugauggcccggcagacgagcuccaccgagaugcuccaggagauccgcaccaugaugacccagcucaagagcuaccugcugcaguccacggagcugaaggcccugguggaccccgcccuccacagcgaggaggagcuggaggcgaucgucgaguccgcccuguacaagugcgugcucaagccgcugaaggaggccaucaacagcugccugcaccagauccacuccaaggacggcagccuccagcagcugaaggagaaccagcuggugauccucgccaccaccaccacggaccugggggucaccaccuccgugcccgaggugcccaugauggagaagauccugcagaaguucaccagcaugcacaaggccuacucccccgagaagaagaucagcauccuccugaagaccugcaagcugaucuacgacuccauggcgcucggcaacccggggaagcccuacggcgccgacgacuuccugcccguccugauguacgugcucgcccggagcaaccugacggagaugcugcucaacguggaguacaugauggagcugauggaccccgcccugcagcucggggagggcuccuacuaccugaccaccaccuacggcgcccuggagcacaucaagagcuacgacaagaucacggucacccgccagcucuccguggaggugcaggacagcauccaccggugggagcgccggcgcacccugaacaaggcgcgcgccagccgguccagcguccaggacuucaucugcguguccuaccuggagccggagcagcaggcccgcacccucgccagccgggcggacacgcaggcccaggcccugugcgcccagugcgccgagaaguucgcgguggagcgcccccaggcccaccggcuguucguccucguggacgggcgcugcuuccagcuggccgacgacgcccugccccacugcaucaagggcuaccuccugcgguccgagcccaagcgcgacuuccacuucguguaccggccgcuggacgggggcggcgggggcgggggcgggagcccgcccugccucgucgugcgcgagcccaacuuccuguga

SEQ ID NO: 35725 - RNA, 1221 nt, Artificial Sequence
  derived and/or modified sequence opt1 from RING1__Homo_sapiens__NP_002922
augaccacccccgccaacgcccagaacgcgagcaagacgugggagcugucccucuacgagcugcaccgcaccccgcaggaggccaucauggacggcaccgagaucgccgugagcccccggucccugcacagcgagcucaugugccccaucugccuggacaugcugaagaacaccaugacgaccaaggagugccuccaccgcuucugcuccgacugcaucgucaccgcccugcggagcgggaacaaggagugcccgaccugccgcaagaagcugguguccaagcggagccuccgccccgaccccaacuucgacgcccugaucuccaagaucuaccccagccgggaggaguacgaggcgcaccaggaccgcgugcugauccggcucucccgccugcacaaccagcaggcccugagcuccagcaucgaggagggccuccggaugcaggccaugcaccgcgcccagcggguccgccggcccaucccgggguccgaccagacgaccaccaugagcggcggggagggcgagcccggcgagggggagggcgacggggaggacguguccagcgacuccgcgcccgacagcgcccccggcccggcccccaagcgcccccggggcgggggcgccgggggcagcuccguggggaccggcggcgggggcaccgggggcgucgggggcggcgccgggagcgaggacuccggcgaccgcgggggcacgcucgggggcggcacccuggggcccccguccccgcccggcgcgcccagcccgcccgagcccgggggcgagaucgagcugguguuccggccccacccccugcugguggagaagggggaguacugccagacccgcuacgucaagacgaccggcaacgccaccguggaccaccucagcaaguaccuggcccugcggaucgcccucgagcgccgccagcagcaggaggccggcgagcccgggggccccgggggcggcgcguccgacaccgggggccccgacgggugcggcggggagggcggcggggccggcgggggcgacgggccggaggagcccgcccugcccagccuggagggcguguccgagaagcaguacacgaucuacaucgccccgggcgggggcgccuucaccacccucaacgggagccugacccuggagcucgucaacgagaaguucuggaaggugucccggccccuggagcugugcuacgcgcccacgaaggaccccaaguga

SEQ ID NO: 35726 - RNA, 2379 nt, Artificial Sequence
  derived and/or modified sequence opt1 from RINT1__Homo_sapiens__NP_068749
augcugcccgccggcgagaucggggccagcccggcggcccccugcugcuccgagagcggcgacgagcgcaagaaccucgaggagaaguccgacaucaacgugaccguccugaucgggagcaagcaggucuccgagggcaccgacaacggggaccugcccagcuacguguccgccuucaucgagaaggaggugggcaacgaccucaagagccugaagaagcuggacaagcucaucgagcagcggacgguguccaagaugcagcuggaggagcagguccugaccaucagcuccgagauccccaagcgcauccggagcgcccucaagaacgccgaggaguccaagcaguuccugaaccaguuccuggagcaggagacccaccucuucagcgcgaucaacucccaccuccugaccgcccagccguggauggacgaccucggcacgaugaucagccagaucgaggagaucgagcgccaccuggccuaccugaaguggaucucccagaucgaggagcucagcgacaacauccagcaguaccugaugaccaacaacgugcccgaggccgcguccacccuggugagcauggccgagcucgacaucaagcugcaggagagcuccugcacccaccuccugggguucaugcgggccacggugaaguucuggcacaagauccugaaggacaagcugaccagcgacuucgaggagauccucgcccagcugcacuggcccuucaucgcgcccccgcagucccagaccgucggccugagccgccccgccuccgcccccgagaucuacagcuaccucgagacccuguucugccagcugcucaagcugcagacguccgacgagcugcucaccgagcccaagcagcugccggagaaguacagccugcccgccucccccagcgugauccuccccauccaggugaugcugaccccgcugcagaagcgguuccgcuaccacuuccgggggaaccgccagaccaacguccucuccaagcccgagugguaccuggcccaggugcugauguggaucggcaaccacacggaguuccucgacgagaagauccagcccauccuggacaagguggggagccuggucaacgcccggcucgaguucucccgcggccugaugaugcuggugcuggagaagcucgcgaccgacauccccugccugcuguacgacgacaaccucuucugccaccugguggacgagguccugcuguucgagcgggagcugcacagcgugcacggcuacccggggaccuucgccuccugcaugcacauccugagcgaggagaccugcuuccagcgcuggcucacgguggagcggaaguucgcccugcagaagauggacuccaugcugagcuccgaggccgccugggucagccaguacaaggacaucaccgacguggacgagaugaaggugcccgacugcgcggagaccuucaugacccuccugcuggucaucacggaccgcuacaagaaccuccccaccgccagccggaagcugcaguuccuggagcuccagaaggaccugguggacgacuuccgcauccggcugacccaggucaugaaggaggagacccgcgccucccucggcuuccgguacugcgccauccugaacgccgugaacuacaucagcacggugcuggcggacugggccgacaacgucuucuuccuccagcugcagcaggccgcccuggagguguucgcggagaacaacacccucuccaagcugcagcuggggcagcucgccagcauggaguccagcguguucgacgacaugaucaaccugcuggagcgccucaagcacgacaugcugacccgccaggucgaccacguguuccgggaggugaaggacgccgccaagcuguacaagaaggagcgcuggcucucccugcccagccaguccgagcaggccgucaugagccuguccagcuccgcgugcccgcuccugcugacccuccgggaccaccuccugcagcuggagcagcagcugugcuucagccuguucaagaucuucuggcagaugcucguggagaagcuggacguguacaucuaccaggagaucauccuggccaaccacuucaacgagggcggcgccgcccagcuccaguucgacaugacgcgcaaccuguucccccuguucucccacuacugcaagcggcccgagaacuacuucaagcacaucaaggaggccugcaucguccucaaccugaacguggggagcgcgcugcuccugaaggacgugcugcaguccgccagcggccagcuccccgccaccgccgcccugaacgaggucgggaucuacaagcuggcgcagcaggacguggagauccuccugaaccugcgcaccaacuggccgaacaccggcaaguga

SEQ ID NO: 35727 - RNA, 1707 nt, Artificial Sequence
  derived and/or modified sequence opt1 from RIOK1__Homo_sapiens__NP_113668
auggacuaccgccggcugcucaugagccgcgugguccccggccaguucgacgacgccgacuccagcgacuccgagaaccgggaccugaagaccgugaaggagaaggacgacauccuguucgaggaccuccaggacaacgugaacgagaacggggagggcgagaucgaggacgaggaggaggagggguacgacgacgacgacgacgacugggacugggacgagggcgucgggaagcuggccaagggcuacguguggaacggcgggagcaacccgcaggcgaaccgccagaccuccgacagcuccagcgccaagauguccacgcccgccgacaaggugcugcggaaguucgagaacaagaucaaccucgacaagcugaacgucaccgacagcgugaucaacaaggugaccgagaagucccgccagaaggaggccgacauguaccggaucaaggacaaggccgaccgcgcgaccgucgagcagguccuggacccccggacgcgcaugauccucuucaagaugcugacccggggcaucaucaccgagaucaacgggugcaucagcaccggcaaggaggccaacguguaccacgccuccacggccaacggggagagccgcgcgaucaagaucuacaagaccuccauccugguguucaaggaccgggacaaguacgugagcggcgaguuccgcuuccggcacggcuacugcaaggggaacccccgcaagauggugaagaccugggccgagaaggagaugcggaaccucauccgccugaacaccgccgagaucccgugccccgagcccaucaugcugcggucccacguccucgugaugagcuucaucggcaaggacgacaugcccgccccgcugcugaagaacgugcagcucuccgagagcaaggcccgcgagcuguaccugcaggucauccaguacaugcggcgcauguaccaggacgcgcgccucgugcacgccgaccugagcgaguucaacaugcuguaccacgggggcggcguguacaucaucgacgucucccagagcguggagcacgaccacccccacgcccucgaguuccugcggaaggacugcgccaacgugaacgacuucuucaugcgccacuccgucgccgugaugacgguccgggagcuguucgaguucgugaccgaccccagcaucacccacgagaacauggacgcguaccucuccaaggccauggagaucgccagccagcgcaccaaggaggagcgguccagccaggaccacguggacgaggaggucuucaagcgcgccuacaucccccggacgcugaacgaggugaagaacuacgagcgcgacauggacaucaucaugaagcugaaggaggaggacauggccaugaacgcgcagcaggacaacauccucuaccagaccgugaccgggcugaagaaggaccuguccggcguccagaaggugccggcccuccuggagaaccagguggaggagcggaccugcagcgacuccgaggacaucgggagcuccgagugcagcgacacggacuccgaggagcagggcgaccacgcccgccccaagaagcacaccaccgaccccgacaucgacaagaaggagcggaagaagauggucaaggaggcccagcgcgagaagcggaagaacaagauccccaagcacgugaagaagcgcaaggagaagaccgccaagacgaagaaggggaaguga

SEQ ID NO: 35728 - RNA, 1425 nt, Artificial Sequence
  derived and/or modified sequence opt1 from RIOK2__Homo_sapiens__NP_001153221
augggcaaggugaacgucgccaagcugcgcuacaugagccgggacgacuuccgcgugcucaccgccguggagauggggaugaagaaccacgagaucguccccggcucccugaucgcgagcaucgccucccugaagcacgggggcugcaacaaggugcuccgggagcuggugaagcacaagcugaucgccugggagcgcaccaagacgguccagggguaccggcucaccaacgccggcuacgacuaccuggcccugaagacccucagcucccgccaggugguggagagcgucggcaaccagaugggggugggcaaggaguccgacaucuacaucguggcgaacgaggaggggcagcaguucgcccugaagcugcaccggcucggccgcaccagcuuccggaaccugaagaacaagcgcgacuaccacaagcaccggcacaacgucuccuggcuguaccucagccgccuguccgccaugaaggaguucgccuacaugaaggcgcuguacgagcggaaguucccggugcccaagcccaucgacuacaaccgccacgccguggucauggagcucaucaacggguacccccugugccagauccaccacguggaggacccggccagcguguacgacgaggccauggagcugaucgucaagcucgccaaccacggccugauccacggcgacuucaacgaguucaaccugauccucgacgaguccgaccacaucacgaugaucgacuucccccagauggugagcaccucccaccccaacgcggagugguacuucgaccgggacgugaagugcaucaaggacuucuucaugaagcgcuucagcuacgaguccgagcuguuccccaccuucaaggacauccggcgcgaggacacccuggacgucgaggugagcgccuccggguacacgaaggagaugcaggccgacgacgagcuccugcacccgcugggccccgacgacaagaacaucgagaccaaggaggggagcgaguucagcuucuccgacggcgagguggccgagaaggccgaggucuacggcagcgagaacgaguccgagcggaacugccucgaggagagcgaggggugcuacugccgcuccagcggcgaccccgagcagaucaaggaggacucccugagcgaggaguccgcggacgcccggagcuucgagaugaccgaguucaaccaggcccuggaggagaucaagggccagguggucgagaacaacuccgugaccgaguucagcgaggagaagaaccgcacggagaacuacaaccgccaggacgggcagcgggugcagggcgggguccccgccggcuccgacgaguacgaggacgagugcccgcaccucaucgcccugagcucccugaaccgcgaguuccggcccuuccgcuaccggcuccugagcaucgcguucuga

SEQ ID NO: 35729 - RNA, 1560 nt, Artificial Sequence
  derived and/or modified sequence opt1 from RIOK3__Homo_sapiens__NP_003822
auggaccuggugggcgucgccagccccgagcccgggaccgccgcggccuggggccccuccaagugccccugggccaucccccagaacaccaucagcugcucccucgccgacgugaugagcgagcagcuggccaaggagcugcagcucgaggaggaggcggccguguucccggaggucgccguggccgaggggcccuucaucacgggcgagaacaucgacaccuccagcgaccugaugcuggcgcagaugcuccagauggaguacgaccgcgaguacgacgcccagcugcggcgcgaggagaagaaguucaacggggacuccaaggugagcaucuccuucgagaacuaccggaagguccaccccuacgaggacagcgacuccagcgaggacgagguggacuggcaggacacccgcgacgaccccuaccggccggccaagcccgugcccacccccaagaagggcuucaucggcaaggggaaggacaucacgaccaagcacgacgaggucgugugcggccgcaagaacaccgcccggauggagaacuucgccccggaguuccaggugggggacggcaucgggauggaccugaagcucuccaaccacgucuucaacgcgcugaagcagcacgccuacagcgaggagcgccgguccgcccgccugcacgagaagaaggagcacagcaccgccgagaaggccguggaccccaagacgcggcuccugauguacaagauggugaacuccggcaugcuggagaccaucaccggcugcaucagcaccgggaaggaguccgucguguuccacgcguacggcgggagcauggaggacgagaaggaggacagcaaggugauccccacggagugcgccaucaaggucuucaagaccacccucaacgaguucaagaaccgcgacaaguacaucaaggacgacuuccgguucaaggaccgcuucuccaagcugaacccccggaagaucauccgcaugugggccgagaaggagaugcacaaccuggcccggaugcagcgcgccggcaucccgugccccaccguggugcuccugaagaagcacauccuggucaugagcuucaucggccacgaccaggugcccgcgcccaagcucaaggaggugaagcugaacuccgaggagaugaaggaggccuacuaccagacgcugcaccucaugcggcagcuguaccacgagugcacccugguccacgccgaccucagcgaguacaacaugcuguggcacgccgggaagguguggcugaucgacgucucccagagcguggagccgacccacccccacggccucgaguuccuguuccgcgacugccggaacgugucccaguucuuccagaagggcggggucaaggaggcccugagcgagcgcgagcuguucaacgcgguguccgggcucaacaucaccgccgacaacgaggccgacuuccuggccgagaucgaggcgcucgagaagaugaacgaggaccacgugcagaagaacggccgcaaggccgccagcuuccugaaggacgacggcgacccgccccugcucuacgacgaguga

SEQ ID NO: 35730 - RNA, 2016 nt, Artificial Sequence
  derived and/or modified sequence opt1 from RIPK1__Homo_sapiens__NP_003795
augcagcccgacaugagccugaacgugaucaagaugaaguccagcgacuuccucgaguccgccgagcuggacagcggcggguucggcaaggucucccugugcuuccaccgcacccaggggcucaugaucaugaagaccguguacaagggcccgaacugcaucgagcacaacgaggcccugcuggaggaggcgaagaugaugaaccggcuccgccacagccggguggucaagcugcugggggugaucaucgaggagggcaaguacucccucgugauggaguacauggagaagggcaaccugaugcacguccugaaggccgagaugagcacgccccucuccgugaaggggcgcaucauccuggagaucaucgagggcaugugcuaccugcacgggaagggcgugauccacaaggaccucaagcccgagaacauccuggucgacaacgacuuccacaucaagaucgccgaccuggggcucgccagcuucaagaugugguccaagcugaacaacgaggagcacaacgagcugcgggagguggacggcaccgccaagaagaacggcgggacccucuacuacauggcgcccgagcaccugaacgacgugaacgccaagccgaccgagaaguccgacgucuacagcuucgccguggugcugugggccaucuucgcgaacaaggagcccuacgagaacgccaucugcgagcagcagcucaucaugugcaucaagagcggcaaccgccccgacgucgacgacaucacggaguacugcccccgggagaucaucucccugaugaagcugugcugggaggccaacccggaggcccgccccaccuuccccgggaucgaggagaaguuccggcccuucuaccucagccagcuggaggaguccguggaggaggacgucaagagccugaagaaggaguacuccaacgagaacgccguggugaagcgcaugcagagccuccagcuggacugcguggcggucccgagcucccggagcaacuccgccaccgagcagcccggcagccugcacuccagccagggccucgggaugggccccguggaggaguccugguucgcccccagccuggagcacccgcaggaggagaacgagcccucccugcagagcaagcuccaggacgaggccaacuaccaccuguacgggucccgcauggaccggcagaccaagcagcagccccgccagaacguggccuacaaccgggaggaggagcgccggcgccgggucagccacgaccccuucgcgcagcagcgcccguacgagaacuuccagaacacggagggcaaggggaccgccuacuccagcgccgccucccacggcaacgccgugcaccagcccagcggccugaccucccagccccagguccucuaccagaacaacgggcuguacagcucccacggcuucgggacccggccccuggacccgggcacggcggggccccgcgugugguaccgccccauccccagccacaugccgagccuccacaacauccccgugcccgagaccaacuaccugggcaacaccccgaccaugcccuucuccagccugccgcccacggacgaguccaucaaguacaccaucuacaacagcaccggcauccagaucggggccuacaacuacauggagaucggcgggaccuccagcucccuccuggacagcacgaacaccaacuucaaggaggagcccgccgccaaguaccaggccaucuucgacaacaccaccucccugacggacaagcaccucgaccccauccgggagaaccugggcaagcacuggaagaacugcgcgcgcaagcugggguucacccagagccagaucgacgagaucgaccacgacuacgagcgggacggccugaaggagaaggucuaccagaugcuccagaagugggugaugcgcgagggcaucaagggggccaccgugggcaagcuggcccaggcccugcaccagugcucccggaucgaccuccugagcucccugaucuacgucagccagaacuga

SEQ ID NO: 35731 - RNA, 1623 nt, Artificial Sequence
  derived and/or modified sequence opt1 from RIPK2__Homo_sapiens__NP_003812
augaacggcgaggccaucugcagcgcccugcccaccaucccguaccacaagcucgcggaccugcgcuaccugucccgcggggccagcggcaccguguccagcgcccggcacgccgacuggcggguccagguggccgugaagcaccuccacauccacacgccccugcuggacuccgagcgcaaggacguccuccgggaggcggagauccugcacaaggcccgcuucagcuacauccugcccauccucgggaucugcaacgagcccgaguuccugggcaucgugaccgaguacaugccgaacgggucccugaacgagcuccugcaccggaagaccgaguaccccgacguggccuggccccugcgcuuccggauccuccacgagaucgcccugggcgucaacuaccugcacaacaugacgcccccgcuccugcaccacgaccugaagacccagaacauccuccuggacaacgaguuccacgugaagaucgcggacuucggccugagcaaguggcgcaugaugucccucagccagucccggagcuccaagagcgcccccgagggcgggaccaucaucuacaugccgcccgagaacuacgagcccgggcagaagucccgcgccagcaucaagcacgacaucuacuccuacgccgugaucaccugggagguccugagccggaagcagcccuucgaggacgugaccaacccccugcagaucauguacuccgugagccagggccaccgccccgucaucaacgaggagagccucccguacgacaucccccaccgggcccgcaugaucucccugaucgagagcgggugggcgcagaaccccgacgagcggcccuccuuccugaagugccucaucgagcuggagccggugcugcgcacguucgaggagaucaccuuccucgaggccgugauccagcugaagaagaccaagcugcagagcgucuccagcgccauccaccucugcgacaagaagaagauggagcugucccugaacauccccgugaaccacggcccccaggaggagagcugcggcuccagccagcuccacgagaacuccgggagccccgagaccucccggagccugccggcgccccaggacaacgacuuccugucccgcaaggcccaggacugcuacuucaugaagcuccaccacugccccggcaaccacagcugggacuccacgaucagcgggucccagcgggccgccuucugcgaccacaagaccacccccugcagcagcgccaucaucaacccgcuguccaccgccggcaacagcgagcgccugcagcccggcaucgcccagcaguggauccaguccaagcgcgaggacaucgugaaccagaugacggaggcgugccucaaccagagccuggacgcccugcucucccgggaccugaucaugaaggaggacuacgagcuggucagcaccaagcccacccgcaccuccaaggugcggcagcugcucgacacgaccgacauccagggggaggaguucgccaaggugaucguccagaagcugaaggacaacaagcagaugggccugcagccguaccccgagauccucguggugagccgcucccccagccugaaccugcuccagaacaaguccauguga

SEQ ID NO: 35732 - RNA, 1557 nt, Artificial Sequence
  derived and/or modified sequence opt1 from RIPK3__Homo_sapiens__NP_006862
augagcugcgugaagcuguggcccuccggcgcccccgcgccccucgucagcaucgaggagcuggagaaccaggagcugguggggaagggcggguucggcaccguguuccgcgcccagcaccggaaguggggguacgacgucgccgugaagaucgugaacuccaaggccaucagccgcgaggucaaggccauggccucccucgacaacgaguucgugcugcggcuggagggcgugaucgagaaggucaacugggaccaggaccccaagcccgcgcucgugaccaaguucauggagaacggcagccuguccgggcugcuccagagccagugcccgcgccccuggccccugcugugccggcuccugaaggaggugguccugggcauguucuaccuccacgaccagaaccccgugcugcugcaccgcgaccucaagccguccaacgugcugcuggaccccgagcuccacgucaagcuggccgacuucgggcugagcacguuccagggcgggucccagagcggcaccggcuccggggagcccggcgggacccucggcuaccuggcccccgagcuguucgugaacgugaaccggaaggccagcaccgcguccgacgucuacagcuucggcauccucaugugggccgugcuggccgggcgcgagguggagcugccgacggagcccucccucgucuacgaggccgugugcaaccggcagaaccgccccagccuggccgagcugccccaggcgggcccggagacccccgggcucgagggccugaaggagcugaugcagcucugcugguccagcgagcccaaggaccggcccagcuuccaggagugccugccgaagaccgacgagguguuccagauggucgagaacaacaugaacgccgccguguccaccgucaaggacuuccugagccagcuccgcuccagcaaccggcgcuucuccauccccgagagcgggcagggcggcacggagauggacggguuccggcgcaccaucgagaaccagcacucccggaacgacgugauggugagcgaguggcugaacaagcugaaccucgaggagccgcccuccagcguccccaagaagugccccucccugaccaagcgcagccgggcccaggaggagcaggucccccaggccuggaccgcgggcacguccagcgacuccauggcccagcccccgcagacccccgagaccagcaccuuccgcaaccagaugcccuccccgacgagcaccgggacccccucccccggcccccgggggaaccagggcgccgagcgccagggcaugaacuggagcugccgcaccccggagcccaaccccgugacggggcggccccuggugaacaucuacaacugcagcggcguccaggugggggacaacaacuaccucaccaugcagcagaccaccgcccugccgacguggggccuggcccccuccgggaagggccgcggccuccagcacccgccgcccguggggagccaggagggccccaaggaccccgaggcguggucccggccccaggggugguacaaccacagcggcaaguga

SEQ ID NO: 35733 - RNA, 2355 nt, Artificial Sequence
  derived and/or modified sequence opt1 from RIPK4__Homo_sapiens__NP_065690
auggagggcgacgggggcacccccugggcccuggcccuccugcgcaccuucgacgcgggggaguucacgggcugggagaagguggggagcggcggcuucgggcaggucuacaaggugcggcacgugcacuggaagaccuggcuggccaucaagugcuccccgagccuccacgucgacgaccgcgagcggauggagcugcuggaggaggccaagaagauggagauggccaaguuccgcuacauccuccccguguacggcaucugccgggagcccguggggcuggucauggaguacauggagaccggcucccuggagaagcuccuggccagcgagccccugccgugggaccuccgcuuccggaucauccacgagaccgcgguggggaugaacuuccugcacugcauggccccgccccugcuccaccuggaccugaagcccgccaacauccuccuggacgcccacuaccacgugaagaucuccgacuucggccuggcgaagugcaacggccucagccacucccacgaccugagcauggacgggcuguucggcacgaucgccuaccucccgcccgagcgcauccgggagaagucccgccuguucgacaccaagcacgacgucuacagcuucgccaucgugaucuggggcgugcugacccagaagaagcccuucgccgacgagaagaacauccuccacaucauggucaagguggugaaggggcaccggcccgagcugccgcccgucugccgcgcccggccccgcgcgugcucccaccugauccggcucaugcagcgcugcuggcagggcgacccccgggugcgcccgaccuuccaggagaucacgagcgagaccgaggaccugugcgagaagcccgacgacgaggugaaggagaccgcccacgaccuggacgucaaguccccgcccgagccccggagcgagguggugcccgcccgccucaagcgggccuccgcccccaccuucgacaacgacuacagccuguccgagcugcucagccagcuggacuccggggucagccaggcgguggagggccccgaggagcugagccgcuccagcuccgagagcaagcucccguccagcggguccggcaagcgccugagcgggguguccagcgucgacuccgccuucagcucccggggcagccugucccucagcuucgagcgcgagcccuccacgagcgaccugggcaccaccgacgugcagaagaagaagcuggucgacgccaucguguccggggacaccagcaagcucaugaagauccugcagccccaggacguggaccuggcccucgacagcggcgccucccugcugcaccuggcggucgaggccgggcaggaggagugcgccaaguggcuccugcugaacaacgccaaccccaaccucagcaaccggcgcggcuccacgccgcugcacauggccguggagcggcgcgugcgcggggucguggagcugcuccuggcgcggaagaucagcgugaacgccaaggacgaggaccaguggaccgcccugcacuucgccgcgcagaacggcgacgaguccagcacccggcuccugcuggagaagaacgccuccgucaacgagguggacuucgagggccgcacccccaugcacguggccugccagcacgggcaggagaacaucguccggauccuccugcgccggggcguggacgugagccugcaggggaaggacgccuggcucccccugcacuacgccgcguggcagggccaccuccccaucgucaagcugcuggccaagcagcccgggguguccgugaacgcccagacgcuggacggccgcacgccccuccaccuggccgcccagcggggccacuaccgcgucgcgcggauccugaucgaccucugcagcgacgugaacgugugcucccugcuggcccagacgccccuccacgucgccgccgagaccgggcacaccagcaccgcccgccugcugcuccaccggggcgcggggaaggaggccaugaccuccgacggcuacaccgcccugcaccuggccgcgcgcaacggccaccucgccaccgugaagcugcugguggaggagaaggccgacguccucgcccgcgggccgcugaaccagaccgcccugcaccucgcggccgcccacggccacagcgaggugguggaggagcuggucuccgccgacgugaucgaccuguucgacgagcaggggcucagcgcccugcaccuggcggcccagggccggcacgcccagaccguggagacccuccugcgccacggggcccacaucaaccugcagucccucaaguuccagggcggccacgggcccgccgcgacgcugcugcggcgcagcaagaccuga

SEQ ID NO: 35734 - RNA, 387 nt, Artificial Sequence
  derived and/or modified sequence opt1 from RIPPLY2__Homo_sapiens__NP_001009994
auggagaacgccggcggggccgagggcaccgagagcggggcggccgccugcgccgccaccgacggccccacgcgccgggcgggggccgacuccggcuacgccggcuucuggcgcccguggguggacgccgggggcaagaaggaggaggagacccccaaccacgcggccgaggccaugcccgacgggcccggcaugaccgccgccagcgggaagcuguaccaguuccggcacccgguccgccucuucuggcccaaguccaagugcuacgacuaccuguaccaggaggcggaggcccugcucaagaacuuccccauccaggccaccaucagcuucuacgaggacuccgacagcgaggacgagaucgaggaccugacgugcgagaacuga

SEQ ID NO: 35735 - RNA, 552 nt, Artificial Sequence
  derived and/or modified sequence opt1 from RIT1__Homo_sapiens__NP_001243749
augaccaugcaguucaucagccaccgcuuccccgaggaccacgacccgaccaucgaggacgccuacaagauccggauccgcaucgacgacgagcccgccaaccuggacauccucgacacggcgggccaggccgaguucaccgccaugcgggaccaguacaugcgcgccggggagggcuucaucaucugcuacuccaucaccgaccggcgcagcuuccacgaggugcgggaguucaagcagcugaucuaccgcguccggcgcaccgacgacacgcccguggugcuggucgggaacaaguccgaccucaagcagcugcgccaggugaccaaggaggagggccuggcccucgcgcgggaguucagcugccccuucuucgagaccuccgccgccuaccgguacuacaucgacgacguguuccacgcccugguccgcgagauccggcgcaaggagaaggaggcggugcuggccauggagaagaaguccaagccgaagaacagcguguggaagcggcucaagagccccuuccgcaagaagaaggacuccgucaccuga

SEQ ID NO: 35736 - RNA, 462 nt, Artificial Sequence
  derived and/or modified sequence opt1 from RIT2__Homo_sapiens__NP_001259006
auggagguggagaacgaggccagcugcucccccggcagcgccuccgggggcagccgcgaguacaaggucgugaugcugggggcgggcggggugggcaaguccgccaugaccaugcaguucaucagccaccaguucccggacuaccacgaccccaccaucgaggacgccuacaagacgcagguccggaucgacaacgagcccgccuaccucgacauccuggacaccgccggccaggcggaguucaccgccaugcgcgagcaguacaugcgcgggggcgagggguucaucaucugcuacuccgugaccgaccggcagagcuuccaggaggccgccaaguucaaggagcugaucuuccaggugcggcacacguacgagaucccccucguccuggugggcaacaagaucgaccuggagcaguuccgccagccgacccucaaggaguucgggcgggaggaguucuga

SEQ ID NO: 35737 - RNA, 882 nt, Artificial Sequence
  derived and/or modified sequence opt1 from RITA1__Homo_sapiens__NP_001273144
augcugcgcgagccccggaagcagggccucgccgggcgcgcccaccuccugagcccgggcaccaccggguccaugaagacgcccguggagcuggcggucagcggcaugcagacccuggggcugcagcaccggugccgcggcggcuaccgggugaaggcccgcaccuccuacguggacgagacccucuucgggagccccgccggcacgcggcccaccccgcccgacuucgacccgcccugggucgagaaggccaaccgcacccgcggggugggcaaggaggccuccaaggcgcugggggccaagggcagcugcgagaccacgcccucccggggcagcacccccacccugacgccccggaagaagaacaaguaccgccccaucucccacaccccgagcuacugcgacgagucccucuucgggagccgguccgagggcgccagcuucggggcgccccgcauggccaagggcgacgccgccaagcugcgggcccugcucuggacgcccccgcccacgccccgcggcucccacagcccccggccccgcgaggccccgcugcgggcgauccaccccgccgggcccuccaagaccgagcccggcccggccgccgacagccagaagcuguccaugggcgggcuccacagcagccgcccccugaagcgggggcugucccacagccucacccaccugaacgugcccuccaccggccaccccgccaccagcgcgccgcacaccaacggcccccaggaccugcgccccuccaccagcggggucaccuuccgcuccccgcucgugaccagccgggcccgcuccgugagcaucuccguccccagcacgccccggcgcggcggggccacccagaagcccaagccgcccuggaaguga

SEQ ID NO: 35738 - RNA, 954 nt, Artificial Sequence
  derived and/or modified sequence opt1 from RLBP1__Homo_sapiens__XP_011520172
augagcgagggcguggggaccuuccgcaugguccccgaggaggagcaggagcugcgggcccagcucgagcagcugaccacgaaggaccacggcccgguguucgggcccugcucccagcugccccgccacacccuccagaaggccaaggacgagcugaacgagcgggaggagacccgcgaggaggcggugcgggagcugcaggagaugguccaggcccaggccgccagcggcgaggagcucgccguggcgguggccgagcgcguccaggagaaggacuccggguucuuccugcgguucauccgcgcccggaaguucaacgugggccgcgccuacgagcugcuccggggcuacgugaacuuccgccugcaguaccccgagcuguucgacagccucuccccggaggcgguccggugcaccaucgaggccggguaccccggcgugcugagcucccgcgacaaguacgggcggguggucaugcuguucaacaucgagaacuggcagagccaggagaucacguucgacgagauccuccaggccuacugcuucauccuggagaagcugcucgagaacgaggagacccagaucaacggcuucugcaucaucgagaacuucaagggguucaccaugcagcaggccgccucccugcgcaccagcgaccugcggaagaugguggacaugcuccaggacuccuuccccgcgcgcuucaaggccauccacuucauccaccagcccugguacuucacgaccaccuacaacguggucaagccguuccucaagagcaagcugcuggagcggguguucgugcacggcgacgaccuguccggcuucuaccaggagaucgacgagaacauccugcccagcgacuucgggggcacccuccccaaguacgacgggaaggccgucgccgagcagcuguucggcccccaggcccaggcggagaacacggccuucuga

SEQ ID NO: 35739 - RNA, 4578 nt, Artificial Sequence
  derived and/or modified sequence opt1 from RLF__Homo_sapiens__XP_011540196
augaaggccagcgugugcaagaccaucgccugccugcuccccgaggaccuggagguccgccgggcgugccagcugaccgaguuccucaucgagccgucccuggacggcuucaacaugcuggaggagcucuaccugcagcccgaccagaaguucgacgaggagaacgcccccgugcccaacagccugcgcugcgagcuccugcuggcccucaaggcccacuggccguucgaccccgaguucugggacuggaagacgcugaagcggcacugccaccagcugcucgggcaggaggccuccgacagcgacgacgaccuguccggcuacgagaugagcaucaacgacaccgacgugcuggaguccuuccucagcgacuacgacgaggggaaggaggacaagcaguaccgccggcgcgaccugaccgaccagcacaaggagaagcgggacaagaagcccaucggcuccagcgagcgcuaccagcgguggcugcaguacaaguucuucugccuccugugcaagcgcgagugcaucgaggcgcggauccugcaccacuccaagaugcacauggaggacgggaucuacaccugccccgucugcaucaagaaguucaagcgcaaggagauguucgugccgcacgugauggagcacgucaagaugccccccagccggcgcgaccgguccaagaagaagcuccugcugaagggcagccagaagggcaucugccccaaguccccgagcgccauccccgagcagaaccacucccucaacgaccaggccaagggggagagccacgaguacgugacguucuccaagcuggaggacugccaccugcaggaccgcgaccucuaccccugccccggcaccgacugcagccggguguucaagcaguucaaguaccugagcguccaccugaaggccgagcaccagaacaacgacgagaacgcgaagcacuaccucgacaugaagaaccgccgggagaagugcaccuacugccgccggcacuucauguccgccuuccaccugcgcgagcacgagcaggugcacugcgggccgcagcccuacaugugcgugagcaucgacugcuacgcccgcuucggcuccgucaacgagcugcucaaccacaagcagaagcacgacgaccugcgguacaagugcgagcugaacgggugcaacaucguguucagcgaccucggccagcuguaccaccacgaggcccagcacuuccgcgacgccuccuacaccugcaacuuccugggcugcaagaaguucuacuacagcaagaucgaguaccagaaccaccucuccaugcacaacguggagaacagcaacggggacaucaagaaguccgucaagcuggaggagagcgcgacgggcgagaagcaggacugcaucaaccagccccaccugcucaaccagaccgacaagucccaccugcccgaggaccuguucugcgccgagagcgccaacucccagaucgacaccgagaccgccgagaaccucaaggagaacagcgacuccaacagcuccgaccagcugagccacuccagcagcgccuccaugaacgaggagcugaucgacacgcuggaccacagcgagaccaugcaggacgugcuccuguccaacgagaagguguucgggccgagcucccugaaggagaagugcagcuccauggcggucugcuucgacggcaccaaguucaccugcggcuucgacgggugcggcagcacguacaagaacgcccgggggaugcagaagcaccuccgcaaggugcaccccuaccacuucaagcccaagaagaucaagaccaaggaccuguuccccucccugggcaacgagcacaaccagaccaccgagaagcucgacgccgagccgaagcccugcagcgacacgaacuccgacagccccgacgaggggcuggaccacaacauccacaucaagugcaagcgggagcaccagggcuacuccagcgaguccagcaucugcgccuccaagcgccccugcaccgaggacaccaugcuggagcuccugcugcggcucaagcaccugagccugaagaacagcaucacccacggcuccuucagcgggucccuccagggcuacccgagcuccggggccaagagccugcaguccgugagcuccaucagcgaccugaacuuccagaaccaggacgagaacaugcccucccaguaccucgcgcagcuggccgccaagcccuucuucugcgagcugcagggcugcaaguacgaguucgucacgcgcgaggcccuccugaugcacuaccugaagaagcacaacuacagcaaggagaaggugcuccagcugaccauguuccagcaccgguacuccccguuccagugccacaucugccagcgcagcuucacccggaagacccaccugcgcauccacuacaagaacaagcaccagaucggguccgaccgggccacgcacaagcuccuggacaacgagaagugcgaccacgagggccccugcagcguggaccgccugaagggcgacugcuccgcggagcucgggggcgaccccagcuccaacagcgagaagccccacugccacccgaagaaggacgagugcagcuccgagaccgaccuggagagcuccugcgaggagaccgagagcaagaccuccgacaucagcucccccaucgggagccaccgggaggagcaggagggccgcgaggggcggggcucccgccggacggucgccaagggcaaccugugcuacauccucaacaaguaccacaagcccuuccacugcauccacaagaccugcaacagcuccuucaccaaccugaaggggcugauccgccacuaccgcaccgugcaccaguacaacaaggagcagcucugccuggagaaggacaaggcccggacgaagcgcgagcuggucaagugcaagaagaucuucgccugcaaguacaaggagugcaacaagcgguuccucugcagcaaggcgcuggccaagcacugcuccgacagccacaaccuggaccacaucgaggagcccaaggugcucuccgaggccggcagcgccgcccgcuucuccugcaaccagccgcagugccccgcgguguucuacaccuucaacaagcugaagcaccaccugauggagcagcacaacaucgagggggagauccacagcgacuacgagauccacugcgaccucaacggcugcggccagaucuucacccaccgguccaacuacagccagcacgucuacuaccgccacaaggacuacuacgacgaccuguuccggagccagaagguggccaacgagcgccugcuccgguccgagaaggugugccagaccgccgacacccaggggcacgagcaccagacgacccgccggagcuucaacgccaaguccaagaagugcggccugaucaaggagaagaaggcccccaucagcuucaagacccgcgcggaggcccugcacaugugcgucgagcacuccgagcacacccaguaccccugcauggugcaggggugccucagcguggucaagcuggaguccagcaucgugcggcacuacaagcgcacgcaccagauguccagcgccuaccuggagcagcagauggagaaccucguggucugcgugaaguacggcaccaagaucaaggaggagccgcccuccgaggccgaccccugcaucaagaaggaggagaaccggagcugcgaguccgagcgcaccgagcacagccacucccccggggacagcuccgccccgauccagaacaccgacugcugccacagcuccgagcgggacggcggccagaaggggugcaucgagagcagcuccguguucgacgcggacacgcugcuguaccgcggcacccucaagugcaaccacagcuccaagaccaccagccuggagcagugcaacaucguccagcccccccccccgugcaagaucgagaacuccauccccaaccccaacgggacggagagcggcaccuacuucaccuccuuccagcugccccucccgcggaucaaggagagcgagacccgccagcacuccagcgggcaggagaacacggugaagaaccccacccacgugcccaaggagaacuuccggaagcacucccagccgcgcagcuucgaccugaagaccuacaagcccaugggcuucgaguccagcuuccugaaguucauccaggaguccgaggagaaggaggacgacuucgacgacugggagcccagcgagcaccucacccuguccaacagcucccagagcagcaacgaccugacgggcaacgucguggccaacaacauggugaacgacuccgagcccgaggucgacaucccgcacagcuccagcgacuccaccauccacgagaaccucaccgccauccccccccugaucguggccgagaccacgaccgugcccagccuggagaaccuccgcgucgugcuggacaaggcgcugaccgacugcggggagcucgcccugaagcagcugcacuaccuccggccgguggucgugcuggagcgcuccaaguucagcacccccauccuggaccucuuccccacgaagaagaccgacgagcugugcgugggcuccagcuga

SEQ ID NO: 35740 - RNA, 1875 nt, Artificial Sequence
  derived and/or modified sequence opt1 from RLIM__Homo_sapiens__NP_899196
auggagaacagcgacuccaacgacaagggcagcggggaccaguccgccgcccagcgccggagccagauggaccgccuggaccgggaggaggcguucuaccaguucgugaacaaccucuccgaggaggacuaccgccugaugcgggacaacaaccugcucggcacccccggggagagcaccgaggaggagcugcugcgccggcuccagcagaucaaggagggcccgccgccccagaacuccgacgagaaccgcgggggcgacagcuccgacgacgucagcaacggcgacuccaucaucgacuggcugaacagcgugcggcagacggggaacaccacccgcuccggccagcgggggaaccagagcuggcgcgccgugucccggaccaaccccaacagcggcgacuuccgcuucucccuggagaucaacgucaaccggaacaacgggagccagaacuccgagaacgagaacgagcccagcgcccgccggagcuccggcgagaacguggagaacaacagccagcgccagguggagaacccccgguccgagagcacguccgcccgccccagccgguccgagcgcaacagcaccgaggcccucaccgaggugcccccgacccgcggccagcggcgcgcgcggucccgcagccccgaccaccggcgcacgcgggcccgcgccgagcggucccgcagcccccugcaccccauguccgagaucccgcggcgcagccaccacuccaucagcucccagaccuucgagcacccccuggucaacgagaccgaggggagcucccggacccgccaccacgugacgcuccggcagcagaucagcggccccgagcugcugagccgcgggcuguucgccgcguccggcacccggaacgccagccagggcgccggguccagcgacaccgccgccuccggcgagagcaccggguccggccagcggcccccgacgaucguccuggaccuccaggugcgccgcgugcgccccggggaguaccggcagcgcgacagcaucgcgucccggacccgcagccggucccagacccccaacaacaccgucacguacgagagcgagcgcggcggcuuccggcgcaccuucucccggagcgagcgcgccggggugcggaccuacguguccaccauccgcauccccauccggcgcauccucaacacgggccugagcgagaccaccuccgucgccauccagaccaugcugcggcagaucaugacgggguucggcgagcucagcuacuucauguacagcgacuccgacagcgagccgaccggguccgugagcaaccgcaacauggagcgggccgagucccgcagcggccggggcggguccggcgggggcagcuccagcggguccagcuccagcuccagcuccagcuccagcagcuccagcuccagcuccagcuccagcucccccagcuccagcuccggcggcgagagcuccgagaccagcuccgaccuguucgaggggagcaacgagggcuccagcagcuccgggagcuccggcgcccgccgggagggccgccaccgcgcgcccgugaccuucgacgagagcgggucccugcccuuccucagccuggcccaguucuuccugcucaacgaggacgacgacgaccagccgcggggccugacgaaggagcagaucgacaaccuggccaugcgcuccuucggggagaacgacgcccucaagaccugcagcgucugcaucaccgaguacaccgagggcaacaagcugcggaagcugcccugcucccacgaguaccacgugcacugcaucgaccgcuggcucagcgagaacuccacgugccccaucugccggcgcgccgugcuggcgagcgggaaccgggaguccgucguguga

SEQ ID NO: 35741 - RNA, 558 nt, Artificial Sequence
  derived and/or modified sequence opt1 from RLN1__Homo_sapiens__NP_008842
augccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcuga

SEQ ID NO: 35742 - RNA, 354 nt, Artificial Sequence
  derived and/or modified sequence opt1 from RLN2__Homo_sapiens__NP_005050
augccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccggggacuucauccagaccgugagccugggcaucucccccgacgggggcaaggcccuccgcaccggcagcugcuucacccgggaguuccugggggcgcuguccaagcucugccacccgagcuccaccaagauccagaagcccuga

SEQ ID NO: 35743 - RNA, 429 nt, Artificial Sequence
  derived and/or modified sequence opt1 from RLN3__Homo_sapiens__NP_543140
auggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcuga

SEQ ID NO: 35744 - RNA, 855 nt, Artificial Sequence
  derived and/or modified sequence opt1 from RMDN1__Homo_sapiens__NP_001273648
auggcccuggccgcgcgccucuggcggcugcugcccuuccgccggggcgccgccccggggagccgccuccccgccggcaccuccgggagccggggccacugcgggcccugccgcuuccggggcuucgaggugaugggcaaccccgggaccuucaagcgcggccugcugcucuccgcccugagcuaccugggguucgagacguaccaggucaucucccaggcggccguggugcacgccaccgccaaggucgaggagauccucgagcaggcggacuaccuguacgagagcggcgagaccgagaagcuguaccagcuccugacccaguacaaggaguccgaggacgccgagcugcucuggcggcuggcccgcgccagccgggacguggcccagcugucccgcacgagcgaggaggagaagaagcuccugguguacgaggcgcuggaguacgccaagcgggcccucgagaagaacgaguccagcuucgccucccacaagaaggccaucgagcugaacccgaaggacgcgaccagcauccaccugauggggaucuggugcuacaccuucgccgagaugcccugguaccagcgccggaucgccaagaugcuguucgccaccccgcccuccagcacguacgagaaggcccucggcuacuuccaccgcgcggagcaggucgaccccaacuucuacuccaagaaccugcuccugcugggcaagaccuaccucaagcugcacaacaagaagcuggccgccuucuggcucaugaaggccaaggacuaccccgcccacaccgaggaggacaagcagauccagaccgaggcggcccagcugcugacgagcuucuccgagaagaacuga

SEQ ID NO: 35745 - RNA, 1233 nt, Artificial Sequence
  derived and/or modified sequence opt1 from RMDN2__Homo_sapiens__NP_001164263
augcccuacagcaccaacaaggagcugauccucggcaucaugguggggaccgccggcaucucccugcugcuccugugguaccacaagguccgcaagccggggaucgccaugaagcugcccgaguuccucagccugggcaacacguucaacuccaucacccugcaggacgagauccacgacgaccaggggaccaccgugaucuuccaggagcggcagcuccagauccuggagaagcugaacgagcuccugacgaacauggaggagcugaaggaggagauccgcuuccucaaggaggcgauccccaagcuggaggaguacauccaggacgagcugggcggcaagaucaccgugcacaagaucagcccccagcaccgggcccgcaagcggcgccucccgaccauccaguccagcgccaccuccaacagcuccgaggaggccgagagcgagggcggguacaucacggccaacaccgacaccgaggagcaguccuuccccguccccaaggcguucaacacccggguggaggagcugaaccuggacgugcuccugcagaaggucgaccaccuccgcaugagcgaguccggcaagagcgaguccuucgagcugcugcgggaccacaaggagaaguuccgcgacgagaucgaguucauguggcgguucgcccgcgccuacggggacauguacgagcugagcacgaacacccaggagaagaagcacuacgccaacaucgggaagacccucuccgagcgggcgaucaaccgcgcccccaugaacggccacugccaccugugguacgccgugcugugcggcuacgugagcgaguucgaggggcuccagaacaagaucaacuacggccaccuguucaaggagcaccuggacaucgccaucaagcuccugccggaggagcccuuccuguacuaccucaaggggcgguacugcuacaccgucuccaagcugagcuggaucgagaagaagauggccgcgacgcuguucggcaagauccccagcuccaccgugcaggaggcccuccacaacuuccugaaggccgaggagcugugccccggcuacagcaacccgaacuacauguaccucgccaagugcuacaccgaccuggaggagaaccagaacgcccugaaguucugcaaccucgcgcugcugcuccccaccgugacgaaggaggacaaggaggcccagaaggagaugcagaagaucaugaccucccugaagcgcuga

SEQ ID NO: 35746 - RNA, 1413 nt, Artificial Sequence
  derived and/or modified sequence opt1 from RMDN3__Homo_sapiens__NP_001291731
augagccgccugggcgcccucgggggcgcccgggcggggcugggccugcuccuggggaccgccgccggccugggcuuccucugccugcuguacucccagcgcuggaagcggacccagcgccacgggcggagccagucccuccccaacagccuggacuacacgcagaccuccgacccgggccgccacgugaugcugcuccgggccguccccgggggcgccggggacgcgagcgugcugcccucccugccccgcgagggccaggagaaggugcucgaccggcuggacuucguccugaccagccucguggcccugcgccgggagguggaggagcugcgcuccagccuccggggccuggccggggagaucgucggcgaggugcgcugccacauggaggagaaccagcggguggcccgccggcgccgguucccguucguccgcgagcgguccgacagcaccggguccagcuccguguacuucacggcgagcuccggcgccaccuucaccgacgccgagagcgagggcggguacaccacggccaacgccgaguccgacaacgagcgcgacagcgacaaggagagcgaggacggcgaggacgagguguccugcgagaccgucaagauggggcgcaaggacagccuggaccucgaggaggaggcggccuccggcgccagcuccgcccuggaggccgggggcagcuccggccuggaggacgugcucccccugcugcagcaggcggacgagcuccaccgcggggacgagcagggcaagcgggagggguuccagcugcugcucaacaacaagcugguguacggcagccggcaggacuuccuguggcgccucgcccgggccuacuccgacaugugcgagcugaccgaggaggucagcgagaagaaguccuacgcccuggacgggaaggaggaggccgaggcggcccucgagaagggcgacgagagcgccgacugccaccugugguacgccgugcugugcggccagcucgccgagcacgaguccauccagcgccggauccagagcggguucuccuucaaggagcacguggacaaggcgaucgcccugcagcccgagaaccccauggcccacuuccugcucggccgcuggugcuaccaggucagccaccuguccuggcuggagaagaagaccgccacggcgcuccuggagagcccgcuguccgccaccguggaggacgcccugcagagcuuccucaaggccgaggagcugcagcccggguucagcaaggccggccggguguacaucuccaagugcuaccgcgagcuggggaagaacagcgaggcgcggugguggaugaagcucgcccuggagcugcccgacgucaccaaggaggaccucgccauccagaaggaccuggaggagcuggaggugauccuccgcgacuga

SEQ ID NO: 35747 - RNA, 1878 nt, Artificial Sequence
  derived and/or modified sequence opt1 from RMI1__Homo_sapiens__XP_011517336
augaacgugaccagcaucgcccugcgcgccgagaccuggcuccuggcggccuggcacgucaaggugcccccgauguggcuggaggccugcaucaacuggauccaggaggagaacaacaacgugaaccucucccaggcccagaugaacaagcaggucuucgagcaguggcugcugacggaccuccgggaccuggagcacccccugcuccccgacggcauccuggagauccccaagggggagcugaacggcuucuacgcccuccagaucaacagccugguggacgugucccagccggcguacagccagauccagaagcugcgcgggaagaacaccaccaacgaccucgucaccgccgaggcccaggugacgcccaagcccugggaggccaagcccucccggaugcugaugcugcagcucaccgacggcaucgugcagauccaggggauggaguaccagccgauccccauccugcacagcgaccugccgcccggcaccaagauccucaucuacggcaacaucuccuuccgccuggggguccugcuccugaagcccgagaacgugaaggugcugggcggggaggucgacgcgcuccuggaggaguacgcccaggagaaggugcuggcccggcucaucggcgagcccgaccugguggucagcgugauccccaacaacuccaacgagaacaucccccgcgugaccgacguccuggacccggcccucgggcccagcgacgaggagcugcuggccucccucgacgagaacgacgagcugacggcgaacaacgacaccagcuccgagcggugcuucaccaccggcagcuccagcaacacgauccccacccgccaguccagcuucgagcccgaguucgugaucuccccgcggcccaaggaggagcccagcaaccugagcauccacgugauggacggcgagcucgacgacuucucccuggaggaggcccugcuccuggaggagaccguccagaaggagcagauggagaccaaggagcugcagccccucacguucaaccgcaacgccgaccggagcaucgagcgcuucucccacaacccgaacaccaccaacaacuucagccugaccugcaagaacgggaacaacaacugguccgagaagaacgugagcgagcagaugacgaacgaggacaaguccuucggcugccccagcgugcgggaccagaaccgcuccaucuucagcguccacugcaacgugccccuggcccacgacuucaccaacaaggagaagaaccucgagaccgacaacaagaucaagcagaccuccagcuccgacagccacucccugaacaacaagauccugaaccgggaggucgugaacuacgugcagaagcgcaacagccagaucuccaacgagaacgacugcaaccugcagagcugcucccuccggagcagcgagaacuccaucaaccugagcaucgccauggaccuguacuccccgcccuucgucuaccucagcgugcugauggcguccaagcccaaggaggugacgaccgucaaggugaaggccuucaucgugacccugaccgggaaccucagcuccagcggcggcaucugguccaucacggccaaggucagcgacgggaccgccuaccuggacguggacuucguggacgagauccugaccucccucaucggcuucagcguccccgagaugaagcaguccaagaaggacccgcugcaguaccagaaguuccuggaggggcuccagaagugccagcgcgaccugaucgaccugugcugccucaugaccaucagcuucaaccccucccugagcaaggccauggugcuggcgcuccaggacgugaacauggagcaccuggagaaccugaagaagcggcucaacaaguga

SEQ ID NO: 35748 - RNA, 444 nt, Artificial Sequence
  derived and/or modified sequence opt1 from RMI2__Homo_sapiens__NP_689521
auggccgccgcggccgacagcuucuccggcgggcccgccggcgugcgccugccgcggagcccgccccucaagguccuggccgagcagcugcgccgggacgccgagggcgggcccggggcguggcgccucucccgggccgccgccggccgcggcccccuggaccuggcggccguguggaugcaggggcggguggucauggccgaccgcggcgaggcccggcuccgcgaccccagcggggacuucuccgugcggggccuggagcgcgugccccgggggcgccccugccuggucccgggcaaguacgugauggugaugggcgucgugcaggccugcagccccgagcccugccuccaggcggugaagaugaccgaccuguccgacaaccccauccacgagagcaugugggagcuggaggucgaggaccuccaccggaacaucccguga

SEQ ID NO: 35749 - RNA, 840 nt, Artificial Sequence
  derived and/or modified sequence opt1 from RMND1__Homo_sapiens__NP_001258866
augcacugcaccgccuucgccaccgcggacgaguaccaccugggcaaccucagccaggaccuggccucccacggguacguggaggucacgagccugccccgcgacgccgccaacauccucgugaugggcguggagaacuccgccaaggagggggacccgggcaccaucuucuucuuccgggagggggcggccgucuucuggaacgugaaggacaagaccaugaagcacgugaugaagguccuggagaagcacgagauccagcccuacgagaucgcccuggugcacugggagaacgaggagcucaacuacaucaagaucgagggccagagcaagcugcaccgcggcgagaucaagcugaacuccgagcucgaccuggacgacgccauccuggagaaguucgcguucagcaacgcccucugccuguccgugaagcuggccaucugggaggccagccucgacaaguucaucgaguccauccagagcauccccgaggcccugaaggcggggaagaaggucaagcugucccacgaggaggugaugcagaagaucggcgagcuguucgcccuccggcaccgcaucaaccugagcuccgacuuccucaucacccccgacuucuacugggaccgggagaaccuggaggggcuguacgacaagacgugccaguuccucagcaucggccgccgggugaaggucaugaacgagaagcugcagcacugcauggagcugaccgaccucaugcgcaaccaccugaacgagaagcgggcccugcgccucgaguggaugaucgugauccugaucaccaucgaggugauguucgagcuggggcgggucuucuucuga

SEQ ID NO: 35750 - RNA, 600 nt, Artificial Sequence
  derived and/or modified sequence opt1 from RNASE11__Homo_sapiens__NP_660293
auggagaccuucccccugcuccugcugagccucggccuggugcuggccgaggccuccgagagcaccaugaagaucaucaaggaggaguucacggacgaggagaugcaguacgacauggcgaaguccgggcaggagaagcagaccaucgagauccucaugaacccgauccugcuggucaagaacaccagccucuccaugagcaaggacgacauguccagcacccugcugacguuccgcucccuccacuacaacgaccccaagggcaacagcuccgggaacgacaaggagugcugcaacgacaugaccguguggcggaaggugagcgaggccaacggcuccugcaaguggagcaacaacuucauccgcuccagcaccgaggucaugcggcgcgugcaccgggcccccuccugcaaguucgugcagaaccccgggaucagcugcugcgagucccuggagcuggagaacaccgucugccaguucacgaccggcaagcaguucccgcgcugccaguaccacagcgugaccagccucgagaagauccugaccgugcugacgggccacucccucaugagcuggcuggucugcggguccaagcuguga

SEQ ID NO: 35751 - RNA, 444 nt, Artificial Sequence
  derived and/or modified sequence opt1 from RNASE12__Homo_sapiens__NP_001019993
augaucaucauggugaucaucuuccugguccuccuguucugggagaacgaggugaacgacgaggccgugaugagcacccuggagcaccuccacgucgacuacccccagaacgacgugccggugcccgcccgcuacugcaaccacaugaucauccagcgggucauccgcgagcccgaccacacgugcaagaaggagcacguguucauccacgagcggccccgcaagaucaacggcaucugcaucuccccgaagaagguggcgugccagaaccugagcgccaucuucugcuuccaguccgagaccaaguucaagaugaccgucugccagcugaucgaggggacccgguaccccgccugccgcuaccacuacagccccaccgagggcuucgugcucgugacgugcgacgaccugcggcccgacuccuuccugggguacgucaaguga

SEQ ID NO: 35752 - RNA, 471 nt, Artificial Sequence
  derived and/or modified sequence opt1 from RNASE13__Homo_sapiens__NP_001012264
auggcccccgccgugacccgccuccuguuccugcagcugguccucggcccgacccuggugauggacaucaagaugcagaucgggagccggaacuucuacacgcuguccaucgacuacccccgcgugaacuaccccaagggcuuccggggguacugcaacggccucaugagcuacaugcgcgggaagaugcagaacuccgacugccccaagauccacuacgucauccacgcgccguggaaggccauccagaaguucugcaaguacagcgacuccuucugcgagaacuacaacgaguacugcacccugacccaggacagccugcccaucaccgugugcucccucagccaccagcagccgcccacguccugcuacuacaacagcacccugaccaaccagaagcuguaccuccugugcucccggaaguacgaggccgaccccaucggcaucgccggccuguacagcgggaucuga

SEQ ID NO: 35753 - RNA, 471 nt, Artificial Sequence
  derived and/or modified sequence opt1 from RNASE1__Homo_sapiens__NP_937875
auggcccuggagaagucccucgugcgccugcugcuccugguccugauccuccuggugcugggcugggugcagcccagccucgggaaggagagccgggccaagaaguuccagcgccagcacauggacuccgacagcuccccgagcuccagcuccaccuacugcaaccagaugaugcggcgccggaacaugacccagggccgcugcaagcccgucaacacguucgugcacgagccccugguggacguccagaacgugugcuuccaggagaaggugaccugcaagaacgggcagggcaacugcuacaagagcaacuccagcaugcacaucaccgacugccggcugaccaacgggucccgcuaccccaacugcgcguaccggacgagcccgaaggagcgccacaucaucgucgccugcgagggcucccccuacgugcccgugcacuucgacgccagcgucgaggacuccaccuga

SEQ ID NO: 35754 - RNA, 486 nt, Artificial Sequence
  derived and/or modified sequence opt1 from RNASE2__Homo_sapiens__NP_002925
auggugcccaagcuguucaccagccagaucugccuccugcugcuccugggccugcucgccgucgaggggucccugcacgugaagccgccccaguucaccugggcccagugguucgagacgcagcacaucaacaugaccagccagcagugcaccaacgcgaugcaggucaucaacaacuaccagcgccggugcaagaaccagaacaccuuccugcucacgaccuucgccaacguggugaacgugugcggcaaccccaacaugaccugccccuccaacaagacccgcaagaacugccaccacagcgggucccaggucccgcugauccacugcaaccugacgacccccagcccccagaacaucuccaacugccgguacgcccagacccccgccaacauguucuacaucguggccugcgacaaccgcgaccagcggcgcgacccgccccaguaccccgugguccccgugcaccucgaccggaucaucuga

SEQ ID NO: 35755 - RNA, 483 nt, Artificial Sequence
  derived and/or modified sequence opt1 from RNASE3__Homo_sapiens__NP_002926
auggugcccaagcuguucaccagccagaucugccuccugcugcuccugggccugaugggggucgagggcucccuccacgcccgcccgccccaguucacccgggcccagugguucgcgauccagcacaucagccugaacccgccccgcugcacgaucgccaugcgggccaucaacaacuaccgcuggcggugcaagaaccagaacaccuuccugcgcaccaccuucgccaacguggugaacgucugcgggaaccaguccauccggugcccccacaaccgcacgcucaacaacugccaccggagccgcuuccgggugccccugcugcacugcgaccucaucaaccccggcgcccagaacaucuccaacugcaccuacgcggaccgccccgggcggcgcuucuacguggucgccugcgacaaccgggacccgcgcgacagcccccgguaccccguggugcccguccaccuggacaccaccaucuga

SEQ ID NO: 35756 - RNA, 444 nt, Artificial Sequence
  derived and/or modified sequence opt1 from RNASE4__Homo_sapiens__NP_002928
auggcccugcagcgcacccacagccuccugcugcuccugcugcucacccugcugggccucgggcuggugcagcccuccuacggccaggacgggauguaccagcgguuccugcgccagcacguccacccggaggagacgggcgggagcgaccgguacugcaaccucaugaugcagcgccggaagaugacccuguaccacugcaagcgcuucaacaccuucauccacgaggacaucuggaacauccgguccaucugcagcaccacgaacauccagugcaagaacggcaagaugaacugccacgagggcguggugaaggucaccgacugccgcgacaccggguccagccgggcccccaacugccgcuaccgggcgaucgccuccacccgccggguggugaucgccugcgagggcaacccccagguccccgugcacuucgacggguga

SEQ ID NO: 35757 - RNA, 453 nt, Artificial Sequence
  derived and/or modified sequence opt1 from RNASE6__Homo_sapiens__NP_005606
auggugcugugcuucccccuccugcugcuccugcugguccucuggggccccgugugcccccugcacgccuggcccaagcgccugaccaaggcccacugguucgagauccagcacauccagcccagcccgcuccagugcaaccgggcgauguccgggaucaacaacuacacccagcacugcaagcaccagaacacguuccugcacgacagcuuccagaacguggccgccgucugcgaccugcucuccaucgugugcaagaaccgccggcacaacugccaccagagcuccaagcccgugaacaugaccgacugccgccugaccagcggcaaguacccccagugccgguacuccgccgccgcgcaguacaaguucuucaucgucgccugcgacccgccccagaaguccgacccgcccuacaagcuggugcccgugcaccucgacagcauccuguga

SEQ ID NO: 35758 - RNA, 471 nt, Artificial Sequence
  derived and/or modified sequence opt1 from RNASE7__Homo_sapiens__NP_115961
auggcccccgcccgcgcgggcuucugcccgcugcuccugcugcuccugcuggggcucuggguggccgagauccccgucagcgccaagcccaagggcaugaccuccagccagugguucaagauccagcacaugcagcccuccccgcaggccugcaacagcgccaugaagaacaucaacaagcacaccaagcggugcaaggaccugaacacguuccugcacgagcccuucuccagcguggcggcgaccugccagacccccaagaucgccugcaagaacggggacaagaacugccaccagucccacggcgccgugagccucaccaugugcaagcugacguccgggaaguaccccaacugccgcuacaaggagaagcggcagaacaagagcuacgucguggccugcaagccgccccagaagaaggacucccagcaguuccaccuggugcccguccaccucgaccgcgugcuguga

SEQ ID NO: 35759 - RNA, 465 nt, Artificial Sequence
  derived and/or modified sequence opt1 from RNASE8__Homo_sapiens__NP_612204
auggcccccgcccgcgcgggcugcugcccgcugcuccugcugcuccuggggcuguggguggccgagguccucgugcgggccaagcccaaggacaugaccagcucccagugguucaagacccagcacgugcagcccagcccccaggccugcaacuccgccaugagcaucaucaacaaguacacggagcgcugcaaggaccugaacaccuuccugcacgagccguucuccagcgucgcgaucacgugccagacccccaacaucgccugcaagaacuccugcaagaacugccaccagagccacggccccaugucccucaccaugggggagcugaccagcggcaaguaccccaacugccgguacaaggagaagcaccugaacaccccguacaucguggccugcgacccgccccagcagggggaccccggcuacccccucgugcccguccaccuggacaaggugguguga

SEQ ID NO: 35760 - RNA, 618 nt, Artificial Sequence
  derived and/or modified sequence opt1 from RNASE9__Homo_sapiens__NP_001103826
augaugcgcacccugaucaccacccacccccucccgcugcugcuccugccccagcagcugcuccagcuggugcaguuccaggaggucgacaccgacuucgacuuccccgaggaggacaagaaggaggaguucgaggagugccuggagaaguucuucagcaccggccccgcccggccgcccaccaaggagaaggugaagcgccgggugcucaucgagcccgggaugccccugaaccacaucgaguacugcaaccacgagaucaugggcaagaacgucuacuacaagcaccgcuggguggccgagcacuacuuccugcucaugcaguacgacgagcugcagaagaucugcuacaaccgguucgugccgugcaagaacgggauccgcaagugcaaccgguccaagggccuggucgaggggguguacugcaaccucacggaggcguucgagauccccgccugcaaguacgagagccuguaccgcaagggcuacgugcugaucacgugcuccuggcagaacgagaugcagaagcggaucccccacaccaucaacgaccucgucgagcccccggagcaccgcagcuuccuguccgaggacggcguguucgugaucagccccuga

SEQ ID NO: 35761 - RNA, 861 nt, Artificial Sequence
  derived and/or modified sequence opt1 from RNASEH1__Homo_sapiens__NP_002927
augagcuggcuccuguuccuggcccaccgcguggcccuggcggcccuccccugccggcgcggcucccggggguucggcauguucuacgccguccgccgggggcgcaagaccggcguguuccugaccuggaacgagugccgggcccagguggaccgcuucccggccgcgcgguucaagaaguucgccacggaggacgaggccugggccuucguccgcaagagcgcgucccccgaggugagcgaggggcacgagaaccagcacggccaggaguccgaggccaaggccagcaagcggcugcgcgagccccucgacggcgacgggcacgaguccgccgagcccuacgccaagcacaugaagccgagcguggagcccgcgccgcccgucucccgggacaccuucagcuacaugggcgacuucgugguggucuacaccgacgggugcugcuccagcaacggccgccggcgcccccgggccgggaucggcguguacuggggccccgggcacccccugaacgugggcauccgccugcccgggcggcagaccaaccagcgcgccgagauccacgccgccugcaaggcgaucgagcaggccaagacgcagaacaucaacaagcucguccuguacaccgacuccauguucaccaucaacggcaucaccaacugggugcagggcuggaagaagaacggguggaagacgagcgccggcaaggaggugaucaacaaggaggacuucgucgcccuggagcggcucacccaggggauggacauccaguggaugcacgugccgggccacuccggguucaucggcaacgaggaggccgaccgccuggcgcgcgagggcgccaagcagagcgaggacuga

SEQ ID NO: 35762 - RNA, 900 nt, Artificial Sequence
  derived and/or modified sequence opt1 from RNASEH2A__Homo_sapiens__NP_006388
auggaccugagcgagcucgagcgcgacaacaccggccggugccgccuguccagccccgugccggccgucugccggaaggagcccugcgugcuggggguggacgaggccggccgcgggcccguccucggccccaugguguacgcgaucugcuacugcccgcugccccggcuggccgaccucgaggcccugaagguggccgacuccaagacccugcucgagagcgagcgcgagcggcuguucgccaagauggaggacacggacuucgucgggugggcgcuggacgugcucucccccaaccugaucagcaccuccaugcugggccgcgugaaguacaaccucaacagccugucccacgacaccgccaccggccugauccaguacgcccucgaccagggggucaacgugacccagguguucgucgacacggugggcaugcccgagaccuaccaggcccggcugcagcagagcuucccggggaucgaggugaccgucaaggcgaaggccgacgcccuguaccccgugguguccgccgccagcaucugcgcgaaggucgcccgcgaccaggccgugaagaaguggcaguucguggagaagcuccaggaccuggacacggacuacggcuccggguaccccaacgaccccaagaccaaggccuggcugaaggagcacgucgagccgguguucggcuucccccaguucgugcgguucagcuggcgcaccgcccagaccauccucgagaaggaggcggaggacgucaucugggaggacuccgccagcgagaaccaggagggccugcggaagaucacguccuacuuccugaacgaggggagccaggcccgcccccgguccagccaccgcuacuuccucgagcggggccuggagagcgccaccucccuguga

SEQ ID NO: 35763 - RNA, 774 nt, Artificial Sequence
  derived and/or modified sequence opt1 from RNASEH2B__Homo_sapiens__NP_001135751
auggccgccggcguggacugcggggacggcgucggggcgcgccagcacguguuccuggugagcgaguaccucaaggacgccuccaagaagaugaagaacggccugauguucgucaagcuggugaaccccugcagcggggagggcgccaucuaccucuucaacaugugccugcagcagcuguucgaggugaaggucuucaaggagaagcaccacuccugguucaucaaccagagcgugcaguccggcgggcuccugcacuucgccacccccguggacccccuguuccuccugcugcacuaccucaucaaggccgacaaggagggcaaguuccagccccuggaccaggucgugguggacaacgucuuccccaacugcauccugcuccugaagcugccggggcucgagaagcugcugcaccacgugaccgaggagaagggcaaccccgagaucgacaacaagaaguacuacaaguacagcaaggagaagacgcucaaguggcuggagaagaaggugaaccagaccgucgcggcccugaagaccaacaacgugaacguguccagccggguccaguccaccgccuucuucagcggggaccaggccuccacggacaaggaggaggacuacauccgcuacgcgcacggccucaucagcgacuacauccccaaggagcuguccgacgaccugagcaaguaccucaagcugcccgagccguccgccagccugcccaacccgcccuccaagauggccgcccagcggcagaagcgcggcaaguga

SEQ ID NO: 35764 - RNA, 495 nt, Artificial Sequence
  derived and/or modified sequence opt1 from RNASEH2C__Homo_sapiens__NP_115569
auggagagcggcgacgaggccgccaucgagcgccaccgggugcaccuccgcuccgcgacccugcgggacgccguccccgccacccugcaccuccugccgugcgagguggccguggacgggcccgcccccgucggccgcuucuucacgcccgcgauccggcaggggccggagggccuggaggugagcuuccgcgggcggugccugcgcggcgaggagguggccgucccgcccggccucgugggguacgugauggucaccgaggagaagaagguguccaugggcaagcccgacccccugcgggacagcgggaccgacgaccaggaggaggagccccuggagcgcgacuucgaccgguucaucggcgccaccgccaacuucucccgcuucacgcucugggggcuggagaccauccccggccccgacgcgaaggugcggggcgcccugaccuggccgagccucgccgccgccauccacgcgcagguccccgaggacuga

SEQ ID NO: 35765 - RNA, 414 nt, Artificial Sequence
  derived and/or modified sequence opt1 from RNASEK__Homo_sapiens__NP_001004333
augggcuggcugcgccccgggccgcggccccugugcccgcccgcccgcgccagcugggcguucucccaccgguuccccagcccccuggcgccccgccggucccccaccccguucuucauggccagccugcucugcugcggccccaagcuggccgccugcgggaucgugcuguccgccuggggcgucaucaugcucaucaugcuggggaucuucuucaacgugcacagcgccgugcugaucgaggacguccccuucaccgagaaggacuucgagaacggcccccagaacaucuacaaccucuacgagcaggucuccuacaacugcuucaucgccgccggccuguaccugcuccucgggggcuucagcuucugccaggugcgccugaacaagcggaaggaguacauggugcgcuga

SEQ ID NO: 35766 - RNA, 2226 nt, Artificial Sequence
  derived and/or modified sequence opt1 from RNASEL__Homo_sapiens__NP_066956
auggagagccgcgaccacaacaacccccaggagggcccgaccuccagcuccgggcggcgcgccgccguggaggacaaccaccuccucaucaaggcgguccagaacgaggacguggaccuggugcagcagcugcucgagggcggggccaacgucaacuuccaggaggaggagggcggguggacgccccugcacaacgccgugcagaugagccgggaggacaucguggagcugcuccugcgccacggcgccgaccccguccugcggaagaagaacggcgccacccccuucauccucgcggccaucgccggguccgugaagcugcugaagcuguuccugagcaagggcgccgacgugaacgagugcgacuucuacggguucaccgcguucauggaggccgccgucuacggcaaggugaaggcccugaaguuccucuacaagcgcggggccaacgugaaccugcggcgcaagaccaaggaggaccaggagcggcugcgcaagggcggcgcgaccgcccucauggacgccgccgagaaggggcacgucgaggugcugaagauccugcucgacgagaugggcgccgacgugaacgcgugcgacaacauggggcggaacgcccugauccacgcccugcucuccagcgacgacuccgacgucgaggccaucacgcaccuccugcuggaccacggcgccgacgugaacgugcgcggcgagcgggggaagaccccgcugauccuggcggucgagaagaagcaccucggccuggugcagcgccugcucgagcaggagcacaucgagaucaacgacaccgacagcgacgggaagaccgcccugcugcucgccguggagcugaagcugaagaagaucgccgagcuccugugcaagcggggcgccuccacggacugcggggaccuggucaugaccgcgcgccggaacuacgaccacagccucgugaaggugcugcugucccacggcgccaaggaggacuuccacccgcccgccgaggacuggaagccccagagcucccacuggggcgccgcgcucaaggaccugcaccgcaucuaccggcccaugaucgggaagcugaaguucuucaucgacgagaaguacaagaucgccgacaccagcgagggcgggaucuaccucggcuucuacgagaagcaggaggucgccgugaagaccuucugcgaggggagcccccgcgcccagcgggaggucuccugccugcaguccagccgcgagaacagccaccuggugacguucuacggcuccgagagccaccgcggccaccuguucgugugcgucacccucugcgagcagacccuggaggccugccuggacgugcaccgcggggaggacguggagaacgaggaggacgaguucgcgcggaacguccucuccagcaucuucaaggccgugcaggagcugcaccuguccugcggcuacacccaccaggaccuccagccccagaacauccugaucgacagcaagaaggccgcccaccuggccgacuucgacaaguccaucaagugggcgggggacccccaggaggugaagcgggaccucgaggaccugggccgccugguccucuacguggugaagaaggggagcaucuccuucgaggaccugaaggcccagagcaacgaggaggucgugcagcuguccccggacgaggagacgaaggaccucauccaccggcuguuccaccccggcgagcacgugcgcgacugccugagcgaccuccugggccaccccuucuucuggaccugggagucccgguaccgcacccugcggaacgucgggaacgagagcgacaucaagacccgcaaguccgagagcgagauccuccggcugcugcagcccggcccguccgagcacagcaaguccuucgacaaguggacgaccaagaucaacgagugcgugaugaagaagaugaacaaguucuacgagaagcgcgggaacuucuaccagaacaccgugggcgaccuccugaaguucauccggaaccugggcgagcacaucgacgaggagaagcacaagaagaugaagcucaagaucggggaccccagccuguacuuccagaagaccuuccccgaccuggucaucuacguguacacgaagcuccagaacaccgaguaccgcaagcacuucccccagacccacagcccgaacaagccccagugcgacggcgccgggggcgccuccgggcuggccagccccggcugcuga

SEQ ID NO: 35767 - RNA, 771 nt, Artificial Sequence
  derived and/or modified sequence opt1 from RNASET2__Homo_sapiens__NP_003721
augcgccccgccgcccugcggggcgcgcuccuggggugccugugccucgcccugcugugccucggcggggccgacaagcgccugcgggacaaccacgaguggaagaagcugaucauggugcagcacuggcccgagaccgucugcgagaagauccagaacgacugccgcgacccgcccgacuacuggaccauccacggccucuggcccgacaagagcgaggggugcaaccgguccuggcccuucaaccuggaggagaucaaggaccugcuccccgagaugcgcgccuacuggcccgacgugauccacagcuuccccaaccggucccgcuucuggaagcacgagugggagaagcacggcacgugcgccgcccagguggacgcgcugaacagccagaagaaguacuucggccggucccuggagcucuaccgcgagcuggaccugaacagcguccuccugaagcuggggaucaagccguccaucaacuacuaccagguggccgacuucaaggacgcccucgcgcggguguacggcgucauccccaagauccagugccugccgcccagccaggacgaggaggugcagaccaucgggcagaucgagcugugccucaccaagcaggaccagcagcugcagaacugcaccgagcccggcgagcagcccucccccaagcaggagguguggcuggccaacggggccgccgagagccgcggccuccgggucugcgaggacggccccguguucuacccgccgcccaagaagacgaagcacuga

SEQ ID NO: 35768 - RNA, 699 nt, Artificial Sequence
  derived and/or modified sequence opt1 from RND1__Homo_sapiens__NP_055285
augaaggagcgccgggcgccccagccgguggucgcccgcugcaagcuggugcuggugggcgacguccagugcgggaagaccgccaugcuccaggugcuggccaaggacugcuaccccgagaccuacgugcccacggucuucgagaacuacaccgccugccuggagaccgaggagcagcggguggagcugagccugugggacaccuccggcagccccuacuacgacaacgugcgcccgcucugcuacuccgacagcgacgccguccugcugugcuucgacaucucccggcccgagacgguggacagcgcccucaagaaguggcgcaccgagauccuggacuacugccccuccacccgggugcugcucaucgggugcaagaccgaccugcgcacggaccugagcacccucauggagcugucccaccagaagcaggcgcccaucagcuacgagcagggcugcgccaucgccaagcagcugggggccgagaucuaccucgagggcuccgcguucaccagcgagaaguccauccacagcaucuuccggaccgccuccaugcugugccugaacaagccgagcccccucccccagaagucccccguccgcagccuguccaagcggcugcuccaccucccgagccgcagcgagcugaucuccagcacguucaagaaggagaaggccaaguccugcagcaucauguga

SEQ ID NO: 35769 - RNA, 735 nt, Artificial Sequence
  derived and/or modified sequence opt1 from RND3__Homo_sapiens__NP_005159
augaaggagcgccgggccagccagaagcuguccagcaaguccaucauggaccccaaccagaacgugaagugcaagaucgucguggugggcgacagccagugcgggaagaccgcccuccugcacgucuucgcgaaggacugcuucccggagaacuacgugcccaccguguucgagaacuacacggccuccuucgagaucgacacccagcgcaucgagcugagccucugggacaccuccggcagccccuacuacgacaacguccggccccuguccuacccggacagcgacgccgugcugaucugcuucgacaucucccgccccgagacccucgacagcgugcugaagaaguggaagggggagauccaggaguucugccccaacacgaagaugcugcucgucggcugcaaguccgaccugcggaccgacgugagcacccugguggagcucuccaaccaccgccagacccccgucagcuacgaccagggggccaacauggccaagcagaucggcgcggccacguacaucgagugcuccgcccugcagagcgagaacuccgugcgggacaucuuccacguggccacccuggcgugcgucaacaagaccaacaagaacgugaagcgcaacaagagccagcgggccaccaagcgcaucagccacaugccgucccggcccgagcucagcgccguggccacggaccugcgcaaggacaaggccaaguccugcaccgucauguga

SEQ ID NO: 35770 - RNA, 756 nt, Artificial Sequence
  derived and/or modified sequence opt1 from RNF103-CHMP3__Homo_sapiens__NP_001185883
auggagggcgagcuguacagcgcccucaaggaggaggaggccuccgagagcguguccagcaccaacuucuccggggagaugcacuucuacgagcuggucgaggacaccaaggacggcaucuggcugguccaggugaacgaguggagccucaagauccgcaaggagaugcgggugguggaccgccagauccgggacauccagcgcgaggaggagaaggugaagcgguccgucaaggacgcggccaagaaggggcagaaggacgugugcaucgugcuggccaaggagaugauccgcagccggaaggccgucuccaagcuguacgccagcaaggcgcacaugaacuccgugcucaugggcaugaagaaccagcuggccgugcugcgcgucgccgggagccuccagaaguccacggaggugaugaaggccaugcagagccuggugaagauccccgagauccaggcgaccaugcgggagcuguccaaggagaugaugaaggccggcaucaucgaggagaugcucgaggacaccuucgagagcauggacgaccaggaggagauggaggaggaggccgagauggagaucgaccgcauccuguucgagaucaccgccggcgcccuggggaaggcgccguccaaggucacggacgcccuccccgagcccgagcccccgggcgccauggccgccagcgaggacgaggaggaggaggaggaggcgcuggaggccaugcagucccggcuggccacccuccgcagcuga

SEQ ID NO: 35771 - RNA, 2046 nt, Artificial Sequence
  derived and/or modified sequence opt1 from RNF103__Homo_sapiens__NP_001185880
augagccgccugcggccccgcccgccccucauccacggcugcgggggcuucuucgaggccaucgugugguacgagaccgggaucuucgccacccagcuggucgaccccguggcgcuguccuucaagaagcucaagacgauccuggagugccggggccugggguacagcggccuccccgagaagaaggacgugcgcgagcuggucgagaaguccggcgaccugauggagggggagcucuacagcgcccugaaggaggaggaggccuccgagagcguguccagcaccaacuucuccggcgagaugcacuucuacgagcugguggaggacaccaaggacgggaucuggcucguccaggugaucgccaacgaccggagcccgcuggugggcaagauccacugggagaagauggucaagaaggugucccgcuucgggauccggaccggcacguucaacugcagcuccgacccccgcuacugccggcgccggggcugggugcgcagcacccugaucauguccgucccccagaccagcaccuccaaggggaaggugaugcucaaggaguacagcggccggaagaucgagguggagcacaucuucaaguggaucacggcccacgcggccucccgcaucaagaccaucuacaacgccgagcaccugaaggaggaguggaacaagagcgaccaguacuggcugaagaucuaccucuucgccaaccuggaccagcccccggcguucuucagcgcccuguccaucaaguucaccgggcgggucgaguucaucuucgugaacguggagaacugggacaacaagagcuacaugaccgacaucggcaucuacaacaugcccuccuacauccuccgcacgcccgagggcaucuaccgguacgggaaccacaccggcgaguucaucagccugcaggccauggacuccuuccugcgcagccuccagcccgaggucaacgaccuguucgugcugucccucgugcuggucaaccugauggccuggauggaccucuucaucacccagggggccaccaucaagcgguucguggugcugaucagcacgcugggcaccuacaacucccuccugaucaucagcuggcugccgguccucggguuccugcagcugcccuaccucgacuccuucuacgaguacagccugaagcugcuccgcuacuccaacaccaccacgcuggcgagcugggugcgggccgacuggauguucuacuccagccaccccgcccuguuccucuccaccuaccugggccacggccugcucaucgacuacuucgagaagaagcgccgccggaacaacaacaacgacgaggucaacgccaacaaccuggaguggcugagcucccugugggacugguacaccagcuaccucuuccaccccaucgccagcuuccagaacuucccgguggaguccgacugggacgaggaccccgaccuguuccuggagcgccucgcguuccccgaccuguggcugcacccccucaucccgaccgacuacaucaagaaccugcccauguggcgguucaagugccugggggugcagagcgaggaggagauguccgagggcagccaggacacggagaacgacuccgagagcgagaacaccgacacccucuccagcgagaaggaggucuucgaggacaagcaguccgugcugcacaacagccccgggaccgccucccacugcgacgccgaggccugcagcugcgccaacaaguacugccagacgucccccugcgagcgcaagggccggagcuacggguccuacaacaccaacgaggacauggagccggacuggcugaccuggcccgcggacaugcuccacugcaccgagugcguggucugccuggagaacuucgagaacggcugccugcucaugggccugcccugcgggcacguguuccaccagaacugcaucgugauguggcuggccggcgggcgccacugcugccccgucugccgguggccgagcuacaagaagaagcagcccuacgcccagcaccagccccucuccaacgacgugccgagcuga
